United States Patent 11,640,849 (METHODS FOR HISTOLOGICAL DIAGNOSIS AND TREATMENT OF DISEASES) - sequence listing, part 42

SEQ ID NO: 1611991 - protein, 4 aa, Staphylococcus aureus
NEAT

SEQ ID NO: 1611992 - protein, 5 aa, Staphylococcus aureus
NGYGQ

SEQ ID NO: 1611993 - protein, 11 aa, Staphylococcus aureus
NISKTANKIQT

SEQ ID NO: 1611994 - protein, 4 aa, Staphylococcus aureus
NKKM

SEQ ID NO: 1611995 - protein, 10 aa, Staphylococcus aureus
NKSETPPFSI

SEQ ID NO: 1611996 - protein, 6 aa, Staphylococcus aureus
NQGSLD

SEQ ID NO: 1611997 - protein, 20 aa, Staphylococcus aureus
NQLGGKSNSGEGGEDAKRYE

SEQ ID NO: 1611998 - protein, 5 aa, Staphylococcus aureus
NREGR

SEQ ID NO: 1611999 - protein, 5 aa, Staphylococcus aureus
NRGPV

SEQ ID NO: 1612000 - protein, 5 aa, Staphylococcus aureus
PDSAV

SEQ ID NO: 1612001 - protein, 8 aa, Staphylococcus aureus
PDVRDGLK

SEQ ID NO: 1612002 - protein, 4 aa, Staphylococcus aureus
QALP

SEQ ID NO: 1612003 - protein, 7 aa, Staphylococcus aureus
QASVSDL

SEQ ID NO: 1612004 - protein, 21 aa, Staphylococcus aureus
QFSNSTKSDLENRVNKSIEDL

SEQ ID NO: 1612005 - protein, 6 aa, Staphylococcus aureus
QGQIQE

SEQ ID NO: 1612006 - protein, 6 aa, Staphylococcus aureus
QLAQDS

SEQ ID NO: 1612007 - protein, 5 aa, Staphylococcus aureus
QLENR

SEQ ID NO: 1612008 - protein, 7 aa, Staphylococcus aureus
QSSQQFE

SEQ ID NO: 1612009 - protein, 5 aa, Staphylococcus aureus
QSTEE

SEQ ID NO: 1612010 - protein, 4 aa, Staphylococcus aureus
RDYN

SEQ ID NO: 1612011 - protein, 4 aa, Staphylococcus aureus
RENA

SEQ ID NO: 1612012 - protein, 16 aa, Staphylococcus aureus
RETHPNVDEEVATQFS

SEQ ID NO: 1612013 - protein, 5 aa, Staphylococcus aureus
RLGPY

SEQ ID NO: 1612014 - protein, 7 aa, Staphylococcus aureus
RQNGSTS

SEQ ID NO: 1612015 - protein, 7 aa, Staphylococcus aureus
RRERNDN

SEQ ID NO: 1612016 - protein, 7 aa, Staphylococcus aureus
RRGERRI

SEQ ID NO: 1612017 - protein, 6 aa, Staphylococcus aureus
SDNRYN

SEQ ID NO: 1612018 - protein, 9 aa, Staphylococcus aureus
SHDANEGYS

SEQ ID NO: 1612019 - protein, 7 aa, Staphylococcus aureus
SIKNQGN

SEQ ID NO: 1612020 - protein, 7 aa, Staphylococcus aureus
SKEIKQE

SEQ ID NO: 1612021 - protein, 4 aa, Staphylococcus aureus
SKTF

SEQ ID NO: 1612022 - protein, 7 aa, Staphylococcus aureus
SLASSAA

SEQ ID NO: 1612023 - protein, 10 aa, Staphylococcus aureus
SPNAKDPQKR

SEQ ID NO: 1612024 - protein, 8 aa, Staphylococcus aureus
SRSGVSSK

SEQ ID NO: 1612025 - protein, 4 aa, Staphylococcus aureus
SRTI

SEQ ID NO: 1612026 - protein, 5 aa, Staphylococcus aureus
SSIED

SEQ ID NO: 1612027 - protein, 12 aa, Staphylococcus aureus
SSKALPPEEDEF

SEQ ID NO: 1612028 - protein, 9 aa, Staphylococcus aureus
SVSGESGLK

SEQ ID NO: 1612029 - protein, 10 aa, Staphylococcus aureus
SYKKPRTVNY

SEQ ID NO: 1612030 - protein, 8 aa, Staphylococcus aureus
TDEYENVS

SEQ ID NO: 1612031 - protein, 9 aa, Staphylococcus aureus
TGTNIQGEA

SEQ ID NO: 1612032 - protein, 9 aa, Staphylococcus aureus
TKIERDKPK

SEQ ID NO: 1612033 - protein, 4 aa, Staphylococcus aureus
TPIP

SEQ ID NO: 1612034 - protein, 9 aa, Staphylococcus aureus
TQSQGDVRS

SEQ ID NO: 1612035 - protein, 7 aa, Staphylococcus aureus
TSKTSIL

SEQ ID NO: 1612036 - protein, 13 aa, Staphylococcus aureus
TSNGVSPRPIPGV

SEQ ID NO: 1612037 - protein, 6 aa, Staphylococcus aureus
VENGNL

SEQ ID NO: 1612038 - protein, 12 aa, Staphylococcus aureus
VETQRSKDNIEE

SEQ ID NO: 1612039 - protein, 12 aa, Staphylococcus aureus
VGPNIKKYFFFR

SEQ ID NO: 1612040 - protein, 12 aa, Staphylococcus aureus
VGPTPPDKDHQY

SEQ ID NO: 1612041 - protein, 8 aa, Staphylococcus aureus
YHDKRSAS

SEQ ID NO: 1612042 - protein, 8 aa, Staphylococcus aureus
YKDPYTDK

SEQ ID NO: 1612043 - protein, 5 aa, Staphylococcus aureus
YNQMQ

SEQ ID NO: 1612044 - protein, 9 aa, Staphylococcus aureus
YNVARKNKD

SEQ ID NO: 1612045 - protein, 17 aa, Staphylococcus aureus
ADKLPSKDHPDYADLEK

SEQ ID NO: 1612046 - protein, 4 aa, Staphylococcus aureus
AEAT

SEQ ID NO: 1612047 - protein, 8 aa, Staphylococcus aureus
AEQVHDDL

SEQ ID NO: 1612048 - protein, 6 aa, Staphylococcus aureus
AIEQGF

SEQ ID NO: 1612049 - protein, 9 aa, Staphylococcus aureus
AISNGTQND

SEQ ID NO: 1612050 - protein, 7 aa, Staphylococcus aureus
AKANHGK

SEQ ID NO: 1612051 - protein, 5 aa, Staphylococcus aureus
AKVEK

SEQ ID NO: 1612052 - protein, 5 aa, Staphylococcus aureus
AQQKE

SEQ ID NO: 1612053 - protein, 8 aa, Staphylococcus aureus
ATPNDVEK

SEQ ID NO: 1612054 - protein, 12 aa, Staphylococcus aureus
ATYNKNAVETTD

SEQ ID NO: 1612055 - protein, 10 aa, Staphylococcus aureus
AYGKAKDNKV

SEQ ID NO: 1612056 - protein, 5 aa, Staphylococcus aureus
CSTPL

SEQ ID NO: 1612057 - protein, 25 aa, Staphylococcus aureus
DAPKTQEHAVTESQVNNIDKTVDNE

SEQ ID NO: 1612058 - protein, 7 aa, Staphylococcus aureus
DEDVRQA

SEQ ID NO: 1612059 - protein, 4 aa, Staphylococcus aureus
DEHR

SEQ ID NO: 1612060 - protein, 9 aa, Staphylococcus aureus
DEQSIEQSL

SEQ ID NO: 1612061 - protein, 4 aa, Staphylococcus aureus
DIYE

SEQ ID NO: 1612062 - protein, 16 aa, Staphylococcus aureus
DKIAEAEAAGADYVGE

SEQ ID NO: 1612063 - protein, 10 aa, Staphylococcus aureus
DNSDSNSASI

SEQ ID NO: 1612064 - protein, 10 aa, Staphylococcus aureus
DPQGDYLPSE

SEQ ID NO: 1612065 - protein, 10 aa, Staphylococcus aureus
DSTDGVQRGM

SEQ ID NO: 1612066 - protein, 10 aa, Staphylococcus aureus
DTTSKKGAHE

SEQ ID NO: 1612067 - protein, 4 aa, Staphylococcus aureus
EAVE

SEQ ID NO: 1612068 - protein, 10 aa, Staphylococcus aureus
EEAKNDPDKV

SEQ ID NO: 1612069 - protein, 5 aa, Staphylococcus aureus
EGSEI

SEQ ID NO: 1612070 - protein, 11 aa, Staphylococcus aureus
EGSSKKDDQVL

SEQ ID NO: 1612071 - protein, 5 aa, Staphylococcus aureus
EIEQE

SEQ ID NO: 1612072 - protein, 5 aa, Staphylococcus aureus
EITTA

SEQ ID NO: 1612073 - protein, 4 aa, Staphylococcus aureus
EKYG

SEQ ID NO: 1612074 - protein, 25 aa, Staphylococcus aureus
ELRQAHDKINKADKMDNPDMEKPAE

SEQ ID NO: 1612075 - protein, 13 aa, Staphylococcus aureus
ELSNGGKNSNMPF

SEQ ID NO: 1612076 - protein, 11 aa, Staphylococcus aureus
ETRDDAVGEAY

SEQ ID NO: 1612077 - protein, 6 aa, Staphylococcus aureus
EYNNGG

SEQ ID NO: 1612078 - protein, 15 aa, Staphylococcus aureus
FADKGYAKTIDEEQL

SEQ ID NO: 1612079 - protein, 14 aa, Staphylococcus aureus
FNEEDKKTTKILES

SEQ ID NO: 1612080 - protein, 10 aa, Staphylococcus aureus
FNRSNKPEFM

SEQ ID NO: 1612081 - protein, 6 aa, Staphylococcus aureus
FPEGEY

SEQ ID NO: 1612082 - protein, 4 aa, Staphylococcus aureus
FPKD

SEQ ID NO: 1612083 - protein, 8 aa, Staphylococcus aureus
FSEETAIQ

SEQ ID NO: 1612084 - protein, 8 aa, Staphylococcus aureus
FSSEEVEG

SEQ ID NO: 1612085 - protein, 5 aa, Staphylococcus aureus
FSSSS

SEQ ID NO: 1612086 - protein, 5 aa, Staphylococcus aureus
FTRST

SEQ ID NO: 1612087 - protein, 5 aa, Staphylococcus aureus
GEGSV

SEQ ID NO: 1612088 - protein, 10 aa, Staphylococcus aureus
GEVVERPSSV

SEQ ID NO: 1612089 - protein, 13 aa, Staphylococcus aureus
GGFYKQDETIEYA

SEQ ID NO: 1612090 - protein, 19 aa, Staphylococcus aureus
GGKASSRGVVSTASYEARK

SEQ ID NO: 1612091 - protein, 8 aa, Staphylococcus aureus
GGSTDQTI

SEQ ID NO: 1612092 - protein, 4 aa, Staphylococcus aureus
GLEP

SEQ ID NO: 1612093 - protein, 6 aa, Staphylococcus aureus
GYLDGD

SEQ ID NO: 1612094 - protein, 7 aa, Staphylococcus aureus
IDQTTKH

SEQ ID NO: 1612095 - protein, 13 aa, Staphylococcus aureus
IEDENSTMKPREI

SEQ ID NO: 1612096 - protein, 4 aa, Staphylococcus aureus
IKAT

SEQ ID NO: 1612097 - protein, 21 aa, Staphylococcus aureus
IKHGGTSISDYRHADGKTGEM

SEQ ID NO: 1612098 - protein, 4 aa, Staphylococcus aureus
IKPS

SEQ ID NO: 1612099 - protein, 7 aa, Staphylococcus aureus
INQAQQL

SEQ ID NO: 1612100 - protein, 5 aa, Staphylococcus aureus
IPSNK

SEQ ID NO: 1612101 - protein, 4 aa, Staphylococcus aureus
IQGA

SEQ ID NO: 1612102 - protein, 7 aa, Staphylococcus aureus
IQPDHRP

SEQ ID NO: 1612103 - protein, 13 aa, Staphylococcus aureus
KEDEAAKHPKLGA

SEQ ID NO: 1612104 - protein, 12 aa, Staphylococcus aureus
KEPTPIQKDSIP

SEQ ID NO: 1612105 - protein, 4 aa, Staphylococcus aureus
KETQ

SEQ ID NO: 1612106 - protein, 7 aa, Staphylococcus aureus
KGDEIAQ

SEQ ID NO: 1612107 - protein, 12 aa, Staphylococcus aureus
KIDGETAEKDWD

SEQ ID NO: 1612108 - protein, 7 aa, Staphylococcus aureus
KIEEKNE

SEQ ID NO: 1612109 - protein, 10 aa, Staphylococcus aureus
KITEEDSDSL

SEQ ID NO: 1612110 - protein, 5 aa, Staphylococcus aureus
KITHE

SEQ ID NO: 1612111 - protein, 6 aa, Staphylococcus aureus
KKKIND

SEQ ID NO: 1612112 - protein, 9 aa, Staphylococcus aureus
KPNTDLSSD

SEQ ID NO: 1612113 - protein, 11 aa, Staphylococcus aureus
KSSKGEEELEE

SEQ ID NO: 1612114 - protein, 4 aa, Staphylococcus aureus
KYKD

SEQ ID NO: 1612115 - protein, 9 aa, Staphylococcus aureus
LDPEVANQF

SEQ ID NO: 1612116 - protein, 6 aa, Staphylococcus aureus
LKDAME

SEQ ID NO: 1612117 - protein, 5 aa, Staphylococcus aureus
LLPEE

SEQ ID NO: 1612118 - protein, 4 aa, Staphylococcus aureus
LNQD

SEQ ID NO: 1612119 - protein, 15 aa, Staphylococcus aureus
LPEEKEDTETPSDDY

SEQ ID NO: 1612120 - protein, 13 aa, Staphylococcus aureus
LQQALKSSSKVEH

SEQ ID NO: 1612121 - protein, 23 aa, Staphylococcus aureus
LTDEEKEKISYTNGAKLLGLSSN

SEQ ID NO: 1612122 - protein, 4 aa, Staphylococcus aureus
LTSQ

SEQ ID NO: 1612123 - protein, 4 aa, Staphylococcus aureus
MDDT

SEQ ID NO: 1612124 - protein, 5 aa, Staphylococcus aureus
MGIGA

SEQ ID NO: 1612125 - protein, 8 aa, Staphylococcus aureus
NFKANQTE

SEQ ID NO: 1612126 - protein, 7 aa, Staphylococcus aureus
NKALAQS

SEQ ID NO: 1612127 - protein, 14 aa, Staphylococcus aureus
NKGRIGAKEGPDAI

SEQ ID NO: 1612128 - protein, 11 aa, Staphylococcus aureus
NKQGGVSKEIP

SEQ ID NO: 1612129 - protein, 12 aa, Staphylococcus aureus
NNGEPQERQNEL

SEQ ID NO: 1612130 - protein, 14 aa, Staphylococcus aureus
NQDKRIGPDPKTFE

SEQ ID NO: 1612131 - protein, 7 aa, Staphylococcus aureus
NREIPNL

SEQ ID NO: 1612132 - protein, 8 aa, Staphylococcus aureus
NTINADKA

SEQ ID NO: 1612133 - protein, 13 aa, Staphylococcus aureus
PAGDGWDSNPFEP

SEQ ID NO: 1612134 - protein, 6 aa, Staphylococcus aureus
PDEVKV

SEQ ID NO: 1612135 - protein, 26 aa, Staphylococcus aureus
PGIRPKGASQDDQHRITTPEEARQLG

SEQ ID NO: 1612136 - protein, 8 aa, Staphylococcus aureus
PLKSGQEQ

SEQ ID NO: 1612137 - protein, 9 aa, Staphylococcus aureus
PNLPEAEEI

SEQ ID NO: 1612138 - protein, 14 aa, Staphylococcus aureus
PRKESTSGRINRRF

SEQ ID NO: 1612139 - protein, 5 aa, Staphylococcus aureus
QEKIE

SEQ ID NO: 1612140 - protein, 8 aa, Staphylococcus aureus
QMHGPELP

SEQ ID NO: 1612141 - protein, 9 aa, Staphylococcus aureus
QNLSNNADL

SEQ ID NO: 1612142 - protein, 13 aa, Staphylococcus aureus
QSEKAPPYERERP

SEQ ID NO: 1612143 - protein, 5 aa, Staphylococcus aureus
QSQAL

SEQ ID NO: 1612144 - protein, 4 aa, Staphylococcus aureus
QTGV

SEQ ID NO: 1612145 - protein, 8 aa, Staphylococcus aureus
QVSPDLDN

SEQ ID NO: 1612146 - protein, 11 aa, Staphylococcus aureus
QYQTPNDESAK

SEQ ID NO: 1612147 - protein, 8 aa, Staphylococcus aureus
RDPQASIG

SEQ ID NO: 1612148 - protein, 7 aa, Staphylococcus aureus
RGATSYH

SEQ ID NO: 1612149 - protein, 6 aa, Staphylococcus aureus
RGGGSI

SEQ ID NO: 1612150 - protein, 5 aa, Staphylococcus aureus
RIQGF

SEQ ID NO: 1612151 - protein, 21 aa, Staphylococcus aureus
RLTEGKYDSEEKMSRSAEESI

SEQ ID NO: 1612152 - protein, 12 aa, Staphylococcus aureus
RMEEKKIPEDLD

SEQ ID NO: 1612153 - protein, 11 aa, Staphylococcus aureus
SASSAYDEKNI

SEQ ID NO: 1612154 - protein, 4 aa, Staphylococcus aureus
SDAF

SEQ ID NO: 1612155 - protein, 7 aa, Staphylococcus aureus
SEEDKTL

SEQ ID NO: 1612156 - protein, 11 aa, Staphylococcus aureus
SEENHKLKKEL

SEQ ID NO: 1612157 - protein, 4 aa, Staphylococcus aureus
SEID

SEQ ID NO: 1612158 - protein, 6 aa, Staphylococcus aureus
SETSGV

SEQ ID NO: 1612159 - protein, 7 aa, Staphylococcus aureus
SKTPEVN

SEQ ID NO: 1612160 - protein, 10 aa, Staphylococcus aureus
SKTTSLDPVK

SEQ ID NO: 1612161 - protein, 4 aa, Staphylococcus aureus
SREG

SEQ ID NO: 1612162 - protein, 7 aa, Staphylococcus aureus
SREGRYA

SEQ ID NO: 1612163 - protein, 5 aa, Staphylococcus aureus
SSYIK

SEQ ID NO: 1612164 - protein, 6 aa, Staphylococcus aureus
STCPKD

SEQ ID NO: 1612165 - protein, 18 aa, Staphylococcus aureus
STKIDIDTSDIPINEPYQ

SEQ ID NO: 1612166 - protein, 7 aa, Staphylococcus aureus
STVQEAG

SEQ ID NO: 1612167 - protein, 6 aa, Staphylococcus aureus
TAQNEQ

SEQ ID NO: 1612168 - protein, 8 aa, Staphylococcus aureus
TDEDSVDD

SEQ ID NO: 1612169 - protein, 5 aa, Staphylococcus aureus
TELGA

SEQ ID NO: 1612170 - protein, 13 aa, Staphylococcus aureus
TENVSTTSNPTQQ

SEQ ID NO: 1612171 - protein, 7 aa, Staphylococcus aureus
TFHDPNK

SEQ ID NO: 1612172 - protein, 5 aa, Staphylococcus aureus
TGLQD

SEQ ID NO: 1612173 - protein, 14 aa, Staphylococcus aureus
TGVSDELGGQGVGK

SEQ ID NO: 1612174 - protein, 7 aa, Staphylococcus aureus
TLTIDET

SEQ ID NO: 1612175 - protein, 13 aa, Staphylococcus aureus
TSPDFNASNVKPQ

SEQ ID NO: 1612176 - protein, 18 aa, Staphylococcus aureus
TSTPNEVKRAIENENDTY

SEQ ID NO: 1612177 - protein, 11 aa, Staphylococcus aureus
TTSEGIQSESV

SEQ ID NO: 1612178 - protein, 15 aa, Staphylococcus aureus
VDTAQKYKLNDRDKE

SEQ ID NO: 1612179 - protein, 9 aa, Staphylococcus aureus
VNNGDTIAT

SEQ ID NO: 1612180 - protein, 4 aa, Staphylococcus aureus
VPSY

SEQ ID NO: 1612181 - protein, 9 aa, Staphylococcus aureus
VRAGKNKQE

SEQ ID NO: 1612182 - protein, 4 aa, Staphylococcus aureus
YEIR

SEQ ID NO: 1612183 - protein, 15 aa, Staphylococcus aureus
YNTSNTKTKDGGREG

SEQ ID NO: 1612184 - protein, 17 aa, Staphylococcus aureus
YSKQNSETARKHSKDMA

SEQ ID NO: 1612185 - protein, 7 aa, Staphylococcus aureus
ADNAFDA

SEQ ID NO: 1612186 - protein, 11 aa, Staphylococcus aureus
AENVQDGSKDI

SEQ ID NO: 1612187 - protein, 4 aa, Staphylococcus aureus
AERY

SEQ ID NO: 1612188 - protein, 7 aa, Staphylococcus aureus
ALESQKI

SEQ ID NO: 1612189 - protein, 10 aa, Staphylococcus aureus
ALNEGKPENI

SEQ ID NO: 1612190 - protein, 4 aa, Staphylococcus aureus
ANDT

SEQ ID NO: 1612191 - protein, 10 aa, Staphylococcus aureus
AQPGEESSNV

SEQ ID NO: 1612192 - protein, 18 aa, Staphylococcus aureus
ASTSNRNFEGRQGKGART

SEQ ID NO: 1612193 - protein, 14 aa, Staphylococcus aureus
DDPIPTTYTDGDEC

SEQ ID NO: 1612194 - protein, 7 aa, Staphylococcus aureus
DDPNARV

SEQ ID NO: 1612195 - protein, 4 aa, Staphylococcus aureus
DEYN

SEQ ID NO: 1612196 - protein, 12 aa, Staphylococcus aureus
DHEDERESRFAN

SEQ ID NO: 1612197 - protein, 5 aa, Staphylococcus aureus
DHIKG

SEQ ID NO: 1612198 - protein, 18 aa, Staphylococcus aureus
DKPKMSAQAVGGAVGSNP

SEQ ID NO: 1612199 - protein, 8 aa, Staphylococcus aureus
DKVDKTDI

SEQ ID NO: 1612200 - protein, 8 aa, Staphylococcus aureus
DQAKKRKK

SEQ ID NO: 1612201 - protein, 6 aa, Staphylococcus aureus
DSTDFT

SEQ ID NO: 1612202 - protein, 6 aa, Staphylococcus aureus
DTYDNN

SEQ ID NO: 1612203 - protein, 8 aa, Staphylococcus aureus
DVPGAESI

SEQ ID NO: 1612204 - protein, 11 aa, Staphylococcus aureus
DVPYKSKNPGC

SEQ ID NO: 1612205 - protein, 9 aa, Staphylococcus aureus
EEAQGGGPL

SEQ ID NO: 1612206 - protein, 14 aa, Staphylococcus aureus
EEEGTMSKEDFKTY

SEQ ID NO: 1612207 - protein, 7 aa, Staphylococcus aureus
EGSNRDI

SEQ ID NO: 1612208 - protein, 8 aa, Staphylococcus aureus
EIAQNNNL

SEQ ID NO: 1612209 - protein, 5 aa, Staphylococcus aureus
ENDNA

SEQ ID NO: 1612210 - protein, 5 aa, Staphylococcus aureus
EPFTN

SEQ ID NO: 1612211 - protein, 5 aa, Staphylococcus aureus
EQLGT

SEQ ID NO: 1612212 - protein, 7 aa, Staphylococcus aureus
FDTPEKL

SEQ ID NO: 1612213 - protein, 5 aa, Staphylococcus aureus
FPTGA

SEQ ID NO: 1612214 - protein, 20 aa, Staphylococcus aureus
GNRLTKDGSTTWDPSKSYIK

SEQ ID NO: 1612215 - protein, 10 aa, Staphylococcus aureus
HPDAGKTTLT

SEQ ID NO: 1612216 - protein, 6 aa, Staphylococcus aureus
IAAGAD

SEQ ID NO: 1612217 - protein, 6 aa, Staphylococcus aureus
IDAGYH

SEQ ID NO: 1612218 - protein, 6 aa, Staphylococcus aureus
IEKISQ

SEQ ID NO: 1612219 - protein, 11 aa, Staphylococcus aureus
IGGQVNDTAGI

SEQ ID NO: 1612220 - protein, 5 aa, Staphylococcus aureus
IKNKY

SEQ ID NO: 1612221 - protein, 7 aa, Staphylococcus aureus
INKGQNT

SEQ ID NO: 1612222 - protein, 5 aa, Staphylococcus aureus
ITGAG

SEQ ID NO: 1612223 - protein, 4 aa, Staphylococcus aureus
ITGS

SEQ ID NO: 1612224 - protein, 7 aa, Staphylococcus aureus
ITGVEKA

SEQ ID NO: 1612225 - protein, 7 aa, Staphylococcus aureus
KADIKAA

SEQ ID NO: 1612226 - protein, 6 aa, Staphylococcus aureus
KEKGDY

SEQ ID NO: 1612227 - protein, 13 aa, Staphylococcus aureus
KEKLNNKSSSELK

SEQ ID NO: 1612228 - protein, 11 aa, Staphylococcus aureus
KGTGKDQPIGL

SEQ ID NO: 1612229 - protein, 10 aa, Staphylococcus aureus
KGYNDETSYA

SEQ ID NO: 1612230 - protein, 7 aa, Staphylococcus aureus
KIGNSAR

SEQ ID NO: 1612231 - protein, 7 aa, Staphylococcus aureus
KKDPLQY

SEQ ID NO: 1612232 - protein, 8 aa, Staphylococcus aureus
KKMSEDLT

SEQ ID NO: 1612233 - protein, 7 aa, Staphylococcus aureus
KKPYAKH

SEQ ID NO: 1612234 - protein, 8 aa, Staphylococcus aureus
KPEQFRET

SEQ ID NO: 1612235 - protein, 5 aa, Staphylococcus aureus
KPFVT

SEQ ID NO: 1612236 - protein, 9 aa, Staphylococcus aureus
KQTPAHHTD

SEQ ID NO: 1612237 - protein, 4 aa, Staphylococcus aureus
KRLP

SEQ ID NO: 1612238 - protein, 6 aa, Staphylococcus aureus
KSMQIQ

SEQ ID NO: 1612239 - protein, 4 aa, Staphylococcus aureus
KSYI

SEQ ID NO: 1612240 - protein, 15 aa, Staphylococcus aureus
KTHTPLSQLPEGSII

SEQ ID NO: 1612241 - protein, 10 aa, Staphylococcus aureus
LEQRDKEITS

SEQ ID NO: 1612242 - protein, 7 aa, Staphylococcus aureus
LNGPKAR

SEQ ID NO: 1612243 - protein, 7 aa, Staphylococcus aureus
LPASNIK

SEQ ID NO: 1612244 - protein, 8 aa, Staphylococcus aureus
LSKETSEL

SEQ ID NO: 1612245 - protein, 6 aa, Staphylococcus aureus
LSKKQE

SEQ ID NO: 1612246 - protein, 13 aa, Staphylococcus aureus
LSRKELSEKINVS

SEQ ID NO: 1612247 - protein, 15 aa, Staphylococcus aureus
NEDITITDQKVSELK

SEQ ID NO: 1612248 - protein, 4 aa, Staphylococcus aureus
NEFT

SEQ ID NO: 1612249 - protein, 6 aa, Staphylococcus aureus
NFPGKE

SEQ ID NO: 1612250 - protein, 4 aa, Staphylococcus aureus
NIEG

SEQ ID NO: 1612251 - protein, 15 aa, Staphylococcus aureus
NLDSRVNEAITTDND

SEQ ID NO: 1612252 - protein, 8 aa, Staphylococcus aureus
NNFKPGQE

SEQ ID NO: 1612253 - protein, 5 aa, Staphylococcus aureus
PIPTR

SEQ ID NO: 1612254 - protein, 5 aa, Staphylococcus aureus
PKDCN

SEQ ID NO: 1612255 - protein, 9 aa, Staphylococcus aureus
PKNPATHQY

SEQ ID NO: 1612256 - protein, 8 aa, Staphylococcus aureus
PSELPEMG

SEQ ID NO: 1612257 - protein, 7 aa, Staphylococcus aureus
PTGGGKS

SEQ ID NO: 1612258 - protein, 6 aa, Staphylococcus aureus
PTGMEI

SEQ ID NO: 1612259 - protein, 5 aa, Staphylococcus aureus
QESLQ

SEQ ID NO: 1612260 - protein, 5 aa, Staphylococcus aureus
QLEDH

SEQ ID NO: 1612261 - protein, 5 aa, Staphylococcus aureus
QMSEE

SEQ ID NO: 1612262 - protein, 4 aa, Staphylococcus aureus
QNEL

SEQ ID NO: 1612263 - protein, 6 aa, Staphylococcus aureus
QPNFTE

SEQ ID NO: 1612264 - protein, 16 aa, Staphylococcus aureus
QRSSTLKANSKAASID

SEQ ID NO: 1612265 - protein, 6 aa, Staphylococcus aureus
QSTNEI

SEQ ID NO: 1612266 - protein, 11 aa, Staphylococcus aureus
QYEGDIPDYPI

SEQ ID NO: 1612267 - protein, 6 aa, Staphylococcus aureus
REATRI

SEQ ID NO: 1612268 - protein, 12 aa, Staphylococcus aureus
RIGSGSASRSIY

SEQ ID NO: 1612269 - protein, 5 aa, Staphylococcus aureus
RKRPG

SEQ ID NO: 1612270 - protein, 4 aa, Staphylococcus aureus
RPDL

SEQ ID NO: 1612271 - protein, 6 aa, Staphylococcus aureus
SEVDSF

SEQ ID NO: 1612272 - protein, 6 aa, Staphylococcus aureus
SGCGKS

SEQ ID NO: 1612273 - protein, 7 aa, Staphylococcus aureus
SGEVNGD

SEQ ID NO: 1612274 - protein, 8 aa, Staphylococcus aureus
SGLNTALT

SEQ ID NO: 1612275 - protein, 6 aa, Staphylococcus aureus
SIDPRI

SEQ ID NO: 1612276 - protein, 7 aa, Staphylococcus aureus
SKVNQDD

SEQ ID NO: 1612277 - protein, 7 aa, Staphylococcus aureus
SPTTNIK

SEQ ID NO: 1612278 - protein, 8 aa, Staphylococcus aureus
SSGSFTRN

SEQ ID NO: 1612279 - protein, 13 aa, Staphylococcus aureus
STQGLHNRGSFEG

SEQ ID NO: 1612280 - protein, 8 aa, Staphylococcus aureus
TDKSYQLS

SEQ ID NO: 1612281 - protein, 6 aa, Staphylococcus aureus
TDPHDS

SEQ ID NO: 1612282 - protein, 6 aa, Staphylococcus aureus
TGGCPH

SEQ ID NO: 1612283 - protein, 4 aa, Staphylococcus aureus
THTG

SEQ ID NO: 1612284 - protein, 8 aa, Staphylococcus aureus
TKEGAELK

SEQ ID NO: 1612285 - protein, 6 aa, Staphylococcus aureus
TKGARG

SEQ ID NO: 1612286 - protein, 14 aa, Staphylococcus aureus
TLDEKTKQALQQSY

SEQ ID NO: 1612287 - protein, 12 aa, Staphylococcus aureus
TNLSGTAEKPRL

SEQ ID NO: 1612288 - protein, 8 aa, Staphylococcus aureus
TPQRIGSM

SEQ ID NO: 1612289 - protein, 4 aa, Staphylococcus aureus
TTAN

SEQ ID NO: 1612290 - protein, 7 aa, Staphylococcus aureus
TTDSDDM

SEQ ID NO: 1612291 - protein, 7 aa, Staphylococcus aureus
VDTRSIT

SEQ ID NO: 1612292 - protein, 8 aa, Staphylococcus aureus
VEATTQIK

SEQ ID NO: 1612293 - protein, 15 aa, Staphylococcus aureus
VPTAAGLASSASAYA

SEQ ID NO: 1612294 - protein, 10 aa, Staphylococcus aureus
VPYKKETGYY

SEQ ID NO: 1612295 - protein, 8 aa, Staphylococcus aureus
VRPTENQI

SEQ ID NO: 1612296 - protein, 7 aa, Staphylococcus aureus
VSGNDTT

SEQ ID NO: 1612297 - protein, 7 aa, Staphylococcus aureus
VSPYPGA

SEQ ID NO: 1612298 - protein, 8 aa, Staphylococcus aureus
VTGKDASQ

SEQ ID NO: 1612299 - protein, 6 aa, Staphylococcus aureus
YPDHTL

SEQ ID NO: 1612300 - protein, 5 aa, Staphylococcus aureus
AFPDS

SEQ ID NO: 1612301 - protein, 5 aa, Staphylococcus aureus
AGTVN

SEQ ID NO: 1612302 - protein, 12 aa, Staphylococcus aureus
AHQTINSKEENL

SEQ ID NO: 1612303 - protein, 7 aa, Staphylococcus aureus
AINQTQK

SEQ ID NO: 1612304 - protein, 5 aa, Staphylococcus aureus
AKDID

SEQ ID NO: 1612305 - protein, 10 aa, Staphylococcus aureus
AKDTSKEEMQ

SEQ ID NO: 1612306 - protein, 26 aa, Staphylococcus aureus
ANYSNNETATPKETTKPSTETTEDNH

SEQ ID NO: 1612307 - protein, 10 aa, Staphylococcus aureus
APPKAGKTSL

SEQ ID NO: 1612308 - protein, 13 aa, Staphylococcus aureus
APSYERGKNPFPK

SEQ ID NO: 1612309 - protein, 7 aa, Staphylococcus aureus
ASTTTCD

SEQ ID NO: 1612310 - protein, 20 aa, Staphylococcus aureus
CKPDPNFSSVQSANPEDHRA

SEQ ID NO: 1612311 - protein, 5 aa, Staphylococcus aureus
DAQRY

SEQ ID NO: 1612312 - protein, 12 aa, Staphylococcus aureus
DDETLDTSVGEG

SEQ ID NO: 1612313 - protein, 7 aa, Staphylococcus aureus
DDSGEYK

SEQ ID NO: 1612314 - protein, 7 aa, Staphylococcus aureus
DKESKQL

SEQ ID NO: 1612315 - protein, 10 aa, Staphylococcus aureus
DKVKADVQDL

SEQ ID NO: 1612316 - protein, 5 aa, Staphylococcus aureus
DMKPP

SEQ ID NO: 1612317 - protein, 4 aa, Staphylococcus aureus
DPKL

SEQ ID NO: 1612318 - protein, 12 aa, Staphylococcus aureus
DSEENDEDGRIE

SEQ ID NO: 1612319 - protein, 5 aa, Staphylococcus aureus
DVSEQ

SEQ ID NO: 1612320 - protein, 10 aa, Staphylococcus aureus
EANPDELTKE

SEQ ID NO: 1612321 - protein, 7 aa, Staphylococcus aureus
EDKGCPW

SEQ ID NO: 1612322 - protein, 7 aa, Staphylococcus aureus
EDLEETT

SEQ ID NO: 1612323 - protein, 4 aa, Staphylococcus aureus
EDTY

SEQ ID NO: 1612324 - protein, 6 aa, Staphylococcus aureus
EEKRCP

SEQ ID NO: 1612325 - protein, 6 aa, Staphylococcus aureus
EETTGK

SEQ ID NO: 1612326 - protein, 5 aa, Staphylococcus aureus
EGGQV

SEQ ID NO: 1612327 - protein, 8 aa, Staphylococcus aureus
EIASGTKS

SEQ ID NO: 1612328 - protein, 8 aa, Staphylococcus aureus
EKAMQRRT

SEQ ID NO: 1612329 - protein, 4 aa, Staphylococcus aureus
EKLN

SEQ ID NO: 1612330 - protein, 4 aa, Staphylococcus aureus
EPQE

SEQ ID NO: 1612331 - protein, 15 aa, Staphylococcus aureus
ESVSERGAKGFGSSG

SEQ ID NO: 1612332 - protein, 10 aa, Staphylococcus aureus
ETEKSKAPNG

SEQ ID NO: 1612333 - protein, 6 aa, Staphylococcus aureus
FNATGT

SEQ ID NO: 1612334 - protein, 16 aa, Staphylococcus aureus
FSETQHEAEVKGSGNK

SEQ ID NO: 1612335 - protein, 8 aa, Staphylococcus aureus
GIGGDGDP

SEQ ID NO: 1612336 - protein, 6 aa, Staphylococcus aureus
GKPGLV

SEQ ID NO: 1612337 - protein, 17 aa, Staphylococcus aureus
GNRNYNVPKQEGSATRL

SEQ ID NO: 1612338 - protein, 10 aa, Staphylococcus aureus
GSGGTFTGTA

SEQ ID NO: 1612339 - protein, 7 aa, Staphylococcus aureus
GTIREIS

SEQ ID NO: 1612340 - protein, 13 aa, Staphylococcus aureus
GYREAFKSNQPLS

SEQ ID NO: 1612341 - protein, 12 aa, Staphylococcus aureus
GYTKEEQKMIDE

SEQ ID NO: 1612342 - protein, 10 aa, Staphylococcus aureus
HQDQQLSSQF

SEQ ID NO: 1612343 - protein, 10 aa, Staphylococcus aureus
HQKADPSMKY

SEQ ID NO: 1612344 - protein, 8 aa, Staphylococcus aureus
HTKQTDWG

SEQ ID NO: 1612345 - protein, 10 aa, Staphylococcus aureus
IAEGRRYTGS

SEQ ID NO: 1612346 - protein, 12 aa, Staphylococcus aureus
IEKANSGHPGLP

SEQ ID NO: 1612347 - protein, 20 aa, Staphylococcus aureus
IHGESGLDGPKLPSTPSRQA

SEQ ID NO: 1612348 - protein, 12 aa, Staphylococcus aureus
IKTNAKTTEVVG

SEQ ID NO: 1612349 - protein, 9 aa, Staphylococcus aureus
IVESTRGKG

SEQ ID NO: 1612350 - protein, 9 aa, Staphylococcus aureus
KDGDPRAKY

SEQ ID NO: 1612351 - protein, 5 aa, Staphylococcus aureus
KEGEL

SEQ ID NO: 1612352 - protein, 19 aa, Staphylococcus aureus
KEQRGPLDGDFEHNDNNRI

SEQ ID NO: 1612353 - protein, 4 aa, Staphylococcus aureus
KGIP

SEQ ID NO: 1612354 - protein, 11 aa, Staphylococcus aureus
KKQPGKPLDTQ

SEQ ID NO: 1612355 - protein, 10 aa, Staphylococcus aureus
KLPGLSERER

SEQ ID NO: 1612356 - protein, 8 aa, Staphylococcus aureus
KLSNDKYR

SEQ ID NO: 1612357 - protein, 9 aa, Staphylococcus aureus
KNTKQSQKE

SEQ ID NO: 1612358 - protein, 5 aa, Staphylococcus aureus
KTLGI

SEQ ID NO: 1612359 - protein, 9 aa, Staphylococcus aureus
KVLNTGEKI

SEQ ID NO: 1612360 - protein, 11 aa, Staphylococcus aureus
KVTAGEAGGIT

SEQ ID NO: 1612361 - protein, 5 aa, Staphylococcus aureus
LEEEG

SEQ ID NO: 1612362 - protein, 4 aa, Staphylococcus aureus
LNER

SEQ ID NO: 1612363 - protein, 14 aa, Staphylococcus aureus
LNTTEKLYSYARQV

SEQ ID NO: 1612364 - protein, 10 aa, Staphylococcus aureus
LPKTNSGKIR

SEQ ID NO: 1612365 - protein, 9 aa, Staphylococcus aureus
LRADKKVDG

SEQ ID NO: 1612366 - protein, 12 aa, Staphylococcus aureus
LRSESSSRFEKG

SEQ ID NO: 1612367 - protein, 7 aa, Staphylococcus aureus
LSNYDEV

SEQ ID NO: 1612368 - protein, 17 aa, Staphylococcus aureus
MKEEKDRLSGEDTREGM

SEQ ID NO: 1612369 - protein, 8 aa, Staphylococcus aureus
MPKEERPR

SEQ ID NO: 1612370 - protein, 18 aa, Staphylococcus aureus
MTKPETTSNELELSANDE

SEQ ID NO: 1612371 - protein, 4 aa, Staphylococcus aureus
NDLG

SEQ ID NO: 1612372 - protein, 11 aa, Staphylococcus aureus
NFDPKSKDEIN

SEQ ID NO: 1612373 - protein, 5 aa, Staphylococcus aureus
NGYVK

SEQ ID NO: 1612374 - protein, 9 aa, Staphylococcus aureus
NIDRGRTDV

SEQ ID NO: 1612375 - protein, 10 aa, Staphylococcus aureus
NQDTGVSYGG

SEQ ID NO: 1612376 - protein, 6 aa, Staphylococcus aureus
PENEQL

SEQ ID NO: 1612377 - protein, 11 aa, Staphylococcus aureus
PKAYGGEGATI

SEQ ID NO: 1612378 - protein, 17 aa, Staphylococcus aureus
PPYDKGEPFYAYYKNLK

SEQ ID NO: 1612379 - protein, 10 aa, Staphylococcus aureus
PQDTESYTHR

SEQ ID NO: 1612380 - protein, 7 aa, Staphylococcus aureus
QNNPFGK

SEQ ID NO: 1612381 - protein, 6 aa, Staphylococcus aureus
QQSSMP

SEQ ID NO: 1612382 - protein, 6 aa, Staphylococcus aureus
RDEQGQ

SEQ ID NO: 1612383 - protein, 8 aa, Staphylococcus aureus
RGASNKIN

SEQ ID NO: 1612384 - protein, 5 aa, Staphylococcus aureus
RGMNR

SEQ ID NO: 1612385 - protein, 37 aa, Staphylococcus aureus
RKEDIDKKQQAPASTQTTQQAPAKEEKKYNQYPTKPV

SEQ ID NO: 1612386 - protein, 9 aa, Staphylococcus aureus
RKESQAKNI

SEQ ID NO: 1612387 - protein, 8 aa, Staphylococcus aureus
RYSPEKQL

SEQ ID NO: 1612388 - protein, 5 aa, Staphylococcus aureus
SDQLR

SEQ ID NO: 1612389 - protein, 5 aa, Staphylococcus aureus
SDSHF

SEQ ID NO: 1612390 - protein, 11 aa, Staphylococcus aureus
SEAGQAKGYRR

SEQ ID NO: 1612391 - protein, 8 aa, Staphylococcus aureus
SEQQSYAS

SEQ ID NO: 1612392 - protein, 5 aa, Staphylococcus aureus
SGLDK

SEQ ID NO: 1612393 - protein, 7 aa, Staphylococcus aureus
SNGRYKP

SEQ ID NO: 1612394 - protein, 19 aa, Staphylococcus aureus
SPANDVKGNQPLSGELGKG

SEQ ID NO: 1612395 - protein, 6 aa, Staphylococcus aureus
SRPDKL

SEQ ID NO: 1612396 - protein, 8 aa, Staphylococcus aureus
SSQSSSQA

SEQ ID NO: 1612397 - protein, 14 aa, Staphylococcus aureus
SYNHPEADIGPRIQ

SEQ ID NO: 1612398 - protein, 9 aa, Staphylococcus aureus
TADDEPEYQ

SEQ ID NO: 1612399 - protein, 7 aa, Staphylococcus aureus
TAYENGI

SEQ ID NO: 1612400 - protein, 8 aa, Staphylococcus aureus
TDNGRGIP

SEQ ID NO: 1612401 - protein, 21 aa, Staphylococcus aureus
THIGGGTGASEGSKATTVTPG

SEQ ID NO: 1612402 - protein, 7 aa, Staphylococcus aureus
TLKPVND

SEQ ID NO: 1612403 - protein, 12 aa, Staphylococcus aureus
TNMKQNAAGVDV

SEQ ID NO: 1612404 - protein, 24 aa, Staphylococcus aureus
TSITHSDGHTSISKTPKVTGKGQQ

SEQ ID NO: 1612405 - protein, 6 aa, Staphylococcus aureus
TSKRGY

SEQ ID NO: 1612406 - protein, 7 aa, Staphylococcus aureus
VEEATKT

SEQ ID NO: 1612407 - protein, 12 aa, Staphylococcus aureus
VNPEDNDLDQGF

SEQ ID NO: 1612408 - protein, 5 aa, Staphylococcus aureus
VRHGE

SEQ ID NO: 1612409 - protein, 7 aa, Staphylococcus aureus
VSKGNAI

SEQ ID NO: 1612410 - protein, 13 aa, Staphylococcus aureus
VSVQYDDSKVAVS

SEQ ID NO: 1612411 - protein, 4 aa, Staphylococcus aureus
WNSP

SEQ ID NO: 1612412 - protein, 7 aa, Staphylococcus aureus
YLDTTGD

SEQ ID NO: 1612413 - protein, 14 aa, Staphylococcus aureus
YYQEAGRAGRDGLK

SEQ ID NO: 1612414 - protein, 5 aa, Staphylococcus aureus
AFPER

SEQ ID NO: 1612415 - protein, 10 aa, Staphylococcus aureus
AGHKQPGTET

SEQ ID NO: 1612416 - protein, 11 aa, Staphylococcus aureus
AGRNKDKLQNV

SEQ ID NO: 1612417 - protein, 15 aa, Staphylococcus aureus
AGTKYDEQGSAQPLG

SEQ ID NO: 1612418 - protein, 8 aa, Staphylococcus aureus
AIEPSNGV

SEQ ID NO: 1612419 - protein, 6 aa, Staphylococcus aureus
AKYGYD

SEQ ID NO: 1612420 - protein, 7 aa, Staphylococcus aureus
AQDDKQF

SEQ ID NO: 1612421 - protein, 8 aa, Staphylococcus aureus
ARQDKDYA

SEQ ID NO: 1612422 - protein, 17 aa, Staphylococcus aureus
ARTNKEIEADVKEGGKY

SEQ ID NO: 1612423 - protein, 12 aa, Staphylococcus aureus
ASNIEKYTNQGT

SEQ ID NO: 1612424 - protein, 10 aa, Staphylococcus aureus
ASTGKQDVSD

SEQ ID NO: 1612425 - protein, 4 aa, Staphylococcus aureus
ATQR

SEQ ID NO: 1612426 - protein, 6 aa, Staphylococcus aureus
AYEGGA

SEQ ID NO: 1612427 - protein, 9 aa, Staphylococcus aureus
AYNNKPNSR

SEQ ID NO: 1612428 - protein, 7 aa, Staphylococcus aureus
DAQHGHG

SEQ ID NO: 1612429 - protein, 6 aa, Staphylococcus aureus
DDLDGQ

SEQ ID NO: 1612430 - protein, 5 aa, Staphylococcus aureus
DDNIK

SEQ ID NO: 1612431 - protein, 12 aa, Staphylococcus aureus
DESNKDNKYVRN

SEQ ID NO: 1612432 - protein, 14 aa, Staphylococcus aureus
DGITFNSAGENLAY

SEQ ID NO: 1612433 - protein, 6 aa, Staphylococcus aureus
DGRNNV

SEQ ID NO: 1612434 - protein, 6 aa, Staphylococcus aureus
DHGGKA

SEQ ID NO: 1612435 - protein, 5 aa, Staphylococcus aureus
DHLNQ

SEQ ID NO: 1612436 - protein, 15 aa, Staphylococcus aureus
DIREPEADSPVQNGP

SEQ ID NO: 1612437 - protein, 6 aa, Staphylococcus aureus
DKANVD

SEQ ID NO: 1612438 - protein, 8 aa, Staphylococcus aureus
DKSISNYR

SEQ ID NO: 1612439 - protein, 4 aa, Staphylococcus aureus
DKVY

SEQ ID NO: 1612440 - protein, 19 aa, Staphylococcus aureus
DLSRTKGDYVQGKNSFTSG

SEQ ID NO: 1612441 - protein, 7 aa, Staphylococcus aureus
DNEIEGA

SEQ ID NO: 1612442 - protein, 13 aa, Staphylococcus aureus
DNFQDEQGEDTDR

SEQ ID NO: 1612443 - protein, 8 aa, Staphylococcus aureus
DPKSIGVG

SEQ ID NO: 1612444 - protein, 6 aa, Staphylococcus aureus
DQEYSD

SEQ ID NO: 1612445 - protein, 8 aa, Staphylococcus aureus
DQISNDKK

SEQ ID NO: 1612446 - protein, 8 aa, Staphylococcus aureus
DQQRNGKV

SEQ ID NO: 1612447 - protein, 8 aa, Staphylococcus aureus
DSGLDGPA

SEQ ID NO: 1612448 - protein, 6 aa, Staphylococcus aureus
DSRTQV

SEQ ID NO: 1612449 - protein, 5 aa, Staphylococcus aureus
DVEVS

SEQ ID NO: 1612450 - protein, 5 aa, Staphylococcus aureus
DYENS

SEQ ID NO: 1612451 - protein, 5 aa, Staphylococcus aureus
DYPKA

SEQ ID NO: 1612452 - protein, 4 aa, Staphylococcus aureus
EDGR

SEQ ID NO: 1612453 - protein, 9 aa, Staphylococcus aureus
EDRNSNVES

SEQ ID NO: 1612454 - protein, 14 aa, Staphylococcus aureus
EDSALDKEAYDRAT

SEQ ID NO: 1612455 - protein, 14 aa, Staphylococcus aureus
EDTSESKAFADRDD

SEQ ID NO: 1612456 - protein, 10 aa, Staphylococcus aureus
EEPSDNPELD

SEQ ID NO: 1612457 - protein, 5 aa, Staphylococcus aureus
EGDVI

SEQ ID NO: 1612458 - protein, 6 aa, Staphylococcus aureus
EHFTYD

SEQ ID NO: 1612459 - protein, 14 aa, Staphylococcus aureus
EHNEDAERLFFIAK

SEQ ID NO: 1612460 - protein, 5 aa, Staphylococcus aureus
EIDDA

SEQ ID NO: 1612461 - protein, 11 aa, Staphylococcus aureus
ELNDKENRRDQ

SEQ ID NO: 1612462 - protein, 6 aa, Staphylococcus aureus
ELYHPQ

SEQ ID NO: 1612463 - protein, 4 aa, Staphylococcus aureus
ENDD

SEQ ID NO: 1612464 - protein, 15 aa, Staphylococcus aureus
EQNDKMLEVLSNFKY

SEQ ID NO: 1612465 - protein, 7 aa, Staphylococcus aureus
EQSLPAN

SEQ ID NO: 1612466 - protein, 11 aa, Staphylococcus aureus
ERLKSSRKLDA

SEQ ID NO: 1612467 - protein, 17 aa, Staphylococcus aureus
ESESGYKISKNSGVPYQ

SEQ ID NO: 1612468 - protein, 4 aa, Staphylococcus aureus
ETDY

SEQ ID NO: 1612469 - protein, 13 aa, Staphylococcus aureus
ETMQNGNEDVKAQ

SEQ ID NO: 1612470 - protein, 11 aa, Staphylococcus aureus
FDKKRNEHDER

SEQ ID NO: 1612471 - protein, 10 aa, Staphylococcus aureus
FGCGSSREHA

SEQ ID NO: 1612472 - protein, 10 aa, Staphylococcus aureus
FGSENNDIKT

SEQ ID NO: 1612473 - protein, 10 aa, Staphylococcus aureus
FKDSEENEVD

SEQ ID NO: 1612474 - protein, 6 aa, Staphylococcus aureus
FPQRYT

SEQ ID NO: 1612475 - protein, 5 aa, Staphylococcus aureus
FRVPN

SEQ ID NO: 1612476 - protein, 8 aa, Staphylococcus aureus
FSTKEPKS

SEQ ID NO: 1612477 - protein, 14 aa, Staphylococcus aureus
GDDIKEKDSQLNEI

SEQ ID NO: 1612478 - protein, 6 aa, Staphylococcus aureus
GDLPRN

SEQ ID NO: 1612479 - protein, 7 aa, Staphylococcus aureus
GDNKLSE

SEQ ID NO: 1612480 - protein, 4 aa, Staphylococcus aureus
GKDS

SEQ ID NO: 1612481 - protein, 10 aa, Staphylococcus aureus
GKNTTQNPDA

SEQ ID NO: 1612482 - protein, 17 aa, Staphylococcus aureus
GKTYTSKDKKSQIEVRK

SEQ ID NO: 1612483 - protein, 6 aa, Staphylococcus aureus
GNVKAY

SEQ ID NO: 1612484 - protein, 14 aa, Staphylococcus aureus
HATTREGKYAGQER

SEQ ID NO: 1612485 - protein, 9 aa, Staphylococcus aureus
HKKDHHSRR

SEQ ID NO: 1612486 - protein, 12 aa, Staphylococcus aureus
HNGASRADSGTV

SEQ ID NO: 1612487 - protein, 5 aa, Staphylococcus aureus
HNQHK

SEQ ID NO: 1612488 - protein, 5 aa, Staphylococcus aureus
HSPTA

SEQ ID NO: 1612489 - protein, 8 aa, Staphylococcus aureus
HTNQGSNH

SEQ ID NO: 1612490 - protein, 5 aa, Staphylococcus aureus
HYSPA

SEQ ID NO: 1612491 - protein, 21 aa, Staphylococcus aureus
IDAENKARQQSDDNYLASGST

SEQ ID NO: 1612492 - protein, 7 aa, Staphylococcus aureus
IGGSGNY

SEQ ID NO: 1612493 - protein, 18 aa, Staphylococcus aureus
IKPLPNDKDSIIDYIKGA

SEQ ID NO: 1612494 - protein, 6 aa, Staphylococcus aureus
INDADR

SEQ ID NO: 1612495 - protein, 6 aa, Staphylococcus aureus
IPTEGT

SEQ ID NO: 1612496 - protein, 8 aa, Staphylococcus aureus
IRANTKED

SEQ ID NO: 1612497 - protein, 6 aa, Staphylococcus aureus
IRPNLG

SEQ ID NO: 1612498 - protein, 7 aa, Staphylococcus aureus
ISQREAE

SEQ ID NO: 1612499 - protein, 18 aa, Staphylococcus aureus
IVTETSEEELKQFKDNDL

SEQ ID NO: 1612500 - protein, 6 aa, Staphylococcus aureus
KAKNYK

SEQ ID NO: 1612501 - protein, 7 aa, Staphylococcus aureus
KEKGFTP

SEQ ID NO: 1612502 - protein, 14 aa, Staphylococcus aureus
KETGEITESTEKAV

SEQ ID NO: 1612503 - protein, 6 aa, Staphylococcus aureus
KETGKP

SEQ ID NO: 1612504 - protein, 4 aa, Staphylococcus aureus
KEVE

SEQ ID NO: 1612505 - protein, 14 aa, Staphylococcus aureus
KGFVESKENEQYDD

SEQ ID NO: 1612506 - protein, 9 aa, Staphylococcus aureus
KGTAKGVGN

SEQ ID NO: 1612507 - protein, 10 aa, Staphylococcus aureus
KIDHNSEDEY

SEQ ID NO: 1612508 - protein, 12 aa, Staphylococcus aureus
KKAFDGRGNYTL

SEQ ID NO: 1612509 - protein, 10 aa, Staphylococcus aureus
KKDEARGKSL

SEQ ID NO: 1612510 - protein, 6 aa, Staphylococcus aureus
KKENRP

SEQ ID NO: 1612511 - protein, 7 aa, Staphylococcus aureus
KLADEAG

SEQ ID NO: 1612512 - protein, 8 aa, Staphylococcus aureus
KLALTQSQ

SEQ ID NO: 1612513 - protein, 4 aa, Staphylococcus aureus
KLGA

SEQ ID NO: 1612514 - protein, 6 aa, Staphylococcus aureus
KNDEKL

SEQ ID NO: 1612515 - protein, 8 aa, Staphylococcus aureus
KQHRPSDL

SEQ ID NO: 1612516 - protein, 9 aa, Staphylococcus aureus
KQSSHLKDT

SEQ ID NO: 1612517 - protein, 11 aa, Staphylococcus aureus
KRDAKKENPIP

SEQ ID NO: 1612518 - protein, 7 aa, Staphylococcus aureus
KRSQDVG

SEQ ID NO: 1612519 - protein, 13 aa, Staphylococcus aureus
KRSQELNQSVPEI

SEQ ID NO: 1612520 - protein, 4 aa, Staphylococcus aureus
KSSF

SEQ ID NO: 1612521 - protein, 7 aa, Staphylococcus aureus
KTKNYAK

SEQ ID NO: 1612522 - protein, 10 aa, Staphylococcus aureus
KTPEENITAA

SEQ ID NO: 1612523 - protein, 8 aa, Staphylococcus aureus
KTTNSEVD

SEQ ID NO: 1612524 - protein, 6 aa, Staphylococcus aureus
KVSGKQ

SEQ ID NO: 1612525 - protein, 10 aa, Staphylococcus aureus
LAESQDDLEA

SEQ ID NO: 1612526 - protein, 5 aa, Staphylococcus aureus
LASID

SEQ ID NO: 1612527 - protein, 8 aa, Staphylococcus aureus
LEKESFTT

SEQ ID NO: 1612528 - protein, 19 aa, Staphylococcus aureus
LGPTGSQMGKKETTKDTAR

SEQ ID NO: 1612529 - protein, 4 aa, Staphylococcus aureus
LISP

SEQ ID NO: 1612530 - protein, 9 aa, Staphylococcus aureus
LKAKGDYEA

SEQ ID NO: 1612531 - protein, 6 aa, Staphylococcus aureus
LPDEPL

SEQ ID NO: 1612532 - protein, 5 aa, Staphylococcus aureus
LYENN

SEQ ID NO: 1612533 - protein, 8 aa, Staphylococcus aureus
MEEPPSLK

SEQ ID NO: 1612534 - protein, 13 aa, Staphylococcus aureus
MTATSDNKHESLH

SEQ ID NO: 1612535 - protein, 7 aa, Staphylococcus aureus
MTPPPVK

SEQ ID NO: 1612536 - protein, 14 aa, Staphylococcus aureus
NEAVQEAGKISEGT

SEQ ID NO: 1612537 - protein, 6 aa, Staphylococcus aureus
NEDTPN

SEQ ID NO: 1612538 - protein, 4 aa, Staphylococcus aureus
NFGN

SEQ ID NO: 1612539 - protein, 10 aa, Staphylococcus aureus
NGETQVGEVA

SEQ ID NO: 1612540 - protein, 6 aa, Staphylococcus aureus
NGGNLV

SEQ ID NO: 1612541 - protein, 10 aa, Staphylococcus aureus
NGSSTSSHKV

SEQ ID NO: 1612542 - protein, 9 aa, Staphylococcus aureus
NKDEAAFNQ

SEQ ID NO: 1612543 - protein, 7 aa, Staphylococcus aureus
NKEPIHD

SEQ ID NO: 1612544 - protein, 6 aa, Staphylococcus aureus
NNGLDG

SEQ ID NO: 1612545 - protein, 6 aa, Staphylococcus aureus
NNTINQ

SEQ ID NO: 1612546 - protein, 7 aa, Staphylococcus aureus
NQEPGQR

SEQ ID NO: 1612547 - protein, 8 aa, Staphylococcus aureus
NQPLNDAD

SEQ ID NO: 1612548 - protein, 6 aa, Staphylococcus aureus
NREQPM

SEQ ID NO: 1612549 - protein, 6 aa, Staphylococcus aureus
NRIQKN

SEQ ID NO: 1612550 - protein, 6 aa, Staphylococcus aureus
NRNPDN

SEQ ID NO: 1612551 - protein, 23 aa, Staphylococcus aureus
NSTWDPQSNSIAKYNYPNGKPEH

SEQ ID NO: 1612552 - protein, 7 aa, Staphylococcus aureus
NTEEIDE

SEQ ID NO: 1612553 - protein, 4 aa, Staphylococcus aureus
NVDK

SEQ ID NO: 1612554 - protein, 4 aa, Staphylococcus aureus
NVEA

SEQ ID NO: 1612555 - protein, 4 aa, Staphylococcus aureus
PALT

SEQ ID NO: 1612556 - protein, 6 aa, Staphylococcus aureus
PHETWA

SEQ ID NO: 1612557 - protein, 6 aa, Staphylococcus aureus
PKQVVS

SEQ ID NO: 1612558 - protein, 9 aa, Staphylococcus aureus
PKSLNPKEA

SEQ ID NO: 1612559 - protein, 7 aa, Staphylococcus aureus
PNPETNS

SEQ ID NO: 1612560 - protein, 6 aa, Staphylococcus aureus
PTEYGT

SEQ ID NO: 1612561 - protein, 10 aa, Staphylococcus aureus
PTIPNYKGTN

SEQ ID NO: 1612562 - protein, 8 aa, Staphylococcus aureus
PTKNEEVQ

SEQ ID NO: 1612563 - protein, 15 aa, Staphylococcus aureus
PYVGEDKKNKKPPYK

SEQ ID NO: 1612564 - protein, 8 aa, Staphylococcus aureus
QAEKDGIG

SEQ ID NO: 1612565 - protein, 6 aa, Staphylococcus aureus
QDEEEL

SEQ ID NO: 1612566 - protein, 5 aa, Staphylococcus aureus
QEDGI

SEQ ID NO: 1612567 - protein, 12 aa, Staphylococcus aureus
QGIENLTDEEAA

SEQ ID NO: 1612568 - protein, 9 aa, Staphylococcus aureus
QHKEQPLES

SEQ ID NO: 1612569 - protein, 6 aa, Staphylococcus aureus
QKQYIS

SEQ ID NO: 1612570 - protein, 4 aa, Staphylococcus aureus
QMDD

SEQ ID NO: 1612571 - protein, 7 aa, Staphylococcus aureus
QRYRNRG

SEQ ID NO: 1612572 - protein, 7 aa, Staphylococcus aureus
QSTMRTA

SEQ ID NO: 1612573 - protein, 4 aa, Staphylococcus aureus
QTEQ

SEQ ID NO: 1612574 - protein, 4 aa, Staphylococcus aureus
RAQA

SEQ ID NO: 1612575 - protein, 15 aa, Staphylococcus aureus
RDEGEVTASDITHDS

SEQ ID NO: 1612576 - protein, 7 aa, Staphylococcus aureus
RDGRPLP

SEQ ID NO: 1612577 - protein, 7 aa, Staphylococcus aureus
RFGSTNE

SEQ ID NO: 1612578 - protein, 8 aa, Staphylococcus aureus
RGITGGNG

SEQ ID NO: 1612579 - protein, 8 aa, Staphylococcus aureus
RGQPSPDK

SEQ ID NO: 1612580 - protein, 4 aa, Staphylococcus aureus
RHEP

SEQ ID NO: 1612581 - protein, 6 aa, Staphylococcus aureus
RKNMQS

SEQ ID NO: 1612582 - protein, 8 aa, Staphylococcus aureus
RKPNTDLA

SEQ ID NO: 1612583 - protein, 17 aa, Staphylococcus aureus
RPDNPENVIRSETSRQI

SEQ ID NO: 1612584 - protein, 10 aa, Staphylococcus aureus
RYSPTSHSIN

SEQ ID NO: 1612585 - protein, 20 aa, Staphylococcus aureus
SEMTPAPDCGETSYQGHQRL

SEQ ID NO: 1612586 - protein, 7 aa, Staphylococcus aureus
SERALGS

SEQ ID NO: 1612587 - protein, 8 aa, Staphylococcus aureus
SGKLARGI

SEQ ID NO: 1612588 - protein, 6 aa, Staphylococcus aureus
SGTSIR

SEQ ID NO: 1612589 - protein, 19 aa, Staphylococcus aureus
SHEPDNAGAGKSNLPGNPI

SEQ ID NO: 1612590 - protein, 6 aa, Staphylococcus aureus
SHPNGD

SEQ ID NO: 1612591 - protein, 7 aa, Staphylococcus aureus
SNSISNE

SEQ ID NO: 1612592 - protein, 10 aa, Staphylococcus aureus
SQKPHYTNKL

SEQ ID NO: 1612593 - protein, 7 aa, Staphylococcus aureus
SSEKFTN

SEQ ID NO: 1612594 - protein, 17 aa, Staphylococcus aureus
SSIAQGEAKDLNHAAET

SEQ ID NO: 1612595 - protein, 11 aa, Staphylococcus aureus
SVNQRQNGQRN

SEQ ID NO: 1612596 - protein, 8 aa, Staphylococcus aureus
TAVDYKGT

SEQ ID NO: 1612597 - protein, 7 aa, Staphylococcus aureus
TDTAKNV

SEQ ID NO: 1612598 - protein, 6 aa, Staphylococcus aureus
TDVSAG

SEQ ID NO: 1612599 - protein, 12 aa, Staphylococcus aureus
TEENGNKRTTVD

SEQ ID NO: 1612600 - protein, 13 aa, Staphylococcus aureus
TENNGPEAGEKEE

SEQ ID NO: 1612601 - protein, 9 aa, Staphylococcus aureus
TKQYEEKHI

SEQ ID NO: 1612602 - protein, 9 aa, Staphylococcus aureus
TLQKSKGKL

SEQ ID NO: 1612603 - protein, 5 aa, Staphylococcus aureus
TNEGN

SEQ ID NO: 1612604 - protein, 7 aa, Staphylococcus aureus
TSKEVDE

SEQ ID NO: 1612605 - protein, 12 aa, Staphylococcus aureus
TTAKSGKHSPVA

SEQ ID NO: 1612606 - protein, 10 aa, Staphylococcus aureus
TVYKEGTATE

SEQ ID NO: 1612607 - protein, 10 aa, Staphylococcus aureus
VASEDTLFSP

SEQ ID NO: 1612608 - protein, 7 aa, Staphylococcus aureus
VEATPNH

SEQ ID NO: 1612609 - protein, 9 aa, Staphylococcus aureus
VEEAKNAAR

SEQ ID NO: 1612610 - protein, 16 aa, Staphylococcus aureus
VEGTNKAIASTIDGEA

SEQ ID NO: 1612611 - protein, 6 aa, Staphylococcus aureus
VKAKGH

SEQ ID NO: 1612612 - protein, 6 aa, Staphylococcus aureus
VKSPYV

SEQ ID NO: 1612613 - protein, 12 aa, Staphylococcus aureus
VLPLNSGTEAVE

SEQ ID NO: 1612614 - protein, 4 aa, Staphylococcus aureus
VTQP

SEQ ID NO: 1612615 - protein, 4 aa, Staphylococcus aureus
WRGT

SEQ ID NO: 1612616 - protein, 8 aa, Staphylococcus aureus
YEADSQSI

SEQ ID NO: 1612617 - protein, 11 aa, Staphylococcus aureus
YITPENATTEI

SEQ ID NO: 1612618 - protein, 7 aa, Staphylococcus aureus
YKPSERG

SEQ ID NO: 1612619 - protein, 4 aa, Staphylococcus aureus
YPQG

SEQ ID NO: 1612620 - protein, 12 aa, Staphylococcus aureus
YSAGKNKDANLV

SEQ ID NO: 1612621 - protein, 10 aa, Staphylococcus aureus
YTEDGKIDNG

SEQ ID NO: 1612622 - protein, 8 aa, Staphylococcus aureus
YTEKEQKQ

SEQ ID NO: 1612623 - protein, 9 aa, Staphylococcus aureus
YTQPSGEAA

SEQ ID NO: 1612624 - protein, 7 aa, Staphylococcus aureus
ADDDTSI

SEQ ID NO: 1612625 - protein, 4 aa, Staphylococcus aureus
AEQI

SEQ ID NO: 1612626 - protein, 7 aa, Staphylococcus aureus
AIAKTSM

SEQ ID NO: 1612627 - protein, 8 aa, Staphylococcus aureus
AKEQGIEV

SEQ ID NO: 1612628 - protein, 8 aa, Staphylococcus aureus
AKGADRPL

SEQ ID NO: 1612629 - protein, 15 aa, Staphylococcus aureus
AKNVTTRNDPDGRSR

SEQ ID NO: 1612630 - protein, 11 aa, Staphylococcus aureus
ALKRSKKELSD

SEQ ID NO: 1612631 - protein, 10 aa, Staphylococcus aureus
ANEEERQQSK

SEQ ID NO: 1612632 - protein, 6 aa, Staphylococcus aureus
ANGTGD

SEQ ID NO: 1612633 - protein, 7 aa, Staphylococcus aureus
ANLGSSV

SEQ ID NO: 1612634 - protein, 6 aa, Staphylococcus aureus
ANRERL

SEQ ID NO: 1612635 - protein, 6 aa, Staphylococcus aureus
AQDNDA

SEQ ID NO: 1612636 - protein, 4 aa, Staphylococcus aureus
AQEG

SEQ ID NO: 1612637 - protein, 6 aa, Staphylococcus aureus
ARAEKG

SEQ ID NO: 1612638 - protein, 13 aa, Staphylococcus aureus
ARGPVSKGLLTSN

SEQ ID NO: 1612639 - protein, 20 aa, Staphylococcus aureus
ARKASRAVGKRGTDLPGQIA

SEQ ID NO: 1612640 - protein, 8 aa, Staphylococcus aureus
ASDKDGVP

SEQ ID NO: 1612641 - protein, 10 aa, Staphylococcus aureus
ASNVSDKEAF

SEQ ID NO: 1612642 - protein, 13 aa, Staphylococcus aureus
ASTSNTPHIGEQQ

SEQ ID NO: 1612643 - protein, 10 aa, Staphylococcus aureus
ATRAQTSSAM

SEQ ID NO: 1612644 - protein, 7 aa, Staphylococcus aureus
ATSTVQD

SEQ ID NO: 1612645 - protein, 9 aa, Staphylococcus aureus
AVGPTGEVT

SEQ ID NO: 1612646 - protein, 19 aa, Staphylococcus aureus
AVKSGEADGCVSAGNTGAL

SEQ ID NO: 1612647 - protein, 6 aa, Staphylococcus aureus
CTGRGE

SEQ ID NO: 1612648 - protein, 9 aa, Staphylococcus aureus
DDPEITSHP

SEQ ID NO: 1612649 - protein, 8 aa, Staphylococcus aureus
DDRDTTGI

SEQ ID NO: 1612650 - protein, 15 aa, Staphylococcus aureus
DEAYPSIKARGGGYQ

SEQ ID NO: 1612651 - protein, 5 aa, Staphylococcus aureus
DENAS

SEQ ID NO: 1612652 - protein, 13 aa, Staphylococcus aureus
DENNCNQPYSKEA

SEQ ID NO: 1612653 - protein, 5 aa, Staphylococcus aureus
DEREH

SEQ ID NO: 1612654 - protein, 6 aa, Staphylococcus aureus
DERSKE

SEQ ID NO: 1612655 - protein, 9 aa, Staphylococcus aureus
DEVEKEIEE

SEQ ID NO: 1612656 - protein, 12 aa, Staphylococcus aureus
DHPLQPHTDAVE

SEQ ID NO: 1612657 - protein, 4 aa, Staphylococcus aureus
DIDE

SEQ ID NO: 1612658 - protein, 6 aa, Staphylococcus aureus
DKFETP

SEQ ID NO: 1612659 - protein, 11 aa, Staphylococcus aureus
DLGQTTEQGEW

SEQ ID NO: 1612660 - protein, 4 aa, Staphylococcus aureus
DNNA

SEQ ID NO: 1612661 - protein, 9 aa, Staphylococcus aureus
DPTKVTRSA

SEQ ID NO: 1612662 - protein, 7 aa, Staphylococcus aureus
DQIGPLT

SEQ ID NO: 1612663 - protein, 6 aa, Staphylococcus aureus
DRDDYT

SEQ ID NO: 1612664 - protein, 9 aa, Staphylococcus aureus
DSDDEGDRI

SEQ ID NO: 1612665 - protein, 6 aa, Staphylococcus aureus
DSDDIY

SEQ ID NO: 1612666 - protein, 8 aa, Staphylococcus aureus
DSKKVPVT

SEQ ID NO: 1612667 - protein, 11 aa, Staphylococcus aureus
DSNFPREVKSH

SEQ ID NO: 1612668 - protein, 9 aa, Staphylococcus aureus
DSSTEITTP

SEQ ID NO: 1612669 - protein, 10 aa, Staphylococcus aureus
DSTATSQTPV

SEQ ID NO: 1612670 - protein, 6 aa, Staphylococcus aureus
DSVSNL

SEQ ID NO: 1612671 - protein, 16 aa, Staphylococcus aureus
DVQAGHAASVGRVDPD

SEQ ID NO: 1612672 - protein, 6 aa, Staphylococcus aureus
DYGPSE

SEQ ID NO: 1612673 - protein, 7 aa, Staphylococcus aureus
DYHQKHG

SEQ ID NO: 1612674 - protein, 4 aa, Staphylococcus aureus
DYNM

SEQ ID NO: 1612675 - protein, 9 aa, Staphylococcus aureus
EAAKGYSAE

SEQ ID NO: 1612676 - protein, 4 aa, Staphylococcus aureus
EATL

SEQ ID NO: 1612677 - protein, 7 aa, Staphylococcus aureus
EDGIPTD

SEQ ID NO: 1612678 - protein, 9 aa, Staphylococcus aureus
EDNAQANAF

SEQ ID NO: 1612679 - protein, 5 aa, Staphylococcus aureus
EDQPQ

SEQ ID NO: 1612680 - protein, 9 aa, Staphylococcus aureus
EEGVASDTT

SEQ ID NO: 1612681 - protein, 15 aa, Staphylococcus aureus
EEVEELQKEQPDSVF

SEQ ID NO: 1612682 - protein, 15 aa, Staphylococcus aureus
EEYQSKEEVINDYIN

SEQ ID NO: 1612683 - protein, 5 aa, Staphylococcus aureus
EFPQS

SEQ ID NO: 1612684 - protein, 17 aa, Staphylococcus aureus
EGNEKMSKSKGNVINPD

SEQ ID NO: 1612685 - protein, 6 aa, Staphylococcus aureus
EGYEPW

SEQ ID NO: 1612686 - protein, 9 aa, Staphylococcus aureus
EIAAEQGTK

SEQ ID NO: 1612687 - protein, 8 aa, Staphylococcus aureus
EIGQSKIN

SEQ ID NO: 1612688 - protein, 15 aa, Staphylococcus aureus
EKIKENLREVSGQPY

SEQ ID NO: 1612689 - protein, 7 aa, Staphylococcus aureus
EKLSDRA

SEQ ID NO: 1612690 - protein, 10 aa, Staphylococcus aureus
ENEDGSYSDR

SEQ ID NO: 1612691 - protein, 5 aa, Staphylococcus aureus
ENEVI

SEQ ID NO: 1612692 - protein, 4 aa, Staphylococcus aureus
ENPQ

SEQ ID NO: 1612693 - protein, 5 aa, Staphylococcus aureus
EPPIK

SEQ ID NO: 1612694 - protein, 8 aa, Staphylococcus aureus
EQERQEAV

SEQ ID NO: 1612695 - protein, 13 aa, Staphylococcus aureus
EQTARTIKSYQQP

SEQ ID NO: 1612696 - protein, 10 aa, Staphylococcus aureus
ESANKNTRDI

SEQ ID NO: 1612697 - protein, 7 aa, Staphylococcus aureus
ESTDIDK

SEQ ID NO: 1612698 - protein, 8 aa, Staphylococcus aureus
EYNSSNER

SEQ ID NO: 1612699 - protein, 7 aa, Staphylococcus aureus
FEKKNGG

SEQ ID NO: 1612700 - protein, 11 aa, Staphylococcus aureus
FEQSTMNESRY

SEQ ID NO: 1612701 - protein, 21 aa, Staphylococcus aureus
FESGEWSQETAETRGKKVRAI

SEQ ID NO: 1612702 - protein, 6 aa, Staphylococcus aureus
FPDSTL

SEQ ID NO: 1612703 - protein, 17 aa, Staphylococcus aureus
FPGGKRERGESSAEAVT

SEQ ID NO: 1612704 - protein, 12 aa, Staphylococcus aureus
FSPEYVAKYLTK

SEQ ID NO: 1612705 - protein, 4 aa, Staphylococcus aureus
FSSG

SEQ ID NO: 1612706 - protein, 13 aa, Staphylococcus aureus
GAQNEDEVRERGI

SEQ ID NO: 1612707 - protein, 16 aa, Staphylococcus aureus
GDETGTISNIQKDKLT

SEQ ID NO: 1612708 - protein, 10 aa, Staphylococcus aureus
GDIPGREDDD

SEQ ID NO: 1612709 - protein, 7 aa, Staphylococcus aureus
GEKFPES

SEQ ID NO: 1612710 - protein, 6 aa, Staphylococcus aureus
GEQPFT

SEQ ID NO: 1612711 - protein, 5 aa, Staphylococcus aureus
GHEQP

SEQ ID NO: 1612712 - protein, 8 aa, Staphylococcus aureus
GKKRIEVP

SEQ ID NO: 1612713 - protein, 23 aa, Staphylococcus aureus
GKLEDDEDRVEAAKRELEEETGY

SEQ ID NO: 1612714 - protein, 5 aa, Staphylococcus aureus
GMTEK

SEQ ID NO: 1612715 - protein, 10 aa, Staphylococcus aureus
GNQRISEATI

SEQ ID NO: 1612716 - protein, 14 aa, Staphylococcus aureus
GRGTVATGRVERGQ

SEQ ID NO: 1612717 - protein, 4 aa, Staphylococcus aureus
GRRT

SEQ ID NO: 1612718 - protein, 7 aa, Staphylococcus aureus
GSAAQQL

SEQ ID NO: 1612719 - protein, 7 aa, Staphylococcus aureus
GSHGVDP

SEQ ID NO: 1612720 - protein, 15 aa, Staphylococcus aureus
GTGTNDTEKSIQASI

SEQ ID NO: 1612721 - protein, 9 aa, Staphylococcus aureus
GTNKQNVYQ

SEQ ID NO: 1612722 - protein, 5 aa, Staphylococcus aureus
GTTSG

SEQ ID NO: 1612723 - protein, 12 aa, Staphylococcus aureus
GVDDSKKLTDTK

SEQ ID NO: 1612724 - protein, 9 aa, Staphylococcus aureus
GVEPNKSYQ

SEQ ID NO: 1612725 - protein, 10 aa, Staphylococcus aureus
GVSDPEQKRK

SEQ ID NO: 1612726 - protein, 9 aa, Staphylococcus aureus
GVVDEQKGE

SEQ ID NO: 1612727 - protein, 4 aa, Staphylococcus aureus
GYQS

SEQ ID NO: 1612728 - protein, 9 aa, Staphylococcus aureus
HHGGGHKRQ

SEQ ID NO: 1612729 - protein, 15 aa, Staphylococcus aureus
HKRNNFKGERQNIEQ

SEQ ID NO: 1612730 - protein, 7 aa, Staphylococcus aureus
HKSQGSE

SEQ ID NO: 1612731 - protein, 7 aa, Staphylococcus aureus
HNDQTKK

SEQ ID NO: 1612732 - protein, 11 aa, Staphylococcus aureus
HRADEDAATTA

SEQ ID NO: 1612733 - protein, 8 aa, Staphylococcus aureus
IAKRNRSF

SEQ ID NO: 1612734 - protein, 12 aa, Staphylococcus aureus
IDKDGNAHPLTQ

SEQ ID NO: 1612735 - protein, 5 aa, Staphylococcus aureus
IGTGT

SEQ ID NO: 1612736 - protein, 7 aa, Staphylococcus aureus
IKEDDIK

SEQ ID NO: 1612737 - protein, 6 aa, Staphylococcus aureus
IKNKNE

SEQ ID NO: 1612738 - protein, 8 aa, Staphylococcus aureus
INSENIQT

SEQ ID NO: 1612739 - protein, 20 aa, Staphylococcus aureus
IPEKELNETKLKAKSLLEVS

SEQ ID NO: 1612740 - protein, 5 aa, Staphylococcus aureus
IPKGQ

SEQ ID NO: 1612741 - protein, 19 aa, Staphylococcus aureus
IQSGRNDLTLNGKKVSGAA

SEQ ID NO: 1612742 - protein, 8 aa, Staphylococcus aureus
ISEETYRN

SEQ ID NO: 1612743 - protein, 9 aa, Staphylococcus aureus
ISRQEASKD

SEQ ID NO: 1612744 - protein, 5 aa, Staphylococcus aureus
ITNYS

SEQ ID NO: 1612745 - protein, 15 aa, Staphylococcus aureus
KAGKTLAKYAASTGQ

SEQ ID NO: 1612746 - protein, 13 aa, Staphylococcus aureus
KAPNRDPRDEFET

SEQ ID NO: 1612747 - protein, 7 aa, Staphylococcus aureus
KAQENGL

SEQ ID NO: 1612748 - protein, 7 aa, Staphylococcus aureus
KAQHARE

SEQ ID NO: 1612749 - protein, 9 aa, Staphylococcus aureus
KDASGPYHK

SEQ ID NO: 1612750 - protein, 6 aa, Staphylococcus aureus
KDNKTV

SEQ ID NO: 1612751 - protein, 14 aa, Staphylococcus aureus
KELQKLRDADTVTV

SEQ ID NO: 1612752 - protein, 8 aa, Staphylococcus aureus
KEVSDKTI

SEQ ID NO: 1612753 - protein, 12 aa, Staphylococcus aureus
KFNTRDKNRFER

SEQ ID NO: 1612754 - protein, 11 aa, Staphylococcus aureus
KGDYPGDVTPA

SEQ ID NO: 1612755 - protein, 6 aa, Staphylococcus aureus
KGTEQK

SEQ ID NO: 1612756 - protein, 16 aa, Staphylococcus aureus
KIDGITDLRDETSLRT

SEQ ID NO: 1612757 - protein, 5 aa, Staphylococcus aureus
KIEEK

SEQ ID NO: 1612758 - protein, 8 aa, Staphylococcus aureus
KKAIESGV

SEQ ID NO: 1612759 - protein, 7 aa, Staphylococcus aureus
KKDGSIN

SEQ ID NO: 1612760 - protein, 6 aa, Staphylococcus aureus
KKESPE

SEQ ID NO: 1612761 - protein, 11 aa, Staphylococcus aureus
KKGYKSKEPLD

SEQ ID NO: 1612762 - protein, 9 aa, Staphylococcus aureus
KKYTERLQQ

SEQ ID NO: 1612763 - protein, 7 aa, Staphylococcus aureus
KNGVGKS

SEQ ID NO: 1612764 - protein, 8 aa, Staphylococcus aureus
KNKPEGQN

SEQ ID NO: 1612765 - protein, 7 aa, Staphylococcus aureus
KPSDVHT

SEQ ID NO: 1612766 - protein, 8 aa, Staphylococcus aureus
KSGNEQQW

SEQ ID NO: 1612767 - protein, 9 aa, Staphylococcus aureus
KSVTPNRIS

SEQ ID NO: 1612768 - protein, 15 aa, Staphylococcus aureus
KTLEDTFDSIKYLLE

SEQ ID NO: 1612769 - protein, 4 aa, Staphylococcus aureus
KVQA

SEQ ID NO: 1612770 - protein, 7 aa, Staphylococcus aureus
LADKGTK

SEQ ID NO: 1612771 - protein, 8 aa, Staphylococcus aureus
LANGNTQL

SEQ ID NO: 1612772 - protein, 5 aa, Staphylococcus aureus
LECPT

SEQ ID NO: 1612773 - protein, 6 aa, Staphylococcus aureus
LEEGTV

SEQ ID NO: 1612774 - protein, 9 aa, Staphylococcus aureus
LEENNGNRV

SEQ ID NO: 1612775 - protein, 7 aa, Staphylococcus aureus
LESSPRG

SEQ ID NO: 1612776 - protein, 11 aa, Staphylococcus aureus
LETSNADQADP

SEQ ID NO: 1612777 - protein, 16 aa, Staphylococcus aureus
LKGKEYQLEKNNGEHH

SEQ ID NO: 1612778 - protein, 7 aa, Staphylococcus aureus
LNTEQHH

SEQ ID NO: 1612779 - protein, 4 aa, Staphylococcus aureus
LPQD

SEQ ID NO: 1612780 - protein, 8 aa, Staphylococcus aureus
LQKELGKG

SEQ ID NO: 1612781 - protein, 9 aa, Staphylococcus aureus
LREKTGAGM

SEQ ID NO: 1612782 - protein, 10 aa, Staphylococcus aureus
LRRQDENFDG

SEQ ID NO: 1612783 - protein, 8 aa, Staphylococcus aureus
LSDGQKQK

SEQ ID NO: 1612784 - protein, 10 aa, Staphylococcus aureus
LSERIQDESW

SEQ ID NO: 1612785 - protein, 9 aa, Staphylococcus aureus
LSNGERYDE

SEQ ID NO: 1612786 - protein, 5 aa, Staphylococcus aureus
LSPNE

SEQ ID NO: 1612787 - protein, 4 aa, Staphylococcus aureus
LSQG

SEQ ID NO: 1612788 - protein, 7 aa, Staphylococcus aureus
LSSEQEL

SEQ ID NO: 1612789 - protein, 9 aa, Staphylococcus aureus
LTEPSSKEI

SEQ ID NO: 1612790 - protein, 11 aa, Staphylococcus aureus
LTEQGADKAER

SEQ ID NO: 1612791 - protein, 16 aa, Staphylococcus aureus
LTQPEVYNNPQKANEL

SEQ ID NO: 1612792 - protein, 10 aa, Staphylococcus aureus
MSSTKNKLAG

SEQ ID NO: 1612793 - protein, 15 aa, Staphylococcus aureus
NARMPERNHKTDAGY

SEQ ID NO: 1612794 - protein, 5 aa, Staphylococcus aureus
NATDL

SEQ ID NO: 1612795 - protein, 5 aa, Staphylococcus aureus
NDEEL

SEQ ID NO: 1612796 - protein, 8 aa, Staphylococcus aureus
NDIEKEKY

SEQ ID NO: 1612797 - protein, 10 aa, Staphylococcus aureus
NDNMIDPQSA

SEQ ID NO: 1612798 - protein, 14 aa, Staphylococcus aureus
NDSVNNDVDEHEYR

SEQ ID NO: 1612799 - protein, 8 aa, Staphylococcus aureus
NEEITTVE

SEQ ID NO: 1612800 - protein, 6 aa, Staphylococcus aureus
NERARA

SEQ ID NO: 1612801 - protein, 6 aa, Staphylococcus aureus
NFSDNS

SEQ ID NO: 1612802 - protein, 22 aa, Staphylococcus aureus
NGEEINEQPSNFKDRAKRFFKG

SEQ ID NO: 1612803 - protein, 5 aa, Staphylococcus aureus
NGEKR

SEQ ID NO: 1612804 - protein, 4 aa, Staphylococcus aureus
NHSG

SEQ ID NO: 1612805 - protein, 12 aa, Staphylococcus aureus
NIKNAKSKIERM

SEQ ID NO: 1612806 - protein, 8 aa, Staphylococcus aureus
NINNQQYR

SEQ ID NO: 1612807 - protein, 5 aa, Staphylococcus aureus
NNAAL

SEQ ID NO: 1612808 - protein, 6 aa, Staphylococcus aureus
NNAKSV

SEQ ID NO: 1612809 - protein, 14 aa, Staphylococcus aureus
NNDESTCEVKYRKM

SEQ ID NO: 1612810 - protein, 5 aa, Staphylococcus aureus
NQLNK

SEQ ID NO: 1612811 - protein, 13 aa, Staphylococcus aureus
NQQPDKRSIDSSK

SEQ ID NO: 1612812 - protein, 6 aa, Staphylococcus aureus
NQQSYE

SEQ ID NO: 1612813 - protein, 4 aa, Staphylococcus aureus
NRDD

SEQ ID NO: 1612814 - protein, 6 aa, Staphylococcus aureus
NRLSEQ

SEQ ID NO: 1612815 - protein, 18 aa, Staphylococcus aureus
NRNARQGKNPDDVKIGDL

SEQ ID NO: 1612816 - protein, 11 aa, Staphylococcus aureus
NSEDQAKTSFD

SEQ ID NO: 1612817 - protein, 22 aa, Staphylococcus aureus
NSQNEAIEKAGKALVDSGAVTD

SEQ ID NO: 1612818 - protein, 8 aa, Staphylococcus aureus
NTNPKPWD

SEQ ID NO: 1612819 - protein, 8 aa, Staphylococcus aureus
NTSNKYIT

SEQ ID NO: 1612820 - protein, 8 aa, Staphylococcus aureus
NVNQPEDV

SEQ ID NO: 1612821 - protein, 11 aa, Staphylococcus aureus
NYSKAQAKKRA

SEQ ID NO: 1612822 - protein, 7 aa, Staphylococcus aureus
PATQQRD

SEQ ID NO: 1612823 - protein, 13 aa, Staphylococcus aureus
PDSEVPERTEGYE

SEQ ID NO: 1612824 - protein, 5 aa, Staphylococcus aureus
PDVPS

SEQ ID NO: 1612825 - protein, 7 aa, Staphylococcus aureus
PEGEGQS

SEQ ID NO: 1612826 - protein, 5 aa, Staphylococcus aureus
PEIDE

SEQ ID NO: 1612827 - protein, 14 aa, Staphylococcus aureus
PGSISQSRSSMEET

SEQ ID NO: 1612828 - protein, 7 aa, Staphylococcus aureus
PKDASTK

SEQ ID NO: 1612829 - protein, 5 aa, Staphylococcus aureus
PKVRE

SEQ ID NO: 1612830 - protein, 19 aa, Staphylococcus aureus
PLGNEAGTFGLPGGFTSTE

SEQ ID NO: 1612831 - protein, 5 aa, Staphylococcus aureus
PTGVG

SEQ ID NO: 1612832 - protein, 5 aa, Staphylococcus aureus
QAEEA

SEQ ID NO: 1612833 - protein, 6 aa, Staphylococcus aureus
QDDKQI

SEQ ID NO: 1612834 - protein, 13 aa, Staphylococcus aureus
QDEDYKYDEKTKA

SEQ ID NO: 1612835 - protein, 14 aa, Staphylococcus aureus
QDLPYSSKRPMRSA

SEQ ID NO: 1612836 - protein, 12 aa, Staphylococcus aureus
QFDPELKNKVMQ

SEQ ID NO: 1612837 - protein, 7 aa, Staphylococcus aureus
QGNIDTN

SEQ ID NO: 1612838 - protein, 6 aa, Staphylococcus aureus
QHADDV

SEQ ID NO: 1612839 - protein, 6 aa, Staphylococcus aureus
QNNNGL

SEQ ID NO: 1612840 - protein, 7 aa, Staphylococcus aureus
QNPTDTR

SEQ ID NO: 1612841 - protein, 4 aa, Staphylococcus aureus
QQDL

SEQ ID NO: 1612842 - protein, 9 aa, Staphylococcus aureus
QQSQNGRSL

SEQ ID NO: 1612843 - protein, 12 aa, Staphylococcus aureus
QRYYTGRRDENV

SEQ ID NO: 1612844 - protein, 14 aa, Staphylococcus aureus
QSAASLSDFESSAK

SEQ ID NO: 1612845 - protein, 9 aa, Staphylococcus aureus
QSGYTGEDG

SEQ ID NO: 1612846 - protein, 12 aa, Staphylococcus aureus
QSPRLATTHPAN

SEQ ID NO: 1612847 - protein, 11 aa, Staphylococcus aureus
QSVEDAIKGAQ

SEQ ID NO: 1612848 - protein, 7 aa, Staphylococcus aureus
QTEPSTS

SEQ ID NO: 1612849 - protein, 16 aa, Staphylococcus aureus
RDEKKQDDIRKKYNNS

SEQ ID NO: 1612850 - protein, 4 aa, Staphylococcus aureus
RDNT

SEQ ID NO: 1612851 - protein, 5 aa, Staphylococcus aureus
RDQPN

SEQ ID NO: 1612852 - protein, 22 aa, Staphylococcus aureus
REQNKEANQHAQQALYKLIKKN

SEQ ID NO: 1612853 - protein, 8 aa, Staphylococcus aureus
RISQSGSI

SEQ ID NO: 1612854 - protein, 6 aa, Staphylococcus aureus
RITPQR

SEQ ID NO: 1612855 - protein, 6 aa, Staphylococcus aureus
RKAGNM

SEQ ID NO: 1612856 - protein, 8 aa, Staphylococcus aureus
RNKETGKI

SEQ ID NO: 1612857 - protein, 9 aa, Staphylococcus aureus
RNKSAHNQP

SEQ ID NO: 1612858 - protein, 6 aa, Staphylococcus aureus
RPLDEA

SEQ ID NO: 1612859 - protein, 5 aa, Staphylococcus aureus
RPYNI

SEQ ID NO: 1612860 - protein, 12 aa, Staphylococcus aureus
RQDNQYNDRPLN

SEQ ID NO: 1612861 - protein, 13 aa, Staphylococcus aureus
RVYRPTDENDEYA

SEQ ID NO: 1612862 - protein, 7 aa, Staphylococcus aureus
SAIEASK

SEQ ID NO: 1612863 - protein, 14 aa, Staphylococcus aureus
SALGPGGLTRERAQ

SEQ ID NO: 1612864 - protein, 9 aa, Staphylococcus aureus
SDEGDASGL

SEQ ID NO: 1612865 - protein, 5 aa, Staphylococcus aureus
SDISK

SEQ ID NO: 1612866 - protein, 11 aa, Staphylococcus aureus
SDKEKYKAQAE

SEQ ID NO: 1612867 - protein, 7 aa, Staphylococcus aureus
SEEENVD

SEQ ID NO: 1612868 - protein, 9 aa, Staphylococcus aureus
SEQLNSPDN

SEQ ID NO: 1612869 - protein, 25 aa, Staphylococcus aureus
SGGQPQSKIPTFGQKTPLGRAGQPV

SEQ ID NO: 1612870 - protein, 5 aa, Staphylococcus aureus
SKVEG

SEQ ID NO: 1612871 - protein, 5 aa, Staphylococcus aureus
SLPVP

SEQ ID NO: 1612872 - protein, 6 aa, Staphylococcus aureus
SNHDAY

SEQ ID NO: 1612873 - protein, 10 aa, Staphylococcus aureus
SNKGPFNDNT

SEQ ID NO: 1612874 - protein, 8 aa, Staphylococcus aureus
SNPPQEIQ

SEQ ID NO: 1612875 - protein, 4 aa, Staphylococcus aureus
SNTL

SEQ ID NO: 1612876 - protein, 10 aa, Staphylococcus aureus
SPGPGHPLDD

SEQ ID NO: 1612877 - protein, 10 aa, Staphylococcus aureus
SPNELSNHNN

SEQ ID NO: 1612878 - protein, 6 aa, Staphylococcus aureus
SRTRKK

SEQ ID NO: 1612879 - protein, 5 aa, Staphylococcus aureus
SSSSM

SEQ ID NO: 1612880 - protein, 6 aa, Staphylococcus aureus
STGEKQ

SEQ ID NO: 1612881 - protein, 6 aa, Staphylococcus aureus
STTVTN

SEQ ID NO: 1612882 - protein, 6 aa, Staphylococcus aureus
SYADKT

SEQ ID NO: 1612883 - protein, 9 aa, Staphylococcus aureus
SYETPANLN

SEQ ID NO: 1612884 - protein, 17 aa, Staphylococcus aureus
SYSNSNFDTNSRTPEEV

SEQ ID NO: 1612885 - protein, 4 aa, Staphylococcus aureus
TEEQ

SEQ ID NO: 1612886 - protein, 11 aa, Staphylococcus aureus
TEETLTDERVS

SEQ ID NO: 1612887 - protein, 4 aa, Staphylococcus aureus
TENP

SEQ ID NO: 1612888 - protein, 12 aa, Staphylococcus aureus
TEQTMQQNHANL

SEQ ID NO: 1612889 - protein, 10 aa, Staphylococcus aureus
TERPEGVEAG

SEQ ID NO: 1612890 - protein, 8 aa, Staphylococcus aureus
TGLEENDP

SEQ ID NO: 1612891 - protein, 6 aa, Staphylococcus aureus
THTSGI

SEQ ID NO: 1612892 - protein, 11 aa, Staphylococcus aureus
TIEETSQNAVN

SEQ ID NO: 1612893 - protein, 11 aa, Staphylococcus aureus
TKGETSGHTQR

SEQ ID NO: 1612894 - protein, 11 aa, Staphylococcus aureus
TLKQKPNTSQL

SEQ ID NO: 1612895 - protein, 5 aa, Staphylococcus aureus
TPGSD

SEQ ID NO: 1612896 - protein, 8 aa, Staphylococcus aureus
TPLDEKTM

SEQ ID NO: 1612897 - protein, 8 aa, Staphylococcus aureus
TPNEYRNL

SEQ ID NO: 1612898 - protein, 5 aa, Staphylococcus aureus
TQTGG

SEQ ID NO: 1612899 - protein, 12 aa, Staphylococcus aureus
TSNTYSKDEEKL

SEQ ID NO: 1612900 - protein, 14 aa, Staphylococcus aureus
TVGNMSDTITINVE

SEQ ID NO: 1612901 - protein, 7 aa, Staphylococcus aureus
TVKDGYA

SEQ ID NO: 1612902 - protein, 5 aa, Staphylococcus aureus
TYPGG

SEQ ID NO: 1612903 - protein, 8 aa, Staphylococcus aureus
VAGNQNNI

SEQ ID NO: 1612904 - protein, 22 aa, Staphylococcus aureus
VDIPSYSVKPGQTISVREKSQK

SEQ ID NO: 1612905 - protein, 12 aa, Staphylococcus aureus
VEDGQGTLSDAV

SEQ ID NO: 1612906 - protein, 5 aa, Staphylococcus aureus
VEEES

SEQ ID NO: 1612907 - protein, 4 aa, Staphylococcus aureus
VEQG

SEQ ID NO: 1612908 - protein, 10 aa, Staphylococcus aureus
VESSKDLQDT

SEQ ID NO: 1612909 - protein, 14 aa, Staphylococcus aureus
VHEAASAVDEKDLY

SEQ ID NO: 1612910 - protein, 11 aa, Staphylococcus aureus
VKENTLATIGS

SEQ ID NO: 1612911 - protein, 4 aa, Staphylococcus aureus
VKTA

SEQ ID NO: 1612912 - protein, 7 aa, Staphylococcus aureus
VNQAGSL

SEQ ID NO: 1612913 - protein, 4 aa, Staphylococcus aureus
VNSF

SEQ ID NO: 1612914 - protein, 17 aa, Staphylococcus aureus
VPQPQGKTATSPEEALA

SEQ ID NO: 1612915 - protein, 6 aa, Staphylococcus aureus
VSEGKS

SEQ ID NO: 1612916 - protein, 10 aa, Staphylococcus aureus
YDDPLGDYGK

SEQ ID NO: 1612917 - protein, 8 aa, Staphylococcus aureus
YEHEETVN

SEQ ID NO: 1612918 - protein, 12 aa, Staphylococcus aureus
YGENGPGDPGTV

SEQ ID NO: 1612919 - protein, 9 aa, Staphylococcus aureus
YKEISSCSN

SEQ ID NO: 1612920 - protein, 9 aa, Staphylococcus aureus
YKPTEENKK

SEQ ID NO: 1612921 - protein, 6 aa, Staphylococcus aureus
YKRDGE

SEQ ID NO: 1612922 - protein, 5 aa, Staphylococcus aureus
YKVST

SEQ ID NO: 1612923 - protein, 5 aa, Staphylococcus aureus
YLPDK

SEQ ID NO: 1612924 - protein, 8 aa, Staphylococcus aureus
YNIPTDKA

SEQ ID NO: 1612925 - protein, 10 aa, Staphylococcus aureus
YPAEGYNNPR

SEQ ID NO: 1612926 - protein, 5 aa, Staphylococcus aureus
YPYYA

SEQ ID NO: 1612927 - protein, 4 aa, Staphylococcus aureus
YRGK

SEQ ID NO: 1612928 - protein, 5 aa, Staphylococcus aureus
YYQNP

SEQ ID NO: 1612929 - protein, 8 aa, Staphylococcus aureus
ADVEEQVE

SEQ ID NO: 1612930 - protein, 8 aa, Staphylococcus aureus
AENGYPVT

SEQ ID NO: 1612931 - protein, 6 aa, Staphylococcus aureus
AGGSLA

SEQ ID NO: 1612932 - protein, 7 aa, Staphylococcus aureus
AGVPSAA

SEQ ID NO: 1612933 - protein, 9 aa, Staphylococcus aureus
AKDKATRAK

SEQ ID NO: 1612934 - protein, 7 aa, Staphylococcus aureus
AKEITGE

SEQ ID NO: 1612935 - protein, 11 aa, Staphylococcus aureus
AKFGKEPRAYG

SEQ ID NO: 1612936 - protein, 31 aa, Staphylococcus aureus
AKGMPEGEYDLGGQKVTVQSQQARLANGALA

SEQ ID NO: 1612937 - protein, 9 aa, Staphylococcus aureus
AKKTGATVI

SEQ ID NO: 1612938 - protein, 5 aa, Staphylococcus aureus
AKPIE

SEQ ID NO: 1612939 - protein, 9 aa, Staphylococcus aureus
AKQNGYHED

SEQ ID NO: 1612940 - protein, 8 aa, Staphylococcus aureus
AKSNKQEY

SEQ ID NO: 1612941 - protein, 4 aa, Staphylococcus aureus
ALVG

SEQ ID NO: 1612942 - protein, 5 aa, Staphylococcus aureus
ANKNH

SEQ ID NO: 1612943 - protein, 4 aa, Staphylococcus aureus
APEF

SEQ ID NO: 1612944 - protein, 18 aa, Staphylococcus aureus
AQKAGEETKQAAEKQAEA

SEQ ID NO: 1612945 - protein, 6 aa, Staphylococcus aureus
AQRGDL

SEQ ID NO: 1612946 - protein, 10 aa, Staphylococcus aureus
ASAGNHAQGV

SEQ ID NO: 1612947 - protein, 12 aa, Staphylococcus aureus
ATEQVTSRLKDK

SEQ ID NO: 1612948 - protein, 6 aa, Staphylococcus aureus
AVERGA

SEQ ID NO: 1612949 - protein, 6 aa, Staphylococcus aureus
DAEDQY

SEQ ID NO: 1612950 - protein, 9 aa, Staphylococcus aureus
DASDNTAKL

SEQ ID NO: 1612951 - protein, 11 aa, Staphylococcus aureus
DDRIPTRNLND

SEQ ID NO: 1612952 - protein, 5 aa, Staphylococcus aureus
DDRVD

SEQ ID NO: 1612953 - protein, 9 aa, Staphylococcus aureus
DEEMKEDLE

SEQ ID NO: 1612954 - protein, 7 aa, Staphylococcus aureus
DEEYRED

SEQ ID NO: 1612955 - protein, 7 aa, Staphylococcus aureus
DETTVQA

SEQ ID NO: 1612956 - protein, 4 aa, Staphylococcus aureus
DGEV

SEQ ID NO: 1612957 - protein, 13 aa, Staphylococcus aureus
DGNYSEEMKEVYY

SEQ ID NO: 1612958 - protein, 7 aa, Staphylococcus aureus
DGTLSSK

SEQ ID NO: 1612959 - protein, 5 aa, Staphylococcus aureus
DKDLS

SEQ ID NO: 1612960 - protein, 15 aa, Staphylococcus aureus
DKNKDKVSLTMIDPH

SEQ ID NO: 1612961 - protein, 5 aa, Staphylococcus aureus
DNGPM

SEQ ID NO: 1612962 - protein, 10 aa, Staphylococcus aureus
DNKVTEGSTV

SEQ ID NO: 1612963 - protein, 6 aa, Staphylococcus aureus
DPTQYN

SEQ ID NO: 1612964 - protein, 5 aa, Staphylococcus aureus
DQKAT

SEQ ID NO: 1612965 - protein, 6 aa, Staphylococcus aureus
DQPMHK

SEQ ID NO: 1612966 - protein, 6 aa, Staphylococcus aureus
DQTREI

SEQ ID NO: 1612967 - protein, 5 aa, Staphylococcus aureus
DVTVE

SEQ ID NO: 1612968 - protein, 5 aa, Staphylococcus aureus
EDLDD

SEQ ID NO: 1612969 - protein, 10 aa, Staphylococcus aureus
EEGDSIGQHP

SEQ ID NO: 1612970 - protein, 5 aa, Staphylococcus aureus
EFETK

SEQ ID NO: 1612971 - protein, 10 aa, Staphylococcus aureus
EKHGITPKTI

SEQ ID NO: 1612972 - protein, 25 aa, Staphylococcus aureus
ELAEHTSKRERRAIEAERDTDELKK

SEQ ID NO: 1612973 - protein, 16 aa, Staphylococcus aureus
ELDSQTGHVSLGKNER

SEQ ID NO: 1612974 - protein, 11 aa, Staphylococcus aureus
ELKNGKLKDDD

SEQ ID NO: 1612975 - protein, 4 aa, Staphylococcus aureus
EMGG

SEQ ID NO: 1612976 - protein, 5 aa, Staphylococcus aureus
ENEHR

SEQ ID NO: 1612977 - protein, 8 aa, Staphylococcus aureus
ENNQEDGY

SEQ ID NO: 1612978 - protein, 13 aa, Staphylococcus aureus
EPLGGAHKDIEQQ

SEQ ID NO: 1612979 - protein, 5 aa, Staphylococcus aureus
EPQVG

SEQ ID NO: 1612980 - protein, 10 aa, Staphylococcus aureus
EPTNDLDTET

SEQ ID NO: 1612981 - protein, 11 aa, Staphylococcus aureus
EQKTGIKPDIV

SEQ ID NO: 1612982 - protein, 4 aa, Staphylococcus aureus
EQYR

SEQ ID NO: 1612983 - protein, 9 aa, Staphylococcus aureus
EREGKYQVE

SEQ ID NO: 1612984 - protein, 18 aa, Staphylococcus aureus
ERKKNQSETNARYEEEQE

SEQ ID NO: 1612985 - protein, 18 aa, Staphylococcus aureus
ETDEVVPDKNATSEDSEE

SEQ ID NO: 1612986 - protein, 9 aa, Staphylococcus aureus
ETTSSTLEK

SEQ ID NO: 1612987 - protein, 5 aa, Staphylococcus aureus
ETYNP

SEQ ID NO: 1612988 - protein, 13 aa, Staphylococcus aureus
EVRKKLRDQYAKE

SEQ ID NO: 1612989 - protein, 5 aa, Staphylococcus aureus
FANKD

SEQ ID NO: 1612990 - protein, 6 aa, Staphylococcus aureus
FARSGD

SEQ ID NO: 1612991 - protein, 8 aa, Staphylococcus aureus
FDDDKPAV

SEQ ID NO: 1612992 - protein, 4 aa, Staphylococcus aureus
FIGS

SEQ ID NO: 1612993 - protein, 9 aa, Staphylococcus aureus
FKPNTNDEV

SEQ ID NO: 1612994 - protein, 10 aa, Staphylococcus aureus
FNPKDRSQRA

SEQ ID NO: 1612995 - protein, 6 aa, Staphylococcus aureus
FNQTNQ

SEQ ID NO: 1612996 - protein, 7 aa, Staphylococcus aureus
GAPPHGG

SEQ ID NO: 1612997 - protein, 8 aa, Staphylococcus aureus
GDENSNEW

SEQ ID NO: 1612998 - protein, 17 aa, Staphylococcus aureus
GDTSDNIPGVAGVGEKT

SEQ ID NO: 1612999 - protein, 15 aa, Staphylococcus aureus
GEPADDENGAAKPRL

SEQ ID NO: 1613000 - protein, 9 aa, Staphylococcus aureus
GHSERSGAV

SEQ ID NO: 1613001 - protein, 7 aa, Staphylococcus aureus
GKLDDKM

SEQ ID NO: 1613002 - protein, 12 aa, Staphylococcus aureus
GKYDSQLIIPIV

SEQ ID NO: 1613003 - protein, 4 aa, Staphylococcus aureus
GLQL

SEQ ID NO: 1613004 - protein, 5 aa, Staphylococcus aureus
GLSDG

SEQ ID NO: 1613005 - protein, 5 aa, Staphylococcus aureus
GRDEG

SEQ ID NO: 1613006 - protein, 9 aa, Staphylococcus aureus
GSDWEGQFA

SEQ ID NO: 1613007 - protein, 21 aa, Staphylococcus aureus
GSITLKGKKLEKLSNKELSDI

SEQ ID NO: 1613008 - protein, 12 aa, Staphylococcus aureus
GVSGDSVYPTSS

SEQ ID NO: 1613009 - protein, 11 aa, Staphylococcus aureus
HETQSKPKQKT

SEQ ID NO: 1613010 - protein, 19 aa, Staphylococcus aureus
HIPNGDADDMNAEASKYND

SEQ ID NO: 1613011 - protein, 12 aa, Staphylococcus aureus
HKSNQVNENRIN

SEQ ID NO: 1613012 - protein, 10 aa, Staphylococcus aureus
HLERKKGSIT

SEQ ID NO: 1613013 - protein, 11 aa, Staphylococcus aureus
HLTDEQKEKGI

SEQ ID NO: 1613014 - protein, 8 aa, Staphylococcus aureus
HQGDPQQS

SEQ ID NO: 1613015 - protein, 7 aa, Staphylococcus aureus
HQRDNDR

SEQ ID NO: 1613016 - protein, 8 aa, Staphylococcus aureus
HSQNDKVA

SEQ ID NO: 1613017 - protein, 4 aa, Staphylococcus aureus
IASN

SEQ ID NO: 1613018 - protein, 7 aa, Staphylococcus aureus
IDINGNR

SEQ ID NO: 1613019 - protein, 13 aa, Staphylococcus aureus
IEENEAKKSRLDS

SEQ ID NO: 1613020 - protein, 5 aa, Staphylococcus aureus
IGMPE

SEQ ID NO: 1613021 - protein, 11 aa, Staphylococcus aureus
IGTDKTDTKTF

SEQ ID NO: 1613022 - protein, 6 aa, Staphylococcus aureus
IKNDSD

SEQ ID NO: 1613023 - protein, 11 aa, Staphylococcus aureus
IKNPNKEGHGE

SEQ ID NO: 1613024 - protein, 8 aa, Staphylococcus aureus
IKQSTSGI

SEQ ID NO: 1613025 - protein, 11 aa, Staphylococcus aureus
INPDASNDQIK

SEQ ID NO: 1613026 - protein, 9 aa, Staphylococcus aureus
IPGSNGAVN

SEQ ID NO: 1613027 - protein, 11 aa, Staphylococcus aureus
ISEYSAHNQRG

SEQ ID NO: 1613028 - protein, 6 aa, Staphylococcus aureus
ISYTES

SEQ ID NO: 1613029 - protein, 14 aa, Staphylococcus aureus
ITETGLTAGQQILG

SEQ ID NO: 1613030 - protein, 10 aa, Staphylococcus aureus
ITINDKPARL

SEQ ID NO: 1613031 - protein, 12 aa, Staphylococcus aureus
IVTTNNKSLDKV

SEQ ID NO: 1613032 - protein, 7 aa, Staphylococcus aureus
KAKGVDS

SEQ ID NO: 1613033 - protein, 6 aa, Staphylococcus aureus
KAPKAD

SEQ ID NO: 1613034 - protein, 8 aa, Staphylococcus aureus
KASRIRQI

SEQ ID NO: 1613035 - protein, 9 aa, Staphylococcus aureus
KDAPSYETS

SEQ ID NO: 1613036 - protein, 7 aa, Staphylococcus aureus
KDIAKPN

SEQ ID NO: 1613037 - protein, 10 aa, Staphylococcus aureus
KEQEQTTKSG

SEQ ID NO: 1613038 - protein, 5 aa, Staphylococcus aureus
KERPH

SEQ ID NO: 1613039 - protein, 6 aa, Staphylococcus aureus
KGATHE

SEQ ID NO: 1613040 - protein, 5 aa, Staphylococcus aureus
KGNAY

SEQ ID NO: 1613041 - protein, 12 aa, Staphylococcus aureus
KGPLSTLGGGVM

SEQ ID NO: 1613042 - protein, 15 aa, Staphylococcus aureus
KHENKGRIVIDFGVD

SEQ ID NO: 1613043 - protein, 5 aa, Staphylococcus aureus
KIKTD

SEQ ID NO: 1613044 - protein, 6 aa, Staphylococcus aureus
KKEKRF

SEQ ID NO: 1613045 - protein, 6 aa, Staphylococcus aureus
KKHAEE

SEQ ID NO: 1613046 - protein, 7 aa, Staphylococcus aureus
KKVEREV

SEQ ID NO: 1613047 - protein, 7 aa, Staphylococcus aureus
KKWPQKN

SEQ ID NO: 1613048 - protein, 12 aa, Staphylococcus aureus
KNDNKGENYGSI

SEQ ID NO: 1613049 - protein, 8 aa, Staphylococcus aureus
KNERSLDN

SEQ ID NO: 1613050 - protein, 11 aa, Staphylococcus aureus
KPVDTTGAGDA

SEQ ID NO: 1613051 - protein, 9 aa, Staphylococcus aureus
KQRADNKQL

SEQ ID NO: 1613052 - protein, 8 aa, Staphylococcus aureus
KRIDSAEE

SEQ ID NO: 1613053 - protein, 4 aa, Staphylococcus aureus
KRYE

SEQ ID NO: 1613054 - protein, 10 aa, Staphylococcus aureus
KSERKDSRKM

SEQ ID NO: 1613055 - protein, 9 aa, Staphylococcus aureus
KSNTKGYAS

SEQ ID NO: 1613056 - protein, 8 aa, Staphylococcus aureus
KSSRNDGR

SEQ ID NO: 1613057 - protein, 8 aa, Staphylococcus aureus
KVPGEQTY

SEQ ID NO: 1613058 - protein, 27 aa, Staphylococcus aureus
KYEESNVDRLKSPLAKTEELKHQHPAD

SEQ ID NO: 1613059 - protein, 17 aa, Staphylococcus aureus
KYEKELRDQDAQKDAFE

SEQ ID NO: 1613060 - protein, 16 aa, Staphylococcus aureus
KYHGASKTSGAGGGDC

SEQ ID NO: 1613061 - protein, 9 aa, Staphylococcus aureus
KYPNVKDTD

SEQ ID NO: 1613062 - protein, 9 aa, Staphylococcus aureus
LDEEKLTKE

SEQ ID NO: 1613063 - protein, 11 aa, Staphylococcus aureus
LDQGRDKAHKV

SEQ ID NO: 1613064 - protein, 17 aa, Staphylococcus aureus
LESKGYDDAESKYTPAW

SEQ ID NO: 1613065 - protein, 14 aa, Staphylococcus aureus
LGLPDSPGVPEGIA

SEQ ID NO: 1613066 - protein, 11 aa, Staphylococcus aureus
LISGSSTAYEE

SEQ ID NO: 1613067 - protein, 11 aa, Staphylococcus aureus
LNEGVAPGVPW

SEQ ID NO: 1613068 - protein, 7 aa, Staphylococcus aureus
LTDDNDI

SEQ ID NO: 1613069 - protein, 6 aa, Staphylococcus aureus
LTLPQD

SEQ ID NO: 1613070 - protein, 10 aa, Staphylococcus aureus
MQPVQPPTHE

SEQ ID NO: 1613071 - protein, 9 aa, Staphylococcus aureus
NAAKDEHGR

SEQ ID NO: 1613072 - protein, 9 aa, Staphylococcus aureus
NALDKKTVN

SEQ ID NO: 1613073 - protein, 19 aa, Staphylococcus aureus
NAPGEVSDKQLEELSLRIR

SEQ ID NO: 1613074 - protein, 6 aa, Staphylococcus aureus
NARAND

SEQ ID NO: 1613075 - protein, 6 aa, Staphylococcus aureus
NDEVSV

SEQ ID NO: 1613076 - protein, 8 aa, Staphylococcus aureus
NDPSRSVG

SEQ ID NO: 1613077 - protein, 12 aa, Staphylococcus aureus
NDSRSARAYGSA

SEQ ID NO: 1613078 - protein, 7 aa, Staphylococcus aureus
NEADDFG

SEQ ID NO: 1613079 - protein, 9 aa, Staphylococcus aureus
NEELNNKEI

SEQ ID NO: 1613080 - protein, 7 aa, Staphylococcus aureus
NFATPGA

SEQ ID NO: 1613081 - protein, 12 aa, Staphylococcus aureus
NGEKGLSGQIRN

SEQ ID NO: 1613082 - protein, 14 aa, Staphylococcus aureus
NGKMNDKAGKYEGM

SEQ ID NO: 1613083 - protein, 10 aa, Staphylococcus aureus
NKAEKRKADT

SEQ ID NO: 1613084 - protein, 6 aa, Staphylococcus aureus
NKESNL

SEQ ID NO: 1613085 - protein, 8 aa, Staphylococcus aureus
NKNYNDLR

SEQ ID NO: 1613086 - protein, 17 aa, Staphylococcus aureus
NKRNKTGKTPKAPYEVS

SEQ ID NO: 1613087 - protein, 14 aa, Staphylococcus aureus
NKTLGSSEAKPYLD

SEQ ID NO: 1613088 - protein, 6 aa, Staphylococcus aureus
NLEGSI

SEQ ID NO: 1613089 - protein, 20 aa, Staphylococcus aureus
NMTTGESETIELDALVEYFK

SEQ ID NO: 1613090 - protein, 8 aa, Staphylococcus aureus
NNSSYQKT

SEQ ID NO: 1613091 - protein, 7 aa, Staphylococcus aureus
NPITEDD

SEQ ID NO: 1613092 - protein, 7 aa, Staphylococcus aureus
NPRATVN

SEQ ID NO: 1613093 - protein, 14 aa, Staphylococcus aureus
NQFEGGYDKGGKGL

SEQ ID NO: 1613094 - protein, 5 aa, Staphylococcus aureus
NRYGN

SEQ ID NO: 1613095 - protein, 4 aa, Staphylococcus aureus
NSHD

SEQ ID NO: 1613096 - protein, 10 aa, Staphylococcus aureus
NSPGYKAFKT

SEQ ID NO: 1613097 - protein, 8 aa, Staphylococcus aureus
NTDQAASI

SEQ ID NO: 1613098 - protein, 8 aa, Staphylococcus aureus
NTYRGEEK

SEQ ID NO: 1613099 - protein, 6 aa, Staphylococcus aureus
NVEQAG

SEQ ID NO: 1613100 - protein, 13 aa, Staphylococcus aureus
PAMDNDDYRRGKL

SEQ ID NO: 1613101 - protein, 7 aa, Staphylococcus aureus
PEDAGER

SEQ ID NO: 1613102 - protein, 5 aa, Staphylococcus aureus
PGDSI

SEQ ID NO: 1613103 - protein, 4 aa, Staphylococcus aureus
PGNK

SEQ ID NO: 1613104 - protein, 6 aa, Staphylococcus aureus
PHEGDT

SEQ ID NO: 1613105 - protein, 7 aa, Staphylococcus aureus
PISREKL

SEQ ID NO: 1613106 - protein, 11 aa, Staphylococcus aureus
PKSLTNNVKAG

SEQ ID NO: 1613107 - protein, 4 aa, Staphylococcus aureus
PLSI

SEQ ID NO: 1613108 - protein, 5 aa, Staphylococcus aureus
PNGTE

SEQ ID NO: 1613109 - protein, 12 aa, Staphylococcus aureus
PPFTSDQAKEKV

SEQ ID NO: 1613110 - protein, 11 aa, Staphylococcus aureus
PPLRSTEDREA

SEQ ID NO: 1613111 - protein, 17 aa, Staphylococcus aureus
PQSTSDMDVDDDPREDL

SEQ ID NO: 1613112 - protein, 6 aa, Staphylococcus aureus
PSGEYE

SEQ ID NO: 1613113 - protein, 9 aa, Staphylococcus aureus
QATPVEPQD

SEQ ID NO: 1613114 - protein, 10 aa, Staphylococcus aureus
QEGRVRAGQT

SEQ ID NO: 1613115 - protein, 4 aa, Staphylococcus aureus
QEYE

SEQ ID NO: 1613116 - protein, 8 aa, Staphylococcus aureus
QHRDPFQS

SEQ ID NO: 1613117 - protein, 8 aa, Staphylococcus aureus
QKAIDNLS

SEQ ID NO: 1613118 - protein, 10 aa, Staphylococcus aureus
QKGAGEKKVN

SEQ ID NO: 1613119 - protein, 7 aa, Staphylococcus aureus
QKSRAEQ

SEQ ID NO: 1613120 - protein, 6 aa, Staphylococcus aureus
QLRKGA

SEQ ID NO: 1613121 - protein, 4 aa, Staphylococcus aureus
QMAE

SEQ ID NO: 1613122 - protein, 14 aa, Staphylococcus aureus
QNVSQQSLNTEPNE

SEQ ID NO: 1613123 - protein, 5 aa, Staphylococcus aureus
QPETI

SEQ ID NO: 1613124 - protein, 11 aa, Staphylococcus aureus
QRGTPIDENVS

SEQ ID NO: 1613125 - protein, 5 aa, Staphylococcus aureus
QSTYV

SEQ ID NO: 1613126 - protein, 4 aa, Staphylococcus aureus
QSVN

SEQ ID NO: 1613127 - protein, 11 aa, Staphylococcus aureus
QWNPGGSVKDR

SEQ ID NO: 1613128 - protein, 13 aa, Staphylococcus aureus
RDGRARVSVGARS

SEQ ID NO: 1613129 - protein, 12 aa, Staphylococcus aureus
RGVEQRQDKRPM

SEQ ID NO: 1613130 - protein, 4 aa, Staphylococcus aureus
RKAE

SEQ ID NO: 1613131 - protein, 6 aa, Staphylococcus aureus
RPTDLS

SEQ ID NO: 1613132 - protein, 34 aa, Staphylococcus aureus
RRDYGESELTEPLPDSASNPDSDYRVKRDAQDIA

SEQ ID NO: 1613133 - protein, 6 aa, Staphylococcus aureus
RSLSNE

SEQ ID NO: 1613134 - protein, 13 aa, Staphylococcus aureus
RSTDKPLKGKELD

SEQ ID NO: 1613135 - protein, 5 aa, Staphylococcus aureus
SAPKI

SEQ ID NO: 1613136 - protein, 16 aa, Staphylococcus aureus
SGEERIDGIPEPALPF

SEQ ID NO: 1613137 - protein, 9 aa, Staphylococcus aureus
SGMNKPDGM

SEQ ID NO: 1613138 - protein, 5 aa, Staphylococcus aureus
SITKG

SEQ ID NO: 1613139 - protein, 7 aa, Staphylococcus aureus
SKRKGYQ

SEQ ID NO: 1613140 - protein, 8 aa, Staphylococcus aureus
SNSGTITK

SEQ ID NO: 1613141 - protein, 10 aa, Staphylococcus aureus
SPEEAESPGI

SEQ ID NO: 1613142 - protein, 5 aa, Staphylococcus aureus
SQSLR

SEQ ID NO: 1613143 - protein, 8 aa, Staphylococcus aureus
SQSTTFTE

SEQ ID NO: 1613144 - protein, 8 aa, Staphylococcus aureus
SSATSAKI

SEQ ID NO: 1613145 - protein, 20 aa, Staphylococcus aureus
SVTDLTRENAREMIQHNQRR

SEQ ID NO: 1613146 - protein, 6 aa, Staphylococcus aureus
TADLDE

SEQ ID NO: 1613147 - protein, 8 aa, Staphylococcus aureus
TDHSAENI

SEQ ID NO: 1613148 - protein, 4 aa, Staphylococcus aureus
TDIN

SEQ ID NO: 1613149 - protein, 7 aa, Staphylococcus aureus
TDPDGHK

SEQ ID NO: 1613150 - protein, 6 aa, Staphylococcus aureus
TGERDG

SEQ ID NO: 1613151 - protein, 9 aa, Staphylococcus aureus
TGTNGKTSI

SEQ ID NO: 1613152 - protein, 12 aa, Staphylococcus aureus
TGVSKGKGFQGA

SEQ ID NO: 1613153 - protein, 5 aa, Staphylococcus aureus
TNERG

SEQ ID NO: 1613154 - protein, 26 aa, Staphylococcus aureus
TQNEEQLDNSDEQSQQNEKTFSQEEV

SEQ ID NO: 1613155 - protein, 7 aa, Staphylococcus aureus
TSDNPRF

SEQ ID NO: 1613156 - protein, 4 aa, Staphylococcus aureus
TTAH

SEQ ID NO: 1613157 - protein, 14 aa, Staphylococcus aureus
TTNGGGLSSSQQKV

SEQ ID NO: 1613158 - protein, 11 aa, Staphylococcus aureus
VDANGKQTEFK

SEQ ID NO: 1613159 - protein, 9 aa, Staphylococcus aureus
VDDNASKDG

SEQ ID NO: 1613160 - protein, 7 aa, Staphylococcus aureus
VEKHSDY

SEQ ID NO: 1613161 - protein, 15 aa, Staphylococcus aureus
VERPGARLSTTDEGE

SEQ ID NO: 1613162 - protein, 5 aa, Staphylococcus aureus
VETEE

SEQ ID NO: 1613163 - protein, 6 aa, Staphylococcus aureus
VETPSE

SEQ ID NO: 1613164 - protein, 4 aa, Staphylococcus aureus
VGTT

SEQ ID NO: 1613165 - protein, 17 aa, Staphylococcus aureus
VKEAGGTVVQEPTVSQG

SEQ ID NO: 1613166 - protein, 14 aa, Staphylococcus aureus
VNPVDTKQRQMEVT

SEQ ID NO: 1613167 - protein, 12 aa, Staphylococcus aureus
VQAAQQHDSVKL

SEQ ID NO: 1613168 - protein, 15 aa, Staphylococcus aureus
VRGGNHVTSQNPEVN

SEQ ID NO: 1613169 - protein, 9 aa, Staphylococcus aureus
VTKDDMDNQ

SEQ ID NO: 1613170 - protein, 4 aa, Staphylococcus aureus
VTRM

SEQ ID NO: 1613171 - protein, 8 aa, Staphylococcus aureus
VVPTGVPR

SEQ ID NO: 1613172 - protein, 7 aa, Staphylococcus aureus
YGKQSEE

SEQ ID NO: 1613173 - protein, 5 aa, Staphylococcus aureus
YGPNE

SEQ ID NO: 1613174 - protein, 7 aa, Staphylococcus aureus
YNPKPAW

SEQ ID NO: 1613175 - protein, 5 aa, Staphylococcus aureus
YQAQE

SEQ ID NO: 1613176 - protein, 12 aa, Staphylococcus aureus
YQGNSELTLSGE

SEQ ID NO: 1613177 - protein, 7 aa, Staphylococcus aureus
YSEITGD

SEQ ID NO: 1613178 - protein, 5 aa, Staphylococcus aureus
YTPRA

SEQ ID NO: 1613179 - protein, 5 aa, Staphylococcus aureus
YYDDK

SEQ ID NO: 1613180 - protein, 21 aa, Staphylococcus aureus
ADSEEDGATNKEEYSGSQIDD

SEQ ID NO: 1613181 - protein, 14 aa, Staphylococcus aureus
AGADVSDSINGNPI

SEQ ID NO: 1613182 - protein, 9 aa, Staphylococcus aureus
AGDTEPVKG

SEQ ID NO: 1613183 - protein, 6 aa, Staphylococcus aureus
AGPIRT

SEQ ID NO: 1613184 - protein, 26 aa, Staphylococcus aureus
AGRDITDDIAQGLNTSYETAEKVKHQ

SEQ ID NO: 1613185 - protein, 38 aa, Staphylococcus aureus
AKAQKNHQKPQNKTNIEKSKQIKPKQYNQTKNHQQQKK

SEQ ID NO: 1613186 - protein, 7 aa, Staphylococcus aureus
AKFKSNE

SEQ ID NO: 1613187 - protein, 6 aa, Staphylococcus aureus
AKKEHG

SEQ ID NO: 1613188 - protein, 8 aa, Staphylococcus aureus
ANRDTAPA

SEQ ID NO: 1613189 - protein, 4 aa, Staphylococcus aureus
APAQ

SEQ ID NO: 1613190 - protein, 11 aa, Staphylococcus aureus
APLKNGHEDLA

SEQ ID NO: 1613191 - protein, 4 aa, Staphylococcus aureus
AQMD

SEQ ID NO: 1613192 - protein, 6 aa, Staphylococcus aureus
ARTLSE

SEQ ID NO: 1613193 - protein, 5 aa, Staphylococcus aureus
ASEMP

SEQ ID NO: 1613194 - protein, 10 aa, Staphylococcus aureus
ATERASIKHS

SEQ ID NO: 1613195 - protein, 14 aa, Staphylococcus aureus
ATNAQDIKNILKEH

SEQ ID NO: 1613196 - protein, 5 aa, Staphylococcus aureus
ATPTQ

SEQ ID NO: 1613197 - protein, 14 aa, Staphylococcus aureus
ATSSEKSQIQNREK

SEQ ID NO: 1613198 - protein, 7 aa, Staphylococcus aureus
AVAGKFN

SEQ ID NO: 1613199 - protein, 5 aa, Staphylococcus aureus
AVGGG

SEQ ID NO: 1613200 - protein, 12 aa, Staphylococcus aureus
AVNNEKSRAIPE

SEQ ID NO: 1613201 - protein, 7 aa, Staphylococcus aureus
AVTLGTS

SEQ ID NO: 1613202 - protein, 9 aa, Staphylococcus aureus
CATGTNSIG

SEQ ID NO: 1613203 - protein, 7 aa, Staphylococcus aureus
DAKKDIR

SEQ ID NO: 1613204 - protein, 10 aa, Staphylococcus aureus
DAKLETRNGY

SEQ ID NO: 1613205 - protein, 7 aa, Staphylococcus aureus
DDDVEQL

SEQ ID NO: 1613206 - protein, 11 aa, Staphylococcus aureus
DEPGDMTTEQY

SEQ ID NO: 1613207 - protein, 7 aa, Staphylococcus aureus
DESDALN

SEQ ID NO: 1613208 - protein, 16 aa, Staphylococcus aureus
DEVKSYSDDALKQKTI

SEQ ID NO: 1613209 - protein, 15 aa, Staphylococcus aureus
DGEPVNDGKVGPITR

SEQ ID NO: 1613210 - protein, 17 aa, Staphylococcus aureus
DGLNQTQLAKQAGVSRQ

SEQ ID NO: 1613211 - protein, 13 aa, Staphylococcus aureus
DGPHPKVVESFKD

SEQ ID NO: 1613212 - protein, 9 aa, Staphylococcus aureus
DKDKTLNEG

SEQ ID NO: 1613213 - protein, 9 aa, Staphylococcus aureus
DKNDKNYRV

SEQ ID NO: 1613214 - protein, 17 aa, Staphylococcus aureus
DLPTTTIGSFPQSREVR

SEQ ID NO: 1613215 - protein, 7 aa, Staphylococcus aureus
DLSNAGA

SEQ ID NO: 1613216 - protein, 51 aa, Staphylococcus aureus
DNNQGGGTHYYPNNHGKFDSQPEYKKPPFPTDGYGYEYNQRQDDDNYFEQP

SEQ ID NO: 1613217 - protein, 5 aa, Staphylococcus aureus
DPFPN

SEQ ID NO: 1613218 - protein, 8 aa, Staphylococcus aureus
DPQYENGK

SEQ ID NO: 1613219 - protein, 16 aa, Staphylococcus aureus
DPYTNYGRPNSKYEKM

SEQ ID NO: 1613220 - protein, 20 aa, Staphylococcus aureus
DQISSGSVIANGQELNKLNQ

SEQ ID NO: 1613221 - protein, 4 aa, Staphylococcus aureus
DSTE

SEQ ID NO: 1613222 - protein, 6 aa, Staphylococcus aureus
DTDGKQ

SEQ ID NO: 1613223 - protein, 8 aa, Staphylococcus aureus
DTTARDAY

SEQ ID NO: 1613224 - protein, 22 aa, Staphylococcus aureus
DTYTSVKRNTNAYYRYDRDSIT

SEQ ID NO: 1613225 - protein, 8 aa, Staphylococcus aureus
EATGIPES

SEQ ID NO: 1613226 - protein, 7 aa, Staphylococcus aureus
EERNNKL

SEQ ID NO: 1613227 - protein, 17 aa, Staphylococcus aureus
EETYQSRLAKKTPTKAG

SEQ ID NO: 1613228 - protein, 5 aa, Staphylococcus aureus
EGYGK

SEQ ID NO: 1613229 - protein, 9 aa, Staphylococcus aureus
EKDPNIREQ

SEQ ID NO: 1613230 - protein, 10 aa, Staphylococcus aureus
EKVVDANKQY

SEQ ID NO: 1613231 - protein, 4 aa, Staphylococcus aureus
ENVH

SEQ ID NO: 1613232 - protein, 5 aa, Staphylococcus aureus
ESHNE

SEQ ID NO: 1613233 - protein, 21 aa, Staphylococcus aureus
ESTIKANSRYFKNEDDVPKQA

SEQ ID NO: 1613234 - protein, 4 aa, Staphylococcus aureus
ETAD

SEQ ID NO: 1613235 - protein, 5 aa, Staphylococcus aureus
ETTTL

SEQ ID NO: 1613236 - protein, 6 aa, Staphylococcus aureus
EYFDTT

SEQ ID NO: 1613237 - protein, 10 aa, Staphylococcus aureus
FHKKKQTIDA

SEQ ID NO: 1613238 - protein, 6 aa, Staphylococcus aureus
FKEKID

SEQ ID NO: 1613239 - protein, 11 aa, Staphylococcus aureus
FTTEGTWQQRQ

SEQ ID NO: 1613240 - protein, 15 aa, Staphylococcus aureus
GDNGAENVNKKGGKR

SEQ ID NO: 1613241 - protein, 6 aa, Staphylococcus aureus
GEAFDQ

SEQ ID NO: 1613242 - protein, 10 aa, Staphylococcus aureus
GGHSNDTDIA

SEQ ID NO: 1613243 - protein, 20 aa, Staphylococcus aureus
GIKNSDRKYKHDNLTTTECP

SEQ ID NO: 1613244 - protein, 9 aa, Staphylococcus aureus
GKEAVENSI

SEQ ID NO: 1613245 - protein, 19 aa, Staphylococcus aureus
GKYDENTKFSDHRTTRRDF

SEQ ID NO: 1613246 - protein, 13 aa, Staphylococcus aureus
GKYPSGHALPTEK

SEQ ID NO: 1613247 - protein, 6 aa, Staphylococcus aureus
GLVDSN

SEQ ID NO: 1613248 - protein, 6 aa, Staphylococcus aureus
GQASNL

SEQ ID NO: 1613249 - protein, 7 aa, Staphylococcus aureus
GQLDNPD

SEQ ID NO: 1613250 - protein, 7 aa, Staphylococcus aureus
GTENKTY

SEQ ID NO: 1613251 - protein, 6 aa, Staphylococcus aureus
GVGNGQ

SEQ ID NO: 1613252 - protein, 6 aa, Staphylococcus aureus
GVNKED

SEQ ID NO: 1613253 - protein, 10 aa, Staphylococcus aureus
HDTQRNESNL

SEQ ID NO: 1613254 - protein, 6 aa, Staphylococcus aureus
HEGPDS

SEQ ID NO: 1613255 - protein, 5 aa, Staphylococcus aureus
HHSSI

SEQ ID NO: 1613256 - protein, 11 aa, Staphylococcus aureus
HKVDEGSYQPS

SEQ ID NO: 1613257 - protein, 6 aa, Staphylococcus aureus
HQKELA

SEQ ID NO: 1613258 - protein, 5 aa, Staphylococcus aureus
HTPSQ

SEQ ID NO: 1613259 - protein, 8 aa, Staphylococcus aureus
IADSTGEI

SEQ ID NO: 1613260 - protein, 4 aa, Staphylococcus aureus
IANH

SEQ ID NO: 1613261 - protein, 4 aa, Staphylococcus aureus
IARQ

SEQ ID NO: 1613262 - protein, 13 aa, Staphylococcus aureus
IEDAQQNATINQC

SEQ ID NO: 1613263 - protein, 10 aa, Staphylococcus aureus
IELRGDDPKV

SEQ ID NO: 1613264 - protein, 11 aa, Staphylococcus aureus
IETEEQVSQLT

SEQ ID NO: 1613265 - protein, 7 aa, Staphylococcus aureus
IKEDEDK

SEQ ID NO: 1613266 - protein, 7 aa, Staphylococcus aureus
IKKEPYG

SEQ ID NO: 1613267 - protein, 15 aa, Staphylococcus aureus
IKPSNETTSSTSIPI

SEQ ID NO: 1613268 - protein, 11 aa, Staphylococcus aureus
IKRNNAINDKD

SEQ ID NO: 1613269 - protein, 10 aa, Staphylococcus aureus
IKSEDEISKI

SEQ ID NO: 1613270 - protein, 8 aa, Staphylococcus aureus
IPSTANEV

SEQ ID NO: 1613271 - protein, 8 aa, Staphylococcus aureus
IQNNSISE

SEQ ID NO: 1613272 - protein, 8 aa, Staphylococcus aureus
IQRRIDNG

SEQ ID NO: 1613273 - protein, 9 aa, Staphylococcus aureus
IRDKAKDKA

SEQ ID NO: 1613274 - protein, 5 aa, Staphylococcus aureus
ISHNN

SEQ ID NO: 1613275 - protein, 4 aa, Staphylococcus aureus
ISKR

SEQ ID NO: 1613276 - protein, 6 aa, Staphylococcus aureus
ISLDGE

SEQ ID NO: 1613277 - protein, 9 aa, Staphylococcus aureus
IVDKSGAWY

SEQ ID NO: 1613278 - protein, 5 aa, Staphylococcus aureus
KAERH

SEQ ID NO: 1613279 - protein, 14 aa, Staphylococcus aureus
KAREELSSDKLEEN

SEQ ID NO: 1613280 - protein, 8 aa, Staphylococcus aureus
KDFNKRDL

SEQ ID NO: 1613281 - protein, 45 aa, Staphylococcus aureus
KDIEKRPENKKAHNKRDNLQQQLDANEQKIEEGKRLQEEHGNELP

SEQ ID NO: 1613282 - protein, 7 aa, Staphylococcus aureus
KEAYGNK

SEQ ID NO: 1613283 - protein, 6 aa, Staphylococcus aureus
KEGHIY

SEQ ID NO: 1613284 - protein, 5 aa, Staphylococcus aureus
KGGEK

SEQ ID NO: 1613285 - protein, 7 aa, Staphylococcus aureus
KKEKDDN

SEQ ID NO: 1613286 - protein, 12 aa, Staphylococcus aureus
KKESNANQCPFH

SEQ ID NO: 1613287 - protein, 21 aa, Staphylococcus aureus
KKSKAEQKEFRNKLDESRFVI

SEQ ID NO: 1613288 - protein, 23 aa, Staphylococcus aureus
KLSKEGKESVTKTQQTLHQKQSD

SEQ ID NO: 1613289 - protein, 5 aa, Staphylococcus aureus
KMKEV

SEQ ID NO: 1613290 - protein, 7 aa, Staphylococcus aureus
KNDGVDL

SEQ ID NO: 1613291 - protein, 9 aa, Staphylococcus aureus
KNGDSVAQS

SEQ ID NO: 1613292 - protein, 8 aa, Staphylococcus aureus
KNGEQAEQ

SEQ ID NO: 1613293 - protein, 8 aa, Staphylococcus aureus
KNGVGKTT

SEQ ID NO: 1613294 - protein, 13 aa, Staphylococcus aureus
KNIESGHYQPTTT

SEQ ID NO: 1613295 - protein, 8 aa, Staphylococcus aureus
KNTSEKSL

SEQ ID NO: 1613296 - protein, 5 aa, Staphylococcus aureus
KPNGQ

SEQ ID NO: 1613297 - protein, 10 aa, Staphylococcus aureus
KPVSKEGTER

SEQ ID NO: 1613298 - protein, 5 aa, Staphylococcus aureus
KQGNA

SEQ ID NO: 1613299 - protein, 10 aa, Staphylococcus aureus
KQHNEKEKFE

SEQ ID NO: 1613300 - protein, 14 aa, Staphylococcus aureus
KQQERQLREQYGTK

SEQ ID NO: 1613301 - protein, 4 aa, Staphylococcus aureus
KSER

SEQ ID NO: 1613302 - protein, 16 aa, Staphylococcus aureus
KSGDSLMDNDTKQNLQ

SEQ ID NO: 1613303 - protein, 10 aa, Staphylococcus aureus
KSLSGGQRQR

SEQ ID NO: 1613304 - protein, 4 aa, Staphylococcus aureus
KSLY

SEQ ID NO: 1613305 - protein, 4 aa, Staphylococcus aureus
KTMA

SEQ ID NO: 1613306 - protein, 7 aa, Staphylococcus aureus
KTPTQER

SEQ ID NO: 1613307 - protein, 4 aa, Staphylococcus aureus
KYSD

SEQ ID NO: 1613308 - protein, 10 aa, Staphylococcus aureus
LDINENTADR

SEQ ID NO: 1613309 - protein, 12 aa, Staphylococcus aureus
LERGKTITKDID

SEQ ID NO: 1613310 - protein, 4 aa, Staphylococcus aureus
LETR

SEQ ID NO: 1613311 - protein, 5 aa, Staphylococcus aureus
LETYN

SEQ ID NO: 1613312 - protein, 7 aa, Staphylococcus aureus
LKDPNIK

SEQ ID NO: 1613313 - protein, 12 aa, Staphylococcus aureus
LPSSTNPTLPYT

SEQ ID NO: 1613314 - protein, 7 aa, Staphylococcus aureus
LQDGAGA

SEQ ID NO: 1613315 - protein, 9 aa, Staphylococcus aureus
LSPTDLPKG

SEQ ID NO: 1613316 - protein, 7 aa, Staphylococcus aureus
LSTEDKK

SEQ ID NO: 1613317 - protein, 5 aa, Staphylococcus aureus
MKHNA

SEQ ID NO: 1613318 - protein, 30 aa, Staphylococcus aureus
MTAHSSDDDDQYRTKEEREALKKADCNEKF

SEQ ID NO: 1613319 - protein, 5 aa, Staphylococcus aureus
NAVGG

SEQ ID NO: 1613320 - protein, 6 aa, Staphylococcus aureus
NAVKQG

SEQ ID NO: 1613321 - protein, 8 aa, Staphylococcus aureus
NDQESEIE

SEQ ID NO: 1613322 - protein, 7 aa, Staphylococcus aureus
NDSVKYD

SEQ ID NO: 1613323 - protein, 6 aa, Staphylococcus aureus
NDYTGH

SEQ ID NO: 1613324 - protein, 6 aa, Staphylococcus aureus
NEAQRE

SEQ ID NO: 1613325 - protein, 5 aa, Staphylococcus aureus
NEIRN

SEQ ID NO: 1613326 - protein, 10 aa, Staphylococcus aureus
NENALNNQRD

SEQ ID NO: 1613327 - protein, 29 aa, Staphylococcus aureus
NGGGHGRDTYGASGKIAKGDAKKSDSDVY

SEQ ID NO: 1613328 - protein, 8 aa, Staphylococcus aureus
NGGHGTHN

SEQ ID NO: 1613329 - protein, 17 aa, Staphylococcus aureus
NGGKDEKSGAQVGPNFE

SEQ ID NO: 1613330 - protein, 12 aa, Staphylococcus aureus
NKINEPGTIIET

SEQ ID NO: 1613331 - protein, 8 aa, Staphylococcus aureus
NKTDKTYI

SEQ ID NO: 1613332 - protein, 4 aa, Staphylococcus aureus
NNIG

SEQ ID NO: 1613333 - protein, 7 aa, Staphylococcus aureus
NNYPTTK

SEQ ID NO: 1613334 - protein, 11 aa, Staphylococcus aureus
NQASPNAKTTI

SEQ ID NO: 1613335 - protein, 6 aa, Staphylococcus aureus
NQKEKN

SEQ ID NO: 1613336 - protein, 4 aa, Staphylococcus aureus
NSDT

SEQ ID NO: 1613337 - protein, 5 aa, Staphylococcus aureus
NTDEA

SEQ ID NO: 1613338 - protein, 4 aa, Staphylococcus aureus
NTEY

SEQ ID NO: 1613339 - protein, 16 aa, Staphylococcus aureus
NYNEENNAIEISEKDD

SEQ ID NO: 1613340 - protein, 4 aa, Staphylococcus aureus
PEHA

SEQ ID NO: 1613341 - protein, 9 aa, Staphylococcus aureus
PGETEAEFQ

SEQ ID NO: 1613342 - protein, 9 aa, Staphylococcus aureus
PKKNENLLR

SEQ ID NO: 1613343 - protein, 11 aa, Staphylococcus aureus
PKQFDSKAAYE

SEQ ID NO: 1613344 - protein, 4 aa, Staphylococcus aureus
PLKT

SEQ ID NO: 1613345 - protein, 7 aa, Staphylococcus aureus
PLTNADK

SEQ ID NO: 1613346 - protein, 7 aa, Staphylococcus aureus
PQSNMPS

SEQ ID NO: 1613347 - protein, 7 aa, Staphylococcus aureus
PSMGPRS

SEQ ID NO: 1613348 - protein, 4 aa, Staphylococcus aureus
PSYP

SEQ ID NO: 1613349 - protein, 15 aa, Staphylococcus aureus
PTKNSAKITQSSARD

SEQ ID NO: 1613350 - protein, 5 aa, Staphylococcus aureus
PVQRG

SEQ ID NO: 1613351 - protein, 7 aa, Staphylococcus aureus
QAENVNK

SEQ ID NO: 1613352 - protein, 9 aa, Staphylococcus aureus
QAPSSPSYA

SEQ ID NO: 1613353 - protein, 7 aa, Staphylococcus aureus
QDDCPSA

SEQ ID NO: 1613354 - protein, 5 aa, Staphylococcus aureus
QEITG

SEQ ID NO: 1613355 - protein, 5 aa, Staphylococcus aureus
QFPGI

SEQ ID NO: 1613356 - protein, 6 aa, Staphylococcus aureus
QGENEF

SEQ ID NO: 1613357 - protein, 9 aa, Staphylococcus aureus
QGNIPPSAL

SEQ ID NO: 1613358 - protein, 7 aa, Staphylococcus aureus
QKQNPVQ

SEQ ID NO: 1613359 - protein, 5 aa, Staphylococcus aureus
QLEDE

SEQ ID NO: 1613360 - protein, 5 aa, Staphylococcus aureus
QNIPA

SEQ ID NO: 1613361 - protein, 27 aa, Staphylococcus aureus
QNRKNEGDDMPKQQAQQTDIAQKAKDL

SEQ ID NO: 1613362 - protein, 10 aa, Staphylococcus aureus
QQGEGIESTG

SEQ ID NO: 1613363 - protein, 10 aa, Staphylococcus aureus
QQQPQSNSGI

SEQ ID NO: 1613364 - protein, 4 aa, Staphylococcus aureus
QRYQ

SEQ ID NO: 1613365 - protein, 6 aa, Staphylococcus aureus
QSELDR

SEQ ID NO: 1613366 - protein, 5 aa, Staphylococcus aureus
QSERF

SEQ ID NO: 1613367 - protein, 6 aa, Staphylococcus aureus
QSYPGF

SEQ ID NO: 1613368 - protein, 7 aa, Staphylococcus aureus
QVARDSM

SEQ ID NO: 1613369 - protein, 21 aa, Staphylococcus aureus
QVKAYRDEDRVADDSNTPTFV

SEQ ID NO: 1613370 - protein, 11 aa, Staphylococcus aureus
RATQQRTQNQG

SEQ ID NO: 1613371 - protein, 6 aa, Staphylococcus aureus
RDEEIR

SEQ ID NO: 1613372 - protein, 8 aa, Staphylococcus aureus
RGGGKNGL

SEQ ID NO: 1613373 - protein, 23 aa, Staphylococcus aureus
RGIDHSEVKSSRVRKSVGTERTF

SEQ ID NO: 1613374 - protein, 11 aa, Staphylococcus aureus
RGQATHTVQQS

SEQ ID NO: 1613375 - protein, 6 aa, Staphylococcus aureus
RGYRRE

SEQ ID NO: 1613376 - protein, 4 aa, Staphylococcus aureus
RHSA

SEQ ID NO: 1613377 - protein, 12 aa, Staphylococcus aureus
RKPNTSDIGLNN

SEQ ID NO: 1613378 - protein, 8 aa, Staphylococcus aureus
RNNGGGHF

SEQ ID NO: 1613379 - protein, 10 aa, Staphylococcus aureus
SAQESSKRAA

SEQ ID NO: 1613380 - protein, 7 aa, Staphylococcus aureus
SDSEQEA

SEQ ID NO: 1613381 - protein, 14 aa, Staphylococcus aureus
SDYFSREADDLKAD

SEQ ID NO: 1613382 - protein, 6 aa, Staphylococcus aureus
SEDEQP

SEQ ID NO: 1613383 - protein, 4 aa, Staphylococcus aureus
SFEY

SEQ ID NO: 1613384 - protein, 4 aa, Staphylococcus aureus
SGAR

SEQ ID NO: 1613385 - protein, 14 aa, Staphylococcus aureus
SGYSGGHVDNPTYE

SEQ ID NO: 1613386 - protein, 16 aa, Staphylococcus aureus
SIKGQVTTVATGKAYI

SEQ ID NO: 1613387 - protein, 8 aa, Staphylococcus aureus
SKELKRSL

SEQ ID NO: 1613388 - protein, 11 aa, Staphylococcus aureus
SKGRLTKEDHD

SEQ ID NO: 1613389 - protein, 6 aa, Staphylococcus aureus
SKLSNG

SEQ ID NO: 1613390 - protein, 9 aa, Staphylococcus aureus
SKPYSKANA

SEQ ID NO: 1613391 - protein, 31 aa, Staphylococcus aureus
SNDSNLSSSHDVDESSTKQKHIKNKTTIDHN

SEQ ID NO: 1613392 - protein, 12 aa, Staphylococcus aureus
SNEGDTSQASIQ

SEQ ID NO: 1613393 - protein, 16 aa, Staphylococcus aureus
SNKRTDHYGADSLKNR

SEQ ID NO: 1613394 - protein, 9 aa, Staphylococcus aureus
SNLNQKANE

SEQ ID NO: 1613395 - protein, 11 aa, Staphylococcus aureus
SNNTNTKGNVL

SEQ ID NO: 1613396 - protein, 7 aa, Staphylococcus aureus
SPEAKTV

SEQ ID NO: 1613397 - protein, 9 aa, Staphylococcus aureus
SPMNDNGYD

SEQ ID NO: 1613398 - protein, 12 aa, Staphylococcus aureus
SQISEEQATSTT

SEQ ID NO: 1613399 - protein, 12 aa, Staphylococcus aureus
SRLKSGENMKYT

SEQ ID NO: 1613400 - protein, 13 aa, Staphylococcus aureus
SSEVEKGESIKTA

SEQ ID NO: 1613401 - protein, 4 aa, Staphylococcus aureus
SSQP

SEQ ID NO: 1613402 - protein, 7 aa, Staphylococcus aureus
SSSKGQG

SEQ ID NO: 1613403 - protein, 4 aa, Staphylococcus aureus
STLT

SEQ ID NO: 1613404 - protein, 8 aa, Staphylococcus aureus
SVSGNSIS

SEQ ID NO: 1613405 - protein, 8 aa, Staphylococcus aureus
SYENAGEN

SEQ ID NO: 1613406 - protein, 18 aa, Staphylococcus aureus
TAAYQAEGATNTDGKGRV

SEQ ID NO: 1613407 - protein, 4 aa, Staphylococcus aureus
TALN

SEQ ID NO: 1613408 - protein, 8 aa, Staphylococcus aureus
TDESFESL

SEQ ID NO: 1613409 - protein, 10 aa, Staphylococcus aureus
TENDKLTDAG

SEQ ID NO: 1613410 - protein, 8 aa, Staphylococcus aureus
TGGTGIAQ

SEQ ID NO: 1613411 - protein, 23 aa, Staphylococcus aureus
TGNDTRGAEASAHAYASRDGQYR

SEQ ID NO: 1613412 - protein, 9 aa, Staphylococcus aureus
TISNDYQYS

SEQ ID NO: 1613413 - protein, 9 aa, Staphylococcus aureus
TKEEAQEAT

SEQ ID NO: 1613414 - protein, 4 aa, Staphylococcus aureus
TKES

SEQ ID NO: 1613415 - protein, 10 aa, Staphylococcus aureus
TNKDKIEGSL

SEQ ID NO: 1613416 - protein, 7 aa, Staphylococcus aureus
TNTAEAH

SEQ ID NO: 1613417 - protein, 4 aa, Staphylococcus aureus
TPKM

SEQ ID NO: 1613418 - protein, 7 aa, Staphylococcus aureus
TSPTPVV

SEQ ID NO: 1613419 - protein, 7 aa, Staphylococcus aureus
TYGNTPK

SEQ ID NO: 1613420 - protein, 15 aa, Staphylococcus aureus
VDSRTILDSGGAERL

SEQ ID NO: 1613421 - protein, 7 aa, Staphylococcus aureus
VENEKGS

SEQ ID NO: 1613422 - protein, 13 aa, Staphylococcus aureus
VEPLKEEAAIAKE

SEQ ID NO: 1613423 - protein, 9 aa, Staphylococcus aureus
VGAKEGGVV

SEQ ID NO: 1613424 - protein, 8 aa, Staphylococcus aureus
VGDTIQRG

SEQ ID NO: 1613425 - protein, 4 aa, Staphylococcus aureus
VGQE

SEQ ID NO: 1613426 - protein, 5 aa, Staphylococcus aureus
VHTSN

SEQ ID NO: 1613427 - protein, 7 aa, Staphylococcus aureus
VKRPDHE

SEQ ID NO: 1613428 - protein, 5 aa, Staphylococcus aureus
VNEDT

SEQ ID NO: 1613429 - protein, 4 aa, Staphylococcus aureus
VNIG

SEQ ID NO: 1613430 - protein, 9 aa, Staphylococcus aureus
VPSEAEAQS

SEQ ID NO: 1613431 - protein, 9 aa, Staphylococcus aureus
VQPDGTDEP

SEQ ID NO: 1613432 - protein, 16 aa, Staphylococcus aureus
VRKASGKKLAQESPVN

SEQ ID NO: 1613433 - protein, 7 aa, Staphylococcus aureus
VSTKQIA

SEQ ID NO: 1613434 - protein, 6 aa, Staphylococcus aureus
VTAGGI

SEQ ID NO: 1613435 - protein, 16 aa, Staphylococcus aureus
VTDGTTIRYDDNGVAQ

SEQ ID NO: 1613436 - protein, 8 aa, Staphylococcus aureus
VVEPRSKL

SEQ ID NO: 1613437 - protein, 11 aa, Staphylococcus aureus
WGSEVKGITDG

SEQ ID NO: 1613438 - protein, 8 aa, Staphylococcus aureus
YAESNNSD

SEQ ID NO: 1613439 - protein, 6 aa, Staphylococcus aureus
YDDVRS

SEQ ID NO: 1613440 - protein, 9 aa, Staphylococcus aureus
YDNEKSSIQ

SEQ ID NO: 1613441 - protein, 24 aa, Staphylococcus aureus
YEPKTTSKSEQQLKEIYNNLLKQR

SEQ ID NO: 1613442 - protein, 5 aa, Staphylococcus aureus
YKKYK

SEQ ID NO: 1613443 - protein, 11 aa, Staphylococcus aureus
YNGKDKDEAPI

SEQ ID NO: 1613444 - protein, 8 aa, Staphylococcus aureus
YPETSYQA

SEQ ID NO: 1613445 - protein, 6 aa, Staphylococcus aureus
YQQDEQ

SEQ ID NO: 1613446 - protein, 22 aa, Staphylococcus aureus
YRRPASDRKISIRGARSNNLKG

SEQ ID NO: 1613447 - protein, 9 aa, Staphylococcus aureus
YSDKKDVMK

SEQ ID NO: 1613448 - protein, 4 aa, Staphylococcus aureus
YVVP

SEQ ID NO: 1613449 - protein, 5 aa, Staphylococcus aureus
AANDN

SEQ ID NO: 1613450 - protein, 21 aa, Staphylococcus aureus
AAQQTSFEKRMSKENNGREAA

SEQ ID NO: 1613451 - protein, 10 aa, Staphylococcus aureus
AASLEKKNVD

SEQ ID NO: 1613452 - protein, 9 aa, Staphylococcus aureus
AAVDDETAA

SEQ ID NO: 1613453 - protein, 7 aa, Staphylococcus aureus
AEGELQP

SEQ ID NO: 1613454 - protein, 5 aa, Staphylococcus aureus
AESWD

SEQ ID NO: 1613455 - protein, 7 aa, Staphylococcus aureus
AETTQDA

SEQ ID NO: 1613456 - protein, 16 aa, Staphylococcus aureus
AGNGFDPSSKPKGSGL

SEQ ID NO: 1613457 - protein, 6 aa, Staphylococcus aureus
AIEADQ

SEQ ID NO: 1613458 - protein, 5 aa, Staphylococcus aureus
AKHTG

SEQ ID NO: 1613459 - protein, 8 aa, Staphylococcus aureus
AKNAKNIN

SEQ ID NO: 1613460 - protein, 7 aa, Staphylococcus aureus
AKRAEQV

SEQ ID NO: 1613461 - protein, 13 aa, Staphylococcus aureus
APRHKKDDQTNLS

SEQ ID NO: 1613462 - protein, 4 aa, Staphylococcus aureus
AQNE

SEQ ID NO: 1613463 - protein, 18 aa, Staphylococcus aureus
ASDRITVDDTATQLSKDL

SEQ ID NO: 1613464 - protein, 5 aa, Staphylococcus aureus
ATPAI

SEQ ID NO: 1613465 - protein, 4 aa, Staphylococcus aureus
ATVE

SEQ ID NO: 1613466 - protein, 4 aa, Staphylococcus aureus
AVPD

SEQ ID NO: 1613467 - protein, 6 aa, Staphylococcus aureus
CGPQQR

SEQ ID NO: 1613468 - protein, 5 aa, Staphylococcus aureus
CNTLE

SEQ ID NO: 1613469 - protein, 22 aa, Staphylococcus aureus
DAYRQAATEAGFDASPKSLPVS

SEQ ID NO: 1613470 - protein, 7 aa, Staphylococcus aureus
DCDSASD

SEQ ID NO: 1613471 - protein, 6 aa, Staphylococcus aureus
DDEEEA

SEQ ID NO: 1613472 - protein, 7 aa, Staphylococcus aureus
DEKEKYS

SEQ ID NO: 1613473 - protein, 7 aa, Staphylococcus aureus
DENNNGI

SEQ ID NO: 1613474 - protein, 6 aa, Staphylococcus aureus
DHKGRI

SEQ ID NO: 1613475 - protein, 14 aa, Staphylococcus aureus
DHNENGIPHALKKL

SEQ ID NO: 1613476 - protein, 5 aa, Staphylococcus aureus
DITGN

SEQ ID NO: 1613477 - protein, 6 aa, Staphylococcus aureus
DKANLQ

SEQ ID NO: 1613478 - protein, 6 aa, Staphylococcus aureus
DNEDYE

SEQ ID NO: 1613479 - protein, 8 aa, Staphylococcus aureus
DNQNINPS

SEQ ID NO: 1613480 - protein, 12 aa, Staphylococcus aureus
DPLETPGTGTRV

SEQ ID NO: 1613481 - protein, 26 aa, Staphylococcus aureus
DQSGGSTPKALKEYGVNEDQYSNEDE

SEQ ID NO: 1613482 - protein, 6 aa, Staphylococcus aureus
DQSGVE

SEQ ID NO: 1613483 - protein, 6 aa, Staphylococcus aureus
DREISS

SEQ ID NO: 1613484 - protein, 22 aa, Staphylococcus aureus
DRNGALEGIGKPEKLKSNLTGY

SEQ ID NO: 1613485 - protein, 10 aa, Staphylococcus aureus
DVTTKYHSGQ

SEQ ID NO: 1613486 - protein, 5 aa, Staphylococcus aureus
DVYDD

SEQ ID NO: 1613487 - protein, 4 aa, Staphylococcus aureus
DYDH

SEQ ID NO: 1613488 - protein, 14 aa, Staphylococcus aureus
EAFHGGHTKGTINI

SEQ ID NO: 1613489 - protein, 12 aa, Staphylococcus aureus
EAYNQNNQYQDK

SEQ ID NO: 1613490 - protein, 12 aa, Staphylococcus aureus
EDDSDSESPKLS

SEQ ID NO: 1613491 - protein, 6 aa, Staphylococcus aureus
EDENTD

SEQ ID NO: 1613492 - protein, 4 aa, Staphylococcus aureus
EDET

SEQ ID NO: 1613493 - protein, 15 aa, Staphylococcus aureus
EEEAAQLRENKLVTQ

SEQ ID NO: 1613494 - protein, 14 aa, Staphylococcus aureus
EEKDYNTSKNDYTH

SEQ ID NO: 1613495 - protein, 12 aa, Staphylococcus aureus
EELRDEVEYGGV

SEQ ID NO: 1613496 - protein, 9 aa, Staphylococcus aureus
EEQYPETEL

SEQ ID NO: 1613497 - protein, 5 aa, Staphylococcus aureus
EERKR

SEQ ID NO: 1613498 - protein, 8 aa, Staphylococcus aureus
EISESDHQ

SEQ ID NO: 1613499 - protein, 36 aa, Staphylococcus aureus
EKFKNSDNEQVKNVKDKINEYTGSNNEEKKENEDKE

SEQ ID NO: 1613500 - protein, 15 aa, Staphylococcus aureus
EKRPEIAQKVSTKKL

SEQ ID NO: 1613501 - protein, 7 aa, Staphylococcus aureus
EKSFGKG

SEQ ID NO: 1613502 - protein, 8 aa, Staphylococcus aureus
EKSQYNPL

SEQ ID NO: 1613503 - protein, 8 aa, Staphylococcus aureus
EKVTEEDV

SEQ ID NO: 1613504 - protein, 6 aa, Staphylococcus aureus
EKYAPE

SEQ ID NO: 1613505 - protein, 9 aa, Staphylococcus aureus
ENEKAKAEL

SEQ ID NO: 1613506 - protein, 7 aa, Staphylococcus aureus
ENGKQNI

SEQ ID NO: 1613507 - protein, 9 aa, Staphylococcus aureus
ENPQIKEEI

SEQ ID NO: 1613508 - protein, 6 aa, Staphylococcus aureus
EPEEGL

SEQ ID NO: 1613509 - protein, 10 aa, Staphylococcus aureus
EPLGDSKPDW

SEQ ID NO: 1613510 - protein, 4 aa, Staphylococcus aureus
ESVT

SEQ ID NO: 1613511 - protein, 4 aa, Staphylococcus aureus
ETEV

SEQ ID NO: 1613512 - protein, 10 aa, Staphylococcus aureus
EVPNQNPTTV

SEQ ID NO: 1613513 - protein, 20 aa, Staphylococcus aureus
FASTKEELEAKAASLSTKTI

SEQ ID NO: 1613514 - protein, 5 aa, Staphylococcus aureus
FAYDD

SEQ ID NO: 1613515 - protein, 4 aa, Staphylococcus aureus
FEQI

SEQ ID NO: 1613516 - protein, 9 aa, Staphylococcus aureus
FNKKEGMAL

SEQ ID NO: 1613517 - protein, 14 aa, Staphylococcus aureus
GADVNDSTSAPVDD

SEQ ID NO: 1613518 - protein, 8 aa, Staphylococcus aureus
GARAAGKD

SEQ ID NO: 1613519 - protein, 12 aa, Staphylococcus aureus
GAVEESKSQFKD

SEQ ID NO: 1613520 - protein, 6 aa, Staphylococcus aureus
GEHGDT

SEQ ID NO: 1613521 - protein, 9 aa, Staphylococcus aureus
GEQGAPEEM

SEQ ID NO: 1613522 - protein, 6 aa, Staphylococcus aureus
GGAPQL

SEQ ID NO: 1613523 - protein, 7 aa, Staphylococcus aureus
GGGSSVP

SEQ ID NO: 1613524 - protein, 5 aa, Staphylococcus aureus
GIPDT

SEQ ID NO: 1613525 - protein, 5 aa, Staphylococcus aureus
GKGHM

SEQ ID NO: 1613526 - protein, 7 aa, Staphylococcus aureus
GKIERSC

SEQ ID NO: 1613527 - protein, 14 aa, Staphylococcus aureus
GLAISGGDVGGSKN

SEQ ID NO: 1613528 - protein, 13 aa, Staphylococcus aureus
GMNQTLDQLDALL

SEQ ID NO: 1613529 - protein, 6 aa, Staphylococcus aureus
GNFEVS

SEQ ID NO: 1613530 - protein, 9 aa, Staphylococcus aureus
GNGTDSISD

SEQ ID NO: 1613531 - protein, 14 aa, Staphylococcus aureus
GNKSITSNSGSTDL

SEQ ID NO: 1613532 - protein, 14 aa, Staphylococcus aureus
GNRSANASKYLAKQ

SEQ ID NO: 1613533 - protein, 5 aa, Staphylococcus aureus
GPGSI

SEQ ID NO: 1613534 - protein, 9 aa, Staphylococcus aureus
GQPKAGDTV

SEQ ID NO: 1613535 - protein, 7 aa, Staphylococcus aureus
GQQAQNV

SEQ ID NO: 1613536 - protein, 5 aa, Staphylococcus aureus
GRAQL

SEQ ID NO: 1613537 - protein, 20 aa, Staphylococcus aureus
GRGTESDEKIQSRINEARKE

SEQ ID NO: 1613538 - protein, 7 aa, Staphylococcus aureus
GSKDIDN

SEQ ID NO: 1613539 - protein, 33 aa, Staphylococcus aureus
GSKFDRSGLSSDLKEEWDQYSKEELVEKEADSH

SEQ ID NO: 1613540 - protein, 4 aa, Staphylococcus aureus
GSSF

SEQ ID NO: 1613541 - protein, 8 aa, Staphylococcus aureus
GTDGVGTK

SEQ ID NO: 1613542 - protein, 6 aa, Staphylococcus aureus
GVTPRN

SEQ ID NO: 1613543 - protein, 10 aa, Staphylococcus aureus
GYENTKNYDQ

SEQ ID NO: 1613544 - protein, 5 aa, Staphylococcus aureus
HDNDK

SEQ ID NO: 1613545 - protein, 4 aa, Staphylococcus aureus
HEAL

SEQ ID NO: 1613546 - protein, 6 aa, Staphylococcus aureus
HERNRY

SEQ ID NO: 1613547 - protein, 7 aa, Staphylococcus aureus
HGRQNQA

SEQ ID NO: 1613548 - protein, 6 aa, Staphylococcus aureus
HISQEE

SEQ ID NO: 1613549 - protein, 4 aa, Staphylococcus aureus
HKKK

SEQ ID NO: 1613550 - protein, 5 aa, Staphylococcus aureus
HKTQS

SEQ ID NO: 1613551 - protein, 6 aa, Staphylococcus aureus
HLSGQE

SEQ ID NO: 1613552 - protein, 10 aa, Staphylococcus aureus
HNVPGAEEYT

SEQ ID NO: 1613553 - protein, 8 aa, Staphylococcus aureus
HPHGDSSV

SEQ ID NO: 1613554 - protein, 12 aa, Staphylococcus aureus
HPKKDRAAYEAR

SEQ ID NO: 1613555 - protein, 11 aa, Staphylococcus aureus
HPTPALGGYPK

SEQ ID NO: 1613556 - protein, 15 aa, Staphylococcus aureus
HQEKRTQVLATFKAL

SEQ ID NO: 1613557 - protein, 18 aa, Staphylococcus aureus
HRPTSPDYTVGTEPLTQQ

SEQ ID NO: 1613558 - protein, 25 aa, Staphylococcus aureus
HYGNPSSIHAKGRDARKYLDESRRQ

SEQ ID NO: 1613559 - protein, 9 aa, Staphylococcus aureus
IAEGEAETT

SEQ ID NO: 1613560 - protein, 5 aa, Staphylococcus aureus
IDNPI

SEQ ID NO: 1613561 - protein, 14 aa, Staphylococcus aureus
IEGTPTIENGVPTV

SEQ ID NO: 1613562 - protein, 12 aa, Staphylococcus aureus
IGATENANHNLF

SEQ ID NO: 1613563 - protein, 6 aa, Staphylococcus aureus
IGNGSP

SEQ ID NO: 1613564 - protein, 8 aa, Staphylococcus aureus
INPEKDVD

SEQ ID NO: 1613565 - protein, 17 aa, Staphylococcus aureus
IPANTEPIRGGTDGSQL

SEQ ID NO: 1613566 - protein, 28 aa, Staphylococcus aureus
ISREEQDTFAVNSQQKAVRAQQNGEFDS

SEQ ID NO: 1613567 - protein, 36 aa, Staphylococcus aureus
ITTDEYKEKVKAYQTEASKKSDLERTDLAKDKSGVF

SEQ ID NO: 1613568 - protein, 7 aa, Staphylococcus aureus
IVKENPD

SEQ ID NO: 1613569 - protein, 7 aa, Staphylococcus aureus
KASKTFP

SEQ ID NO: 1613570 - protein, 12 aa, Staphylococcus aureus
KASTEQREENDL

SEQ ID NO: 1613571 - protein, 6 aa, Staphylococcus aureus
KDDQME

SEQ ID NO: 1613572 - protein, 8 aa, Staphylococcus aureus
KDYADAHE

SEQ ID NO: 1613573 - protein, 9 aa, Staphylococcus aureus
KEAKRYELT

SEQ ID NO: 1613574 - protein, 5 aa, Staphylococcus aureus
KEIQR

SEQ ID NO: 1613575 - protein, 6 aa, Staphylococcus aureus
KETPLL

SEQ ID NO: 1613576 - protein, 17 aa, Staphylococcus aureus
KHAPNSDFKGGSPEENL

SEQ ID NO: 1613577 - protein, 5 aa, Staphylococcus aureus
KIQNK

SEQ ID NO: 1613578 - protein, 5 aa, Staphylococcus aureus
KKDQV

SEQ ID NO: 1613579 - protein, 8 aa, Staphylococcus aureus
KKRHPQYS

SEQ ID NO: 1613580 - protein, 10 aa, Staphylococcus aureus
KLKEEQKRLE

SEQ ID NO: 1613581 - protein, 7 aa, Staphylococcus aureus
KLTGGVE

SEQ ID NO: 1613582 - protein, 10 aa, Staphylococcus aureus
KNINQGIGEV

SEQ ID NO: 1613583 - protein, 19 aa, Staphylococcus aureus
KNQSVAEAIRTASDNIQKV

SEQ ID NO: 1613584 - protein, 6 aa, Staphylococcus aureus
KNVEKH

SEQ ID NO: 1613585 - protein, 6 aa, Staphylococcus aureus
KQRKHE

SEQ ID NO: 1613586 - protein, 11 aa, Staphylococcus aureus
KRYKRNESYYN

SEQ ID NO: 1613587 - protein, 4 aa, Staphylococcus aureus
KSEH

SEQ ID NO: 1613588 - protein, 10 aa, Staphylococcus aureus
KSISKNGGKV

SEQ ID NO: 1613589 - protein, 9 aa, Staphylococcus aureus
KSKKITTYK

SEQ ID NO: 1613590 - protein, 4 aa, Staphylococcus aureus
KSYQ

SEQ ID NO: 1613591 - protein, 9 aa, Staphylococcus aureus
KTKSSIEAD

SEQ ID NO: 1613592 - protein, 14 aa, Staphylococcus aureus
KTVTETIEYEEVEH

SEQ ID NO: 1613593 - protein, 6 aa, Staphylococcus aureus
LDAQRR

SEQ ID NO: 1613594 - protein, 10 aa, Staphylococcus aureus
LESARNKAQH

SEQ ID NO: 1613595 - protein, 12 aa, Staphylococcus aureus
LEYEEKRQEEEL

SEQ ID NO: 1613596 - protein, 7 aa, Staphylococcus aureus
LNHQSGH

SEQ ID NO: 1613597 - protein, 12 aa, Staphylococcus aureus
LNKEVSASIENN

SEQ ID NO: 1613598 - protein, 8 aa, Staphylococcus aureus
LNTEDTDE

SEQ ID NO: 1613599 - protein, 9 aa, Staphylococcus aureus
LPGDEAGIK

SEQ ID NO: 1613600 - protein, 10 aa, Staphylococcus aureus
LPPKEGDDYS

SEQ ID NO: 1613601 - protein, 6 aa, Staphylococcus aureus
LQKTMQ

SEQ ID NO: 1613602 - protein, 8 aa, Staphylococcus aureus
LRNEEDRL

SEQ ID NO: 1613603 - protein, 8 aa, Staphylococcus aureus
LTPPRQEN

SEQ ID NO: 1613604 - protein, 16 aa, Staphylococcus aureus
MGGENTSINMSNKPPT

SEQ ID NO: 1613605 - protein, 10 aa, Staphylococcus aureus
MKTGSYRSAT

SEQ ID NO: 1613606 - protein, 7 aa, Staphylococcus aureus
MSQAETV

SEQ ID NO: 1613607 - protein, 6 aa, Staphylococcus aureus
NAIENG

SEQ ID NO: 1613608 - protein, 10 aa, Staphylococcus aureus
NEDYARYSEK

SEQ ID NO: 1613609 - protein, 6 aa, Staphylococcus aureus
NENTTV

SEQ ID NO: 1613610 - protein, 8 aa, Staphylococcus aureus
NEQANGKR

SEQ ID NO: 1613611 - protein, 10 aa, Staphylococcus aureus
NESKNTQDID

SEQ ID NO: 1613612 - protein, 8 aa, Staphylococcus aureus
NESLDRQD

SEQ ID NO: 1613613 - protein, 7 aa, Staphylococcus aureus
NFPGKEW

SEQ ID NO: 1613614 - protein, 6 aa, Staphylococcus aureus
NGNISN

SEQ ID NO: 1613615 - protein, 6 aa, Staphylococcus aureus
NGRVTV

SEQ ID NO: 1613616 - protein, 7 aa, Staphylococcus aureus
NGSSKYV

SEQ ID NO: 1613617 - protein, 17 aa, Staphylococcus aureus
NKRLETKKSVSKEVKYQ

SEQ ID NO: 1613618 - protein, 7 aa, Staphylococcus aureus
NKSDVVD

SEQ ID NO: 1613619 - protein, 19 aa, Staphylococcus aureus
NNPISPDPIEAKEADETLR

SEQ ID NO: 1613620 - protein, 11 aa, Staphylococcus aureus
NQHQELSKEIE

SEQ ID NO: 1613621 - protein, 11 aa, Staphylococcus aureus
NTEPFKTTNSY

SEQ ID NO: 1613622 - protein, 7 aa, Staphylococcus aureus
PDSTYIG

SEQ ID NO: 1613623 - protein, 5 aa, Staphylococcus aureus
PEEKV

SEQ ID NO: 1613624 - protein, 5 aa, Staphylococcus aureus
PELTS

SEQ ID NO: 1613625 - protein, 10 aa, Staphylococcus aureus
PGDDLPTAGG

SEQ ID NO: 1613626 - protein, 13 aa, Staphylococcus aureus
PGFEDLKKELEER

SEQ ID NO: 1613627 - protein, 5 aa, Staphylococcus aureus
PHPRM

SEQ ID NO: 1613628 - protein, 4 aa, Staphylococcus aureus
PKHK

SEQ ID NO: 1613629 - protein, 28 aa, Staphylococcus aureus
PKKLENGRIPVSKPSEKVESDKQKYDKY

SEQ ID NO: 1613630 - protein, 8 aa, Staphylococcus aureus
PKTPNNDN

SEQ ID NO: 1613631 - protein, 9 aa, Staphylococcus aureus
PLVPTTGKY

SEQ ID NO: 1613632 - protein, 7 aa, Staphylococcus aureus
PNKQSIN

SEQ ID NO: 1613633 - protein, 7 aa, Staphylococcus aureus
PSISQQQ

SEQ ID NO: 1613634 - protein, 7 aa, Staphylococcus aureus
PSTFGQR

SEQ ID NO: 1613635 - protein, 4 aa, Staphylococcus aureus
PTVQ

SEQ ID NO: 1613636 - protein, 5 aa, Staphylococcus aureus
PVEEA

SEQ ID NO: 1613637 - protein, 10 aa, Staphylococcus aureus
PWPKNRHAKR

SEQ ID NO: 1613638 - protein, 6 aa, Staphylococcus aureus
QDIVDD

SEQ ID NO: 1613639 - protein, 6 aa, Staphylococcus aureus
QDTQNA

SEQ ID NO: 1613640 - protein, 13 aa, Staphylococcus aureus
QEDDNSEAMNLED

SEQ ID NO: 1613641 - protein, 7 aa, Staphylococcus aureus
QEDTTKL

SEQ ID NO: 1613642 - protein, 4 aa, Staphylococcus aureus
QELR

SEQ ID NO: 1613643 - protein, 7 aa, Staphylococcus aureus
QHQGNKF

SEQ ID NO: 1613644 - protein, 6 aa, Staphylococcus aureus
QIGGAP

SEQ ID NO: 1613645 - protein, 5 aa, Staphylococcus aureus
QINKD

SEQ ID NO: 1613646 - protein, 5 aa, Staphylococcus aureus
QITGA

SEQ ID NO: 1613647 - protein, 9 aa, Staphylococcus aureus
QKKASSSMV

SEQ ID NO: 1613648 - protein, 5 aa, Staphylococcus aureus
QMTAQ

SEQ ID NO: 1613649 - protein, 4 aa, Staphylococcus aureus
QNVS

SEQ ID NO: 1613650 - protein, 4 aa, Staphylococcus aureus
QPQV

SEQ ID NO: 1613651 - protein, 8 aa, Staphylococcus aureus
QTENNNEI

SEQ ID NO: 1613652 - protein, 5 aa, Staphylococcus aureus
QTRNI

SEQ ID NO: 1613653 - protein, 21 aa, Staphylococcus aureus
REKIETKIANSKKDISKTNNK

SEQ ID NO: 1613654 - protein, 9 aa, Staphylococcus aureus
RERRQRAEA

SEQ ID NO: 1613655 - protein, 7 aa, Staphylococcus aureus
RGQLPEK

SEQ ID NO: 1613656 - protein, 21 aa, Staphylococcus aureus
RGYQLSKTEYRGREATDFKEE

SEQ ID NO: 1613657 - protein, 8 aa, Staphylococcus aureus
RHKDNGSI

SEQ ID NO: 1613658 - protein, 14 aa, Staphylococcus aureus
RQDKEPLKPNPDLS

SEQ ID NO: 1613659 - protein, 9 aa, Staphylococcus aureus
RSNYDTENE

SEQ ID NO: 1613660 - protein, 21 aa, Staphylococcus aureus
SANANSCTGQQGIDDARQTQT

SEQ ID NO: 1613661 - protein, 5 aa, Staphylococcus aureus
SAQKM

SEQ ID NO: 1613662 - protein, 42 aa, Staphylococcus aureus
SAQSPAVDKVETEKRISELENDKRKAVSAEEYKKADDIQNEI

SEQ ID NO: 1613663 - protein, 7 aa, Staphylococcus aureus
SDQRLTK

SEQ ID NO: 1613664 - protein, 9 aa, Staphylococcus aureus
SEAITSTEI

SEQ ID NO: 1613665 - protein, 10 aa, Staphylococcus aureus
SFDNNGTKLI

SEQ ID NO: 1613666 - protein, 15 aa, Staphylococcus aureus
SGATGSDSGSKGLSD

SEQ ID NO: 1613667 - protein, 9 aa, Staphylococcus aureus
SGEGEDALG

SEQ ID NO: 1613668 - protein, 13 aa, Staphylococcus aureus
SGHYTERGEDIGY

SEQ ID NO: 1613669 - protein, 4 aa, Staphylococcus aureus
SGYS

SEQ ID NO: 1613670 - protein, 4 aa, Staphylococcus aureus
SHSV

SEQ ID NO: 1613671 - protein, 4 aa, Staphylococcus aureus
SKTN

SEQ ID NO: 1613672 - protein, 7 aa, Staphylococcus aureus
SLTTDPA

SEQ ID NO: 1613673 - protein, 8 aa, Staphylococcus aureus
SLTTKDAI

SEQ ID NO: 1613674 - protein, 6 aa, Staphylococcus aureus
SNLGET

SEQ ID NO: 1613675 - protein, 8 aa, Staphylococcus aureus
SNMATESG

SEQ ID NO: 1613676 - protein, 9 aa, Staphylococcus aureus
SNNHTAEQA

SEQ ID NO: 1613677 - protein, 4 aa, Staphylococcus aureus
SQKG

SEQ ID NO: 1613678 - protein, 9 aa, Staphylococcus aureus
SQNSNAKYI

SEQ ID NO: 1613679 - protein, 8 aa, Staphylococcus aureus
SSIYQERD

SEQ ID NO: 1613680 - protein, 18 aa, Staphylococcus aureus
STGRKHTHITKAKSNQRF

SEQ ID NO: 1613681 - protein, 12 aa, Staphylococcus aureus
STNEKGKSVAVK

SEQ ID NO: 1613682 - protein, 7 aa, Staphylococcus aureus
SVNEPQI

SEQ ID NO: 1613683 - protein, 8 aa, Staphylococcus aureus
TDPGFPSD

SEQ ID NO: 1613684 - protein, 16 aa, Staphylococcus aureus
TEGQIEIDGKDVRSMN

SEQ ID NO: 1613685 - protein, 7 aa, Staphylococcus aureus
TGEDGEH

SEQ ID NO: 1613686 - protein, 8 aa, Staphylococcus aureus
TGEGPKEL

SEQ ID NO: 1613687 - protein, 6 aa, Staphylococcus aureus
TGEHSQ

SEQ ID NO: 1613688 - protein, 9 aa, Staphylococcus aureus
TIDDPEQFA

SEQ ID NO: 1613689 - protein, 28 aa, Staphylococcus aureus
TKTSESLIADDESSGYNNTREKDEDYFK

SEQ ID NO: 1613690 - protein, 5 aa, Staphylococcus aureus
TPQMS

SEQ ID NO: 1613691 - protein, 4 aa, Staphylococcus aureus
TQKG

SEQ ID NO: 1613692 - protein, 13 aa, Staphylococcus aureus
TRNKNNRKLSDIG

SEQ ID NO: 1613693 - protein, 5 aa, Staphylococcus aureus
TSHAK

SEQ ID NO: 1613694 - protein, 9 aa, Staphylococcus aureus
TSNQPAPPH

SEQ ID NO: 1613695 - protein, 13 aa, Staphylococcus aureus
TSVERPEIQETTA

SEQ ID NO: 1613696 - protein, 9 aa, Staphylococcus aureus
TTASELGGK

SEQ ID NO: 1613697 - protein, 13 aa, Staphylococcus aureus
TTTVDDTPNQLNE

SEQ ID NO: 1613698 - protein, 5 aa, Staphylococcus aureus
TVNQG

SEQ ID NO: 1613699 - protein, 7 aa, Staphylococcus aureus
TVRGNVD

SEQ ID NO: 1613700 - protein, 4 aa, Staphylococcus aureus
TVRN

SEQ ID NO: 1613701 - protein, 9 aa, Staphylococcus aureus
TYKTTYGKV

SEQ ID NO: 1613702 - protein, 11 aa, Staphylococcus aureus
VADSGAIGGSH

SEQ ID NO: 1613703 - protein, 4 aa, Staphylococcus aureus
VEQL

SEQ ID NO: 1613704 - protein, 16 aa, Staphylococcus aureus
VFNSKTSFRIEEKVEN

SEQ ID NO: 1613705 - protein, 7 aa, Staphylococcus aureus
VGYTEQP

SEQ ID NO: 1613706 - protein, 7 aa, Staphylococcus aureus
VNSDTDV

SEQ ID NO: 1613707 - protein, 5 aa, Staphylococcus aureus
VPEYD

SEQ ID NO: 1613708 - protein, 8 aa, Staphylococcus aureus
VVGPQGSK

SEQ ID NO: 1613709 - protein, 10 aa, Staphylococcus aureus
WKGKRSTDDI

SEQ ID NO: 1613710 - protein, 13 aa, Staphylococcus aureus
YAESFNDHTKLGK

SEQ ID NO: 1613711 - protein, 4 aa, Staphylococcus aureus
YDIS

SEQ ID NO: 1613712 - protein, 14 aa, Staphylococcus aureus
YDQRTNGNRKETWS

SEQ ID NO: 1613713 - protein, 9 aa, Staphylococcus aureus
YEAEQDVHN

SEQ ID NO: 1613714 - protein, 6 aa, Staphylococcus aureus
YEDDTR

SEQ ID NO: 1613715 - protein, 28 aa, Staphylococcus aureus
YEKANSGENDEKEKDENTLKGGDEDESG

SEQ ID NO: 1613716 - protein, 15 aa, Staphylococcus aureus
YGNQSRTTDNRGSVP

SEQ ID NO: 1613717 - protein, 7 aa, Staphylococcus aureus
YNDSGER

SEQ ID NO: 1613718 - protein, 9 aa, Staphylococcus aureus
YNGDRARKQ

SEQ ID NO: 1613719 - protein, 4 aa, Staphylococcus aureus
YRNE

SEQ ID NO: 1613720 - protein, 9 aa, Staphylococcus aureus
YRQQDGSSI

SEQ ID NO: 1613721 - protein, 7 aa, Staphylococcus aureus
YTESLGG

SEQ ID NO: 1613722 - protein, 33 aa, Staphylococcus aureus
AAHSNQSNQSMNNNDLTASKANDNSDVSTNDYH

SEQ ID NO: 1613723 - protein, 8 aa, Staphylococcus aureus
AASEQSSS

SEQ ID NO: 1613724 - protein, 8 aa, Staphylococcus aureus
ADDGKISL

SEQ ID NO: 1613725 - protein, 8 aa, Staphylococcus aureus
AEAGRTDN

SEQ ID NO: 1613726 - protein, 10 aa, Staphylococcus aureus
AEKLKNGETL

SEQ ID NO: 1613727 - protein, 4 aa, Staphylococcus aureus
AGKS

SEQ ID NO: 1613728 - protein, 11 aa, Staphylococcus aureus
AGRAGRHEKAG

SEQ ID NO: 1613729 - protein, 6 aa, Staphylococcus aureus
AHEYGE

SEQ ID NO: 1613730 - protein, 10 aa, Staphylococcus aureus
AIDKVQQSKH

SEQ ID NO: 1613731 - protein, 16 aa, Staphylococcus aureus
AISTPRSKQTAAETLA

SEQ ID NO: 1613732 - protein, 8 aa, Staphylococcus aureus
AKDRNKVT

SEQ ID NO: 1613733 - protein, 8 aa, Staphylococcus aureus
AKHSQNGI

SEQ ID NO: 1613734 - protein, 50 aa, Staphylococcus aureus
AKTQTSQNKQLEQEKQNDSVVKQGTASKSSDENVSSTTKSMPNYSKVDNT

SEQ ID NO: 1613735 - protein, 14 aa, Staphylococcus aureus
ALGTSPRMTFIKHK

SEQ ID NO: 1613736 - protein, 8 aa, Staphylococcus aureus
AMSNTASH

SEQ ID NO: 1613737 - protein, 15 aa, Staphylococcus aureus
ANAPRIDDERYSTGR

SEQ ID NO: 1613738 - protein, 8 aa, Staphylococcus aureus
ANISGTAD

SEQ ID NO: 1613739 - protein, 13 aa, Staphylococcus aureus
ANQSVTTANGIEV

SEQ ID NO: 1613740 - protein, 5 aa, Staphylococcus aureus
APKTV

SEQ ID NO: 1613741 - protein, 13 aa, Staphylococcus aureus
APMEVNKRKAEVG

SEQ ID NO: 1613742 - protein, 7 aa, Staphylococcus aureus
AQSEGYT

SEQ ID NO: 1613743 - protein, 4 aa, Staphylococcus aureus
ARAY

SEQ ID NO: 1613744 - protein, 7 aa, Staphylococcus aureus
ASPEFDD

SEQ ID NO: 1613745 - protein, 15 aa, Staphylococcus aureus
ASQFKSGERQLPNFE

SEQ ID NO: 1613746 - protein, 19 aa, Staphylococcus aureus
ATKARNKQLTTEDMQGGTF

SEQ ID NO: 1613747 - protein, 6 aa, Staphylococcus aureus
ATSSGM

SEQ ID NO: 1613748 - protein, 8 aa, Staphylococcus aureus
AYKENNNV

SEQ ID NO: 1613749 - protein, 4 aa, Staphylococcus aureus
DAAG

SEQ ID NO: 1613750 - protein, 4 aa, Staphylococcus aureus
DAIP

SEQ ID NO: 1613751 - protein, 7 aa, Staphylococcus aureus
DATSGSI

SEQ ID NO: 1613752 - protein, 6 aa, Staphylococcus aureus
DCQKEL

SEQ ID NO: 1613753 - protein, 10 aa, Staphylococcus aureus
DDKAAAFESN

SEQ ID NO: 1613754 - protein, 5 aa, Staphylococcus aureus
DDRNK

SEQ ID NO: 1613755 - protein, 8 aa, Staphylococcus aureus
DDVTSLST

SEQ ID NO: 1613756 - protein, 7 aa, Staphylococcus aureus
DEEVGKK

SEQ ID NO: 1613757 - protein, 6 aa, Staphylococcus aureus
DEQHYT

SEQ ID NO: 1613758 - protein, 18 aa, Staphylococcus aureus
DESQSIGKRYRRQDEIGT

SEQ ID NO: 1613759 - protein, 7 aa, Staphylococcus aureus
DGIGNKR

SEQ ID NO: 1613760 - protein, 5 aa, Staphylococcus aureus
DGNHF

SEQ ID NO: 1613761 - protein, 8 aa, Staphylococcus aureus
DHISNTPK

SEQ ID NO: 1613762 - protein, 6 aa, Staphylococcus aureus
DHPENE

SEQ ID NO: 1613763 - protein, 6 aa, Staphylococcus aureus
DHRKQQ

SEQ ID NO: 1613764 - protein, 8 aa, Staphylococcus aureus
DKNSQNVE

SEQ ID NO: 1613765 - protein, 9 aa, Staphylococcus aureus
DKSTVEKAK

SEQ ID NO: 1613766 - protein, 5 aa, Staphylococcus aureus
DLESE

SEQ ID NO: 1613767 - protein, 6 aa, Staphylococcus aureus
DLKEEG

SEQ ID NO: 1613768 - protein, 8 aa, Staphylococcus aureus
DLPESQDN

SEQ ID NO: 1613769 - protein, 7 aa, Staphylococcus aureus
DNISKND

SEQ ID NO: 1613770 - protein, 9 aa, Staphylococcus aureus
DPEVAERPE

SEQ ID NO: 1613771 - protein, 4 aa, Staphylococcus aureus
DQKV

SEQ ID NO: 1613772 - protein, 13 aa, Staphylococcus aureus
DSEGLTITQATET

SEQ ID NO: 1613773 - protein, 5 aa, Staphylococcus aureus
DSSQL

SEQ ID NO: 1613774 - protein, 7 aa, Staphylococcus aureus
DTYHTPN

SEQ ID NO: 1613775 - protein, 16 aa, Staphylococcus aureus
DVTSNKKRYYKSYSRG

SEQ ID NO: 1613776 - protein, 11 aa, Staphylococcus aureus
DYPITPKNHGT

SEQ ID NO: 1613777 - protein, 5 aa, Staphylococcus aureus
EAGTF

SEQ ID NO: 1613778 - protein, 25 aa, Staphylococcus aureus
EDADTTESTEEVNDVSVETNVEKES

SEQ ID NO: 1613779 - protein, 19 aa, Staphylococcus aureus
EDDISNGKGSVTFNKKDAE

SEQ ID NO: 1613780 - protein, 5 aa, Staphylococcus aureus
EDEDM

SEQ ID NO: 1613781 - protein, 24 aa, Staphylococcus aureus
EDNVQDINETAAPLAYGDSELSRT

SEQ ID NO: 1613782 - protein, 4 aa, Staphylococcus aureus
EEEK

SEQ ID NO: 1613783 - protein, 6 aa, Staphylococcus aureus
EEIKAL

SEQ ID NO: 1613784 - protein, 6 aa, Staphylococcus aureus
EELDNT

SEQ ID NO: 1613785 - protein, 6 aa, Staphylococcus aureus
EEQGIT

SEQ ID NO: 1613786 - protein, 4 aa, Staphylococcus aureus
EFKN

SEQ ID NO: 1613787 - protein, 9 aa, Staphylococcus aureus
EGVSSSRFK

SEQ ID NO: 1613788 - protein, 7 aa, Staphylococcus aureus
EIKGESK

SEQ ID NO: 1613789 - protein, 7 aa, Staphylococcus aureus
EITQESS

SEQ ID NO: 1613790 - protein, 9 aa, Staphylococcus aureus
EKGQETIES

SEQ ID NO: 1613791 - protein, 8 aa, Staphylococcus aureus
ELTTQNGK

SEQ ID NO: 1613792 - protein, 14 aa, Staphylococcus aureus
EMKKEDKKLSKSDF

SEQ ID NO: 1613793 - protein, 7 aa, Staphylococcus aureus
ENNGIKS

SEQ ID NO: 1613794 - protein, 19 aa, Staphylococcus aureus
ESAQQYNATTISTKWQNIL

SEQ ID NO: 1613795 - protein, 13 aa, Staphylococcus aureus
ESIDPKSVMGSGS

SEQ ID NO: 1613796 - protein, 10 aa, Staphylococcus aureus
ETRVDKRIDT

SEQ ID NO: 1613797 - protein, 5 aa, Staphylococcus aureus
EVVTN

SEQ ID NO: 1613798 - protein, 16 aa, Staphylococcus aureus
EYIESEVRPFNTKRQH

SEQ ID NO: 1613799 - protein, 8 aa, Staphylococcus aureus
FDGENVSR

SEQ ID NO: 1613800 - protein, 7 aa, Staphylococcus aureus
FDQAENR

SEQ ID NO: 1613801 - protein, 9 aa, Staphylococcus aureus
FKESMTAQQ

SEQ ID NO: 1613802 - protein, 33 aa, Staphylococcus aureus
FKKESHPKYTINQKTNRKEYSRSRTKKQYINDE

SEQ ID NO: 1613803 - protein, 7 aa, Staphylococcus aureus
FKQKATE

SEQ ID NO: 1613804 - protein, 5 aa, Staphylococcus aureus
FRPSY

SEQ ID NO: 1613805 - protein, 6 aa, Staphylococcus aureus
FTTITN

SEQ ID NO: 1613806 - protein, 12 aa, Staphylococcus aureus
FTTNKNRARVNN

SEQ ID NO: 1613807 - protein, 14 aa, Staphylococcus aureus
GDEALEKVESEQPD

SEQ ID NO: 1613808 - protein, 5 aa, Staphylococcus aureus
GDIGA

SEQ ID NO: 1613809 - protein, 6 aa, Staphylococcus aureus
GDPTHI

SEQ ID NO: 1613810 - protein, 7 aa, Staphylococcus aureus
GEETSHT

SEQ ID NO: 1613811 - protein, 65 aa, Staphylococcus aureus
GEGSGNASKENSNDNTPQQNEETNNKKEETTNNSVDKAEVNQANDDNQQRINATPSARRYARENG

SEQ ID NO: 1613812 - protein, 6 aa, Staphylococcus aureus
GEIAGV

SEQ ID NO: 1613813 - protein, 5 aa, Staphylococcus aureus
GELNI

SEQ ID NO: 1613814 - protein, 15 aa, Staphylococcus aureus
GERLNAEVGSKAYGS

SEQ ID NO: 1613815 - protein, 10 aa, Staphylococcus aureus
GIDPKTIPVD

SEQ ID NO: 1613816 - protein, 7 aa, Staphylococcus aureus
GIHDASD

SEQ ID NO: 1613817 - protein, 9 aa, Staphylococcus aureus
GKIEEGESQ

SEQ ID NO: 1613818 - protein, 11 aa, Staphylococcus aureus
GKRLDSFGQRG

SEQ ID NO: 1613819 - protein, 7 aa, Staphylococcus aureus
GKSKLVN

SEQ ID NO: 1613820 - protein, 8 aa, Staphylococcus aureus
GKTKIKEA

SEQ ID NO: 1613821 - protein, 13 aa, Staphylococcus aureus
GLSGTYNTAYQAS

SEQ ID NO: 1613822 - protein, 11 aa, Staphylococcus aureus
GLVPKDPDQFK

SEQ ID NO: 1613823 - protein, 8 aa, Staphylococcus aureus
GMPPTGGL

SEQ ID NO: 1613824 - protein, 5 aa, Staphylococcus aureus
GNGIE

SEQ ID NO: 1613825 - protein, 6 aa, Staphylococcus aureus
GNKKPI

SEQ ID NO: 1613826 - protein, 11 aa, Staphylococcus aureus
GNNRDKYESYI

SEQ ID NO: 1613827 - protein, 7 aa, Staphylococcus aureus
GPRANEV

SEQ ID NO: 1613828 - protein, 11 aa, Staphylococcus aureus
GPSGSGKSTFQ

SEQ ID NO: 1613829 - protein, 6 aa, Staphylococcus aureus
GQHAGK

SEQ ID NO: 1613830 - protein, 6 aa, Staphylococcus aureus
GQIQPI

SEQ ID NO: 1613831 - protein, 5 aa, Staphylococcus aureus
GQQAG

SEQ ID NO: 1613832 - protein, 8 aa, Staphylococcus aureus
GRDGEVQG

SEQ ID NO: 1613833 - protein, 7 aa, Staphylococcus aureus
GRIGAAT

SEQ ID NO: 1613834 - protein, 6 aa, Staphylococcus aureus
GSGTYV

SEQ ID NO: 1613835 - protein, 7 aa, Staphylococcus aureus
GSKEKSI

SEQ ID NO: 1613836 - protein, 9 aa, Staphylococcus aureus
GSSSYDAPA

SEQ ID NO: 1613837 - protein, 30 aa, Staphylococcus aureus
GTDPVELGKTVSNKLKEQGAYEIIKRLNEQ

SEQ ID NO: 1613838 - protein, 16 aa, Staphylococcus aureus
GTTAESPTLTTDEKER

SEQ ID NO: 1613839 - protein, 6 aa, Staphylococcus aureus
GVSERT

SEQ ID NO: 1613840 - protein, 8 aa, Staphylococcus aureus
GVSTRPGH

SEQ ID NO: 1613841 - protein, 16 aa, Staphylococcus aureus
GYNDPGAVGNGTNERD

SEQ ID NO: 1613842 - protein, 6 aa, Staphylococcus aureus
HATDNW

SEQ ID NO: 1613843 - protein, 13 aa, Staphylococcus aureus
HPPVSKKEAAEKD

SEQ ID NO: 1613844 - protein, 12 aa, Staphylococcus aureus
HPSGDVTPSQED

SEQ ID NO: 1613845 - protein, 8 aa, Staphylococcus aureus
HRESPQSV

SEQ ID NO: 1613846 - protein, 9 aa, Staphylococcus aureus
HSEQKGLRN

SEQ ID NO: 1613847 - protein, 9 aa, Staphylococcus aureus
HSRGTGSWN

SEQ ID NO: 1613848 - protein, 10 aa, Staphylococcus aureus
HSSKELHEMG

SEQ ID NO: 1613849 - protein, 13 aa, Staphylococcus aureus
HTPGGGRSLNGSH

SEQ ID NO: 1613850 - protein, 7 aa, Staphylococcus aureus
IDKHNNN

SEQ ID NO: 1613851 - protein, 12 aa, Staphylococcus aureus
IDTFGEPLTEKT

SEQ ID NO: 1613852 - protein, 4 aa, Staphylococcus aureus
IGED

SEQ ID NO: 1613853 - protein, 30 aa, Staphylococcus aureus
IGRSTTTEDQTGDTLETKGVHSADFNKDDI

SEQ ID NO: 1613854 - protein, 10 aa, Staphylococcus aureus
IHEGTGAGSD

SEQ ID NO: 1613855 - protein, 12 aa, Staphylococcus aureus
IKEAVDAGAESM

SEQ ID NO: 1613856 - protein, 9 aa, Staphylococcus aureus
IKQESEDIK

SEQ ID NO: 1613857 - protein, 17 aa, Staphylococcus aureus
IKSPKTHIEPENDKITV

SEQ ID NO: 1613858 - protein, 8 aa, Staphylococcus aureus
IKTNDDFK

SEQ ID NO: 1613859 - protein, 12 aa, Staphylococcus aureus
INHRPRKSLGYR

SEQ ID NO: 1613860 - protein, 9 aa, Staphylococcus aureus
IPKGAGAKV

SEQ ID NO: 1613861 - protein, 6 aa, Staphylococcus aureus
IPTSEI

SEQ ID NO: 1613862 - protein, 5 aa, Staphylococcus aureus
IQDEQ

SEQ ID NO: 1613863 - protein, 7 aa, Staphylococcus aureus
ISENTRQ

SEQ ID NO: 1613864 - protein, 7 aa, Staphylococcus aureus
ISHSSAE

SEQ ID NO: 1613865 - protein, 11 aa, Staphylococcus aureus
ISTPDNKSELI

SEQ ID NO: 1613866 - protein, 5 aa, Staphylococcus aureus
ISTRE

SEQ ID NO: 1613867 - protein, 6 aa, Staphylococcus aureus
ITMESK

SEQ ID NO: 1613868 - protein, 20 aa, Staphylococcus aureus
IVGDKNAINRKGQMPPSSNA

SEQ ID NO: 1613869 - protein, 4 aa, Staphylococcus aureus
KALP

SEQ ID NO: 1613870 - protein, 6 aa, Staphylococcus aureus
KAWSEK

SEQ ID NO: 1613871 - protein, 11 aa, Staphylococcus aureus
KDEHRKESYTY

SEQ ID NO: 1613872 - protein, 7 aa, Staphylococcus aureus
KDTKTYQ

SEQ ID NO: 1613873 - protein, 13 aa, Staphylococcus aureus
KEAKSEGKKYFDD

SEQ ID NO: 1613874 - protein, 23 aa, Staphylococcus aureus
KEERVNASKELNGPKASFDGDKK

SEQ ID NO: 1613875 - protein, 13 aa, Staphylococcus aureus
KEISEEDANYASG

SEQ ID NO: 1613876 - protein, 23 aa, Staphylococcus aureus
KEKESEIDVADSKVSANGFSRFL

SEQ ID NO: 1613877 - protein, 9 aa, Staphylococcus aureus
KEKRKARKA

SEQ ID NO: 1613878 - protein, 12 aa, Staphylococcus aureus
KELADEKEGGLR

SEQ ID NO: 1613879 - protein, 8 aa, Staphylococcus aureus
KENGAKTV

SEQ ID NO: 1613880 - protein, 6 aa, Staphylococcus aureus
KERKEA

SEQ ID NO: 1613881 - protein, 8 aa, Staphylococcus aureus
KFENNRQT

SEQ ID NO: 1613882 - protein, 13 aa, Staphylococcus aureus
KGQHTVEKDKSYP

SEQ ID NO: 1613883 - protein, 10 aa, Staphylococcus aureus
KGVAPFSDNQ

SEQ ID NO: 1613884 - protein, 15 aa, Staphylococcus aureus
KGVEGLSPKTRRKYD

SEQ ID NO: 1613885 - protein, 14 aa, Staphylococcus aureus
KGYKAEGLHGDITQ

SEQ ID NO: 1613886 - protein, 6 aa, Staphylococcus aureus
KHGDQI

SEQ ID NO: 1613887 - protein, 8 aa, Staphylococcus aureus
KIKTPLKE

SEQ ID NO: 1613888 - protein, 6 aa, Staphylococcus aureus
KIKYSG

SEQ ID NO: 1613889 - protein, 8 aa, Staphylococcus aureus
KKEQKAYN

SEQ ID NO: 1613890 - protein, 6 aa, Staphylococcus aureus
KKGRKE

SEQ ID NO: 1613891 - protein, 6 aa, Staphylococcus aureus
KKLQIQ

SEQ ID NO: 1613892 - protein, 25 aa, Staphylococcus aureus
KLQAKAEAERVSSLPKSAQSLSANQ

SEQ ID NO: 1613893 - protein, 23 aa, Staphylococcus aureus
KLQLENEKLPQLQQQAQQSTNQM

SEQ ID NO: 1613894 - protein, 14 aa, Staphylococcus aureus
KLTPAQSKNTEKNE

SEQ ID NO: 1613895 - protein, 6 aa, Staphylococcus aureus
KNDEVS

SEQ ID NO: 1613896 - protein, 8 aa, Staphylococcus aureus
KNGAGKST

SEQ ID NO: 1613897 - protein, 7 aa, Staphylococcus aureus
KNNDGLK

SEQ ID NO: 1613898 - protein, 11 aa, Staphylococcus aureus
KNTAESYLGEK

SEQ ID NO: 1613899 - protein, 7 aa, Staphylococcus aureus
KNVDSLP

SEQ ID NO: 1613900 - protein, 12 aa, Staphylococcus aureus
KPNYISGQSIAE

SEQ ID NO: 1613901 - protein, 8 aa, Staphylococcus aureus
KPSDRLKA

SEQ ID NO: 1613902 - protein, 8 aa, Staphylococcus aureus
KPSELTPN

SEQ ID NO: 1613903 - protein, 8 aa, Staphylococcus aureus
KPTETLKE

SEQ ID NO: 1613904 - protein, 12 aa, Staphylococcus aureus
KPYNDYDPEELR

SEQ ID NO: 1613905 - protein, 10 aa, Staphylococcus aureus
KQAKSSISED

SEQ ID NO: 1613906 - protein, 12 aa, Staphylococcus aureus
KQEFPENYKIAW

SEQ ID NO: 1613907 - protein, 6 aa, Staphylococcus aureus
KSDADV

SEQ ID NO: 1613908 - protein, 4 aa, Staphylococcus aureus
KTIA

SEQ ID NO: 1613909 - protein, 10 aa, Staphylococcus aureus
KTQKDDLDSG

SEQ ID NO: 1613910 - protein, 11 aa, Staphylococcus aureus
KVNNGEKEYSA

SEQ ID NO: 1613911 - protein, 12 aa, Staphylococcus aureus
LADKIRNGEQIE

SEQ ID NO: 1613912 - protein, 6 aa, Staphylococcus aureus
LAPAGM

SEQ ID NO: 1613913 - protein, 17 aa, Staphylococcus aureus
LAQNTSEAMTELPTPKE

SEQ ID NO: 1613914 - protein, 9 aa, Staphylococcus aureus
LEKSSMPSG

SEQ ID NO: 1613915 - protein, 13 aa, Staphylococcus aureus
LGDTARYATEARI

SEQ ID NO: 1613916 - protein, 16 aa, Staphylococcus aureus
LGPAYQAGTMAGNPLS

SEQ ID NO: 1613917 - protein, 11 aa, Staphylococcus aureus
LGSDDKSKELK

SEQ ID NO: 1613918 - protein, 14 aa, Staphylococcus aureus
LGVGGINDATTISE

SEQ ID NO: 1613919 - protein, 14 aa, Staphylococcus aureus
LKAKTTNLARGGAT

SEQ ID NO: 1613920 - protein, 10 aa, Staphylococcus aureus
LKSKNADELL

SEQ ID NO: 1613921 - protein, 4 aa, Staphylococcus aureus
LLND

SEQ ID NO: 1613922 - protein, 13 aa, Staphylococcus aureus
LPKSDIKTNSVES

SEQ ID NO: 1613923 - protein, 5 aa, Staphylococcus aureus
LQNST

SEQ ID NO: 1613924 - protein, 5 aa, Staphylococcus aureus
LQSEN

SEQ ID NO: 1613925 - protein, 7 aa, Staphylococcus aureus
LRPPHRK

SEQ ID NO: 1613926 - protein, 7 aa, Staphylococcus aureus
LSGGQQR

SEQ ID NO: 1613927 - protein, 8 aa, Staphylococcus aureus
LSKARDTF

SEQ ID NO: 1613928 - protein, 9 aa, Staphylococcus aureus
LTKAPKQQE

SEQ ID NO: 1613929 - protein, 9 aa, Staphylococcus aureus
MGTRSGNID

SEQ ID NO: 1613930 - protein, 5 aa, Staphylococcus aureus
MISQQ

SEQ ID NO: 1613931 - protein, 7 aa, Staphylococcus aureus
MSPIDTT

SEQ ID NO: 1613932 - protein, 9 aa, Staphylococcus aureus
NADTIDKSI

SEQ ID NO: 1613933 - protein, 8 aa, Staphylococcus aureus
NANSGEIF

SEQ ID NO: 1613934 - protein, 6 aa, Staphylococcus aureus
NAPKMD

SEQ ID NO: 1613935 - protein, 7 aa, Staphylococcus aureus
NARPEIQ

SEQ ID NO: 1613936 - protein, 16 aa, Staphylococcus aureus
NASDNHDDNVERLWER

SEQ ID NO: 1613937 - protein, 4 aa, Staphylococcus aureus
NASE

SEQ ID NO: 1613938 - protein, 9 aa, Staphylococcus aureus
NDEEWNNGH

SEQ ID NO: 1613939 - protein, 11 aa, Staphylococcus aureus
NDKFDRKRAKQ

SEQ ID NO: 1613940 - protein, 7 aa, Staphylococcus aureus
NDYLETA

SEQ ID NO: 1613941 - protein, 10 aa, Staphylococcus aureus
NELKRPPVSN

SEQ ID NO: 1613942 - protein, 13 aa, Staphylococcus aureus
NFKPGDKLPSVTQ

SEQ ID NO: 1613943 - protein, 8 aa, Staphylococcus aureus
NFPGIGPV

SEQ ID NO: 1613944 - protein, 12 aa, Staphylococcus aureus
NGPTCHTGSQSC

SEQ ID NO: 1613945 - protein, 5 aa, Staphylococcus aureus
NNAPY

SEQ ID NO: 1613946 - protein, 10 aa, Staphylococcus aureus
NNPETVSTDF

SEQ ID NO: 1613947 - protein, 4 aa, Staphylococcus aureus
NNPT

SEQ ID NO: 1613948 - protein, 12 aa, Staphylococcus aureus
NNSPTLTEQPTY

SEQ ID NO: 1613949 - protein, 7 aa, Staphylococcus aureus
NPDSHER

SEQ ID NO: 1613950 - protein, 8 aa, Staphylococcus aureus
NPNLTTNQ

SEQ ID NO: 1613951 - protein, 5 aa, Staphylococcus aureus
NQGSP

SEQ ID NO: 1613952 - protein, 7 aa, Staphylococcus aureus
NRISKTE

SEQ ID NO: 1613953 - protein, 8 aa, Staphylococcus aureus
NTNPNSAI

SEQ ID NO: 1613954 - protein, 7 aa, Staphylococcus aureus
PAKGTTY

SEQ ID NO: 1613955 - protein, 6 aa, Staphylococcus aureus
PARSGA

SEQ ID NO: 1613956 - protein, 5 aa, Staphylococcus aureus
PAVTQ

SEQ ID NO: 1613957 - protein, 4 aa, Staphylococcus aureus
PDFP

SEQ ID NO: 1613958 - protein, 5 aa, Staphylococcus aureus
PIATS

SEQ ID NO: 1613959 - protein, 7 aa, Staphylococcus aureus
PINDRDS

SEQ ID NO: 1613960 - protein, 5 aa, Staphylococcus aureus
PKEKA

SEQ ID NO: 1613961 - protein, 7 aa, Staphylococcus aureus
PKRVKTR

SEQ ID NO: 1613962 - protein, 5 aa, Staphylococcus aureus
PLPDN

SEQ ID NO: 1613963 - protein, 5 aa, Staphylococcus aureus
PLRQV

SEQ ID NO: 1613964 - protein, 14 aa, Staphylococcus aureus
PMNSNDEEQKQVTR

SEQ ID NO: 1613965 - protein, 38 aa, Staphylococcus aureus
PNFGQNNEDEEEPPTEEIKTKRSEIKRQLEEGKLEKEK

SEQ ID NO: 1613966 - protein, 4 aa, Staphylococcus aureus
PNGV

SEQ ID NO: 1613967 - protein, 8 aa, Staphylococcus aureus
PNKRQGAI

SEQ ID NO: 1613968 - protein, 4 aa, Staphylococcus aureus
PRVI

SEQ ID NO: 1613969 - protein, 8 aa, Staphylococcus aureus
PSGPYDAK

SEQ ID NO: 1613970 - protein, 4 aa, Staphylococcus aureus
PSYI

SEQ ID NO: 1613971 - protein, 11 aa, Staphylococcus aureus
PTEEPTEEEIE

SEQ ID NO: 1613972 - protein, 4 aa, Staphylococcus aureus
PYDI

SEQ ID NO: 1613973 - protein, 6 aa, Staphylococcus aureus
QAQTAH

SEQ ID NO: 1613974 - protein, 15 aa, Staphylococcus aureus
QKANDDGEPTGTAGV

SEQ ID NO: 1613975 - protein, 4 aa, Staphylococcus aureus
QKDG

SEQ ID NO: 1613976 - protein, 7 aa, Staphylococcus aureus
QKPKHPQ

SEQ ID NO: 1613977 - protein, 4 aa, Staphylococcus aureus
QKQA

SEQ ID NO: 1613978 - protein, 8 aa, Staphylococcus aureus
QNGYSDAF

SEQ ID NO: 1613979 - protein, 7 aa, Staphylococcus aureus
QNSKPIS

SEQ ID NO: 1613980 - protein, 9 aa, Staphylococcus aureus
QNSTEQDAD

SEQ ID NO: 1613981 - protein, 5 aa, Staphylococcus aureus
QPIPS

SEQ ID NO: 1613982 - protein, 4 aa, Staphylococcus aureus
QQEH

SEQ ID NO: 1613983 - protein, 8 aa, Staphylococcus aureus
QQINEGDF

SEQ ID NO: 1613984 - protein, 5 aa, Staphylococcus aureus
QQLED

SEQ ID NO: 1613985 - protein, 8 aa, Staphylococcus aureus
QTDETLDR

SEQ ID NO: 1613986 - protein, 7 aa, Staphylococcus aureus
QTKPKNL

SEQ ID NO: 1613987 - protein, 9 aa, Staphylococcus aureus
QTRQDADTI

SEQ ID NO: 1613988 - protein, 6 aa, Staphylococcus aureus
QYTENT

SEQ ID NO: 1613989 - protein, 11 aa, Staphylococcus aureus
RALSSEQKEIL

SEQ ID NO: 1613990 - protein, 13 aa, Staphylococcus aureus
RAQSNARKLAKKC

SEQ ID NO: 1613991 - protein, 19 aa, Staphylococcus aureus
RGELTQNGFTSLETSEAVS

SEQ ID NO: 1613992 - protein, 12 aa, Staphylococcus aureus
RIKTAGPSTPVE

SEQ ID NO: 1613993 - protein, 4 aa, Staphylococcus aureus
RMSE

SEQ ID NO: 1613994 - protein, 8 aa, Staphylococcus aureus
RQGESITE

SEQ ID NO: 1613995 - protein, 6 aa, Staphylococcus aureus
RRKDIT

SEQ ID NO: 1613996 - protein, 8 aa, Staphylococcus aureus
RRKDRDQI

SEQ ID NO: 1613997 - protein, 6 aa, Staphylococcus aureus
RRNETY

SEQ ID NO: 1613998 - protein, 19 aa, Staphylococcus aureus
RVNGKEVKSFSEPDASKLP

SEQ ID NO: 1613999 - protein, 4 aa, Staphylococcus aureus
SAHD

SEQ ID NO: 1614000 - protein, 6 aa, Staphylococcus aureus
SAHRTP

SEQ ID NO: 1614001 - protein, 4 aa, Staphylococcus aureus
SALP

SEQ ID NO: 1614002 - protein, 10 aa, Staphylococcus aureus
SAVDAAKAAA

SEQ ID NO: 1614003 - protein, 6 aa, Staphylococcus aureus
SAVPNH

SEQ ID NO: 1614004 - protein, 4 aa, Staphylococcus aureus
SDIP

SEQ ID NO: 1614005 - protein, 6 aa, Staphylococcus aureus
SDKLSI

SEQ ID NO: 1614006 - protein, 14 aa, Staphylococcus aureus
SDSIDEAKAVSSKY

SEQ ID NO: 1614007 - protein, 6 aa, Staphylococcus aureus
SEGQIE

SEQ ID NO: 1614008 - protein, 12 aa, Staphylococcus aureus
SEKNDKNEVKKA

SEQ ID NO: 1614009 - protein, 19 aa, Staphylococcus aureus
SEPTEGHITYNGKKLDKTM

SEQ ID NO: 1614010 - protein, 4 aa, Staphylococcus aureus
SESD

SEQ ID NO: 1614011 - protein, 4 aa, Staphylococcus aureus
SETS

SEQ ID NO: 1614012 - protein, 5 aa, Staphylococcus aureus
SFDAG

SEQ ID NO: 1614013 - protein, 9 aa, Staphylococcus aureus
SGATESNNL

SEQ ID NO: 1614014 - protein, 6 aa, Staphylococcus aureus
SGLTTD

SEQ ID NO: 1614015 - protein, 6 aa, Staphylococcus aureus
SHQEHF

SEQ ID NO: 1614016 - protein, 19 aa, Staphylococcus aureus
SKAASAAEAYGTDNAKVYD

SEQ ID NO: 1614017 - protein, 9 aa, Staphylococcus aureus
SKESESRLK

SEQ ID NO: 1614018 - protein, 13 aa, Staphylococcus aureus
SLAKTELNKRKSA

SEQ ID NO: 1614019 - protein, 12 aa, Staphylococcus aureus
SLKGPLHGGANE

SEQ ID NO: 1614020 - protein, 5 aa, Staphylococcus aureus
SNENI

SEQ ID NO: 1614021 - protein, 14 aa, Staphylococcus aureus
SNENWKNESATVSS

SEQ ID NO: 1614022 - protein, 12 aa, Staphylococcus aureus
SNEYQNKKSYYE

SEQ ID NO: 1614023 - protein, 5 aa, Staphylococcus aureus
SNQDF

SEQ ID NO: 1614024 - protein, 11 aa, Staphylococcus aureus
SPGPGNPDDYP

SEQ ID NO: 1614025 - protein, 6 aa, Staphylococcus aureus
SPTSGE

SEQ ID NO: 1614026 - protein, 6 aa, Staphylococcus aureus
SQGEIA

SEQ ID NO: 1614027 - protein, 6 aa, Staphylococcus aureus
SQLDSK

SEQ ID NO: 1614028 - protein, 6 aa, Staphylococcus aureus
SQNEAD

SEQ ID NO: 1614029 - protein, 8 aa, Staphylococcus aureus
SRYDNETI

SEQ ID NO: 1614030 - protein, 6 aa, Staphylococcus aureus
SSIGTG

SEQ ID NO: 1614031 - protein, 9 aa, Staphylococcus aureus
SSRYNRPSI

SEQ ID NO: 1614032 - protein, 12 aa, Staphylococcus aureus
STDRADANTVLC

SEQ ID NO: 1614033 - protein, 28 aa, Staphylococcus aureus
STGTMDKVREREKDNSGTTNIDDIDWDN

SEQ ID NO: 1614034 - protein, 6 aa, Staphylococcus aureus
STKGMA

SEQ ID NO: 1614035 - protein, 6 aa, Staphylococcus aureus
SVEKPI

SEQ ID NO: 1614036 - protein, 7 aa, Staphylococcus aureus
SYKTNNK

SEQ ID NO: 1614037 - protein, 23 aa, Staphylococcus aureus
TATGDGSIAAQSAAEYIEHLNDQ

SEQ ID NO: 1614038 - protein, 10 aa, Staphylococcus aureus
TAVETGRVSN

SEQ ID NO: 1614039 - protein, 9 aa, Staphylococcus aureus
TEAVTEGVP

SEQ ID NO: 1614040 - protein, 7 aa, Staphylococcus aureus
TEDHAYQ

SEQ ID NO: 1614041 - protein, 41 aa, Staphylococcus aureus
TESTVEETNVKQNIDDSVEQAEESKGHLQDEAIEETSDENV

SEQ ID NO: 1614042 - protein, 23 aa, Staphylococcus aureus
TGDQNTQDAPHRKGDKRRARAAA

SEQ ID NO: 1614043 - protein, 5 aa, Staphylococcus aureus
TIEEK

SEQ ID NO: 1614044 - protein, 9 aa, Staphylococcus aureus
TKETQQAIN

SEQ ID NO: 1614045 - protein, 15 aa, Staphylococcus aureus
TKVDKSSSYYHYYGD

SEQ ID NO: 1614046 - protein, 6 aa, Staphylococcus aureus
TQDESM

SEQ ID NO: 1614047 - protein, 19 aa, Staphylococcus aureus
TREDKLSNTYKKVEETQPR

SEQ ID NO: 1614048 - protein, 15 aa, Staphylococcus aureus
TRNHYKNSFKNKEGY

SEQ ID NO: 1614049 - protein, 9 aa, Staphylococcus aureus
TTADNATQA

SEQ ID NO: 1614050 - protein, 14 aa, Staphylococcus aureus
TTDYEKQEQEVPGL

SEQ ID NO: 1614051 - protein, 9 aa, Staphylococcus aureus
TTEDKDVEI

SEQ ID NO: 1614052 - protein, 8 aa, Staphylococcus aureus
TVDKESLQ

SEQ ID NO: 1614053 - protein, 7 aa, Staphylococcus aureus
TYSPTTK

SEQ ID NO: 1614054 - protein, 7 aa, Staphylococcus aureus
VAKIDKD

SEQ ID NO: 1614055 - protein, 6 aa, Staphylococcus aureus
VDKGES

SEQ ID NO: 1614056 - protein, 11 aa, Staphylococcus aureus
VELNTPKSVEI

SEQ ID NO: 1614057 - protein, 4 aa, Staphylococcus aureus
VEPQ

SEQ ID NO: 1614058 - protein, 9 aa, Staphylococcus aureus
VGANSEQLS

SEQ ID NO: 1614059 - protein, 8 aa, Staphylococcus aureus
VGGKQTYS

SEQ ID NO: 1614060 - protein, 30 aa, Staphylococcus aureus
VKEDAEDETNEDEQSTSTVSEDGTEQQREA

SEQ ID NO: 1614061 - protein, 5 aa, Staphylococcus aureus
VNYKE

SEQ ID NO: 1614062 - protein, 19 aa, Staphylococcus aureus
VQQRLSKGSLAKAQQYSKA

SEQ ID NO: 1614063 - protein, 4 aa, Staphylococcus aureus
VTGV

SEQ ID NO: 1614064 - protein, 8 aa, Staphylococcus aureus
YDEDEANY

SEQ ID NO: 1614065 - protein, 7 aa, Staphylococcus aureus
YEPQTID

SEQ ID NO: 1614066 - protein, 9 aa, Staphylococcus aureus
YGSRAVKPP

SEQ ID NO: 1614067 - protein, 7 aa, Staphylococcus aureus
YKKEDFA

SEQ ID NO: 1614068 - protein, 9 aa, Staphylococcus aureus
YKPSSKQSL

SEQ ID NO: 1614069 - protein, 8 aa, Staphylococcus aureus
YNSSNSPI

SEQ ID NO: 1614070 - protein, 8 aa, Staphylococcus aureus
YRQETKYK

SEQ ID NO: 1614071 - protein, 10 aa, Staphylococcus aureus
YSSGPNHQLP

SEQ ID NO: 1614072 - protein, 8 aa, Staphylococcus aureus
AASGAVGS

SEQ ID NO: 1614073 - protein, 5 aa, Staphylococcus aureus
AEAVS

SEQ ID NO: 1614074 - protein, 6 aa, Staphylococcus aureus
AEGEQL

SEQ ID NO: 1614075 - protein, 7 aa, Staphylococcus aureus
AELQGRV

SEQ ID NO: 1614076 - protein, 9 aa, Staphylococcus aureus
AFKEEDLEP

SEQ ID NO: 1614077 - protein, 13 aa, Staphylococcus aureus
AGTIGRSTSARKY

SEQ ID NO: 1614078 - protein, 9 aa, Staphylococcus aureus
AGTTDSVIP

SEQ ID NO: 1614079 - protein, 5 aa, Staphylococcus aureus
AITSS

SEQ ID NO: 1614080 - protein, 6 aa, Staphylococcus aureus
AKAQQY

SEQ ID NO: 1614081 - protein, 11 aa, Staphylococcus aureus
AKDYRQGLQDQ

SEQ ID NO: 1614082 - protein, 16 aa, Staphylococcus aureus
AKEYYQSKGYKKEANV

SEQ ID NO: 1614083 - protein, 24 aa, Staphylococcus aureus
APAASKEELAGLEGRNFDNQSDEK

SEQ ID NO: 1614084 - protein, 19 aa, Staphylococcus aureus
ATLPNEDVVESDPSTTKAY

SEQ ID NO: 1614085 - protein, 4 aa, Staphylococcus aureus
CNTK

SEQ ID NO: 1614086 - protein, 20 aa, Staphylococcus aureus
DAADSAPSFGDRKTYQMDPA

SEQ ID NO: 1614087 - protein, 6 aa, Staphylococcus aureus
DAGATE

SEQ ID NO: 1614088 - protein, 8 aa, Staphylococcus aureus
DDKGEIEG

SEQ ID NO: 1614089 - protein, 7 aa, Staphylococcus aureus
DDKQTMS

SEQ ID NO: 1614090 - protein, 12 aa, Staphylococcus aureus
DDVDPRHTTGQY

SEQ ID NO: 1614091 - protein, 5 aa, Staphylococcus aureus
DESLA

SEQ ID NO: 1614092 - protein, 12 aa, Staphylococcus aureus
DGEKQQLNAGTS

SEQ ID NO: 1614093 - protein, 10 aa, Staphylococcus aureus
DGKGEIPRED

SEQ ID NO: 1614094 - protein, 5 aa, Staphylococcus aureus
DGVSE

SEQ ID NO: 1614095 - protein, 21 aa, Staphylococcus aureus
DINTKEDFKATIERSDSCAVP

SEQ ID NO: 1614096 - protein, 7 aa, Staphylococcus aureus
DKDKEEV

SEQ ID NO: 1614097 - protein, 4 aa, Staphylococcus aureus
DKMD

SEQ ID NO: 1614098 - protein, 7 aa, Staphylococcus aureus
DKQGRID

SEQ ID NO: 1614099 - protein, 9 aa, Staphylococcus aureus
DKQITKRTA

SEQ ID NO: 1614100 - protein, 9 aa, Staphylococcus aureus
DNDGHGTME

SEQ ID NO: 1614101 - protein, 14 aa, Staphylococcus aureus
DNIKGNGQTPEPYT

SEQ ID NO: 1614102 - protein, 7 aa, Staphylococcus aureus
DQKLDEA

SEQ ID NO: 1614103 - protein, 5 aa, Staphylococcus aureus
DQYSE

SEQ ID NO: 1614104 - protein, 6 aa, Staphylococcus aureus
DSIDDL

SEQ ID NO: 1614105 - protein, 8 aa, Staphylococcus aureus
DVTNDEIS

SEQ ID NO: 1614106 - protein, 17 aa, Staphylococcus aureus
DYDEDGVYEEKQGKQNN

SEQ ID NO: 1614107 - protein, 12 aa, Staphylococcus aureus
EAINKTQNVGYQ

SEQ ID NO: 1614108 - protein, 11 aa, Staphylococcus aureus
EAKDEGIDSNE

SEQ ID NO: 1614109 - protein, 9 aa, Staphylococcus aureus
EDGQQTDVP

SEQ ID NO: 1614110 - protein, 12 aa, Staphylococcus aureus
EDWITDKKKELN

SEQ ID NO: 1614111 - protein, 11 aa, Staphylococcus aureus
EETISKDHPAY

SEQ ID NO: 1614112 - protein, 10 aa, Staphylococcus aureus
EHLTTDEQEI

SEQ ID NO: 1614113 - protein, 21 aa, Staphylococcus aureus
EHTEEDIKQTLKAADYAFSQM

SEQ ID NO: 1614114 - protein, 8 aa, Staphylococcus aureus
EKTPDKLK

SEQ ID NO: 1614115 - protein, 10 aa, Staphylococcus aureus
ELADKSEADM

SEQ ID NO: 1614116 - protein, 9 aa, Staphylococcus aureus
ELRGQKLGR

SEQ ID NO: 1614117 - protein, 9 aa, Staphylococcus aureus
ENEPEINQE

SEQ ID NO: 1614118 - protein, 13 aa, Staphylococcus aureus
ENQYNDRDEQLEH

SEQ ID NO: 1614119 - protein, 6 aa, Staphylococcus aureus
EPTSTM

SEQ ID NO: 1614120 - protein, 6 aa, Staphylococcus aureus
EPYTED

SEQ ID NO: 1614121 - protein, 6 aa, Staphylococcus aureus
EQKDIV

SEQ ID NO: 1614122 - protein, 13 aa, Staphylococcus aureus
EQLYDDKEAREAL

SEQ ID NO: 1614123 - protein, 11 aa, Staphylococcus aureus
EQSAKSLRGSK

SEQ ID NO: 1614124 - protein, 4 aa, Staphylococcus aureus
ESEI

SEQ ID NO: 1614125 - protein, 7 aa, Staphylococcus aureus
ESLENTP

SEQ ID NO: 1614126 - protein, 7 aa, Staphylococcus aureus
ESYQITE

SEQ ID NO: 1614127 - protein, 11 aa, Staphylococcus aureus
ETKSVPEEMEA

SEQ ID NO: 1614128 - protein, 8 aa, Staphylococcus aureus
EVTRVGRG

SEQ ID NO: 1614129 - protein, 6 aa, Staphylococcus aureus
EYAGEM

SEQ ID NO: 1614130 - protein, 10 aa, Staphylococcus aureus
EYVESETYKK

SEQ ID NO: 1614131 - protein, 10 aa, Staphylococcus aureus
FGEPSKEAQE

SEQ ID NO: 1614132 - protein, 6 aa, Staphylococcus aureus
FNDREN

SEQ ID NO: 1614133 - protein, 8 aa, Staphylococcus aureus
FQQQNARA

SEQ ID NO: 1614134 - protein, 10 aa, Staphylococcus aureus
FSPEEAATRE

SEQ ID NO: 1614135 - protein, 17 aa, Staphylococcus aureus
GADGPTGTFINGDGEMP

SEQ ID NO: 1614136 - protein, 8 aa, Staphylococcus aureus
GAMAKHTD

SEQ ID NO: 1614137 - protein, 21 aa, Staphylococcus aureus
GAQALPELTPDGDVVAPSPIS

SEQ ID NO: 1614138 - protein, 18 aa, Staphylococcus aureus
GDLSENSEYDAAKDEQGF

SEQ ID NO: 1614139 - protein, 5 aa, Staphylococcus aureus
GDTAG

SEQ ID NO: 1614140 - protein, 9 aa, Staphylococcus aureus
GEKAPKDMA

SEQ ID NO: 1614141 - protein, 8 aa, Staphylococcus aureus
GEPDPKLK

SEQ ID NO: 1614142 - protein, 9 aa, Staphylococcus aureus
GESGSGKST

SEQ ID NO: 1614143 - protein, 5 aa, Staphylococcus aureus
GEVGQ

SEQ ID NO: 1614144 - protein, 4 aa, Staphylococcus aureus
GFNE

SEQ ID NO: 1614145 - protein, 9 aa, Staphylococcus aureus
GKNFGQGMS

SEQ ID NO: 1614146 - protein, 4 aa, Staphylococcus aureus
GKPI

SEQ ID NO: 1614147 - protein, 6 aa, Staphylococcus aureus
GKTINN

SEQ ID NO: 1614148 - protein, 4 aa, Staphylococcus aureus
GNYD

SEQ ID NO: 1614149 - protein, 18 aa, Staphylococcus aureus
GPILNPDTKYDSHGVYSG

SEQ ID NO: 1614150 - protein, 11 aa, Staphylococcus aureus
GPVPPNPSELI

SEQ ID NO: 1614151 - protein, 22 aa, Staphylococcus aureus
GQDDKADNLYQATDADEKKLKA

SEQ ID NO: 1614152 - protein, 14 aa, Staphylococcus aureus
GSAPDIAGKNVANP

SEQ ID NO: 1614153 - protein, 8 aa, Staphylococcus aureus
GSYGTGKS

SEQ ID NO: 1614154 - protein, 7 aa, Staphylococcus aureus
GTGGLGG

SEQ ID NO: 1614155 - protein, 10 aa, Staphylococcus aureus
GVGIGTNPDE

SEQ ID NO: 1614156 - protein, 12 aa, Staphylococcus aureus
GWQEGDDSILQQ

SEQ ID NO: 1614157 - protein, 7 aa, Staphylococcus aureus
HDSEYRF

SEQ ID NO: 1614158 - protein, 15 aa, Staphylococcus aureus
HGHGKEDIQLQDSDV

SEQ ID NO: 1614159 - protein, 11 aa, Staphylococcus aureus
HKFDDKQASMT

SEQ ID NO: 1614160 - protein, 4 aa, Staphylococcus aureus
HQGY

SEQ ID NO: 1614161 - protein, 12 aa, Staphylococcus aureus
HVADKEQGHSCG

SEQ ID NO: 1614162 - protein, 4 aa, Staphylococcus aureus
IDPL

SEQ ID NO: 1614163 - protein, 4 aa, Staphylococcus aureus
IEAC

SEQ ID NO: 1614164 - protein, 4 aa, Staphylococcus aureus
IGHG

SEQ ID NO: 1614165 - protein, 10 aa, Staphylococcus aureus
IKEDGDSDLT

SEQ ID NO: 1614166 - protein, 5 aa, Staphylococcus aureus
IKSMG

SEQ ID NO: 1614167 - protein, 8 aa, Staphylococcus aureus
INQNDNYS

SEQ ID NO: 1614168 - protein, 14 aa, Staphylococcus aureus
INRNDDKDNQDASH

SEQ ID NO: 1614169 - protein, 16 aa, Staphylococcus aureus
IPTSSFTPEESPDPGF

SEQ ID NO: 1614170 - protein, 8 aa, Staphylococcus aureus
ISANQESE

SEQ ID NO: 1614171 - protein, 5 aa, Staphylococcus aureus
ISDNL

SEQ ID NO: 1614172 - protein, 6 aa, Staphylococcus aureus
ITSAST

SEQ ID NO: 1614173 - protein, 12 aa, Staphylococcus aureus
IVTEEKDDNHGA

SEQ ID NO: 1614174 - protein, 18 aa, Staphylococcus aureus
KAANPKHGVKTKELAGKV

SEQ ID NO: 1614175 - protein, 8 aa, Staphylococcus aureus
KEAEFKGF

SEQ ID NO: 1614176 - protein, 20 aa, Staphylococcus aureus
KENKKLQNQIQKLYGDLYNK

SEQ ID NO: 1614177 - protein, 5 aa, Staphylococcus aureus
KETGV

SEQ ID NO: 1614178 - protein, 5 aa, Staphylococcus aureus
KGAQS

SEQ ID NO: 1614179 - protein, 7 aa, Staphylococcus aureus
KGDKERI

SEQ ID NO: 1614180 - protein, 4 aa, Staphylococcus aureus
KGKV

SEQ ID NO: 1614181 - protein, 14 aa, Staphylococcus aureus
KGNVEEPEHDGSAE

SEQ ID NO: 1614182 - protein, 19 aa, Staphylococcus aureus
KGYQQYKDDSQIRNPTSAS

SEQ ID NO: 1614183 - protein, 15 aa, Staphylococcus aureus
KHNQVDDYPYGGGQG

SEQ ID NO: 1614184 - protein, 9 aa, Staphylococcus aureus
KKDAPVLNG

SEQ ID NO: 1614185 - protein, 4 aa, Staphylococcus aureus
KKEK

SEQ ID NO: 1614186 - protein, 11 aa, Staphylococcus aureus
KKLKTRDASAA

SEQ ID NO: 1614187 - protein, 5 aa, Staphylococcus aureus
KKQGI

SEQ ID NO: 1614188 - protein, 5 aa, Staphylococcus aureus
KKQQI

SEQ ID NO: 1614189 - protein, 8 aa, Staphylococcus aureus
KKSLVGNQ

SEQ ID NO: 1614190 - protein, 16 aa, Staphylococcus aureus
KKWERSDYVFPGNQVD

SEQ ID NO: 1614191 - protein, 13 aa, Staphylococcus aureus
KLDERKKLTKTLK

SEQ ID NO: 1614192 - protein, 16 aa, Staphylococcus aureus
KLGETLSKDLYGKEIN

SEQ ID NO: 1614193 - protein, 4 aa, Staphylococcus aureus
KLRD

SEQ ID NO: 1614194 - protein, 5 aa, Staphylococcus aureus
KNGSS

SEQ ID NO: 1614195 - protein, 6 aa, Staphylococcus aureus
KNKQYF

SEQ ID NO: 1614196 - protein, 8 aa, Staphylococcus aureus
KQKKKEYH

SEQ ID NO: 1614197 - protein, 9 aa, Staphylococcus aureus
KRMAEEKGL

SEQ ID NO: 1614198 - protein, 10 aa, Staphylococcus aureus
KSEAAAKALN

SEQ ID NO: 1614199 - protein, 19 aa, Staphylococcus aureus
KSLSKKGFINKSRNEADER

SEQ ID NO: 1614200 - protein, 5 aa, Staphylococcus aureus
KSYDK

SEQ ID NO: 1614201 - protein, 56 aa, Staphylococcus aureus
KTNKKDTHENEVESTDEEIYQSEDNHQEHKQNHEHVQDKDKDKEESKFKKLMKSLF

SEQ ID NO: 1614202 - protein, 8 aa, Staphylococcus aureus
KYGGGAGH

SEQ ID NO: 1614203 - protein, 8 aa, Staphylococcus aureus
LEKYPNQN

SEQ ID NO: 1614204 - protein, 23 aa, Staphylococcus aureus
LENEEEDNPTIGDMIGDKLKNLK

SEQ ID NO: 1614205 - protein, 7 aa, Staphylococcus aureus
LGITRKK

SEQ ID NO: 1614206 - protein, 5 aa, Staphylococcus aureus
LKGGQ

SEQ ID NO: 1614207 - protein, 40 aa, Staphylococcus aureus
LKRTDASQVDGQDDTSEDDDNESEKADSKSADSESKGGAY

SEQ ID NO: 1614208 - protein, 7 aa, Staphylococcus aureus
LKTRSYQ

SEQ ID NO: 1614209 - protein, 11 aa, Staphylococcus aureus
LNTDSDKYLRP

SEQ ID NO: 1614210 - protein, 11 aa, Staphylococcus aureus
LQDELKSQGVR

SEQ ID NO: 1614211 - protein, 8 aa, Staphylococcus aureus
LSNKDISD

SEQ ID NO: 1614212 - protein, 23 aa, Staphylococcus aureus
LSQYTAPKTDFDGVEHKGAYKDG

SEQ ID NO: 1614213 - protein, 13 aa, Staphylococcus aureus
LTEAQDALSTPSN

SEQ ID NO: 1614214 - protein, 10 aa, Staphylococcus aureus
LTGPSKGGHV

SEQ ID NO: 1614215 - protein, 7 aa, Staphylococcus aureus
LTSSEAS

SEQ ID NO: 1614216 - protein, 5 aa, Staphylococcus aureus
MDPEQ

SEQ ID NO: 1614217 - protein, 9 aa, Staphylococcus aureus
NADNAYSSD

SEQ ID NO: 1614218 - protein, 7 aa, Staphylococcus aureus
NAGNPDI

SEQ ID NO: 1614219 - protein, 8 aa, Staphylococcus aureus
NAIETEEL

SEQ ID NO: 1614220 - protein, 4 aa, Staphylococcus aureus
NARE

SEQ ID NO: 1614221 - protein, 7 aa, Staphylococcus aureus
NDEYRSV

SEQ ID NO: 1614222 - protein, 5 aa, Staphylococcus aureus
NDKNE

SEQ ID NO: 1614223 - protein, 20 aa, Staphylococcus aureus
NEISEAQDTYKSLKSKQKEL

SEQ ID NO: 1614224 - protein, 9 aa, Staphylococcus aureus
NESRVLTGG

SEQ ID NO: 1614225 - protein, 4 aa, Staphylococcus aureus
NFHG

SEQ ID NO: 1614226 - protein, 9 aa, Staphylococcus aureus
NGASEAIDT

SEQ ID NO: 1614227 - protein, 10 aa, Staphylococcus aureus
NGESATQDIE

SEQ ID NO: 1614228 - protein, 6 aa, Staphylococcus aureus
NGGPVG

SEQ ID NO: 1614229 - protein, 5 aa, Staphylococcus aureus
NGINN

SEQ ID NO: 1614230 - protein, 5 aa, Staphylococcus aureus
NKERD

SEQ ID NO: 1614231 - protein, 11 aa, Staphylococcus aureus
NLNRAEDRKEF

SEQ ID NO: 1614232 - protein, 5 aa, Staphylococcus aureus
NNEKA

SEQ ID NO: 1614233 - protein, 4 aa, Staphylococcus aureus
NPEA

SEQ ID NO: 1614234 - protein, 4 aa, Staphylococcus aureus
NPFN

SEQ ID NO: 1614235 - protein, 7 aa, Staphylococcus aureus
NPLTPKE

SEQ ID NO: 1614236 - protein, 15 aa, Staphylococcus aureus
NQFKPKEENKPKTIE

SEQ ID NO: 1614237 - protein, 6 aa, Staphylococcus aureus
NQKALE

SEQ ID NO: 1614238 - protein, 6 aa, Staphylococcus aureus
NQSNRH

SEQ ID NO: 1614239 - protein, 9 aa, Staphylococcus aureus
NQSSKESNV

SEQ ID NO: 1614240 - protein, 6 aa, Staphylococcus aureus
NTPTEQ

SEQ ID NO: 1614241 - protein, 5 aa, Staphylococcus aureus
PDKKV

SEQ ID NO: 1614242 - protein, 4 aa, Staphylococcus aureus
PKLK

SEQ ID NO: 1614243 - protein, 8 aa, Staphylococcus aureus
PKPKGARD

SEQ ID NO: 1614244 - protein, 6 aa, Staphylococcus aureus
PLTRTP

SEQ ID NO: 1614245 - protein, 4 aa, Staphylococcus aureus
PNTA

SEQ ID NO: 1614246 - protein, 5 aa, Staphylococcus aureus
PSEAY

SEQ ID NO: 1614247 - protein, 7 aa, Staphylococcus aureus
PTDVTSN

SEQ ID NO: 1614248 - protein, 5 aa, Staphylococcus aureus
PTEPN

SEQ ID NO: 1614249 - protein, 9 aa, Staphylococcus aureus
PTQELREQG

SEQ ID NO: 1614250 - protein, 20 aa, Staphylococcus aureus
QCPMSGTTIRRKDTDKNKLG

SEQ ID NO: 1614251 - protein, 4 aa, Staphylococcus aureus
QEDI

SEQ ID NO: 1614252 - protein, 12 aa, Staphylococcus aureus
QENKENQQCAEE

SEQ ID NO: 1614253 - protein, 14 aa, Staphylococcus aureus
QESIKQTNQQLEES

SEQ ID NO: 1614254 - protein, 7 aa, Staphylococcus aureus
QHFNSKD

SEQ ID NO: 1614255 - protein, 16 aa, Staphylococcus aureus
QLGGEQELKRRAGTEN

SEQ ID NO: 1614256 - protein, 4 aa, Staphylococcus aureus
QNRK

SEQ ID NO: 1614257 - protein, 45 aa, Staphylococcus aureus
QQLTAELSGVEEALEESPNSKKNKTKRTQLEQQLNSNKRKIDNTI

SEQ ID NO: 1614258 - protein, 8 aa, Staphylococcus aureus
QSAMKGKY

SEQ ID NO: 1614259 - protein, 6 aa, Staphylococcus aureus
QTFENE

SEQ ID NO: 1614260 - protein, 18 aa, Staphylococcus aureus
QTLNNEGKTVEIMDGIDS

SEQ ID NO: 1614261 - protein, 12 aa, Staphylococcus aureus
RARGEAIKGIKG

SEQ ID NO: 1614262 - protein, 10 aa, Staphylococcus aureus
RDNPKLKGKP

SEQ ID NO: 1614263 - protein, 12 aa, Staphylococcus aureus
REDRKLSEDTYK

SEQ ID NO: 1614264 - protein, 5 aa, Staphylococcus aureus
RETGE

SEQ ID NO: 1614265 - protein, 7 aa, Staphylococcus aureus
RKAEDKK

SEQ ID NO: 1614266 - protein, 8 aa, Staphylococcus aureus
RKDKDGKL

SEQ ID NO: 1614267 - protein, 21 aa, Staphylococcus aureus
RKGGAYESKLETDPKRKIDDK

SEQ ID NO: 1614268 - protein, 17 aa, Staphylococcus aureus
RKQGGRHKGPPPFTKQD

SEQ ID NO: 1614269 - protein, 8 aa, Staphylococcus aureus
RKSDEPIA

SEQ ID NO: 1614270 - protein, 7 aa, Staphylococcus aureus
RLARNTS

SEQ ID NO: 1614271 - protein, 6 aa, Staphylococcus aureus
RRDGNR

SEQ ID NO: 1614272 - protein, 10 aa, Staphylococcus aureus
RRNIQDTEDL

SEQ ID NO: 1614273 - protein, 13 aa, Staphylococcus aureus
RYATGGDTTIEAG

SEQ ID NO: 1614274 - protein, 10 aa, Staphylococcus aureus
SDEYKGPDMT

SEQ ID NO: 1614275 - protein, 10 aa, Staphylococcus aureus
SDIDEDKLEQ

SEQ ID NO: 1614276 - protein, 4 aa, Staphylococcus aureus
SDSA

SEQ ID NO: 1614277 - protein, 4 aa, Staphylococcus aureus
SELS

SEQ ID NO: 1614278 - protein, 14 aa, Staphylococcus aureus
SGLSKKKQKQIAEQ

SEQ ID NO: 1614279 - protein, 10 aa, Staphylococcus aureus
SGTDDYVTKP

SEQ ID NO: 1614280 - protein, 4 aa, Staphylococcus aureus
SHDE

SEQ ID NO: 1614281 - protein, 9 aa, Staphylococcus aureus
SIDSTQLAA

SEQ ID NO: 1614282 - protein, 7 aa, Staphylococcus aureus
SKERNKG

SEQ ID NO: 1614283 - protein, 7 aa, Staphylococcus aureus
SKYGPDL

SEQ ID NO: 1614284 - protein, 11 aa, Staphylococcus aureus
SLKKYQPTHVE

SEQ ID NO: 1614285 - protein, 11 aa, Staphylococcus aureus
SLSKEKVGTFD

SEQ ID NO: 1614286 - protein, 26 aa, Staphylococcus aureus
SLTKDKELLDSDKLKDEYELKKGKMN

SEQ ID NO: 1614287 - protein, 12 aa, Staphylococcus aureus
SNQRYTNKETLE

SEQ ID NO: 1614288 - protein, 4 aa, Staphylococcus aureus
SNTK

SEQ ID NO: 1614289 - protein, 4 aa, Staphylococcus aureus
SNYQ

SEQ ID NO: 1614290 - protein, 8 aa, Staphylococcus aureus
SPTLNSPY

SEQ ID NO: 1614291 - protein, 5 aa, Staphylococcus aureus
STIAD

SEQ ID NO: 1614292 - protein, 6 aa, Staphylococcus aureus
STNAFE

SEQ ID NO: 1614293 - protein, 13 aa, Staphylococcus aureus
SYTDPKTGTTTSA

SEQ ID NO: 1614294 - protein, 4 aa, Staphylococcus aureus
TASE

SEQ ID NO: 1614295 - protein, 7 aa, Staphylococcus aureus
TDKVPGL

SEQ ID NO: 1614296 - protein, 4 aa, Staphylococcus aureus
TGEP

SEQ ID NO: 1614297 - protein, 6 aa, Staphylococcus aureus
TGETSG

SEQ ID NO: 1614298 - protein, 7 aa, Staphylococcus aureus
TGGQHRS

SEQ ID NO: 1614299 - protein, 5 aa, Staphylococcus aureus
TGTDS

SEQ ID NO: 1614300 - protein, 6 aa, Staphylococcus aureus
TGTLTV

SEQ ID NO: 1614301 - protein, 10 aa, Staphylococcus aureus
TPPQPNGVSQ

SEQ ID NO: 1614302 - protein, 6 aa, Staphylococcus aureus
TRPETM

SEQ ID NO: 1614303 - protein, 5 aa, Staphylococcus aureus
TSDNN

SEQ ID NO: 1614304 - protein, 5 aa, Staphylococcus aureus
TSGKE

SEQ ID NO: 1614305 - protein, 7 aa, Staphylococcus aureus
TSKFNDD

SEQ ID NO: 1614306 - protein, 6 aa, Staphylococcus aureus
TSKIID

SEQ ID NO: 1614307 - protein, 8 aa, Staphylococcus aureus
TSTKDLSD

SEQ ID NO: 1614308 - protein, 4 aa, Staphylococcus aureus
TSYD

SEQ ID NO: 1614309 - protein, 6 aa, Staphylococcus aureus
VAHARG

SEQ ID NO: 1614310 - protein, 15 aa, Staphylococcus aureus
VEETTDTLSQKDFEQ

SEQ ID NO: 1614311 - protein, 12 aa, Staphylococcus aureus
VGISEDALEPYG

SEQ ID NO: 1614312 - protein, 13 aa, Staphylococcus aureus
VGQGFQPPAEKDA

SEQ ID NO: 1614313 - protein, 13 aa, Staphylococcus aureus
VGSDDAGDRIASN

SEQ ID NO: 1614314 - protein, 6 aa, Staphylococcus aureus
VKDPRV

SEQ ID NO: 1614315 - protein, 6 aa, Staphylococcus aureus
VKSSQN

SEQ ID NO: 1614316 - protein, 4 aa, Staphylococcus aureus
VLQP

SEQ ID NO: 1614317 - protein, 7 aa, Staphylococcus aureus
VNDDSDM

SEQ ID NO: 1614318 - protein, 6 aa, Staphylococcus aureus
VTTEDV

SEQ ID NO: 1614319 - protein, 6 aa, Staphylococcus aureus
YSAKGT

SEQ ID NO: 1614320 - protein, 19 aa, Staphylococcus aureus
YSSEKAAHSMENGYSSAAT

SEQ ID NO: 1614321 - protein, 6 aa, Staphylococcus aureus
ADKKYK

SEQ ID NO: 1614322 - protein, 19 aa, Staphylococcus aureus
ADKVTEDASFKDDLGADSL

SEQ ID NO: 1614323 - protein, 4 aa, Staphylococcus aureus
AESN

SEQ ID NO: 1614324 - protein, 13 aa, Staphylococcus aureus
AGFGNGNDAEEKD

SEQ ID NO: 1614325 - protein, 14 aa, Staphylococcus aureus
AQLSKEQKGQISHR

SEQ ID NO: 1614326 - protein, 7 aa, Staphylococcus aureus
ASGRFGV

SEQ ID NO: 1614327 - protein, 4 aa, Staphylococcus aureus
ASKY

SEQ ID NO: 1614328 - protein, 17 aa, Staphylococcus aureus
ASPSLEKDGTFTNTERR

SEQ ID NO: 1614329 - protein, 4 aa, Staphylococcus aureus
CSAG

SEQ ID NO: 1614330 - protein, 5 aa, Staphylococcus aureus
DEKPI

SEQ ID NO: 1614331 - protein, 8 aa, Staphylococcus aureus
DGFENAPH

SEQ ID NO: 1614332 - protein, 5 aa, Staphylococcus aureus
DGTYS

SEQ ID NO: 1614333 - protein, 4 aa, Staphylococcus aureus
DHKQ

SEQ ID NO: 1614334 - protein, 6 aa, Staphylococcus aureus
DHVEAG

SEQ ID NO: 1614335 - protein, 5 aa, Staphylococcus aureus
DKAFT

SEQ ID NO: 1614336 - protein, 8 aa, Staphylococcus aureus
DKTKQAEV

SEQ ID NO: 1614337 - protein, 14 aa, Staphylococcus aureus
DNDLPSETLNDETI

SEQ ID NO: 1614338 - protein, 16 aa, Staphylococcus aureus
DNSYAYEHENGQYGKS

SEQ ID NO: 1614339 - protein, 10 aa, Staphylococcus aureus
DNTGKSPNTI

SEQ ID NO: 1614340 - protein, 8 aa, Staphylococcus aureus
DQPSRTTI

SEQ ID NO: 1614341 - protein, 8 aa, Staphylococcus aureus
DRTPYDSD

SEQ ID NO: 1614342 - protein, 8 aa, Staphylococcus aureus
DSAPESMN

SEQ ID NO: 1614343 - protein, 22 aa, Staphylococcus aureus
DVTAYTNEEDGAAKYLAKHFLA

SEQ ID NO: 1614344 - protein, 6 aa, Staphylococcus aureus
DWSRNQ

SEQ ID NO: 1614345 - protein, 13 aa, Staphylococcus aureus
EAGMTKQQSSTRA

SEQ ID NO: 1614346 - protein, 7 aa, Staphylococcus aureus
EANEKGI

SEQ ID NO: 1614347 - protein, 7 aa, Staphylococcus aureus
EDDNNNL

SEQ ID NO: 1614348 - protein, 7 aa, Staphylococcus aureus
EDENTAS

SEQ ID NO: 1614349 - protein, 21 aa, Staphylococcus aureus
EEAKEKANQKIKAATKEADDI

SEQ ID NO: 1614350 - protein, 4 aa, Staphylococcus aureus
EEYE

SEQ ID NO: 1614351 - protein, 5 aa, Staphylococcus aureus
EKATS

SEQ ID NO: 1614352 - protein, 20 aa, Staphylococcus aureus
ELRDGDKSRYLGKGVTKAVE

SEQ ID NO: 1614353 - protein, 9 aa, Staphylococcus aureus
EQAKSDNVN

SEQ ID NO: 1614354 - protein, 9 aa, Staphylococcus aureus
EQEKQQAMR

SEQ ID NO: 1614355 - protein, 4 aa, Staphylococcus aureus
EQKA

SEQ ID NO: 1614356 - protein, 9 aa, Staphylococcus aureus
ESETTLPDL

SEQ ID NO: 1614357 - protein, 4 aa, Staphylococcus aureus
EYAN

SEQ ID NO: 1614358 - protein, 9 aa, Staphylococcus aureus
FDEEQDAVH

SEQ ID NO: 1614359 - protein, 10 aa, Staphylococcus aureus
FEPKEQEPEF

SEQ ID NO: 1614360 - protein, 11 aa, Staphylococcus aureus
FTIDEDDQHLR

SEQ ID NO: 1614361 - protein, 8 aa, Staphylococcus aureus
GEGLSETK

SEQ ID NO: 1614362 - protein, 8 aa, Staphylococcus aureus
GEVKYDEA

SEQ ID NO: 1614363 - protein, 8 aa, Staphylococcus aureus
GGDSAIGR

SEQ ID NO: 1614364 - protein, 5 aa, Staphylococcus aureus
GGGTI

SEQ ID NO: 1614365 - protein, 8 aa, Staphylococcus aureus
GGGTPTAL

SEQ ID NO: 1614366 - protein, 5 aa, Staphylococcus aureus
GIEDN

SEQ ID NO: 1614367 - protein, 9 aa, Staphylococcus aureus
GKPLFTSEE

SEQ ID NO: 1614368 - protein, 10 aa, Staphylococcus aureus
GMQKSITQLG

SEQ ID NO: 1614369 - protein, 5 aa, Staphylococcus aureus
GPAEE

SEQ ID NO: 1614370 - protein, 7 aa, Staphylococcus aureus
GPGNNRH

SEQ ID NO: 1614371 - protein, 9 aa, Staphylococcus aureus
HARRKMTEK

SEQ ID NO: 1614372 - protein, 9 aa, Staphylococcus aureus
HEPATDSPL

SEQ ID NO: 1614373 - protein, 9 aa, Staphylococcus aureus
HGLAEETRF

SEQ ID NO: 1614374 - protein, 21 aa, Staphylococcus aureus
HTQSEDSRCGAGHDRKIRAEQ

SEQ ID NO: 1614375 - protein, 10 aa, Staphylococcus aureus
IANTTPSDLL

SEQ ID NO: 1614376 - protein, 10 aa, Staphylococcus aureus
IEIEESKGIS

SEQ ID NO: 1614377 - protein, 5 aa, Staphylococcus aureus
IESPG

SEQ ID NO: 1614378 - protein, 6 aa, Staphylococcus aureus
IETDDS

SEQ ID NO: 1614379 - protein, 8 aa, Staphylococcus aureus
IEYTTPTG

SEQ ID NO: 1614380 - protein, 4 aa, Staphylococcus aureus
ILGH

SEQ ID NO: 1614381 - protein, 4 aa, Staphylococcus aureus
INEE

SEQ ID NO: 1614382 - protein, 6 aa, Staphylococcus aureus
IPEDEN

SEQ ID NO: 1614383 - protein, 10 aa, Staphylococcus aureus
IQYDPNRSAN

SEQ ID NO: 1614384 - protein, 13 aa, Staphylococcus aureus
ISAVQGEKPQFVV

SEQ ID NO: 1614385 - protein, 11 aa, Staphylococcus aureus
IYPTPSKHDAH

SEQ ID NO: 1614386 - protein, 6 aa, Staphylococcus aureus
KAIQGN

SEQ ID NO: 1614387 - protein, 6 aa, Staphylococcus aureus
KDLKDK

SEQ ID NO: 1614388 - protein, 5 aa, Staphylococcus aureus
KDSKD

SEQ ID NO: 1614389 - protein, 6 aa, Staphylococcus aureus
KEANVS

SEQ ID NO: 1614390 - protein, 5 aa, Staphylococcus aureus
KEDVD

SEQ ID NO: 1614391 - protein, 16 aa, Staphylococcus aureus
KEERNPLYTSSYGTGE

SEQ ID NO: 1614392 - protein, 7 aa, Staphylococcus aureus
KEKEQIS

SEQ ID NO: 1614393 - protein, 8 aa, Staphylococcus aureus
KEPHIEAN

SEQ ID NO: 1614394 - protein, 5 aa, Staphylococcus aureus
KEQGF

SEQ ID NO: 1614395 - protein, 12 aa, Staphylococcus aureus
KERQLSTIGSSV

SEQ ID NO: 1614396 - protein, 4 aa, Staphylococcus aureus
KGKG

SEQ ID NO: 1614397 - protein, 5 aa, Staphylococcus aureus
KGYPY

SEQ ID NO: 1614398 - protein, 7 aa, Staphylococcus aureus
KKNQKEK

SEQ ID NO: 1614399 - protein, 10 aa, Staphylococcus aureus
KKQGKMDRRT

SEQ ID NO: 1614400 - protein, 16 aa, Staphylococcus aureus
KLRTTKEEFNATNRTL

SEQ ID NO: 1614401 - protein, 11 aa, Staphylococcus aureus
KLTEDQDEPDY

SEQ ID NO: 1614402 - protein, 7 aa, Staphylococcus aureus
KNQPTKG

SEQ ID NO: 1614403 - protein, 9 aa, Staphylococcus aureus
KRTTTYDVE

SEQ ID NO: 1614404 - protein, 6 aa, Staphylococcus aureus
KSKSEK

SEQ ID NO: 1614405 - protein, 11 aa, Staphylococcus aureus
KSSKLKEAGIR

SEQ ID NO: 1614406 - protein, 5 aa, Staphylococcus aureus
KTRRD

SEQ ID NO: 1614407 - protein, 6 aa, Staphylococcus aureus
KYQGTY

SEQ ID NO: 1614408 - protein, 22 aa, Staphylococcus aureus
LGKEMEQISDQNDQEKNSEEDS

SEQ ID NO: 1614409 - protein, 8 aa, Staphylococcus aureus
LKENGKIK

SEQ ID NO: 1614410 - protein, 5 aa, Staphylococcus aureus
LPTLP

SEQ ID NO: 1614411 - protein, 5 aa, Staphylococcus aureus
LSGLG

SEQ ID NO: 1614412 - protein, 5 aa, Staphylococcus aureus
LSSQI

SEQ ID NO: 1614413 - protein, 12 aa, Staphylococcus aureus
LVPEGHPTHPLT

SEQ ID NO: 1614414 - protein, 9 aa, Staphylococcus aureus
NANNGAVGK

SEQ ID NO: 1614415 - protein, 20 aa, Staphylococcus aureus
NATDELKDISNDLEKIQDIK

SEQ ID NO: 1614416 - protein, 5 aa, Staphylococcus aureus
NDEGK

SEQ ID NO: 1614417 - protein, 6 aa, Staphylococcus aureus
NDKTNT

SEQ ID NO: 1614418 - protein, 14 aa, Staphylococcus aureus
NDLPYEHNNKLFLK

SEQ ID NO: 1614419 - protein, 12 aa, Staphylococcus aureus
NEDTKIATIQQR

SEQ ID NO: 1614420 - protein, 9 aa, Staphylococcus aureus
NEFESETGN

SEQ ID NO: 1614421 - protein, 4 aa, Staphylococcus aureus
NEQV

SEQ ID NO: 1614422 - protein, 7 aa, Staphylococcus aureus
NGAGKTT

SEQ ID NO: 1614423 - protein, 39 aa, Staphylococcus aureus
NGGTTAQSDKQVQTKSTSVDTSSNQSSEDNSENSTIPVN

SEQ ID NO: 1614424 - protein, 8 aa, Staphylococcus aureus
NHKNAQKY

SEQ ID NO: 1614425 - protein, 12 aa, Staphylococcus aureus
NHKTYKNQGKVN

SEQ ID NO: 1614426 - protein, 40 aa, Staphylococcus aureus
NHSSGKRQTIQPKAKPFAKRGFSQRTTSTKKQVSSSDWNV

SEQ ID NO: 1614427 - protein, 6 aa, Staphylococcus aureus
NKYHDR

SEQ ID NO: 1614428 - protein, 7 aa, Staphylococcus aureus
NNKHFKS

SEQ ID NO: 1614429 - protein, 10 aa, Staphylococcus aureus
NNKTIDKPKQ

SEQ ID NO: 1614430 - protein, 12 aa, Staphylococcus aureus
NNNFKGDFQEAE

SEQ ID NO: 1614431 - protein, 13 aa, Staphylococcus aureus
NQGIRGHKSLRDT

SEQ ID NO: 1614432 - protein, 26 aa, Staphylococcus aureus
NRDKPSEEDSAKDNSVDDQQLEQDRQ

SEQ ID NO: 1614433 - protein, 6 aa, Staphylococcus aureus
NVETIE

SEQ ID NO: 1614434 - protein, 11 aa, Staphylococcus aureus
NYTRPSFSENK

SEQ ID NO: 1614435 - protein, 7 aa, Staphylococcus aureus
PGHTPES

SEQ ID NO: 1614436 - protein, 5 aa, Staphylococcus aureus
PGSFP

SEQ ID NO: 1614437 - protein, 5 aa, Staphylococcus aureus
PKHFQ

SEQ ID NO: 1614438 - protein, 6 aa, Staphylococcus aureus
PKYTGK

SEQ ID NO: 1614439 - protein, 16 aa, Staphylococcus aureus
PSIEDSDIDDVSSIDT

SEQ ID NO: 1614440 - protein, 7 aa, Staphylococcus aureus
QAINAGA

SEQ ID NO: 1614441 - protein, 6 aa, Staphylococcus aureus
QDAEKL

SEQ ID NO: 1614442 - protein, 12 aa, Staphylococcus aureus
QDDGYRIGYGGG

SEQ ID NO: 1614443 - protein, 6 aa, Staphylococcus aureus
QDNIVN

SEQ ID NO: 1614444 - protein, 10 aa, Staphylococcus aureus
QIEDSSRPNV

SEQ ID NO: 1614445 - protein, 5 aa, Staphylococcus aureus
QKEQA

SEQ ID NO: 1614446 - protein, 8 aa, Staphylococcus aureus
QNKLKSDE

SEQ ID NO: 1614447 - protein, 5 aa, Staphylococcus aureus
QPTNH

SEQ ID NO: 1614448 - protein, 8 aa, Staphylococcus aureus
QQHPDDEV

SEQ ID NO: 1614449 - protein, 8 aa, Staphylococcus aureus
QRIDEPDK

SEQ ID NO: 1614450 - protein, 25 aa, Staphylococcus aureus
QVSTTKQLSDDEVTVSNVTSQHQSA

SEQ ID NO: 1614451 - protein, 22 aa, Staphylococcus aureus
QVTNQGLASSHDLDYKEILNVI

SEQ ID NO: 1614452 - protein, 5 aa, Staphylococcus aureus
RCGSE

SEQ ID NO: 1614453 - protein, 5 aa, Staphylococcus aureus
RDAAY

SEQ ID NO: 1614454 - protein, 5 aa, Staphylococcus aureus
RERNG

SEQ ID NO: 1614455 - protein, 7 aa, Staphylococcus aureus
RGRCKPT

SEQ ID NO: 1614456 - protein, 12 aa, Staphylococcus aureus
RKLNRKDNTYDT

SEQ ID NO: 1614457 - protein, 5 aa, Staphylococcus aureus
RKTSN

SEQ ID NO: 1614458 - protein, 5 aa, Staphylococcus aureus
RPASL

SEQ ID NO: 1614459 - protein, 9 aa, Staphylococcus aureus
SADMTGKEE

SEQ ID NO: 1614460 - protein, 26 aa, Staphylococcus aureus
SAYSAANAATGKNIVTGRKLSKEERI

SEQ ID NO: 1614461 - protein, 4 aa, Staphylococcus aureus
SDGA

SEQ ID NO: 1614462 - protein, 8 aa, Staphylococcus aureus
SDGREDTV

SEQ ID NO: 1614463 - protein, 6 aa, Staphylococcus aureus
SETNPY

SEQ ID NO: 1614464 - protein, 9 aa, Staphylococcus aureus
SFNKEKNKT

SEQ ID NO: 1614465 - protein, 5 aa, Staphylococcus aureus
SGYET

SEQ ID NO: 1614466 - protein, 7 aa, Staphylococcus aureus
SKFDGNN

SEQ ID NO: 1614467 - protein, 23 aa, Staphylococcus aureus
SKSNTTKTTVTSTSVFPTKEAAQ

SEQ ID NO: 1614468 - protein, 6 aa, Staphylococcus aureus
SMSSGQ

SEQ ID NO: 1614469 - protein, 5 aa, Staphylococcus aureus
SPSDS

SEQ ID NO: 1614470 - protein, 10 aa, Staphylococcus aureus
SSNAKGDADI

SEQ ID NO: 1614471 - protein, 5 aa, Staphylococcus aureus
SSSGS

SEQ ID NO: 1614472 - protein, 9 aa, Staphylococcus aureus
STGTLATTQ

SEQ ID NO: 1614473 - protein, 8 aa, Staphylococcus aureus
STSGTFSD

SEQ ID NO: 1614474 - protein, 18 aa, Staphylococcus aureus
TENLPQGMKARAKYQNTT

SEQ ID NO: 1614475 - protein, 5 aa, Staphylococcus aureus
TGKPG

SEQ ID NO: 1614476 - protein, 5 aa, Staphylococcus aureus
TIGSD

SEQ ID NO: 1614477 - protein, 7 aa, Staphylococcus aureus
TKGNITG

SEQ ID NO: 1614478 - protein, 6 aa, Staphylococcus aureus
TNQLNE

SEQ ID NO: 1614479 - protein, 4 aa, Staphylococcus aureus
TQVL

SEQ ID NO: 1614480 - protein, 13 aa, Staphylococcus aureus
TRDPELRTTQSGV

SEQ ID NO: 1614481 - protein, 13 aa, Staphylococcus aureus
TSHIRTNQQSQIT

SEQ ID NO: 1614482 - protein, 9 aa, Staphylococcus aureus
TSMEDLSNS

SEQ ID NO: 1614483 - protein, 8 aa, Staphylococcus aureus
TSQYEGQG

SEQ ID NO: 1614484 - protein, 6 aa, Staphylococcus aureus
TTTVND

SEQ ID NO: 1614485 - protein, 13 aa, Staphylococcus aureus
TVETEGQASTESE

SEQ ID NO: 1614486 - protein, 16 aa, Staphylococcus aureus
VDDGLADEIIEAYNSL

SEQ ID NO: 1614487 - protein, 19 aa, Staphylococcus aureus
VDTTEIQNAALPNNKVESL

SEQ ID NO: 1614488 - protein, 6 aa, Staphylococcus aureus
VKTDDG

SEQ ID NO: 1614489 - protein, 8 aa, Staphylococcus aureus
VPSSSANY

SEQ ID NO: 1614490 - protein, 5 aa, Staphylococcus aureus
VSNIR

SEQ ID NO: 1614491 - protein, 8 aa, Staphylococcus aureus
WETSQEAK

SEQ ID NO: 1614492 - protein, 5 aa, Staphylococcus aureus
YDTNE

SEQ ID NO: 1614493 - protein, 7 aa, Staphylococcus aureus
YGTPVET

SEQ ID NO: 1614494 - protein, 10 aa, Staphylococcus aureus
YISEQSPGAS

SEQ ID NO: 1614495 - protein, 8 aa, Staphylococcus aureus
YKKEKEQN

SEQ ID NO: 1614496 - protein, 9 aa, Staphylococcus aureus
YKRNKQRKI

SEQ ID NO: 1614497 - protein, 10 aa, Staphylococcus aureus
YNIQQAKGWT

SEQ ID NO: 1614498 - protein, 12 aa, Staphylococcus aureus
YQASKPKLQEDK

SEQ ID NO: 1614499 - protein, 9 aa, Staphylococcus aureus
YQRTGTPIH

SEQ ID NO: 1614500 - protein, 14 aa, Staphylococcus aureus
YRLPKSGISTQSVH

SEQ ID NO: 1614501 - protein, 8 aa, Staphylococcus aureus
YTTTPQKC

SEQ ID NO: 1614502 - protein, 4 aa, Staphylococcus aureus
AADI

SEQ ID NO: 1614503 - protein, 10 aa, Staphylococcus aureus
AAGESASGGH

SEQ ID NO: 1614504 - protein, 6 aa, Staphylococcus aureus
AASEVE

SEQ ID NO: 1614505 - protein, 18 aa, Staphylococcus aureus
ADELPTEESDDLKEYQRY

SEQ ID NO: 1614506 - protein, 8 aa, Staphylococcus aureus
AEAKTGQA

SEQ ID NO: 1614507 - protein, 4 aa, Staphylococcus aureus
AESP

SEQ ID NO: 1614508 - protein, 7 aa, Staphylococcus aureus
AETAREI

SEQ ID NO: 1614509 - protein, 7 aa, Staphylococcus aureus
AFKQNAP

SEQ ID NO: 1614510 - protein, 5 aa, Staphylococcus aureus
AFSDA

SEQ ID NO: 1614511 - protein, 9 aa, Staphylococcus aureus
AGLAESHPH

SEQ ID NO: 1614512 - protein, 8 aa, Staphylococcus aureus
AGLDTSRK

SEQ ID NO: 1614513 - protein, 5 aa, Staphylococcus aureus
AGLPK

SEQ ID NO: 1614514 - protein, 15 aa, Staphylococcus aureus
AISNDEDLHLALGTT

SEQ ID NO: 1614515 - protein, 6 aa, Staphylococcus aureus
AKGDVT

SEQ ID NO: 1614516 - protein, 9 aa, Staphylococcus aureus
ALMEKAGSN

SEQ ID NO: 1614517 - protein, 23 aa, Staphylococcus aureus
ANVEESENTDNINSQDTSYTPQV

SEQ ID NO: 1614518 - protein, 6 aa, Staphylococcus aureus
ASNTGG

SEQ ID NO: 1614519 - protein, 5 aa, Staphylococcus aureus
AVESA

SEQ ID NO: 1614520 - protein, 14 aa, Staphylococcus aureus
DDKAAIDNDTTNKI

SEQ ID NO: 1614521 - protein, 11 aa, Staphylococcus aureus
DGKIRNSNGPM

SEQ ID NO: 1614522 - protein, 7 aa, Staphylococcus aureus
DGQPKEV

SEQ ID NO: 1614523 - protein, 14 aa, Staphylococcus aureus
DITEDDIKGKDAED

SEQ ID NO: 1614524 - protein, 8 aa, Staphylococcus aureus
DKETTAED

SEQ ID NO: 1614525 - protein, 6 aa, Staphylococcus aureus
DLGTEI

SEQ ID NO: 1614526 - protein, 8 aa, Staphylococcus aureus
DLSDNVSL

SEQ ID NO: 1614527 - protein, 15 aa, Staphylococcus aureus
DPAYIPRQNEARNQI

SEQ ID NO: 1614528 - protein, 10 aa, Staphylococcus aureus
DQESANQEAL

SEQ ID NO: 1614529 - protein, 7 aa, Staphylococcus aureus
DSNKNNK

SEQ ID NO: 1614530 - protein, 12 aa, Staphylococcus aureus
DTSKILKPRKFF

SEQ ID NO: 1614531 - protein, 4 aa, Staphylococcus aureus
DTTV

SEQ ID NO: 1614532 - protein, 14 aa, Staphylococcus aureus
DVKPPAETEEQREA

SEQ ID NO: 1614533 - protein, 8 aa, Staphylococcus aureus
EDANAQAT

SEQ ID NO: 1614534 - protein, 7 aa, Staphylococcus aureus
EGSVKDK

SEQ ID NO: 1614535 - protein, 4 aa, Staphylococcus aureus
EHLP

SEQ ID NO: 1614536 - protein, 5 aa, Staphylococcus aureus
EIEYG

SEQ ID NO: 1614537 - protein, 8 aa, Staphylococcus aureus
EKPGIKGK

SEQ ID NO: 1614538 - protein, 9 aa, Staphylococcus aureus
ENPNTKKVV

SEQ ID NO: 1614539 - protein, 5 aa, Staphylococcus aureus
ENVDD

SEQ ID NO: 1614540 - protein, 10 aa, Staphylococcus aureus
ERTTNMSGEI

SEQ ID NO: 1614541 - protein, 7 aa, Staphylococcus aureus
ESDRGTG

SEQ ID NO: 1614542 - protein, 11 aa, Staphylococcus aureus
ETHGVNPKAIE

SEQ ID NO: 1614543 - protein, 5 aa, Staphylococcus aureus
FDNKT

SEQ ID NO: 1614544 - protein, 7 aa, Staphylococcus aureus
FDRTSDL

SEQ ID NO: 1614545 - protein, 8 aa, Staphylococcus aureus
GDDENNAL

SEQ ID NO: 1614546 - protein, 5 aa, Staphylococcus aureus
GEESQ

SEQ ID NO: 1614547 - protein, 12 aa, Staphylococcus aureus
GEHSKKAQEDVL

SEQ ID NO: 1614548 - protein, 9 aa, Staphylococcus aureus
GELKPKADY

SEQ ID NO: 1614549 - protein, 9 aa, Staphylococcus aureus
GGSTETSYF

SEQ ID NO: 1614550 - protein, 8 aa, Staphylococcus aureus
GHKASFES

SEQ ID NO: 1614551 - protein, 12 aa, Staphylococcus aureus
GHLTDTKGRTVD

SEQ ID NO: 1614552 - protein, 6 aa, Staphylococcus aureus
GIESAV

SEQ ID NO: 1614553 - protein, 9 aa, Staphylococcus aureus
GIKDSTARS

SEQ ID NO: 1614554 - protein, 5 aa, Staphylococcus aureus
GIKTH

SEQ ID NO: 1614555 - protein, 10 aa, Staphylococcus aureus
GIKTSTESGQ

SEQ ID NO: 1614556 - protein, 8 aa, Staphylococcus aureus
GITGPNGL

SEQ ID NO: 1614557 - protein, 9 aa, Staphylococcus aureus
GKPDTPSMP

SEQ ID NO: 1614558 - protein, 7 aa, Staphylococcus aureus
GKYGEEV

SEQ ID NO: 1614559 - protein, 6 aa, Staphylococcus aureus
GLGSKK

SEQ ID NO: 1614560 - protein, 5 aa, Staphylococcus aureus
GSHAS

SEQ ID NO: 1614561 - protein, 5 aa, Staphylococcus aureus
GTIPP

SEQ ID NO: 1614562 - protein, 4 aa, Staphylococcus aureus
GTQM

SEQ ID NO: 1614563 - protein, 10 aa, Staphylococcus aureus
GVQKDADEVE

SEQ ID NO: 1614564 - protein, 9 aa, Staphylococcus aureus
HPRVAETTT

SEQ ID NO: 1614565 - protein, 6 aa, Staphylococcus aureus
IAAEQV

SEQ ID NO: 1614566 - protein, 4 aa, Staphylococcus aureus
IGNP

SEQ ID NO: 1614567 - protein, 19 aa, Staphylococcus aureus
IKNNPQKTNPFLKLHENKK

SEQ ID NO: 1614568 - protein, 4 aa, Staphylococcus aureus
ISND

SEQ ID NO: 1614569 - protein, 4 aa, Staphylococcus aureus
ITSK

SEQ ID NO: 1614570 - protein, 10 aa, Staphylococcus aureus
KAAANIGLEP

SEQ ID NO: 1614571 - protein, 9 aa, Staphylococcus aureus
KAKEKGLSD

SEQ ID NO: 1614572 - protein, 5 aa, Staphylococcus aureus
KAKYK

SEQ ID NO: 1614573 - protein, 14 aa, Staphylococcus aureus
KASQKFRYGEKYTD

SEQ ID NO: 1614574 - protein, 15 aa, Staphylococcus aureus
KDENGEDYPDWENSK

SEQ ID NO: 1614575 - protein, 6 aa, Staphylococcus aureus
KEDNRT

SEQ ID NO: 1614576 - protein, 6 aa, Staphylococcus aureus
KEEFEE

SEQ ID NO: 1614577 - protein, 9 aa, Staphylococcus aureus
KEEGRKKDS

SEQ ID NO: 1614578 - protein, 7 aa, Staphylococcus aureus
KEFATGL

SEQ ID NO: 1614579 - protein, 9 aa, Staphylococcus aureus
KEKAEQSRF

SEQ ID NO: 1614580 - protein, 8 aa, Staphylococcus aureus
KEKAKDLD

SEQ ID NO: 1614581 - protein, 82 aa, Staphylococcus aureus
KFKKEQKNDNKQSTQNNHQKSNNQNQNKGQQKDNKKNQQQNNKGNKGNKKNNRNNKKNNKNNKPQNQPAAPKEIPSKVTYQE

SEQ ID NO: 1614582 - protein, 17 aa, Staphylococcus aureus
KGASSLSPLKEERVEGT

SEQ ID NO: 1614583 - protein, 5 aa, Staphylococcus aureus
KGDIK

SEQ ID NO: 1614584 - protein, 7 aa, Staphylococcus aureus
KGEKVEA

SEQ ID NO: 1614585 - protein, 8 aa, Staphylococcus aureus
KGRHEVSD

SEQ ID NO: 1614586 - protein, 14 aa, Staphylococcus aureus
KGYPDAYEKGHKVS

SEQ ID NO: 1614587 - protein, 10 aa, Staphylococcus aureus
KKAIREETTV

SEQ ID NO: 1614588 - protein, 5 aa, Staphylococcus aureus
KKIKP

SEQ ID NO: 1614589 - protein, 13 aa, Staphylococcus aureus
KKNNVEVTTSKEL

SEQ ID NO: 1614590 - protein, 8 aa, Staphylococcus aureus
KKVNADED

SEQ ID NO: 1614591 - protein, 10 aa, Staphylococcus aureus
KNDLQSQDTL

SEQ ID NO: 1614592 - protein, 9 aa, Staphylococcus aureus
KNKRITDEA

SEQ ID NO: 1614593 - protein, 19 aa, Staphylococcus aureus
KNKVRSKIKNKVKPGYKKK

SEQ ID NO: 1614594 - protein, 8 aa, Staphylococcus aureus
KPARANQL

SEQ ID NO: 1614595 - protein, 21 aa, Staphylococcus aureus
KQHQNTGPFNHQDNLKSDEKE

SEQ ID NO: 1614596 - protein, 9 aa, Staphylococcus aureus
KRDGSYQAQ

SEQ ID NO: 1614597 - protein, 6 aa, Staphylococcus aureus
KRERYF

SEQ ID NO: 1614598 - protein, 4 aa, Staphylococcus aureus
KRID

SEQ ID NO: 1614599 - protein, 8 aa, Staphylococcus aureus
KTSSTTLR

SEQ ID NO: 1614600 - protein, 13 aa, Staphylococcus aureus
KYKDIENGLKGEE

SEQ ID NO: 1614601 - protein, 4 aa, Staphylococcus aureus
KYSN

SEQ ID NO: 1614602 - protein, 7 aa, Staphylococcus aureus
LAPNLKT

SEQ ID NO: 1614603 - protein, 16 aa, Staphylococcus aureus
LARGERTGEEVAKRME

SEQ ID NO: 1614604 - protein, 4 aa, Staphylococcus aureus
LEGS

SEQ ID NO: 1614605 - protein, 11 aa, Staphylococcus aureus
LINQPEDKYGE

SEQ ID NO: 1614606 - protein, 4 aa, Staphylococcus aureus
LKDA

SEQ ID NO: 1614607 - protein, 6 aa, Staphylococcus aureus
LKEGEI

SEQ ID NO: 1614608 - protein, 75 aa, Staphylococcus aureus
LPKNDRSQRPARGKTIQAKTRGKSLDKSKSDDKGRKKKGKQRKGKNQRNNDKSGNSKHKPFYKDKSVKKKARRKK

SEQ ID NO: 1614609 - protein, 10 aa, Staphylococcus aureus
LQGGYGQFTN

SEQ ID NO: 1614610 - protein, 8 aa, Staphylococcus aureus
LQINAPTK

SEQ ID NO: 1614611 - protein, 11 aa, Staphylococcus aureus
LQKQQQKQRAL

SEQ ID NO: 1614612 - protein, 12 aa, Staphylococcus aureus
MQEETLNQSKIG

SEQ ID NO: 1614613 - protein, 7 aa, Staphylococcus aureus
MTEGGYE

SEQ ID NO: 1614614 - protein, 14 aa, Staphylococcus aureus
MTNHDGDGEKGEEA

SEQ ID NO: 1614615 - protein, 5 aa, Staphylococcus aureus
NDGIT

SEQ ID NO: 1614616 - protein, 4 aa, Staphylococcus aureus
NDKI

SEQ ID NO: 1614617 - protein, 10 aa, Staphylococcus aureus
NDRYEDEHQQ

SEQ ID NO: 1614618 - protein, 6 aa, Staphylococcus aureus
NEESQH

SEQ ID NO: 1614619 - protein, 19 aa, Staphylococcus aureus
NEQTIKNGFETYTSDNGRM

SEQ ID NO: 1614620 - protein, 4 aa, Staphylococcus aureus
NETE

SEQ ID NO: 1614621 - protein, 12 aa, Staphylococcus aureus
NFDDTGAFKKSE

SEQ ID NO: 1614622 - protein, 13 aa, Staphylococcus aureus
NKEQITKKQFKTK

SEQ ID NO: 1614623 - protein, 11 aa, Staphylococcus aureus
NKKSIKKENGL

SEQ ID NO: 1614624 - protein, 17 aa, Staphylococcus aureus
NKTAGQTQKWQCKYFFE

SEQ ID NO: 1614625 - protein, 5 aa, Staphylococcus aureus
NMSKP

SEQ ID NO: 1614626 - protein, 8 aa, Staphylococcus aureus
NPKSQNIF

SEQ ID NO: 1614627 - protein, 14 aa, Staphylococcus aureus
NQSWSNGNIGTNGV

SEQ ID NO: 1614628 - protein, 14 aa, Staphylococcus aureus
NSDGQVTAEAQGIA

SEQ ID NO: 1614629 - protein, 5 aa, Staphylococcus aureus
NTSKS

SEQ ID NO: 1614630 - protein, 4 aa, Staphylococcus aureus
PAER

SEQ ID NO: 1614631 - protein, 5 aa, Staphylococcus aureus
PLAEG

SEQ ID NO: 1614632 - protein, 19 aa, Staphylococcus aureus
PMAASNTTNTLKDGTKKRI

SEQ ID NO: 1614633 - protein, 6 aa, Staphylococcus aureus
PSKGSD

SEQ ID NO: 1614634 - protein, 4 aa, Staphylococcus aureus
PSLD

SEQ ID NO: 1614635 - protein, 11 aa, Staphylococcus aureus
QATRSAKYKSE

SEQ ID NO: 1614636 - protein, 9 aa, Staphylococcus aureus
QKNSAYLGT

SEQ ID NO: 1614637 - protein, 4 aa, Staphylococcus aureus
QKVF

SEQ ID NO: 1614638 - protein, 6 aa, Staphylococcus aureus
QQRSQY

SEQ ID NO: 1614639 - protein, 9 aa, Staphylococcus aureus
QSGGSREGL

SEQ ID NO: 1614640 - protein, 9 aa, Staphylococcus aureus
RAKDKDVDH

SEQ ID NO: 1614641 - protein, 5 aa, Staphylococcus aureus
RDTLN

SEQ ID NO: 1614642 - protein, 11 aa, Staphylococcus aureus
RETIEDYTSRT

SEQ ID NO: 1614643 - protein, 4 aa, Staphylococcus aureus
RFGN

SEQ ID NO: 1614644 - protein, 12 aa, Staphylococcus aureus
RGQYGEGYIDGK

SEQ ID NO: 1614645 - protein, 9 aa, Staphylococcus aureus
RHQQGQTDF

SEQ ID NO: 1614646 - protein, 18 aa, Staphylococcus aureus
RKGIPFEPKEIDNEAEIQ

SEQ ID NO: 1614647 - protein, 4 aa, Staphylococcus aureus
RKGK

SEQ ID NO: 1614648 - protein, 23 aa, Staphylococcus aureus
RNLGNPPFATRESLPSIRERELE

SEQ ID NO: 1614649 - protein, 16 aa, Staphylococcus aureus
RPKTEELRRFLNVINE

SEQ ID NO: 1614650 - protein, 5 aa, Staphylococcus aureus
RVKES

SEQ ID NO: 1614651 - protein, 6 aa, Staphylococcus aureus
RWGPRT

SEQ ID NO: 1614652 - protein, 14 aa, Staphylococcus aureus
SAIKAGYSANSAHV

SEQ ID NO: 1614653 - protein, 8 aa, Staphylococcus aureus
SEENETKY

SEQ ID NO: 1614654 - protein, 8 aa, Staphylococcus aureus
SHTATHGA

SEQ ID NO: 1614655 - protein, 9 aa, Staphylococcus aureus
SKAPENTIA

SEQ ID NO: 1614656 - protein, 6 aa, Staphylococcus aureus
SKDNEV

SEQ ID NO: 1614657 - protein, 10 aa, Staphylococcus aureus
SKSGTTTEPA

SEQ ID NO: 1614658 - protein, 13 aa, Staphylococcus aureus
SLYESEKQSALGK

SEQ ID NO: 1614659 - protein, 8 aa, Staphylococcus aureus
SPHSDEKV

SEQ ID NO: 1614660 - protein, 11 aa, Staphylococcus aureus
STNQQQTKGRY

SEQ ID NO: 1614661 - protein, 11 aa, Staphylococcus aureus
SYTDSLTGVTT

SEQ ID NO: 1614662 - protein, 8 aa, Staphylococcus aureus
TDDIEKTK

SEQ ID NO: 1614663 - protein, 20 aa, Staphylococcus aureus
TDSTRETKTPEVDENLEKDR

SEQ ID NO: 1614664 - protein, 5 aa, Staphylococcus aureus
TEPYT

SEQ ID NO: 1614665 - protein, 5 aa, Staphylococcus aureus
TESQQ

SEQ ID NO: 1614666 - protein, 6 aa, Staphylococcus aureus
TEYKDE

SEQ ID NO: 1614667 - protein, 5 aa, Staphylococcus aureus
TGTNV

SEQ ID NO: 1614668 - protein, 5 aa, Staphylococcus aureus
TGTTL

SEQ ID NO: 1614669 - protein, 13 aa, Staphylococcus aureus
TIEERHSNAYQKG

SEQ ID NO: 1614670 - protein, 6 aa, Staphylococcus aureus
TIPFDQ

SEQ ID NO: 1614671 - protein, 4 aa, Staphylococcus aureus
TISK

SEQ ID NO: 1614672 - protein, 7 aa, Staphylococcus aureus
TKDEQIK

SEQ ID NO: 1614673 - protein, 4 aa, Staphylococcus aureus
TSNS

SEQ ID NO: 1614674 - protein, 13 aa, Staphylococcus aureus
TVAKPIDEFTSGG

SEQ ID NO: 1614675 - protein, 9 aa, Staphylococcus aureus
TYRPNGTNK

SEQ ID NO: 1614676 - protein, 10 aa, Staphylococcus aureus
VEEDTSKNLR

SEQ ID NO: 1614677 - protein, 8 aa, Staphylococcus aureus
VENPHIAT

SEQ ID NO: 1614678 - protein, 10 aa, Staphylococcus aureus
VGNSGNSTEP

SEQ ID NO: 1614679 - protein, 11 aa, Staphylococcus aureus
VINTENDSVPY

SEQ ID NO: 1614680 - protein, 12 aa, Staphylococcus aureus
VNDKDELKNQSR

SEQ ID NO: 1614681 - protein, 8 aa, Staphylococcus aureus
VNKGTPEF

SEQ ID NO: 1614682 - protein, 11 aa, Staphylococcus aureus
VNTEDAKLTKA

SEQ ID NO: 1614683 - protein, 5 aa, Staphylococcus aureus
YNDKT

SEQ ID NO: 1614684 - protein, 4 aa, Staphylococcus aureus
YPTK

SEQ ID NO: 1614685 - protein, 24 aa, Staphylococcus aureus
YRNQTNDMTEPYTIGGGTYARNLD

SEQ ID NO: 1614686 - protein, 26 aa, Staphylococcus aureus
AAIEGGARRIEGTVNGIGERAGNAAL

SEQ ID NO: 1614687 - protein, 14 aa, Staphylococcus aureus
AEEAVEKAKELNSD

SEQ ID NO: 1614688 - protein, 7 aa, Staphylococcus aureus
AGDEQQV

SEQ ID NO: 1614689 - protein, 8 aa, Staphylococcus aureus
AGYGSEQN

SEQ ID NO: 1614690 - protein, 17 aa, Staphylococcus aureus
AITRPKEITKRFVQIME

SEQ ID NO: 1614691 - protein, 6 aa, Staphylococcus aureus
AIYDGT

SEQ ID NO: 1614692 - protein, 6 aa, Staphylococcus aureus
AKGRNF

SEQ ID NO: 1614693 - protein, 7 aa, Staphylococcus aureus
AKTYSLG

SEQ ID NO: 1614694 - protein, 13 aa, Staphylococcus aureus
AMDEAIKNGEDYA

SEQ ID NO: 1614695 - protein, 6 aa, Staphylococcus aureus
ANPNLG

SEQ ID NO: 1614696 - protein, 13 aa, Staphylococcus aureus
APISEEERENMKR

SEQ ID NO: 1614697 - protein, 12 aa, Staphylococcus aureus
AQGSEAGGHRGS

SEQ ID NO: 1614698 - protein, 6 aa, Staphylococcus aureus
ARPGNH

SEQ ID NO: 1614699 - protein, 8 aa, Staphylococcus aureus
ASRRAQTL

SEQ ID NO: 1614700 - protein, 4 aa, Staphylococcus aureus
ASSQ

SEQ ID NO: 1614701 - protein, 9 aa, Staphylococcus aureus
ATENGDNLQ

SEQ ID NO: 1614702 - protein, 4 aa, Staphylococcus aureus
ATGN

SEQ ID NO: 1614703 - protein, 15 aa, Staphylococcus aureus
ATKDNSLDTHGDETL

SEQ ID NO: 1614704 - protein, 12 aa, Staphylococcus aureus
AWQRGTNENTNG

SEQ ID NO: 1614705 - protein, 8 aa, Staphylococcus aureus
DEDELDAG

SEQ ID NO: 1614706 - protein, 16 aa, Staphylococcus aureus
DETSANNDNKYKSEPL

SEQ ID NO: 1614707 - protein, 8 aa, Staphylococcus aureus
DFKDDKDR

SEQ ID NO: 1614708 - protein, 13 aa, Staphylococcus aureus
DFKSEENAKKIAE

SEQ ID NO: 1614709 - protein, 11 aa, Staphylococcus aureus
DGPNTKEIQQN

SEQ ID NO: 1614710 - protein, 8 aa, Staphylococcus aureus
DKDSGKKA

SEQ ID NO: 1614711 - protein, 32 aa, Staphylococcus aureus
DLKPDEVAANAQNNASNTPDNNQQSNDSETTK

SEQ ID NO: 1614712 - protein, 7 aa, Staphylococcus aureus
DLPEGLA

SEQ ID NO: 1614713 - protein, 5 aa, Staphylococcus aureus
DNYEA

SEQ ID NO: 1614714 - protein, 8 aa, Staphylococcus aureus
DPKTRQIQ

SEQ ID NO: 1614715 - protein, 7 aa, Staphylococcus aureus
DQVKAGD

SEQ ID NO: 1614716 - protein, 5 aa, Staphylococcus aureus
DREQV

SEQ ID NO: 1614717 - protein, 15 aa, Staphylococcus aureus
DRGKHFPEQLSGGMK

SEQ ID NO: 1614718 - protein, 13 aa, Staphylococcus aureus
DTEEDDNLFSESG

SEQ ID NO: 1614719 - protein, 5 aa, Staphylococcus aureus
DTTLQ

SEQ ID NO: 1614720 - protein, 9 aa, Staphylococcus aureus
DVPYRSQSD

SEQ ID NO: 1614721 - protein, 6 aa, Staphylococcus aureus
DYSEYG

SEQ ID NO: 1614722 - protein, 9 aa, Staphylococcus aureus
EAQKTLAEE

SEQ ID NO: 1614723 - protein, 8 aa, Staphylococcus aureus
EASNWNKE

SEQ ID NO: 1614724 - protein, 9 aa, Staphylococcus aureus
EDEKGGTVD

SEQ ID NO: 1614725 - protein, 14 aa, Staphylococcus aureus
EDGQASQRICQTIF

SEQ ID NO: 1614726 - protein, 6 aa, Staphylococcus aureus
EDYRDN

SEQ ID NO: 1614727 - protein, 4 aa, Staphylococcus aureus
EEEF

SEQ ID NO: 1614728 - protein, 9 aa, Staphylococcus aureus
EESNGLNTE

SEQ ID NO: 1614729 - protein, 8 aa, Staphylococcus aureus
EETKGAFP

SEQ ID NO: 1614730 - protein, 29 aa, Staphylococcus aureus
EFESFKDTGASIEEMTKSKPYTKVGSQER

SEQ ID NO: 1614731 - protein, 6 aa, Staphylococcus aureus
EGEEGY

SEQ ID NO: 1614732 - protein, 8 aa, Staphylococcus aureus
EGKEGEAE

SEQ ID NO: 1614733 - protein, 7 aa, Staphylococcus aureus
EGLTEED

SEQ ID NO: 1614734 - protein, 4 aa, Staphylococcus aureus
EHTT

SEQ ID NO: 1614735 - protein, 4 aa, Staphylococcus aureus
EKEN

SEQ ID NO: 1614736 - protein, 8 aa, Staphylococcus aureus
EKLAKQGQ

SEQ ID NO: 1614737 - protein, 4 aa, Staphylococcus aureus
EKTR

SEQ ID NO: 1614738 - protein, 5 aa, Staphylococcus aureus
ELGNS

SEQ ID NO: 1614739 - protein, 5 aa, Staphylococcus aureus
ELGQK

SEQ ID NO: 1614740 - protein, 6 aa, Staphylococcus aureus
ELKDQQ

SEQ ID NO: 1614741 - protein, 5 aa, Staphylococcus aureus
EMEDG

SEQ ID NO: 1614742 - protein, 8 aa, Staphylococcus aureus
ENAETSKP

SEQ ID NO: 1614743 - protein, 4 aa, Staphylococcus aureus
EPDK

SEQ ID NO: 1614744 - protein, 6 aa, Staphylococcus aureus
EQARRG

SEQ ID NO: 1614745 - protein, 17 aa, Staphylococcus aureus
EQESKQQLTEDQYKAYE

SEQ ID NO: 1614746 - protein, 6 aa, Staphylococcus aureus
EQLERT

SEQ ID NO: 1614747 - protein, 6 aa, Staphylococcus aureus
EQQING

SEQ ID NO: 1614748 - protein, 4 aa, Staphylococcus aureus
EQVA

SEQ ID NO: 1614749 - protein, 4 aa, Staphylococcus aureus
ERLG

SEQ ID NO: 1614750 - protein, 10 aa, Staphylococcus aureus
ESEDGLTGQP

SEQ ID NO: 1614751 - protein, 5 aa, Staphylococcus aureus
ESEEL

SEQ ID NO: 1614752 - protein, 7 aa, Staphylococcus aureus
ESGDRHT

SEQ ID NO: 1614753 - protein, 15 aa, Staphylococcus aureus
ETAPQAKQQATKGYG

SEQ ID NO: 1614754 - protein, 9 aa, Staphylococcus aureus
ETDGETVLK

SEQ ID NO: 1614755 - protein, 8 aa, Staphylococcus aureus
EVETPPTY

SEQ ID NO: 1614756 - protein, 9 aa, Staphylococcus aureus
EVKSKQTQF

SEQ ID NO: 1614757 - protein, 7 aa, Staphylococcus aureus
EYQDNEQ

SEQ ID NO: 1614758 - protein, 8 aa, Staphylococcus aureus
FEKPSMEA

SEQ ID NO: 1614759 - protein, 11 aa, Staphylococcus aureus
FGERTTRLEAK

SEQ ID NO: 1614760 - protein, 7 aa, Staphylococcus aureus
FGPDSSS

SEQ ID NO: 1614761 - protein, 7 aa, Staphylococcus aureus
FGPNEDF

SEQ ID NO: 1614762 - protein, 17 aa, Staphylococcus aureus
FNASGVEDIGLKDGDSL

SEQ ID NO: 1614763 - protein, 9 aa, Staphylococcus aureus
GDLPSSFPK

SEQ ID NO: 1614764 - protein, 16 aa, Staphylococcus aureus
GDQDIKDALTQFENET

SEQ ID NO: 1614765 - protein, 9 aa, Staphylococcus aureus
GDSNPNNRN

SEQ ID NO: 1614766 - protein, 19 aa, Staphylococcus aureus
GEGMEKREENFADEVKGQM

SEQ ID NO: 1614767 - protein, 12 aa, Staphylococcus aureus
GFETEETRQGAL

SEQ ID NO: 1614768 - protein, 9 aa, Staphylococcus aureus
GGHGTHNGY

SEQ ID NO: 1614769 - protein, 7 aa, Staphylococcus aureus
GHPEKPY

SEQ ID NO: 1614770 - protein, 12 aa, Staphylococcus aureus
GINKTKDTRAIQ

SEQ ID NO: 1614771 - protein, 5 aa, Staphylococcus aureus
GKLKN

SEQ ID NO: 1614772 - protein, 16 aa, Staphylococcus aureus
GKTESYTKEDVTMGEA

SEQ ID NO: 1614773 - protein, 6 aa, Staphylococcus aureus
GNNENT

SEQ ID NO: 1614774 - protein, 15 aa, Staphylococcus aureus
GNNGSIDNDPPAAMR

SEQ ID NO: 1614775 - protein, 6 aa, Staphylococcus aureus
GNQLEN

SEQ ID NO: 1614776 - protein, 8 aa, Staphylococcus aureus
GRLTSAHG

SEQ ID NO: 1614777 - protein, 6 aa, Staphylococcus aureus
GSFTTS

SEQ ID NO: 1614778 - protein, 10 aa, Staphylococcus aureus
GSKVSTEDFE

SEQ ID NO: 1614779 - protein, 8 aa, Staphylococcus aureus
GSPKSIIP

SEQ ID NO: 1614780 - protein, 7 aa, Staphylococcus aureus
GSSGLSA

SEQ ID NO: 1614781 - protein, 14 aa, Staphylococcus aureus
GSYDKRADEEAAKY

SEQ ID NO: 1614782 - protein, 10 aa, Staphylococcus aureus
GVKKSERKKM

SEQ ID NO: 1614783 - protein, 5 aa, Staphylococcus aureus
GYGNE

SEQ ID NO: 1614784 - protein, 16 aa, Staphylococcus aureus
HAPHARDEKAQPMEKA

SEQ ID NO: 1614785 - protein, 13 aa, Staphylococcus aureus
HDKQAQFLAWLDV

SEQ ID NO: 1614786 - protein, 4 aa, Staphylococcus aureus
HDNH

SEQ ID NO: 1614787 - protein, 5 aa, Staphylococcus aureus
HDPLI

SEQ ID NO: 1614788 - protein, 15 aa, Staphylococcus aureus
HENSQKVENKNEIAQ

SEQ ID NO: 1614789 - protein, 6 aa, Staphylococcus aureus
HHTSTD

SEQ ID NO: 1614790 - protein, 7 aa, Staphylococcus aureus
HKGNYTP

SEQ ID NO: 1614791 - protein, 30 aa, Staphylococcus aureus
HKKSMEQSSYHNQKEQRREQRKLERQISEC

SEQ ID NO: 1614792 - protein, 5 aa, Staphylococcus aureus
HRDNH

SEQ ID NO: 1614793 - protein, 11 aa, Staphylococcus aureus
HSAKDGRVTAT

SEQ ID NO: 1614794 - protein, 4 aa, Staphylococcus aureus
HSRF

SEQ ID NO: 1614795 - protein, 8 aa, Staphylococcus aureus
IASPPQTC

SEQ ID NO: 1614796 - protein, 15 aa, Staphylococcus aureus
IDGVTSADVNLENGQ

SEQ ID NO: 1614797 - protein, 6 aa, Staphylococcus aureus
IDKSTY

SEQ ID NO: 1614798 - protein, 15 aa, Staphylococcus aureus
IDRLEQSKNEAPHLR

SEQ ID NO: 1614799 - protein, 4 aa, Staphylococcus aureus
IDTN

SEQ ID NO: 1614800 - protein, 10 aa, Staphylococcus aureus
IGKSGATGNF

SEQ ID NO: 1614801 - protein, 7 aa, Staphylococcus aureus
INIPPEG

SEQ ID NO: 1614802 - protein, 5 aa, Staphylococcus aureus
INPDT

SEQ ID NO: 1614803 - protein, 7 aa, Staphylococcus aureus
IPDNSEN

SEQ ID NO: 1614804 - protein, 11 aa, Staphylococcus aureus
ISSNDDGTISD

SEQ ID NO: 1614805 - protein, 5 aa, Staphylococcus aureus
KAEQY

SEQ ID NO: 1614806 - protein, 12 aa, Staphylococcus aureus
KAHQEEQSVNVQ

SEQ ID NO: 1614807 - protein, 9 aa, Staphylococcus aureus
KEDAAELAN

SEQ ID NO: 1614808 - protein, 12 aa, Staphylococcus aureus
KEKYSDVNVSYI

SEQ ID NO: 1614809 - protein, 8 aa, Staphylococcus aureus
KEQATDML

SEQ ID NO: 1614810 - protein, 7 aa, Staphylococcus aureus
KFAEEEN

SEQ ID NO: 1614811 - protein, 5 aa, Staphylococcus aureus
KFTEH

SEQ ID NO: 1614812 - protein, 6 aa, Staphylococcus aureus
KGRYQK

SEQ ID NO: 1614813 - protein, 9 aa, Staphylococcus aureus
KGYRGECDD

SEQ ID NO: 1614814 - protein, 6 aa, Staphylococcus aureus
KHPLTR

SEQ ID NO: 1614815 - protein, 10 aa, Staphylococcus aureus
KIGNTDSVRP

SEQ ID NO: 1614816 - protein, 7 aa, Staphylococcus aureus
KKDYKKY

SEQ ID NO: 1614817 - protein, 10 aa, Staphylococcus aureus
KNGKTTTISG

SEQ ID NO: 1614818 - protein, 14 aa, Staphylococcus aureus
KNLATGEKVEVGEA

SEQ ID NO: 1614819 - protein, 7 aa, Staphylococcus aureus
KNNDTAY

SEQ ID NO: 1614820 - protein, 9 aa, Staphylococcus aureus
KPKSTISEK

SEQ ID NO: 1614821 - protein, 9 aa, Staphylococcus aureus
KPPMKEQEI

SEQ ID NO: 1614822 - protein, 8 aa, Staphylococcus aureus
KPPQTGGD

SEQ ID NO: 1614823 - protein, 9 aa, Staphylococcus aureus
KPSKGSKRQ

SEQ ID NO: 1614824 - protein, 4 aa, Staphylococcus aureus
KPSV

SEQ ID NO: 1614825 - protein, 7 aa, Staphylococcus aureus
KSIDKNT

SEQ ID NO: 1614826 - protein, 12 aa, Staphylococcus aureus
KSLKGGDKNVNE

SEQ ID NO: 1614827 - protein, 16 aa, Staphylococcus aureus
KTRGEKAEAPEPTKLT

SEQ ID NO: 1614828 - protein, 9 aa, Staphylococcus aureus
KVPSRRRDE

SEQ ID NO: 1614829 - protein, 7 aa, Staphylococcus aureus
KYTHTSN

SEQ ID NO: 1614830 - protein, 11 aa, Staphylococcus aureus
LAGRDYRAKEI

SEQ ID NO: 1614831 - protein, 6 aa, Staphylococcus aureus
LDQQTE

SEQ ID NO: 1614832 - protein, 5 aa, Staphylococcus aureus
LEKPR

SEQ ID NO: 1614833 - protein, 8 aa, Staphylococcus aureus
LNNGRYQG

SEQ ID NO: 1614834 - protein, 20 aa, Staphylococcus aureus
LNTSNKKLKQAYSKSDSKNM

SEQ ID NO: 1614835 - protein, 11 aa, Staphylococcus aureus
LQTSSKDRAEN

SEQ ID NO: 1614836 - protein, 12 aa, Staphylococcus aureus
LREQKGADVKEH

SEQ ID NO: 1614837 - protein, 5 aa, Staphylococcus aureus
LRQQI

SEQ ID NO: 1614838 - protein, 9 aa, Staphylococcus aureus
LSETSSKLD

SEQ ID NO: 1614839 - protein, 18 aa, Staphylococcus aureus
LTAAQRKKIVQEEGGFGD

SEQ ID NO: 1614840 - protein, 4 aa, Staphylococcus aureus
LTPT

SEQ ID NO: 1614841 - protein, 7 aa, Staphylococcus aureus
LVSDSNE

SEQ ID NO: 1614842 - protein, 5 aa, Staphylococcus aureus
MQKPD

SEQ ID NO: 1614843 - protein, 14 aa, Staphylococcus aureus
MSGRGLGHTGGTID

SEQ ID NO: 1614844 - protein, 8 aa, Staphylococcus aureus
MSTKTYTK

SEQ ID NO: 1614845 - protein, 16 aa, Staphylococcus aureus
NDDPHRPNANNKTIKQ

SEQ ID NO: 1614846 - protein, 9 aa, Staphylococcus aureus
NDTPGMVGK

SEQ ID NO: 1614847 - protein, 9 aa, Staphylococcus aureus
NEKKYQYTG

SEQ ID NO: 1614848 - protein, 8 aa, Staphylococcus aureus
NEPGTPFD

SEQ ID NO: 1614849 - protein, 8 aa, Staphylococcus aureus
NESKMKEE

SEQ ID NO: 1614850 - protein, 18 aa, Staphylococcus aureus
NFDDKKELAETLSEATHS

SEQ ID NO: 1614851 - protein, 6 aa, Staphylococcus aureus
NGEGHA

SEQ ID NO: 1614852 - protein, 6 aa, Staphylococcus aureus
NGLTPG

SEQ ID NO: 1614853 - protein, 6 aa, Staphylococcus aureus
NGTTNF

SEQ ID NO: 1614854 - protein, 16 aa, Staphylococcus aureus
NIGRRVSTTSTGSVTL

SEQ ID NO: 1614855 - protein, 4 aa, Staphylococcus aureus
NKDK

SEQ ID NO: 1614856 - protein, 6 aa, Staphylococcus aureus
NKKQRV

SEQ ID NO: 1614857 - protein, 24 aa, Staphylococcus aureus
NLKGAYKSFNKSKEIIQNAKDRDA

SEQ ID NO: 1614858 - protein, 13 aa, Staphylococcus aureus
NNLSTSALQQIRG

SEQ ID NO: 1614859 - protein, 13 aa, Staphylococcus aureus
NQQGDGTREENTS

SEQ ID NO: 1614860 - protein, 7 aa, Staphylococcus aureus
NQSKTKC

SEQ ID NO: 1614861 - protein, 10 aa, Staphylococcus aureus
NQSRNFAQNT

SEQ ID NO: 1614862 - protein, 6 aa, Staphylococcus aureus
NVGPRG

SEQ ID NO: 1614863 - protein, 12 aa, Staphylococcus aureus
NVSENDNANQPH

SEQ ID NO: 1614864 - protein, 5 aa, Staphylococcus aureus
NVTET

SEQ ID NO: 1614865 - protein, 12 aa, Staphylococcus aureus
NVVDSDGNGGGI

SEQ ID NO: 1614866 - protein, 4 aa, Staphylococcus aureus
NYRP

SEQ ID NO: 1614867 - protein, 4 aa, Staphylococcus aureus
PADI

SEQ ID NO: 1614868 - protein, 5 aa, Staphylococcus aureus
PEATK

SEQ ID NO: 1614869 - protein, 10 aa, Staphylococcus aureus
PGGKASYPST

SEQ ID NO: 1614870 - protein, 7 aa, Staphylococcus aureus
PGKNEFK

SEQ ID NO: 1614871 - protein, 5 aa, Staphylococcus aureus
PITQI

SEQ ID NO: 1614872 - protein, 25 aa, Staphylococcus aureus
PKELYEKTPTADLEDDKPQLPDEDA

SEQ ID NO: 1614873 - protein, 17 aa, Staphylococcus aureus
PLPKKTKFETKGESKSL

SEQ ID NO: 1614874 - protein, 27 aa, Staphylococcus aureus
PMPQAQSTDSNKTEAPKPTSDNHKTIN

SEQ ID NO: 1614875 - protein, 5 aa, Staphylococcus aureus
PNLYP

SEQ ID NO: 1614876 - protein, 4 aa, Staphylococcus aureus
PQLT

SEQ ID NO: 1614877 - protein, 9 aa, Staphylococcus aureus
PRNNSANEI

SEQ ID NO: 1614878 - protein, 5 aa, Staphylococcus aureus
PRSQW

SEQ ID NO: 1614879 - protein, 13 aa, Staphylococcus aureus
PTKKHPNGYEYKD

SEQ ID NO: 1614880 - protein, 7 aa, Staphylococcus aureus
QAGSEVS

SEQ ID NO: 1614881 - protein, 6 aa, Staphylococcus aureus
QARTEE

SEQ ID NO: 1614882 - protein, 18 aa, Staphylococcus aureus
QENKKEAPNATKMRQKER

SEQ ID NO: 1614883 - protein, 13 aa, Staphylococcus aureus
QFKEGDKFYSKRQ

SEQ ID NO: 1614884 - protein, 13 aa, Staphylococcus aureus
QFNRKAQAKELND

SEQ ID NO: 1614885 - protein, 9 aa, Staphylococcus aureus
QGHPQNPQI

SEQ ID NO: 1614886 - protein, 20 aa, Staphylococcus aureus
QGYAEENNKSFVKNSNNAIS

SEQ ID NO: 1614887 - protein, 6 aa, Staphylococcus aureus
QHDSND

SEQ ID NO: 1614888 - protein, 7 aa, Staphylococcus aureus
QKHPRGR

SEQ ID NO: 1614889 - protein, 7 aa, Staphylococcus aureus
QKSPNGK

SEQ ID NO: 1614890 - protein, 5 aa, Staphylococcus aureus
QSANG

SEQ ID NO: 1614891 - protein, 21 aa, Staphylococcus aureus
QSGLAAKERKDALAVSPKSGL

SEQ ID NO: 1614892 - protein, 9 aa, Staphylococcus aureus
RADSATQAE

SEQ ID NO: 1614893 - protein, 9 aa, Staphylococcus aureus
REKYAKKNK

SEQ ID NO: 1614894 - protein, 8 aa, Staphylococcus aureus
RENIGKPM

SEQ ID NO: 1614895 - protein, 11 aa, Staphylococcus aureus
RIDAGEHKEDA

SEQ ID NO: 1614896 - protein, 15 aa, Staphylococcus aureus
RNGNWLPSKQSRYRK

SEQ ID NO: 1614897 - protein, 9 aa, Staphylococcus aureus
RSEPGKRAR

SEQ ID NO: 1614898 - protein, 4 aa, Staphylococcus aureus
RSTN

SEQ ID NO: 1614899 - protein, 11 aa, Staphylococcus aureus
SDDDATDQFDE

SEQ ID NO: 1614900 - protein, 6 aa, Staphylococcus aureus
SETEDF

SEQ ID NO: 1614901 - protein, 13 aa, Staphylococcus aureus
SEVENMSGGERQR

SEQ ID NO: 1614902 - protein, 19 aa, Staphylococcus aureus
SGKTAERLNKLQKSAKTVT

SEQ ID NO: 1614903 - protein, 8 aa, Staphylococcus aureus
SKKLGDKV

SEQ ID NO: 1614904 - protein, 7 aa, Staphylococcus aureus
SKKTYDK

SEQ ID NO: 1614905 - protein, 4 aa, Staphylococcus aureus
SLAD

SEQ ID NO: 1614906 - protein, 7 aa, Staphylococcus aureus
SLEEQQK

SEQ ID NO: 1614907 - protein, 8 aa, Staphylococcus aureus
SLGSGKSL

SEQ ID NO: 1614908 - protein, 9 aa, Staphylococcus aureus
SLTDKPVKG

SEQ ID NO: 1614909 - protein, 8 aa, Staphylococcus aureus
SNAVKTRK

SEQ ID NO: 1614910 - protein, 13 aa, Staphylococcus aureus
SNSNQDTANTTDP

SEQ ID NO: 1614911 - protein, 7 aa, Staphylococcus aureus
SNVKPGQ

SEQ ID NO: 1614912 - protein, 5 aa, Staphylococcus aureus
SSYVE

SEQ ID NO: 1614913 - protein, 8 aa, Staphylococcus aureus
STDTINPR

SEQ ID NO: 1614914 - protein, 6 aa, Staphylococcus aureus
STNQVP

SEQ ID NO: 1614915 - protein, 6 aa, Staphylococcus aureus
STPLTE

SEQ ID NO: 1614916 - protein, 13 aa, Staphylococcus aureus
STSALDVNNKEKI

SEQ ID NO: 1614917 - protein, 5 aa, Staphylococcus aureus
TAKYR

SEQ ID NO: 1614918 - protein, 7 aa, Staphylococcus aureus
TANGVGS

SEQ ID NO: 1614919 - protein, 14 aa, Staphylococcus aureus
TATMKGTDSDANLD

SEQ ID NO: 1614920 - protein, 7 aa, Staphylococcus aureus
TCGNREQ

SEQ ID NO: 1614921 - protein, 6 aa, Staphylococcus aureus
TDAEGR

SEQ ID NO: 1614922 - protein, 17 aa, Staphylococcus aureus
TDDTKRFTDFPTERKGV

SEQ ID NO: 1614923 - protein, 11 aa, Staphylococcus aureus
TDKDPHYKNTQ

SEQ ID NO: 1614924 - protein, 9 aa, Staphylococcus aureus
TGEITSKDV

SEQ ID NO: 1614925 - protein, 9 aa, Staphylococcus aureus
TKTDREKNR

SEQ ID NO: 1614926 - protein, 6 aa, Staphylococcus aureus
TKVKKG

SEQ ID NO: 1614927 - protein, 22 aa, Staphylococcus aureus
TNKADISRRQQRLTDYKDKQRL

SEQ ID NO: 1614928 - protein, 4 aa, Staphylococcus aureus
TNLR

SEQ ID NO: 1614929 - protein, 9 aa, Staphylococcus aureus
TSDTQPMQG

SEQ ID NO: 1614930 - protein, 7 aa, Staphylococcus aureus
TSISPGM

SEQ ID NO: 1614931 - protein, 6 aa, Staphylococcus aureus
TSPQAF

SEQ ID NO: 1614932 - protein, 5 aa, Staphylococcus aureus
TSQYI

SEQ ID NO: 1614933 - protein, 23 aa, Staphylococcus aureus
TTRQRDGLTSANKVEEGGLSGRP

SEQ ID NO: 1614934 - protein, 6 aa, Staphylococcus aureus
VEGARN

SEQ ID NO: 1614935 - protein, 8 aa, Staphylococcus aureus
VEIPPEKV

SEQ ID NO: 1614936 - protein, 6 aa, Staphylococcus aureus
VETEDE

SEQ ID NO: 1614937 - protein, 13 aa, Staphylococcus aureus
VEVPDNKKLSIEQ

SEQ ID NO: 1614938 - protein, 8 aa, Staphylococcus aureus
VGGDGNRT

SEQ ID NO: 1614939 - protein, 7 aa, Staphylococcus aureus
VNGETFD

SEQ ID NO: 1614940 - protein, 4 aa, Staphylococcus aureus
VNGF

SEQ ID NO: 1614941 - protein, 15 aa, Staphylococcus aureus
VNPAKIKSKGIKSVR

SEQ ID NO: 1614942 - protein, 9 aa, Staphylococcus aureus
VPDYDKDDL

SEQ ID NO: 1614943 - protein, 7 aa, Staphylococcus aureus
VPNRKQQ

SEQ ID NO: 1614944 - protein, 8 aa, Staphylococcus aureus
VSPNNSLS

SEQ ID NO: 1614945 - protein, 5 aa, Staphylococcus aureus
VTPEL

SEQ ID NO: 1614946 - protein, 6 aa, Staphylococcus aureus
YADQEE

SEQ ID NO: 1614947 - protein, 18 aa, Staphylococcus aureus
YDSKTSSGPWTLHEGRII

SEQ ID NO: 1614948 - protein, 19 aa, Staphylococcus aureus
YESRGYSNDQSRSKVFNEK

SEQ ID NO: 1614949 - protein, 13 aa, Staphylococcus aureus
YKDEISANPKYEK

SEQ ID NO: 1614950 - protein, 7 aa, Staphylococcus aureus
YNESDEP

SEQ ID NO: 1614951 - protein, 5 aa, Staphylococcus aureus
YPESY

SEQ ID NO: 1614952 - protein, 7 aa, Staphylococcus aureus
YPTLSRK

SEQ ID NO: 1614953 - protein, 4 aa, Staphylococcus aureus
YQLD

SEQ ID NO: 1614954 - protein, 12 aa, Staphylococcus aureus
AAEASGAEMATT

SEQ ID NO: 1614955 - protein, 9 aa, Staphylococcus aureus
AAEGEDTYS

SEQ ID NO: 1614956 - protein, 7 aa, Staphylococcus aureus
ADNVNNY

SEQ ID NO: 1614957 - protein, 8 aa, Staphylococcus aureus
ADNVNNYL

SEQ ID NO: 1614958 - protein, 19 aa, Staphylococcus aureus
AEKENASNKLEMADTTRDD

SEQ ID NO: 1614959 - protein, 22 aa, Staphylococcus aureus
AFDEQEKQNILTRTKEKNDLRI

SEQ ID NO: 1614960 - protein, 4 aa, Staphylococcus aureus
AFNQ

SEQ ID NO: 1614961 - protein, 11 aa, Staphylococcus aureus
AGDKIKDGASW

SEQ ID NO: 1614962 - protein, 6 aa, Staphylococcus aureus
AINENT

SEQ ID NO: 1614963 - protein, 43 aa, Staphylococcus aureus
ANKKEKLALDKSKEALKSSNTELKKAENQYKRTNQRKQDAYQK

SEQ ID NO: 1614964 - protein, 4 aa, Staphylococcus aureus
ANVQ

SEQ ID NO: 1614965 - protein, 13 aa, Staphylococcus aureus
APTAGQEASQLAS

SEQ ID NO: 1614966 - protein, 15 aa, Staphylococcus aureus
AQASSKDLKSMSNQA

SEQ ID NO: 1614967 - protein, 7 aa, Staphylococcus aureus
AQEVKPT

SEQ ID NO: 1614968 - protein, 6 aa, Staphylococcus aureus
ASQADV

SEQ ID NO: 1614969 - protein, 5 aa, Staphylococcus aureus
ATELG

SEQ ID NO: 1614970 - protein, 11 aa, Staphylococcus aureus
CGFDNDSNKGF

SEQ ID NO: 1614971 - protein, 6 aa, Staphylococcus aureus
CGRPHS

SEQ ID NO: 1614972 - protein, 8 aa, Staphylococcus aureus
DEDNEVDD

SEQ ID NO: 1614973 - protein, 5 aa, Staphylococcus aureus
DEKRE

SEQ ID NO: 1614974 - protein, 19 aa, Staphylococcus aureus
DGDWRKQNNITAEIKSTDE

SEQ ID NO: 1614975 - protein, 14 aa, Staphylococcus aureus
DGTTYDTDKDVKKG

SEQ ID NO: 1614976 - protein, 13 aa, Staphylococcus aureus
DIDTHATSNDEDF

SEQ ID NO: 1614977 - protein, 4 aa, Staphylococcus aureus
DKDG

SEQ ID NO: 1614978 - protein, 4 aa, Staphylococcus aureus
DKGK

SEQ ID NO: 1614979 - protein, 5 aa, Staphylococcus aureus
DKSGE

SEQ ID NO: 1614980 - protein, 17 aa, Staphylococcus aureus
DLGAKTSKSANEVAKGM

SEQ ID NO: 1614981 - protein, 9 aa, Staphylococcus aureus
DLKGSSVGY

SEQ ID NO: 1614982 - protein, 5 aa, Staphylococcus aureus
DMHQH

SEQ ID NO: 1614983 - protein, 8 aa, Staphylococcus aureus
DNRYNYQA

SEQ ID NO: 1614984 - protein, 7 aa, Staphylococcus aureus
DPESKEV

SEQ ID NO: 1614985 - protein, 6 aa, Staphylococcus aureus
DQISDG

SEQ ID NO: 1614986 - protein, 12 aa, Staphylococcus aureus
DRGSGNAPGGGV

SEQ ID NO: 1614987 - protein, 4 aa, Staphylococcus aureus
DSNP

SEQ ID NO: 1614988 - protein, 8 aa, Staphylococcus aureus
DTTYPSKD

SEQ ID NO: 1614989 - protein, 11 aa, Staphylococcus aureus
EADTTYPKGTY

SEQ ID NO: 1614990 - protein, 19 aa, Staphylococcus aureus
EAGRANGRSSKLDGPYDGY

SEQ ID NO: 1614991 - protein, 7 aa, Staphylococcus aureus
EAQKENI

SEQ ID NO: 1614992 - protein, 8 aa, Staphylococcus aureus
EAVNPSEN

SEQ ID NO: 1614993 - protein, 7 aa, Staphylococcus aureus
EDEPEID

SEQ ID NO: 1614994 - protein, 5 aa, Staphylococcus aureus
EEKAQ

SEQ ID NO: 1614995 - protein, 14 aa, Staphylococcus aureus
EENGKESSKVDVPQ

SEQ ID NO: 1614996 - protein, 27 aa, Staphylococcus aureus
EENKEETEEKQSEQKVITGTDLRKLFG

SEQ ID NO: 1614997 - protein, 5 aa, Staphylococcus aureus
EGRPC

SEQ ID NO: 1614998 - protein, 8 aa, Staphylococcus aureus
EGTAKSIG

SEQ ID NO: 1614999 - protein, 11 aa, Staphylococcus aureus
EIEAEGDIETG

SEQ ID NO: 1615000 - protein, 25 aa, Staphylococcus aureus
EINEAGRKPDLPFGGYKQSGLGREW

SEQ ID NO: 1615001 - protein, 13 aa, Staphylococcus aureus
EKRNKKELEKTQE

SEQ ID NO: 1615002 - protein, 20 aa, Staphylococcus aureus
ELEAEREAQIARGEMPRYGG

SEQ ID NO: 1615003 - protein, 9 aa, Staphylococcus aureus
ELGKDGSEI

SEQ ID NO: 1615004 - protein, 4 aa, Staphylococcus aureus
ENDL

SEQ ID NO: 1615005 - protein, 20 aa, Staphylococcus aureus
ENKDSSYDLKNDYPSGYSHG

SEQ ID NO: 1615006 - protein, 7 aa, Staphylococcus aureus
ENLTRER

SEQ ID NO: 1615007 - protein, 6 aa, Staphylococcus aureus
ENRKQD

SEQ ID NO: 1615008 - protein, 18 aa, Staphylococcus aureus
EPNVAAKKIKSAVTDSDG

SEQ ID NO: 1615009 - protein, 10 aa, Staphylococcus aureus
EPSDTYPTIS

SEQ ID NO: 1615010 - protein, 7 aa, Staphylococcus aureus
EQKSRHT

SEQ ID NO: 1615011 - protein, 11 aa, Staphylococcus aureus
ERSSARETAAR

SEQ ID NO: 1615012 - protein, 6 aa, Staphylococcus aureus
ESATSH

SEQ ID NO: 1615013 - protein, 15 aa, Staphylococcus aureus
ESQRFKSVNADQPLE

SEQ ID NO: 1615014 - protein, 4 aa, Staphylococcus aureus
ETNT

SEQ ID NO: 1615015 - protein, 12 aa, Staphylococcus aureus
EVEENANQEQLD

SEQ ID NO: 1615016 - protein, 7 aa, Staphylococcus aureus
FKGTDTK

SEQ ID NO: 1615017 - protein, 6 aa, Staphylococcus aureus
FPKTAS

SEQ ID NO: 1615018 - protein, 12 aa, Staphylococcus aureus
FRSGGTKTAPVT

SEQ ID NO: 1615019 - protein, 8 aa, Staphylococcus aureus
FSKSSLDG

SEQ ID NO: 1615020 - protein, 12 aa, Staphylococcus aureus
FSSIGDKMTSLG

SEQ ID NO: 1615021 - protein, 5 aa, Staphylococcus aureus
GAKYR

SEQ ID NO: 1615022 - protein, 12 aa, Staphylococcus aureus
GDGDLKGSSIGH

SEQ ID NO: 1615023 - protein, 5 aa, Staphylococcus aureus
GETYG

SEQ ID NO: 1615024 - protein, 9 aa, Staphylococcus aureus
GGGANATVK

SEQ ID NO: 1615025 - protein, 5 aa, Staphylococcus aureus
GISAQ

SEQ ID NO: 1615026 - protein, 12 aa, Staphylococcus aureus
GKDTDIKAEPEL

SEQ ID NO: 1615027 - protein, 16 aa, Staphylococcus aureus
GKPNNITVNNDTSTVE

SEQ ID NO: 1615028 - protein, 17 aa, Staphylococcus aureus
GLEGKSFEASYNRKNDV

SEQ ID NO: 1615029 - protein, 5 aa, Staphylococcus aureus
GLKSF

SEQ ID NO: 1615030 - protein, 5 aa, Staphylococcus aureus
GSERP

SEQ ID NO: 1615031 - protein, 18 aa, Staphylococcus aureus
GSGSRASDNRQQEVSEIS

SEQ ID NO: 1615032 - protein, 19 aa, Staphylococcus aureus
GSGSRASDNRQQEVSEISR

SEQ ID NO: 1615033 - protein, 6 aa, Staphylococcus aureus
GSHEAE

SEQ ID NO: 1615034 - protein, 11 aa, Staphylococcus aureus
GTASKKASDTV

SEQ ID NO: 1615035 - protein, 6 aa, Staphylococcus aureus
GTEAAS

SEQ ID NO: 1615036 - protein, 10 aa, Staphylococcus aureus
GVGKSTLTQA

SEQ ID NO: 1615037 - protein, 12 aa, Staphylococcus aureus
GYGQDAMDGSYD

SEQ ID NO: 1615038 - protein, 8 aa, Staphylococcus aureus
GYSESVNW

SEQ ID NO: 1615039 - protein, 8 aa, Staphylococcus aureus
HESPEMTS

SEQ ID NO: 1615040 - protein, 8 aa, Staphylococcus aureus
HPTLRQKA

SEQ ID NO: 1615041 - protein, 4 aa, Staphylococcus aureus
HREL

SEQ ID NO: 1615042 - protein, 12 aa, Staphylococcus aureus
IGRTGRAGKEGI

SEQ ID NO: 1615043 - protein, 9 aa, Staphylococcus aureus
IKDASAGSW

SEQ ID NO: 1615044 - protein, 10 aa, Staphylococcus aureus
IKDEPAGEDC

SEQ ID NO: 1615045 - protein, 14 aa, Staphylococcus aureus
IKDTIKKASIASGV

SEQ ID NO: 1615046 - protein, 5 aa, Staphylococcus aureus
IKENF

SEQ ID NO: 1615047 - protein, 14 aa, Staphylococcus aureus
IKEPATEKESEEEP

SEQ ID NO: 1615048 - protein, 5 aa, Staphylococcus aureus
INAND

SEQ ID NO: 1615049 - protein, 4 aa, Staphylococcus aureus
INKP

SEQ ID NO: 1615050 - protein, 13 aa, Staphylococcus aureus
IQKVTGAPVYVGG

SEQ ID NO: 1615051 - protein, 18 aa, Staphylococcus aureus
ISEDEAKKYGLNDEENGQ

SEQ ID NO: 1615052 - protein, 4 aa, Staphylococcus aureus
ISGE

SEQ ID NO: 1615053 - protein, 9 aa, Staphylococcus aureus
ISKKTGVSQ

SEQ ID NO: 1615054 - protein, 13 aa, Staphylococcus aureus
KATVKTMSPEELR

SEQ ID NO: 1615055 - protein, 8 aa, Staphylococcus aureus
KDGELKEV

SEQ ID NO: 1615056 - protein, 8 aa, Staphylococcus aureus
KDKTPIEK

SEQ ID NO: 1615057 - protein, 21 aa, Staphylococcus aureus
KDMGRAAADLGKNVANKAIGG

SEQ ID NO: 1615058 - protein, 13 aa, Staphylococcus aureus
KEAGIYESLLTVN

SEQ ID NO: 1615059 - protein, 10 aa, Staphylococcus aureus
KETTGSEFSS

SEQ ID NO: 1615060 - protein, 4 aa, Staphylococcus aureus
KEVK

SEQ ID NO: 1615061 - protein, 5 aa, Staphylococcus aureus
KEVKQ

SEQ ID NO: 1615062 - protein, 4 aa, Staphylococcus aureus
KEVR

SEQ ID NO: 1615063 - protein, 8 aa, Staphylococcus aureus
KGMTREQK

SEQ ID NO: 1615064 - protein, 13 aa, Staphylococcus aureus
KGYVTKKGKPFSI

SEQ ID NO: 1615065 - protein, 10 aa, Staphylococcus aureus
KIDEDKKEQF

SEQ ID NO: 1615066 - protein, 6 aa, Staphylococcus aureus
KIEPRD

SEQ ID NO: 1615067 - protein, 9 aa, Staphylococcus aureus
KKEQELNQK

SEQ ID NO: 1615068 - protein, 7 aa, Staphylococcus aureus
KKGNPLC

SEQ ID NO: 1615069 - protein, 7 aa, Staphylococcus aureus
KLTPENL

SEQ ID NO: 1615070 - protein, 6 aa, Staphylococcus aureus
KNEDIV

SEQ ID NO: 1615071 - protein, 7 aa, Staphylococcus aureus
KNGPVPV

SEQ ID NO: 1615072 - protein, 9 aa, Staphylococcus aureus
KNNAETEKY

SEQ ID NO: 1615073 - protein, 9 aa, Staphylococcus aureus
KQGTNEVKS

SEQ ID NO: 1615074 - protein, 13 aa, Staphylococcus aureus
KSAHASENADEAL

SEQ ID NO: 1615075 - protein, 6 aa, Staphylococcus aureus
KSMPEL

SEQ ID NO: 1615076 - protein, 7 aa, Staphylococcus aureus
KSQLRTD

SEQ ID NO: 1615077 - protein, 9 aa, Staphylococcus aureus
KTNATVDSL

SEQ ID NO: 1615078 - protein, 20 aa, Staphylococcus aureus
KTSGSGANANKVTITKIMGW

SEQ ID NO: 1615079 - protein, 7 aa, Staphylococcus aureus
KTTKALN

SEQ ID NO: 1615080 - protein, 7 aa, Staphylococcus aureus
KVGAQHP

SEQ ID NO: 1615081 - protein, 18 aa, Staphylococcus aureus
KVSNEETEILKWVDNHVK

SEQ ID NO: 1615082 - protein, 8 aa, Staphylococcus aureus
LDPEKRFN

SEQ ID NO: 1615083 - protein, 5 aa, Staphylococcus aureus
LGQKK

SEQ ID NO: 1615084 - protein, 6 aa, Staphylococcus aureus
LGQKKD

SEQ ID NO: 1615085 - protein, 5 aa, Staphylococcus aureus
LHGSE

SEQ ID NO: 1615086 - protein, 9 aa, Staphylococcus aureus
LKEAAKKCD

SEQ ID NO: 1615087 - protein, 19 aa, Staphylococcus aureus
LKEKADVYPNQLSGGQKQR

SEQ ID NO: 1615088 - protein, 11 aa, Staphylococcus aureus
LKTSADFEGQM

SEQ ID NO: 1615089 - protein, 6 aa, Staphylococcus aureus
LMPEGG

SEQ ID NO: 1615090 - protein, 15 aa, Staphylococcus aureus
LNDKGLTVSGQKIGR

SEQ ID NO: 1615091 - protein, 15 aa, Staphylococcus aureus
LNENEGQAIQTMDQS

SEQ ID NO: 1615092 - protein, 12 aa, Staphylococcus aureus
LPKNENIQAQQK

SEQ ID NO: 1615093 - protein, 13 aa, Staphylococcus aureus
LPLPDDKVNPTQY

SEQ ID NO: 1615094 - protein, 8 aa, Staphylococcus aureus
LQQSNATA

SEQ ID NO: 1615095 - protein, 17 aa, Staphylococcus aureus
LQSQYDKEASIKYGHTK

SEQ ID NO: 1615096 - protein, 5 aa, Staphylococcus aureus
LSGTV

SEQ ID NO: 1615097 - protein, 9 aa, Staphylococcus aureus
LSKTEKEQE

SEQ ID NO: 1615098 - protein, 11 aa, Staphylococcus aureus
LSNTNSKAMKS

SEQ ID NO: 1615099 - protein, 5 aa, Staphylococcus aureus
LTGTF

SEQ ID NO: 1615100 - protein, 13 aa, Staphylococcus aureus
MDRELTQKLENIP

SEQ ID NO: 1615101 - protein, 8 aa, Staphylococcus aureus
NETQPMQG

SEQ ID NO: 1615102 - protein, 4 aa, Staphylococcus aureus
NGLG

SEQ ID NO: 1615103 - protein, 15 aa, Staphylococcus aureus
NGRSQAAVNKSLQSQ

SEQ ID NO: 1615104 - protein, 9 aa, Staphylococcus aureus
NGVEHEGEL

SEQ ID NO: 1615105 - protein, 9 aa, Staphylococcus aureus
NLSKSEKDK

SEQ ID NO: 1615106 - protein, 6 aa, Staphylococcus aureus
NLYQSA

SEQ ID NO: 1615107 - protein, 9 aa, Staphylococcus aureus
NQEFPEISE

SEQ ID NO: 1615108 - protein, 7 aa, Staphylococcus aureus
NQKTSVK

SEQ ID NO: 1615109 - protein, 13 aa, Staphylococcus aureus
NSGLEGSQAGTAL

SEQ ID NO: 1615110 - protein, 18 aa, Staphylococcus aureus
NTANVTSNLKDGSSTEIE

SEQ ID NO: 1615111 - protein, 27 aa, Staphylococcus aureus
NTIKNHSANVAKAETAVNKEKAALNNL

SEQ ID NO: 1615112 - protein, 6 aa, Staphylococcus aureus
NTTDFD

SEQ ID NO: 1615113 - protein, 11 aa, Staphylococcus aureus
NVTSGANPVGL

SEQ ID NO: 1615114 - protein, 8 aa, Staphylococcus aureus
PASAGHGL

SEQ ID NO: 1615115 - protein, 12 aa, Staphylococcus aureus
PELAEDRGIHEG

SEQ ID NO: 1615116 - protein, 4 aa, Staphylococcus aureus
PGTE

SEQ ID NO: 1615117 - protein, 16 aa, Staphylococcus aureus
PMRGGLPNKEPQIQEK

SEQ ID NO: 1615118 - protein, 6 aa, Staphylococcus aureus
PSTITG

SEQ ID NO: 1615119 - protein, 7 aa, Staphylococcus aureus
QDGEHHR

SEQ ID NO: 1615120 - protein, 6 aa, Staphylococcus aureus
QDMKNE

SEQ ID NO: 1615121 - protein, 10 aa, Staphylococcus aureus
QEQTAEAVKE

SEQ ID NO: 1615122 - protein, 6 aa, Staphylococcus aureus
QGINVG

SEQ ID NO: 1615123 - protein, 14 aa, Staphylococcus aureus
QGIPKNIYYKNQRI

SEQ ID NO: 1615124 - protein, 6 aa, Staphylococcus aureus
QHYHQT

SEQ ID NO: 1615125 - protein, 10 aa, Staphylococcus aureus
QINDTPKTEL

SEQ ID NO: 1615126 - protein, 16 aa, Staphylococcus aureus
QPGLSPRALKEKYGIE

SEQ ID NO: 1615127 - protein, 7 aa, Staphylococcus aureus
QQQDTYL

SEQ ID NO: 1615128 - protein, 5 aa, Staphylococcus aureus
QQRTL

SEQ ID NO: 1615129 - protein, 6 aa, Staphylococcus aureus
QSAGSM

SEQ ID NO: 1615130 - protein, 5 aa, Staphylococcus aureus
QSEIS

SEQ ID NO: 1615131 - protein, 5 aa, Staphylococcus aureus
QTLPN

SEQ ID NO: 1615132 - protein, 5 aa, Staphylococcus aureus
QTMEA

SEQ ID NO: 1615133 - protein, 13 aa, Staphylococcus aureus
QTTGGSLSSSQQQ

SEQ ID NO: 1615134 - protein, 7 aa, Staphylococcus aureus
RDPHDSR

SEQ ID NO: 1615135 - protein, 12 aa, Staphylococcus aureus
RGGLGKKKNRRT

SEQ ID NO: 1615136 - protein, 14 aa, Staphylococcus aureus
RKDGSPLKQETFRG

SEQ ID NO: 1615137 - protein, 5 aa, Staphylococcus aureus
RKITK

SEQ ID NO: 1615138 - protein, 4 aa, Staphylococcus aureus
RKSY

SEQ ID NO: 1615139 - protein, 4 aa, Staphylococcus aureus
RMGP

SEQ ID NO: 1615140 - protein, 24 aa, Staphylococcus aureus
RQQDPPKNKTRQAYEDVIEWVGPK

SEQ ID NO: 1615141 - protein, 10 aa, Staphylococcus aureus
RSANDSAADI

SEQ ID NO: 1615142 - protein, 4 aa, Staphylococcus aureus
SAVA

SEQ ID NO: 1615143 - protein, 7 aa, Staphylococcus aureus
SAVARRA

SEQ ID NO: 1615144 - protein, 5 aa, Staphylococcus aureus
SEEPT

SEQ ID NO: 1615145 - protein, 4 aa, Staphylococcus aureus
SGLQ

SEQ ID NO: 1615146 - protein, 8 aa, Staphylococcus aureus
SGRTGDIS

SEQ ID NO: 1615147 - protein, 7 aa, Staphylococcus aureus
SKAITDK

SEQ ID NO: 1615148 - protein, 5 aa, Staphylococcus aureus
SKNAD

SEQ ID NO: 1615149 - protein, 7 aa, Staphylococcus aureus
SKNPALR

SEQ ID NO: 1615150 - protein, 18 aa, Staphylococcus aureus
SKQSGHRANANNYMGGLT

SEQ ID NO: 1615151 - protein, 16 aa, Staphylococcus aureus
SKSDVEKTLNKPKRVT

SEQ ID NO: 1615152 - protein, 20 aa, Staphylococcus aureus
SLEPEQLNEKTLNDMRSGSE

SEQ ID NO: 1615153 - protein, 6 aa, Staphylococcus aureus
SNEFNT

SEQ ID NO: 1615154 - protein, 4 aa, Staphylococcus aureus
SNRE

SEQ ID NO: 1615155 - protein, 4 aa, Staphylococcus aureus
SPGF

SEQ ID NO: 1615156 - protein, 8 aa, Staphylococcus aureus
SPKKGRAL

SEQ ID NO: 1615157 - protein, 4 aa, Staphylococcus aureus
SPQQ

SEQ ID NO: 1615158 - protein, 14 aa, Staphylococcus aureus
SQRFKSVNADQPLE

SEQ ID NO: 1615159 - protein, 4 aa, Staphylococcus aureus
SQVE

SEQ ID NO: 1615160 - protein, 5 aa, Staphylococcus aureus
SSNPI

SEQ ID NO: 1615161 - protein, 7 aa, Staphylococcus aureus
SSQPITI

SEQ ID NO: 1615162 - protein, 19 aa, Staphylococcus aureus
STGFTGDEQAYKDHGGPHK

SEQ ID NO: 1615163 - protein, 27 aa, Staphylococcus aureus
SVKSTTGSIYNQTKQKYSDASDKAWAH

SEQ ID NO: 1615164 - protein, 8 aa, Staphylococcus aureus
SYDNQRQH

SEQ ID NO: 1615165 - protein, 6 aa, Staphylococcus aureus
TADLEK

SEQ ID NO: 1615166 - protein, 8 aa, Staphylococcus aureus
TDTVSATV

SEQ ID NO: 1615167 - protein, 17 aa, Staphylococcus aureus
TDYGGGNSIQIKTGANE

SEQ ID NO: 1615168 - protein, 8 aa, Staphylococcus aureus
TEQPSDTR

SEQ ID NO: 1615169 - protein, 5 aa, Staphylococcus aureus
TEVPA

SEQ ID NO: 1615170 - protein, 8 aa, Staphylococcus aureus
TFHAPQGR

SEQ ID NO: 1615171 - protein, 4 aa, Staphylococcus aureus
TGYE

SEQ ID NO: 1615172 - protein, 4 aa, Staphylococcus aureus
TIDQ

SEQ ID NO: 1615173 - protein, 9 aa, Staphylococcus aureus
TKSSRTSLT

SEQ ID NO: 1615174 - protein, 19 aa, Staphylococcus aureus
TMDDAVSDVSSLDEDGAIS

SEQ ID NO: 1615175 - protein, 14 aa, Staphylococcus aureus
TRNGSSEKFDVTKD

SEQ ID NO: 1615176 - protein, 13 aa, Staphylococcus aureus
TYEYKEKPYEKDY

SEQ ID NO: 1615177 - protein, 7 aa, Staphylococcus aureus
VATGNYS

SEQ ID NO: 1615178 - protein, 11 aa, Staphylococcus aureus
VFDGSKPIDFE

SEQ ID NO: 1615179 - protein, 11 aa, Staphylococcus aureus
VGVGKSTLTQA

SEQ ID NO: 1615180 - protein, 15 aa, Staphylococcus aureus
VKDTEIKNGKKVKKT

SEQ ID NO: 1615181 - protein, 16 aa, Staphylococcus aureus
VKGNNVRDGYSTNSRI

SEQ ID NO: 1615182 - protein, 12 aa, Staphylococcus aureus
VKKQDKDKNTTL

SEQ ID NO: 1615183 - protein, 4 aa, Staphylococcus aureus
VLST

SEQ ID NO: 1615184 - protein, 7 aa, Staphylococcus aureus
VSKETSV

SEQ ID NO: 1615185 - protein, 12 aa, Staphylococcus aureus
VSKPKKSSRSEE

SEQ ID NO: 1615186 - protein, 15 aa, Staphylococcus aureus
VTAAINNDGAKLGTS

SEQ ID NO: 1615187 - protein, 5 aa, Staphylococcus aureus
VTDDE

SEQ ID NO: 1615188 - protein, 6 aa, Staphylococcus aureus
VTENNK

SEQ ID NO: 1615189 - protein, 9 aa, Staphylococcus aureus
YAGTPAKAL

SEQ ID NO: 1615190 - protein, 7 aa, Staphylococcus aureus
YDVPVEE

SEQ ID NO: 1615191 - protein, 9 aa, Staphylococcus aureus
YKQEGNQVQ

SEQ ID NO: 1615192 - protein, 9 aa, Staphylococcus aureus
YPKIPRAKP

SEQ ID NO: 1615193 - protein, 7 aa, Staphylococcus aureus
YVRPSES

SEQ ID NO: 1615194 - protein, 13 aa, Staphylococcus aureus
AAEGYARVSGKTG

SEQ ID NO: 1615195 - protein, 7 aa, Staphylococcus aureus
AATNAAN

SEQ ID NO: 1615196 - protein, 5 aa, Staphylococcus aureus
AENPY

SEQ ID NO: 1615197 - protein, 6 aa, Staphylococcus aureus
AENPYK

SEQ ID NO: 1615198 - protein, 18 aa, Staphylococcus aureus
AESKEEAKEKYEKQVKRD

SEQ ID NO: 1615199 - protein, 9 aa, Staphylococcus aureus
AETSRKQKQ

SEQ ID NO: 1615200 - protein, 11 aa, Staphylococcus aureus
AGEEKEQEGAK

SEQ ID NO: 1615201 - protein, 4 aa, Staphylococcus aureus
APQI

SEQ ID NO: 1615202 - protein, 12 aa, Staphylococcus aureus
ARIDAGEHKEDA

SEQ ID NO: 1615203 - protein, 5 aa, Staphylococcus aureus
ASEHN

SEQ ID NO: 1615204 - protein, 7 aa, Staphylococcus aureus
ASIGRTA

SEQ ID NO: 1615205 - protein, 9 aa, Staphylococcus aureus
ATNNHTPIE

SEQ ID NO: 1615206 - protein, 7 aa, Staphylococcus aureus
ATRKAEV

SEQ ID NO: 1615207 - protein, 5 aa, Staphylococcus aureus
ATTKT

SEQ ID NO: 1615208 - protein, 9 aa, Staphylococcus aureus
DAGNQDNWT

SEQ ID NO: 1615209 - protein, 5 aa, Staphylococcus aureus
DEAIE

SEQ ID NO: 1615210 - protein, 9 aa, Staphylococcus aureus
DEASLDQTY

SEQ ID NO: 1615211 - protein, 5 aa, Staphylococcus aureus
DEAYT

SEQ ID NO: 1615212 - protein, 6 aa, Staphylococcus aureus
DEAYTQ

SEQ ID NO: 1615213 - protein, 10 aa, Staphylococcus aureus
DEKTTQEFSK

SEQ ID NO: 1615214 - protein, 7 aa, Staphylococcus aureus
DENTGAI

SEQ ID NO: 1615215 - protein, 7 aa, Staphylococcus aureus
DFKDDKD

SEQ ID NO: 1615216 - protein, 5 aa, Staphylococcus aureus
DGKIA

SEQ ID NO: 1615217 - protein, 12 aa, Staphylococcus aureus
DGPNTKEIQQNH

SEQ ID NO: 1615218 - protein, 9 aa, Staphylococcus aureus
DGRLTSAHG

SEQ ID NO: 1615219 - protein, 4 aa, Staphylococcus aureus
DIAQ

SEQ ID NO: 1615220 - protein, 4 aa, Staphylococcus aureus
DILP

SEQ ID NO: 1615221 - protein, 8 aa, Staphylococcus aureus
DKEDIKAQ

SEQ ID NO: 1615222 - protein, 7 aa, Staphylococcus aureus
DKGNKLT

SEQ ID NO: 1615223 - protein, 14 aa, Staphylococcus aureus
DLRADQSKEEFDKA

SEQ ID NO: 1615224 - protein, 8 aa, Staphylococcus aureus
DNSGRNQY

SEQ ID NO: 1615225 - protein, 5 aa, Staphylococcus aureus
DNTYI

SEQ ID NO: 1615226 - protein, 5 aa, Staphylococcus aureus
DQQTE

SEQ ID NO: 1615227 - protein, 10 aa, Staphylococcus aureus
DQTAIDNAKE

SEQ ID NO: 1615228 - protein, 9 aa, Staphylococcus aureus
DRDDQPDLE

SEQ ID NO: 1615229 - protein, 7 aa, Staphylococcus aureus
DRETNQR

SEQ ID NO: 1615230 - protein, 7 aa, Staphylococcus aureus
DTTYPSK

SEQ ID NO: 1615231 - protein, 6 aa, Staphylococcus aureus
DTTYQP

SEQ ID NO: 1615232 - protein, 24 aa, Staphylococcus aureus
DWSEKRRKGLNDKPVIAEGKHSPI

SEQ ID NO: 1615233 - protein, 12 aa, Staphylococcus aureus
DYFDEKNVSVGK

SEQ ID NO: 1615234 - protein, 7 aa, Staphylococcus aureus
DYKKSDD

SEQ ID NO: 1615235 - protein, 18 aa, Staphylococcus aureus
EAAKEEGKVSKFGGKVPA

SEQ ID NO: 1615236 - protein, 7 aa, Staphylococcus aureus
EDDAPCV

SEQ ID NO: 1615237 - protein, 7 aa, Staphylococcus aureus
EDDVEGV

SEQ ID NO: 1615238 - protein, 14 aa, Staphylococcus aureus
EDGHASQRICQTIF

SEQ ID NO: 1615239 - protein, 11 aa, Staphylococcus aureus
EEGHRQSVEGE

SEQ ID NO: 1615240 - protein, 6 aa, Staphylococcus aureus
EESQGQ

SEQ ID NO: 1615241 - protein, 12 aa, Staphylococcus aureus
EFGERTTRLEAK

SEQ ID NO: 1615242 - protein, 7 aa, Staphylococcus aureus
EGMPQED

SEQ ID NO: 1615243 - protein, 7 aa, Staphylococcus aureus
EHHTSTD

SEQ ID NO: 1615244 - protein, 7 aa, Staphylococcus aureus
EHKPDAY

SEQ ID NO: 1615245 - protein, 10 aa, Staphylococcus aureus
EIKYTQSKQH

SEQ ID NO: 1615246 - protein, 7 aa, Staphylococcus aureus
EKSNDWD

SEQ ID NO: 1615247 - protein, 4 aa, Staphylococcus aureus
EKST

SEQ ID NO: 1615248 - protein, 11 aa, Staphylococcus aureus
ELAEDRGIHEG

SEQ ID NO: 1615249 - protein, 21 aa, Staphylococcus aureus
ELEAEREAQIARGEMPRYGGQ

SEQ ID NO: 1615250 - protein, 6 aa, Staphylococcus aureus
EPKPQH

SEQ ID NO: 1615251 - protein, 7 aa, Staphylococcus aureus
EPLKPNH

SEQ ID NO: 1615252 - protein, 5 aa, Staphylococcus aureus
EPVSL

SEQ ID NO: 1615253 - protein, 4 aa, Staphylococcus aureus
EQAI

SEQ ID NO: 1615254 - protein, 4 aa, Staphylococcus aureus
EQLE

SEQ ID NO: 1615255 - protein, 5 aa, Staphylococcus aureus
EQWGS

SEQ ID NO: 1615256 - protein, 22 aa, Staphylococcus aureus
ESDNIGEQVRNGLQEKAKQGRL

SEQ ID NO: 1615257 - protein, 8 aa, Staphylococcus aureus
ESLRKVKG

SEQ ID NO: 1615258 - protein, 10 aa, Staphylococcus aureus
ESSNNQKTID

SEQ ID NO: 1615259 - protein, 4 aa, Staphylococcus aureus
ETKE

SEQ ID NO: 1615260 - protein, 21 aa, Staphylococcus aureus
ETKTQINKEETIRELNKTKQE

SEQ ID NO: 1615261 - protein, 11 aa, Staphylococcus aureus
ETSFEEEGKTL

SEQ ID NO: 1615262 - protein, 9 aa, Staphylococcus aureus
ETTGSEFSS

SEQ ID NO: 1615263 - protein, 7 aa, Staphylococcus aureus
EVNTSSG

SEQ ID NO: 1615264 - protein, 9 aa, Staphylococcus aureus
EVTAEEVNQ

SEQ ID NO: 1615265 - protein, 14 aa, Staphylococcus aureus
EVTAEEVNQAFENA

SEQ ID NO: 1615266 - protein, 9 aa, Staphylococcus aureus
FNEPGTPFD

SEQ ID NO: 1615267 - protein, 18 aa, Staphylococcus aureus
FNPRGGWSPSGPRRYANG

SEQ ID NO: 1615268 - protein, 6 aa, Staphylococcus aureus
FTPETK

SEQ ID NO: 1615269 - protein, 6 aa, Staphylococcus aureus
GAAPDL

SEQ ID NO: 1615270 - protein, 9 aa, Staphylococcus aureus
GGANGVGTT

SEQ ID NO: 1615271 - protein, 7 aa, Staphylococcus aureus
GGDISRK

SEQ ID NO: 1615272 - protein, 8 aa, Staphylococcus aureus
GGDISRKR

SEQ ID NO: 1615273 - protein, 5 aa, Staphylococcus aureus
GIIES

SEQ ID NO: 1615274 - protein, 7 aa, Staphylococcus aureus
GINGEIR

SEQ ID NO: 1615275 - protein, 5 aa, Staphylococcus aureus
GITAP

SEQ ID NO: 1615276 - protein, 14 aa, Staphylococcus aureus
GKGTFVKEQDSSIL

SEQ ID NO: 1615277 - protein, 5 aa, Staphylococcus aureus
GKQFN

SEQ ID NO: 1615278 - protein, 4 aa, Staphylococcus aureus
GPEP

SEQ ID NO: 1615279 - protein, 8 aa, Staphylococcus aureus
GPQGVGKS

SEQ ID NO: 1615280 - protein, 8 aa, Staphylococcus aureus
GSGKGHFT

SEQ ID NO: 1615281 - protein, 15 aa, Staphylococcus aureus
GSHPGNDTAKDPEKW

SEQ ID NO: 1615282 - protein, 8 aa, Staphylococcus aureus
GSSGLSAT

SEQ ID NO: 1615283 - protein, 4 aa, Staphylococcus aureus
GSVR

SEQ ID NO: 1615284 - protein, 6 aa, Staphylococcus aureus
GTGGHT

SEQ ID NO: 1615285 - protein, 8 aa, Staphylococcus aureus
GTQSYETF

SEQ ID NO: 1615286 - protein, 12 aa, Staphylococcus aureus
GVFDGSKPIDFE

SEQ ID NO: 1615287 - protein, 13 aa, Staphylococcus aureus
GYGQDAMDGSYDG

SEQ ID NO: 1615288 - protein, 4 aa, Staphylococcus aureus
GYKN

SEQ ID NO: 1615289 - protein, 4 aa, Staphylococcus aureus
GYQP

SEQ ID NO: 1615290 - protein, 5 aa, Staphylococcus aureus
GYQPE

SEQ ID NO: 1615291 - protein, 13 aa, Staphylococcus aureus
GYTRDGKKYTPRG

SEQ ID NO: 1615292 - protein, 4 aa, Staphylococcus aureus
HDPL

SEQ ID NO: 1615293 - protein, 5 aa, Staphylococcus aureus
HDQDQ

SEQ ID NO: 1615294 - protein, 5 aa, Staphylococcus aureus
HDSND

SEQ ID NO: 1615295 - protein, 7 aa, Staphylococcus aureus
HNTDPVS

SEQ ID NO: 1615296 - protein, 7 aa, Staphylococcus aureus
HPTLRQK

SEQ ID NO: 1615297 - protein, 15 aa, Staphylococcus aureus
HQKGSMRSNDNGDDM

SEQ ID NO: 1615298 - protein, 6 aa, Staphylococcus aureus
HQSTSD

SEQ ID NO: 1615299 - protein, 7 aa, Staphylococcus aureus
HQSTSDL

SEQ ID NO: 1615300 - protein, 5 aa, Staphylococcus aureus
HREIS

SEQ ID NO: 1615301 - protein, 8 aa, Staphylococcus aureus
HSGKTKDA

SEQ ID NO: 1615302 - protein, 5 aa, Staphylococcus aureus
HYHQT

SEQ ID NO: 1615303 - protein, 8 aa, Staphylococcus aureus
IEDNPDLT

SEQ ID NO: 1615304 - protein, 7 aa, Staphylococcus aureus
IEEAKAS

SEQ ID NO: 1615305 - protein, 8 aa, Staphylococcus aureus
IEEAKASI

SEQ ID NO: 1615306 - protein, 4 aa, Staphylococcus aureus
IKAQ

SEQ ID NO: 1615307 - protein, 19 aa, Staphylococcus aureus
IKQRSERQKQRNTAIENSK

SEQ ID NO: 1615308 - protein, 9 aa, Staphylococcus aureus
INNQEIENI

SEQ ID NO: 1615309 - protein, 4 aa, Staphylococcus aureus
IPST

SEQ ID NO: 1615310 - protein, 7 aa, Staphylococcus aureus
IRNEKGN

SEQ ID NO: 1615311 - protein, 7 aa, Staphylococcus aureus
IRQGQNK

SEQ ID NO: 1615312 - protein, 6 aa, Staphylococcus aureus
ITKYTN

SEQ ID NO: 1615313 - protein, 4 aa, Staphylococcus aureus
IYSD

SEQ ID NO: 1615314 - protein, 11 aa, Staphylococcus aureus
KDKGDSRGSME

SEQ ID NO: 1615315 - protein, 9 aa, Staphylococcus aureus
KDSIQKGDQ

SEQ ID NO: 1615316 - protein, 8 aa, Staphylococcus aureus
KEAAKKCD

SEQ ID NO: 1615317 - protein, 10 aa, Staphylococcus aureus
KEDAAELANK

SEQ ID NO: 1615318 - protein, 10 aa, Staphylococcus aureus
KEGKRRAGQV

SEQ ID NO: 1615319 - protein, 9 aa, Staphylococcus aureus
KEKHPDADK

SEQ ID NO: 1615320 - protein, 6 aa, Staphylococcus aureus
KELGQK

SEQ ID NO: 1615321 - protein, 6 aa, Staphylococcus aureus
KERGIK

SEQ ID NO: 1615322 - protein, 17 aa, Staphylococcus aureus
KGDVSDIKTTFKFPFIY

SEQ ID NO: 1615323 - protein, 12 aa, Staphylococcus aureus
KGLFPESELVAW

SEQ ID NO: 1615324 - protein, 6 aa, Staphylococcus aureus
KGSERP

SEQ ID NO: 1615325 - protein, 11 aa, Staphylococcus aureus
KGVSKETEKAL

SEQ ID NO: 1615326 - protein, 19 aa, Staphylococcus aureus
KGYVDTTIKKSSNGGPRRK

SEQ ID NO: 1615327 - protein, 13 aa, Staphylococcus aureus
KIDEAKNEGDSIG

SEQ ID NO: 1615328 - protein, 8 aa, Staphylococcus aureus
KKDGNHKK

SEQ ID NO: 1615329 - protein, 16 aa, Staphylococcus aureus
KKQVSQKPQVHGKGTN

SEQ ID NO: 1615330 - protein, 20 aa, Staphylococcus aureus
KKYHPDINKEEGADEKFKEI

SEQ ID NO: 1615331 - protein, 21 aa, Staphylococcus aureus
KKYHPDINKEEGADEKFKEIS

SEQ ID NO: 1615332 - protein, 6 aa, Staphylococcus aureus
KLSDKL

SEQ ID NO: 1615333 - protein, 12 aa, Staphylococcus aureus
KMSRRKKTAAKK

SEQ ID NO: 1615334 - protein, 5 aa, Staphylococcus aureus
KNKLD

SEQ ID NO: 1615335 - protein, 8 aa, Staphylococcus aureus
KNMPSKTQ

SEQ ID NO: 1615336 - protein, 8 aa, Staphylococcus aureus
KPKSTISE

SEQ ID NO: 1615337 - protein, 6 aa, Staphylococcus aureus
KPTYGR

SEQ ID NO: 1615338 - protein, 14 aa, Staphylococcus aureus
KQKSKKTREKVDKA

SEQ ID NO: 1615339 - protein, 20 aa, Staphylococcus aureus
KQNKDIDKEMDLSSGRVYKN

SEQ ID NO: 1615340 - protein, 7 aa, Staphylococcus aureus
KQQQYDE

SEQ ID NO: 1615341 - protein, 14 aa, Staphylococcus aureus
KSAHASENADEALN

SEQ ID NO: 1615342 - protein, 8 aa, Staphylococcus aureus
KSDTSTIK

SEQ ID NO: 1615343 - protein, 9 aa, Staphylococcus aureus
KSGTTTEPA

SEQ ID NO: 1615344 - protein, 6 aa, Staphylococcus aureus
KVEQRL

SEQ ID NO: 1615345 - protein, 10 aa, Staphylococcus aureus
KVPSRRRDEK

SEQ ID NO: 1615346 - protein, 4 aa, Staphylococcus aureus
LDNQ

SEQ ID NO: 1615347 - protein, 15 aa, Staphylococcus aureus
LEESYESEKKRIENE

SEQ ID NO: 1615348 - protein, 5 aa, Staphylococcus aureus
LERTG

SEQ ID NO: 1615349 - protein, 6 aa, Staphylococcus aureus
LERTGL

SEQ ID NO: 1615350 - protein, 5 aa, Staphylococcus aureus
LGPEP

SEQ ID NO: 1615351 - protein, 4 aa, Staphylococcus aureus
LHGS

SEQ ID NO: 1615352 - protein, 18 aa, Staphylococcus aureus
LKNKNDELSQKATDPNID

SEQ ID NO: 1615353 - protein, 7 aa, Staphylococcus aureus
LNNNEKR

SEQ ID NO: 1615354 - protein, 8 aa, Staphylococcus aureus
LNNNEKRA

SEQ ID NO: 1615355 - protein, 14 aa, Staphylococcus aureus
LNSPFETMDIGSVL

SEQ ID NO: 1615356 - protein, 17 aa, Staphylococcus aureus
LPRSQMGVDTEDNYEPK

SEQ ID NO: 1615357 - protein, 4 aa, Staphylococcus aureus
LPTI

SEQ ID NO: 1615358 - protein, 5 aa, Staphylococcus aureus
LQQMG

SEQ ID NO: 1615359 - protein, 14 aa, Staphylococcus aureus
LRDGDTEREDDVNY

SEQ ID NO: 1615360 - protein, 7 aa, Staphylococcus aureus
LTPETDN

SEQ ID NO: 1615361 - protein, 4 aa, Staphylococcus aureus
MDSI

SEQ ID NO: 1615362 - protein, 4 aa, Staphylococcus aureus
NACK

SEQ ID NO: 1615363 - protein, 11 aa, Staphylococcus aureus
NDNVKASIEGK

SEQ ID NO: 1615364 - protein, 16 aa, Staphylococcus aureus
NELDAEANTVDEYKEN

SEQ ID NO: 1615365 - protein, 17 aa, Staphylococcus aureus
NELDAEANTVDEYKENL

SEQ ID NO: 1615366 - protein, 8 aa, Staphylococcus aureus
NGEDLDKH

SEQ ID NO: 1615367 - protein, 8 aa, Staphylococcus aureus
NKVGAQHP

SEQ ID NO: 1615368 - protein, 7 aa, Staphylococcus aureus
NKVPGVR

SEQ ID NO: 1615369 - protein, 13 aa, Staphylococcus aureus
NLATGEKVEVGEA

SEQ ID NO: 1615370 - protein, 9 aa, Staphylococcus aureus
NLNNGRYQG

SEQ ID NO: 1615371 - protein, 5 aa, Staphylococcus aureus
NLYQS

SEQ ID NO: 1615372 - protein, 5 aa, Staphylococcus aureus
NNNNE

SEQ ID NO: 1615373 - protein, 5 aa, Staphylococcus aureus
NQYGQ

SEQ ID NO: 1615374 - protein, 5 aa, Staphylococcus aureus
NRQPY

SEQ ID NO: 1615375 - protein, 6 aa, Staphylococcus aureus
NSDGAV

SEQ ID NO: 1615376 - protein, 7 aa, Staphylococcus aureus
NSDGAVK

SEQ ID NO: 1615377 - protein, 11 aa, Staphylococcus aureus
NTQTNEDIETQ

SEQ ID NO: 1615378 - protein, 9 aa, Staphylococcus aureus
NVVPTGVPR

SEQ ID NO: 1615379 - protein, 4 aa, Staphylococcus aureus
PEDH

SEQ ID NO: 1615380 - protein, 7 aa, Staphylococcus aureus
PGTRGVP

SEQ ID NO: 1615381 - protein, 4 aa, Staphylococcus aureus
PNGQ

SEQ ID NO: 1615382 - protein, 7 aa, Staphylococcus aureus
PNKHVSK

SEQ ID NO: 1615383 - protein, 8 aa, Staphylococcus aureus
PNKHVSKK

SEQ ID NO: 1615384 - protein, 9 aa, Staphylococcus aureus
PNNDENIKP

SEQ ID NO: 1615385 - protein, 12 aa, Staphylococcus aureus
PQASDSDKLDGL

SEQ ID NO: 1615386 - protein, 10 aa, Staphylococcus aureus
PQPAPADHPW

SEQ ID NO: 1615387 - protein, 11 aa, Staphylococcus aureus
PRDKNAAKQRA

SEQ ID NO: 1615388 - protein, 16 aa, Staphylococcus aureus
PRSQMGVDTEDNYEPK

SEQ ID NO: 1615389 - protein, 9 aa, Staphylococcus aureus
PSKHISSNE

SEQ ID NO: 1615390 - protein, 4 aa, Staphylococcus aureus
PTHQ

SEQ ID NO: 1615391 - protein, 5 aa, Staphylococcus aureus
PTYGR

SEQ ID NO: 1615392 - protein, 13 aa, Staphylococcus aureus
QDKLENSNGEHTA

SEQ ID NO: 1615393 - protein, 7 aa, Staphylococcus aureus
QGNPAKG

SEQ ID NO: 1615394 - protein, 4 aa, Staphylococcus aureus
QGSV

SEQ ID NO: 1615395 - protein, 10 aa, Staphylococcus aureus
QLETEKAGLQ

SEQ ID NO: 1615396 - protein, 8 aa, Staphylococcus aureus
QLKSKKVR

SEQ ID NO: 1615397 - protein, 9 aa, Staphylococcus aureus
QLKSKKVRS

SEQ ID NO: 1615398 - protein, 7 aa, Staphylococcus aureus
QNESPTV

SEQ ID NO: 1615399 - protein, 4 aa, Staphylococcus aureus
QQKN

SEQ ID NO: 1615400 - protein, 13 aa, Staphylococcus aureus
QRTNKKQKITRST

SEQ ID NO: 1615401 - protein, 10 aa, Staphylococcus aureus
QSLTDKPVKG

SEQ ID NO: 1615402 - protein, 5 aa, Staphylococcus aureus
QTEYN

SEQ ID NO: 1615403 - protein, 6 aa, Staphylococcus aureus
QVAKDT

SEQ ID NO: 1615404 - protein, 7 aa, Staphylococcus aureus
RDETGGR

SEQ ID NO: 1615405 - protein, 7 aa, Staphylococcus aureus
RERNEEL

SEQ ID NO: 1615406 - protein, 13 aa, Staphylococcus aureus
RFRSGGTKTAPVT

SEQ ID NO: 1615407 - protein, 5 aa, Staphylococcus aureus
RIATD

SEQ ID NO: 1615408 - protein, 8 aa, Staphylococcus aureus
RKRPATAK

SEQ ID NO: 1615409 - protein, 12 aa, Staphylococcus aureus
RQAITNPNTVQS

SEQ ID NO: 1615410 - protein, 13 aa, Staphylococcus aureus
RSIDKASSEMKTF

SEQ ID NO: 1615411 - protein, 10 aa, Staphylococcus aureus
RSSSAEETNA

SEQ ID NO: 1615412 - protein, 8 aa, Staphylococcus aureus
RTGESDSS

SEQ ID NO: 1615413 - protein, 11 aa, Staphylococcus aureus
SADVGTTVVGA

SEQ ID NO: 1615414 - protein, 5 aa, Staphylococcus aureus
SAKQF

SEQ ID NO: 1615415 - protein, 5 aa, Staphylococcus aureus
SEGYT

SEQ ID NO: 1615416 - protein, 8 aa, Staphylococcus aureus
SGINGEIR

SEQ ID NO: 1615417 - protein, 14 aa, Staphylococcus aureus
SHKKISKKEANNLA

SEQ ID NO: 1615418 - protein, 9 aa, Staphylococcus aureus
SHNPKDYNG

SEQ ID NO: 1615419 - protein, 9 aa, Staphylococcus aureus
SIARSGRGT

SEQ ID NO: 1615420 - protein, 6 aa, Staphylococcus aureus
SISSQV

SEQ ID NO: 1615421 - protein, 7 aa, Staphylococcus aureus
SKGIEPR

SEQ ID NO: 1615422 - protein, 24 aa, Staphylococcus aureus
SKGSLAGVDGRLQTRNYENKEGQR

SEQ ID NO: 1615423 - protein, 10 aa, Staphylococcus aureus
SKNITKETHT

SEQ ID NO: 1615424 - protein, 6 aa, Staphylococcus aureus
SKQPLT

SEQ ID NO: 1615425 - protein, 12 aa, Staphylococcus aureus
SNDNVKASIEGK

SEQ ID NO: 1615426 - protein, 6 aa, Staphylococcus aureus
SNVKPG

SEQ ID NO: 1615427 - protein, 5 aa, Staphylococcus aureus
SPYTN

SEQ ID NO: 1615428 - protein, 4 aa, Staphylococcus aureus
SQKL

SEQ ID NO: 1615429 - protein, 21 aa, Staphylococcus aureus
SQRGSGANANRGTINKIIGVR

SEQ ID NO: 1615430 - protein, 10 aa, Staphylococcus aureus
SRRKKTAAKK

SEQ ID NO: 1615431 - protein, 4 aa, Staphylococcus aureus
SSNM

SEQ ID NO: 1615432 - protein, 18 aa, Staphylococcus aureus
STGFTGDEQAYKDHGGPH

SEQ ID NO: 1615433 - protein, 5 aa, Staphylococcus aureus
STNQV

SEQ ID NO: 1615434 - protein, 13 aa, Staphylococcus aureus
STTGKTSKGFKGL

SEQ ID NO: 1615435 - protein, 7 aa, Staphylococcus aureus
SYVNGKE

SEQ ID NO: 1615436 - protein, 12 aa, Staphylococcus aureus
TAGEEKEQEGAK

SEQ ID NO: 1615437 - protein, 6 aa, Staphylococcus aureus
TCGNRE

SEQ ID NO: 1615438 - protein, 4 aa, Staphylococcus aureus
TDDE

SEQ ID NO: 1615439 - protein, 8 aa, Staphylococcus aureus
TEKQCQDI

SEQ ID NO: 1615440 - protein, 4 aa, Staphylococcus aureus
TEVP

SEQ ID NO: 1615441 - protein, 12 aa, Staphylococcus aureus
TFKSPKSQRFKS

SEQ ID NO: 1615442 - protein, 9 aa, Staphylococcus aureus
TGNHNNDSR

SEQ ID NO: 1615443 - protein, 5 aa, Staphylococcus aureus
TIDCP

SEQ ID NO: 1615444 - protein, 12 aa, Staphylococcus aureus
TIKQTAPKVEGD

SEQ ID NO: 1615445 - protein, 5 aa, Staphylococcus aureus
TMDSI

SEQ ID NO: 1615446 - protein, 6 aa, Staphylococcus aureus
TNKENT

SEQ ID NO: 1615447 - protein, 6 aa, Staphylococcus aureus
TNLNQN

SEQ ID NO: 1615448 - protein, 4 aa, Staphylococcus aureus
TPDA

SEQ ID NO: 1615449 - protein, 6 aa, Staphylococcus aureus
TPIPSN

SEQ ID NO: 1615450 - protein, 5 aa, Staphylococcus aureus
TSEHP

SEQ ID NO: 1615451 - protein, 5 aa, Staphylococcus aureus
TSGQQ

SEQ ID NO: 1615452 - protein, 6 aa, Staphylococcus aureus
TSGQQL

SEQ ID NO: 1615453 - protein, 9 aa, Staphylococcus aureus
TSKGTFKAS

SEQ ID NO: 1615454 - protein, 4 aa, Staphylococcus aureus
TTTV

SEQ ID NO: 1615455 - protein, 5 aa, Staphylococcus aureus
VDEKT

SEQ ID NO: 1615456 - protein, 18 aa, Staphylococcus aureus
VDKDDPRFDNPTKPIGPF

SEQ ID NO: 1615457 - protein, 7 aa, Staphylococcus aureus
VDNTEGK

SEQ ID NO: 1615458 - protein, 4 aa, Staphylococcus aureus
VPAY

SEQ ID NO: 1615459 - protein, 5 aa, Staphylococcus aureus
VQSET

SEQ ID NO: 1615460 - protein, 15 aa, Staphylococcus aureus
VSSQDNNLGSNDAIR

SEQ ID NO: 1615461 - protein, 9 aa, Staphylococcus aureus
VTGKEAYEA

SEQ ID NO: 1615462 - protein, 7 aa, Staphylococcus aureus
VTKPDID

SEQ ID NO: 1615463 - protein, 12 aa, Staphylococcus aureus
VVASEQGEGKVS

SEQ ID NO: 1615464 - protein, 8 aa, Staphylococcus aureus
WGTNPEMG

SEQ ID NO: 1615465 - protein, 5 aa, Staphylococcus aureus
YGNET

SEQ ID NO: 1615466 - protein, 16 aa, Staphylococcus aureus
YKTIKEQQTNQLINDF

SEQ ID NO: 1615467 - protein, 14 aa, Staphylococcus aureus
YNTSELSDTGLRAA

SEQ ID NO: 1615468 - protein, 15 aa, Staphylococcus aureus
YNTSELSDTGLRAAG

SEQ ID NO: 1615469 - protein, 8 aa, Staphylococcus aureus
YYEPKESD

SEQ ID NO: 1615470 - protein, 14 aa, Staphylococcus aureus
ADRGISGKSMNRPE

SEQ ID NO: 1615471 - protein, 12 aa, Staphylococcus aureus
AEKSSLEKNTRD

SEQ ID NO: 1615472 - protein, 11 aa, Staphylococcus aureus
AGLQNYKNRSI

SEQ ID NO: 1615473 - protein, 27 aa, Staphylococcus aureus
AGPDKINSYSKSLKNSNGESKKAADLM

SEQ ID NO: 1615474 - protein, 10 aa, Staphylococcus aureus
AGYKPEDITE

SEQ ID NO: 1615475 - protein, 6 aa, Staphylococcus aureus
AKEASR

SEQ ID NO: 1615476 - protein, 14 aa, Staphylococcus aureus
APTAGQEASQLASQ

SEQ ID NO: 1615477 - protein, 25 aa, Staphylococcus aureus
ASNVSDVGKAFPGQPSIAHDSDIEG

SEQ ID NO: 1615478 - protein, 11 aa, Staphylococcus aureus
ASSNIKSKQAP

SEQ ID NO: 1615479 - protein, 12 aa, Staphylococcus aureus
ATVKTMSPEELR

SEQ ID NO: 1615480 - protein, 5 aa, Staphylococcus aureus
CGRPH

SEQ ID NO: 1615481 - protein, 4 aa, Staphylococcus aureus
DEET

SEQ ID NO: 1615482 - protein, 6 aa, Staphylococcus aureus
DGLKSF

SEQ ID NO: 1615483 - protein, 9 aa, Staphylococcus aureus
DKQSKEELL

SEQ ID NO: 1615484 - protein, 5 aa, Staphylococcus aureus
DMSKP

SEQ ID NO: 1615485 - protein, 6 aa, Staphylococcus aureus
DQISDS

SEQ ID NO: 1615486 - protein, 4 aa, Staphylococcus aureus
DSGK

SEQ ID NO: 1615487 - protein, 24 aa, Staphylococcus aureus
DYSEEKDDLHQQIDSEEQNTVASD

SEQ ID NO: 1615488 - protein, 9 aa, Staphylococcus aureus
EDANAQATV

SEQ ID NO: 1615489 - protein, 8 aa, Staphylococcus aureus
EEGNRRPV

SEQ ID NO: 1615490 - protein, 14 aa, Staphylococcus aureus
EEKGKIIATEIKEM

SEQ ID NO: 1615491 - protein, 5 aa, Staphylococcus aureus
EGFTE

SEQ ID NO: 1615492 - protein, 5 aa, Staphylococcus aureus
EGNSI

SEQ ID NO: 1615493 - protein, 16 aa, Staphylococcus aureus
EGRGKHFPEQLSGGMK

SEQ ID NO: 1615494 - protein, 6 aa, Staphylococcus aureus
EGVTER

SEQ ID NO: 1615495 - protein, 5 aa, Staphylococcus aureus
EIESN

SEQ ID NO: 1615496 - protein, 11 aa, Staphylococcus aureus
EIKYTQSKQHI

SEQ ID NO: 1615497 - protein, 7 aa, Staphylococcus aureus
ELKDQQE

SEQ ID NO: 1615498 - protein, 5 aa, Staphylococcus aureus
ENLEE

SEQ ID NO: 1615499 - protein, 7 aa, Staphylococcus aureus
EQQVEQD

SEQ ID NO: 1615500 - protein, 14 aa, Staphylococcus aureus
ESEIAKEKDGTSVS

SEQ ID NO: 1615501 - protein, 5 aa, Staphylococcus aureus
ETEDE

SEQ ID NO: 1615502 - protein, 8 aa, Staphylococcus aureus
ETGEEAYQ

SEQ ID NO: 1615503 - protein, 5 aa, Staphylococcus aureus
EYANN

SEQ ID NO: 1615504 - protein, 10 aa, Staphylococcus aureus
FAETSRKQKQ

SEQ ID NO: 1615505 - protein, 6 aa, Staphylococcus aureus
FDRTSD

SEQ ID NO: 1615506 - protein, 7 aa, Staphylococcus aureus
FKDTDTK

SEQ ID NO: 1615507 - protein, 15 aa, Staphylococcus aureus
FRNKGSKVCSANSVR

SEQ ID NO: 1615508 - protein, 6 aa, Staphylococcus aureus
FSTEEL

SEQ ID NO: 1615509 - protein, 9 aa, Staphylococcus aureus
GEITGNAGN

SEQ ID NO: 1615510 - protein, 8 aa, Staphylococcus aureus
GERLESSF

SEQ ID NO: 1615511 - protein, 5 aa, Staphylococcus aureus
GGITR

SEQ ID NO: 1615512 - protein, 4 aa, Staphylococcus aureus
GGLR

SEQ ID NO: 1615513 - protein, 13 aa, Staphylococcus aureus
GGSSQSQDMYQDT

SEQ ID NO: 1615514 - protein, 9 aa, Staphylococcus aureus
GLEGKKKIE

SEQ ID NO: 1615515 - protein, 4 aa, Staphylococcus aureus
GRGQ

SEQ ID NO: 1615516 - protein, 11 aa, Staphylococcus aureus
GRTGRAGKEGI

SEQ ID NO: 1615517 - protein, 5 aa, Staphylococcus aureus
GSHEA

SEQ ID NO: 1615518 - protein, 8 aa, Staphylococcus aureus
GTGRWAGR

SEQ ID NO: 1615519 - protein, 22 aa, Staphylococcus aureus
GTHTDDYDATETIDASGKVVSP

SEQ ID NO: 1615520 - protein, 4 aa, Staphylococcus aureus
GTVA

SEQ ID NO: 1615521 - protein, 11 aa, Staphylococcus aureus
HLTDTKGRTVD

SEQ ID NO: 1615522 - protein, 14 aa, Staphylococcus aureus
HPRKSKCNCPHADG

SEQ ID NO: 1615523 - protein, 4 aa, Staphylococcus aureus
IDCP

SEQ ID NO: 1615524 - protein, 12 aa, Staphylococcus aureus
IDDEMKNSRTYY

SEQ ID NO: 1615525 - protein, 6 aa, Staphylococcus aureus
IKRHRQ

SEQ ID NO: 1615526 - protein, 8 aa, Staphylococcus aureus
INNQEIEN

SEQ ID NO: 1615527 - protein, 14 aa, Staphylococcus aureus
IPENVAKNLHEQLH

SEQ ID NO: 1615528 - protein, 18 aa, Staphylococcus aureus
IPLPKKTKFETKGESKSL

SEQ ID NO: 1615529 - protein, 13 aa, Staphylococcus aureus
IQGEAGINIPPEG

SEQ ID NO: 1615530 - protein, 5 aa, Staphylococcus aureus
ITKYT

SEQ ID NO: 1615531 - protein, 5 aa, Staphylococcus aureus
ITTTK

SEQ ID NO: 1615532 - protein, 9 aa, Staphylococcus aureus
KEKNRETVK

SEQ ID NO: 1615533 - protein, 11 aa, Staphylococcus aureus
KENYNKYIQGQ

SEQ ID NO: 1615534 - protein, 5 aa, Staphylococcus aureus
KEVRG

SEQ ID NO: 1615535 - protein, 25 aa, Staphylococcus aureus
KGEPLGGASAAEDDFDELDTDDEDF

SEQ ID NO: 1615536 - protein, 10 aa, Staphylococcus aureus
KGPYPDEEEK

SEQ ID NO: 1615537 - protein, 4 aa, Staphylococcus aureus
KGQA

SEQ ID NO: 1615538 - protein, 4 aa, Staphylococcus aureus
KHKG

SEQ ID NO: 1615539 - protein, 7 aa, Staphylococcus aureus
KHPLTRT

SEQ ID NO: 1615540 - protein, 9 aa, Staphylococcus aureus
KKDKTPIEK

SEQ ID NO: 1615541 - protein, 8 aa, Staphylococcus aureus
KKEINEHN

SEQ ID NO: 1615542 - protein, 29 aa, Staphylococcus aureus
KKGVSKTTKNDSEIEKSNKENKLTGKVGE

SEQ ID NO: 1615543 - protein, 11 aa, Staphylococcus aureus
KKNFTKDNTVD

SEQ ID NO: 1615544 - protein, 8 aa, Staphylococcus aureus
KLSASGAK

SEQ ID NO: 1615545 - protein, 9 aa, Staphylococcus aureus
KNGKKRISH

SEQ ID NO: 1615546 - protein, 16 aa, Staphylococcus aureus
KPTKVNGGRTRNLPEH

SEQ ID NO: 1615547 - protein, 5 aa, Staphylococcus aureus
KSELE

SEQ ID NO: 1615548 - protein, 18 aa, Staphylococcus aureus
KSQIEETESDFDREKLQE

SEQ ID NO: 1615549 - protein, 8 aa, Staphylococcus aureus
KSSSIDEL

SEQ ID NO: 1615550 - protein, 12 aa, Staphylococcus aureus
KTDLAKVNQEQL

SEQ ID NO: 1615551 - protein, 7 aa, Staphylococcus aureus
KVSNEET

SEQ ID NO: 1615552 - protein, 16 aa, Staphylococcus aureus
LADGSMKRYEALKRIK

SEQ ID NO: 1615553 - protein, 16 aa, Staphylococcus aureus
LDDPQYTTRIQDGKNP

SEQ ID NO: 1615554 - protein, 9 aa, Staphylococcus aureus
LEGTAKSIG

SEQ ID NO: 1615555 - protein, 4 aa, Staphylococcus aureus
LHKR

SEQ ID NO: 1615556 - protein, 20 aa, Staphylococcus aureus
LKEKADVYPNQLSGGQKQRV

SEQ ID NO: 1615557 - protein, 7 aa, Staphylococcus aureus
LKTYGGK

SEQ ID NO: 1615558 - protein, 13 aa, Staphylococcus aureus
LNSDGFTSPFYMK

SEQ ID NO: 1615559 - protein, 6 aa, Staphylococcus aureus
LPMRPD

SEQ ID NO: 1615560 - protein, 5 aa, Staphylococcus aureus
LQPTA

SEQ ID NO: 1615561 - protein, 5 aa, Staphylococcus aureus
LQQKN

SEQ ID NO: 1615562 - protein, 4 aa, Staphylococcus aureus
LQQM

SEQ ID NO: 1615563 - protein, 6 aa, Staphylococcus aureus
LRDPNY

SEQ ID NO: 1615564 - protein, 11 aa, Staphylococcus aureus
LRNGKTKLEDA

SEQ ID NO: 1615565 - protein, 7 aa, Staphylococcus aureus
LSNDTTN

SEQ ID NO: 1615566 - protein, 9 aa, Staphylococcus aureus
LSYDNQRQH

SEQ ID NO: 1615567 - protein, 5 aa, Staphylococcus aureus
LYGED

SEQ ID NO: 1615568 - protein, 18 aa, Staphylococcus aureus
MPNARQTKEDVEVSPFDD

SEQ ID NO: 1615569 - protein, 12 aa, Staphylococcus aureus
MSGSKSKRPGLD

SEQ ID NO: 1615570 - protein, 7 aa, Staphylococcus aureus
NAQNNKP

SEQ ID NO: 1615571 - protein, 5 aa, Staphylococcus aureus
NDSRE

SEQ ID NO: 1615572 - protein, 13 aa, Staphylococcus aureus
NEAEERSARIQNK

SEQ ID NO: 1615573 - protein, 5 aa, Staphylococcus aureus
NFHGQ

SEQ ID NO: 1615574 - protein, 6 aa, Staphylococcus aureus
NIRNGK

SEQ ID NO: 1615575 - protein, 9 aa, Staphylococcus aureus
NITKETKDG

SEQ ID NO: 1615576 - protein, 7 aa, Staphylococcus aureus
NKELTQE

SEQ ID NO: 1615577 - protein, 25 aa, Staphylococcus aureus
NKPTDNNSDISYSTNRNRAREFNGM

SEQ ID NO: 1615578 - protein, 10 aa, Staphylococcus aureus
NNISDNEWQQ

SEQ ID NO: 1615579 - protein, 11 aa, Staphylococcus aureus
NTVKSRKTHHT

SEQ ID NO: 1615580 - protein, 10 aa, Staphylococcus aureus
NYKRNQYYSE

SEQ ID NO: 1615581 - protein, 15 aa, Staphylococcus aureus
NYPDYDYNQETATDP

SEQ ID NO: 1615582 - protein, 12 aa, Staphylococcus aureus
PADIRAKEGITD

SEQ ID NO: 1615583 - protein, 6 aa, Staphylococcus aureus
PESKEV

SEQ ID NO: 1615584 - protein, 4 aa, Staphylococcus aureus
PKAA

SEQ ID NO: 1615585 - protein, 5 aa, Staphylococcus aureus
PSMKD

SEQ ID NO: 1615586 - protein, 7 aa, Staphylococcus aureus
PSVGLSS

SEQ ID NO: 1615587 - protein, 6 aa, Staphylococcus aureus
QDGEHH

SEQ ID NO: 1615588 - protein, 5 aa, Staphylococcus aureus
QINKP

SEQ ID NO: 1615589 - protein, 6 aa, Staphylococcus aureus
QKRDLS

SEQ ID NO: 1615590 - protein, 4 aa, Staphylococcus aureus
QPLN

SEQ ID NO: 1615591 - protein, 17 aa, Staphylococcus aureus
QQGRNEGVGKAKITRGY

SEQ ID NO: 1615592 - protein, 4 aa, Staphylococcus aureus
QQQL

SEQ ID NO: 1615593 - protein, 17 aa, Staphylococcus aureus
QRHKDEVRKAKSKKDAV

SEQ ID NO: 1615594 - protein, 5 aa, Staphylococcus aureus
QSAGS

SEQ ID NO: 1615595 - protein, 25 aa, Staphylococcus aureus
QTVRTKEDLTEYNKMSKSEQADIKD

SEQ ID NO: 1615596 - protein, 7 aa, Staphylococcus aureus
REAGFDP

SEQ ID NO: 1615597 - protein, 17 aa, Staphylococcus aureus
RGKDGGYLANDQSADVS

SEQ ID NO: 1615598 - protein, 9 aa, Staphylococcus aureus
RHQTRKKCE

SEQ ID NO: 1615599 - protein, 9 aa, Staphylococcus aureus
RKRPATAKP

SEQ ID NO: 1615600 - protein, 6 aa, Staphylococcus aureus
RNANPN

SEQ ID NO: 1615601 - protein, 10 aa, Staphylococcus aureus
RSSARETAAR

SEQ ID NO: 1615602 - protein, 11 aa, Staphylococcus aureus
RSSSADETNAI

SEQ ID NO: 1615603 - protein, 5 aa, Staphylococcus aureus
RYSSE

SEQ ID NO: 1615604 - protein, 5 aa, Staphylococcus aureus
SATSH

SEQ ID NO: 1615605 - protein, 12 aa, Staphylococcus aureus
SDDDATDQFDEQ

SEQ ID NO: 1615606 - protein, 7 aa, Staphylococcus aureus
SDDGENI

SEQ ID NO: 1615607 - protein, 18 aa, Staphylococcus aureus
SDYKTIKEQQTNQLINDF

SEQ ID NO: 1615608 - protein, 6 aa, Staphylococcus aureus
SEEKFG

SEQ ID NO: 1615609 - protein, 4 aa, Staphylococcus aureus
SEGY

SEQ ID NO: 1615610 - protein, 22 aa, Staphylococcus aureus
SGQDETQLREQMKDDAEQRVKT

SEQ ID NO: 1615611 - protein, 13 aa, Staphylococcus aureus
SGRGLGHTGGTID

SEQ ID NO: 1615612 - protein, 16 aa, Staphylococcus aureus
SITKGDPLRQKGKVSE

SEQ ID NO: 1615613 - protein, 11 aa, Staphylococcus aureus
SKNITKETHTS

SEQ ID NO: 1615614 - protein, 10 aa, Staphylococcus aureus
SKVTKTSYDS

SEQ ID NO: 1615615 - protein, 4 aa, Staphylococcus aureus
SNSM

SEQ ID NO: 1615616 - protein, 22 aa, Staphylococcus aureus
SPLRKADDAVTLDTTGKSIEEV

SEQ ID NO: 1615617 - protein, 12 aa, Staphylococcus aureus
SRLPHSEESHTF

SEQ ID NO: 1615618 - protein, 8 aa, Staphylococcus aureus
SRSECDTT

SEQ ID NO: 1615619 - protein, 7 aa, Staphylococcus aureus
SSEEATN

SEQ ID NO: 1615620 - protein, 6 aa, Staphylococcus aureus
STSNDA

SEQ ID NO: 1615621 - protein, 4 aa, Staphylococcus aureus
SVAR

SEQ ID NO: 1615622 - protein, 14 aa, Staphylococcus aureus
TAAINNDGAKLGTS

SEQ ID NO: 1615623 - protein, 5 aa, Staphylococcus aureus
TDAMQ

SEQ ID NO: 1615624 - protein, 9 aa, Staphylococcus aureus
TDDIEKTKA

SEQ ID NO: 1615625 - protein, 7 aa, Staphylococcus aureus
TGGRVKP

SEQ ID NO: 1615626 - protein, 7 aa, Staphylococcus aureus
TGNQNGV

SEQ ID NO: 1615627 - protein, 10 aa, Staphylococcus aureus
TGTPSPNSLQ

SEQ ID NO: 1615628 - protein, 6 aa, Staphylococcus aureus
TGTTLK

SEQ ID NO: 1615629 - protein, 5 aa, Staphylococcus aureus
TIKDQ

SEQ ID NO: 1615630 - protein, 6 aa, Staphylococcus aureus
TITTTK

SEQ ID NO: 1615631 - protein, 13 aa, Staphylococcus aureus
TMKQQSLAAQKQA

SEQ ID NO: 1615632 - protein, 9 aa, Staphylococcus aureus
TNKAGASNI

SEQ ID NO: 1615633 - protein, 10 aa, Staphylococcus aureus
TRAKDKDVDH

SEQ ID NO: 1615634 - protein, 5 aa, Staphylococcus aureus
TTKEI

SEQ ID NO: 1615635 - protein, 6 aa, Staphylococcus aureus
TYNENE

SEQ ID NO: 1615636 - protein, 5 aa, Staphylococcus aureus
VEQRL

SEQ ID NO: 1615637 - protein, 28 aa, Staphylococcus aureus
VETGGELKTAYADGGPIESGNTDGEGKI

SEQ ID NO: 1615638 - protein, 12 aa, Staphylococcus aureus
VEYSNEKIPYRE

SEQ ID NO: 1615639 - protein, 7 aa, Staphylococcus aureus
VKEHGQL

SEQ ID NO: 1615640 - protein, 14 aa, Staphylococcus aureus
VNPAKIKSKGIKSV

SEQ ID NO: 1615641 - protein, 34 aa, Staphylococcus aureus
VQNDNLSKSNDKIESSYAKTNTKLKQTEKEFNDL

SEQ ID NO: 1615642 - protein, 7 aa, Staphylococcus aureus
VTENNKF

SEQ ID NO: 1615643 - protein, 4 aa, Staphylococcus aureus
YDNP

SEQ ID NO: 1615644 - protein, 5 aa, Staphylococcus aureus
YEASA

SEQ ID NO: 1615645 - protein, 4 aa, Staphylococcus aureus
YEKY

SEQ ID NO: 1615646 - protein, 5 aa, Staphylococcus aureus
YIYSD

SEQ ID NO: 1615647 - protein, 7 aa, Staphylococcus aureus
YKDELRR

SEQ ID NO: 1615648 - protein, 5 aa, Staphylococcus aureus
YSKED

SEQ ID NO: 1615649 - protein, 9 aa, Staphylococcus aureus
YSPEVNLGT

SEQ ID NO: 1615650 - protein, 9 aa, Staphylococcus aureus
AAGLDTSRK

SEQ ID NO: 1615651 - protein, 8 aa, Staphylococcus aureus
AETAREID

SEQ ID NO: 1615652 - protein, 5 aa, Staphylococcus aureus
AFENA

SEQ ID NO: 1615653 - protein, 5 aa, Staphylococcus aureus
AGSEV

SEQ ID NO: 1615654 - protein, 7 aa, Staphylococcus aureus
AGVGSDH

SEQ ID NO: 1615655 - protein, 5 aa, Staphylococcus aureus
AHDNH

SEQ ID NO: 1615656 - protein, 4 aa, Staphylococcus aureus
AIKA

SEQ ID NO: 1615657 - protein, 9 aa, Staphylococcus aureus
AKITKDDGK

SEQ ID NO: 1615658 - protein, 6 aa, Staphylococcus aureus
AKSDLK

SEQ ID NO: 1615659 - protein, 5 aa, Staphylococcus aureus
ALNGN

SEQ ID NO: 1615660 - protein, 7 aa, Staphylococcus aureus
AQTNSPT

SEQ ID NO: 1615661 - protein, 6 aa, Staphylococcus aureus
ASGRFG

SEQ ID NO: 1615662 - protein, 4 aa, Staphylococcus aureus
AYNN

SEQ ID NO: 1615663 - protein, 11 aa, Staphylococcus aureus
CAKNATRQPLK

SEQ ID NO: 1615664 - protein, 7 aa, Staphylococcus aureus
DAENRDF

SEQ ID NO: 1615665 - protein, 5 aa, Staphylococcus aureus
DANEP

SEQ ID NO: 1615666 - protein, 7 aa, Staphylococcus aureus
DATGHSV

SEQ ID NO: 1615667 - protein, 5 aa, Staphylococcus aureus
DDEQE

SEQ ID NO: 1615668 - protein, 4 aa, Staphylococcus aureus
DDET

SEQ ID NO: 1615669 - protein, 5 aa, Staphylococcus aureus
DDNVT

SEQ ID NO: 1615670 - protein, 5 aa, Staphylococcus aureus
DDQIK

SEQ ID NO: 1615671 - protein, 4 aa, Staphylococcus aureus
DEGG

SEQ ID NO: 1615672 - protein, 4 aa, Staphylococcus aureus
DKED

SEQ ID NO: 1615673 - protein, 14 aa, Staphylococcus aureus
DLRAGQSKEEFDKA

SEQ ID NO: 1615674 - protein, 4 aa, Staphylococcus aureus
DNYE

SEQ ID NO: 1615675 - protein, 7 aa, Staphylococcus aureus
DPKTRQI

SEQ ID NO: 1615676 - protein, 6 aa, Staphylococcus aureus
DPNLKG

SEQ ID NO: 1615677 - protein, 8 aa, Staphylococcus aureus
DPTNTDKA

SEQ ID NO: 1615678 - protein, 4 aa, Staphylococcus aureus
DREQ

SEQ ID NO: 1615679 - protein, 7 aa, Staphylococcus aureus
DRVDTKQ

SEQ ID NO: 1615680 - protein, 8 aa, Staphylococcus aureus
DSLQSQDI

SEQ ID NO: 1615681 - protein, 7 aa, Staphylococcus aureus
DTDNGLD

SEQ ID NO: 1615682 - protein, 23 aa, Staphylococcus aureus
DTEVDEDTTSNIEDNTNRNASEM

SEQ ID NO: 1615683 - protein, 10 aa, Staphylococcus aureus
DTNQSSSSMR

SEQ ID NO: 1615684 - protein, 8 aa, Staphylococcus aureus
DVDGTSQG

SEQ ID NO: 1615685 - protein, 8 aa, Staphylococcus aureus
DVPYRSQS

SEQ ID NO: 1615686 - protein, 7 aa, Staphylococcus aureus
DYSEYGG

SEQ ID NO: 1615687 - protein, 23 aa, Staphylococcus aureus
EAFKQSVNSGGLVTSGSTSNWQK

SEQ ID NO: 1615688 - protein, 8 aa, Staphylococcus aureus
EDSIKDGT

SEQ ID NO: 1615689 - protein, 7 aa, Staphylococcus aureus
EEGHEPW

SEQ ID NO: 1615690 - protein, 6 aa, Staphylococcus aureus
EEQDNH

SEQ ID NO: 1615691 - protein, 7 aa, Staphylococcus aureus
EETKGAF

SEQ ID NO: 1615692 - protein, 14 aa, Staphylococcus aureus
EEYTGNVTEGNEET

SEQ ID NO: 1615693 - protein, 18 aa, Staphylococcus aureus
EGMEKREENFADEVKGQM

SEQ ID NO: 1615694 - protein, 5 aa, Staphylococcus aureus
EGMKG

SEQ ID NO: 1615695 - protein, 30 aa, Staphylococcus aureus
EIQEDSEIEEIRTAQKDKTLKEVEAPKGII

SEQ ID NO: 1615696 - protein, 7 aa, Staphylococcus aureus
ELSQEEL

SEQ ID NO: 1615697 - protein, 8 aa, Staphylococcus aureus
EPLKPNHE

SEQ ID NO: 1615698 - protein, 7 aa, Staphylococcus aureus
EQARRGR

SEQ ID NO: 1615699 - protein, 5 aa, Staphylococcus aureus
ERELE

SEQ ID NO: 1615700 - protein, 15 aa, Staphylococcus aureus
ERSDLSPEVTVNTET

SEQ ID NO: 1615701 - protein, 6 aa, Staphylococcus aureus
ESEELK

SEQ ID NO: 1615702 - protein, 8 aa, Staphylococcus aureus
ESNGLNTE

SEQ ID NO: 1615703 - protein, 9 aa, Staphylococcus aureus
EVGEGDKQE

SEQ ID NO: 1615704 - protein, 6 aa, Staphylococcus aureus
FAEEEN

SEQ ID NO: 1615705 - protein, 5 aa, Staphylococcus aureus
GAEGL

SEQ ID NO: 1615706 - protein, 21 aa, Staphylococcus aureus
GFGYKDTTKTISSKRSISINS

SEQ ID NO: 1615707 - protein, 9 aa, Staphylococcus aureus
GGKASYPST

SEQ ID NO: 1615708 - protein, 11 aa, Staphylococcus aureus
GINKTKDTRAI

SEQ ID NO: 1615709 - protein, 5 aa, Staphylococcus aureus
GKKMT

SEQ ID NO: 1615710 - protein, 10 aa, Staphylococcus aureus
GKLAPKSKAD

SEQ ID NO: 1615711 - protein, 6 aa, Staphylococcus aureus
GQNVKY

SEQ ID NO: 1615712 - protein, 19 aa, Staphylococcus aureus
GREKAYPSELSGGQKQRVG

SEQ ID NO: 1615713 - protein, 7 aa, Staphylococcus aureus
GSPKSII

SEQ ID NO: 1615714 - protein, 9 aa, Staphylococcus aureus
GTLKTNTDL

SEQ ID NO: 1615715 - protein, 9 aa, Staphylococcus aureus
GTQSYETFS

SEQ ID NO: 1615716 - protein, 14 aa, Staphylococcus aureus
GVQDNSIGSTNESQ

SEQ ID NO: 1615717 - protein, 4 aa, Staphylococcus aureus
GYGN

SEQ ID NO: 1615718 - protein, 15 aa, Staphylococcus aureus
HAPHARDEKAQPMEK

SEQ ID NO: 1615719 - protein, 5 aa, Staphylococcus aureus
HDLTE

SEQ ID NO: 1615720 - protein, 14 aa, Staphylococcus aureus
HENSQKVENKNEIA

SEQ ID NO: 1615721 - protein, 11 aa, Staphylococcus aureus
HMKNGQLKPGY

SEQ ID NO: 1615722 - protein, 20 aa, Staphylococcus aureus
HVETKDVDGNTSFENEQTSY

SEQ ID NO: 1615723 - protein, 4 aa, Staphylococcus aureus
IDAD

SEQ ID NO: 1615724 - protein, 24 aa, Staphylococcus aureus
IDRLEQSKNEAPHLREAQKTLAEE

SEQ ID NO: 1615725 - protein, 18 aa, Staphylococcus aureus
IEDDENGLKTYQPKIDED

SEQ ID NO: 1615726 - protein, 5 aa, Staphylococcus aureus
IEGNI

SEQ ID NO: 1615727 - protein, 6 aa, Staphylococcus aureus
IEKPGN

SEQ ID NO: 1615728 - protein, 7 aa, Staphylococcus aureus
IKRQRNI

SEQ ID NO: 1615729 - protein, 24 aa, Staphylococcus aureus
INEAGRKPDLPFGGYKQSGLGREW

SEQ ID NO: 1615730 - protein, 16 aa, Staphylococcus aureus
IPTADYKEVERKKDAL

SEQ ID NO: 1615731 - protein, 9 aa, Staphylococcus aureus
ISADDYRKY

SEQ ID NO: 1615732 - protein, 9 aa, Staphylococcus aureus
ISKSKNEDM

SEQ ID NO: 1615733 - protein, 10 aa, Staphylococcus aureus
ITKTKDEQIK

SEQ ID NO: 1615734 - protein, 5 aa, Staphylococcus aureus
IYDGT

SEQ ID NO: 1615735 - protein, 15 aa, Staphylococcus aureus
KAESINSTYEHQTSY

SEQ ID NO: 1615736 - protein, 12 aa, Staphylococcus aureus
KAGKPTKSEQEK

SEQ ID NO: 1615737 - protein, 6 aa, Staphylococcus aureus
KAQEIN

SEQ ID NO: 1615738 - protein, 9 aa, Staphylococcus aureus
KATESKSGL

SEQ ID NO: 1615739 - protein, 13 aa, Staphylococcus aureus
KDTIKKASIASGV

SEQ ID NO: 1615740 - protein, 16 aa, Staphylococcus aureus
KEEWEKAKRTPAERGD

SEQ ID NO: 1615741 - protein, 9 aa, Staphylococcus aureus
KELSDIQSK

SEQ ID NO: 1615742 - protein, 6 aa, Staphylococcus aureus
KGHGYR

SEQ ID NO: 1615743 - protein, 21 aa, Staphylococcus aureus
KGSGVRSGSGVNKAASAWAGD

SEQ ID NO: 1615744 - protein, 15 aa, Staphylococcus aureus
KGYPDAYEKGHKVSG

SEQ ID NO: 1615745 - protein, 13 aa, Staphylococcus aureus
KIDEAKNDGDSIG

SEQ ID NO: 1615746 - protein, 10 aa, Staphylococcus aureus
KLQKSAKTVT

SEQ ID NO: 1615747 - protein, 4 aa, Staphylococcus aureus
KNEI

SEQ ID NO: 1615748 - protein, 5 aa, Staphylococcus aureus
KQMPP

SEQ ID NO: 1615749 - protein, 14 aa, Staphylococcus aureus
KQQLESKKQNYKPF

SEQ ID NO: 1615750 - protein, 4 aa, Staphylococcus aureus
KQRL

SEQ ID NO: 1615751 - protein, 11 aa, Staphylococcus aureus
KQSKEKTPKWL

SEQ ID NO: 1615752 - protein, 8 aa, Staphylococcus aureus
KSQLRTDL

SEQ ID NO: 1615753 - protein, 7 aa, Staphylococcus aureus
KTSVKKY

SEQ ID NO: 1615754 - protein, 7 aa, Staphylococcus aureus
KVNADED

SEQ ID NO: 1615755 - protein, 16 aa, Staphylococcus aureus
KYTAEEKKNYNPIRTT

SEQ ID NO: 1615756 - protein, 10 aa, Staphylococcus aureus
LAAEGEDTYS

SEQ ID NO: 1615757 - protein, 14 aa, Staphylococcus aureus
LDSRSFKSFSKPKW

SEQ ID NO: 1615758 - protein, 4 aa, Staphylococcus aureus
LEKP

SEQ ID NO: 1615759 - protein, 5 aa, Staphylococcus aureus
LKPTH

SEQ ID NO: 1615760 - protein, 6 aa, Staphylococcus aureus
LNEEDT

SEQ ID NO: 1615761 - protein, 34 aa, Staphylococcus aureus
LRDAEQKLKNSNQATTAQLKRASDAVQKQSAKHK

SEQ ID NO: 1615762 - protein, 11 aa, Staphylococcus aureus
LREQKGADVKE

SEQ ID NO: 1615763 - protein, 7 aa, Staphylococcus aureus
LSTVDSS

SEQ ID NO: 1615764 - protein, 10 aa, Staphylococcus aureus
MQQRAQNDEV

SEQ ID NO: 1615765 - protein, 15 aa, Staphylococcus aureus
MRKQRDEYKKQRDEL

SEQ ID NO: 1615766 - protein, 5 aa, Staphylococcus aureus
NAQNY

SEQ ID NO: 1615767 - protein, 11 aa, Staphylococcus aureus
NDNPGSQHGHG

SEQ ID NO: 1615768 - protein, 8 aa, Staphylococcus aureus
NDRVEAGQ

SEQ ID NO: 1615769 - protein, 10 aa, Staphylococcus aureus
NDTPGMVGKT

SEQ ID NO: 1615770 - protein, 6 aa, Staphylococcus aureus
NGPVPV

SEQ ID NO: 1615771 - protein, 6 aa, Staphylococcus aureus
NHRDNH

SEQ ID NO: 1615772 - protein, 7 aa, Staphylococcus aureus
NIDADVP

SEQ ID NO: 1615773 - protein, 15 aa, Staphylococcus aureus
NIGRRVSTTSTGSVT

SEQ ID NO: 1615774 - protein, 14 aa, Staphylococcus aureus
NNGSIDNDPPAAMR

SEQ ID NO: 1615775 - protein, 10 aa, Staphylococcus aureus
NNPEQRIGDS

SEQ ID NO: 1615776 - protein, 4 aa, Staphylococcus aureus
NPQE

SEQ ID NO: 1615777 - protein, 9 aa, Staphylococcus aureus
NQENQVDGA

SEQ ID NO: 1615778 - protein, 5 aa, Staphylococcus aureus
NSHDE

SEQ ID NO: 1615779 - protein, 8 aa, Staphylococcus aureus
PDQVKAGD

SEQ ID NO: 1615780 - protein, 4 aa, Staphylococcus aureus
PEID

SEQ ID NO: 1615781 - protein, 6 aa, Staphylococcus aureus
PINDED

SEQ ID NO: 1615782 - protein, 4 aa, Staphylococcus aureus
PNLY

SEQ ID NO: 1615783 - protein, 17 aa, Staphylococcus aureus
PNVAAKKIKSAVTDSDG

SEQ ID NO: 1615784 - protein, 12 aa, Staphylococcus aureus
PSDQRGKTLNDP

SEQ ID NO: 1615785 - protein, 7 aa, Staphylococcus aureus
QEKGKLH

SEQ ID NO: 1615786 - protein, 11 aa, Staphylococcus aureus
QGSEAGGHRGS

SEQ ID NO: 1615787 - protein, 8 aa, Staphylococcus aureus
QKNNDTAY

SEQ ID NO: 1615788 - protein, 10 aa, Staphylococcus aureus
QKNSAYLGTN

SEQ ID NO: 1615789 - protein, 6 aa, Staphylococcus aureus
QLSGLG

SEQ ID NO: 1615790 - protein, 17 aa, Staphylococcus aureus
QPGLSPRALKEKYGIEG

SEQ ID NO: 1615791 - protein, 6 aa, Staphylococcus aureus
QQTEYN

SEQ ID NO: 1615792 - protein, 14 aa, Staphylococcus aureus
QRTNKKQKITRSTS

SEQ ID NO: 1615793 - protein, 11 aa, Staphylococcus aureus
QSKHTEESPYT

SEQ ID NO: 1615794 - protein, 24 aa, Staphylococcus aureus
QTFDSNDDTSVQNYENKASDDYYD

SEQ ID NO: 1615795 - protein, 8 aa, Staphylococcus aureus
REKYAKKN

SEQ ID NO: 1615796 - protein, 9 aa, Staphylococcus aureus
RESDTDKVA

SEQ ID NO: 1615797 - protein, 5 aa, Staphylococcus aureus
RFRPD

SEQ ID NO: 1615798 - protein, 9 aa, Staphylococcus aureus
RKTDTSPRY

SEQ ID NO: 1615799 - protein, 13 aa, Staphylococcus aureus
RMGPAGLAESHPH

SEQ ID NO: 1615800 - protein, 9 aa, Staphylococcus aureus
RNKAAGIKV

SEQ ID NO: 1615801 - protein, 18 aa, Staphylococcus aureus
RNLGNPPFATRESLPSIR

SEQ ID NO: 1615802 - protein, 11 aa, Staphylococcus aureus
RQAITNPNTVQ

SEQ ID NO: 1615803 - protein, 11 aa, Staphylococcus aureus
RSNTNFAKNEE

SEQ ID NO: 1615804 - protein, 8 aa, Staphylococcus aureus
SADVGTTV

SEQ ID NO: 1615805 - protein, 13 aa, Staphylococcus aureus
SAFDKSEKSMEKY

SEQ ID NO: 1615806 - protein, 12 aa, Staphylococcus aureus
SAVQGEKPQFVV

SEQ ID NO: 1615807 - protein, 9 aa, Staphylococcus aureus
SGKTAERLN

SEQ ID NO: 1615808 - protein, 10 aa, Staphylococcus aureus
SKEKHPDADK

SEQ ID NO: 1615809 - protein, 7 aa, Staphylococcus aureus
SKKLGDK

SEQ ID NO: 1615810 - protein, 7 aa, Staphylococcus aureus
SKSSLDG

SEQ ID NO: 1615811 - protein, 7 aa, Staphylococcus aureus
SLGSGKS

SEQ ID NO: 1615812 - protein, 7 aa, Staphylococcus aureus
SLNDDNY

SEQ ID NO: 1615813 - protein, 11 aa, Staphylococcus aureus
SNVGKEKRQQV

SEQ ID NO: 1615814 - protein, 4 aa, Staphylococcus aureus
SPAL

SEQ ID NO: 1615815 - protein, 18 aa, Staphylococcus aureus
SSQPITIEGRASKQPLTA

SEQ ID NO: 1615816 - protein, 10 aa, Staphylococcus aureus
SSSSNIPNDI

SEQ ID NO: 1615817 - protein, 13 aa, Staphylococcus aureus
TATMKGTDSDANL

SEQ ID NO: 1615818 - protein, 16 aa, Staphylococcus aureus
TDDNVEPNIAPSTATN

SEQ ID NO: 1615819 - protein, 4 aa, Staphylococcus aureus
TGTF

SEQ ID NO: 1615820 - protein, 6 aa, Staphylococcus aureus
THDLTE

SEQ ID NO: 1615821 - protein, 5 aa, Staphylococcus aureus
TKGQA

SEQ ID NO: 1615822 - protein, 6 aa, Staphylococcus aureus
TLETNE

SEQ ID NO: 1615823 - protein, 8 aa, Staphylococcus aureus
TLSNDTTN

SEQ ID NO: 1615824 - protein, 16 aa, Staphylococcus aureus
TLYATPDYELIQKMKQ

SEQ ID NO: 1615825 - protein, 10 aa, Staphylococcus aureus
TNVVGKDDGV

SEQ ID NO: 1615826 - protein, 6 aa, Staphylococcus aureus
TPLAEG

SEQ ID NO: 1615827 - protein, 15 aa, Staphylococcus aureus
TPNSTIPNSLSKNGH

SEQ ID NO: 1615828 - protein, 7 aa, Staphylococcus aureus
TSEVEGI

SEQ ID NO: 1615829 - protein, 5 aa, Staphylococcus aureus
TSYTQ

SEQ ID NO: 1615830 - protein, 6 aa, Staphylococcus aureus
TTEILG

SEQ ID NO: 1615831 - protein, 24 aa, Staphylococcus aureus
TTRQRDGLTSANKVEEGGLSGRPL

SEQ ID NO: 1615832 - protein, 8 aa, Staphylococcus aureus
VAQEVKPT

SEQ ID NO: 1615833 - protein, 6 aa, Staphylococcus aureus
VENYSS

SEQ ID NO: 1615834 - protein, 15 aa, Staphylococcus aureus
VGSYDKRADEEAAKY

SEQ ID NO: 1615835 - protein, 11 aa, Staphylococcus aureus
VKKQDKDKNTT

SEQ ID NO: 1615836 - protein, 13 aa, Staphylococcus aureus
VKPPAETEEQREA

SEQ ID NO: 1615837 - protein, 8 aa, Staphylococcus aureus
VPQKPPHL

SEQ ID NO: 1615838 - protein, 11 aa, Staphylococcus aureus
VPSNTSKTEMA

SEQ ID NO: 1615839 - protein, 6 aa, Staphylococcus aureus
VTPELA

SEQ ID NO: 1615840 - protein, 11 aa, Staphylococcus aureus
YDGNKSGKIRF

SEQ ID NO: 1615841 - protein, 26 aa, Staphylococcus aureus
YNEKKKKFGKNWEDAQKAGKAVGEDL

SEQ ID NO: 1615842 - protein, 7 aa, Staphylococcus aureus
YNYQKKE

SEQ ID NO: 1615843 - protein, 19 aa, Staphylococcus aureus
YSKEHAKETIRKTNGAIRS

SEQ ID NO: 1615844 - protein, 6 aa, Staphylococcus aureus
AAIQTG

SEQ ID NO: 1615845 - protein, 9 aa, Staphylococcus aureus
AAKDTDAST

SEQ ID NO: 1615846 - protein, 14 aa, Staphylococcus aureus
AGTIGRATSAKKYK

SEQ ID NO: 1615847 - protein, 8 aa, Staphylococcus aureus
AIANSTGK

SEQ ID NO: 1615848 - protein, 5 aa, Staphylococcus aureus
AIDKR

SEQ ID NO: 1615849 - protein, 25 aa, Staphylococcus aureus
AIEGGARRIEGTVNGIGERAGNAAL

SEQ ID NO: 1615850 - protein, 6 aa, Staphylococcus aureus
AIRTKN

SEQ ID NO: 1615851 - protein, 9 aa, Staphylococcus aureus
ARETAPEHV

SEQ ID NO: 1615852 - protein, 9 aa, Staphylococcus aureus
ATGAGIGEE

SEQ ID NO: 1615853 - protein, 6 aa, Staphylococcus aureus
DCTERR

SEQ ID NO: 1615854 - protein, 6 aa, Staphylococcus aureus
DDENHA

SEQ ID NO: 1615855 - protein, 6 aa, Staphylococcus aureus
DDNDIE

SEQ ID NO: 1615856 - protein, 7 aa, Staphylococcus aureus
DGNVPGN

SEQ ID NO: 1615857 - protein, 7 aa, Staphylococcus aureus
DGPKTIE

SEQ ID NO: 1615858 - protein, 7 aa, Staphylococcus aureus
DGQPKDV

SEQ ID NO: 1615859 - protein, 10 aa, Staphylococcus aureus
DKQITKRTAV

SEQ ID NO: 1615860 - protein, 14 aa, Staphylococcus aureus
DPAYIPRQNEARNQ

SEQ ID NO: 1615861 - protein, 14 aa, Staphylococcus aureus
DPKEVDDRQTWEKA

SEQ ID NO: 1615862 - protein, 9 aa, Staphylococcus aureus
DQTAIDNAK

SEQ ID NO: 1615863 - protein, 9 aa, Staphylococcus aureus
DSNTANPNY

SEQ ID NO: 1615864 - protein, 4 aa, Staphylococcus aureus
DTIA

SEQ ID NO: 1615865 - protein, 4 aa, Staphylococcus aureus
DTLN

SEQ ID NO: 1615866 - protein, 7 aa, Staphylococcus aureus
DVTNDEI

SEQ ID NO: 1615867 - protein, 4 aa, Staphylococcus aureus
EAIE

SEQ ID NO: 1615868 - protein, 9 aa, Staphylococcus aureus
EASNWNKEL

SEQ ID NO: 1615869 - protein, 9 aa, Staphylococcus aureus
EDSSMNEIE

SEQ ID NO: 1615870 - protein, 6 aa, Staphylococcus aureus
EITYGN

SEQ ID NO: 1615871 - protein, 13 aa, Staphylococcus aureus
EKGKIIATEIKEM

SEQ ID NO: 1615872 - protein, 29 aa, Staphylococcus aureus
EKPQGKLTLATESDKRPAIKQSAEDDFDK

SEQ ID NO: 1615873 - protein, 13 aa, Staphylococcus aureus
ELESGKKLSDDTF

SEQ ID NO: 1615874 - protein, 14 aa, Staphylococcus aureus
ELRDGDKSRYLGKG

SEQ ID NO: 1615875 - protein, 4 aa, Staphylococcus aureus
EMSK

SEQ ID NO: 1615876 - protein, 13 aa, Staphylococcus aureus
ENGQIQEPSYDPD

SEQ ID NO: 1615877 - protein, 6 aa, Staphylococcus aureus
ENYKYG

SEQ ID NO: 1615878 - protein, 14 aa, Staphylococcus aureus
EPQSDDQNMNETRL

SEQ ID NO: 1615879 - protein, 4 aa, Staphylococcus aureus
EQQQ

SEQ ID NO: 1615880 - protein, 13 aa, Staphylococcus aureus
ETEDGSKINPTLS

SEQ ID NO: 1615881 - protein, 7 aa, Staphylococcus aureus
ETLKNRE

SEQ ID NO: 1615882 - protein, 8 aa, Staphylococcus aureus
EYNQTHPD

SEQ ID NO: 1615883 - protein, 6 aa, Staphylococcus aureus
EYQDNE

SEQ ID NO: 1615884 - protein, 4 aa, Staphylococcus aureus
FDDT

SEQ ID NO: 1615885 - protein, 24 aa, Staphylococcus aureus
FTTSDSASYAQDFKSEENAKKIAE

SEQ ID NO: 1615886 - protein, 15 aa, Staphylococcus aureus
GDITEDDIKGKDAED

SEQ ID NO: 1615887 - protein, 10 aa, Staphylococcus aureus
GDVKNTYGTG

SEQ ID NO: 1615888 - protein, 11 aa, Staphylococcus aureus
GEHSKKAQEDV

SEQ ID NO: 1615889 - protein, 9 aa, Staphylococcus aureus
GFSNKNKQN

SEQ ID NO: 1615890 - protein, 9 aa, Staphylococcus aureus
GGDSAIGRA

SEQ ID NO: 1615891 - protein, 6 aa, Staphylococcus aureus
GITPGM

SEQ ID NO: 1615892 - protein, 9 aa, Staphylococcus aureus
GKEVSPEEL

SEQ ID NO: 1615893 - protein, 4 aa, Staphylococcus aureus
GLPK

SEQ ID NO: 1615894 - protein, 6 aa, Staphylococcus aureus
GNVPGN

SEQ ID NO: 1615895 - protein, 6 aa, Staphylococcus aureus
GPTPQL

SEQ ID NO: 1615896 - protein, 14 aa, Staphylococcus aureus
GSDNAGDRVASNSI

SEQ ID NO: 1615897 - protein, 4 aa, Staphylococcus aureus
GSHA

SEQ ID NO: 1615898 - protein, 8 aa, Staphylococcus aureus
HQQGQTDF

SEQ ID NO: 1615899 - protein, 9 aa, Staphylococcus aureus
IASPPQTSI

SEQ ID NO: 1615900 - protein, 18 aa, Staphylococcus aureus
IEDEENGLKTYQPKIDED

SEQ ID NO: 1615901 - protein, 6 aa, Staphylococcus aureus
IEKAPN

SEQ ID NO: 1615902 - protein, 41 aa, Staphylococcus aureus
IEKETHKSKTHNMYSNNTNHRAKDSTPDYHKESFKTSEVPS

SEQ ID NO: 1615903 - protein, 9 aa, Staphylococcus aureus
IKGGNNNRY

SEQ ID NO: 1615904 - protein, 9 aa, Staphylococcus aureus
IKTSTESGQ

SEQ ID NO: 1615905 - protein, 9 aa, Staphylococcus aureus
INDKDSEFY

SEQ ID NO: 1615906 - protein, 10 aa, Staphylococcus aureus
INEDDQFSHS

SEQ ID NO: 1615907 - protein, 4 aa, Staphylococcus aureus
INRA

SEQ ID NO: 1615908 - protein, 21 aa, Staphylococcus aureus
ISESTLNTIKEKYSDVNVSYI

SEQ ID NO: 1615909 - protein, 43 aa, Staphylococcus aureus
KAHQEEQSVNVQAHEKSMEQSSYHNQKEQRREQRKLERQISEC

SEQ ID NO: 1615910 - protein, 6 aa, Staphylococcus aureus
KAKYKK

SEQ ID NO: 1615911 - protein, 5 aa, Staphylococcus aureus
KEEFE

SEQ ID NO: 1615912 - protein, 13 aa, Staphylococcus aureus
KGTFVKEQDSSIL

SEQ ID NO: 1615913 - protein, 6 aa, Staphylococcus aureus
KKEKQF

SEQ ID NO: 1615914 - protein, 4 aa, Staphylococcus aureus
KPYR

SEQ ID NO: 1615915 - protein, 15 aa, Staphylococcus aureus
KQEIENEKISTTSIR

SEQ ID NO: 1615916 - protein, 8 aa, Staphylococcus aureus
KQIRTLRS

SEQ ID NO: 1615917 - protein, 4 aa, Staphylococcus aureus
KSEK

SEQ ID NO: 1615918 - protein, 7 aa, Staphylococcus aureus
KSKSRKI

SEQ ID NO: 1615919 - protein, 7 aa, Staphylococcus aureus
KVPEDWR

SEQ ID NO: 1615920 - protein, 10 aa, Staphylococcus aureus
LARQGQRIKA

SEQ ID NO: 1615921 - protein, 13 aa, Staphylococcus aureus
LGGEGNLLAPDET

SEQ ID NO: 1615922 - protein, 12 aa, Staphylococcus aureus
LIEDEKRLTQSL

SEQ ID NO: 1615923 - protein, 7 aa, Staphylococcus aureus
LKEGEIE

SEQ ID NO: 1615924 - protein, 12 aa, Staphylococcus aureus
LPPVEGGDKPLI

SEQ ID NO: 1615925 - protein, 7 aa, Staphylococcus aureus
LQQSNAT

SEQ ID NO: 1615926 - protein, 6 aa, Staphylococcus aureus
LTSSEA

SEQ ID NO: 1615927 - protein, 4 aa, Staphylococcus aureus
MKTF

SEQ ID NO: 1615928 - protein, 5 aa, Staphylococcus aureus
MLEGS

SEQ ID NO: 1615929 - protein, 18 aa, Staphylococcus aureus
MPNARQTKEEVEVSPFDD

SEQ ID NO: 1615930 - protein, 9 aa, Staphylococcus aureus
NADSAYETD

SEQ ID NO: 1615931 - protein, 8 aa, Staphylococcus aureus
NAGNPDIM

SEQ ID NO: 1615932 - protein, 6 aa, Staphylococcus aureus
NAQTLE

SEQ ID NO: 1615933 - protein, 15 aa, Staphylococcus aureus
NDDPHRPNANNKTIK

SEQ ID NO: 1615934 - protein, 4 aa, Staphylococcus aureus
NELN

SEQ ID NO: 1615935 - protein, 6 aa, Staphylococcus aureus
NGEIEG

SEQ ID NO: 1615936 - protein, 13 aa, Staphylococcus aureus
NGFETYTSDNGRM

SEQ ID NO: 1615937 - protein, 5 aa, Staphylococcus aureus
NMNNS

SEQ ID NO: 1615938 - protein, 9 aa, Staphylococcus aureus
NNDTTAKPL

SEQ ID NO: 1615939 - protein, 6 aa, Staphylococcus aureus
NNEKAY

SEQ ID NO: 1615940 - protein, 8 aa, Staphylococcus aureus
NQKGSNEI

SEQ ID NO: 1615941 - protein, 34 aa, Staphylococcus aureus
NRNAYSIDEASKAIKEAEKARKARKKEVDKQYED

SEQ ID NO: 1615942 - protein, 6 aa, Staphylococcus aureus
NSERYG

SEQ ID NO: 1615943 - protein, 15 aa, Staphylococcus aureus
NSNDTTSDSNQQQLE

SEQ ID NO: 1615944 - protein, 14 aa, Staphylococcus aureus
NTTEILGEDDVEGV

SEQ ID NO: 1615945 - protein, 11 aa, Staphylococcus aureus
PDLPGSVESYE

SEQ ID NO: 1615946 - protein, 6 aa, Staphylococcus aureus
PESFGT

SEQ ID NO: 1615947 - protein, 5 aa, Staphylococcus aureus
PETEY

SEQ ID NO: 1615948 - protein, 19 aa, Staphylococcus aureus
PFSKNENISLKGEETTTGD

SEQ ID NO: 1615949 - protein, 15 aa, Staphylococcus aureus
PKNKYPDSIEESTAK

SEQ ID NO: 1615950 - protein, 8 aa, Staphylococcus aureus
PKNSGKWE

SEQ ID NO: 1615951 - protein, 4 aa, Staphylococcus aureus
PNIE

SEQ ID NO: 1615952 - protein, 6 aa, Staphylococcus aureus
PSNGSD

SEQ ID NO: 1615953 - protein, 12 aa, Staphylococcus aureus
QEQNEKSKSAEE

SEQ ID NO: 1615954 - protein, 9 aa, Staphylococcus aureus
QGSNQVGNK

SEQ ID NO: 1615955 - protein, 13 aa, Staphylococcus aureus
QQSKIEKLEELIN

SEQ ID NO: 1615956 - protein, 6 aa, Staphylococcus aureus
QSDNGR

SEQ ID NO: 1615957 - protein, 8 aa, Staphylococcus aureus
RDVKDADE

SEQ ID NO: 1615958 - protein, 8 aa, Staphylococcus aureus
RRDGNSYV

SEQ ID NO: 1615959 - protein, 14 aa, Staphylococcus aureus
RRRKALEKEQALKE

SEQ ID NO: 1615960 - protein, 10 aa, Staphylococcus aureus
RSDCTTCGDV

SEQ ID NO: 1615961 - protein, 9 aa, Staphylococcus aureus
SANIESREA

SEQ ID NO: 1615962 - protein, 4 aa, Staphylococcus aureus
SELT

SEQ ID NO: 1615963 - protein, 9 aa, Staphylococcus aureus
SEVKEQTSN

SEQ ID NO: 1615964 - protein, 10 aa, Staphylococcus aureus
SGSTSTGKTF

SEQ ID NO: 1615965 - protein, 7 aa, Staphylococcus aureus
SHRTEQA

SEQ ID NO: 1615966 - protein, 7 aa, Staphylococcus aureus
SHTATHG

SEQ ID NO: 1615967 - protein, 11 aa, Staphylococcus aureus
SINASLNNKTI

SEQ ID NO: 1615968 - protein, 8 aa, Staphylococcus aureus
SITHDKDE

SEQ ID NO: 1615969 - protein, 5 aa, Staphylococcus aureus
SKEEL

SEQ ID NO: 1615970 - protein, 8 aa, Staphylococcus aureus
SKRSNKGL

SEQ ID NO: 1615971 - protein, 10 aa, Staphylococcus aureus
SLYGPTVGDS

SEQ ID NO: 1615972 - protein, 7 aa, Staphylococcus aureus
SNAVKTR

SEQ ID NO: 1615973 - protein, 12 aa, Staphylococcus aureus
SNVNPSLRDATV

SEQ ID NO: 1615974 - protein, 11 aa, Staphylococcus aureus
SPNTKNKPGLN

SEQ ID NO: 1615975 - protein, 4 aa, Staphylococcus aureus
SRTY

SEQ ID NO: 1615976 - protein, 9 aa, Staphylococcus aureus
SSKQAPGII

SEQ ID NO: 1615977 - protein, 15 aa, Staphylococcus aureus
STFQETHDKSSNMID

SEQ ID NO: 1615978 - protein, 10 aa, Staphylococcus aureus
STNQQQTKGR

SEQ ID NO: 1615979 - protein, 15 aa, Staphylococcus aureus
TDSEDHSEDSAGSLP

SEQ ID NO: 1615980 - protein, 5 aa, Staphylococcus aureus
TGQWD

SEQ ID NO: 1615981 - protein, 6 aa, Staphylococcus aureus
TGTDSN

SEQ ID NO: 1615982 - protein, 10 aa, Staphylococcus aureus
TISKSKNEDM

SEQ ID NO: 1615983 - protein, 10 aa, Staphylococcus aureus
TKGYPPSVRE

SEQ ID NO: 1615984 - protein, 8 aa, Staphylococcus aureus
TKKEAATY

SEQ ID NO: 1615985 - protein, 4 aa, Staphylococcus aureus
TNEN

SEQ ID NO: 1615986 - protein, 19 aa, Staphylococcus aureus
TRLKQNKQQITHEENRRNQ

SEQ ID NO: 1615987 - protein, 4 aa, Staphylococcus aureus
TSQY

SEQ ID NO: 1615988 - protein, 13 aa, Staphylococcus aureus
TTDDTFTATEANK

SEQ ID NO: 1615989 - protein, 14 aa, Staphylococcus aureus
TVAKPIDEFTSGGF

SEQ ID NO: 1615990 - protein, 4 aa, Staphylococcus aureus
VGRR

SEQ ID NO: 1615991 - protein, 9 aa, Staphylococcus aureus
VKASGGVRN

SEQ ID NO: 1615992 - protein, 11 aa, Staphylococcus aureus
VPEGHPTHPLT

SEQ ID NO: 1615993 - protein, 6 aa, Staphylococcus aureus
VTKAVE

SEQ ID NO: 1615994 - protein, 17 aa, Staphylococcus aureus
YDKEGYRDGEFKKGDKG

SEQ ID NO: 1615995 - protein, 7 aa, Staphylococcus aureus
YDSRSPQ

SEQ ID NO: 1615996 - protein, 8 aa, Staphylococcus aureus
YDVPVEES

SEQ ID NO: 1615997 - protein, 11 aa, Staphylococcus aureus
YEDFKQSDAFN

SEQ ID NO: 1615998 - protein, 11 aa, Staphylococcus aureus
YNIQQAKGWTQ

SEQ ID NO: 1615999 - protein, 23 aa, Staphylococcus aureus
YRNQTNDMTEPYTIGGGTYARNL

SEQ ID NO: 1616000 - protein, 8 aa, Staphylococcus aureus
YRQGQNHT

SEQ ID NO: 1616001 - protein, 9 aa, Staphylococcus aureus
YYEPKESDF

SEQ ID NO: 1616002 - protein, 7 aa, Staphylococcus aureus
ADDGKIS

SEQ ID NO: 1616003 - protein, 17 aa, Staphylococcus aureus
ADELPTEESDDLKEYQR

SEQ ID NO: 1616004 - protein, 18 aa, Staphylococcus aureus
ADKVTEDASFKDDLGADS

SEQ ID NO: 1616005 - protein, 63 aa, Staphylococcus aureus
AERYVGDSSLNDDSDLTDNSTDASQLHTNGIENETVSNDENKQASIQNEDTNDTHVDESPYNY

SEQ ID NO: 1616006 - protein, 16 aa, Staphylococcus aureus
AESKEEAKEKYEAQVK

SEQ ID NO: 1616007 - protein, 8 aa, Staphylococcus aureus
AGTTDSVI

SEQ ID NO: 1616008 - protein, 4 aa, Staphylococcus aureus
AGVP

SEQ ID NO: 1616009 - protein, 7 aa, Staphylococcus aureus
AIETEEL

SEQ ID NO: 1616010 - protein, 4 aa, Staphylococcus aureus
AKLQ

SEQ ID NO: 1616011 - protein, 11 aa, Staphylococcus aureus
AKYIGTEKPML

SEQ ID NO: 1616012 - protein, 6 aa, Staphylococcus aureus
ANEKGI

SEQ ID NO: 1616013 - protein, 9 aa, Staphylococcus aureus
ATENGDNIQ

SEQ ID NO: 1616014 - protein, 16 aa, Staphylococcus aureus
ATTLEDSNYKERWNSG

SEQ ID NO: 1616015 - protein, 8 aa, Staphylococcus aureus
AVDTEGVA

SEQ ID NO: 1616016 - protein, 4 aa, Staphylococcus aureus
AVTQ

SEQ ID NO: 1616017 - protein, 9 aa, Staphylococcus aureus
DARETAPAH

SEQ ID NO: 1616018 - protein, 9 aa, Staphylococcus aureus
DDHISNTPK

SEQ ID NO: 1616019 - protein, 13 aa, Staphylococcus aureus
DEPTGSLDTKNGK

SEQ ID NO: 1616020 - protein, 5 aa, Staphylococcus aureus
DGGAI

SEQ ID NO: 1616021 - protein, 4 aa, Staphylococcus aureus
DGRI

SEQ ID NO: 1616022 - protein, 6 aa, Staphylococcus aureus
DIESNE

SEQ ID NO: 1616023 - protein, 5 aa, Staphylococcus aureus
DIGNP

SEQ ID NO: 1616024 - protein, 6 aa, Staphylococcus aureus
DLESED

SEQ ID NO: 1616025 - protein, 4 aa, Staphylococcus aureus
DNTS

SEQ ID NO: 1616026 - protein, 6 aa, Staphylococcus aureus
DSLEKI

SEQ ID NO: 1616027 - protein, 7 aa, Staphylococcus aureus
DTNIGGE

SEQ ID NO: 1616028 - protein, 8 aa, Staphylococcus aureus
DTRNTHPK

SEQ ID NO: 1616029 - protein, 8 aa, Staphylococcus aureus
DTVQYENA

SEQ ID NO: 1616030 - protein, 5 aa, Staphylococcus aureus
DTYTN

SEQ ID NO: 1616031 - protein, 9 aa, Staphylococcus aureus
DVTSSTSTK

SEQ ID NO: 1616032 - protein, 11 aa, Staphylococcus aureus
EAKDEGIESNE

SEQ ID NO: 1616033 - protein, 5 aa, Staphylococcus aureus
EAVTN

SEQ ID NO: 1616034 - protein, 8 aa, Staphylococcus aureus
EDETPSNA

SEQ ID NO: 1616035 - protein, 4 aa, Staphylococcus aureus
EDIG

SEQ ID NO: 1616036 - protein, 14 aa, Staphylococcus aureus
EESYESEKKRIENE

SEQ ID NO: 1616037 - protein, 10 aa, Staphylococcus aureus
EEVADETIES

SEQ ID NO: 1616038 - protein, 5 aa, Staphylococcus aureus
EGKDC

SEQ ID NO: 1616039 - protein, 9 aa, Staphylococcus aureus
EGQVDASDI

SEQ ID NO: 1616040 - protein, 7 aa, Staphylococcus aureus
EIPPEKV

SEQ ID NO: 1616041 - protein, 15 aa, Staphylococcus aureus
EITADVKNESFAQSK

SEQ ID NO: 1616042 - protein, 7 aa, Staphylococcus aureus
EKDASRA

SEQ ID NO: 1616043 - protein, 8 aa, Staphylococcus aureus
EKEATAED

SEQ ID NO: 1616044 - protein, 7 aa, Staphylococcus aureus
EKYAPEC

SEQ ID NO: 1616045 - protein, 17 aa, Staphylococcus aureus
ENLPQGMKARAKYQNTT

SEQ ID NO: 1616046 - protein, 7 aa, Staphylococcus aureus
ERYKGGL

SEQ ID NO: 1616047 - protein, 17 aa, Staphylococcus aureus
ESEEEGTVVAQNGASLS

SEQ ID NO: 1616048 - protein, 4 aa, Staphylococcus aureus
ESPG

SEQ ID NO: 1616049 - protein, 5 aa, Staphylococcus aureus
EVLST

SEQ ID NO: 1616050 - protein, 10 aa, Staphylococcus aureus
EWEEKQLGDL

SEQ ID NO: 1616051 - protein, 5 aa, Staphylococcus aureus
EYPGL

SEQ ID NO: 1616052 - protein, 5 aa, Staphylococcus aureus
FSKEA

SEQ ID NO: 1616053 - protein, 7 aa, Staphylococcus aureus
GEGLSET

SEQ ID NO: 1616054 - protein, 5 aa, Staphylococcus aureus
GEKNH

SEQ ID NO: 1616055 - protein, 11 aa, Staphylococcus aureus
GEKQQLNAGTS

SEQ ID NO: 1616056 - protein, 4 aa, Staphylococcus aureus
GGFE

SEQ ID NO: 1616057 - protein, 4 aa, Staphylococcus aureus
GGGT

SEQ ID NO: 1616058 - protein, 8 aa, Staphylococcus aureus
GGSTETSY

SEQ ID NO: 1616059 - protein, 13 aa, Staphylococcus aureus
GKLELKSGSRISK

SEQ ID NO: 1616060 - protein, 7 aa, Staphylococcus aureus
GKPLFTS

SEQ ID NO: 1616061 - protein, 8 aa, Staphylococcus aureus
GLAEETRF

SEQ ID NO: 1616062 - protein, 9 aa, Staphylococcus aureus
GLPNDPKMT

SEQ ID NO: 1616063 - protein, 6 aa, Staphylococcus aureus
GNVTET

SEQ ID NO: 1616064 - protein, 6 aa, Staphylococcus aureus
GRCKPT

SEQ ID NO: 1616065 - protein, 19 aa, Staphylococcus aureus
GRTKDKNGTSWVGENTRAP

SEQ ID NO: 1616066 - protein, 5 aa, Staphylococcus aureus
GSKSN

SEQ ID NO: 1616067 - protein, 8 aa, Staphylococcus aureus
GSRAVKPP

SEQ ID NO: 1616068 - protein, 9 aa, Staphylococcus aureus
GVAPFSDNQ

SEQ ID NO: 1616069 - protein, 4 aa, Staphylococcus aureus
HDQD

SEQ ID NO: 1616070 - protein, 9 aa, Staphylococcus aureus
HPESKANRI

SEQ ID NO: 1616071 - protein, 13 aa, Staphylococcus aureus
HPINERAQTVAEH

SEQ ID NO: 1616072 - protein, 8 aa, Staphylococcus aureus
HPRVAETT

SEQ ID NO: 1616073 - protein, 12 aa, Staphylococcus aureus
HRETIEDYTSRT

SEQ ID NO: 1616074 - protein, 9 aa, Staphylococcus aureus
HSSKELHEM

SEQ ID NO: 1616075 - protein, 6 aa, Staphylococcus aureus
HTYSGQ

SEQ ID NO: 1616076 - protein, 13 aa, Staphylococcus aureus
IDSTEKQKAIEEL

SEQ ID NO: 1616077 - protein, 6 aa, Staphylococcus aureus
IEDTSA

SEQ ID NO: 1616078 - protein, 10 aa, Staphylococcus aureus
IKNGANDHGE

SEQ ID NO: 1616079 - protein, 5 aa, Staphylococcus aureus
INTNN

SEQ ID NO: 1616080 - protein, 11 aa, Staphylococcus aureus
IPTPDNKSELI

SEQ ID NO: 1616081 - protein, 9 aa, Staphylococcus aureus
ISEQSPGAS

SEQ ID NO: 1616082 - protein, 7 aa, Staphylococcus aureus
KDFTKAN

SEQ ID NO: 1616083 - protein, 4 aa, Staphylococcus aureus
KDKI

SEQ ID NO: 1616084 - protein, 17 aa, Staphylococcus aureus
KEERNPLYTSSYGTGEL

SEQ ID NO: 1616085 - protein, 15 aa, Staphylococcus aureus
KEGEFSRQNVTNALE

SEQ ID NO: 1616086 - protein, 8 aa, Staphylococcus aureus
KEKYGPDA

SEQ ID NO: 1616087 - protein, 6 aa, Staphylococcus aureus
KGDERN

SEQ ID NO: 1616088 - protein, 20 aa, Staphylococcus aureus
KGDNVQDAQRDAYEKVSQIQ

SEQ ID NO: 1616089 - protein, 10 aa, Staphylococcus aureus
KINKKDSALQ

SEQ ID NO: 1616090 - protein, 6 aa, Staphylococcus aureus
KKNNGA

SEQ ID NO: 1616091 - protein, 12 aa, Staphylococcus aureus
KLELKSGSRISK

SEQ ID NO: 1616092 - protein, 26 aa, Staphylococcus aureus
KLGNLTTKIGSGKTPKGGSENYTNKG

SEQ ID NO: 1616093 - protein, 7 aa, Staphylococcus aureus
KNDGNLT

SEQ ID NO: 1616094 - protein, 9 aa, Staphylococcus aureus
KNQLREKAR

SEQ ID NO: 1616095 - protein, 8 aa, Staphylococcus aureus
KQESEDIK

SEQ ID NO: 1616096 - protein, 7 aa, Staphylococcus aureus
KRKAEVG

SEQ ID NO: 1616097 - protein, 4 aa, Staphylococcus aureus
KRME

SEQ ID NO: 1616098 - protein, 4 aa, Staphylococcus aureus
KSEL

SEQ ID NO: 1616099 - protein, 6 aa, Staphylococcus aureus
KSFPEG

SEQ ID NO: 1616100 - protein, 6 aa, Staphylococcus aureus
KSGADV

SEQ ID NO: 1616101 - protein, 10 aa, Staphylococcus aureus
KSHAPGEDVK

SEQ ID NO: 1616102 - protein, 9 aa, Staphylococcus aureus
KSKKLTTYK

SEQ ID NO: 1616103 - protein, 6 aa, Staphylococcus aureus
KSWSEK

SEQ ID NO: 1616104 - protein, 5 aa, Staphylococcus aureus
KTDDG

SEQ ID NO: 1616105 - protein, 8 aa, Staphylococcus aureus
KTKSSIEA

SEQ ID NO: 1616106 - protein, 5 aa, Staphylococcus aureus
KTPVN

SEQ ID NO: 1616107 - protein, 10 aa, Staphylococcus aureus
KTQQDDLDSG

SEQ ID NO: 1616108 - protein, 4 aa, Staphylococcus aureus
KTSN

SEQ ID NO: 1616109 - protein, 7 aa, Staphylococcus aureus
KVDPKNI

SEQ ID NO: 1616110 - protein, 24 aa, Staphylococcus aureus
KVSVGDKAKSVIKQATAKKQAVIK

SEQ ID NO: 1616111 - protein, 8 aa, Staphylococcus aureus
KYSRETME

SEQ ID NO: 1616112 - protein, 6 aa, Staphylococcus aureus
LAPDET

SEQ ID NO: 1616113 - protein, 12 aa, Staphylococcus aureus
LARGERTGEEVA

SEQ ID NO: 1616114 - protein, 17 aa, Staphylococcus aureus
LDDPQYTTRIQDGKNPI

SEQ ID NO: 1616115 - protein, 14 aa, Staphylococcus aureus
LGVGGITDATTISE

SEQ ID NO: 1616116 - protein, 23 aa, Staphylococcus aureus
LKGAYKSFNKSKEIIQNAKDRDA

SEQ ID NO: 1616117 - protein, 7 aa, Staphylococcus aureus
LMPEGGS

SEQ ID NO: 1616118 - protein, 4 aa, Staphylococcus aureus
LQNS

SEQ ID NO: 1616119 - protein, 7 aa, Staphylococcus aureus
LSNKDIS

SEQ ID NO: 1616120 - protein, 14 aa, Staphylococcus aureus
LTNLSTSALQQIRG

SEQ ID NO: 1616121 - protein, 9 aa, Staphylococcus aureus
LTPNEMTNQ

SEQ ID NO: 1616122 - protein, 4 aa, Staphylococcus aureus
LYGE

SEQ ID NO: 1616123 - protein, 9 aa, Staphylococcus aureus
LYGPTVGDS

SEQ ID NO: 1616124 - protein, 8 aa, Staphylococcus aureus
MADTTRDD

SEQ ID NO: 1616125 - protein, 7 aa, Staphylococcus aureus
MPPTGGL

SEQ ID NO: 1616126 - protein, 4 aa, Staphylococcus aureus
MSKR

SEQ ID NO: 1616127 - protein, 18 aa, Staphylococcus aureus
NADYGGTLDSFPGEFAEA

SEQ ID NO: 1616128 - protein, 5 aa, Staphylococcus aureus
NDKGF

SEQ ID NO: 1616129 - protein, 19 aa, Staphylococcus aureus
NFDDKKELAETLSEATRSE

SEQ ID NO: 1616130 - protein, 22 aa, Staphylococcus aureus
NGEDEEDSETEPEEMGKTEEQS

SEQ ID NO: 1616131 - protein, 7 aa, Staphylococcus aureus
NKLQGRP

SEQ ID NO: 1616132 - protein, 13 aa, Staphylococcus aureus
NKNLESKKPLTIS

SEQ ID NO: 1616133 - protein, 8 aa, Staphylococcus aureus
NKRITDEA

SEQ ID NO: 1616134 - protein, 7 aa, Staphylococcus aureus
NNEYRSV

SEQ ID NO: 1616135 - protein, 10 aa, Staphylococcus aureus
NNNDQATEIL

SEQ ID NO: 1616136 - protein, 9 aa, Staphylococcus aureus
NQKDKAGKN

SEQ ID NO: 1616137 - protein, 6 aa, Staphylococcus aureus
NQNALP

SEQ ID NO: 1616138 - protein, 6 aa, Staphylococcus aureus
NSALEQ

SEQ ID NO: 1616139 - protein, 6 aa, Staphylococcus aureus
NYDTNE

SEQ ID NO: 1616140 - protein, 15 aa, Staphylococcus aureus
NYPDYDYNHETATDP

SEQ ID NO: 1616141 - protein, 6 aa, Staphylococcus aureus
PDEFTV

SEQ ID NO: 1616142 - protein, 5 aa, Staphylococcus aureus
PEDEN

SEQ ID NO: 1616143 - protein, 15 aa, Staphylococcus aureus
PKGNVEEPEHDGSAE

SEQ ID NO: 1616144 - protein, 17 aa, Staphylococcus aureus
PKRRKTIEDIEKDESKM

SEQ ID NO: 1616145 - protein, 7 aa, Staphylococcus aureus
PLTRTPD

SEQ ID NO: 1616146 - protein, 5 aa, Staphylococcus aureus
PNEHK

SEQ ID NO: 1616147 - protein, 10 aa, Staphylococcus aureus
PSKHISSNEI

SEQ ID NO: 1616148 - protein, 5 aa, Staphylococcus aureus
PTDKA

SEQ ID NO: 1616149 - protein, 9 aa, Staphylococcus aureus
QAKSSISED

SEQ ID NO: 1616150 - protein, 4 aa, Staphylococcus aureus
QDDL

SEQ ID NO: 1616151 - protein, 9 aa, Staphylococcus aureus
QEQTAEAVK

SEQ ID NO: 1616152 - protein, 10 aa, Staphylococcus aureus
QIKGSTEISA

SEQ ID NO: 1616153 - protein, 6 aa, Staphylococcus aureus
QKYQTK

SEQ ID NO: 1616154 - protein, 4 aa, Staphylococcus aureus
QNGK

SEQ ID NO: 1616155 - protein, 7 aa, Staphylococcus aureus
QNGYSDA

SEQ ID NO: 1616156 - protein, 21 aa, Staphylococcus aureus
QQCKRDGKLTTYDKSKRKSLD

SEQ ID NO: 1616157 - protein, 11 aa, Staphylococcus aureus
RALSSAQKEIL

SEQ ID NO: 1616158 - protein, 7 aa, Staphylococcus aureus
RKSDEPI

SEQ ID NO: 1616159 - protein, 7 aa, Staphylococcus aureus
RQQEINQ

SEQ ID NO: 1616160 - protein, 13 aa, Staphylococcus aureus
RRKALEKEQALKE

SEQ ID NO: 1616161 - protein, 5 aa, Staphylococcus aureus
RRNET

SEQ ID NO: 1616162 - protein, 4 aa, Staphylococcus aureus
RTEG

SEQ ID NO: 1616163 - protein, 4 aa, Staphylococcus aureus
RWST

SEQ ID NO: 1616164 - protein, 5 aa, Staphylococcus aureus
SAREH

SEQ ID NO: 1616165 - protein, 4 aa, Staphylococcus aureus
SDKL

SEQ ID NO: 1616166 - protein, 9 aa, Staphylococcus aureus
SDLSESEYN

SEQ ID NO: 1616167 - protein, 4 aa, Staphylococcus aureus
SEQP

SEQ ID NO: 1616168 - protein, 7 aa, Staphylococcus aureus
SGMDTGE

SEQ ID NO: 1616169 - protein, 7 aa, Staphylococcus aureus
SGTDDYV

SEQ ID NO: 1616170 - protein, 8 aa, Staphylococcus aureus
SHKGNYTP

SEQ ID NO: 1616171 - protein, 9 aa, Staphylococcus aureus
SNSSTTENI

SEQ ID NO: 1616172 - protein, 6 aa, Staphylococcus aureus
SPIDTT

SEQ ID NO: 1616173 - protein, 21 aa, Staphylococcus aureus
SQNEGKSVDALKNSTASLKNN

SEQ ID NO: 1616174 - protein, 13 aa, Staphylococcus aureus
SRKGTPADNAPIE

SEQ ID NO: 1616175 - protein, 13 aa, Staphylococcus aureus
SRLPHSEESHTFH

SEQ ID NO: 1616176 - protein, 5 aa, Staphylococcus aureus
SRTYH

SEQ ID NO: 1616177 - protein, 4 aa, Staphylococcus aureus
SSQI

SEQ ID NO: 1616178 - protein, 21 aa, Staphylococcus aureus
STNPDVSIPKERGLLPGNGAI

SEQ ID NO: 1616179 - protein, 5 aa, Staphylococcus aureus
SVEKP

SEQ ID NO: 1616180 - protein, 21 aa, Staphylococcus aureus
SVESNKLDDDSSETGKTPEYS

SEQ ID NO: 1616181 - protein, 6 aa, Staphylococcus aureus
SVWKGT

SEQ ID NO: 1616182 - protein, 5 aa, Staphylococcus aureus
TDAEG

SEQ ID NO: 1616183 - protein, 12 aa, Staphylococcus aureus
TEAQDALSTPSN

SEQ ID NO: 1616184 - protein, 4 aa, Staphylococcus aureus
TELE

SEQ ID NO: 1616185 - protein, 6 aa, Staphylococcus aureus
TEPRSD

SEQ ID NO: 1616186 - protein, 4 aa, Staphylococcus aureus
TERH

SEQ ID NO: 1616187 - protein, 18 aa, Staphylococcus aureus
TGESSIANMADEKAGVSA

SEQ ID NO: 1616188 - protein, 19 aa, Staphylococcus aureus
TGEVDKAGNRISSFGKFSA

SEQ ID NO: 1616189 - protein, 6 aa, Staphylococcus aureus
TGGQHR

SEQ ID NO: 1616190 - protein, 4 aa, Staphylococcus aureus
TGQL

SEQ ID NO: 1616191 - protein, 5 aa, Staphylococcus aureus
TIPFD

SEQ ID NO: 1616192 - protein, 12 aa, Staphylococcus aureus
TLQTSSKDRAEN

SEQ ID NO: 1616193 - protein, 5 aa, Staphylococcus aureus
TNAFE

SEQ ID NO: 1616194 - protein, 8 aa, Staphylococcus aureus
TNGNKGIA

SEQ ID NO: 1616195 - protein, 8 aa, Staphylococcus aureus
TQELREQG

SEQ ID NO: 1616196 - protein, 6 aa, Staphylococcus aureus
TSEVEG

SEQ ID NO: 1616197 - protein, 6 aa, Staphylococcus aureus
TSMEDL

SEQ ID NO: 1616198 - protein, 8 aa, Staphylococcus aureus
TSTSSSIE

SEQ ID NO: 1616199 - protein, 6 aa, Staphylococcus aureus
TTKSNV

SEQ ID NO: 1616200 - protein, 12 aa, Staphylococcus aureus
TTLGRGGSDTTA

SEQ ID NO: 1616201 - protein, 14 aa, Staphylococcus aureus
TYEYKEKPYEKDYG

SEQ ID NO: 1616202 - protein, 6 aa, Staphylococcus aureus
VGNADV

SEQ ID NO: 1616203 - protein, 24 aa, Staphylococcus aureus
VKSPATSSSTGKSSEVNPKPQSDE

SEQ ID NO: 1616204 - protein, 8 aa, Staphylococcus aureus
VNKSGQLI

SEQ ID NO: 1616205 - protein, 12 aa, Staphylococcus aureus
VPTDVTNKEEVD

SEQ ID NO: 1616206 - protein, 21 aa, Staphylococcus aureus
VQKGVSVTEGAYPEKEEQGTL

SEQ ID NO: 1616207 - protein, 18 aa, Staphylococcus aureus
VRATKAKDDNNASAIAND

SEQ ID NO: 1616208 - protein, 10 aa, Staphylococcus aureus
VTLTDGKVKP

SEQ ID NO: 1616209 - protein, 6 aa, Staphylococcus aureus
VTNNGD

SEQ ID NO: 1616210 - protein, 7 aa, Staphylococcus aureus
VTSGDVG

SEQ ID NO: 1616211 - protein, 9 aa, Staphylococcus aureus
WETSQEAKA

SEQ ID NO: 1616212 - protein, 11 aa, Staphylococcus aureus
WSKKKKSEMVG

SEQ ID NO: 1616213 - protein, 9 aa, Staphylococcus aureus
WSSTQNSIE

SEQ ID NO: 1616214 - protein, 4 aa, Staphylococcus aureus
YDRA

SEQ ID NO: 1616215 - protein, 14 aa, Staphylococcus aureus
YNFSSGESKSRSNI

SEQ ID NO: 1616216 - protein, 11 aa, Staphylococcus aureus
YNKSYSNGYPL

SEQ ID NO: 1616217 - protein, 8 aa, Staphylococcus aureus
YQGGAGAL

SEQ ID NO: 1616218 - protein, 10 aa, Staphylococcus aureus
YQRTGTPIHP

SEQ ID NO: 1616219 - protein, 6 aa, Staphylococcus aureus
AANDNP

SEQ ID NO: 1616220 - protein, 6 aa, Staphylococcus aureus
AATNAA

SEQ ID NO: 1616221 - protein, 5 aa, Staphylococcus aureus
ADAAG

SEQ ID NO: 1616222 - protein, 8 aa, Staphylococcus aureus
AEEISDSR

SEQ ID NO: 1616223 - protein, 10 aa, Staphylococcus aureus
AEKLENGETL

SEQ ID NO: 1616224 - protein, 6 aa, Staphylococcus aureus
AGRDTL

SEQ ID NO: 1616225 - protein, 8 aa, Staphylococcus aureus
AHPHPKRK

SEQ ID NO: 1616226 - protein, 5 aa, Staphylococcus aureus
AIEAD

SEQ ID NO: 1616227 - protein, 17 aa, Staphylococcus aureus
AISTPRSKQTAAETLAQ

SEQ ID NO: 1616228 - protein, 4 aa, Staphylococcus aureus
AKSV

SEQ ID NO: 1616229 - protein, 6 aa, Staphylococcus aureus
AKTYSL

SEQ ID NO: 1616230 - protein, 10 aa, Staphylococcus aureus
AMANDQGITK

SEQ ID NO: 1616231 - protein, 6 aa, Staphylococcus aureus
APMEVN

SEQ ID NO: 1616232 - protein, 4 aa, Staphylococcus aureus
AQLE

SEQ ID NO: 1616233 - protein, 5 aa, Staphylococcus aureus
AQNET

SEQ ID NO: 1616234 - protein, 12 aa, Staphylococcus aureus
AQYDSEDKRQDV

SEQ ID NO: 1616235 - protein, 7 aa, Staphylococcus aureus
ASGAVGS

SEQ ID NO: 1616236 - protein, 12 aa, Staphylococcus aureus
AYSNPNTTTTGY

SEQ ID NO: 1616237 - protein, 5 aa, Staphylococcus aureus
CTERR

SEQ ID NO: 1616238 - protein, 7 aa, Staphylococcus aureus
DAGATEI

SEQ ID NO: 1616239 - protein, 8 aa, Staphylococcus aureus
DASNKASI

SEQ ID NO: 1616240 - protein, 11 aa, Staphylococcus aureus
DDDDDINDSSN

SEQ ID NO: 1616241 - protein, 4 aa, Staphylococcus aureus
DELQ

SEQ ID NO: 1616242 - protein, 13 aa, Staphylococcus aureus
DEPTGALDSDTSK

SEQ ID NO: 1616243 - protein, 6 aa, Staphylococcus aureus
DGTTTV

SEQ ID NO: 1616244 - protein, 7 aa, Staphylococcus aureus
DKIKYSG

SEQ ID NO: 1616245 - protein, 5 aa, Staphylococcus aureus
DKMDK

SEQ ID NO: 1616246 - protein, 11 aa, Staphylococcus aureus
DKTAEAKEQVN

SEQ ID NO: 1616247 - protein, 6 aa, Staphylococcus aureus
DKTEQK

SEQ ID NO: 1616248 - protein, 5 aa, Staphylococcus aureus
DLQGD

SEQ ID NO: 1616249 - protein, 14 aa, Staphylococcus aureus
DNEVPSEALNDETL

SEQ ID NO: 1616250 - protein, 5 aa, Staphylococcus aureus
DNIVN

SEQ ID NO: 1616251 - protein, 7 aa, Staphylococcus aureus
DNNGITS

SEQ ID NO: 1616252 - protein, 9 aa, Staphylococcus aureus
DQESANQEA

SEQ ID NO: 1616253 - protein, 7 aa, Staphylococcus aureus
DQGSVYT

SEQ ID NO: 1616254 - protein, 6 aa, Staphylococcus aureus
DQQLDE

SEQ ID NO: 1616255 - protein, 5 aa, Staphylococcus aureus
DRMSE

SEQ ID NO: 1616256 - protein, 16 aa, Staphylococcus aureus
DTANSEVVGKHGEKVT

SEQ ID NO: 1616257 - protein, 13 aa, Staphylococcus aureus
DYATGGDTTIESG

SEQ ID NO: 1616258 - protein, 19 aa, Staphylococcus aureus
EAGRANGRSSKLDSPYDGY

SEQ ID NO: 1616259 - protein, 4 aa, Staphylococcus aureus
EAHP

SEQ ID NO: 1616260 - protein, 5 aa, Staphylococcus aureus
EFGQM

SEQ ID NO: 1616261 - protein, 10 aa, Staphylococcus aureus
EFKPKQIEDF

SEQ ID NO: 1616262 - protein, 10 aa, Staphylococcus aureus
EGPGLTKKMN

SEQ ID NO: 1616263 - protein, 14 aa, Staphylococcus aureus
EGTYRTETIGSKAT

SEQ ID NO: 1616264 - protein, 21 aa, Staphylococcus aureus
EHTEEDIQQTLKAADYAFSQM

SEQ ID NO: 1616265 - protein, 8 aa, Staphylococcus aureus
ELGKDGSE

SEQ ID NO: 1616266 - protein, 7 aa, Staphylococcus aureus
ELPEGTK

SEQ ID NO: 1616267 - protein, 7 aa, Staphylococcus aureus
ENRKQDS

SEQ ID NO: 1616268 - protein, 8 aa, Staphylococcus aureus
EPATDSPL

SEQ ID NO: 1616269 - protein, 7 aa, Staphylococcus aureus
EPHIEAN

SEQ ID NO: 1616270 - protein, 12 aa, Staphylococcus aureus
EPTGALDSKTSK

SEQ ID NO: 1616271 - protein, 16 aa, Staphylococcus aureus
EQESKQQLTEDQYKAY

SEQ ID NO: 1616272 - protein, 6 aa, Staphylococcus aureus
EQKDVV

SEQ ID NO: 1616273 - protein, 7 aa, Staphylococcus aureus
EQKPRHT

SEQ ID NO: 1616274 - protein, 4 aa, Staphylococcus aureus
ERNG

SEQ ID NO: 1616275 - protein, 11 aa, Staphylococcus aureus
ERQLSTIGSSV

SEQ ID NO: 1616276 - protein, 8 aa, Staphylococcus aureus
ESETTLPD

SEQ ID NO: 1616277 - protein, 4 aa, Staphylococcus aureus
FDEL

SEQ ID NO: 1616278 - protein, 19 aa, Staphylococcus aureus
FGDLSENSEYDAAKDEQGF

SEQ ID NO: 1616279 - protein, 23 aa, Staphylococcus aureus
FNFDGKDAKIYGNNATGKTTTAT

SEQ ID NO: 1616280 - protein, 5 aa, Staphylococcus aureus
FNGGR

SEQ ID NO: 1616281 - protein, 4 aa, Staphylococcus aureus
FNQN

SEQ ID NO: 1616282 - protein, 11 aa, Staphylococcus aureus
FSPEEAATPEA

SEQ ID NO: 1616283 - protein, 14 aa, Staphylococcus aureus
FTDKRKAQSFNQTT

SEQ ID NO: 1616284 - protein, 8 aa, Staphylococcus aureus
GAKRAEQV

SEQ ID NO: 1616285 - protein, 7 aa, Staphylococcus aureus
GAMAKHT

SEQ ID NO: 1616286 - protein, 8 aa, Staphylococcus aureus
GASEAIDT

SEQ ID NO: 1616287 - protein, 5 aa, Staphylococcus aureus
GDKNH

SEQ ID NO: 1616288 - protein, 6 aa, Staphylococcus aureus
GDTAGI

SEQ ID NO: 1616289 - protein, 5 aa, Staphylococcus aureus
GEDFE

SEQ ID NO: 1616290 - protein, 4 aa, Staphylococcus aureus
GELN

SEQ ID NO: 1616291 - protein, 7 aa, Staphylococcus aureus
GEPDPKL

SEQ ID NO: 1616292 - protein, 16 aa, Staphylococcus aureus
GEQDIKDALTQFEIEK

SEQ ID NO: 1616293 - protein, 24 aa, Staphylococcus aureus
GFGSPNKAGTNGVHGAPLGEDERK

SEQ ID NO: 1616294 - protein, 5 aa, Staphylococcus aureus
GFNEN

SEQ ID NO: 1616295 - protein, 5 aa, Staphylococcus aureus
GIDEQ

SEQ ID NO: 1616296 - protein, 17 aa, Staphylococcus aureus
GISGQFSAPSKLTPRDV

SEQ ID NO: 1616297 - protein, 5 aa, Staphylococcus aureus
GKMTE

SEQ ID NO: 1616298 - protein, 20 aa, Staphylococcus aureus
GLDGKGDFTPSKLSGGQQQR

SEQ ID NO: 1616299 - protein, 16 aa, Staphylococcus aureus
GLEGKSFEASYNRKND

SEQ ID NO: 1616300 - protein, 32 aa, Staphylococcus aureus
GRQETTYQVATDNTQDNRDNQQLNQNTATTNM

SEQ ID NO: 1616301 - protein, 13 aa, Staphylococcus aureus
GSAPDIAGKNVAN

SEQ ID NO: 1616302 - protein, 8 aa, Staphylococcus aureus
GSAPNDQF

SEQ ID NO: 1616303 - protein, 5 aa, Staphylococcus aureus
GTGGH

SEQ ID NO: 1616304 - protein, 7 aa, Staphylococcus aureus
GTKNVSV

SEQ ID NO: 1616305 - protein, 11 aa, Staphylococcus aureus
GYSREKANELL

SEQ ID NO: 1616306 - protein, 9 aa, Staphylococcus aureus
HARSQRRKH

SEQ ID NO: 1616307 - protein, 9 aa, Staphylococcus aureus
HEGTGAGSD

SEQ ID NO: 1616308 - protein, 4 aa, Staphylococcus aureus
HEPY

SEQ ID NO: 1616309 - protein, 12 aa, Staphylococcus aureus
HKSDTPPENPVN

SEQ ID NO: 1616310 - protein, 5 aa, Staphylococcus aureus
HKTES

SEQ ID NO: 1616311 - protein, 4 aa, Staphylococcus aureus
HPSA

SEQ ID NO: 1616312 - protein, 4 aa, Staphylococcus aureus
IEEN

SEQ ID NO: 1616313 - protein, 7 aa, Staphylococcus aureus
IEGIEDN

SEQ ID NO: 1616314 - protein, 6 aa, Staphylococcus aureus
IGPGSI

SEQ ID NO: 1616315 - protein, 5 aa, Staphylococcus aureus
IGTVA

SEQ ID NO: 1616316 - protein, 6 aa, Staphylococcus aureus
IKSMGK

SEQ ID NO: 1616317 - protein, 6 aa, Staphylococcus aureus
INRENY

SEQ ID NO: 1616318 - protein, 15 aa, Staphylococcus aureus
IPYAGSSDIDGLPQD

SEQ ID NO: 1616319 - protein, 4 aa, Staphylococcus aureus
ISTR

SEQ ID NO: 1616320 - protein, 10 aa, Staphylococcus aureus
ITEAVTEGVP

SEQ ID NO: 1616321 - protein, 11 aa, Staphylococcus aureus
KAQQESYSPYS

SEQ ID NO: 1616322 - protein, 13 aa, Staphylococcus aureus
KASQKFRYGEKYT

SEQ ID NO: 1616323 - protein, 17 aa, Staphylococcus aureus
KATEDISDQTTNAEIAT

SEQ ID NO: 1616324 - protein, 8 aa, Staphylococcus aureus
KCKENIPQ

SEQ ID NO: 1616325 - protein, 10 aa, Staphylococcus aureus
KDDLQSQDTL

SEQ ID NO: 1616326 - protein, 9 aa, Staphylococcus aureus
KDEPAGEDC

SEQ ID NO: 1616327 - protein, 9 aa, Staphylococcus aureus
KDSIQKGDD

SEQ ID NO: 1616328 - protein, 7 aa, Staphylococcus aureus
KEAEFKG

SEQ ID NO: 1616329 - protein, 8 aa, Staphylococcus aureus
KEATAETN

SEQ ID NO: 1616330 - protein, 6 aa, Staphylococcus aureus
KEFATG

SEQ ID NO: 1616331 - protein, 7 aa, Staphylococcus aureus
KEWQTTR

SEQ ID NO: 1616332 - protein, 4 aa, Staphylococcus aureus
KGDK

SEQ ID NO: 1616333 - protein, 8 aa, Staphylococcus aureus
KGDKERIV

SEQ ID NO: 1616334 - protein, 8 aa, Staphylococcus aureus
KGEKVEAK

SEQ ID NO: 1616335 - protein, 5 aa, Staphylococcus aureus
KGKYY

SEQ ID NO: 1616336 - protein, 7 aa, Staphylococcus aureus
KGRHEIS

SEQ ID NO: 1616337 - protein, 4 aa, Staphylococcus aureus
KGVA

SEQ ID NO: 1616338 - protein, 15 aa, Staphylococcus aureus
KGVEGLSPKTRRKYE

SEQ ID NO: 1616339 - protein, 5 aa, Staphylococcus aureus
KKEKY

SEQ ID NO: 1616340 - protein, 9 aa, Staphylococcus aureus
KKKPGKPLD

SEQ ID NO: 1616341 - protein, 11 aa, Staphylococcus aureus
KLIDSNKANID

SEQ ID NO: 1616342 - protein, 7 aa, Staphylococcus aureus
KLQGGYG

SEQ ID NO: 1616343 - protein, 7 aa, Staphylococcus aureus
KNGDKNI

SEQ ID NO: 1616344 - protein, 9 aa, Staphylococcus aureus
KNKKDNMNL

SEQ ID NO: 1616345 - protein, 7 aa, Staphylococcus aureus
KPTNQQL

SEQ ID NO: 1616346 - protein, 5 aa, Staphylococcus aureus
KQPQV

SEQ ID NO: 1616347 - protein, 4 aa, Staphylococcus aureus
KQQI

SEQ ID NO: 1616348 - protein, 8 aa, Staphylococcus aureus
KRMAEEKG

SEQ ID NO: 1616349 - protein, 17 aa, Staphylococcus aureus
KSIRKDVSEQSDQSIEN

SEQ ID NO: 1616350 - protein, 4 aa, Staphylococcus aureus
KSTL

SEQ ID NO: 1616351 - protein, 17 aa, Staphylococcus aureus
KTLYATPDYEHIQKMKQ

SEQ ID NO: 1616352 - protein, 6 aa, Staphylococcus aureus
KTTSKY

SEQ ID NO: 1616353 - protein, 15 aa, Staphylococcus aureus
KWERPDYVFPGNQVD

SEQ ID NO: 1616354 - protein, 12 aa, Staphylococcus aureus
KYPSGHALPTEK

SEQ ID NO: 1616355 - protein, 10 aa, Staphylococcus aureus
LAEDQDEPDY

SEQ ID NO: 1616356 - protein, 7 aa, Staphylococcus aureus
LDPEKRF

SEQ ID NO: 1616357 - protein, 11 aa, Staphylococcus aureus
LGSDEKSKELK

SEQ ID NO: 1616358 - protein, 4 aa, Staphylococcus aureus
LGSE

SEQ ID NO: 1616359 - protein, 27 aa, Staphylococcus aureus
LKDGGRNNHAQRTVGGEDRLPDDDGGH

SEQ ID NO: 1616360 - protein, 6 aa, Staphylococcus aureus
LKGGQK

SEQ ID NO: 1616361 - protein, 10 aa, Staphylococcus aureus
LNRAEDRKEF

SEQ ID NO: 1616362 - protein, 10 aa, Staphylococcus aureus
LQDELKSQGV

SEQ ID NO: 1616363 - protein, 4 aa, Staphylococcus aureus
LQQP

SEQ ID NO: 1616364 - protein, 9 aa, Staphylococcus aureus
LQQRPKETL

SEQ ID NO: 1616365 - protein, 4 aa, Staphylococcus aureus
LRQV

SEQ ID NO: 1616366 - protein, 4 aa, Staphylococcus aureus
LSKG

SEQ ID NO: 1616367 - protein, 6 aa, Staphylococcus aureus
MEQERT

SEQ ID NO: 1616368 - protein, 10 aa, Staphylococcus aureus
MPDSPTSKLS

SEQ ID NO: 1616369 - protein, 4 aa, Staphylococcus aureus
NDEL

SEQ ID NO: 1616370 - protein, 4 aa, Staphylococcus aureus
NDKN

SEQ ID NO: 1616371 - protein, 6 aa, Staphylococcus aureus
NDQYSE

SEQ ID NO: 1616372 - protein, 13 aa, Staphylococcus aureus
NEKTLNDMRSGSE

SEQ ID NO: 1616373 - protein, 8 aa, Staphylococcus aureus
NESLENTP

SEQ ID NO: 1616374 - protein, 5 aa, Staphylococcus aureus
NGNPV

SEQ ID NO: 1616375 - protein, 6 aa, Staphylococcus aureus
NHIENQ

SEQ ID NO: 1616376 - protein, 7 aa, Staphylococcus aureus
NISKQDN

SEQ ID NO: 1616377 - protein, 6 aa, Staphylococcus aureus
NKDKES

SEQ ID NO: 1616378 - protein, 17 aa, Staphylococcus aureus
NKTINSDKLHLDIYLFK

SEQ ID NO: 1616379 - protein, 19 aa, Staphylococcus aureus
NNPISPDPTEAKEADETLR

SEQ ID NO: 1616380 - protein, 19 aa, Staphylococcus aureus
NNTARATWYPDDSNDEYTK

SEQ ID NO: 1616381 - protein, 9 aa, Staphylococcus aureus
NPENLKGIG

SEQ ID NO: 1616382 - protein, 4 aa, Staphylococcus aureus
NQAS

SEQ ID NO: 1616383 - protein, 4 aa, Staphylococcus aureus
NRER

SEQ ID NO: 1616384 - protein, 5 aa, Staphylococcus aureus
NSKKI

SEQ ID NO: 1616385 - protein, 7 aa, Staphylococcus aureus
NTRTAKG

SEQ ID NO: 1616386 - protein, 8 aa, Staphylococcus aureus
NTRTTKGN

SEQ ID NO: 1616387 - protein, 35 aa, Staphylococcus aureus
PFGSKFDRSGLSSDLKEEWDQYSKEELVEKEADSH

SEQ ID NO: 1616388 - protein, 8 aa, Staphylococcus aureus
PNKQSINE

SEQ ID NO: 1616389 - protein, 4 aa, Staphylococcus aureus
PTEA

SEQ ID NO: 1616390 - protein, 7 aa, Staphylococcus aureus
PTETLKE

SEQ ID NO: 1616391 - protein, 6 aa, Staphylococcus aureus
PTKELD

SEQ ID NO: 1616392 - protein, 4 aa, Staphylococcus aureus
PYID

SEQ ID NO: 1616393 - protein, 8 aa, Staphylococcus aureus
QDDDVEQL

SEQ ID NO: 1616394 - protein, 9 aa, Staphylococcus aureus
QDGTATYVH

SEQ ID NO: 1616395 - protein, 8 aa, Staphylococcus aureus
QDPPYPDN

SEQ ID NO: 1616396 - protein, 18 aa, Staphylococcus aureus
QDTSVTQQLEDYRSNNKY

SEQ ID NO: 1616397 - protein, 11 aa, Staphylococcus aureus
QELADKSEADM

SEQ ID NO: 1616398 - protein, 4 aa, Staphylococcus aureus
QGSP

SEQ ID NO: 1616399 - protein, 6 aa, Staphylococcus aureus
QHFNSK

SEQ ID NO: 1616400 - protein, 14 aa, Staphylococcus aureus
QKANDDGEPTGTAG

SEQ ID NO: 1616401 - protein, 4 aa, Staphylococcus aureus
QKEF

SEQ ID NO: 1616402 - protein, 5 aa, Staphylococcus aureus
QNIID

SEQ ID NO: 1616403 - protein, 44 aa, Staphylococcus aureus
QQLTAELSGVEEALEESPNSKKNKTKRTQLEQQLNSNKRKIDNT

SEQ ID NO: 1616404 - protein, 18 aa, Staphylococcus aureus
QQRLSKGSLAKAQQYSKA

SEQ ID NO: 1616405 - protein, 7 aa, Staphylococcus aureus
QTDETLD

SEQ ID NO: 1616406 - protein, 4 aa, Staphylococcus aureus
QTLP

SEQ ID NO: 1616407 - protein, 10 aa, Staphylococcus aureus
QVEDSSRPNV

SEQ ID NO: 1616408 - protein, 4 aa, Staphylococcus aureus
RDKA

SEQ ID NO: 1616409 - protein, 10 aa, Staphylococcus aureus
REGEDERTAI

SEQ ID NO: 1616410 - protein, 22 aa, Staphylococcus aureus
RGPNTEADRKSAYNNVQVGGAP

SEQ ID NO: 1616411 - protein, 4 aa, Staphylococcus aureus
RGQR

SEQ ID NO: 1616412 - protein, 7 aa, Staphylococcus aureus
RHKDNGS

SEQ ID NO: 1616413 - protein, 7 aa, Staphylococcus aureus
RNNGGGH

SEQ ID NO: 1616414 - protein, 4 aa, Staphylococcus aureus
RPSY

SEQ ID NO: 1616415 - protein, 7 aa, Staphylococcus aureus
RSNNPEL

SEQ ID NO: 1616416 - protein, 4 aa, Staphylococcus aureus
RSVQ

SEQ ID NO: 1616417 - protein, 7 aa, Staphylococcus aureus
RTYSAPA

SEQ ID NO: 1616418 - protein, 6 aa, Staphylococcus aureus
SDESQL

SEQ ID NO: 1616419 - protein, 16 aa, Staphylococcus aureus
SDLTEAETQEAQKIKA

SEQ ID NO: 1616420 - protein, 4 aa, Staphylococcus aureus
SDQI

SEQ ID NO: 1616421 - protein, 8 aa, Staphylococcus aureus
SDQRLTKP

SEQ ID NO: 1616422 - protein, 5 aa, Staphylococcus aureus
SEDDR

SEQ ID NO: 1616423 - protein, 8 aa, Staphylococcus aureus
SEENEAKY

SEQ ID NO: 1616424 - protein, 22 aa, Staphylococcus aureus
SGLSKKKQKQIAEQISANQESE

SEQ ID NO: 1616425 - protein, 4 aa, Staphylococcus aureus
SGLT

SEQ ID NO: 1616426 - protein, 12 aa, Staphylococcus aureus
SIDPKSVMGSGS

SEQ ID NO: 1616427 - protein, 17 aa, Staphylococcus aureus
SIDSTQLAAKKSLVGNQ

SEQ ID NO: 1616428 - protein, 6 aa, Staphylococcus aureus
SISQQQ

SEQ ID NO: 1616429 - protein, 7 aa, Staphylococcus aureus
SKARDTF

SEQ ID NO: 1616430 - protein, 5 aa, Staphylococcus aureus
SKPNS

SEQ ID NO: 1616431 - protein, 17 aa, Staphylococcus aureus
SLNPSNLPDGDGNGGGV

SEQ ID NO: 1616432 - protein, 14 aa, Staphylococcus aureus
SNDTTSDSNQQQLE

SEQ ID NO: 1616433 - protein, 11 aa, Staphylococcus aureus
SNQRYTNKETL

SEQ ID NO: 1616434 - protein, 9 aa, Staphylococcus aureus
SNTPGNTTQ

SEQ ID NO: 1616435 - protein, 8 aa, Staphylococcus aureus
SPAKCTKA

SEQ ID NO: 1616436 - protein, 10 aa, Staphylococcus aureus
SPGPGNPDDY

SEQ ID NO: 1616437 - protein, 8 aa, Staphylococcus aureus
SPHSDDKV

SEQ ID NO: 1616438 - protein, 5 aa, Staphylococcus aureus
SQKGF

SEQ ID NO: 1616439 - protein, 7 aa, Staphylococcus aureus
SVAENDA

SEQ ID NO: 1616440 - protein, 11 aa, Staphylococcus aureus
SVNASLNNKTI

SEQ ID NO: 1616441 - protein, 5 aa, Staphylococcus aureus
SVTAS

SEQ ID NO: 1616442 - protein, 6 aa, Staphylococcus aureus
SYQDGV

SEQ ID NO: 1616443 - protein, 11 aa, Staphylococcus aureus
SYTDSLNGVTT

SEQ ID NO: 1616444 - protein, 5 aa, Staphylococcus aureus
TDSGL

SEQ ID NO: 1616445 - protein, 4 aa, Staphylococcus aureus
TEHR

SEQ ID NO: 1616446 - protein, 4 aa, Staphylococcus aureus
TELG

SEQ ID NO: 1616447 - protein, 4 aa, Staphylococcus aureus
TELK

SEQ ID NO: 1616448 - protein, 7 aa, Staphylococcus aureus
TEYAGEM

SEQ ID NO: 1616449 - protein, 24 aa, Staphylococcus aureus
TGDQNTQDAPHRKGDKRRARAAAE

SEQ ID NO: 1616450 - protein, 15 aa, Staphylococcus aureus
TGETYNNIELIKSLS

SEQ ID NO: 1616451 - protein, 6 aa, Staphylococcus aureus
TGGLGG

SEQ ID NO: 1616452 - protein, 5 aa, Staphylococcus aureus
TGSEK

SEQ ID NO: 1616453 - protein, 5 aa, Staphylococcus aureus
TGTRV

SEQ ID NO: 1616454 - protein, 5 aa, Staphylococcus aureus
TKEEL

SEQ ID NO: 1616455 - protein, 13 aa, Staphylococcus aureus
TLTKKGWSRIDSK

SEQ ID NO: 1616456 - protein, 12 aa, Staphylococcus aureus
TMTQSTDKIDKA

SEQ ID NO: 1616457 - protein, 5 aa, Staphylococcus aureus
TPKLK

SEQ ID NO: 1616458 - protein, 11 aa, Staphylococcus aureus
TSGKEQFKREL

SEQ ID NO: 1616459 - protein, 9 aa, Staphylococcus aureus
TTEAKTGQA

SEQ ID NO: 1616460 - protein, 7 aa, Staphylococcus aureus
TTRPETM

SEQ ID NO: 1616461 - protein, 9 aa, Staphylococcus aureus
TYRQETKYK

SEQ ID NO: 1616462 - protein, 18 aa, Staphylococcus aureus
VDKDDPRFNNPTKPIGPF

SEQ ID NO: 1616463 - protein, 9 aa, Staphylococcus aureus
VGGKQTYSF

SEQ ID NO: 1616464 - protein, 13 aa, Staphylococcus aureus
VGISEDALEPYGH

SEQ ID NO: 1616465 - protein, 5 aa, Staphylococcus aureus
VKDLP

SEQ ID NO: 1616466 - protein, 5 aa, Staphylococcus aureus
VKDPR

SEQ ID NO: 1616467 - protein, 9 aa, Staphylococcus aureus
VNADEYEAI

SEQ ID NO: 1616468 - protein, 18 aa, Staphylococcus aureus
VNGKEVKSFSEPDASKLP

SEQ ID NO: 1616469 - protein, 9 aa, Staphylococcus aureus
VPSRRKDIT

SEQ ID NO: 1616470 - protein, 7 aa, Staphylococcus aureus
VTRVGRG

SEQ ID NO: 1616471 - protein, 7 aa, Staphylococcus aureus
VTTEDVE

SEQ ID NO: 1616472 - protein, 7 aa, Staphylococcus aureus
YDNNPNY

SEQ ID NO: 1616473 - protein, 7 aa, Staphylococcus aureus
YDQTISE

SEQ ID NO: 1616474 - protein, 14 aa, Staphylococcus aureus
YEQDARTWKNKGYP

SEQ ID NO: 1616475 - protein, 7 aa, Staphylococcus aureus
YNGGPVG

SEQ ID NO: 1616476 - protein, 12 aa, Staphylococcus aureus
YNYTRPSFSENK

SEQ ID NO: 1616477 - protein, 6 aa, Staphylococcus aureus
YSQSLE

SEQ ID NO: 1616478 - protein, 5 aa, Staphylococcus aureus
YTENT

SEQ ID NO: 1616479 - protein, 6 aa, Staphylococcus aureus
YVEQED

SEQ ID NO: 1616480 - protein, 5 aa, Staphylococcus aureus
AAQMD

SEQ ID NO: 1616481 - protein, 9 aa, Staphylococcus aureus
AFQQQNARA

SEQ ID NO: 1616482 - protein, 17 aa, Staphylococcus aureus
AGNGFDPSSKPKGSGLG

SEQ ID NO: 1616483 - protein, 11 aa, Staphylococcus aureus
AKDYRQGLQNQ

SEQ ID NO: 1616484 - protein, 4 aa, Staphylococcus aureus
AKEM

SEQ ID NO: 1616485 - protein, 8 aa, Staphylococcus aureus
AKHNQNGI

SEQ ID NO: 1616486 - protein, 27 aa, Staphylococcus aureus
AKHQEDTNHDAVDTQETEQKAQAKVTT

SEQ ID NO: 1616487 - protein, 10 aa, Staphylococcus aureus
AKNGDSVAQS

SEQ ID NO: 1616488 - protein, 8 aa, Staphylococcus aureus
ALRPPHRK

SEQ ID NO: 1616489 - protein, 16 aa, Staphylococcus aureus
ANAPRIDDERYSTGSK

SEQ ID NO: 1616490 - protein, 13 aa, Staphylococcus aureus
APISDEERENMKR

SEQ ID NO: 1616491 - protein, 4 aa, Staphylococcus aureus
APKT

SEQ ID NO: 1616492 - protein, 9 aa, Staphylococcus aureus
ARSAGQEVE

SEQ ID NO: 1616493 - protein, 11 aa, Staphylococcus aureus
ASTEQREENDL

SEQ ID NO: 1616494 - protein, 8 aa, Staphylococcus aureus
ASVDENET

SEQ ID NO: 1616495 - protein, 22 aa, Staphylococcus aureus
ATGDGSIAAQSAAEYIEHLNDQ

SEQ ID NO: 1616496 - protein, 4 aa, Staphylococcus aureus
ATGG

SEQ ID NO: 1616497 - protein, 42 aa, Staphylococcus aureus
ATLPNEDVVESDPSTTKAYLESEEEDNPTIGDMIGDKLKNLK

SEQ ID NO: 1616498 - protein, 10 aa, Staphylococcus aureus
AVGAKEGGVV

SEQ ID NO: 1616499 - protein, 6 aa, Staphylococcus aureus
AVGHGY

SEQ ID NO: 1616500 - protein, 8 aa, Staphylococcus aureus
AYKEKNNV

SEQ ID NO: 1616501 - protein, 10 aa, Staphylococcus aureus
CGRPTRFTPE

SEQ ID NO: 1616502 - protein, 9 aa, Staphylococcus aureus
CNDTSKANA

SEQ ID NO: 1616503 - protein, 17 aa, Staphylococcus aureus
DADGPTGTFINGNGEMP

SEQ ID NO: 1616504 - protein, 12 aa, Staphylococcus aureus
DAFDSDDHAQPN

SEQ ID NO: 1616505 - protein, 6 aa, Staphylococcus aureus
DAGAQD

SEQ ID NO: 1616506 - protein, 5 aa, Staphylococcus aureus
DAIPS

SEQ ID NO: 1616507 - protein, 6 aa, Staphylococcus aureus
DATSGS

SEQ ID NO: 1616508 - protein, 6 aa, Staphylococcus aureus
DAVKQG

SEQ ID NO: 1616509 - protein, 5 aa, Staphylococcus aureus
DDDIY

SEQ ID NO: 1616510 - protein, 8 aa, Staphylococcus aureus
DDNQYGND

SEQ ID NO: 1616511 - protein, 7 aa, Staphylococcus aureus
DDTTNQE

SEQ ID NO: 1616512 - protein, 18 aa, Staphylococcus aureus
DEKALQNSKTHNNFKEEM

SEQ ID NO: 1616513 - protein, 7 aa, Staphylococcus aureus
DFTTITN

SEQ ID NO: 1616514 - protein, 8 aa, Staphylococcus aureus
DGIGSKRK

SEQ ID NO: 1616515 - protein, 7 aa, Staphylococcus aureus
DGLNQTQ

SEQ ID NO: 1616516 - protein, 8 aa, Staphylococcus aureus
DGQTYSGQ

SEQ ID NO: 1616517 - protein, 13 aa, Staphylococcus aureus
DGTMAKGQDLQKF

SEQ ID NO: 1616518 - protein, 8 aa, Staphylococcus aureus
DKDIETLK

SEQ ID NO: 1616519 - protein, 4 aa, Staphylococcus aureus
DKDM

SEQ ID NO: 1616520 - protein, 5 aa, Staphylococcus aureus
DKGET

SEQ ID NO: 1616521 - protein, 7 aa, Staphylococcus aureus
DKKKELN

SEQ ID NO: 1616522 - protein, 7 aa, Staphylococcus aureus
DKKYKFQ

SEQ ID NO: 1616523 - protein, 5 aa, Staphylococcus aureus
DKLSI

SEQ ID NO: 1616524 - protein, 5 aa, Staphylococcus aureus
DKQRK

SEQ ID NO: 1616525 - protein, 5 aa, Staphylococcus aureus
DKTNT

SEQ ID NO: 1616526 - protein, 12 aa, Staphylococcus aureus
DLEYEEQKQLTL

SEQ ID NO: 1616527 - protein, 7 aa, Staphylococcus aureus
DNEAGDR

SEQ ID NO: 1616528 - protein, 7 aa, Staphylococcus aureus
DQSGVER

SEQ ID NO: 1616529 - protein, 10 aa, Staphylococcus aureus
DRSSNSMETA

SEQ ID NO: 1616530 - protein, 7 aa, Staphylococcus aureus
DSDDKDI

SEQ ID NO: 1616531 - protein, 7 aa, Staphylococcus aureus
DSDEKDI

SEQ ID NO: 1616532 - protein, 11 aa, Staphylococcus aureus
DTFGEPLTEKT

SEQ ID NO: 1616533 - protein, 6 aa, Staphylococcus aureus
DTLPTF

SEQ ID NO: 1616534 - protein, 7 aa, Staphylococcus aureus
DTYHTPK

SEQ ID NO: 1616535 - protein, 5 aa, Staphylococcus aureus
DWSRN

SEQ ID NO: 1616536 - protein, 12 aa, Staphylococcus aureus
DYPITPKNHGTE

SEQ ID NO: 1616537 - protein, 5 aa, Staphylococcus aureus
EAAEN

SEQ ID NO: 1616538 - protein, 7 aa, Staphylococcus aureus
EATGIPE

SEQ ID NO: 1616539 - protein, 25 aa, Staphylococcus aureus
EDADTTESTEEVTDVSVETNVEKES

SEQ ID NO: 1616540 - protein, 8 aa, Staphylococcus aureus
EDEEVGKK

SEQ ID NO: 1616541 - protein, 7 aa, Staphylococcus aureus
EDEPDID

SEQ ID NO: 1616542 - protein, 6 aa, Staphylococcus aureus
EDGSIA

SEQ ID NO: 1616543 - protein, 12 aa, Staphylococcus aureus
EDVDPRHTTGQY

SEQ ID NO: 1616544 - protein, 5 aa, Staphylococcus aureus
EEEWG

SEQ ID NO: 1616545 - protein, 14 aa, Staphylococcus aureus
EEKNYNTSKNDYTH

SEQ ID NO: 1616546 - protein, 17 aa, Staphylococcus aureus
EESEVKDLTEEKYNQDY

SEQ ID NO: 1616547 - protein, 6 aa, Staphylococcus aureus
EGHEPW

SEQ ID NO: 1616548 - protein, 10 aa, Staphylococcus aureus
EGKGEIPRED

SEQ ID NO: 1616549 - protein, 7 aa, Staphylococcus aureus
EIEHQRG

SEQ ID NO: 1616550 - protein, 16 aa, Staphylococcus aureus
EKAGKLYGRGTTDMKG

SEQ ID NO: 1616551 - protein, 8 aa, Staphylococcus aureus
EKDEREDI

SEQ ID NO: 1616552 - protein, 7 aa, Staphylococcus aureus
EKWPGTI

SEQ ID NO: 1616553 - protein, 10 aa, Staphylococcus aureus
ELTTQNGKAN

SEQ ID NO: 1616554 - protein, 12 aa, Staphylococcus aureus
EMQSTEGYSIDG

SEQ ID NO: 1616555 - protein, 7 aa, Staphylococcus aureus
ENGAKTV

SEQ ID NO: 1616556 - protein, 10 aa, Staphylococcus aureus
ENYDSGNVSK

SEQ ID NO: 1616557 - protein, 6 aa, Staphylococcus aureus
EPEDGL

SEQ ID NO: 1616558 - protein, 20 aa, Staphylococcus aureus
EPTVHGGGQEYGVRSGTVNL

SEQ ID NO: 1616559 - protein, 8 aa, Staphylococcus aureus
EQAINAGA

SEQ ID NO: 1616560 - protein, 4 aa, Staphylococcus aureus
ERAP

SEQ ID NO: 1616561 - protein, 6 aa, Staphylococcus aureus
ERLTEN

SEQ ID NO: 1616562 - protein, 5 aa, Staphylococcus aureus
ERSGE

SEQ ID NO: 1616563 - protein, 11 aa, Staphylococcus aureus
ESAVDAAKAAA

SEQ ID NO: 1616564 - protein, 5 aa, Staphylococcus aureus
ESMPD

SEQ ID NO: 1616565 - protein, 17 aa, Staphylococcus aureus
ESQSIGKRYRRQDEIGT

SEQ ID NO: 1616566 - protein, 21 aa, Staphylococcus aureus
ESTIKANSRYFENEDDVPKQA

SEQ ID NO: 1616567 - protein, 4 aa, Staphylococcus aureus
ETGE

SEQ ID NO: 1616568 - protein, 4 aa, Staphylococcus aureus
ETPF

SEQ ID NO: 1616569 - protein, 5 aa, Staphylococcus aureus
FDDDK

SEQ ID NO: 1616570 - protein, 15 aa, Staphylococcus aureus
FNSKTSFRIEEKVEN

SEQ ID NO: 1616571 - protein, 5 aa, Staphylococcus aureus
GAQLE

SEQ ID NO: 1616572 - protein, 5 aa, Staphylococcus aureus
GAVRG

SEQ ID NO: 1616573 - protein, 14 aa, Staphylococcus aureus
GDEALEKVENEQPD

SEQ ID NO: 1616574 - protein, 8 aa, Staphylococcus aureus
GDNVTKNE

SEQ ID NO: 1616575 - protein, 18 aa, Staphylococcus aureus
GDPTQRISKRNSTGNARL

SEQ ID NO: 1616576 - protein, 6 aa, Staphylococcus aureus
GDTTHI

SEQ ID NO: 1616577 - protein, 7 aa, Staphylococcus aureus
GEETTHT

SEQ ID NO: 1616578 - protein, 17 aa, Staphylococcus aureus
GEGDDKAAIDNDTTNKI

SEQ ID NO: 1616579 - protein, 9 aa, Staphylococcus aureus
GEKSPKDMA

SEQ ID NO: 1616580 - protein, 10 aa, Staphylococcus aureus
GFDNDSNKGF

SEQ ID NO: 1616581 - protein, 11 aa, Staphylococcus aureus
GIANDTGKSVE

SEQ ID NO: 1616582 - protein, 11 aa, Staphylococcus aureus
GIDPKTIPVDD

SEQ ID NO: 1616583 - protein, 8 aa, Staphylococcus aureus
GKATEVAN

SEQ ID NO: 1616584 - protein, 15 aa, Staphylococcus aureus
GKTVTIGGSAKGSGM

SEQ ID NO: 1616585 - protein, 6 aa, Staphylococcus aureus
GKVKNS

SEQ ID NO: 1616586 - protein, 17 aa, Staphylococcus aureus
GKYDENTKFSDHRTTRR

SEQ ID NO: 1616587 - protein, 14 aa, Staphylococcus aureus
GLGDTARYATEARI

SEQ ID NO: 1616588 - protein, 7 aa, Staphylococcus aureus
GLNPAKN

SEQ ID NO: 1616589 - protein, 9 aa, Staphylococcus aureus
GLSGTFNTA

SEQ ID NO: 1616590 - protein, 10 aa, Staphylococcus aureus
GNASDELKQY

SEQ ID NO: 1616591 - protein, 6 aa, Staphylococcus aureus
GNKKPL

SEQ ID NO: 1616592 - protein, 25 aa, Staphylococcus aureus
GPNKEADEKSAYNNVQVGDGPQHRE

SEQ ID NO: 1616593 - protein, 8 aa, Staphylococcus aureus
GPNKENFE

SEQ ID NO: 1616594 - protein, 6 aa, Staphylococcus aureus
GPRANE

SEQ ID NO: 1616595 - protein, 10 aa, Staphylococcus aureus
GPSGSGKSTF

SEQ ID NO: 1616596 - protein, 11 aa, Staphylococcus aureus
GPTCHTGSQSC

SEQ ID NO: 1616597 - protein, 6 aa, Staphylococcus aureus
GQHAGE

SEQ ID NO: 1616598 - protein, 5 aa, Staphylococcus aureus
GQIQP

SEQ ID NO: 1616599 - protein, 5 aa, Staphylococcus aureus
GQTHR

SEQ ID NO: 1616600 - protein, 10 aa, Staphylococcus aureus
GRAGRHEKAG

SEQ ID NO: 1616601 - protein, 4 aa, Staphylococcus aureus
GRAQ

SEQ ID NO: 1616602 - protein, 4 aa, Staphylococcus aureus
GRDN

SEQ ID NO: 1616603 - protein, 4 aa, Staphylococcus aureus
GRHE

SEQ ID NO: 1616604 - protein, 15 aa, Staphylococcus aureus
GSDGAQLSTDASELA

SEQ ID NO: 1616605 - protein, 7 aa, Staphylococcus aureus
GSEEAAN

SEQ ID NO: 1616606 - protein, 7 aa, Staphylococcus aureus
GTDGVGT

SEQ ID NO: 1616607 - protein, 15 aa, Staphylococcus aureus
GTEPAKGNSLTKKSY

SEQ ID NO: 1616608 - protein, 10 aa, Staphylococcus aureus
GTPQKHSRDP

SEQ ID NO: 1616609 - protein, 14 aa, Staphylococcus aureus
GTTAESPTLTTDEK

SEQ ID NO: 1616610 - protein, 10 aa, Staphylococcus aureus
GVGANSEQLS

SEQ ID NO: 1616611 - protein, 7 aa, Staphylococcus aureus
GVKSSQN

SEQ ID NO: 1616612 - protein, 5 aa, Staphylococcus aureus
GVSRQ

SEQ ID NO: 1616613 - protein, 10 aa, Staphylococcus aureus
GYENTKSYDQ

SEQ ID NO: 1616614 - protein, 8 aa, Staphylococcus aureus
GYPPSVRE

SEQ ID NO: 1616615 - protein, 6 aa, Staphylococcus aureus
HAEAVS

SEQ ID NO: 1616616 - protein, 5 aa, Staphylococcus aureus
HAKNI

SEQ ID NO: 1616617 - protein, 5 aa, Staphylococcus aureus
HDDDK

SEQ ID NO: 1616618 - protein, 14 aa, Staphylococcus aureus
HDFKEARKGDIKHS

SEQ ID NO: 1616619 - protein, 4 aa, Staphylococcus aureus
HDTT

SEQ ID NO: 1616620 - protein, 7 aa, Staphylococcus aureus
HKASFES

SEQ ID NO: 1616621 - protein, 9 aa, Staphylococcus aureus
HMSGGERQR

SEQ ID NO: 1616622 - protein, 13 aa, Staphylococcus aureus
HNENGIPHALKKL

SEQ ID NO: 1616623 - protein, 8 aa, Staphylococcus aureus
HNPSENIG

SEQ ID NO: 1616624 - protein, 8 aa, Staphylococcus aureus
HPDGTDEP

SEQ ID NO: 1616625 - protein, 10 aa, Staphylococcus aureus
HRNYDKTANF

SEQ ID NO: 1616626 - protein, 14 aa, Staphylococcus aureus
HTPGGGRSQNGSHA

SEQ ID NO: 1616627 - protein, 8 aa, Staphylococcus aureus
IDEDKLEQ

SEQ ID NO: 1616628 - protein, 5 aa, Staphylococcus aureus
IENPI

SEQ ID NO: 1616629 - protein, 20 aa, Staphylococcus aureus
IERTKTDRYQKKHSSKGHSK

SEQ ID NO: 1616630 - protein, 4 aa, Staphylococcus aureus
IEVP

SEQ ID NO: 1616631 - protein, 9 aa, Staphylococcus aureus
IKSGKSIEN

SEQ ID NO: 1616632 - protein, 8 aa, Staphylococcus aureus
IKTNSVES

SEQ ID NO: 1616633 - protein, 8 aa, Staphylococcus aureus
INPDKDVD

SEQ ID NO: 1616634 - protein, 4 aa, Staphylococcus aureus
INTD

SEQ ID NO: 1616635 - protein, 5 aa, Staphylococcus aureus
INTEP

SEQ ID NO: 1616636 - protein, 6 aa, Staphylococcus aureus
INTSNV

SEQ ID NO: 1616637 - protein, 5 aa, Staphylococcus aureus
IPTSE

SEQ ID NO: 1616638 - protein, 4 aa, Staphylococcus aureus
IQQQ

SEQ ID NO: 1616639 - protein, 6 aa, Staphylococcus aureus
ISGETI

SEQ ID NO: 1616640 - protein, 6 aa, Staphylococcus aureus
ISHSSA

SEQ ID NO: 1616641 - protein, 12 aa, Staphylococcus aureus
ISNNTNTKGNVL

SEQ ID NO: 1616642 - protein, 10 aa, Staphylococcus aureus
ISSNDDGTIS

SEQ ID NO: 1616643 - protein, 9 aa, Staphylococcus aureus
ISSNPTEVD

SEQ ID NO: 1616644 - protein, 5 aa, Staphylococcus aureus
ISSQV

SEQ ID NO: 1616645 - protein, 5 aa, Staphylococcus aureus
ITMES

SEQ ID NO: 1616646 - protein, 5 aa, Staphylococcus aureus
ITSAS

SEQ ID NO: 1616647 - protein, 5 aa, Staphylococcus aureus
ITTQL

SEQ ID NO: 1616648 - protein, 8 aa, Staphylococcus aureus
IVKENPDV

SEQ ID NO: 1616649 - protein, 15 aa, Staphylococcus aureus
IYPTPSKHDAHTPVG

SEQ ID NO: 1616650 - protein, 15 aa, Staphylococcus aureus
KAGKHFKHNTAKTKD

SEQ ID NO: 1616651 - protein, 6 aa, Staphylococcus aureus
KAMGGV

SEQ ID NO: 1616652 - protein, 4 aa, Staphylococcus aureus
KATR

SEQ ID NO: 1616653 - protein, 6 aa, Staphylococcus aureus
KDESLA

SEQ ID NO: 1616654 - protein, 7 aa, Staphylococcus aureus
KDGELKE

SEQ ID NO: 1616655 - protein, 6 aa, Staphylococcus aureus
KDGNHF

SEQ ID NO: 1616656 - protein, 7 aa, Staphylococcus aureus
KDTNTYQ

SEQ ID NO: 1616657 - protein, 15 aa, Staphylococcus aureus
KDTTLNDSKTYTDSK

SEQ ID NO: 1616658 - protein, 10 aa, Staphylococcus aureus
KEAKRYELSD

SEQ ID NO: 1616659 - protein, 9 aa, Staphylococcus aureus
KEATGKAKK

SEQ ID NO: 1616660 - protein, 11 aa, Staphylococcus aureus
KEAVDAGAESM

SEQ ID NO: 1616661 - protein, 24 aa, Staphylococcus aureus
KEERVNASKELNGPKASFDGDKKD

SEQ ID NO: 1616662 - protein, 11 aa, Staphylococcus aureus
KELADEKEGGL

SEQ ID NO: 1616663 - protein, 10 aa, Staphylococcus aureus
KENEKAKAEL

SEQ ID NO: 1616664 - protein, 10 aa, Staphylococcus aureus
KFDDKQASMT

SEQ ID NO: 1616665 - protein, 5 aa, Staphylococcus aureus
KFRSG

SEQ ID NO: 1616666 - protein, 6 aa, Staphylococcus aureus
KGALEQ

SEQ ID NO: 1616667 - protein, 5 aa, Staphylococcus aureus
KGIEP

SEQ ID NO: 1616668 - protein, 14 aa, Staphylococcus aureus
KGKGTLNNQGKAFA

SEQ ID NO: 1616669 - protein, 15 aa, Staphylococcus aureus
KGLKSDLEKAKNQKF

SEQ ID NO: 1616670 - protein, 4 aa, Staphylococcus aureus
KGQF

SEQ ID NO: 1616671 - protein, 5 aa, Staphylococcus aureus
KGTTL

SEQ ID NO: 1616672 - protein, 14 aa, Staphylococcus aureus
KHNQVDDYPYGGGQ

SEQ ID NO: 1616673 - protein, 7 aa, Staphylococcus aureus
KHQPTKG

SEQ ID NO: 1616674 - protein, 9 aa, Staphylococcus aureus
KIKTPLKEA

SEQ ID NO: 1616675 - protein, 13 aa, Staphylococcus aureus
KKYEGKNQETIDN

SEQ ID NO: 1616676 - protein, 12 aa, Staphylococcus aureus
KLDERKKLTKTL

SEQ ID NO: 1616677 - protein, 14 aa, Staphylococcus aureus
KLTPAQSKNTDKNE

SEQ ID NO: 1616678 - protein, 8 aa, Staphylococcus aureus
KNDYLETA

SEQ ID NO: 1616679 - protein, 11 aa, Staphylococcus aureus
KNELKRPPVSN

SEQ ID NO: 1616680 - protein, 11 aa, Staphylococcus aureus
KNINQGIGEVT

SEQ ID NO: 1616681 - protein, 6 aa, Staphylococcus aureus
KNQHRH

SEQ ID NO: 1616682 - protein, 4 aa, Staphylococcus aureus
KPEW

SEQ ID NO: 1616683 - protein, 14 aa, Staphylococcus aureus
KPGFEDLKKELEER

SEQ ID NO: 1616684 - protein, 13 aa, Staphylococcus aureus
KPNYISGQSIAES

SEQ ID NO: 1616685 - protein, 8 aa, Staphylococcus aureus
KPYDDYEP

SEQ ID NO: 1616686 - protein, 6 aa, Staphylococcus aureus
KQKATE

SEQ ID NO: 1616687 - protein, 12 aa, Staphylococcus aureus
KQLKPSKDTGAL

SEQ ID NO: 1616688 - protein, 12 aa, Staphylococcus aureus
KQQERQLREQYG

SEQ ID NO: 1616689 - protein, 14 aa, Staphylococcus aureus
KQWQRQVETNSRVK

SEQ ID NO: 1616690 - protein, 6 aa, Staphylococcus aureus
KREAYR

SEQ ID NO: 1616691 - protein, 7 aa, Staphylococcus aureus
KRIEDGV

SEQ ID NO: 1616692 - protein, 19 aa, Staphylococcus aureus
KRKPYRRSTPQITSENKLN

SEQ ID NO: 1616693 - protein, 6 aa, Staphylococcus aureus
KRTRSD

SEQ ID NO: 1616694 - protein, 9 aa, Staphylococcus aureus
KSEAAAKAL

SEQ ID NO: 1616695 - protein, 9 aa, Staphylococcus aureus
KSISKNGGK

SEQ ID NO: 1616696 - protein, 10 aa, Staphylococcus aureus
KTISNDYQYS

SEQ ID NO: 1616697 - protein, 14 aa, Staphylococcus aureus
KTITIGGSAKGSGM

SEQ ID NO: 1616698 - protein, 11 aa, Staphylococcus aureus
KTSFEEEGKTL

SEQ ID NO: 1616699 - protein, 17 aa, Staphylococcus aureus
LAQNTSEAITELPTPKE

SEQ ID NO: 1616700 - protein, 4 aa, Staphylococcus aureus
LEQL

SEQ ID NO: 1616701 - protein, 12 aa, Staphylococcus aureus
LESLNKKESIKE

SEQ ID NO: 1616702 - protein, 7 aa, Staphylococcus aureus
LGGEGNL

SEQ ID NO: 1616703 - protein, 5 aa, Staphylococcus aureus
LGNKE

SEQ ID NO: 1616704 - protein, 7 aa, Staphylococcus aureus
LGPSNNN

SEQ ID NO: 1616705 - protein, 10 aa, Staphylococcus aureus
LKEKRKARKA

SEQ ID NO: 1616706 - protein, 8 aa, Staphylococcus aureus
LKETGKIK

SEQ ID NO: 1616707 - protein, 6 aa, Staphylococcus aureus
LKKDQV

SEQ ID NO: 1616708 - protein, 4 aa, Staphylococcus aureus
LKTT

SEQ ID NO: 1616709 - protein, 5 aa, Staphylococcus aureus
LLNDP

SEQ ID NO: 1616710 - protein, 8 aa, Staphylococcus aureus
LNAETIDD

SEQ ID NO: 1616711 - protein, 8 aa, Staphylococcus aureus
LNHNQAAE

SEQ ID NO: 1616712 - protein, 15 aa, Staphylococcus aureus
LNNQSQQTKHQLNDV

SEQ ID NO: 1616713 - protein, 14 aa, Staphylococcus aureus
LNRNDDKDNQDASH

SEQ ID NO: 1616714 - protein, 19 aa, Staphylococcus aureus
LNTSNKKLKQAYSKSDSKN

SEQ ID NO: 1616715 - protein, 5 aa, Staphylococcus aureus
LPSLP

SEQ ID NO: 1616716 - protein, 6 aa, Staphylococcus aureus
LSGYPA

SEQ ID NO: 1616717 - protein, 24 aa, Staphylococcus aureus
LSQYTAPKTDFDGVEHKGAYKDGK

SEQ ID NO: 1616718 - protein, 4 aa, Staphylococcus aureus
LTEA

SEQ ID NO: 1616719 - protein, 5 aa, Staphylococcus aureus
MEQER

SEQ ID NO: 1616720 - protein, 10 aa, Staphylococcus aureus
MGPNKEKLDS

SEQ ID NO: 1616721 - protein, 10 aa, Staphylococcus aureus
MGTRSGNIDP

SEQ ID NO: 1616722 - protein, 4 aa, Staphylococcus aureus
MKKG

SEQ ID NO: 1616723 - protein, 19 aa, Staphylococcus aureus
NAATTTGDVTTAKDTAVQK

SEQ ID NO: 1616724 - protein, 42 aa, Staphylococcus aureus
NAEITENVQNEAAESEQNVEEKTIENVNPKKQTEKVSTLSKR

SEQ ID NO: 1616725 - protein, 5 aa, Staphylococcus aureus
NAPKM

SEQ ID NO: 1616726 - protein, 5 aa, Staphylococcus aureus
NDGEL

SEQ ID NO: 1616727 - protein, 5 aa, Staphylococcus aureus
NDNET

SEQ ID NO: 1616728 - protein, 4 aa, Staphylococcus aureus
NDQL

SEQ ID NO: 1616729 - protein, 6 aa, Staphylococcus aureus
NDSGER

SEQ ID NO: 1616730 - protein, 11 aa, Staphylococcus aureus
NEFKNKKSYYE

SEQ ID NO: 1616731 - protein, 4 aa, Staphylococcus aureus
NERG

SEQ ID NO: 1616732 - protein, 12 aa, Staphylococcus aureus
NESKMKEEYTKR

SEQ ID NO: 1616733 - protein, 10 aa, Staphylococcus aureus
NEVKSKQTQF

SEQ ID NO: 1616734 - protein, 37 aa, Staphylococcus aureus
NFGQNNEDEEEPPTEEIKTKRSEIKRQLEEGKLEKEK

SEQ ID NO: 1616735 - protein, 8 aa, Staphylococcus aureus
NGDRARKQ

SEQ ID NO: 1616736 - protein, 18 aa, Staphylococcus aureus
NGGKDEKSGAQVGPNFEG

SEQ ID NO: 1616737 - protein, 13 aa, Staphylococcus aureus
NIKENGQTPEPYT

SEQ ID NO: 1616738 - protein, 9 aa, Staphylococcus aureus
NIKNGSVHS

SEQ ID NO: 1616739 - protein, 14 aa, Staphylococcus aureus
NITGRTIADSTGEI

SEQ ID NO: 1616740 - protein, 5 aa, Staphylococcus aureus
NKGIG

SEQ ID NO: 1616741 - protein, 5 aa, Staphylococcus aureus
NKQYF

SEQ ID NO: 1616742 - protein, 6 aa, Staphylococcus aureus
NKVKNI

SEQ ID NO: 1616743 - protein, 9 aa, Staphylococcus aureus
NNPETVSTD

SEQ ID NO: 1616744 - protein, 4 aa, Staphylococcus aureus
NNPS

SEQ ID NO: 1616745 - protein, 7 aa, Staphylococcus aureus
NQGIRGH

SEQ ID NO: 1616746 - protein, 5 aa, Staphylococcus aureus
NQKAL

SEQ ID NO: 1616747 - protein, 14 aa, Staphylococcus aureus
NQSEMNDDDELEVG

SEQ ID NO: 1616748 - protein, 8 aa, Staphylococcus aureus
NRKAEDKK

SEQ ID NO: 1616749 - protein, 8 aa, Staphylococcus aureus
NRNEFSNT

SEQ ID NO: 1616750 - protein, 4 aa, Staphylococcus aureus
NSNY

SEQ ID NO: 1616751 - protein, 10 aa, Staphylococcus aureus
NTAESYLGEK

SEQ ID NO: 1616752 - protein, 6 aa, Staphylococcus aureus
NTGYPF

SEQ ID NO: 1616753 - protein, 5 aa, Staphylococcus aureus
NTPIN

SEQ ID NO: 1616754 - protein, 5 aa, Staphylococcus aureus
NVDNY

SEQ ID NO: 1616755 - protein, 7 aa, Staphylococcus aureus
PARSGAK

SEQ ID NO: 1616756 - protein, 5 aa, Staphylococcus aureus
PDFPN

SEQ ID NO: 1616757 - protein, 4 aa, Staphylococcus aureus
PDKK

SEQ ID NO: 1616758 - protein, 13 aa, Staphylococcus aureus
PDSFSDGGKFNNV

SEQ ID NO: 1616759 - protein, 17 aa, Staphylococcus aureus
PDSFSDGGKFNNVESAV

SEQ ID NO: 1616760 - protein, 7 aa, Staphylococcus aureus
PGKMTEI

SEQ ID NO: 1616761 - protein, 16 aa, Staphylococcus aureus
PGVAEKKAPGAKLQGD

SEQ ID NO: 1616762 - protein, 6 aa, Staphylococcus aureus
PKEKAD

SEQ ID NO: 1616763 - protein, 8 aa, Staphylococcus aureus
PKKRQGAI

SEQ ID NO: 1616764 - protein, 6 aa, Staphylococcus aureus
PKRVKT

SEQ ID NO: 1616765 - protein, 17 aa, Staphylococcus aureus
PLGPAYQAGTMAGNPLS

SEQ ID NO: 1616766 - protein, 4 aa, Staphylococcus aureus
PLPD

SEQ ID NO: 1616767 - protein, 10 aa, Staphylococcus aureus
PNHKHTTVQP

SEQ ID NO: 1616768 - protein, 11 aa, Staphylococcus aureus
PNQTVSSPDKS

SEQ ID NO: 1616769 - protein, 4 aa, Staphylococcus aureus
PQSV

SEQ ID NO: 1616770 - protein, 20 aa, Staphylococcus aureus
PQVSMTDSGGRVKPLPIQNP

SEQ ID NO: 1616771 - protein, 7 aa, Staphylococcus aureus
PQYDISK

SEQ ID NO: 1616772 - protein, 9 aa, Staphylococcus aureus
PRGGSDITG

SEQ ID NO: 1616773 - protein, 9 aa, Staphylococcus aureus
PRGSNGLKE

SEQ ID NO: 1616774 - protein, 7 aa, Staphylococcus aureus
PSELTPN

SEQ ID NO: 1616775 - protein, 7 aa, Staphylococcus aureus
PSGPYDA

SEQ ID NO: 1616776 - protein, 10 aa, Staphylococcus aureus
PSTANEVTQI

SEQ ID NO: 1616777 - protein, 6 aa, Staphylococcus aureus
PTDVTR

SEQ ID NO: 1616778 - protein, 10 aa, Staphylococcus aureus
PTPALGGYPK

SEQ ID NO: 1616779 - protein, 7 aa, Staphylococcus aureus
PVQRGEV

SEQ ID NO: 1616780 - protein, 5 aa, Staphylococcus aureus
PYDIT

SEQ ID NO: 1616781 - protein, 5 aa, Staphylococcus aureus
QDESM

SEQ ID NO: 1616782 - protein, 5 aa, Staphylococcus aureus
QDESN

SEQ ID NO: 1616783 - protein, 5 aa, Staphylococcus aureus
QDLKN

SEQ ID NO: 1616784 - protein, 10 aa, Staphylococcus aureus
QDLQINDSTK

SEQ ID NO: 1616785 - protein, 9 aa, Staphylococcus aureus
QDSTEQDAD

SEQ ID NO: 1616786 - protein, 10 aa, Staphylococcus aureus
QESEQRQRKE

SEQ ID NO: 1616787 - protein, 8 aa, Staphylococcus aureus
QHQGNKFK

SEQ ID NO: 1616788 - protein, 7 aa, Staphylococcus aureus
QKHQTKL

SEQ ID NO: 1616789 - protein, 17 aa, Staphylococcus aureus
QLGGEQELKRRAGTENL

SEQ ID NO: 1616790 - protein, 7 aa, Staphylococcus aureus
QNGKPIS

SEQ ID NO: 1616791 - protein, 34 aa, Staphylococcus aureus
QNQLTSKIDSNSESLKAIQTSQEAIQEAQASQAK

SEQ ID NO: 1616792 - protein, 38 aa, Staphylococcus aureus
QNRKNEGDDMPKQQAQQTDIAQKAKDLFGEETVHVIDE

SEQ ID NO: 1616793 - protein, 9 aa, Staphylococcus aureus
QQINEGDFA

SEQ ID NO: 1616794 - protein, 10 aa, Staphylococcus aureus
QQQTQSNSGI

SEQ ID NO: 1616795 - protein, 13 aa, Staphylococcus aureus
QRENKSRHTKRSK

SEQ ID NO: 1616796 - protein, 7 aa, Staphylococcus aureus
QRPKHPQ

SEQ ID NO: 1616797 - protein, 10 aa, Staphylococcus aureus
QSAKSLRGSK

SEQ ID NO: 1616798 - protein, 7 aa, Staphylococcus aureus
QSLGTKT

SEQ ID NO: 1616799 - protein, 4 aa, Staphylococcus aureus
QYFP

SEQ ID NO: 1616800 - protein, 6 aa, Staphylococcus aureus
QYNHYS

SEQ ID NO: 1616801 - protein, 11 aa, Staphylococcus aureus
RDNPKLKGKPV

SEQ ID NO: 1616802 - protein, 7 aa, Staphylococcus aureus
RGGSDIT

SEQ ID NO: 1616803 - protein, 4 aa, Staphylococcus aureus
RGHA

SEQ ID NO: 1616804 - protein, 26 aa, Staphylococcus aureus
RGPNKEADEKSAYNNVQVGDGPQHRE

SEQ ID NO: 1616805 - protein, 5 aa, Staphylococcus aureus
RGTGE

SEQ ID NO: 1616806 - protein, 6 aa, Staphylococcus aureus
RIGAAT

SEQ ID NO: 1616807 - protein, 9 aa, Staphylococcus aureus
RKEAGSWSE

SEQ ID NO: 1616808 - protein, 5 aa, Staphylococcus aureus
RKEYP

SEQ ID NO: 1616809 - protein, 20 aa, Staphylococcus aureus
RKGIPFEPKEIDNEAEKQAK

SEQ ID NO: 1616810 - protein, 4 aa, Staphylococcus aureus
RKNS

SEQ ID NO: 1616811 - protein, 4 aa, Staphylococcus aureus
RLSK

SEQ ID NO: 1616812 - protein, 13 aa, Staphylococcus aureus
RNDKFDKKRAKQL

SEQ ID NO: 1616813 - protein, 21 aa, Staphylococcus aureus
RNDSTTQNNNIGETKDVLNRT

SEQ ID NO: 1616814 - protein, 14 aa, Staphylococcus aureus
RQTYEDFKNSDAFK

SEQ ID NO: 1616815 - protein, 32 aa, Staphylococcus aureus
RSVSTISREISRNNLNQSYQAETAQKNYETKR

SEQ ID NO: 1616816 - protein, 6 aa, Staphylococcus aureus
RYNPPL

SEQ ID NO: 1616817 - protein, 8 aa, Staphylococcus aureus
RYTEAKGK

SEQ ID NO: 1616818 - protein, 11 aa, Staphylococcus aureus
SAQESSKRAAE

SEQ ID NO: 1616819 - protein, 6 aa, Staphylococcus aureus
SAQKMG

SEQ ID NO: 1616820 - protein, 8 aa, Staphylococcus aureus
SDDDTYTK

SEQ ID NO: 1616821 - protein, 8 aa, Staphylococcus aureus
SDKDKEEV

SEQ ID NO: 1616822 - protein, 9 aa, Staphylococcus aureus
SEPTEGHIT

SEQ ID NO: 1616823 - protein, 10 aa, Staphylococcus aureus
SFKESMTAQQ

SEQ ID NO: 1616824 - protein, 7 aa, Staphylococcus aureus
SGAGHLS

SEQ ID NO: 1616825 - protein, 21 aa, Staphylococcus aureus
SGAHGKARQITESIDPNHYYP

SEQ ID NO: 1616826 - protein, 22 aa, Staphylococcus aureus
SGQDESQLREQMKDDAEQRVKT

SEQ ID NO: 1616827 - protein, 15 aa, Staphylococcus aureus
SGYGTSNFANGKDGV

SEQ ID NO: 1616828 - protein, 5 aa, Staphylococcus aureus
SIGQA

SEQ ID NO: 1616829 - protein, 7 aa, Staphylococcus aureus
SKEDATA

SEQ ID NO: 1616830 - protein, 9 aa, Staphylococcus aureus
SKKTYDKPR

SEQ ID NO: 1616831 - protein, 12 aa, Staphylococcus aureus
SLKTNDVNDGHV

SEQ ID NO: 1616832 - protein, 13 aa, Staphylococcus aureus
SLNRNNSIQNEAR

SEQ ID NO: 1616833 - protein, 6 aa, Staphylococcus aureus
SNIKDV

SEQ ID NO: 1616834 - protein, 7 aa, Staphylococcus aureus
SNLGETM

SEQ ID NO: 1616835 - protein, 14 aa, Staphylococcus aureus
SNSNQDTANTSDPF

SEQ ID NO: 1616836 - protein, 14 aa, Staphylococcus aureus
SNYQTQSDNQLANI

SEQ ID NO: 1616837 - protein, 6 aa, Staphylococcus aureus
SPTSGT

SEQ ID NO: 1616838 - protein, 7 aa, Staphylococcus aureus
SQSLDPS

SEQ ID NO: 1616839 - protein, 4 aa, Staphylococcus aureus
SRTV

SEQ ID NO: 1616840 - protein, 6 aa, Staphylococcus aureus
SSSGSI

SEQ ID NO: 1616841 - protein, 8 aa, Staphylococcus aureus
SSSYDAPA

SEQ ID NO: 1616842 - protein, 9 aa, Staphylococcus aureus
STLSDTAER

SEQ ID NO: 1616843 - protein, 13 aa, Staphylococcus aureus
STSALDINNKEKI

SEQ ID NO: 1616844 - protein, 7 aa, Staphylococcus aureus
SYSPNTK

SEQ ID NO: 1616845 - protein, 11 aa, Staphylococcus aureus
TAFTNEERKQL

SEQ ID NO: 1616846 - protein, 10 aa, Staphylococcus aureus
TAVETGRVTN

SEQ ID NO: 1616847 - protein, 19 aa, Staphylococcus aureus
TELPYGESIGTSLELEENK

SEQ ID NO: 1616848 - protein, 21 aa, Staphylococcus aureus
TFREQTQSLRQQPQRTTSING

SEQ ID NO: 1616849 - protein, 5 aa, Staphylococcus aureus
TGTLA

SEQ ID NO: 1616850 - protein, 9 aa, Staphylococcus aureus
TKDGTPEKL

SEQ ID NO: 1616851 - protein, 19 aa, Staphylococcus aureus
TKKARFDDKKVVSFGAFED

SEQ ID NO: 1616852 - protein, 6 aa, Staphylococcus aureus
TKPKNL

SEQ ID NO: 1616853 - protein, 5 aa, Staphylococcus aureus
TKRYT

SEQ ID NO: 1616854 - protein, 9 aa, Staphylococcus aureus
TKSVTENKV

SEQ ID NO: 1616855 - protein, 4 aa, Staphylococcus aureus
TLAG

SEQ ID NO: 1616856 - protein, 9 aa, Staphylococcus aureus
TLEQQAEQC

SEQ ID NO: 1616857 - protein, 10 aa, Staphylococcus aureus
TLSQQFTEAD

SEQ ID NO: 1616858 - protein, 10 aa, Staphylococcus aureus
TLTKTPKQQE

SEQ ID NO: 1616859 - protein, 10 aa, Staphylococcus aureus
TMTQSTDKID

SEQ ID NO: 1616860 - protein, 6 aa, Staphylococcus aureus
TNAVGG

SEQ ID NO: 1616861 - protein, 4 aa, Staphylococcus aureus
TNHL

SEQ ID NO: 1616862 - protein, 8 aa, Staphylococcus aureus
TNTAEAHP

SEQ ID NO: 1616863 - protein, 7 aa, Staphylococcus aureus
TQNDGTI

SEQ ID NO: 1616864 - protein, 6 aa, Staphylococcus aureus
TSPTPI

SEQ ID NO: 1616865 - protein, 11 aa, Staphylococcus aureus
TSTQTGAFTED

SEQ ID NO: 1616866 - protein, 9 aa, Staphylococcus aureus
TTAENATQA

SEQ ID NO: 1616867 - protein, 6 aa, Staphylococcus aureus
TTATGI

SEQ ID NO: 1616868 - protein, 8 aa, Staphylococcus aureus
TTSQYNPV

SEQ ID NO: 1616869 - protein, 7 aa, Staphylococcus aureus
TVDRGKE

SEQ ID NO: 1616870 - protein, 9 aa, Staphylococcus aureus
TYKTTYGQV

SEQ ID NO: 1616871 - protein, 5 aa, Staphylococcus aureus
VDDGL

SEQ ID NO: 1616872 - protein, 7 aa, Staphylococcus aureus
VDKESLQ

SEQ ID NO: 1616873 - protein, 9 aa, Staphylococcus aureus
VDTTARDAY

SEQ ID NO: 1616874 - protein, 7 aa, Staphylococcus aureus
VGLSPTL

SEQ ID NO: 1616875 - protein, 8 aa, Staphylococcus aureus
VGTNNEQL

SEQ ID NO: 1616876 - protein, 5 aa, Staphylococcus aureus
VIEPD

SEQ ID NO: 1616877 - protein, 6 aa, Staphylococcus aureus
VNDNQL

SEQ ID NO: 1616878 - protein, 10 aa, Staphylococcus aureus
VNPDEPGAAV

SEQ ID NO: 1616879 - protein, 14 aa, Staphylococcus aureus
VNRQGNDIGEKYRT

SEQ ID NO: 1616880 - protein, 12 aa, Staphylococcus aureus
VPTDVTKKEEVD

SEQ ID NO: 1616881 - protein, 10 aa, Staphylococcus aureus
VSQDGENGAE

SEQ ID NO: 1616882 - protein, 10 aa, Staphylococcus aureus
VSSRGKSKGC

SEQ ID NO: 1616883 - protein, 14 aa, Staphylococcus aureus
VYWSPSSESSLAEA

SEQ ID NO: 1616884 - protein, 5 aa, Staphylococcus aureus
YAPEF

SEQ ID NO: 1616885 - protein, 5 aa, Staphylococcus aureus
YEEGL

SEQ ID NO: 1616886 - protein, 9 aa, Staphylococcus aureus
YINTSTDSN

SEQ ID NO: 1616887 - protein, 9 aa, Staphylococcus aureus
YNGKKLDKT

SEQ ID NO: 1616888 - protein, 10 aa, Staphylococcus aureus
YNNNDQATEI

SEQ ID NO: 1616889 - protein, 20 aa, Staphylococcus aureus
YNPAFRKSSMPDGLHPNERG

SEQ ID NO: 1616890 - protein, 8 aa, Staphylococcus aureus
YNQTHPDS

SEQ ID NO: 1616891 - protein, 27 aa, Staphylococcus aureus
YNSNFEKEDVPNASNQQSASDLSDEEL

SEQ ID NO: 1616892 - protein, 4 aa, Staphylococcus aureus
YRKE

SEQ ID NO: 1616893 - protein, 15 aa, Staphylococcus aureus
YRSSRVYEGIFYKEE

SEQ ID NO: 1616894 - protein, 9 aa, Staphylococcus aureus
YSKESPENM

SEQ ID NO: 1616895 - protein, 9 aa, Staphylococcus aureus
YSSGPNHQL

SEQ ID NO: 1616896 - protein, 13 aa, Staphylococcus aureus
YTDSKYNISPNEL

SEQ ID NO: 1616897 - protein, 14 aa, Staphylococcus aureus
YTIPTGKKESATTD

SEQ ID NO: 1616898 - protein, 17 aa, Staphylococcus aureus
AAATKNVGTENKPKEEY

SEQ ID NO: 1616899 - protein, 16 aa, Staphylococcus aureus
AAYNPSDRKKLDPQDI

SEQ ID NO: 1616900 - protein, 13 aa, Staphylococcus aureus
ADAMAQKSNYRGR

SEQ ID NO: 1616901 - protein, 8 aa, Staphylococcus aureus
AEANGIDE

SEQ ID NO: 1616902 - protein, 7 aa, Staphylococcus aureus
AEDKDTI

SEQ ID NO: 1616903 - protein, 11 aa, Staphylococcus aureus
AEGYARVSGKT

SEQ ID NO: 1616904 - protein, 10 aa, Staphylococcus aureus
AGGDKRKYTF

SEQ ID NO: 1616905 - protein, 10 aa, Staphylococcus aureus
AGSTLSREAD

SEQ ID NO: 1616906 - protein, 4 aa, Staphylococcus aureus
AGYL

SEQ ID NO: 1616907 - protein, 10 aa, Staphylococcus aureus
AHVKNSTNFL

SEQ ID NO: 1616908 - protein, 13 aa, Staphylococcus aureus
AIRTKNLDQMTKA

SEQ ID NO: 1616909 - protein, 6 aa, Staphylococcus aureus
AKGNVT

SEQ ID NO: 1616910 - protein, 12 aa, Staphylococcus aureus
AKLQEKAKNQMK

SEQ ID NO: 1616911 - protein, 6 aa, Staphylococcus aureus
ANAEGG

SEQ ID NO: 1616912 - protein, 16 aa, Staphylococcus aureus
ANKEREKASKEAQLTD

SEQ ID NO: 1616913 - protein, 24 aa, Staphylococcus aureus
APSASKEELAGLEGRNFDNQSDNK

SEQ ID NO: 1616914 - protein, 5 aa, Staphylococcus aureus
AQGSV

SEQ ID NO: 1616915 - protein, 10 aa, Staphylococcus aureus
AQSIEKTNKV

SEQ ID NO: 1616916 - protein, 5 aa, Staphylococcus aureus
AQTEL

SEQ ID NO: 1616917 - protein, 7 aa, Staphylococcus aureus
AQTNNPT

SEQ ID NO: 1616918 - protein, 13 aa, Staphylococcus aureus
AQTTNDVTQIKDQ

SEQ ID NO: 1616919 - protein, 14 aa, Staphylococcus aureus
ARSAGKEVEFQGKT

SEQ ID NO: 1616920 - protein, 6 aa, Staphylococcus aureus
ASDANH

SEQ ID NO: 1616921 - protein, 16 aa, Staphylococcus aureus
ASPSLEKDGTFTNTER

SEQ ID NO: 1616922 - protein, 10 aa, Staphylococcus aureus
ATFVENEKGS

SEQ ID NO: 1616923 - protein, 15 aa, Staphylococcus aureus
ATSSEKSQIQNREKA

SEQ ID NO: 1616924 - protein, 7 aa, Staphylococcus aureus
ATSSGMS

SEQ ID NO: 1616925 - protein, 18 aa, Staphylococcus aureus
AVDQDNKKDTLNRSPKDF

SEQ ID NO: 1616926 - protein, 6 aa, Staphylococcus aureus
AVGGGN

SEQ ID NO: 1616927 - protein, 5 aa, Staphylococcus aureus
CGSSF

SEQ ID NO: 1616928 - protein, 9 aa, Staphylococcus aureus
DASDAEKGV

SEQ ID NO: 1616929 - protein, 4 aa, Staphylococcus aureus
DASE

SEQ ID NO: 1616930 - protein, 5 aa, Staphylococcus aureus
DDELE

SEQ ID NO: 1616931 - protein, 8 aa, Staphylococcus aureus
DDEVRNEA

SEQ ID NO: 1616932 - protein, 7 aa, Staphylococcus aureus
DDLKEEG

SEQ ID NO: 1616933 - protein, 4 aa, Staphylococcus aureus
DDRV

SEQ ID NO: 1616934 - protein, 5 aa, Staphylococcus aureus
DEFTV

SEQ ID NO: 1616935 - protein, 14 aa, Staphylococcus aureus
DESTGVPSLSKQTI

SEQ ID NO: 1616936 - protein, 19 aa, Staphylococcus aureus
DGDWRKQNNITTEIKSTDE

SEQ ID NO: 1616937 - protein, 8 aa, Staphylococcus aureus
DGFENAPR

SEQ ID NO: 1616938 - protein, 7 aa, Staphylococcus aureus
DGNVVER

SEQ ID NO: 1616939 - protein, 5 aa, Staphylococcus aureus
DGSVR

SEQ ID NO: 1616940 - protein, 8 aa, Staphylococcus aureus
DITKTRGL

SEQ ID NO: 1616941 - protein, 4 aa, Staphylococcus aureus
DKDT

SEQ ID NO: 1616942 - protein, 4 aa, Staphylococcus aureus
DKKI

SEQ ID NO: 1616943 - protein, 4 aa, Staphylococcus aureus
DLEG

SEQ ID NO: 1616944 - protein, 5 aa, Staphylococcus aureus
DLGHH

SEQ ID NO: 1616945 - protein, 5 aa, Staphylococcus aureus
DLKDK

SEQ ID NO: 1616946 - protein, 11 aa, Staphylococcus aureus
DLPGKDREISS

SEQ ID NO: 1616947 - protein, 4 aa, Staphylococcus aureus
DNEP

SEQ ID NO: 1616948 - protein, 34 aa, Staphylococcus aureus
DNNQGGGTHYYPNNHGKFDSQPEYKKPPFPTDGY

SEQ ID NO: 1616949 - protein, 14 aa, Staphylococcus aureus
DNQITEITSSKRYG

SEQ ID NO: 1616950 - protein, 16 aa, Staphylococcus aureus
DPGTPSQRGLNEHSNG

SEQ ID NO: 1616951 - protein, 11 aa, Staphylococcus aureus
DPLETPGTGTR

SEQ ID NO: 1616952 - protein, 5 aa, Staphylococcus aureus
DPTQY

SEQ ID NO: 1616953 - protein, 11 aa, Staphylococcus aureus
DPWPKNRHAKR

SEQ ID NO: 1616954 - protein, 6 aa, Staphylococcus aureus
DQAENR

SEQ ID NO: 1616955 - protein, 7 aa, Staphylococcus aureus
DQNVQTA

SEQ ID NO: 1616956 - protein, 8 aa, Staphylococcus aureus
DRAKNTGK

SEQ ID NO: 1616957 - protein, 8 aa, Staphylococcus aureus
DRTPYDND

SEQ ID NO: 1616958 - protein, 10 aa, Staphylococcus aureus
DSYIEKDNQI

SEQ ID NO: 1616959 - protein, 5 aa, Staphylococcus aureus
DVEPQ

SEQ ID NO: 1616960 - protein, 4 aa, Staphylococcus aureus
DVYD

SEQ ID NO: 1616961 - protein, 7 aa, Staphylococcus aureus
DYSASKN

SEQ ID NO: 1616962 - protein, 4 aa, Staphylococcus aureus
DYTN

SEQ ID NO: 1616963 - protein, 5 aa, Staphylococcus aureus
EAGHG

SEQ ID NO: 1616964 - protein, 8 aa, Staphylococcus aureus
EAITTTEI

SEQ ID NO: 1616965 - protein, 12 aa, Staphylococcus aureus
EDDPDSESPKLS

SEQ ID NO: 1616966 - protein, 13 aa, Staphylococcus aureus
EDFGTTDSLRSDA

SEQ ID NO: 1616967 - protein, 4 aa, Staphylococcus aureus
EDID

SEQ ID NO: 1616968 - protein, 4 aa, Staphylococcus aureus
EDVN

SEQ ID NO: 1616969 - protein, 4 aa, Staphylococcus aureus
EEDA

SEQ ID NO: 1616970 - protein, 4 aa, Staphylococcus aureus
EEID

SEQ ID NO: 1616971 - protein, 7 aa, Staphylococcus aureus
EEIKALE

SEQ ID NO: 1616972 - protein, 14 aa, Staphylococcus aureus
EESNGIKAELPNLE

SEQ ID NO: 1616973 - protein, 14 aa, Staphylococcus aureus
EESSGIKAELPNLE

SEQ ID NO: 1616974 - protein, 5 aa, Staphylococcus aureus
EGGYE

SEQ ID NO: 1616975 - protein, 8 aa, Staphylococcus aureus
EGMPQEDT

SEQ ID NO: 1616976 - protein, 4 aa, Staphylococcus aureus
EGSK

SEQ ID NO: 1616977 - protein, 4 aa, Staphylococcus aureus
EGYG

SEQ ID NO: 1616978 - protein, 11 aa, Staphylococcus aureus
EHLTTDEQEIR

SEQ ID NO: 1616979 - protein, 10 aa, Staphylococcus aureus
EIKNQSPKTG

SEQ ID NO: 1616980 - protein, 12 aa, Staphylococcus aureus
EISEYSAHNQRG

SEQ ID NO: 1616981 - protein, 7 aa, Staphylococcus aureus
EKANEIL

SEQ ID NO: 1616982 - protein, 11 aa, Staphylococcus aureus
EKLSNKALSDI

SEQ ID NO: 1616983 - protein, 8 aa, Staphylococcus aureus
EKNVSDNV

SEQ ID NO: 1616984 - protein, 8 aa, Staphylococcus aureus
EKRTNNVV

SEQ ID NO: 1616985 - protein, 8 aa, Staphylococcus aureus
EKTKQAEV

SEQ ID NO: 1616986 - protein, 6 aa, Staphylococcus aureus
EKWPGT

SEQ ID NO: 1616987 - protein, 18 aa, Staphylococcus aureus
ELQRKKIRNTNKGKELQA

SEQ ID NO: 1616988 - protein, 9 aa, Staphylococcus aureus
ELRGDDPKV

SEQ ID NO: 1616989 - protein, 5 aa, Staphylococcus aureus
EMQQE

SEQ ID NO: 1616990 - protein, 6 aa, Staphylococcus aureus
ENEHRN

SEQ ID NO: 1616991 - protein, 12 aa, Staphylococcus aureus
ENPQIKEEIDRK

SEQ ID NO: 1616992 - protein, 7 aa, Staphylococcus aureus
EQEQPAY

SEQ ID NO: 1616993 - protein, 8 aa, Staphylococcus aureus
EQRPRLNH

SEQ ID NO: 1616994 - protein, 8 aa, Staphylococcus aureus
EQSKTDNV

SEQ ID NO: 1616995 - protein, 11 aa, Staphylococcus aureus
EQYNENFSRPQ

SEQ ID NO: 1616996 - protein, 21 aa, Staphylococcus aureus
ERGRKAIENELKRDKTKAEEI

SEQ ID NO: 1616997 - protein, 22 aa, Staphylococcus aureus
ERGYQLSKTEYRGREATDFKEE

SEQ ID NO: 1616998 - protein, 6 aa, Staphylococcus aureus
ESGNPV

SEQ ID NO: 1616999 - protein, 19 aa, Staphylococcus aureus
ESIKSAKEKKYSKSNPYQA

SEQ ID NO: 1617000 - protein, 9 aa, Staphylococcus aureus
ESKNTQDID

SEQ ID NO: 1617001 - protein, 7 aa, Staphylococcus aureus
ESNEGVG

SEQ ID NO: 1617002 - protein, 10 aa, Staphylococcus aureus
ESPMNDNGYD

SEQ ID NO: 1617003 - protein, 8 aa, Staphylococcus aureus
ESSRPNEI

SEQ ID NO: 1617004 - protein, 16 aa, Staphylococcus aureus
ETAQLSTVKNEDGTPV

SEQ ID NO: 1617005 - protein, 12 aa, Staphylococcus aureus
ETEDGSKINPTL

SEQ ID NO: 1617006 - protein, 12 aa, Staphylococcus aureus
ETIDTPVQTLDQ

SEQ ID NO: 1617007 - protein, 7 aa, Staphylococcus aureus
ETSPYTF

SEQ ID NO: 1617008 - protein, 10 aa, Staphylococcus aureus
EYDRGSRRFE

SEQ ID NO: 1617009 - protein, 5 aa, Staphylococcus aureus
EYFDT

SEQ ID NO: 1617010 - protein, 9 aa, Staphylococcus aureus
FASDNNLTF

SEQ ID NO: 1617011 - protein, 9 aa, Staphylococcus aureus
FDDDKPAVI

SEQ ID NO: 1617012 - protein, 9 aa, Staphylococcus aureus
FDEQQDAVH

SEQ ID NO: 1617013 - protein, 11 aa, Staphylococcus aureus
FEGTARQKTAA

SEQ ID NO: 1617014 - protein, 14 aa, Staphylococcus aureus
FKEAKSEGKKYFDD

SEQ ID NO: 1617015 - protein, 10 aa, Staphylococcus aureus
FKTNATVDSL

SEQ ID NO: 1617016 - protein, 6 aa, Staphylococcus aureus
FNKSKH

SEQ ID NO: 1617017 - protein, 6 aa, Staphylococcus aureus
FRENYG

SEQ ID NO: 1617018 - protein, 10 aa, Staphylococcus aureus
FVKTEKSHDQ

SEQ ID NO: 1617019 - protein, 5 aa, Staphylococcus aureus
GATTV

SEQ ID NO: 1617020 - protein, 11 aa, Staphylococcus aureus
GDDKAAAFESN

SEQ ID NO: 1617021 - protein, 9 aa, Staphylococcus aureus
GDDLPTAGG

SEQ ID NO: 1617022 - protein, 20 aa, Staphylococcus aureus
GDIKDVEQALQGTKMTREDL

SEQ ID NO: 1617023 - protein, 9 aa, Staphylococcus aureus
GDSDSASDY

SEQ ID NO: 1617024 - protein, 7 aa, Staphylococcus aureus
GEHGDTE

SEQ ID NO: 1617025 - protein, 7 aa, Staphylococcus aureus
GEIAGVA

SEQ ID NO: 1617026 - protein, 6 aa, Staphylococcus aureus
GELTAS

SEQ ID NO: 1617027 - protein, 8 aa, Staphylococcus aureus
GEQGYIGA

SEQ ID NO: 1617028 - protein, 8 aa, Staphylococcus aureus
GFAGGELK

SEQ ID NO: 1617029 - protein, 9 aa, Staphylococcus aureus
GFLPGNGAI

SEQ ID NO: 1617030 - protein, 15 aa, Staphylococcus aureus
GGENTSINMSNKPPT

SEQ ID NO: 1617031 - protein, 7 aa, Staphylococcus aureus
GGTAGMG

SEQ ID NO: 1617032 - protein, 12 aa, Staphylococcus aureus
GHKPALEGTEET

SEQ ID NO: 1617033 - protein, 12 aa, Staphylococcus aureus
GHYTERGEDIGY

SEQ ID NO: 1617034 - protein, 10 aa, Staphylococcus aureus
GIKGAVSDSP

SEQ ID NO: 1617035 - protein, 21 aa, Staphylococcus aureus
GKEMEQISDQNDQEKNSEEDS

SEQ ID NO: 1617036 - protein, 6 aa, Staphylococcus aureus
GKGHMN

SEQ ID NO: 1617037 - protein, 6 aa, Staphylococcus aureus
GKQSEE

SEQ ID NO: 1617038 - protein, 9 aa, Staphylococcus aureus
GKYEAKQDK

SEQ ID NO: 1617039 - protein, 10 aa, Staphylococcus aureus
GLRKSSNKEY

SEQ ID NO: 1617040 - protein, 4 aa, Staphylococcus aureus
GNDT

SEQ ID NO: 1617041 - protein, 4 aa, Staphylococcus aureus
GNGI

SEQ ID NO: 1617042 - protein, 9 aa, Staphylococcus aureus
GNGSNTISD

SEQ ID NO: 1617043 - protein, 5 aa, Staphylococcus aureus
GPTLS

SEQ ID NO: 1617044 - protein, 12 aa, Staphylococcus aureus
GQHTVEKDKSYP

SEQ ID NO: 1617045 - protein, 9 aa, Staphylococcus aureus
GQPKDGDTV

SEQ ID NO: 1617046 - protein, 6 aa, Staphylococcus aureus
GQQAGS

SEQ ID NO: 1617047 - protein, 7 aa, Staphylococcus aureus
GRDGEIQ

SEQ ID NO: 1617048 - protein, 4 aa, Staphylococcus aureus
GRIA

SEQ ID NO: 1617049 - protein, 8 aa, Staphylococcus aureus
GRVRAGQT

SEQ ID NO: 1617050 - protein, 6 aa, Staphylococcus aureus
GSETEY

SEQ ID NO: 1617051 - protein, 12 aa, Staphylococcus aureus
GSGNLKGSSVGY

SEQ ID NO: 1617052 - protein, 10 aa, Staphylococcus aureus
GTKEESGTRL

SEQ ID NO: 1617053 - protein, 15 aa, Staphylococcus aureus
GVAEKKAPGAKLQGD

SEQ ID NO: 1617054 - protein, 7 aa, Staphylococcus aureus
GVPKENI

SEQ ID NO: 1617055 - protein, 17 aa, Staphylococcus aureus
GVPNHENSHPHQSSNGR

SEQ ID NO: 1617056 - protein, 10 aa, Staphylococcus aureus
GVQKDADEVD

SEQ ID NO: 1617057 - protein, 17 aa, Staphylococcus aureus
GYEYNQRQDDDNYFEQP

SEQ ID NO: 1617058 - protein, 7 aa, Staphylococcus aureus
HAADDVE

SEQ ID NO: 1617059 - protein, 15 aa, Staphylococcus aureus
HGNKSVTSNSGSTDL

SEQ ID NO: 1617060 - protein, 9 aa, Staphylococcus aureus
HISQEEAET

SEQ ID NO: 1617061 - protein, 10 aa, Staphylococcus aureus
HKDKIAKRGE

SEQ ID NO: 1617062 - protein, 11 aa, Staphylococcus aureus
HKSDTPPENPV

SEQ ID NO: 1617063 - protein, 4 aa, Staphylococcus aureus
HPDY

SEQ ID NO: 1617064 - protein, 7 aa, Staphylococcus aureus
HSSELND

SEQ ID NO: 1617065 - protein, 5 aa, Staphylococcus aureus
HYTYS

SEQ ID NO: 1617066 - protein, 9 aa, Staphylococcus aureus
IAESEAETT

SEQ ID NO: 1617067 - protein, 11 aa, Staphylococcus aureus
IDELGNKNGLE

SEQ ID NO: 1617068 - protein, 7 aa, Staphylococcus aureus
IDSKTSK

SEQ ID NO: 1617069 - protein, 5 aa, Staphylococcus aureus
IEEKA

SEQ ID NO: 1617070 - protein, 14 aa, Staphylococcus aureus
IEGNPTIENGVPTV

SEQ ID NO: 1617071 - protein, 8 aa, Staphylococcus aureus
IENGNTKL

SEQ ID NO: 1617072 - protein, 7 aa, Staphylococcus aureus
IEPRSKL

SEQ ID NO: 1617073 - protein, 4 aa, Staphylococcus aureus
IGQD

SEQ ID NO: 1617074 - protein, 9 aa, Staphylococcus aureus
IGRKGTINK

SEQ ID NO: 1617075 - protein, 4 aa, Staphylococcus aureus
IGSD

SEQ ID NO: 1617076 - protein, 7 aa, Staphylococcus aureus
IGSGSPI

SEQ ID NO: 1617077 - protein, 13 aa, Staphylococcus aureus
INDKDIDSSNRIK

SEQ ID NO: 1617078 - protein, 10 aa, Staphylococcus aureus
INTENDSVPY

SEQ ID NO: 1617079 - protein, 7 aa, Staphylococcus aureus
ISENSRQ

SEQ ID NO: 1617080 - protein, 14 aa, Staphylococcus aureus
ISNDEDLRIALGTT

SEQ ID NO: 1617081 - protein, 10 aa, Staphylococcus aureus
ISSPGALPAS

SEQ ID NO: 1617082 - protein, 10 aa, Staphylococcus aureus
ITADTTIKDV

SEQ ID NO: 1617083 - protein, 36 aa, Staphylococcus aureus
ITTDEYKDQVKAYQTEASKKSDLERTDLAKDKSGVF

SEQ ID NO: 1617084 - protein, 10 aa, Staphylococcus aureus
KAQQESYSPY

SEQ ID NO: 1617085 - protein, 14 aa, Staphylococcus aureus
KAREELSSDKLEDN

SEQ ID NO: 1617086 - protein, 6 aa, Staphylococcus aureus
KARSDR

SEQ ID NO: 1617087 - protein, 6 aa, Staphylococcus aureus
KAVQQN

SEQ ID NO: 1617088 - protein, 12 aa, Staphylococcus aureus
KCNNEAELKEGI

SEQ ID NO: 1617089 - protein, 9 aa, Staphylococcus aureus
KDFNKRDLK

SEQ ID NO: 1617090 - protein, 6 aa, Staphylococcus aureus
KDTAFT

SEQ ID NO: 1617091 - protein, 6 aa, Staphylococcus aureus
KEDTDI

SEQ ID NO: 1617092 - protein, 8 aa, Staphylococcus aureus
KEHGREAD

SEQ ID NO: 1617093 - protein, 6 aa, Staphylococcus aureus
KEISPE

SEQ ID NO: 1617094 - protein, 9 aa, Staphylococcus aureus
KEKDPKYKL

SEQ ID NO: 1617095 - protein, 5 aa, Staphylococcus aureus
KEKQF

SEQ ID NO: 1617096 - protein, 6 aa, Staphylococcus aureus
KETGVY

SEQ ID NO: 1617097 - protein, 8 aa, Staphylococcus aureus
KGITSKDK

SEQ ID NO: 1617098 - protein, 8 aa, Staphylococcus aureus
KGKTITGP

SEQ ID NO: 1617099 - protein, 13 aa, Staphylococcus aureus
KGYKAEGLHGDIT

SEQ ID NO: 1617100 - protein, 20 aa, Staphylococcus aureus
KISQSELSRRTGIGRNSISD

SEQ ID NO: 1617101 - protein, 6 aa, Staphylococcus aureus
KKDGTL

SEQ ID NO: 1617102 - protein, 7 aa, Staphylococcus aureus
KKKLQIQ

SEQ ID NO: 1617103 - protein, 24 aa, Staphylococcus aureus
KKLQLENEKLPQLQQQAQQSTNQM

SEQ ID NO: 1617104 - protein, 8 aa, Staphylococcus aureus
KKRETGRV

SEQ ID NO: 1617105 - protein, 10 aa, Staphylococcus aureus
KLKEGQKRLE

SEQ ID NO: 1617106 - protein, 27 aa, Staphylococcus aureus
KNADIANVRDSSPTANNGSASKQPQII

SEQ ID NO: 1617107 - protein, 8 aa, Staphylococcus aureus
KNFGQGMS

SEQ ID NO: 1617108 - protein, 8 aa, Staphylococcus aureus
KNGEQAER

SEQ ID NO: 1617109 - protein, 8 aa, Staphylococcus aureus
KNGKKRIS

SEQ ID NO: 1617110 - protein, 4 aa, Staphylococcus aureus
KNTI

SEQ ID NO: 1617111 - protein, 4 aa, Staphylococcus aureus
KPQQ

SEQ ID NO: 1617112 - protein, 21 aa, Staphylococcus aureus
KQHNEKEKFEFTTEGTWQQRQ

SEQ ID NO: 1617113 - protein, 10 aa, Staphylococcus aureus
KRASINPKDV

SEQ ID NO: 1617114 - protein, 6 aa, Staphylococcus aureus
KSFGKG

SEQ ID NO: 1617115 - protein, 6 aa, Staphylococcus aureus
KSGKSY

SEQ ID NO: 1617116 - protein, 28 aa, Staphylococcus aureus
KSKSPTVNDLPERDLSQQISDYEKYGAN

SEQ ID NO: 1617117 - protein, 27 aa, Staphylococcus aureus
KSKSPTVNDLPERDLSQQISDYEQYGA

SEQ ID NO: 1617118 - protein, 6 aa, Staphylococcus aureus
KSLSNE

SEQ ID NO: 1617119 - protein, 4 aa, Staphylococcus aureus
KSNE

SEQ ID NO: 1617120 - protein, 7 aa, Staphylococcus aureus
KSNEELS

SEQ ID NO: 1617121 - protein, 6 aa, Staphylococcus aureus
KSTTEI

SEQ ID NO: 1617122 - protein, 7 aa, Staphylococcus aureus
KTKELNV

SEQ ID NO: 1617123 - protein, 6 aa, Staphylococcus aureus
KTTFEE

SEQ ID NO: 1617124 - protein, 4 aa, Staphylococcus aureus
KTVD

SEQ ID NO: 1617125 - protein, 7 aa, Staphylococcus aureus
KVEANAN

SEQ ID NO: 1617126 - protein, 5 aa, Staphylococcus aureus
KVPGV

SEQ ID NO: 1617127 - protein, 11 aa, Staphylococcus aureus
LDTNGKQTEFK

SEQ ID NO: 1617128 - protein, 8 aa, Staphylococcus aureus
LEKEGDTY

SEQ ID NO: 1617129 - protein, 10 aa, Staphylococcus aureus
LEKSSTPSGV

SEQ ID NO: 1617130 - protein, 6 aa, Staphylococcus aureus
LETYNN

SEQ ID NO: 1617131 - protein, 7 aa, Staphylococcus aureus
LGGAPQL

SEQ ID NO: 1617132 - protein, 11 aa, Staphylococcus aureus
LKQEPRANTQV

SEQ ID NO: 1617133 - protein, 11 aa, Staphylococcus aureus
LKTNDVNDGHV

SEQ ID NO: 1617134 - protein, 14 aa, Staphylococcus aureus
LNENEGQAIQTMDQ

SEQ ID NO: 1617135 - protein, 11 aa, Staphylococcus aureus
LNKEVSASIEN

SEQ ID NO: 1617136 - protein, 8 aa, Staphylococcus aureus
LNTKDTDE

SEQ ID NO: 1617137 - protein, 4 aa, Staphylococcus aureus
LQQV

SEQ ID NO: 1617138 - protein, 4 aa, Staphylococcus aureus
LRKQ

SEQ ID NO: 1617139 - protein, 17 aa, Staphylococcus aureus
LSGEERIDGIPEPALPF

SEQ ID NO: 1617140 - protein, 6 aa, Staphylococcus aureus
LTGGVE

SEQ ID NO: 1617141 - protein, 4 aa, Staphylococcus aureus
LTKK

SEQ ID NO: 1617142 - protein, 11 aa, Staphylococcus aureus
MSKENNGREAA

SEQ ID NO: 1617143 - protein, 8 aa, Staphylococcus aureus
NAAKDEHG

SEQ ID NO: 1617144 - protein, 5 aa, Staphylococcus aureus
NAGYV

SEQ ID NO: 1617145 - protein, 4 aa, Staphylococcus aureus
NDDR

SEQ ID NO: 1617146 - protein, 6 aa, Staphylococcus aureus
NESRVL

SEQ ID NO: 1617147 - protein, 5 aa, Staphylococcus aureus
NFTTN

SEQ ID NO: 1617148 - protein, 6 aa, Staphylococcus aureus
NGAQRE

SEQ ID NO: 1617149 - protein, 10 aa, Staphylococcus aureus
NGESTTQEIE

SEQ ID NO: 1617150 - protein, 4 aa, Staphylococcus aureus
NIEK

SEQ ID NO: 1617151 - protein, 4 aa, Staphylococcus aureus
NIPA

SEQ ID NO: 1617152 - protein, 9 aa, Staphylococcus aureus
NKDTGISYG

SEQ ID NO: 1617153 - protein, 9 aa, Staphylococcus aureus
NKVTEGSTV

SEQ ID NO: 1617154 - protein, 4 aa, Staphylococcus aureus
NNAP

SEQ ID NO: 1617155 - protein, 8 aa, Staphylococcus aureus
NNDDLEEI

SEQ ID NO: 1617156 - protein, 5 aa, Staphylococcus aureus
NNETW

SEQ ID NO: 1617157 - protein, 8 aa, Staphylococcus aureus
NNVKPQVF

SEQ ID NO: 1617158 - protein, 10 aa, Staphylococcus aureus
NPEVSNDQIK

SEQ ID NO: 1617159 - protein, 11 aa, Staphylococcus aureus
NPTKLAEATAQ

SEQ ID NO: 1617160 - protein, 12 aa, Staphylococcus aureus
NQASPNAKTSVR

SEQ ID NO: 1617161 - protein, 9 aa, Staphylococcus aureus
NQGLSTEEA

SEQ ID NO: 1617162 - protein, 10 aa, Staphylococcus aureus
NQGNNPFGKS

SEQ ID NO: 1617163 - protein, 13 aa, Staphylococcus aureus
NQQDDGTREENTS

SEQ ID NO: 1617164 - protein, 48 aa, Staphylococcus aureus
NSEDEEMLENTATNDTGASQTTIDDQVEAPMSSNDSGEVTSDSTKTDI

SEQ ID NO: 1617165 - protein, 9 aa, Staphylococcus aureus
NSNQSTQDI

SEQ ID NO: 1617166 - protein, 11 aa, Staphylococcus aureus
NTKYQDKENMN

SEQ ID NO: 1617167 - protein, 18 aa, Staphylococcus aureus
NTRDASGGADDTREGTVI

SEQ ID NO: 1617168 - protein, 11 aa, Staphylococcus aureus
NTSRTPGEHFG

SEQ ID NO: 1617169 - protein, 13 aa, Staphylococcus aureus
NWATEKYSRQQHA

SEQ ID NO: 1617170 - protein, 9 aa, Staphylococcus aureus
NYNSSNSPI

SEQ ID NO: 1617171 - protein, 5 aa, Staphylococcus aureus
NYVVP

SEQ ID NO: 1617172 - protein, 5 aa, Staphylococcus aureus
PAEDC

SEQ ID NO: 1617173 - protein, 18 aa, Staphylococcus aureus
PDLPTTTIGSFPQSREVR

SEQ ID NO: 1617174 - protein, 4 aa, Staphylococcus aureus
PEAV

SEQ ID NO: 1617175 - protein, 4 aa, Staphylococcus aureus
PEGE

SEQ ID NO: 1617176 - protein, 18 aa, Staphylococcus aureus
PESNRSKYTFDSYSGDTN

SEQ ID NO: 1617177 - protein, 7 aa, Staphylococcus aureus
PGQSGFS

SEQ ID NO: 1617178 - protein, 4 aa, Staphylococcus aureus
PIPS

SEQ ID NO: 1617179 - protein, 8 aa, Staphylococcus aureus
PKFGKQRP

SEQ ID NO: 1617180 - protein, 5 aa, Staphylococcus aureus
PKKET

SEQ ID NO: 1617181 - protein, 6 aa, Staphylococcus aureus
PLATSA

SEQ ID NO: 1617182 - protein, 9 aa, Staphylococcus aureus
PLGDSKPDW

SEQ ID NO: 1617183 - protein, 4 aa, Staphylococcus aureus
PNEP

SEQ ID NO: 1617184 - protein, 10 aa, Staphylococcus aureus
PNHKHSTVQP

SEQ ID NO: 1617185 - protein, 5 aa, Staphylococcus aureus
PSGEY

SEQ ID NO: 1617186 - protein, 10 aa, Staphylococcus aureus
PTEEPTEEEI

SEQ ID NO: 1617187 - protein, 6 aa, Staphylococcus aureus
PVESTR

SEQ ID NO: 1617188 - protein, 7 aa, Staphylococcus aureus
QASIGQG

SEQ ID NO: 1617189 - protein, 28 aa, Staphylococcus aureus
QDIEEKEKAKVKDKGEAYQSLSDNEKMV

SEQ ID NO: 1617190 - protein, 7 aa, Staphylococcus aureus
QDQIEQE

SEQ ID NO: 1617191 - protein, 9 aa, Staphylococcus aureus
QDTTAMDTT

SEQ ID NO: 1617192 - protein, 10 aa, Staphylococcus aureus
QEGDDSILQQ

SEQ ID NO: 1617193 - protein, 15 aa, Staphylococcus aureus
QEYEAKFGKEPRAYG

SEQ ID NO: 1617194 - protein, 12 aa, Staphylococcus aureus
QFKEGDKFYSKR

SEQ ID NO: 1617195 - protein, 14 aa, Staphylococcus aureus
QGMNQTLDQLDALL

SEQ ID NO: 1617196 - protein, 14 aa, Staphylococcus aureus
QKLSEPETKKIYSQ

SEQ ID NO: 1617197 - protein, 8 aa, Staphylococcus aureus
QNDSVKYD

SEQ ID NO: 1617198 - protein, 8 aa, Staphylococcus aureus
QNNQYQDK

SEQ ID NO: 1617199 - protein, 12 aa, Staphylococcus aureus
QNYHDTSSKDNF

SEQ ID NO: 1617200 - protein, 11 aa, Staphylococcus aureus
QRLSQSPQKMA

SEQ ID NO: 1617201 - protein, 7 aa, Staphylococcus aureus
QSERFDP

SEQ ID NO: 1617202 - protein, 9 aa, Staphylococcus aureus
QSGETADSR

SEQ ID NO: 1617203 - protein, 5 aa, Staphylococcus aureus
QSYRE

SEQ ID NO: 1617204 - protein, 7 aa, Staphylococcus aureus
QTENNNE

SEQ ID NO: 1617205 - protein, 5 aa, Staphylococcus aureus
QTMSS

SEQ ID NO: 1617206 - protein, 12 aa, Staphylococcus aureus
QWNPGGSVKDRL

SEQ ID NO: 1617207 - protein, 11 aa, Staphylococcus aureus
QYDSEDKRQDV

SEQ ID NO: 1617208 - protein, 13 aa, Staphylococcus aureus
QYTELENDKPIDV

SEQ ID NO: 1617209 - protein, 11 aa, Staphylococcus aureus
RDNDGRGTMER

SEQ ID NO: 1617210 - protein, 10 aa, Staphylococcus aureus
RDTRASAPKN

SEQ ID NO: 1617211 - protein, 17 aa, Staphylococcus aureus
RGKDGGYLANDRSADVS

SEQ ID NO: 1617212 - protein, 11 aa, Staphylococcus aureus
RGQYGEGYIDG

SEQ ID NO: 1617213 - protein, 6 aa, Staphylococcus aureus
RHPNEY

SEQ ID NO: 1617214 - protein, 7 aa, Staphylococcus aureus
RKEEYMA

SEQ ID NO: 1617215 - protein, 16 aa, Staphylococcus aureus
RKLERKRKREAELRRK

SEQ ID NO: 1617216 - protein, 85 aa, Staphylococcus aureus
RLKDASKKLDTAGEDFNKGQSSYNKVEISTSDWKGERRTKSDSKKKDVDSELKKVEQDFDDAKKAIKKDIQDKEEEIKGVEGEIS

SEQ ID NO: 1617217 - protein, 7 aa, Staphylococcus aureus
RLTTLSS

SEQ ID NO: 1617218 - protein, 21 aa, Staphylococcus aureus
RNDSTTQNNNIGETEDVLNRT

SEQ ID NO: 1617219 - protein, 8 aa, Staphylococcus aureus
RNTRTAKG

SEQ ID NO: 1617220 - protein, 13 aa, Staphylococcus aureus
RPSEEVLGSLFEK

SEQ ID NO: 1617221 - protein, 13 aa, Staphylococcus aureus
RQWQDGDDSSLRS

SEQ ID NO: 1617222 - protein, 8 aa, Staphylococcus aureus
RRKDRDKI

SEQ ID NO: 1617223 - protein, 7 aa, Staphylococcus aureus
RRLEKPK

SEQ ID NO: 1617224 - protein, 10 aa, Staphylococcus aureus
RSKGTLQGYS

SEQ ID NO: 1617225 - protein, 6 aa, Staphylococcus aureus
RSSTQV

SEQ ID NO: 1617226 - protein, 15 aa, Staphylococcus aureus
SANWATEKYSRQQHA

SEQ ID NO: 1617227 - protein, 5 aa, Staphylococcus aureus
SDGVP

SEQ ID NO: 1617228 - protein, 6 aa, Staphylococcus aureus
SDKDLS

SEQ ID NO: 1617229 - protein, 7 aa, Staphylococcus aureus
SDKIEEN

SEQ ID NO: 1617230 - protein, 12 aa, Staphylococcus aureus
SDKPDEFVPLRH

SEQ ID NO: 1617231 - protein, 12 aa, Staphylococcus aureus
SDKPDEFVPLRR

SEQ ID NO: 1617232 - protein, 22 aa, Staphylococcus aureus
SEKNDKNEVKKAKTLMEKAGSN

SEQ ID NO: 1617233 - protein, 5 aa, Staphylococcus aureus
SETDT

SEQ ID NO: 1617234 - protein, 7 aa, Staphylococcus aureus
SFSGEQG

SEQ ID NO: 1617235 - protein, 9 aa, Staphylococcus aureus
SGATESNNI

SEQ ID NO: 1617236 - protein, 4 aa, Staphylococcus aureus
SGTV

SEQ ID NO: 1617237 - protein, 11 aa, Staphylococcus aureus
SIQYDPNRSAN

SEQ ID NO: 1617238 - protein, 9 aa, Staphylococcus aureus
SKAKKVNQQ

SEQ ID NO: 1617239 - protein, 6 aa, Staphylococcus aureus
SKELKR

SEQ ID NO: 1617240 - protein, 10 aa, Staphylococcus aureus
SKESESRLKR

SEQ ID NO: 1617241 - protein, 11 aa, Staphylococcus aureus
SKGRLTKEDHE

SEQ ID NO: 1617242 - protein, 9 aa, Staphylococcus aureus
SKKEGEPDK

SEQ ID NO: 1617243 - protein, 15 aa, Staphylococcus aureus
SKLPDIPHHKFLEMI

SEQ ID NO: 1617244 - protein, 10 aa, Staphylococcus aureus
SKPYSKANTY

SEQ ID NO: 1617245 - protein, 10 aa, Staphylococcus aureus
SKSVSSKNLE

SEQ ID NO: 1617246 - protein, 7 aa, Staphylococcus aureus
SKTQNRS

SEQ ID NO: 1617247 - protein, 10 aa, Staphylococcus aureus
SLSTKGCPYD

SEQ ID NO: 1617248 - protein, 8 aa, Staphylococcus aureus
SNFPGKEW

SEQ ID NO: 1617249 - protein, 7 aa, Staphylococcus aureus
SNSGAIT

SEQ ID NO: 1617250 - protein, 8 aa, Staphylococcus aureus
SNYDTENE

SEQ ID NO: 1617251 - protein, 5 aa, Staphylococcus aureus
SPQAF

SEQ ID NO: 1617252 - protein, 6 aa, Staphylococcus aureus
SQAATV

SEQ ID NO: 1617253 - protein, 6 aa, Staphylococcus aureus
SQSVTS

SEQ ID NO: 1617254 - protein, 8 aa, Staphylococcus aureus
SRGTGSWN

SEQ ID NO: 1617255 - protein, 13 aa, Staphylococcus aureus
SRGVEQRQDKRPM

SEQ ID NO: 1617256 - protein, 7 aa, Staphylococcus aureus
SSAWSNA

SEQ ID NO: 1617257 - protein, 9 aa, Staphylococcus aureus
SSIYQERDH

SEQ ID NO: 1617258 - protein, 8 aa, Staphylococcus aureus
SSNDISKC

SEQ ID NO: 1617259 - protein, 7 aa, Staphylococcus aureus
SSQEVNY

SEQ ID NO: 1617260 - protein, 4 aa, Staphylococcus aureus
SSRL

SEQ ID NO: 1617261 - protein, 6 aa, Staphylococcus aureus
STFGQR

SEQ ID NO: 1617262 - protein, 7 aa, Staphylococcus aureus
STGQPHE

SEQ ID NO: 1617263 - protein, 7 aa, Staphylococcus aureus
STKAYTA

SEQ ID NO: 1617264 - protein, 8 aa, Staphylococcus aureus
SVPTARKR

SEQ ID NO: 1617265 - protein, 5 aa, Staphylococcus aureus
TAGGI

SEQ ID NO: 1617266 - protein, 15 aa, Staphylococcus aureus
TAKELKAKGDTVKFT

SEQ ID NO: 1617267 - protein, 5 aa, Staphylococcus aureus
TAKPL

SEQ ID NO: 1617268 - protein, 7 aa, Staphylococcus aureus
TDESFES

SEQ ID NO: 1617269 - protein, 7 aa, Staphylococcus aureus
TDQRDYE

SEQ ID NO: 1617270 - protein, 6 aa, Staphylococcus aureus
TEAGTF

SEQ ID NO: 1617271 - protein, 4 aa, Staphylococcus aureus
TEDI

SEQ ID NO: 1617272 - protein, 7 aa, Staphylococcus aureus
TGEGPKE

SEQ ID NO: 1617273 - protein, 7 aa, Staphylococcus aureus
TGEHSQY

SEQ ID NO: 1617274 - protein, 6 aa, Staphylococcus aureus
TGEINQ

SEQ ID NO: 1617275 - protein, 9 aa, Staphylococcus aureus
TGGTGIAQR

SEQ ID NO: 1617276 - protein, 13 aa, Staphylococcus aureus
TGYEISKKTGVSQ

SEQ ID NO: 1617277 - protein, 18 aa, Staphylococcus aureus
THGSSKNDPKRTYYLLGF

SEQ ID NO: 1617278 - protein, 8 aa, Staphylococcus aureus
THKNSVER

SEQ ID NO: 1617279 - protein, 7 aa, Staphylococcus aureus
TKKDKNK

SEQ ID NO: 1617280 - protein, 5 aa, Staphylococcus aureus
TKNVS

SEQ ID NO: 1617281 - protein, 8 aa, Staphylococcus aureus
TKPTVTKS

SEQ ID NO: 1617282 - protein, 5 aa, Staphylococcus aureus
TLRKN

SEQ ID NO: 1617283 - protein, 13 aa, Staphylococcus aureus
TNIEENPQLSNYE

SEQ ID NO: 1617284 - protein, 7 aa, Staphylococcus aureus
TNVDNEK

SEQ ID NO: 1617285 - protein, 9 aa, Staphylococcus aureus
TNVVGSGDG

SEQ ID NO: 1617286 - protein, 6 aa, Staphylococcus aureus
TPFQHR

SEQ ID NO: 1617287 - protein, 20 aa, Staphylococcus aureus
TQAVDENNSELNQVGTSTKA

SEQ ID NO: 1617288 - protein, 4 aa, Staphylococcus aureus
TQEK

SEQ ID NO: 1617289 - protein, 6 aa, Staphylococcus aureus
TQKEGF

SEQ ID NO: 1617290 - protein, 8 aa, Staphylococcus aureus
TRNSTGRN

SEQ ID NO: 1617291 - protein, 10 aa, Staphylococcus aureus
TRRAQEGYYQ

SEQ ID NO: 1617292 - protein, 14 aa, Staphylococcus aureus
TSVERPEIQETTAL

SEQ ID NO: 1617293 - protein, 4 aa, Staphylococcus aureus
TTQI

SEQ ID NO: 1617294 - protein, 13 aa, Staphylococcus aureus
TTSVDDTPKQLDE

SEQ ID NO: 1617295 - protein, 5 aa, Staphylococcus aureus
VANGR

SEQ ID NO: 1617296 - protein, 13 aa, Staphylococcus aureus
VDKPRNLAKSVTV

SEQ ID NO: 1617297 - protein, 9 aa, Staphylococcus aureus
VDPQYENGK

SEQ ID NO: 1617298 - protein, 5 aa, Staphylococcus aureus
VEDET

SEQ ID NO: 1617299 - protein, 16 aa, Staphylococcus aureus
VEISTETNIAQPKFKY

SEQ ID NO: 1617300 - protein, 8 aa, Staphylococcus aureus
VEKHSDYD

SEQ ID NO: 1617301 - protein, 4 aa, Staphylococcus aureus
VETD

SEQ ID NO: 1617302 - protein, 10 aa, Staphylococcus aureus
VGKPDTPSMP

SEQ ID NO: 1617303 - protein, 7 aa, Staphylococcus aureus
VGNGDFE

SEQ ID NO: 1617304 - protein, 5 aa, Staphylococcus aureus
VGQRN

SEQ ID NO: 1617305 - protein, 6 aa, Staphylococcus aureus
VNDDQL

SEQ ID NO: 1617306 - protein, 5 aa, Staphylococcus aureus
VNDDT

SEQ ID NO: 1617307 - protein, 6 aa, Staphylococcus aureus
VNSDAD

SEQ ID NO: 1617308 - protein, 9 aa, Staphylococcus aureus
VNVGNNKDY

SEQ ID NO: 1617309 - protein, 9 aa, Staphylococcus aureus
VPNQNPTTV

SEQ ID NO: 1617310 - protein, 4 aa, Staphylococcus aureus
VPTE

SEQ ID NO: 1617311 - protein, 6 aa, Staphylococcus aureus
VRGNVD

SEQ ID NO: 1617312 - protein, 5 aa, Staphylococcus aureus
VSINS

SEQ ID NO: 1617313 - protein, 22 aa, Staphylococcus aureus
VSPKDLEEKELKYPKKITKEHH

SEQ ID NO: 1617314 - protein, 11 aa, Staphylococcus aureus
VYSEPNNSSVQ

SEQ ID NO: 1617315 - protein, 8 aa, Staphylococcus aureus
WGNVQGQV

SEQ ID NO: 1617316 - protein, 8 aa, Staphylococcus aureus
YDGTESDL

SEQ ID NO: 1617317 - protein, 7 aa, Staphylococcus aureus
YDNQGDH

SEQ ID NO: 1617318 - protein, 24 aa, Staphylococcus aureus
YGNPSSIHAKGRDARKYLDESRRQ

SEQ ID NO: 1617319 - protein, 15 aa, Staphylococcus aureus
YHGASKTSGAGGGDC

SEQ ID NO: 1617320 - protein, 12 aa, Staphylococcus aureus
YHNVPGAEEYTH

SEQ ID NO: 1617321 - protein, 16 aa, Staphylococcus aureus
YNDNNTTPSDYFYITS

SEQ ID NO: 1617322 - protein, 4 aa, Staphylococcus aureus
YPTG

SEQ ID NO: 1617323 - protein, 5 aa, Staphylococcus aureus
YPTSS

SEQ ID NO: 1617324 - protein, 9 aa, Staphylococcus aureus
YQDAEGNLK

SEQ ID NO: 1617325 - protein, 4 aa, Staphylococcus aureus
YQDK

SEQ ID NO: 1617326 - protein, 8 aa, Staphylococcus aureus
YRQQDGSS

SEQ ID NO: 1617327 - protein, 14 aa, Staphylococcus aureus
AAEAYGTDNAKVYD

SEQ ID NO: 1617328 - protein, 10 aa, Staphylococcus aureus
ADEASLDQTY

SEQ ID NO: 1617329 - protein, 8 aa, Staphylococcus aureus
ADSTKGMA

SEQ ID NO: 1617330 - protein, 6 aa, Staphylococcus aureus
AGEDIT

SEQ ID NO: 1617331 - protein, 4 aa, Staphylococcus aureus
AHDA

SEQ ID NO: 1617332 - protein, 5 aa, Staphylococcus aureus
AKALG

SEQ ID NO: 1617333 - protein, 8 aa, Staphylococcus aureus
AKDDMDNQ

SEQ ID NO: 1617334 - protein, 5 aa, Staphylococcus aureus
AKEEG

SEQ ID NO: 1617335 - protein, 7 aa, Staphylococcus aureus
AKEQGIE

SEQ ID NO: 1617336 - protein, 50 aa, Staphylococcus aureus
AKTQTSQNKHLEQEKQKDSVVKQGTASKSSDENVSSTTKSTPNYSKVDNT

SEQ ID NO: 1617337 - protein, 13 aa, Staphylococcus aureus
ALGPGGLTRERAQ

SEQ ID NO: 1617338 - protein, 4 aa, Staphylococcus aureus
AMTP

SEQ ID NO: 1617339 - protein, 4 aa, Staphylococcus aureus
ANDI

SEQ ID NO: 1617340 - protein, 8 aa, Staphylococcus aureus
ANISGTAN

SEQ ID NO: 1617341 - protein, 4 aa, Staphylococcus aureus
ANLD

SEQ ID NO: 1617342 - protein, 9 aa, Staphylococcus aureus
APHTAENVV

SEQ ID NO: 1617343 - protein, 9 aa, Staphylococcus aureus
APTKNAASH

SEQ ID NO: 1617344 - protein, 7 aa, Staphylococcus aureus
AQESPVK

SEQ ID NO: 1617345 - protein, 6 aa, Staphylococcus aureus
ASEMPK

SEQ ID NO: 1617346 - protein, 17 aa, Staphylococcus aureus
ASQEQGEQITVKTPNKV

SEQ ID NO: 1617347 - protein, 6 aa, Staphylococcus aureus
ATDIEN

SEQ ID NO: 1617348 - protein, 17 aa, Staphylococcus aureus
ATEGQIEIDGKDVRSMN

SEQ ID NO: 1617349 - protein, 10 aa, Staphylococcus aureus
ATERASINHS

SEQ ID NO: 1617350 - protein, 10 aa, Staphylococcus aureus
ATKSARHQFQ

SEQ ID NO: 1617351 - protein, 8 aa, Staphylococcus aureus
ATPVEPQD

SEQ ID NO: 1617352 - protein, 6 aa, Staphylococcus aureus
ATRSAL

SEQ ID NO: 1617353 - protein, 7 aa, Staphylococcus aureus
AVETPSE

SEQ ID NO: 1617354 - protein, 5 aa, Staphylococcus aureus
AVNQT

SEQ ID NO: 1617355 - protein, 7 aa, Staphylococcus aureus
AVYTDEE

SEQ ID NO: 1617356 - protein, 7 aa, Staphylococcus aureus
CTGKGEK

SEQ ID NO: 1617357 - protein, 7 aa, Staphylococcus aureus
DDIQGTG

SEQ ID NO: 1617358 - protein, 5 aa, Staphylococcus aureus
DEEIR

SEQ ID NO: 1617359 - protein, 14 aa, Staphylococcus aureus
DEKGEHKHTTDRKG

SEQ ID NO: 1617360 - protein, 11 aa, Staphylococcus aureus
DENATQEDYKA

SEQ ID NO: 1617361 - protein, 5 aa, Staphylococcus aureus
DEQYR

SEQ ID NO: 1617362 - protein, 7 aa, Staphylococcus aureus
DHQKELA

SEQ ID NO: 1617363 - protein, 7 aa, Staphylococcus aureus
DISLDGE

SEQ ID NO: 1617364 - protein, 21 aa, Staphylococcus aureus
DIVGDKNAINRKGQMPPSSNA

SEQ ID NO: 1617365 - protein, 6 aa, Staphylococcus aureus
DKMKEV

SEQ ID NO: 1617366 - protein, 16 aa, Staphylococcus aureus
DKSSHKEVQEHNSAYE

SEQ ID NO: 1617367 - protein, 10 aa, Staphylococcus aureus
DLDDDVSGYI

SEQ ID NO: 1617368 - protein, 7 aa, Staphylococcus aureus
DLPESQD

SEQ ID NO: 1617369 - protein, 16 aa, Staphylococcus aureus
DLSDSVSLQSAMKGKY

SEQ ID NO: 1617370 - protein, 19 aa, Staphylococcus aureus
DMPKADDDTSSYSTSEKNG

SEQ ID NO: 1617371 - protein, 18 aa, Staphylococcus aureus
DNGEISGFNHSKAKKKEV

SEQ ID NO: 1617372 - protein, 6 aa, Staphylococcus aureus
DNISKK

SEQ ID NO: 1617373 - protein, 6 aa, Staphylococcus aureus
DPFPNA

SEQ ID NO: 1617374 - protein, 8 aa, Staphylococcus aureus
DPISREKL

SEQ ID NO: 1617375 - protein, 5 aa, Staphylococcus aureus
DQAIK

SEQ ID NO: 1617376 - protein, 5 aa, Staphylococcus aureus
DQQSL

SEQ ID NO: 1617377 - protein, 11 aa, Staphylococcus aureus
DQSASGEDAIE

SEQ ID NO: 1617378 - protein, 4 aa, Staphylococcus aureus
DSDY

SEQ ID NO: 1617379 - protein, 15 aa, Staphylococcus aureus
DSKGYAQSKDTKYPV

SEQ ID NO: 1617380 - protein, 14 aa, Staphylococcus aureus
DTVEERENGKKVGS

SEQ ID NO: 1617381 - protein, 9 aa, Staphylococcus aureus
DVESHNRSL

SEQ ID NO: 1617382 - protein, 31 aa, Staphylococcus aureus
DVESTAKDVQTAKSSANKDSVSVKGKAPNTL

SEQ ID NO: 1617383 - protein, 6 aa, Staphylococcus aureus
DVTVEQ

SEQ ID NO: 1617384 - protein, 9 aa, Staphylococcus aureus
EAEVDSSDE

SEQ ID NO: 1617385 - protein, 4 aa, Staphylococcus aureus
EARL

SEQ ID NO: 1617386 - protein, 12 aa, Staphylococcus aureus
EATKNEDSVTGS

SEQ ID NO: 1617387 - protein, 28 aa, Staphylococcus aureus
EDAIKSRSISDEQVAKRRRLNDETKAYI

SEQ ID NO: 1617388 - protein, 18 aa, Staphylococcus aureus
EDKQQKVSSKTVTTSDGT

SEQ ID NO: 1617389 - protein, 15 aa, Staphylococcus aureus
EEEAARLRKNLLVTQ

SEQ ID NO: 1617390 - protein, 5 aa, Staphylococcus aureus
EEGNE

SEQ ID NO: 1617391 - protein, 5 aa, Staphylococcus aureus
EEQPQ

SEQ ID NO: 1617392 - protein, 4 aa, Staphylococcus aureus
EETD

SEQ ID NO: 1617393 - protein, 8 aa, Staphylococcus aureus
EGELTDDE

SEQ ID NO: 1617394 - protein, 8 aa, Staphylococcus aureus
EGENDKKE

SEQ ID NO: 1617395 - protein, 6 aa, Staphylococcus aureus
EGHEQP

SEQ ID NO: 1617396 - protein, 10 aa, Staphylococcus aureus
EGNDSEYRFT

SEQ ID NO: 1617397 - protein, 6 aa, Staphylococcus aureus
EGNFRK

SEQ ID NO: 1617398 - protein, 8 aa, Staphylococcus aureus
EGVSSRRF

SEQ ID NO: 1617399 - protein, 15 aa, Staphylococcus aureus
EHDMDSEKSNDYKEE

SEQ ID NO: 1617400 - protein, 7 aa, Staphylococcus aureus
EIKESNE

SEQ ID NO: 1617401 - protein, 6 aa, Staphylococcus aureus
EKATSL

SEQ ID NO: 1617402 - protein, 11 aa, Staphylococcus aureus
EKHGITPKTIN

SEQ ID NO: 1617403 - protein, 10 aa, Staphylococcus aureus
EKIERTKDMP

SEQ ID NO: 1617404 - protein, 6 aa, Staphylococcus aureus
EKVENT

SEQ ID NO: 1617405 - protein, 14 aa, Staphylococcus aureus
EKYSELKKHDTKHE

SEQ ID NO: 1617406 - protein, 6 aa, Staphylococcus aureus
ELDGTN

SEQ ID NO: 1617407 - protein, 4 aa, Staphylococcus aureus
ELKN

SEQ ID NO: 1617408 - protein, 7 aa, Staphylococcus aureus
ELYHPQQ

SEQ ID NO: 1617409 - protein, 8 aa, Staphylococcus aureus
ENDNEKFY

SEQ ID NO: 1617410 - protein, 7 aa, Staphylococcus aureus
EPGPDDV

SEQ ID NO: 1617411 - protein, 13 aa, Staphylococcus aureus
EPKVPAELTNLYD

SEQ ID NO: 1617412 - protein, 8 aa, Staphylococcus aureus
EPMEGTEK

SEQ ID NO: 1617413 - protein, 10 aa, Staphylococcus aureus
EPSDAYPTIS

SEQ ID NO: 1617414 - protein, 9 aa, Staphylococcus aureus
EPTNDLDTE

SEQ ID NO: 1617415 - protein, 5 aa, Staphylococcus aureus
EQPFT

SEQ ID NO: 1617416 - protein, 9 aa, Staphylococcus aureus
EQQDDISEA

SEQ ID NO: 1617417 - protein, 8 aa, Staphylococcus aureus
EQQPEIEE

SEQ ID NO: 1617418 - protein, 5 aa, Staphylococcus aureus
EQQQQ

SEQ ID NO: 1617419 - protein, 6 aa, Staphylococcus aureus
EQTREI

SEQ ID NO: 1617420 - protein, 7 aa, Staphylococcus aureus
ERRDGTF

SEQ ID NO: 1617421 - protein, 16 aa, Staphylococcus aureus
ESKSGGKSGDFQRQSG

SEQ ID NO: 1617422 - protein, 9 aa, Staphylococcus aureus
ESMAQSEGL

SEQ ID NO: 1617423 - protein, 6 aa, Staphylococcus aureus
ETSHAK

SEQ ID NO: 1617424 - protein, 5 aa, Staphylococcus aureus
EVGQE

SEQ ID NO: 1617425 - protein, 7 aa, Staphylococcus aureus
EVKEHTS

SEQ ID NO: 1617426 - protein, 5 aa, Staphylococcus aureus
FDQIA

SEQ ID NO: 1617427 - protein, 15 aa, Staphylococcus aureus
FEEKDLEESDVFGLF

SEQ ID NO: 1617428 - protein, 30 aa, Staphylococcus aureus
FKQEVEKMKRQERKQFSKQQNRQKRKQNKK

SEQ ID NO: 1617429 - protein, 8 aa, Staphylococcus aureus
FNDEHTNR

SEQ ID NO: 1617430 - protein, 10 aa, Staphylococcus aureus
FQSEQNGLRN

SEQ ID NO: 1617431 - protein, 7 aa, Staphylococcus aureus
FVPQPGD

SEQ ID NO: 1617432 - protein, 4 aa, Staphylococcus aureus
GARF

SEQ ID NO: 1617433 - protein, 6 aa, Staphylococcus aureus
GEKVDA

SEQ ID NO: 1617434 - protein, 15 aa, Staphylococcus aureus
GEPAEDENGAAKPRL

SEQ ID NO: 1617435 - protein, 5 aa, Staphylococcus aureus
GESYR

SEQ ID NO: 1617436 - protein, 15 aa, Staphylococcus aureus
GIDENTTSHHLSNQQ

SEQ ID NO: 1617437 - protein, 5 aa, Staphylococcus aureus
GISER

SEQ ID NO: 1617438 - protein, 8 aa, Staphylococcus aureus
GKDALQPN

SEQ ID NO: 1617439 - protein, 4 aa, Staphylococcus aureus
GKQL

SEQ ID NO: 1617440 - protein, 7 aa, Staphylococcus aureus
GKSKLVS

SEQ ID NO: 1617441 - protein, 4 aa, Staphylococcus aureus
GKST

SEQ ID NO: 1617442 - protein, 11 aa, Staphylococcus aureus
GLKDEKQDEQL

SEQ ID NO: 1617443 - protein, 9 aa, Staphylococcus aureus
GNYSGEETF

SEQ ID NO: 1617444 - protein, 5 aa, Staphylococcus aureus
GPRVI

SEQ ID NO: 1617445 - protein, 10 aa, Staphylococcus aureus
GPVPPNPTEL

SEQ ID NO: 1617446 - protein, 17 aa, Staphylococcus aureus
GRALAYPKASVGENSWG

SEQ ID NO: 1617447 - protein, 20 aa, Staphylococcus aureus
GRGTESNEKIQSRINEARKE

SEQ ID NO: 1617448 - protein, 13 aa, Staphylococcus aureus
GRKPNTSDIGLNN

SEQ ID NO: 1617449 - protein, 15 aa, Staphylococcus aureus
GSEGRGPGTRYYLIR

SEQ ID NO: 1617450 - protein, 7 aa, Staphylococcus aureus
GSLTDTL

SEQ ID NO: 1617451 - protein, 9 aa, Staphylococcus aureus
GSPFGGGKI

SEQ ID NO: 1617452 - protein, 6 aa, Staphylococcus aureus
GSRRDV

SEQ ID NO: 1617453 - protein, 30 aa, Staphylococcus aureus
GTDPVELGKKVSNKLKEQGAYEIIKRLNEQ

SEQ ID NO: 1617454 - protein, 4 aa, Staphylococcus aureus
GTGC

SEQ ID NO: 1617455 - protein, 4 aa, Staphylococcus aureus
GTGT

SEQ ID NO: 1617456 - protein, 11 aa, Staphylococcus aureus
GVPPKDKYEAL

SEQ ID NO: 1617457 - protein, 11 aa, Staphylococcus aureus
GVSDPEQKRKI

SEQ ID NO: 1617458 - protein, 5 aa, Staphylococcus aureus
HAPAQ

SEQ ID NO: 1617459 - protein, 4 aa, Staphylococcus aureus
HDST

SEQ ID NO: 1617460 - protein, 13 aa, Staphylococcus aureus
HEFKEARKGDIKH

SEQ ID NO: 1617461 - protein, 6 aa, Staphylococcus aureus
HGAKYR

SEQ ID NO: 1617462 - protein, 16 aa, Staphylococcus aureus
HKHKYKDIENGLKGEE

SEQ ID NO: 1617463 - protein, 7 aa, Staphylococcus aureus
HSDHRTT

SEQ ID NO: 1617464 - protein, 19 aa, Staphylococcus aureus
HSVKANTNAYYRYDRDSIT

SEQ ID NO: 1617465 - protein, 10 aa, Staphylococcus aureus
HYDPKLESYR

SEQ ID NO: 1617466 - protein, 9 aa, Staphylococcus aureus
IAKRNRSFE

SEQ ID NO: 1617467 - protein, 7 aa, Staphylococcus aureus
IDKNNAK

SEQ ID NO: 1617468 - protein, 5 aa, Staphylococcus aureus
IDPLG

SEQ ID NO: 1617469 - protein, 10 aa, Staphylococcus aureus
IDSGGKISQT

SEQ ID NO: 1617470 - protein, 8 aa, Staphylococcus aureus
IEERNNKL

SEQ ID NO: 1617471 - protein, 4 aa, Staphylococcus aureus
IHDV

SEQ ID NO: 1617472 - protein, 5 aa, Staphylococcus aureus
IHSEQ

SEQ ID NO: 1617473 - protein, 18 aa, Staphylococcus aureus
IKSPKTHIEPENDKISVR

SEQ ID NO: 1617474 - protein, 7 aa, Staphylococcus aureus
INQSNRH

SEQ ID NO: 1617475 - protein, 6 aa, Staphylococcus aureus
IPTERD

SEQ ID NO: 1617476 - protein, 5 aa, Staphylococcus aureus
IQGKE

SEQ ID NO: 1617477 - protein, 6 aa, Staphylococcus aureus
ISHSNG

SEQ ID NO: 1617478 - protein, 5 aa, Staphylococcus aureus
ISSQP

SEQ ID NO: 1617479 - protein, 9 aa, Staphylococcus aureus
KAEQEYADA

SEQ ID NO: 1617480 - protein, 8 aa, Staphylococcus aureus
KAKKEQGV

SEQ ID NO: 1617481 - protein, 12 aa, Staphylococcus aureus
KALKRSKKELSD

SEQ ID NO: 1617482 - protein, 29 aa, Staphylococcus aureus
KAQGVSVAPTQKSSKKPARGIQKSKNAFS

SEQ ID NO: 1617483 - protein, 6 aa, Staphylococcus aureus
KARSYQ

SEQ ID NO: 1617484 - protein, 7 aa, Staphylococcus aureus
KDEDSEF

SEQ ID NO: 1617485 - protein, 11 aa, Staphylococcus aureus
KDEYRKESYTY

SEQ ID NO: 1617486 - protein, 10 aa, Staphylococcus aureus
KDGKAEINRE

SEQ ID NO: 1617487 - protein, 8 aa, Staphylococcus aureus
KDKATRAK

SEQ ID NO: 1617488 - protein, 8 aa, Staphylococcus aureus
KDLSNAGA

SEQ ID NO: 1617489 - protein, 5 aa, Staphylococcus aureus
KDTLG

SEQ ID NO: 1617490 - protein, 9 aa, Staphylococcus aureus
KEGGRKKDS

SEQ ID NO: 1617491 - protein, 14 aa, Staphylococcus aureus
KEYKAEDFKKRENN

SEQ ID NO: 1617492 - protein, 8 aa, Staphylococcus aureus
KGNPMQTE

SEQ ID NO: 1617493 - protein, 5 aa, Staphylococcus aureus
KGQLK

SEQ ID NO: 1617494 - protein, 6 aa, Staphylococcus aureus
KGTTLP

SEQ ID NO: 1617495 - protein, 7 aa, Staphylococcus aureus
KIDGITD

SEQ ID NO: 1617496 - protein, 40 aa, Staphylococcus aureus
KIEEDEKESIKKAQKGIYKDPRDINDDEQDDDTKDTVDKK

SEQ ID NO: 1617497 - protein, 6 aa, Staphylococcus aureus
KIPNSK

SEQ ID NO: 1617498 - protein, 7 aa, Staphylococcus aureus
KKFTESL

SEQ ID NO: 1617499 - protein, 5 aa, Staphylococcus aureus
KKPGN

SEQ ID NO: 1617500 - protein, 7 aa, Staphylococcus aureus
KKSERHF

SEQ ID NO: 1617501 - protein, 21 aa, Staphylococcus aureus
KKSKAEQKEFRNKLDEARFVI

SEQ ID NO: 1617502 - protein, 6 aa, Staphylococcus aureus
KKTVQE

SEQ ID NO: 1617503 - protein, 7 aa, Staphylococcus aureus
KNGRVTV

SEQ ID NO: 1617504 - protein, 12 aa, Staphylococcus aureus
KNKTPEEKAKIE

SEQ ID NO: 1617505 - protein, 10 aa, Staphylococcus aureus
KNNTEETTAI

SEQ ID NO: 1617506 - protein, 11 aa, Staphylococcus aureus
KPIDKTDEDEV

SEQ ID NO: 1617507 - protein, 6 aa, Staphylococcus aureus
KQEITG

SEQ ID NO: 1617508 - protein, 6 aa, Staphylococcus aureus
KQELDS

SEQ ID NO: 1617509 - protein, 7 aa, Staphylococcus aureus
KQIGGAP

SEQ ID NO: 1617510 - protein, 14 aa, Staphylococcus aureus
KQMARGNPKKSNAW

SEQ ID NO: 1617511 - protein, 6 aa, Staphylococcus aureus
KQNPVQ

SEQ ID NO: 1617512 - protein, 6 aa, Staphylococcus aureus
KQRNHE

SEQ ID NO: 1617513 - protein, 9 aa, Staphylococcus aureus
KQYKDSDFK

SEQ ID NO: 1617514 - protein, 6 aa, Staphylococcus aureus
KRDGTM

SEQ ID NO: 1617515 - protein, 6 aa, Staphylococcus aureus
KRPDHE

SEQ ID NO: 1617516 - protein, 6 aa, Staphylococcus aureus
KRSVDG

SEQ ID NO: 1617517 - protein, 5 aa, Staphylococcus aureus
KSEHN

SEQ ID NO: 1617518 - protein, 22 aa, Staphylococcus aureus
KSFKEKFSKDMKDGYKSLSDDD

SEQ ID NO: 1617519 - protein, 11 aa, Staphylococcus aureus
KSKYKYTGYTE

SEQ ID NO: 1617520 - protein, 6 aa, Staphylococcus aureus
KSVSAN

SEQ ID NO: 1617521 - protein, 13 aa, Staphylococcus aureus
KSYDEVKAKRNKY

SEQ ID NO: 1617522 - protein, 10 aa, Staphylococcus aureus
KTMARGYRRE

SEQ ID NO: 1617523 - protein, 17 aa, Staphylococcus aureus
KTNHNDNIKIETNLFMS

SEQ ID NO: 1617524 - protein, 12 aa, Staphylococcus aureus
KTSGSKRTTIKT

SEQ ID NO: 1617525 - protein, 19 aa, Staphylococcus aureus
KVRATKAKDDNSANAIAND

SEQ ID NO: 1617526 - protein, 18 aa, Staphylococcus aureus
LAAETIERSMDEGDIAPY

SEQ ID NO: 1617527 - protein, 9 aa, Staphylococcus aureus
LASKTTDDI

SEQ ID NO: 1617528 - protein, 12 aa, Staphylococcus aureus
LDQMTKAKQRLE

SEQ ID NO: 1617529 - protein, 7 aa, Staphylococcus aureus
LEEDASD

SEQ ID NO: 1617530 - protein, 12 aa, Staphylococcus aureus
LENKKDSKWNDG

SEQ ID NO: 1617531 - protein, 9 aa, Staphylococcus aureus
LERKKGSIT

SEQ ID NO: 1617532 - protein, 15 aa, Staphylococcus aureus
LESLNKKESIKETAK

SEQ ID NO: 1617533 - protein, 4 aa, Staphylococcus aureus
LGAV

SEQ ID NO: 1617534 - protein, 5 aa, Staphylococcus aureus
LGRKG

SEQ ID NO: 1617535 - protein, 11 aa, Staphylococcus aureus
LKGPLHGGANE

SEQ ID NO: 1617536 - protein, 8 aa, Staphylococcus aureus
LPGDEAGI

SEQ ID NO: 1617537 - protein, 9 aa, Staphylococcus aureus
LPPKEGDDY

SEQ ID NO: 1617538 - protein, 9 aa, Staphylococcus aureus
LRDETSLRT

SEQ ID NO: 1617539 - protein, 4 aa, Staphylococcus aureus
LRDP

SEQ ID NO: 1617540 - protein, 5 aa, Staphylococcus aureus
LRPKK

SEQ ID NO: 1617541 - protein, 11 aa, Staphylococcus aureus
LRRQDENFDGK

SEQ ID NO: 1617542 - protein, 8 aa, Staphylococcus aureus
LSGTGNDI

SEQ ID NO: 1617543 - protein, 9 aa, Staphylococcus aureus
LSGTGNGIK

SEQ ID NO: 1617544 - protein, 7 aa, Staphylococcus aureus
LSKDETH

SEQ ID NO: 1617545 - protein, 10 aa, Staphylococcus aureus
LVPKDPDQFK

SEQ ID NO: 1617546 - protein, 11 aa, Staphylococcus aureus
LYGADSEDITR

SEQ ID NO: 1617547 - protein, 13 aa, Staphylococcus aureus
LYQASKPKLQEDK

SEQ ID NO: 1617548 - protein, 5 aa, Staphylococcus aureus
MPTEV

SEQ ID NO: 1617549 - protein, 4 aa, Staphylococcus aureus
NADG

SEQ ID NO: 1617550 - protein, 14 aa, Staphylococcus aureus
NALSKKSDINHSHD

SEQ ID NO: 1617551 - protein, 8 aa, Staphylococcus aureus
NDPSRPVG

SEQ ID NO: 1617552 - protein, 7 aa, Staphylococcus aureus
NDQESEI

SEQ ID NO: 1617553 - protein, 9 aa, Staphylococcus aureus
NELNTRYDK

SEQ ID NO: 1617554 - protein, 10 aa, Staphylococcus aureus
NENALNNQRE

SEQ ID NO: 1617555 - protein, 12 aa, Staphylococcus aureus
NGEKGLNGQIRN

SEQ ID NO: 1617556 - protein, 21 aa, Staphylococcus aureus
NGIKNSDRKYKHDNLTTTECP

SEQ ID NO: 1617557 - protein, 5 aa, Staphylococcus aureus
NGTVA

SEQ ID NO: 1617558 - protein, 15 aa, Staphylococcus aureus
NHENKGRIVIDFGVD

SEQ ID NO: 1617559 - protein, 4 aa, Staphylococcus aureus
NHRG

SEQ ID NO: 1617560 - protein, 5 aa, Staphylococcus aureus
NIKNG

SEQ ID NO: 1617561 - protein, 17 aa, Staphylococcus aureus
NKTINRDKLHLDIYLFK

SEQ ID NO: 1617562 - protein, 17 aa, Staphylococcus aureus
NKTVESKSINVEVHLTK

SEQ ID NO: 1617563 - protein, 4 aa, Staphylococcus aureus
NNEK

SEQ ID NO: 1617564 - protein, 10 aa, Staphylococcus aureus
NPSKNTAKEM

SEQ ID NO: 1617565 - protein, 14 aa, Staphylococcus aureus
NQFEGGYEKGGKGL

SEQ ID NO: 1617566 - protein, 7 aa, Staphylococcus aureus
NQKDKNH

SEQ ID NO: 1617567 - protein, 6 aa, Staphylococcus aureus
NQPETI

SEQ ID NO: 1617568 - protein, 8 aa, Staphylococcus aureus
NQTPSYKT

SEQ ID NO: 1617569 - protein, 5 aa, Staphylococcus aureus
NRLSE

SEQ ID NO: 1617570 - protein, 18 aa, Staphylococcus aureus
NRNNIAGDGYSSVKNGDI

SEQ ID NO: 1617571 - protein, 7 aa, Staphylococcus aureus
NTEISTK

SEQ ID NO: 1617572 - protein, 6 aa, Staphylococcus aureus
NTNPHS

SEQ ID NO: 1617573 - protein, 31 aa, Staphylococcus aureus
NTPFETVQSAQSKANMAESNAKLYADDKFNK

SEQ ID NO: 1617574 - protein, 11 aa, Staphylococcus aureus
NTSRTPGDHFG

SEQ ID NO: 1617575 - protein, 9 aa, Staphylococcus aureus
NTSSRKERE

SEQ ID NO: 1617576 - protein, 7 aa, Staphylococcus aureus
PGEATEY

SEQ ID NO: 1617577 - protein, 4 aa, Staphylococcus aureus
PIEN

SEQ ID NO: 1617578 - protein, 8 aa, Staphylococcus aureus
PKGAGAKV

SEQ ID NO: 1617579 - protein, 7 aa, Staphylococcus aureus
PKNDEKL

SEQ ID NO: 1617580 - protein, 11 aa, Staphylococcus aureus
PKQFGSKAAYE

SEQ ID NO: 1617581 - protein, 6 aa, Staphylococcus aureus
PKQNRQ

SEQ ID NO: 1617582 - protein, 7 aa, Staphylococcus aureus
PMNPDDE

SEQ ID NO: 1617583 - protein, 19 aa, Staphylococcus aureus
PSIKASEGIADKSSVFAEE

SEQ ID NO: 1617584 - protein, 15 aa, Staphylococcus aureus
PTSSFTPEESPDPGF

SEQ ID NO: 1617585 - protein, 5 aa, Staphylococcus aureus
PVKEV

SEQ ID NO: 1617586 - protein, 15 aa, Staphylococcus aureus
PVYWSPSSESSLAEA

SEQ ID NO: 1617587 - protein, 7 aa, Staphylococcus aureus
QANRERL

SEQ ID NO: 1617588 - protein, 5 aa, Staphylococcus aureus
QAVPD

SEQ ID NO: 1617589 - protein, 8 aa, Staphylococcus aureus
QDDETRLY

SEQ ID NO: 1617590 - protein, 6 aa, Staphylococcus aureus
QDESNE

SEQ ID NO: 1617591 - protein, 8 aa, Staphylococcus aureus
QEDCPSGY

SEQ ID NO: 1617592 - protein, 5 aa, Staphylococcus aureus
QGEAG

SEQ ID NO: 1617593 - protein, 6 aa, Staphylococcus aureus
QITGAN

SEQ ID NO: 1617594 - protein, 14 aa, Staphylococcus aureus
QKGKRQKPKETRGK

SEQ ID NO: 1617595 - protein, 15 aa, Staphylococcus aureus
QKLSEPETKKIYSQR

SEQ ID NO: 1617596 - protein, 7 aa, Staphylococcus aureus
QKSLDEA

SEQ ID NO: 1617597 - protein, 11 aa, Staphylococcus aureus
QNNEDEHVKNA

SEQ ID NO: 1617598 - protein, 12 aa, Staphylococcus aureus
QNSNQTSNKKYY

SEQ ID NO: 1617599 - protein, 7 aa, Staphylococcus aureus
QNVNRDK

SEQ ID NO: 1617600 - protein, 12 aa, Staphylococcus aureus
QPGVGKTLSSRY

SEQ ID NO: 1617601 - protein, 11 aa, Staphylococcus aureus
QQGEGIESTGE

SEQ ID NO: 1617602 - protein, 4 aa, Staphylococcus aureus
QQGV

SEQ ID NO: 1617603 - protein, 5 aa, Staphylococcus aureus
QQMEQ

SEQ ID NO: 1617604 - protein, 10 aa, Staphylococcus aureus
QQSQNGRSLA

SEQ ID NO: 1617605 - protein, 6 aa, Staphylococcus aureus
QRDNDR

SEQ ID NO: 1617606 - protein, 7 aa, Staphylococcus aureus
QRPRLNH

SEQ ID NO: 1617607 - protein, 9 aa, Staphylococcus aureus
QRTKTKEGL

SEQ ID NO: 1617608 - protein, 8 aa, Staphylococcus aureus
QTEPSPSL

SEQ ID NO: 1617609 - protein, 13 aa, Staphylococcus aureus
QTQQNKQDVPEFD

SEQ ID NO: 1617610 - protein, 11 aa, Staphylococcus aureus
QVTNQGLATSH

SEQ ID NO: 1617611 - protein, 13 aa, Staphylococcus aureus
RAQSNARKLAEKC

SEQ ID NO: 1617612 - protein, 17 aa, Staphylococcus aureus
RDEKKQDDIRKKYNNSK

SEQ ID NO: 1617613 - protein, 8 aa, Staphylococcus aureus
RDGSEEKI

SEQ ID NO: 1617614 - protein, 4 aa, Staphylococcus aureus
REQR

SEQ ID NO: 1617615 - protein, 6 aa, Staphylococcus aureus
REVTGS

SEQ ID NO: 1617616 - protein, 5 aa, Staphylococcus aureus
RHSAT

SEQ ID NO: 1617617 - protein, 13 aa, Staphylococcus aureus
RKATIDKYSYSAT

SEQ ID NO: 1617618 - protein, 8 aa, Staphylococcus aureus
RKSEGDRQ

SEQ ID NO: 1617619 - protein, 8 aa, Staphylococcus aureus
RKVAEKAD

SEQ ID NO: 1617620 - protein, 22 aa, Staphylococcus aureus
RLNEGKDIRFSSERDEYEPQNN

SEQ ID NO: 1617621 - protein, 5 aa, Staphylococcus aureus
RNDDD

SEQ ID NO: 1617622 - protein, 17 aa, Staphylococcus aureus
RNTLSEVQKPKENNSLL

SEQ ID NO: 1617623 - protein, 16 aa, Staphylococcus aureus
RPISQRPKEIKKRNTF

SEQ ID NO: 1617624 - protein, 5 aa, Staphylococcus aureus
RPLKT

SEQ ID NO: 1617625 - protein, 8 aa, Staphylococcus aureus
RPQSNMPS

SEQ ID NO: 1617626 - protein, 8 aa, Staphylococcus aureus
RPTPARLT

SEQ ID NO: 1617627 - protein, 4 aa, Staphylococcus aureus
RRPS

SEQ ID NO: 1617628 - protein, 9 aa, Staphylococcus aureus
RSARAYGSA

SEQ ID NO: 1617629 - protein, 5 aa, Staphylococcus aureus
RSSGA

SEQ ID NO: 1617630 - protein, 6 aa, Staphylococcus aureus
RSYPMS

SEQ ID NO: 1617631 - protein, 4 aa, Staphylococcus aureus
RTNG

SEQ ID NO: 1617632 - protein, 21 aa, Staphylococcus aureus
SANANSCTGQQGIDDAQQTQT

SEQ ID NO: 1617633 - protein, 7 aa, Staphylococcus aureus
SAQRGDL

SEQ ID NO: 1617634 - protein, 8 aa, Staphylococcus aureus
SASKSSLQ

SEQ ID NO: 1617635 - protein, 13 aa, Staphylococcus aureus
SDLTEAETQEAHK

SEQ ID NO: 1617636 - protein, 13 aa, Staphylococcus aureus
SEASGIDISDEGY

SEQ ID NO: 1617637 - protein, 7 aa, Staphylococcus aureus
SEGQLEK

SEQ ID NO: 1617638 - protein, 6 aa, Staphylococcus aureus
SEITGD

SEQ ID NO: 1617639 - protein, 6 aa, Staphylococcus aureus
SEPLSE

SEQ ID NO: 1617640 - protein, 18 aa, Staphylococcus aureus
SESISTANYDAKEESKKR

SEQ ID NO: 1617641 - protein, 6 aa, Staphylococcus aureus
SFDAGA

SEQ ID NO: 1617642 - protein, 15 aa, Staphylococcus aureus
SGADANDSTSAPVDD

SEQ ID NO: 1617643 - protein, 18 aa, Staphylococcus aureus
SGGFGVKDTTKTESSYRT

SEQ ID NO: 1617644 - protein, 6 aa, Staphylococcus aureus
SKLSSG

SEQ ID NO: 1617645 - protein, 6 aa, Staphylococcus aureus
SKNGSS

SEQ ID NO: 1617646 - protein, 10 aa, Staphylococcus aureus
SLDNNGTKLI

SEQ ID NO: 1617647 - protein, 13 aa, Staphylococcus aureus
SLDRNNSIQNEAR

SEQ ID NO: 1617648 - protein, 12 aa, Staphylococcus aureus
SLSSISKSKGIA

SEQ ID NO: 1617649 - protein, 12 aa, Staphylococcus aureus
SNEGDTSQASIK

SEQ ID NO: 1617650 - protein, 5 aa, Staphylococcus aureus
SNFEE

SEQ ID NO: 1617651 - protein, 15 aa, Staphylococcus aureus
SNKKIQKLENQLEKE

SEQ ID NO: 1617652 - protein, 11 aa, Staphylococcus aureus
SPEEAESPGIT

SEQ ID NO: 1617653 - protein, 7 aa, Staphylococcus aureus
SRTRKKY

SEQ ID NO: 1617654 - protein, 7 aa, Staphylococcus aureus
SSDDESM

SEQ ID NO: 1617655 - protein, 4 aa, Staphylococcus aureus
SSEE

SEQ ID NO: 1617656 - protein, 6 aa, Staphylococcus aureus
SSKMYG

SEQ ID NO: 1617657 - protein, 10 aa, Staphylococcus aureus
SSNAKGDADM

SEQ ID NO: 1617658 - protein, 8 aa, Staphylococcus aureus
STTDLPKG

SEQ ID NO: 1617659 - protein, 8 aa, Staphylococcus aureus
SVENKRNE

SEQ ID NO: 1617660 - protein, 8 aa, Staphylococcus aureus
SVSTKQIA

SEQ ID NO: 1617661 - protein, 12 aa, Staphylococcus aureus
SYPEADPQPGDI

SEQ ID NO: 1617662 - protein, 8 aa, Staphylococcus aureus
SYTESLGG

SEQ ID NO: 1617663 - protein, 10 aa, Staphylococcus aureus
TATKDTDAST

SEQ ID NO: 1617664 - protein, 9 aa, Staphylococcus aureus
TDDVTSLST

SEQ ID NO: 1617665 - protein, 7 aa, Staphylococcus aureus
TEAMKQE

SEQ ID NO: 1617666 - protein, 5 aa, Staphylococcus aureus
TEEEY

SEQ ID NO: 1617667 - protein, 4 aa, Staphylococcus aureus
TEYE

SEQ ID NO: 1617668 - protein, 11 aa, Staphylococcus aureus
TGDTPGREDDD

SEQ ID NO: 1617669 - protein, 7 aa, Staphylococcus aureus
TGERDGF

SEQ ID NO: 1617670 - protein, 24 aa, Staphylococcus aureus
TGNDTRGAEASAHAYASKDGQYRG

SEQ ID NO: 1617671 - protein, 4 aa, Staphylococcus aureus
TGVV

SEQ ID NO: 1617672 - protein, 9 aa, Staphylococcus aureus
THKNSVERE

SEQ ID NO: 1617673 - protein, 5 aa, Staphylococcus aureus
TIEET

SEQ ID NO: 1617674 - protein, 4 aa, Staphylococcus aureus
TKDN

SEQ ID NO: 1617675 - protein, 5 aa, Staphylococcus aureus
TKESV

SEQ ID NO: 1617676 - protein, 5 aa, Staphylococcus aureus
TKFNG

SEQ ID NO: 1617677 - protein, 8 aa, Staphylococcus aureus
TKSNKQEY

SEQ ID NO: 1617678 - protein, 6 aa, Staphylococcus aureus
TLKNRE

SEQ ID NO: 1617679 - protein, 8 aa, Staphylococcus aureus
TLKTNTDL

SEQ ID NO: 1617680 - protein, 9 aa, Staphylococcus aureus
TNEVQRRGV

SEQ ID NO: 1617681 - protein, 13 aa, Staphylococcus aureus
TNIKNAKSKIERM

SEQ ID NO: 1617682 - protein, 13 aa, Staphylococcus aureus
TNKINEPGTIIET

SEQ ID NO: 1617683 - protein, 13 aa, Staphylococcus aureus
TPDIGYNTVVLSE

SEQ ID NO: 1617684 - protein, 4 aa, Staphylococcus aureus
TPRA

SEQ ID NO: 1617685 - protein, 16 aa, Staphylococcus aureus
TREEKLKNHKSRIKED

SEQ ID NO: 1617686 - protein, 15 aa, Staphylococcus aureus
TRNHYKNNFKNKEGY

SEQ ID NO: 1617687 - protein, 5 aa, Staphylococcus aureus
TRYDS

SEQ ID NO: 1617688 - protein, 17 aa, Staphylococcus aureus
TSIKGQVTTVATGKAYI

SEQ ID NO: 1617689 - protein, 5 aa, Staphylococcus aureus
TTAHK

SEQ ID NO: 1617690 - protein, 21 aa, Staphylococcus aureus
TTASELGGKAEVTVEQSYPGF

SEQ ID NO: 1617691 - protein, 4 aa, Staphylococcus aureus
TTHY

SEQ ID NO: 1617692 - protein, 4 aa, Staphylococcus aureus
TTSG

SEQ ID NO: 1617693 - protein, 11 aa, Staphylococcus aureus
VADKNPKSKNY

SEQ ID NO: 1617694 - protein, 11 aa, Staphylococcus aureus
VADKNQKSKNY

SEQ ID NO: 1617695 - protein, 11 aa, Staphylococcus aureus
VADSSDFDGPV

SEQ ID NO: 1617696 - protein, 7 aa, Staphylococcus aureus
VAKLDKD

SEQ ID NO: 1617697 - protein, 6 aa, Staphylococcus aureus
VARDSM

SEQ ID NO: 1617698 - protein, 14 aa, Staphylococcus aureus
VDADATTEEKEAFT

SEQ ID NO: 1617699 - protein, 33 aa, Staphylococcus aureus
VDEHTQKSTKKASATVEQTFTAKQNQPRNNGRF

SEQ ID NO: 1617700 - protein, 4 aa, Staphylococcus aureus
VDKI

SEQ ID NO: 1617701 - protein, 4 aa, Staphylococcus aureus
VDLP

SEQ ID NO: 1617702 - protein, 13 aa, Staphylococcus aureus
VEDSIGNNESDYE

SEQ ID NO: 1617703 - protein, 7 aa, Staphylococcus aureus
VENPHIA

SEQ ID NO: 1617704 - protein, 4 aa, Staphylococcus aureus
VEQD

SEQ ID NO: 1617705 - protein, 8 aa, Staphylococcus aureus
VESSKDLQ

SEQ ID NO: 1617706 - protein, 9 aa, Staphylococcus aureus
VGIGTNPDE

SEQ ID NO: 1617707 - protein, 4 aa, Staphylococcus aureus
VGNF

SEQ ID NO: 1617708 - protein, 6 aa, Staphylococcus aureus
VHTSNQ

SEQ ID NO: 1617709 - protein, 12 aa, Staphylococcus aureus
VKDKADDDGGNF

SEQ ID NO: 1617710 - protein, 5 aa, Staphylococcus aureus
VKGTT

SEQ ID NO: 1617711 - protein, 21 aa, Staphylococcus aureus
VKGYQDENNKALKSVRKQTRH

SEQ ID NO: 1617712 - protein, 10 aa, Staphylococcus aureus
VPSEAEAQSH

SEQ ID NO: 1617713 - protein, 7 aa, Staphylococcus aureus
VPSSPSY

SEQ ID NO: 1617714 - protein, 12 aa, Staphylococcus aureus
VQGTEAYKDRLN

SEQ ID NO: 1617715 - protein, 4 aa, Staphylococcus aureus
VQSR

SEQ ID NO: 1617716 - protein, 8 aa, Staphylococcus aureus
VRKASGKM

SEQ ID NO: 1617717 - protein, 10 aa, Staphylococcus aureus
VTGTNGKTSI

SEQ ID NO: 1617718 - protein, 4 aa, Staphylococcus aureus
VTPE

SEQ ID NO: 1617719 - protein, 6 aa, Staphylococcus aureus
VYQAQE

SEQ ID NO: 1617720 - protein, 8 aa, Staphylococcus aureus
WDEKKPAC

SEQ ID NO: 1617721 - protein, 8 aa, Staphylococcus aureus
WSSSKGQG

SEQ ID NO: 1617722 - protein, 8 aa, Staphylococcus aureus
YDKKKDRY

SEQ ID NO: 1617723 - protein, 6 aa, Staphylococcus aureus
YGPGEL

SEQ ID NO: 1617724 - protein, 9 aa, Staphylococcus aureus
YHDGPGGGV

SEQ ID NO: 1617725 - protein, 9 aa, Staphylococcus aureus
YKEQNQMNK

SEQ ID NO: 1617726 - protein, 9 aa, Staphylococcus aureus
YKGNSQRPT

SEQ ID NO: 1617727 - protein, 11 aa, Staphylococcus aureus
YKSSKEEALSK

SEQ ID NO: 1617728 - protein, 13 aa, Staphylococcus aureus
YKYENGERTDKTV

SEQ ID NO: 1617729 - protein, 5 aa, Staphylococcus aureus
YQGTY

SEQ ID NO: 1617730 - protein, 4 aa, Staphylococcus aureus
YQQS

SEQ ID NO: 1617731 - protein, 14 aa, Staphylococcus aureus
YSVTGNKNTAISDQ

SEQ ID NO: 1617732 - protein, 12 aa, Staphylococcus aureus
YTNNATGSPPYK

SEQ ID NO: 1617733 - protein, 7 aa, Staphylococcus aureus
AAGGPID

SEQ ID NO: 1617734 - protein, 17 aa, Staphylococcus aureus
AAYQAEGATNTDGKGRV

SEQ ID NO: 1617735 - protein, 10 aa, Staphylococcus aureus
ADDEESSQEL

SEQ ID NO: 1617736 - protein, 5 aa, Staphylococcus aureus
ADNYT

SEQ ID NO: 1617737 - protein, 7 aa, Staphylococcus aureus
ADVEEQV

SEQ ID NO: 1617738 - protein, 8 aa, Staphylococcus aureus
AEAKEQVN

SEQ ID NO: 1617739 - protein, 14 aa, Staphylococcus aureus
AEEIEEQKKKEEAI

SEQ ID NO: 1617740 - protein, 7 aa, Staphylococcus aureus
AEKGYSL

SEQ ID NO: 1617741 - protein, 4 aa, Staphylococcus aureus
AERC

SEQ ID NO: 1617742 - protein, 10 aa, Staphylococcus aureus
AEYEEERKRR

SEQ ID NO: 1617743 - protein, 4 aa, Staphylococcus aureus
AEYN

SEQ ID NO: 1617744 - protein, 7 aa, Staphylococcus aureus
AEYPNQN

SEQ ID NO: 1617745 - protein, 19 aa, Staphylococcus aureus
AFSGESQVLESGKDPQIDN

SEQ ID NO: 1617746 - protein, 12 aa, Staphylococcus aureus
AGGTDPDPSDLY

SEQ ID NO: 1617747 - protein, 31 aa, Staphylococcus aureus
AHGKNGLVDGRGKGKPKSMMTPEEQKEAEIQ

SEQ ID NO: 1617748 - protein, 4 aa, Staphylococcus aureus
AHYE

SEQ ID NO: 1617749 - protein, 5 aa, Staphylococcus aureus
AIEAG

SEQ ID NO: 1617750 - protein, 6 aa, Staphylococcus aureus
AIERSA

SEQ ID NO: 1617751 - protein, 7 aa, Staphylococcus aureus
AKELSES

SEQ ID NO: 1617752 - protein, 4 aa, Staphylococcus aureus
AKKI

SEQ ID NO: 1617753 - protein, 14 aa, Staphylococcus aureus
AKNAQDIKNILKEH

SEQ ID NO: 1617754 - protein, 4 aa, Staphylococcus aureus
ALAG

SEQ ID NO: 1617755 - protein, 7 aa, Staphylococcus aureus
ALGVGAS

SEQ ID NO: 1617756 - protein, 4 aa, Staphylococcus aureus
AMVG

SEQ ID NO: 1617757 - protein, 13 aa, Staphylococcus aureus
ANNSIDGDKTDNL

SEQ ID NO: 1617758 - protein, 11 aa, Staphylococcus aureus
ANPPNNERIPT

SEQ ID NO: 1617759 - protein, 7 aa, Staphylococcus aureus
ANRDTAP

SEQ ID NO: 1617760 - protein, 18 aa, Staphylococcus aureus
APGEVSDKQLEELSLRIR

SEQ ID NO: 1617761 - protein, 9 aa, Staphylococcus aureus
APGYRVKES

SEQ ID NO: 1617762 - protein, 4 aa, Staphylococcus aureus
APKI

SEQ ID NO: 1617763 - protein, 4 aa, Staphylococcus aureus
APSL

SEQ ID NO: 1617764 - protein, 6 aa, Staphylococcus aureus
AQFSGG

SEQ ID NO: 1617765 - protein, 6 aa, Staphylococcus aureus
AQNNDA

SEQ ID NO: 1617766 - protein, 11 aa, Staphylococcus aureus
ARFTNGNQPIT

SEQ ID NO: 1617767 - protein, 9 aa, Staphylococcus aureus
ARNNPFKKG

SEQ ID NO: 1617768 - protein, 6 aa, Staphylococcus aureus
ASSYVD

SEQ ID NO: 1617769 - protein, 4 aa, Staphylococcus aureus
ATPA

SEQ ID NO: 1617770 - protein, 21 aa, Staphylococcus aureus
ATPQSPQWGTKEEAHQSAQEI

SEQ ID NO: 1617771 - protein, 6 aa, Staphylococcus aureus
ATRNAL

SEQ ID NO: 1617772 - protein, 10 aa, Staphylococcus aureus
ATRSAKYKSG

SEQ ID NO: 1617773 - protein, 5 aa, Staphylococcus aureus
AVDKY

SEQ ID NO: 1617774 - protein, 12 aa, Staphylococcus aureus
AVNNEKSQAIPE

SEQ ID NO: 1617775 - protein, 7 aa, Staphylococcus aureus
AYKKDGE

SEQ ID NO: 1617776 - protein, 10 aa, Staphylococcus aureus
CATGTNSIGE

SEQ ID NO: 1617777 - protein, 8 aa, Staphylococcus aureus
DASNEASI

SEQ ID NO: 1617778 - protein, 9 aa, Staphylococcus aureus
DASNNTAKL

SEQ ID NO: 1617779 - protein, 22 aa, Staphylococcus aureus
DAYRQAATEAGFDASHKSLPVS

SEQ ID NO: 1617780 - protein, 4 aa, Staphylococcus aureus
DDKM

SEQ ID NO: 1617781 - protein, 4 aa, Staphylococcus aureus
DEAY

SEQ ID NO: 1617782 - protein, 10 aa, Staphylococcus aureus
DEPGDMTTEQ

SEQ ID NO: 1617783 - protein, 7 aa, Staphylococcus aureus
DEQVGGF

SEQ ID NO: 1617784 - protein, 11 aa, Staphylococcus aureus
DESNKDNKYIR

SEQ ID NO: 1617785 - protein, 11 aa, Staphylococcus aureus
DFSESAEDYGV

SEQ ID NO: 1617786 - protein, 4 aa, Staphylococcus aureus
DFTG

SEQ ID NO: 1617787 - protein, 13 aa, Staphylococcus aureus
DGNYSEEMKDVYY

SEQ ID NO: 1617788 - protein, 7 aa, Staphylococcus aureus
DHSAENI

SEQ ID NO: 1617789 - protein, 8 aa, Staphylococcus aureus
DHSSHQEV

SEQ ID NO: 1617790 - protein, 9 aa, Staphylococcus aureus
DISKQNANK

SEQ ID NO: 1617791 - protein, 15 aa, Staphylococcus aureus
DKTLDIDGKVNWITE

SEQ ID NO: 1617792 - protein, 11 aa, Staphylococcus aureus
DLGQTTEQSEW

SEQ ID NO: 1617793 - protein, 13 aa, Staphylococcus aureus
DLTESVKEEVEDL

SEQ ID NO: 1617794 - protein, 10 aa, Staphylococcus aureus
DNIGKKSWQE

SEQ ID NO: 1617795 - protein, 7 aa, Staphylococcus aureus
DNLEGSI

SEQ ID NO: 1617796 - protein, 6 aa, Staphylococcus aureus
DNLNSF

SEQ ID NO: 1617797 - protein, 9 aa, Staphylococcus aureus
DNQDINPSW

SEQ ID NO: 1617798 - protein, 5 aa, Staphylococcus aureus
DNYED

SEQ ID NO: 1617799 - protein, 5 aa, Staphylococcus aureus
DPENT

SEQ ID NO: 1617800 - protein, 13 aa, Staphylococcus aureus
DQRTNGNRKETWS

SEQ ID NO: 1617801 - protein, 25 aa, Staphylococcus aureus
DQSGGSTPKALKEYGVNEDQYSNED

SEQ ID NO: 1617802 - protein, 18 aa, Staphylococcus aureus
DRNARQGKNPDDVKIGDL

SEQ ID NO: 1617803 - protein, 22 aa, Staphylococcus aureus
DRNGALKGIGKPEKLKSNLTGY

SEQ ID NO: 1617804 - protein, 7 aa, Staphylococcus aureus
DSRTQVM

SEQ ID NO: 1617805 - protein, 10 aa, Staphylococcus aureus
DSTATSQTPM

SEQ ID NO: 1617806 - protein, 8 aa, Staphylococcus aureus
DSTKSYKD

SEQ ID NO: 1617807 - protein, 15 aa, Staphylococcus aureus
DVQAGHAASVGRVDP

SEQ ID NO: 1617808 - protein, 12 aa, Staphylococcus aureus
DVTSNKKRYYKS

SEQ ID NO: 1617809 - protein, 13 aa, Staphylococcus aureus
DYFSREADDLKAD

SEQ ID NO: 1617810 - protein, 10 aa, Staphylococcus aureus
EACQKQTQQL

SEQ ID NO: 1617811 - protein, 4 aa, Staphylococcus aureus
EDEH

SEQ ID NO: 1617812 - protein, 10 aa, Staphylococcus aureus
EDGTTVTEDG

SEQ ID NO: 1617813 - protein, 11 aa, Staphylococcus aureus
EDKVSEEFPDS

SEQ ID NO: 1617814 - protein, 7 aa, Staphylococcus aureus
EDQQQQF

SEQ ID NO: 1617815 - protein, 14 aa, Staphylococcus aureus
EDYFDKKRNEHDER

SEQ ID NO: 1617816 - protein, 7 aa, Staphylococcus aureus
EENYGNR

SEQ ID NO: 1617817 - protein, 15 aa, Staphylococcus aureus
EESEVAKEKDGTSVS

SEQ ID NO: 1617818 - protein, 12 aa, Staphylococcus aureus
EETISKDHPGYD

SEQ ID NO: 1617819 - protein, 11 aa, Staphylococcus aureus
EGFEKAGPINI

SEQ ID NO: 1617820 - protein, 12 aa, Staphylococcus aureus
EGFNNKQKEDLS

SEQ ID NO: 1617821 - protein, 14 aa, Staphylococcus aureus
EGPGLTKKMNKGIT

SEQ ID NO: 1617822 - protein, 7 aa, Staphylococcus aureus
EGSSGNF

SEQ ID NO: 1617823 - protein, 4 aa, Staphylococcus aureus
EGTP

SEQ ID NO: 1617824 - protein, 4 aa, Staphylococcus aureus
EHKH

SEQ ID NO: 1617825 - protein, 5 aa, Staphylococcus aureus
EIETK

SEQ ID NO: 1617826 - protein, 8 aa, Staphylococcus aureus
EIGQNKIN

SEQ ID NO: 1617827 - protein, 7 aa, Staphylococcus aureus
EIPQKYP

SEQ ID NO: 1617828 - protein, 8 aa, Staphylococcus aureus
EISESNHQ

SEQ ID NO: 1617829 - protein, 5 aa, Staphylococcus aureus
EISNG

SEQ ID NO: 1617830 - protein, 10 aa, Staphylococcus aureus
EKRDDTQNGF

SEQ ID NO: 1617831 - protein, 9 aa, Staphylococcus aureus
EKRPEIAQK

SEQ ID NO: 1617832 - protein, 17 aa, Staphylococcus aureus
EKYEKELRDNETQKEAF

SEQ ID NO: 1617833 - protein, 7 aa, Staphylococcus aureus
EKYTRGV

SEQ ID NO: 1617834 - protein, 24 aa, Staphylococcus aureus
ELEETCSTTVNGVEYDSGLNNASR

SEQ ID NO: 1617835 - protein, 7 aa, Staphylococcus aureus
ELNTHYD

SEQ ID NO: 1617836 - protein, 10 aa, Staphylococcus aureus
ELNTPKSVEI

SEQ ID NO: 1617837 - protein, 13 aa, Staphylococcus aureus
ELQKLRDADTVTV

SEQ ID NO: 1617838 - protein, 13 aa, Staphylococcus aureus
ENAYDEERKQLND

SEQ ID NO: 1617839 - protein, 29 aa, Staphylococcus aureus
ENEPEINQENSNLSVEETTDTLSQKDFEQ

SEQ ID NO: 1617840 - protein, 6 aa, Staphylococcus aureus
ENEVIS

SEQ ID NO: 1617841 - protein, 9 aa, Staphylococcus aureus
ENGQETIES

SEQ ID NO: 1617842 - protein, 8 aa, Staphylococcus aureus
ENKEPIHD

SEQ ID NO: 1617843 - protein, 15 aa, Staphylococcus aureus
ENTDEQDRLINLVMK

SEQ ID NO: 1617844 - protein, 14 aa, Staphylococcus aureus
EPLGGAHKDVEQQA

SEQ ID NO: 1617845 - protein, 20 aa, Staphylococcus aureus
EPLGNEAGTFGLPGGFTSTE

SEQ ID NO: 1617846 - protein, 6 aa, Staphylococcus aureus
EPTSNM

SEQ ID NO: 1617847 - protein, 5 aa, Staphylococcus aureus
EQMAE

SEQ ID NO: 1617848 - protein, 20 aa, Staphylococcus aureus
ERANKKGLRIAGADSDLNDL

SEQ ID NO: 1617849 - protein, 8 aa, Staphylococcus aureus
EREGKYRV

SEQ ID NO: 1617850 - protein, 5 aa, Staphylococcus aureus
ERKEA

SEQ ID NO: 1617851 - protein, 8 aa, Staphylococcus aureus
ESGSGKST

SEQ ID NO: 1617852 - protein, 18 aa, Staphylococcus aureus
ESIKSAKEKKYSKLNPYQ

SEQ ID NO: 1617853 - protein, 7 aa, Staphylococcus aureus
ESKETAI

SEQ ID NO: 1617854 - protein, 8 aa, Staphylococcus aureus
ESKETAIK

SEQ ID NO: 1617855 - protein, 16 aa, Staphylococcus aureus
ESKSGGKSGDFQRQLD

SEQ ID NO: 1617856 - protein, 6 aa, Staphylococcus aureus
ETCKGD

SEQ ID NO: 1617857 - protein, 4 aa, Staphylococcus aureus
ETIN

SEQ ID NO: 1617858 - protein, 4 aa, Staphylococcus aureus
EVDT

SEQ ID NO: 1617859 - protein, 12 aa, Staphylococcus aureus
EVKKEKAQIENR

SEQ ID NO: 1617860 - protein, 20 aa, Staphylococcus aureus
FASTKEELEAKASSLSTKTI

SEQ ID NO: 1617861 - protein, 7 aa, Staphylococcus aureus
FESSPRG

SEQ ID NO: 1617862 - protein, 10 aa, Staphylococcus aureus
FGEPSQEAQE

SEQ ID NO: 1617863 - protein, 12 aa, Staphylococcus aureus
FHKNSNNEKIRG

SEQ ID NO: 1617864 - protein, 7 aa, Staphylococcus aureus
FNATGTK

SEQ ID NO: 1617865 - protein, 7 aa, Staphylococcus aureus
FPDSTLN

SEQ ID NO: 1617866 - protein, 18 aa, Staphylococcus aureus
FTQQGGNHSAEQSAQAFQ

SEQ ID NO: 1617867 - protein, 4 aa, Staphylococcus aureus
GADI

SEQ ID NO: 1617868 - protein, 12 aa, Staphylococcus aureus
GADNTLKSLKMK

SEQ ID NO: 1617869 - protein, 7 aa, Staphylococcus aureus
GAPVPVE

SEQ ID NO: 1617870 - protein, 4 aa, Staphylococcus aureus
GAQA

SEQ ID NO: 1617871 - protein, 9 aa, Staphylococcus aureus
GCGAQSPLV

SEQ ID NO: 1617872 - protein, 38 aa, Staphylococcus aureus
GDSEDAVQTEHVGEDTVSSKMHEQHTTNVKVRDIGDDK

SEQ ID NO: 1617873 - protein, 12 aa, Staphylococcus aureus
GDYSESSEDYGV

SEQ ID NO: 1617874 - protein, 6 aa, Staphylococcus aureus
GEDFDN

SEQ ID NO: 1617875 - protein, 4 aa, Staphylococcus aureus
GEEY

SEQ ID NO: 1617876 - protein, 66 aa, Staphylococcus aureus
GEGSGNASKENSNDNTPQQNDETTNNKKEETTNKSADKAEVNQTNDDNQQRVNATPSARRYARENG

SEQ ID NO: 1617877 - protein, 9 aa, Staphylococcus aureus
GEQGAPEEI

SEQ ID NO: 1617878 - protein, 4 aa, Staphylococcus aureus
GEVG

SEQ ID NO: 1617879 - protein, 7 aa, Staphylococcus aureus
GGDLPRN

SEQ ID NO: 1617880 - protein, 7 aa, Staphylococcus aureus
GHEGPDS

SEQ ID NO: 1617881 - protein, 12 aa, Staphylococcus aureus
GHKPALEDTEET

SEQ ID NO: 1617882 - protein, 9 aa, Staphylococcus aureus
GHKQPGTET

SEQ ID NO: 1617883 - protein, 8 aa, Staphylococcus aureus
GHSERSGA

SEQ ID NO: 1617884 - protein, 5 aa, Staphylococcus aureus
GKALK

SEQ ID NO: 1617885 - protein, 10 aa, Staphylococcus aureus
GKDEPSYETS

SEQ ID NO: 1617886 - protein, 24 aa, Staphylococcus aureus
GKLGSQGTEVAKGINQSASKEDLE

SEQ ID NO: 1617887 - protein, 16 aa, Staphylococcus aureus
GKQAMQAKSDKALNEA

SEQ ID NO: 1617888 - protein, 4 aa, Staphylococcus aureus
GKRV

SEQ ID NO: 1617889 - protein, 12 aa, Staphylococcus aureus
GKVEKNETEKDA

SEQ ID NO: 1617890 - protein, 7 aa, Staphylococcus aureus
GLGSKKI

SEQ ID NO: 1617891 - protein, 10 aa, Staphylococcus aureus
GLRKSANKEY

SEQ ID NO: 1617892 - protein, 6 aa, Staphylococcus aureus
GLVDGN

SEQ ID NO: 1617893 - protein, 4 aa, Staphylococcus aureus
GNPI

SEQ ID NO: 1617894 - protein, 6 aa, Staphylococcus aureus
GPSEAY

SEQ ID NO: 1617895 - protein, 10 aa, Staphylococcus aureus
GPSGSGKTTT

SEQ ID NO: 1617896 - protein, 8 aa, Staphylococcus aureus
GQLDNPDR

SEQ ID NO: 1617897 - protein, 18 aa, Staphylococcus aureus
GREKAYPSELSGGQKQRV

SEQ ID NO: 1617898 - protein, 9 aa, Staphylococcus aureus
GRISQSGSI

SEQ ID NO: 1617899 - protein, 7 aa, Staphylococcus aureus
GRPKSGI

SEQ ID NO: 1617900 - protein, 6 aa, Staphylococcus aureus
GRSRRM

SEQ ID NO: 1617901 - protein, 7 aa, Staphylococcus aureus
GSNTCDE

SEQ ID NO: 1617902 - protein, 13 aa, Staphylococcus aureus
GTEPAKGNSLTKK

SEQ ID NO: 1617903 - protein, 5 aa, Staphylococcus aureus
GTGGV

SEQ ID NO: 1617904 - protein, 6 aa, Staphylococcus aureus
GTNPEM

SEQ ID NO: 1617905 - protein, 13 aa, Staphylococcus aureus
GTPKERNDALNTE

SEQ ID NO: 1617906 - protein, 8 aa, Staphylococcus aureus
GTTNNRKQ

SEQ ID NO: 1617907 - protein, 11 aa, Staphylococcus aureus
GVDDSKKLTDT

SEQ ID NO: 1617908 - protein, 24 aa, Staphylococcus aureus
GVVDEQKGEIGYAGPTIPNYKGTN

SEQ ID NO: 1617909 - protein, 18 aa, Staphylococcus aureus
GYKAYEENDSYDTQEEYK

SEQ ID NO: 1617910 - protein, 19 aa, Staphylococcus aureus
GYKDRDGDGFREDPKGNKF

SEQ ID NO: 1617911 - protein, 28 aa, Staphylococcus aureus
HAETENDYQNAQQYSEQKPSADSTQTEI

SEQ ID NO: 1617912 - protein, 9 aa, Staphylococcus aureus
HENGQYGKS

SEQ ID NO: 1617913 - protein, 10 aa, Staphylococcus aureus
HGGTKKKDWL

SEQ ID NO: 1617914 - protein, 9 aa, Staphylococcus aureus
HNDDEKNVE

SEQ ID NO: 1617915 - protein, 4 aa, Staphylococcus aureus
HPHG

SEQ ID NO: 1617916 - protein, 15 aa, Staphylococcus aureus
HQEKRTQVLAAFKAL

SEQ ID NO: 1617917 - protein, 5 aa, Staphylococcus aureus
HQSKQ

SEQ ID NO: 1617918 - protein, 9 aa, Staphylococcus aureus
HSKAKVPIG

SEQ ID NO: 1617919 - protein, 7 aa, Staphylococcus aureus
HSNAYQK

SEQ ID NO: 1617920 - protein, 20 aa, Staphylococcus aureus
HSQLNTNKTKKKNMANSSLE

SEQ ID NO: 1617921 - protein, 9 aa, Staphylococcus aureus
HTDRPQNEM

SEQ ID NO: 1617922 - protein, 4 aa, Staphylococcus aureus
HTPS

SEQ ID NO: 1617923 - protein, 8 aa, Staphylococcus aureus
IAAEQGTK

SEQ ID NO: 1617924 - protein, 9 aa, Staphylococcus aureus
IDEKKRKDI

SEQ ID NO: 1617925 - protein, 7 aa, Staphylococcus aureus
IDSGSAE

SEQ ID NO: 1617926 - protein, 8 aa, Staphylococcus aureus
IEDNKNGY

SEQ ID NO: 1617927 - protein, 12 aa, Staphylococcus aureus
IETEEQVSQLTE

SEQ ID NO: 1617928 - protein, 12 aa, Staphylococcus aureus
IGASAAAGAAVG

SEQ ID NO: 1617929 - protein, 5 aa, Staphylococcus aureus
IGQDQ

SEQ ID NO: 1617930 - protein, 9 aa, Staphylococcus aureus
IHDNDKGEC

SEQ ID NO: 1617931 - protein, 9 aa, Staphylococcus aureus
IKEKHGPDA

SEQ ID NO: 1617932 - protein, 6 aa, Staphylococcus aureus
IKHQRG

SEQ ID NO: 1617933 - protein, 19 aa, Staphylococcus aureus
IKNNPLKTNPFLKLHENKK

SEQ ID NO: 1617934 - protein, 20 aa, Staphylococcus aureus
IKPDGNKEYIKKDEVRRKTD

SEQ ID NO: 1617935 - protein, 15 aa, Staphylococcus aureus
IKPSNDTTSSTSIPI

SEQ ID NO: 1617936 - protein, 11 aa, Staphylococcus aureus
IKRNNSINDKD

SEQ ID NO: 1617937 - protein, 9 aa, Staphylococcus aureus
IKSEDEINK

SEQ ID NO: 1617938 - protein, 7 aa, Staphylococcus aureus
IKTPENL

SEQ ID NO: 1617939 - protein, 12 aa, Staphylococcus aureus
INGKRNIRRILN

SEQ ID NO: 1617940 - protein, 15 aa, Staphylococcus aureus
INNNTQAICKVLKSY

SEQ ID NO: 1617941 - protein, 6 aa, Staphylococcus aureus
INPTKS

SEQ ID NO: 1617942 - protein, 6 aa, Staphylococcus aureus
INQNSQ

SEQ ID NO: 1617943 - protein, 6 aa, Staphylococcus aureus
IPGDSI

SEQ ID NO: 1617944 - protein, 9 aa, Staphylococcus aureus
IPGSNDAVN

SEQ ID NO: 1617945 - protein, 5 aa, Staphylococcus aureus
IPQND

SEQ ID NO: 1617946 - protein, 8 aa, Staphylococcus aureus
IPTGDPVS

SEQ ID NO: 1617947 - protein, 9 aa, Staphylococcus aureus
IRDKTKDKA

SEQ ID NO: 1617948 - protein, 9 aa, Staphylococcus aureus
IRQGESITE

SEQ ID NO: 1617949 - protein, 12 aa, Staphylococcus aureus
ISSDRGNDVQIL

SEQ ID NO: 1617950 - protein, 9 aa, Staphylococcus aureus
ISYTNSATF

SEQ ID NO: 1617951 - protein, 7 aa, Staphylococcus aureus
ITGRTDD

SEQ ID NO: 1617952 - protein, 7 aa, Staphylococcus aureus
ITGRTED

SEQ ID NO: 1617953 - protein, 9 aa, Staphylococcus aureus
ITINDKPAR

SEQ ID NO: 1617954 - protein, 5 aa, Staphylococcus aureus
KAGNM

SEQ ID NO: 1617955 - protein, 29 aa, Staphylococcus aureus
KAQGVSVAPAQKSSKKPARGIQKSKNAFS

SEQ ID NO: 1617956 - protein, 4 aa, Staphylococcus aureus
KDAT

SEQ ID NO: 1617957 - protein, 7 aa, Staphylococcus aureus
KDIDQTV

SEQ ID NO: 1617958 - protein, 11 aa, Staphylococcus aureus
KDNYNKYIQGQ

SEQ ID NO: 1617959 - protein, 6 aa, Staphylococcus aureus
KDPNIK

SEQ ID NO: 1617960 - protein, 6 aa, Staphylococcus aureus
KEENRT

SEQ ID NO: 1617961 - protein, 7 aa, Staphylococcus aureus
KEIAKPN

SEQ ID NO: 1617962 - protein, 6 aa, Staphylococcus aureus
KEIEYG

SEQ ID NO: 1617963 - protein, 6 aa, Staphylococcus aureus
KEIQKM

SEQ ID NO: 1617964 - protein, 8 aa, Staphylococcus aureus
KEKGVYKG

SEQ ID NO: 1617965 - protein, 13 aa, Staphylococcus aureus
KEKWGELKQSIHK

SEQ ID NO: 1617966 - protein, 6 aa, Staphylococcus aureus
KENLEE

SEQ ID NO: 1617967 - protein, 5 aa, Staphylococcus aureus
KERGH

SEQ ID NO: 1617968 - protein, 5 aa, Staphylococcus aureus
KESNL

SEQ ID NO: 1617969 - protein, 6 aa, Staphylococcus aureus
KEVYGN

SEQ ID NO: 1617970 - protein, 17 aa, Staphylococcus aureus
KGASSLSPLKAERVEGT

SEQ ID NO: 1617971 - protein, 4 aa, Staphylococcus aureus
KGAY

SEQ ID NO: 1617972 - protein, 13 aa, Staphylococcus aureus
KGKHYGATWQDKE

SEQ ID NO: 1617973 - protein, 6 aa, Staphylococcus aureus
KGNEQK

SEQ ID NO: 1617974 - protein, 7 aa, Staphylococcus aureus
KHERNRY

SEQ ID NO: 1617975 - protein, 16 aa, Staphylococcus aureus
KHSTNRYTYHEGSTAG

SEQ ID NO: 1617976 - protein, 4 aa, Staphylococcus aureus
KIEQ

SEQ ID NO: 1617977 - protein, 6 aa, Staphylococcus aureus
KIERSC

SEQ ID NO: 1617978 - protein, 15 aa, Staphylococcus aureus
KIKNENANAATALTD

SEQ ID NO: 1617979 - protein, 6 aa, Staphylococcus aureus
KKEPYG

SEQ ID NO: 1617980 - protein, 8 aa, Staphylococcus aureus
KKKDKKMS

SEQ ID NO: 1617981 - protein, 9 aa, Staphylococcus aureus
KKKYPDSEI

SEQ ID NO: 1617982 - protein, 7 aa, Staphylococcus aureus
KKNIPHD

SEQ ID NO: 1617983 - protein, 6 aa, Staphylococcus aureus
KKQENY

SEQ ID NO: 1617984 - protein, 9 aa, Staphylococcus aureus
KKSDWDKGD

SEQ ID NO: 1617985 - protein, 6 aa, Staphylococcus aureus
KKTGKP

SEQ ID NO: 1617986 - protein, 8 aa, Staphylococcus aureus
KKVEREVA

SEQ ID NO: 1617987 - protein, 12 aa, Staphylococcus aureus
KKYEGKDQETID

SEQ ID NO: 1617988 - protein, 6 aa, Staphylococcus aureus
KLFESN

SEQ ID NO: 1617989 - protein, 6 aa, Staphylococcus aureus
KLGHKS

SEQ ID NO: 1617990 - protein, 33 aa, Staphylococcus aureus
KLNDSTSHIRTNQQSQITLSDEYKRKLKPDKDD

SEQ ID NO: 1617991 - protein, 8 aa, Staphylococcus aureus
KLSGGQQR

SEQ ID NO: 1617992 - protein, 5 aa, Staphylococcus aureus
KNASF

SEQ ID NO: 1617993 - protein, 7 aa, Staphylococcus aureus
KNFDSNA

SEQ ID NO: 1617994 - protein, 6 aa, Staphylococcus aureus
KNGLDG

SEQ ID NO: 1617995 - protein, 11 aa, Staphylococcus aureus
KNLKTRDASAA

SEQ ID NO: 1617996 - protein, 21 aa, Staphylococcus aureus
KNMTTGESETIELDALVEYFK

SEQ ID NO: 1617997 - protein, 4 aa, Staphylococcus aureus
KNSG

SEQ ID NO: 1617998 - protein, 7 aa, Staphylococcus aureus
KNYNDLR

SEQ ID NO: 1617999 - protein, 6 aa, Staphylococcus aureus
KPTYAR

SEQ ID NO: 1618000 - protein, 7 aa, Staphylococcus aureus
KQENTSF

SEQ ID NO: 1618001 - protein, 24 aa, Staphylococcus aureus
KQLYEKTPTADLEDDKPQLPDEDA

SEQ ID NO: 1618002 - protein, 7 aa, Staphylococcus aureus
KQNITAS

SEQ ID NO: 1618003 - protein, 14 aa, Staphylococcus aureus
KQPWSNGNIGTNGV

SEQ ID NO: 1618004 - protein, 8 aa, Staphylococcus aureus
KQQPYNAN

SEQ ID NO: 1618005 - protein, 10 aa, Staphylococcus aureus
KQRADNKQLQ

SEQ ID NO: 1618006 - protein, 7 aa, Staphylococcus aureus
KQSTSGI

SEQ ID NO: 1618007 - protein, 5 aa, Staphylococcus aureus
KQVNR

SEQ ID NO: 1618008 - protein, 18 aa, Staphylococcus aureus
KRDDTMDDIINQGDIVFY

SEQ ID NO: 1618009 - protein, 7 aa, Staphylococcus aureus
KRNKYGT

SEQ ID NO: 1618010 - protein, 13 aa, Staphylococcus aureus
KRSQELNQTVPEI

SEQ ID NO: 1618011 - protein, 16 aa, Staphylococcus aureus
KSATELAKDGINSGIN

SEQ ID NO: 1618012 - protein, 6 aa, Staphylococcus aureus
KSDEVS

SEQ ID NO: 1618013 - protein, 8 aa, Staphylococcus aureus
KSGNKQQW

SEQ ID NO: 1618014 - protein, 10 aa, Staphylococcus aureus
KSGRKDSRKM

SEQ ID NO: 1618015 - protein, 10 aa, Staphylococcus aureus
KSIDSSLSAI

SEQ ID NO: 1618016 - protein, 4 aa, Staphylococcus aureus
KSKL

SEQ ID NO: 1618017 - protein, 8 aa, Staphylococcus aureus
KSNTKGYA

SEQ ID NO: 1618018 - protein, 6 aa, Staphylococcus aureus
KSSPVK

SEQ ID NO: 1618019 - protein, 8 aa, Staphylococcus aureus
KSSSHSSS

SEQ ID NO: 1618020 - protein, 13 aa, Staphylococcus aureus
KSTDKPLKGKELD

SEQ ID NO: 1618021 - protein, 8 aa, Staphylococcus aureus
KSYQGQDY

SEQ ID NO: 1618022 - protein, 8 aa, Staphylococcus aureus
KTPEENIT

SEQ ID NO: 1618023 - protein, 9 aa, Staphylococcus aureus
KTSGSKLTT

SEQ ID NO: 1618024 - protein, 14 aa, Staphylococcus aureus
KVEDSIGNNESDYE

SEQ ID NO: 1618025 - protein, 6 aa, Staphylococcus aureus
KVENEK

SEQ ID NO: 1618026 - protein, 17 aa, Staphylococcus aureus
KVKSGFGKVTSGFKTVF

SEQ ID NO: 1618027 - protein, 16 aa, Staphylococcus aureus
KVKSSKFENGGEGDTR

SEQ ID NO: 1618028 - protein, 8 aa, Staphylococcus aureus
KVPGEKTY

SEQ ID NO: 1618029 - protein, 27 aa, Staphylococcus aureus
KYEESNVDRLKSPLAKTEDLKHQHPAD

SEQ ID NO: 1618030 - protein, 6 aa, Staphylococcus aureus
KYLSEQ

SEQ ID NO: 1618031 - protein, 11 aa, Staphylococcus aureus
KYPDNKKTDDV

SEQ ID NO: 1618032 - protein, 17 aa, Staphylococcus aureus
LAASERKYREIIKKELA

SEQ ID NO: 1618033 - protein, 23 aa, Staphylococcus aureus
LADKQSELKRIEDNNSASNENKI

SEQ ID NO: 1618034 - protein, 148 aa, Staphylococcus aureus
LAESTNKVEKNAVTEDKADSKDSKVAGVNTSTDAKTDTKAENAGDGTATKVDKEDQISATEAIEKASVEQSKNENAAETSNKEATVDADAQHDAEQQVAEAHAEASKQATSNDSLEAKAENDSTASQSEMSEPKPQEEKKGFFARLFN

SEQ ID NO: 1618035 - protein, 7 aa, Staphylococcus aureus
LAGSSSV

SEQ ID NO: 1618036 - protein, 5 aa, Staphylococcus aureus
LAGYA

SEQ ID NO: 1618037 - protein, 7 aa, Staphylococcus aureus
LASKKYK

SEQ ID NO: 1618038 - protein, 10 aa, Staphylococcus aureus
LDINDNTADR

SEQ ID NO: 1618039 - protein, 14 aa, Staphylococcus aureus
LDQGRDKAHKASFK

SEQ ID NO: 1618040 - protein, 4 aa, Staphylococcus aureus
LECP

SEQ ID NO: 1618041 - protein, 7 aa, Staphylococcus aureus
LEETPKY

SEQ ID NO: 1618042 - protein, 4 aa, Staphylococcus aureus
LENK

SEQ ID NO: 1618043 - protein, 17 aa, Staphylococcus aureus
LESNGYDDAESKYTPAW

SEQ ID NO: 1618044 - protein, 4 aa, Staphylococcus aureus
LKAH

SEQ ID NO: 1618045 - protein, 10 aa, Staphylococcus aureus
LKEKPDTSQL

SEQ ID NO: 1618046 - protein, 7 aa, Staphylococcus aureus
LKKENRP

SEQ ID NO: 1618047 - protein, 5 aa, Staphylococcus aureus
LKSYQ

SEQ ID NO: 1618048 - protein, 6 aa, Staphylococcus aureus
LKTYQP

SEQ ID NO: 1618049 - protein, 8 aa, Staphylococcus aureus
LLGEPNDM

SEQ ID NO: 1618050 - protein, 6 aa, Staphylococcus aureus
LLQSEN

SEQ ID NO: 1618051 - protein, 11 aa, Staphylococcus aureus
LNDGVAPGVPW

SEQ ID NO: 1618052 - protein, 5 aa, Staphylococcus aureus
LNHSG

SEQ ID NO: 1618053 - protein, 16 aa, Staphylococcus aureus
LNQSEMNDDDELEVGE

SEQ ID NO: 1618054 - protein, 6 aa, Staphylococcus aureus
LPKDTK

SEQ ID NO: 1618055 - protein, 11 aa, Staphylococcus aureus
LPSSTNPTLPY

SEQ ID NO: 1618056 - protein, 9 aa, Staphylococcus aureus
LQDGAGAAF

SEQ ID NO: 1618057 - protein, 5 aa, Staphylococcus aureus
LRQRI

SEQ ID NO: 1618058 - protein, 8 aa, Staphylococcus aureus
LSDSEQEA

SEQ ID NO: 1618059 - protein, 4 aa, Staphylococcus aureus
LSGA

SEQ ID NO: 1618060 - protein, 10 aa, Staphylococcus aureus
LSKEKVGTFD

SEQ ID NO: 1618061 - protein, 12 aa, Staphylococcus aureus
LSKEQKGQISHR

SEQ ID NO: 1618062 - protein, 10 aa, Staphylococcus aureus
LSKKEQKAYN

SEQ ID NO: 1618063 - protein, 5 aa, Staphylococcus aureus
LSPSE

SEQ ID NO: 1618064 - protein, 8 aa, Staphylococcus aureus
LTDTTKNV

SEQ ID NO: 1618065 - protein, 9 aa, Staphylococcus aureus
LTEPSAQDI

SEQ ID NO: 1618066 - protein, 8 aa, Staphylococcus aureus
LTGEDGEH

SEQ ID NO: 1618067 - protein, 7 aa, Staphylococcus aureus
LTPNEMT

SEQ ID NO: 1618068 - protein, 10 aa, Staphylococcus aureus
LTSNKKQKKY

SEQ ID NO: 1618069 - protein, 8 aa, Staphylococcus aureus
MEHKPDAY

SEQ ID NO: 1618070 - protein, 7 aa, Staphylococcus aureus
MGADNAT

SEQ ID NO: 1618071 - protein, 18 aa, Staphylococcus aureus
MGDTSDNIPGVAGVGEKT

SEQ ID NO: 1618072 - protein, 18 aa, Staphylococcus aureus
MKPNRARISSTSGKIEGA

SEQ ID NO: 1618073 - protein, 6 aa, Staphylococcus aureus
MKPQDT

SEQ ID NO: 1618074 - protein, 11 aa, Staphylococcus aureus
MNAKRISSTIH

SEQ ID NO: 1618075 - protein, 7 aa, Staphylococcus aureus
MPDSPIS

SEQ ID NO: 1618076 - protein, 10 aa, Staphylococcus aureus
MQPVQPPTHD

SEQ ID NO: 1618077 - protein, 5 aa, Staphylococcus aureus
MRKAE

SEQ ID NO: 1618078 - protein, 7 aa, Staphylococcus aureus
MTKDGKS

SEQ ID NO: 1618079 - protein, 7 aa, Staphylococcus aureus
NAIEASK

SEQ ID NO: 1618080 - protein, 8 aa, Staphylococcus aureus
NCTRTQAS

SEQ ID NO: 1618081 - protein, 6 aa, Staphylococcus aureus
NDDQME

SEQ ID NO: 1618082 - protein, 6 aa, Staphylococcus aureus
NDEREH

SEQ ID NO: 1618083 - protein, 8 aa, Staphylococcus aureus
NEQASGKR

SEQ ID NO: 1618084 - protein, 8 aa, Staphylococcus aureus
NESLNRQD

SEQ ID NO: 1618085 - protein, 8 aa, Staphylococcus aureus
NEVQRRGV

SEQ ID NO: 1618086 - protein, 12 aa, Staphylococcus aureus
NEYNNKKNNSSF

SEQ ID NO: 1618087 - protein, 6 aa, Staphylococcus aureus
NFNGKK

SEQ ID NO: 1618088 - protein, 6 aa, Staphylococcus aureus
NFSNNS

SEQ ID NO: 1618089 - protein, 7 aa, Staphylococcus aureus
NGDQEKL

SEQ ID NO: 1618090 - protein, 9 aa, Staphylococcus aureus
NGKKEYSAS

SEQ ID NO: 1618091 - protein, 14 aa, Staphylococcus aureus
NGKMNNKAGKYEGM

SEQ ID NO: 1618092 - protein, 9 aa, Staphylococcus aureus
NGPQTPHDI

SEQ ID NO: 1618093 - protein, 17 aa, Staphylococcus aureus
NGSAPPNQILGDLWGEI

SEQ ID NO: 1618094 - protein, 6 aa, Staphylococcus aureus
NHIESQ

SEQ ID NO: 1618095 - protein, 12 aa, Staphylococcus aureus
NHPLQPHTDAVE

SEQ ID NO: 1618096 - protein, 13 aa, Staphylococcus aureus
NIKSNSEETSAIS

SEQ ID NO: 1618097 - protein, 5 aa, Staphylococcus aureus
NIQNK

SEQ ID NO: 1618098 - protein, 9 aa, Staphylococcus aureus
NKDYEGAYY

SEQ ID NO: 1618099 - protein, 8 aa, Staphylococcus aureus
NKEITSYQ

SEQ ID NO: 1618100 - protein, 4 aa, Staphylococcus aureus
NKKE

SEQ ID NO: 1618101 - protein, 6 aa, Staphylococcus aureus
NKLQGR

SEQ ID NO: 1618102 - protein, 7 aa, Staphylococcus aureus
NKPTYAR

SEQ ID NO: 1618103 - protein, 8 aa, Staphylococcus aureus
NMIDPQSA

SEQ ID NO: 1618104 - protein, 7 aa, Staphylococcus aureus
NNEIEGA

SEQ ID NO: 1618105 - protein, 15 aa, Staphylococcus aureus
NNHIGGKVNRHESDD

SEQ ID NO: 1618106 - protein, 17 aa, Staphylococcus aureus
NNPKTEELKRFLNVINE

SEQ ID NO: 1618107 - protein, 7 aa, Staphylococcus aureus
NNSAYEE

SEQ ID NO: 1618108 - protein, 10 aa, Staphylococcus aureus
NNSQATNRRL

SEQ ID NO: 1618109 - protein, 7 aa, Staphylococcus aureus
NPITEED

SEQ ID NO: 1618110 - protein, 9 aa, Staphylococcus aureus
NPKDRSQRA

SEQ ID NO: 1618111 - protein, 6 aa, Staphylococcus aureus
NPKVRD

SEQ ID NO: 1618112 - protein, 9 aa, Staphylococcus aureus
NPNLTSNQT

SEQ ID NO: 1618113 - protein, 5 aa, Staphylococcus aureus
NPQHT

SEQ ID NO: 1618114 - protein, 6 aa, Staphylococcus aureus
NQEYSD

SEQ ID NO: 1618115 - protein, 21 aa, Staphylococcus aureus
NQKRSNIRKTIQDKVSGIDDK

SEQ ID NO: 1618116 - protein, 9 aa, Staphylococcus aureus
NQTVSSPDK

SEQ ID NO: 1618117 - protein, 4 aa, Staphylococcus aureus
NRAA

SEQ ID NO: 1618118 - protein, 8 aa, Staphylococcus aureus
NRFGSTNE

SEQ ID NO: 1618119 - protein, 14 aa, Staphylococcus aureus
NRNNPAELLPEEEE

SEQ ID NO: 1618120 - protein, 8 aa, Staphylococcus aureus
NRTSENDF

SEQ ID NO: 1618121 - protein, 5 aa, Staphylococcus aureus
NSGIN

SEQ ID NO: 1618122 - protein, 5 aa, Staphylococcus aureus
NSNQL

SEQ ID NO: 1618123 - protein, 10 aa, Staphylococcus aureus
NSNRKSVIQE

SEQ ID NO: 1618124 - protein, 9 aa, Staphylococcus aureus
NSPGQKYEE

SEQ ID NO: 1618125 - protein, 5 aa, Staphylococcus aureus
NSSIN

SEQ ID NO: 1618126 - protein, 7 aa, Staphylococcus aureus
NTNPKPW

SEQ ID NO: 1618127 - protein, 10 aa, Staphylococcus aureus
NTNQSSSSMR

SEQ ID NO: 1618128 - protein, 7 aa, Staphylococcus aureus
NTPTEKH

SEQ ID NO: 1618129 - protein, 6 aa, Staphylococcus aureus
NTTTAL

SEQ ID NO: 1618130 - protein, 6 aa, Staphylococcus aureus
NVEKAG

SEQ ID NO: 1618131 - protein, 5 aa, Staphylococcus aureus
NVNIG

SEQ ID NO: 1618132 - protein, 12 aa, Staphylococcus aureus
NVTSGANPVGLR

SEQ ID NO: 1618133 - protein, 14 aa, Staphylococcus aureus
PAMDNDDYRRGKLT

SEQ ID NO: 1618134 - protein, 12 aa, Staphylococcus aureus
PDSEVPERTEGY

SEQ ID NO: 1618135 - protein, 5 aa, Staphylococcus aureus
PEHAS

SEQ ID NO: 1618136 - protein, 11 aa, Staphylococcus aureus
PEVKPSSEVYG

SEQ ID NO: 1618137 - protein, 6 aa, Staphylococcus aureus
PGKATI

SEQ ID NO: 1618138 - protein, 4 aa, Staphylococcus aureus
PITQ

SEQ ID NO: 1618139 - protein, 7 aa, Staphylococcus aureus
PKGASTK

SEQ ID NO: 1618140 - protein, 5 aa, Staphylococcus aureus
PKQVV

SEQ ID NO: 1618141 - protein, 7 aa, Staphylococcus aureus
PKSDQYL

SEQ ID NO: 1618142 - protein, 12 aa, Staphylococcus aureus
PKSLTNNVKAGD

SEQ ID NO: 1618143 - protein, 14 aa, Staphylococcus aureus
PMNGNDEEQKQVTR

SEQ ID NO: 1618144 - protein, 5 aa, Staphylococcus aureus
PNGQR

SEQ ID NO: 1618145 - protein, 5 aa, Staphylococcus aureus
PNRKA

SEQ ID NO: 1618146 - protein, 11 aa, Staphylococcus aureus
PPFTSDQAKEK

SEQ ID NO: 1618147 - protein, 10 aa, Staphylococcus aureus
PPLRSTEDRE

SEQ ID NO: 1618148 - protein, 10 aa, Staphylococcus aureus
PTEDESRDYL

SEQ ID NO: 1618149 - protein, 10 aa, Staphylococcus aureus
PTEDESREYL

SEQ ID NO: 1618150 - protein, 7 aa, Staphylococcus aureus
PVEEAQR

SEQ ID NO: 1618151 - protein, 4 aa, Staphylococcus aureus
QAAE

SEQ ID NO: 1618152 - protein, 5 aa, Staphylococcus aureus
QARRE

SEQ ID NO: 1618153 - protein, 13 aa, Staphylococcus aureus
QATEQVTSRLKDK

SEQ ID NO: 1618154 - protein, 5 aa, Staphylococcus aureus
QDEEE

SEQ ID NO: 1618155 - protein, 14 aa, Staphylococcus aureus
QDLPYSSKRPIRSA

SEQ ID NO: 1618156 - protein, 6 aa, Staphylococcus aureus
QEDTAK

SEQ ID NO: 1618157 - protein, 7 aa, Staphylococcus aureus
QGNIETN

SEQ ID NO: 1618158 - protein, 6 aa, Staphylococcus aureus
QGYQSV

SEQ ID NO: 1618159 - protein, 17 aa, Staphylococcus aureus
QKAGEETKQAAEKQAEA

SEQ ID NO: 1618160 - protein, 4 aa, Staphylococcus aureus
QLQT

SEQ ID NO: 1618161 - protein, 7 aa, Staphylococcus aureus
QMKPKDT

SEQ ID NO: 1618162 - protein, 7 aa, Staphylococcus aureus
QNSFPKN

SEQ ID NO: 1618163 - protein, 5 aa, Staphylococcus aureus
QPLPY

SEQ ID NO: 1618164 - protein, 5 aa, Staphylococcus aureus
QPVVK

SEQ ID NO: 1618165 - protein, 6 aa, Staphylococcus aureus
QPVVKE

SEQ ID NO: 1618166 - protein, 19 aa, Staphylococcus aureus
QQGRNEGVGKAKKTRGYNL

SEQ ID NO: 1618167 - protein, 13 aa, Staphylococcus aureus
QRIKTAGPSTPVE

SEQ ID NO: 1618168 - protein, 5 aa, Staphylococcus aureus
QRYQE

SEQ ID NO: 1618169 - protein, 4 aa, Staphylococcus aureus
QSAE

SEQ ID NO: 1618170 - protein, 7 aa, Staphylococcus aureus
QSATFTE

SEQ ID NO: 1618171 - protein, 11 aa, Staphylococcus aureus
QSEVDNNASAI

SEQ ID NO: 1618172 - protein, 4 aa, Staphylococcus aureus
QSNL

SEQ ID NO: 1618173 - protein, 26 aa, Staphylococcus aureus
QVSTTKQLSDDEVTVSDVTSQRQSAL

SEQ ID NO: 1618174 - protein, 10 aa, Staphylococcus aureus
REGDDERTAI

SEQ ID NO: 1618175 - protein, 20 aa, Staphylococcus aureus
REKIETKIANSKKDISETNN

SEQ ID NO: 1618176 - protein, 6 aa, Staphylococcus aureus
RENGKQ

SEQ ID NO: 1618177 - protein, 7 aa, Staphylococcus aureus
RENLGQP

SEQ ID NO: 1618178 - protein, 8 aa, Staphylococcus aureus
REQASDQF

SEQ ID NO: 1618179 - protein, 9 aa, Staphylococcus aureus
RERRERAEA

SEQ ID NO: 1618180 - protein, 9 aa, Staphylococcus aureus
RGITGGNGI

SEQ ID NO: 1618181 - protein, 7 aa, Staphylococcus aureus
RGNMKEY

SEQ ID NO: 1618182 - protein, 7 aa, Staphylococcus aureus
RHKTSEE

SEQ ID NO: 1618183 - protein, 5 aa, Staphylococcus aureus
RINQG

SEQ ID NO: 1618184 - protein, 12 aa, Staphylococcus aureus
RKDSKSKDEVEY

SEQ ID NO: 1618185 - protein, 7 aa, Staphylococcus aureus
RKPNTAL

SEQ ID NO: 1618186 - protein, 9 aa, Staphylococcus aureus
RKTNTSPRY

SEQ ID NO: 1618187 - protein, 9 aa, Staphylococcus aureus
RLSTTDDGE

SEQ ID NO: 1618188 - protein, 5 aa, Staphylococcus aureus
RLTQE

SEQ ID NO: 1618189 - protein, 5 aa, Staphylococcus aureus
RNQPN

SEQ ID NO: 1618190 - protein, 16 aa, Staphylococcus aureus
RPDNPENVIRSETSRQ

SEQ ID NO: 1618191 - protein, 5 aa, Staphylococcus aureus
RQQEI

SEQ ID NO: 1618192 - protein, 13 aa, Staphylococcus aureus
RQQGQQSGNGNYL

SEQ ID NO: 1618193 - protein, 34 aa, Staphylococcus aureus
RRDYGESELAEPLPDSASNPDSDYRVKRDAQDIA

SEQ ID NO: 1618194 - protein, 8 aa, Staphylococcus aureus
RRGRQNQA

SEQ ID NO: 1618195 - protein, 9 aa, Staphylococcus aureus
RRPTPARLT

SEQ ID NO: 1618196 - protein, 5 aa, Staphylococcus aureus
RSEKM

SEQ ID NO: 1618197 - protein, 4 aa, Staphylococcus aureus
RYGN

SEQ ID NO: 1618198 - protein, 5 aa, Staphylococcus aureus
SAHDS

SEQ ID NO: 1618199 - protein, 5 aa, Staphylococcus aureus
SALSN

SEQ ID NO: 1618200 - protein, 9 aa, Staphylococcus aureus
SARRVENED

SEQ ID NO: 1618201 - protein, 22 aa, Staphylococcus aureus
SASRQGKKVGKRIKRTGRSENN

SEQ ID NO: 1618202 - protein, 5 aa, Staphylococcus aureus
SATVS

SEQ ID NO: 1618203 - protein, 5 aa, Staphylococcus aureus
SDESQ

SEQ ID NO: 1618204 - protein, 6 aa, Staphylococcus aureus
SELTKS

SEQ ID NO: 1618205 - protein, 4 aa, Staphylococcus aureus
SENI

SEQ ID NO: 1618206 - protein, 15 aa, Staphylococcus aureus
SGALNNKSDEYGIKR

SEQ ID NO: 1618207 - protein, 14 aa, Staphylococcus aureus
SGATGSDSGSKGLS

SEQ ID NO: 1618208 - protein, 24 aa, Staphylococcus aureus
SGGQPQSKIPTFGQKTPLGRAGQP

SEQ ID NO: 1618209 - protein, 8 aa, Staphylococcus aureus
SHNPKDYN

SEQ ID NO: 1618210 - protein, 7 aa, Staphylococcus aureus
SHQEHFT

SEQ ID NO: 1618211 - protein, 6 aa, Staphylococcus aureus
SIENDD

SEQ ID NO: 1618212 - protein, 7 aa, Staphylococcus aureus
SITGDSI

SEQ ID NO: 1618213 - protein, 4 aa, Staphylococcus aureus
SKII

SEQ ID NO: 1618214 - protein, 21 aa, Staphylococcus aureus
SKVQNTIKTDIKQEDSNTHVY

SEQ ID NO: 1618215 - protein, 12 aa, Staphylococcus aureus
SKYDSQLIIPIV

SEQ ID NO: 1618216 - protein, 16 aa, Staphylococcus aureus
SLRHTSKKLATILKGD

SEQ ID NO: 1618217 - protein, 6 aa, Staphylococcus aureus
SMGPRS

SEQ ID NO: 1618218 - protein, 14 aa, Staphylococcus aureus
SMPAQRGLNEHSNG

SEQ ID NO: 1618219 - protein, 8 aa, Staphylococcus aureus
SNHDAYKS

SEQ ID NO: 1618220 - protein, 11 aa, Staphylococcus aureus
SNNERRKGDYE

SEQ ID NO: 1618221 - protein, 7 aa, Staphylococcus aureus
SPEANTV

SEQ ID NO: 1618222 - protein, 7 aa, Staphylococcus aureus
SQNDKVA

SEQ ID NO: 1618223 - protein, 6 aa, Staphylococcus aureus
SQNEAN

SEQ ID NO: 1618224 - protein, 4 aa, Staphylococcus aureus
SQSL

SEQ ID NO: 1618225 - protein, 8 aa, Staphylococcus aureus
SQSPQKMA

SEQ ID NO: 1618226 - protein, 6 aa, Staphylococcus aureus
SRANVQ

SEQ ID NO: 1618227 - protein, 10 aa, Staphylococcus aureus
SREEAVASSR

SEQ ID NO: 1618228 - protein, 13 aa, Staphylococcus aureus
SRIPGKNGDATKF

SEQ ID NO: 1618229 - protein, 7 aa, Staphylococcus aureus
SRTDNIS

SEQ ID NO: 1618230 - protein, 14 aa, Staphylococcus aureus
SSATVDQLKDYDGV

SEQ ID NO: 1618231 - protein, 21 aa, Staphylococcus aureus
SSEISEAQDTYKSLKSKQKEL

SEQ ID NO: 1618232 - protein, 15 aa, Staphylococcus aureus
SSIEDAQQNATINQC

SEQ ID NO: 1618233 - protein, 12 aa, Staphylococcus aureus
STDRADTNTVLC

SEQ ID NO: 1618234 - protein, 5 aa, Staphylococcus aureus
STSEM

SEQ ID NO: 1618235 - protein, 4 aa, Staphylococcus aureus
STSG

SEQ ID NO: 1618236 - protein, 9 aa, Staphylococcus aureus
STSGTFSDK

SEQ ID NO: 1618237 - protein, 5 aa, Staphylococcus aureus
SVSAN

SEQ ID NO: 1618238 - protein, 20 aa, Staphylococcus aureus
SVTDLTRENAREMIQHNQRH

SEQ ID NO: 1618239 - protein, 9 aa, Staphylococcus aureus
TAPIKEQAT

SEQ ID NO: 1618240 - protein, 9 aa, Staphylococcus aureus
TAVDTEGVA

SEQ ID NO: 1618241 - protein, 7 aa, Staphylococcus aureus
TDRGNIK

SEQ ID NO: 1618242 - protein, 15 aa, Staphylococcus aureus
TEETLTDERVSKVQA

SEQ ID NO: 1618243 - protein, 12 aa, Staphylococcus aureus
TEHREDSTIADG

SEQ ID NO: 1618244 - protein, 9 aa, Staphylococcus aureus
TEQPSDTRA

SEQ ID NO: 1618245 - protein, 10 aa, Staphylococcus aureus
TERPEGVDAG

SEQ ID NO: 1618246 - protein, 8 aa, Staphylococcus aureus
TESKEMQE

SEQ ID NO: 1618247 - protein, 15 aa, Staphylococcus aureus
TGETYNNIEVIKSVS

SEQ ID NO: 1618248 - protein, 5 aa, Staphylococcus aureus
TGKQR

SEQ ID NO: 1618249 - protein, 6 aa, Staphylococcus aureus
TGLEEH

SEQ ID NO: 1618250 - protein, 11 aa, Staphylococcus aureus
TGVSKGKGFQG

SEQ ID NO: 1618251 - protein, 7 aa, Staphylococcus aureus
THEQDVY

SEQ ID NO: 1618252 - protein, 4 aa, Staphylococcus aureus
TKDQ

SEQ ID NO: 1618253 - protein, 9 aa, Staphylococcus aureus
TKEDAQEAT

SEQ ID NO: 1618254 - protein, 12 aa, Staphylococcus aureus
TKPSDKNKRKEL

SEQ ID NO: 1618255 - protein, 11 aa, Staphylococcus aureus
TKPSDTNKRKE

SEQ ID NO: 1618256 - protein, 11 aa, Staphylococcus aureus
TLGRGGSDTTA

SEQ ID NO: 1618257 - protein, 4 aa, Staphylococcus aureus
TNER

SEQ ID NO: 1618258 - protein, 18 aa, Staphylococcus aureus
TPNMKDDNFSGTQSGEAM

SEQ ID NO: 1618259 - protein, 5 aa, Staphylococcus aureus
TPQMN

SEQ ID NO: 1618260 - protein, 6 aa, Staphylococcus aureus
TPTNLK

SEQ ID NO: 1618261 - protein, 13 aa, Staphylococcus aureus
TQNEADASEVEGY

SEQ ID NO: 1618262 - protein, 7 aa, Staphylococcus aureus
TQNGSNN

SEQ ID NO: 1618263 - protein, 9 aa, Staphylococcus aureus
TQPTSDDYV

SEQ ID NO: 1618264 - protein, 19 aa, Staphylococcus aureus
TREDKLSNTYKKVEENQPR

SEQ ID NO: 1618265 - protein, 11 aa, Staphylococcus aureus
TRSIDANKDFN

SEQ ID NO: 1618266 - protein, 8 aa, Staphylococcus aureus
TSSEKFTN

SEQ ID NO: 1618267 - protein, 8 aa, Staphylococcus aureus
TSTSCPHR

SEQ ID NO: 1618268 - protein, 4 aa, Staphylococcus aureus
TSYH

SEQ ID NO: 1618269 - protein, 14 aa, Staphylococcus aureus
TTEYEKQEQEVPGL

SEQ ID NO: 1618270 - protein, 5 aa, Staphylococcus aureus
TTTVN

SEQ ID NO: 1618271 - protein, 8 aa, Staphylococcus aureus
TYGDTPKL

SEQ ID NO: 1618272 - protein, 4 aa, Staphylococcus aureus
TYNP

SEQ ID NO: 1618273 - protein, 5 aa, Staphylococcus aureus
VAHAR

SEQ ID NO: 1618274 - protein, 6 aa, Staphylococcus aureus
VATKKL

SEQ ID NO: 1618275 - protein, 10 aa, Staphylococcus aureus
VDDNASKDGV

SEQ ID NO: 1618276 - protein, 7 aa, Staphylococcus aureus
VEEQGIT

SEQ ID NO: 1618277 - protein, 21 aa, Staphylococcus aureus
VENEGRDAANAAQEKAEKEGK

SEQ ID NO: 1618278 - protein, 8 aa, Staphylococcus aureus
VESPNYTK

SEQ ID NO: 1618279 - protein, 8 aa, Staphylococcus aureus
VESTRGKG

SEQ ID NO: 1618280 - protein, 12 aa, Staphylococcus aureus
VETEAQESTESE

SEQ ID NO: 1618281 - protein, 14 aa, Staphylococcus aureus
VETTELSSDNYHTT

SEQ ID NO: 1618282 - protein, 4 aa, Staphylococcus aureus
VGKG

SEQ ID NO: 1618283 - protein, 10 aa, Staphylococcus aureus
VGNGSALRGY

SEQ ID NO: 1618284 - protein, 14 aa, Staphylococcus aureus
VHEAASAVDEKGLY

SEQ ID NO: 1618285 - protein, 17 aa, Staphylococcus aureus
VKEAGGAVVQEPTVSQG

SEQ ID NO: 1618286 - protein, 12 aa, Staphylococcus aureus
VKENTLATIGSS

SEQ ID NO: 1618287 - protein, 5 aa, Staphylococcus aureus
VKSSF

SEQ ID NO: 1618288 - protein, 7 aa, Staphylococcus aureus
VKYGEQY

SEQ ID NO: 1618289 - protein, 4 aa, Staphylococcus aureus
VNQT

SEQ ID NO: 1618290 - protein, 8 aa, Staphylococcus aureus
VPEGEGQS

SEQ ID NO: 1618291 - protein, 4 aa, Staphylococcus aureus
VPGE

SEQ ID NO: 1618292 - protein, 9 aa, Staphylococcus aureus
VPSSSANYD

SEQ ID NO: 1618293 - protein, 7 aa, Staphylococcus aureus
VRKQKEA

SEQ ID NO: 1618294 - protein, 6 aa, Staphylococcus aureus
VSYTES

SEQ ID NO: 1618295 - protein, 7 aa, Staphylococcus aureus
VTKETSV

SEQ ID NO: 1618296 - protein, 4 aa, Staphylococcus aureus
VVTN

SEQ ID NO: 1618297 - protein, 11 aa, Staphylococcus aureus
WGSDVKGITDG

SEQ ID NO: 1618298 - protein, 9 aa, Staphylococcus aureus
YDEDEANHE

SEQ ID NO: 1618299 - protein, 20 aa, Staphylococcus aureus
YDKKANKTGKVRPKYEDKEL

SEQ ID NO: 1618300 - protein, 18 aa, Staphylococcus aureus
YDTSNETVVPKDSPSNIL

SEQ ID NO: 1618301 - protein, 8 aa, Staphylococcus aureus
YEDSTNYG

SEQ ID NO: 1618302 - protein, 4 aa, Staphylococcus aureus
YEEN

SEQ ID NO: 1618303 - protein, 6 aa, Staphylococcus aureus
YENDTR

SEQ ID NO: 1618304 - protein, 5 aa, Staphylococcus aureus
YGAGY

SEQ ID NO: 1618305 - protein, 8 aa, Staphylococcus aureus
YGAPPHGG

SEQ ID NO: 1618306 - protein, 5 aa, Staphylococcus aureus
YGPSE

SEQ ID NO: 1618307 - protein, 6 aa, Staphylococcus aureus
YGSKSN

SEQ ID NO: 1618308 - protein, 5 aa, Staphylococcus aureus
YIPEG

SEQ ID NO: 1618309 - protein, 11 aa, Staphylococcus aureus
YITPENAATEI

SEQ ID NO: 1618310 - protein, 8 aa, Staphylococcus aureus
YKEISSCS

SEQ ID NO: 1618311 - protein, 9 aa, Staphylococcus aureus
YKPSSNQSL

SEQ ID NO: 1618312 - protein, 8 aa, Staphylococcus aureus
YQGQGYGS

SEQ ID NO: 1618313 - protein, 12 aa, Staphylococcus aureus
YSGSNPTFEPRT

SEQ ID NO: 1618314 - protein, 7 aa, Staphylococcus aureus
YSTTVTN

SEQ ID NO: 1618315 - protein, 7 aa, Staphylococcus aureus
AAKEITG

SEQ ID NO: 1618316 - protein, 9 aa, Staphylococcus aureus
AARDNDRLK

SEQ ID NO: 1618317 - protein, 27 aa, Staphylococcus aureus
AATENDYQNAQQYSEQKPSADSTQTEI

SEQ ID NO: 1618318 - protein, 9 aa, Staphylococcus aureus
AAVDDDTAA

SEQ ID NO: 1618319 - protein, 14 aa, Staphylococcus aureus
ADADASAKEIARTD

SEQ ID NO: 1618320 - protein, 20 aa, Staphylococcus aureus
ADLSRTKGDYVQGKNSFTSG

SEQ ID NO: 1618321 - protein, 26 aa, Staphylococcus aureus
ADQKKNNILADTNATQDEKQQAIKQV

SEQ ID NO: 1618322 - protein, 21 aa, Staphylococcus aureus
ADSEEDGATNEEEYSGSQIDD

SEQ ID NO: 1618323 - protein, 6 aa, Staphylococcus aureus
ADTVKS

SEQ ID NO: 1618324 - protein, 7 aa, Staphylococcus aureus
ADTVKSA

SEQ ID NO: 1618325 - protein, 9 aa, Staphylococcus aureus
AEAAPVNSF

SEQ ID NO: 1618326 - protein, 9 aa, Staphylococcus aureus
AEGRRYTGS

SEQ ID NO: 1618327 - protein, 7 aa, Staphylococcus aureus
AEGTSNI

SEQ ID NO: 1618328 - protein, 6 aa, Staphylococcus aureus
AEKAEC

SEQ ID NO: 1618329 - protein, 10 aa, Staphylococcus aureus
AEKGHSLTEI

SEQ ID NO: 1618330 - protein, 8 aa, Staphylococcus aureus
AEKGYSLT

SEQ ID NO: 1618331 - protein, 8 aa, Staphylococcus aureus
AEKLSDRA

SEQ ID NO: 1618332 - protein, 6 aa, Staphylococcus aureus
AEKRNA

SEQ ID NO: 1618333 - protein, 8 aa, Staphylococcus aureus
AERVGEQM

SEQ ID NO: 1618334 - protein, 17 aa, Staphylococcus aureus
AESKEEAKEKYESQNTP

SEQ ID NO: 1618335 - protein, 4 aa, Staphylococcus aureus
AETH

SEQ ID NO: 1618336 - protein, 6 aa, Staphylococcus aureus
AFPDSE

SEQ ID NO: 1618337 - protein, 14 aa, Staphylococcus aureus
AGARGLLDQESNEF

SEQ ID NO: 1618338 - protein, 10 aa, Staphylococcus aureus
AGDTKPVKEA

SEQ ID NO: 1618339 - protein, 13 aa, Staphylococcus aureus
AGFGNGNDTEEKD

SEQ ID NO: 1618340 - protein, 6 aa, Staphylococcus aureus
AGINPA

SEQ ID NO: 1618341 - protein, 6 aa, Staphylococcus aureus
AGMTEK

SEQ ID NO: 1618342 - protein, 15 aa, Staphylococcus aureus
AGTKYDEHGSAQPLG

SEQ ID NO: 1618343 - protein, 4 aa, Staphylococcus aureus
AGTV

SEQ ID NO: 1618344 - protein, 12 aa, Staphylococcus aureus
AHRADEDAATTA

SEQ ID NO: 1618345 - protein, 6 aa, Staphylococcus aureus
AINKNT

SEQ ID NO: 1618346 - protein, 26 aa, Staphylococcus aureus
AISELDAKAQEKVTAAQQSKKVTQDE

SEQ ID NO: 1618347 - protein, 38 aa, Staphylococcus aureus
AKAQKIHQKPQNKTNFEKSKQIKPKQYNQTKNHQQQKK

SEQ ID NO: 1618348 - protein, 7 aa, Staphylococcus aureus
AKDYAKD

SEQ ID NO: 1618349 - protein, 7 aa, Staphylococcus aureus
AKEQRKI

SEQ ID NO: 1618350 - protein, 30 aa, Staphylococcus aureus
AKGMPEGEYDLGGQKVTVQSQQARLTNGAL

SEQ ID NO: 1618351 - protein, 8 aa, Staphylococcus aureus
AKKNTELA

SEQ ID NO: 1618352 - protein, 6 aa, Staphylococcus aureus
AKTGTA

SEQ ID NO: 1618353 - protein, 6 aa, Staphylococcus aureus
AKVSGV

SEQ ID NO: 1618354 - protein, 8 aa, Staphylococcus aureus
ALGVGASH

SEQ ID NO: 1618355 - protein, 6 aa, Staphylococcus aureus
ALNNEG

SEQ ID NO: 1618356 - protein, 10 aa, Staphylococcus aureus
ANEEERKQSK

SEQ ID NO: 1618357 - protein, 7 aa, Staphylococcus aureus
ANFNNDD

SEQ ID NO: 1618358 - protein, 13 aa, Staphylococcus aureus
ANGGGLSSSQQKV

SEQ ID NO: 1618359 - protein, 6 aa, Staphylococcus aureus
ANGHTQ

SEQ ID NO: 1618360 - protein, 6 aa, Staphylococcus aureus
ANGTGN

SEQ ID NO: 1618361 - protein, 16 aa, Staphylococcus aureus
ANHVETANRASQADID

SEQ ID NO: 1618362 - protein, 7 aa, Staphylococcus aureus
ANLGSSI

SEQ ID NO: 1618363 - protein, 15 aa, Staphylococcus aureus
ANNVTTRNDPDGRSR

SEQ ID NO: 1618364 - protein, 7 aa, Staphylococcus aureus
ANRTGHT

SEQ ID NO: 1618365 - protein, 11 aa, Staphylococcus aureus
ANSPNNERIPT

SEQ ID NO: 1618366 - protein, 6 aa, Staphylococcus aureus
ANTVKS

SEQ ID NO: 1618367 - protein, 26 aa, Staphylococcus aureus
ANYSNNETATPKEATKPSTETTEDNH

SEQ ID NO: 1618368 - protein, 13 aa, Staphylococcus aureus
APRHKKDDQTNLN

SEQ ID NO: 1618369 - protein, 28 aa, Staphylococcus aureus
APTQRISKRNSTSNASWERSPNWISNFY

SEQ ID NO: 1618370 - protein, 15 aa, Staphylococcus aureus
AQDEDAKTDTPVNRL

SEQ ID NO: 1618371 - protein, 15 aa, Staphylococcus aureus
AQNSDFKGGSPEENL

SEQ ID NO: 1618372 - protein, 9 aa, Staphylococcus aureus
AQQRDPFQS

SEQ ID NO: 1618373 - protein, 8 aa, Staphylococcus aureus
AQSEGYTH

SEQ ID NO: 1618374 - protein, 5 aa, Staphylococcus aureus
ARGNV

SEQ ID NO: 1618375 - protein, 19 aa, Staphylococcus aureus
ARKASRAVGKRGTDLPGQI

SEQ ID NO: 1618376 - protein, 17 aa, Staphylococcus aureus
ARTNKEIEADVKEGGNY

SEQ ID NO: 1618377 - protein, 12 aa, Staphylococcus aureus
ARTRTKKGRAVF

SEQ ID NO: 1618378 - protein, 7 aa, Staphylococcus aureus
ASGTSIR

SEQ ID NO: 1618379 - protein, 9 aa, Staphylococcus aureus
ASNVRDKEA

SEQ ID NO: 1618380 - protein, 10 aa, Staphylococcus aureus
ASTGKQDVSN

SEQ ID NO: 1618381 - protein, 17 aa, Staphylococcus aureus
ATKDNSLDTHGDETIRD

SEQ ID NO: 1618382 - protein, 57 aa, Staphylococcus aureus
ATNKENEEVKSLREEQGQDKLEDTHSEGSTQDVNDLAENAEVKKKPRKLSEADFDDD

SEQ ID NO: 1618383 - protein, 9 aa, Staphylococcus aureus
ATRSALNSV

SEQ ID NO: 1618384 - protein, 5 aa, Staphylococcus aureus
ATSVI

SEQ ID NO: 1618385 - protein, 16 aa, Staphylococcus aureus
ATYNPTDRKKLEPQDI

SEQ ID NO: 1618386 - protein, 7 aa, Staphylococcus aureus
AVAKTSM

SEQ ID NO: 1618387 - protein, 6 aa, Staphylococcus aureus
AVESAL

SEQ ID NO: 1618388 - protein, 7 aa, Staphylococcus aureus
AVGNADV

SEQ ID NO: 1618389 - protein, 10 aa, Staphylococcus aureus
AVGSTGEVTG

SEQ ID NO: 1618390 - protein, 18 aa, Staphylococcus aureus
AVKSGEADGCVSAGNTGA

SEQ ID NO: 1618391 - protein, 6 aa, Staphylococcus aureus
AYENGI

SEQ ID NO: 1618392 - protein, 8 aa, Staphylococcus aureus
AYNNKPNS

SEQ ID NO: 1618393 - protein, 10 aa, Staphylococcus aureus
CAKNATRQPL

SEQ ID NO: 1618394 - protein, 11 aa, Staphylococcus aureus
CGQSRDIKQKQ

SEQ ID NO: 1618395 - protein, 5 aa, Staphylococcus aureus
CRTRA

SEQ ID NO: 1618396 - protein, 6 aa, Staphylococcus aureus
DADNNC

SEQ ID NO: 1618397 - protein, 5 aa, Staphylococcus aureus
DAEDQ

SEQ ID NO: 1618398 - protein, 11 aa, Staphylococcus aureus
DAFDSDDHVQP

SEQ ID NO: 1618399 - protein, 13 aa, Staphylococcus aureus
DAGSKGATAEAYR

SEQ ID NO: 1618400 - protein, 7 aa, Staphylococcus aureus
DAKQTMS

SEQ ID NO: 1618401 - protein, 73 aa, Staphylococcus aureus
DAQDNLKEKESQAYADGKISEEEQRAIQDAQAKLEEAKQNAELKARNAEKKANAYTDNKVKESTDAQRRTLTR

SEQ ID NO: 1618402 - protein, 5 aa, Staphylococcus aureus
DATLN

SEQ ID NO: 1618403 - protein, 10 aa, Staphylococcus aureus
DATSTEQDQF

SEQ ID NO: 1618404 - protein, 48 aa, Staphylococcus aureus
DAYNAKVNEADNSNASTSSEIAEAKQKLAELKQTADQNVNQATSKDDI

SEQ ID NO: 1618405 - protein, 11 aa, Staphylococcus aureus
DDAKLETRNGY

SEQ ID NO: 1618406 - protein, 7 aa, Staphylococcus aureus
DDEVRNE

SEQ ID NO: 1618407 - protein, 7 aa, Staphylococcus aureus
DDKGNAY

SEQ ID NO: 1618408 - protein, 9 aa, Staphylococcus aureus
DDPAGKEWS

SEQ ID NO: 1618409 - protein, 10 aa, Staphylococcus aureus
DDPEITSNPA

SEQ ID NO: 1618410 - protein, 4 aa, Staphylococcus aureus
DDPF

SEQ ID NO: 1618411 - protein, 7 aa, Staphylococcus aureus
DDSIEKI

SEQ ID NO: 1618412 - protein, 9 aa, Staphylococcus aureus
DDSLGDYGK

SEQ ID NO: 1618413 - protein, 11 aa, Staphylococcus aureus
DDYRDCKRKAK

SEQ ID NO: 1618414 - protein, 7 aa, Staphylococcus aureus
DEADDFG

SEQ ID NO: 1618415 - protein, 13 aa, Staphylococcus aureus
DEIKKYKKDIDDA

SEQ ID NO: 1618416 - protein, 11 aa, Staphylococcus aureus
DETLDTSVGEG

SEQ ID NO: 1618417 - protein, 5 aa, Staphylococcus aureus
DETSF

SEQ ID NO: 1618418 - protein, 9 aa, Staphylococcus aureus
DFKNAAQGA

SEQ ID NO: 1618419 - protein, 10 aa, Staphylococcus aureus
DGKIRNSNGP

SEQ ID NO: 1618420 - protein, 9 aa, Staphylococcus aureus
DGKLQGKNV

SEQ ID NO: 1618421 - protein, 13 aa, Staphylococcus aureus
DGTMAKGQDLQNF

SEQ ID NO: 1618422 - protein, 8 aa, Staphylococcus aureus
DHSENELG

SEQ ID NO: 1618423 - protein, 12 aa, Staphylococcus aureus
DIDAATTNAQVE

SEQ ID NO: 1618424 - protein, 16 aa, Staphylococcus aureus
DIEESLQTNYEEPKGN

SEQ ID NO: 1618425 - protein, 7 aa, Staphylococcus aureus
DKANLQH

SEQ ID NO: 1618426 - protein, 11 aa, Staphylococcus aureus
DKDENAHPLTQ

SEQ ID NO: 1618427 - protein, 7 aa, Staphylococcus aureus
DKEGFTI

SEQ ID NO: 1618428 - protein, 12 aa, Staphylococcus aureus
DKIEKGKGEITV

SEQ ID NO: 1618429 - protein, 18 aa, Staphylococcus aureus
DKNEYEAESPLFFFSGRL

SEQ ID NO: 1618430 - protein, 9 aa, Staphylococcus aureus
DKNNDNMKD

SEQ ID NO: 1618431 - protein, 9 aa, Staphylococcus aureus
DKNSQNVEN

SEQ ID NO: 1618432 - protein, 7 aa, Staphylococcus aureus
DKQVGDF

SEQ ID NO: 1618433 - protein, 17 aa, Staphylococcus aureus
DLENGTPTEVLTGENEG

SEQ ID NO: 1618434 - protein, 32 aa, Staphylococcus aureus
DLKPDEVAANAQNNASNTSDNNQQSNDSETTK

SEQ ID NO: 1618435 - protein, 5 aa, Staphylococcus aureus
DLQNI

SEQ ID NO: 1618436 - protein, 10 aa, Staphylococcus aureus
DNFDDEHGAY

SEQ ID NO: 1618437 - protein, 13 aa, Staphylococcus aureus
DNFQDEQGEDSDR

SEQ ID NO: 1618438 - protein, 8 aa, Staphylococcus aureus
DNGNVSNI

SEQ ID NO: 1618439 - protein, 7 aa, Staphylococcus aureus
DNGRGIP

SEQ ID NO: 1618440 - protein, 5 aa, Staphylococcus aureus
DNKTV

SEQ ID NO: 1618441 - protein, 16 aa, Staphylococcus aureus
DNTTTNEEKGKDIEPV

SEQ ID NO: 1618442 - protein, 4 aa, Staphylococcus aureus
DNYG

SEQ ID NO: 1618443 - protein, 17 aa, Staphylococcus aureus
DPKELNDYKYDPEKAKK

SEQ ID NO: 1618444 - protein, 16 aa, Staphylococcus aureus
DPYTNYGRPNSKYEQM

SEQ ID NO: 1618445 - protein, 15 aa, Staphylococcus aureus
DQAPLNPDTTNEEVA

SEQ ID NO: 1618446 - protein, 7 aa, Staphylococcus aureus
DQENTKK

SEQ ID NO: 1618447 - protein, 8 aa, Staphylococcus aureus
DQISNNKK

SEQ ID NO: 1618448 - protein, 4 aa, Staphylococcus aureus
DQKA

SEQ ID NO: 1618449 - protein, 13 aa, Staphylococcus aureus
DRANQNVTTANGI

SEQ ID NO: 1618450 - protein, 7 aa, Staphylococcus aureus
DRDTTGI

SEQ ID NO: 1618451 - protein, 5 aa, Staphylococcus aureus
DRNIQ

SEQ ID NO: 1618452 - protein, 7 aa, Staphylococcus aureus
DRPLDEA

SEQ ID NO: 1618453 - protein, 32 aa, Staphylococcus aureus
DRQETTYQVATDNAKDNRDNQQLNQNTATTNM

SEQ ID NO: 1618454 - protein, 5 aa, Staphylococcus aureus
DSDIP

SEQ ID NO: 1618455 - protein, 8 aa, Staphylococcus aureus
DSDLDGPA

SEQ ID NO: 1618456 - protein, 6 aa, Staphylococcus aureus
DSHNET

SEQ ID NO: 1618457 - protein, 5 aa, Staphylococcus aureus
DSIAE

SEQ ID NO: 1618458 - protein, 8 aa, Staphylococcus aureus
DSKKVPIT

SEQ ID NO: 1618459 - protein, 9 aa, Staphylococcus aureus
DSNDEGDRI

SEQ ID NO: 1618460 - protein, 8 aa, Staphylococcus aureus
DSNSISNE

SEQ ID NO: 1618461 - protein, 7 aa, Staphylococcus aureus
DSTKSYR

SEQ ID NO: 1618462 - protein, 7 aa, Staphylococcus aureus
DSTYGEF

SEQ ID NO: 1618463 - protein, 6 aa, Staphylococcus aureus
DSVSDL

SEQ ID NO: 1618464 - protein, 16 aa, Staphylococcus aureus
DTANSEVFGKHGEKVT

SEQ ID NO: 1618465 - protein, 6 aa, Staphylococcus aureus
DTDVNH

SEQ ID NO: 1618466 - protein, 6 aa, Staphylococcus aureus
DTEDYE

SEQ ID NO: 1618467 - protein, 23 aa, Staphylococcus aureus
DTEVDEDTTSNSEDNTNRDASEM

SEQ ID NO: 1618468 - protein, 12 aa, Staphylococcus aureus
DTFKQEMGETGR

SEQ ID NO: 1618469 - protein, 10 aa, Staphylococcus aureus
DTLQKSKGKL

SEQ ID NO: 1618470 - protein, 13 aa, Staphylococcus aureus
DTRDFDTDKGGQC

SEQ ID NO: 1618471 - protein, 12 aa, Staphylococcus aureus
DTRNFDTDKGGQ

SEQ ID NO: 1618472 - protein, 16 aa, Staphylococcus aureus
DTSTTNYYRGQANDWP

SEQ ID NO: 1618473 - protein, 4 aa, Staphylococcus aureus
DVEV

SEQ ID NO: 1618474 - protein, 11 aa, Staphylococcus aureus
DVKDDDNRNAY

SEQ ID NO: 1618475 - protein, 7 aa, Staphylococcus aureus
DWSPKTI

SEQ ID NO: 1618476 - protein, 5 aa, Staphylococcus aureus
DYDPN

SEQ ID NO: 1618477 - protein, 10 aa, Staphylococcus aureus
EAAKGYSAEQ

SEQ ID NO: 1618478 - protein, 7 aa, Staphylococcus aureus
EADSQSI

SEQ ID NO: 1618479 - protein, 4 aa, Staphylococcus aureus
EATN

SEQ ID NO: 1618480 - protein, 14 aa, Staphylococcus aureus
EAYPSIKARGGGYQ

SEQ ID NO: 1618481 - protein, 21 aa, Staphylococcus aureus
EDAKEKANQKIKAATKEADDI

SEQ ID NO: 1618482 - protein, 7 aa, Staphylococcus aureus
EDDQHIR

SEQ ID NO: 1618483 - protein, 6 aa, Staphylococcus aureus
EDENTG

SEQ ID NO: 1618484 - protein, 9 aa, Staphylococcus aureus
EDQYPETEL

SEQ ID NO: 1618485 - protein, 53 aa, Staphylococcus aureus
EDSSMNEIEKQNAEITENVQNEAAESKQNVEEKTIENVNPKKQTEKVSTLSKR

SEQ ID NO: 1618486 - protein, 5 aa, Staphylococcus aureus
EEAEF

SEQ ID NO: 1618487 - protein, 12 aa, Staphylococcus aureus
EEAVEKAKELNS

SEQ ID NO: 1618488 - protein, 11 aa, Staphylococcus aureus
EEEGDSIGQHP

SEQ ID NO: 1618489 - protein, 6 aa, Staphylococcus aureus
EEHPEF

SEQ ID NO: 1618490 - protein, 24 aa, Staphylococcus aureus
EEHPEYKTVDSPTVRVGGEAQASF

SEQ ID NO: 1618491 - protein, 25 aa, Staphylococcus aureus
EEHPEYKTVDSPTVRVGGEAQASFN

SEQ ID NO: 1618492 - protein, 5 aa, Staphylococcus aureus
EEKDC

SEQ ID NO: 1618493 - protein, 9 aa, Staphylococcus aureus
EENAQANAF

SEQ ID NO: 1618494 - protein, 12 aa, Staphylococcus aureus
EENEVKKSRLDS

SEQ ID NO: 1618495 - protein, 16 aa, Staphylococcus aureus
EENTDEQDRLINLVMR

SEQ ID NO: 1618496 - protein, 7 aa, Staphylococcus aureus
EEPPSLK

SEQ ID NO: 1618497 - protein, 54 aa, Staphylococcus aureus
EESQDDNQLENEQVDQSTSSSVSEVSDITEESEETTHQNNTSGQQDNDDQQKDL

SEQ ID NO: 1618498 - protein, 11 aa, Staphylococcus aureus
EEVKETSADLT

SEQ ID NO: 1618499 - protein, 15 aa, Staphylococcus aureus
EGFEGQTASSVKNYS

SEQ ID NO: 1618500 - protein, 5 aa, Staphylococcus aureus
EGHIY

SEQ ID NO: 1618501 - protein, 4 aa, Staphylococcus aureus
EGKS

SEQ ID NO: 1618502 - protein, 16 aa, Staphylococcus aureus
EGNEKMSKSKGNVINP

SEQ ID NO: 1618503 - protein, 5 aa, Staphylococcus aureus
EGNEV

SEQ ID NO: 1618504 - protein, 10 aa, Staphylococcus aureus
EGQVDASDIH

SEQ ID NO: 1618505 - protein, 8 aa, Staphylococcus aureus
EIANGTKS

SEQ ID NO: 1618506 - protein, 15 aa, Staphylococcus aureus
EIDENTTSHHLSNQQ

SEQ ID NO: 1618507 - protein, 22 aa, Staphylococcus aureus
EISSIRTNGQGLKQSNGNVNLS

SEQ ID NO: 1618508 - protein, 7 aa, Staphylococcus aureus
EIYGDGY

SEQ ID NO: 1618509 - protein, 46 aa, Staphylococcus aureus
EKAEVDSEYATTDNEEHIQEQSNQDKSYFDSESIGNQSGGVRQREP

SEQ ID NO: 1618510 - protein, 7 aa, Staphylococcus aureus
EKDAPRA

SEQ ID NO: 1618511 - protein, 8 aa, Staphylococcus aureus
EKPGINGK

SEQ ID NO: 1618512 - protein, 9 aa, Staphylococcus aureus
EKQSSKVGR

SEQ ID NO: 1618513 - protein, 7 aa, Staphylococcus aureus
EKVTEED

SEQ ID NO: 1618514 - protein, 25 aa, Staphylococcus aureus
ELAEHTSKRERRAIESERDTDELKK

SEQ ID NO: 1618515 - protein, 15 aa, Staphylococcus aureus
ELDSQTGHVSLGKNE

SEQ ID NO: 1618516 - protein, 30 aa, Staphylococcus aureus
ELKEKALSDGQISENERKEIEKLENQRRDI

SEQ ID NO: 1618517 - protein, 5 aa, Staphylococcus aureus
EMEDL

SEQ ID NO: 1618518 - protein, 7 aa, Staphylococcus aureus
ENAMQRR

SEQ ID NO: 1618519 - protein, 14 aa, Staphylococcus aureus
ENANNNDLNNASIQ

SEQ ID NO: 1618520 - protein, 10 aa, Staphylococcus aureus
ENEEGSYSDR

SEQ ID NO: 1618521 - protein, 18 aa, Staphylococcus aureus
ENIQGAKDYHEGKADHIN

SEQ ID NO: 1618522 - protein, 7 aa, Staphylococcus aureus
ENKGCPW

SEQ ID NO: 1618523 - protein, 8 aa, Staphylococcus aureus
ENKKPNHY

SEQ ID NO: 1618524 - protein, 4 aa, Staphylococcus aureus
ENST

SEQ ID NO: 1618525 - protein, 6 aa, Staphylococcus aureus
EPATTG

SEQ ID NO: 1618526 - protein, 7 aa, Staphylococcus aureus
EPATTGG

SEQ ID NO: 1618527 - protein, 4 aa, Staphylococcus aureus
EPKC

SEQ ID NO: 1618528 - protein, 5 aa, Staphylococcus aureus
EPSNL

SEQ ID NO: 1618529 - protein, 7 aa, Staphylococcus aureus
EPYTEDS

SEQ ID NO: 1618530 - protein, 15 aa, Staphylococcus aureus
EQDEADYQTERSEQL

SEQ ID NO: 1618531 - protein, 5 aa, Staphylococcus aureus
EQDNH

SEQ ID NO: 1618532 - protein, 6 aa, Staphylococcus aureus
EQIKEN

SEQ ID NO: 1618533 - protein, 11 aa, Staphylococcus aureus
EQKTSIKPDIV

SEQ ID NO: 1618534 - protein, 15 aa, Staphylococcus aureus
EQNGKMLEVLSNFKY

SEQ ID NO: 1618535 - protein, 8 aa, Staphylococcus aureus
EQQPEIDE

SEQ ID NO: 1618536 - protein, 7 aa, Staphylococcus aureus
EQSLSAN

SEQ ID NO: 1618537 - protein, 10 aa, Staphylococcus aureus
EQSTMNESRY

SEQ ID NO: 1618538 - protein, 13 aa, Staphylococcus aureus
EQTARTIKTYQQP

SEQ ID NO: 1618539 - protein, 20 aa, Staphylococcus aureus
ERANKKGLRITGADSDLNDL

SEQ ID NO: 1618540 - protein, 9 aa, Staphylococcus aureus
ERAQTVAEH

SEQ ID NO: 1618541 - protein, 7 aa, Staphylococcus aureus
ERYGKQN

SEQ ID NO: 1618542 - protein, 7 aa, Staphylococcus aureus
ERYKGEL

SEQ ID NO: 1618543 - protein, 6 aa, Staphylococcus aureus
ESDDIY

SEQ ID NO: 1618544 - protein, 11 aa, Staphylococcus aureus
ESFNDHTKLGK

SEQ ID NO: 1618545 - protein, 7 aa, Staphylococcus aureus
ESGDTHA

SEQ ID NO: 1618546 - protein, 8 aa, Staphylococcus aureus
ESKDIDKA

SEQ ID NO: 1618547 - protein, 14 aa, Staphylococcus aureus
ESQKTGTRKTRKDA

SEQ ID NO: 1618548 - protein, 6 aa, Staphylococcus aureus
ESTAHR

SEQ ID NO: 1618549 - protein, 10 aa, Staphylococcus aureus
ESTNKNTRDI

SEQ ID NO: 1618550 - protein, 6 aa, Staphylococcus aureus
ESVTER

SEQ ID NO: 1618551 - protein, 10 aa, Staphylococcus aureus
ETEKSKASNG

SEQ ID NO: 1618552 - protein, 4 aa, Staphylococcus aureus
ETMG

SEQ ID NO: 1618553 - protein, 7 aa, Staphylococcus aureus
ETRVDKR

SEQ ID NO: 1618554 - protein, 12 aa, Staphylococcus aureus
EVKKENAQIENR

SEQ ID NO: 1618555 - protein, 5 aa, Staphylococcus aureus
EVPNS

SEQ ID NO: 1618556 - protein, 8 aa, Staphylococcus aureus
EVPTGEKS

SEQ ID NO: 1618557 - protein, 5 aa, Staphylococcus aureus
EVRYD

SEQ ID NO: 1618558 - protein, 14 aa, Staphylococcus aureus
EYKDEISANPKYEK

SEQ ID NO: 1618559 - protein, 8 aa, Staphylococcus aureus
EYSRETME

SEQ ID NO: 1618560 - protein, 10 aa, Staphylococcus aureus
FGSENNNIKT

SEQ ID NO: 1618561 - protein, 12 aa, Staphylococcus aureus
FGTGKTTFLTKD

SEQ ID NO: 1618562 - protein, 7 aa, Staphylococcus aureus
FHENDDI

SEQ ID NO: 1618563 - protein, 9 aa, Staphylococcus aureus
FNKKEGMTL

SEQ ID NO: 1618564 - protein, 17 aa, Staphylococcus aureus
FPGGKRERGESSAEAIT

SEQ ID NO: 1618565 - protein, 9 aa, Staphylococcus aureus
FSEYKKDAL

SEQ ID NO: 1618566 - protein, 4 aa, Staphylococcus aureus
FSLD

SEQ ID NO: 1618567 - protein, 12 aa, Staphylococcus aureus
FSPEYVAEYLTK

SEQ ID NO: 1618568 - protein, 17 aa, Staphylococcus aureus
FSYNEENNAIEISEKDD

SEQ ID NO: 1618569 - protein, 9 aa, Staphylococcus aureus
FTQPSGEAA

SEQ ID NO: 1618570 - protein, 12 aa, Staphylococcus aureus
FTTNKNRARVSD

SEQ ID NO: 1618571 - protein, 20 aa, Staphylococcus aureus
GAIKETTEISSIKKPATTHT

SEQ ID NO: 1618572 - protein, 11 aa, Staphylococcus aureus
GAISRQEASKD

SEQ ID NO: 1618573 - protein, 8 aa, Staphylococcus aureus
GAKAAGKD

SEQ ID NO: 1618574 - protein, 5 aa, Staphylococcus aureus
GANEF

SEQ ID NO: 1618575 - protein, 12 aa, Staphylococcus aureus
GAQNEDEVRERG

SEQ ID NO: 1618576 - protein, 11 aa, Staphylococcus aureus
GASGKSNYNGI

SEQ ID NO: 1618577 - protein, 10 aa, Staphylococcus aureus
GASGRSNYNG

SEQ ID NO: 1618578 - protein, 15 aa, Staphylococcus aureus
GDDIKEKDSQLNEID

SEQ ID NO: 1618579 - protein, 15 aa, Staphylococcus aureus
GDETGTISNIQKDKL

SEQ ID NO: 1618580 - protein, 6 aa, Staphylococcus aureus
GDFEVS

SEQ ID NO: 1618581 - protein, 7 aa, Staphylococcus aureus
GDGRNNV

SEQ ID NO: 1618582 - protein, 15 aa, Staphylococcus aureus
GDNGTENVNKKGGKR

SEQ ID NO: 1618583 - protein, 8 aa, Staphylococcus aureus
GDNSADIA

SEQ ID NO: 1618584 - protein, 10 aa, Staphylococcus aureus
GDSEDTVQAE

SEQ ID NO: 1618585 - protein, 20 aa, Staphylococcus aureus
GEKFPESAAITDEVEKEIEE

SEQ ID NO: 1618586 - protein, 14 aa, Staphylococcus aureus
GEPINDGKVGPITR

SEQ ID NO: 1618587 - protein, 7 aa, Staphylococcus aureus
GEQLGDE

SEQ ID NO: 1618588 - protein, 7 aa, Staphylococcus aureus
GEWEEKK

SEQ ID NO: 1618589 - protein, 9 aa, Staphylococcus aureus
GGHSNDADI

SEQ ID NO: 1618590 - protein, 15 aa, Staphylococcus aureus
GGYKDYEAKNFNSAP

SEQ ID NO: 1618591 - protein, 14 aa, Staphylococcus aureus
GHAKEDIQLQDSDV

SEQ ID NO: 1618592 - protein, 13 aa, Staphylococcus aureus
GIAFNSAGENLAY

SEQ ID NO: 1618593 - protein, 18 aa, Staphylococcus aureus
GKAFPGQPSIAHDSDIEG

SEQ ID NO: 1618594 - protein, 10 aa, Staphylococcus aureus
GKIEEGESPV

SEQ ID NO: 1618595 - protein, 8 aa, Staphylococcus aureus
GKINQNLS

SEQ ID NO: 1618596 - protein, 7 aa, Staphylococcus aureus
GKIREIS

SEQ ID NO: 1618597 - protein, 8 aa, Staphylococcus aureus
GKKRIDVP

SEQ ID NO: 1618598 - protein, 4 aa, Staphylococcus aureus
GKKS

SEQ ID NO: 1618599 - protein, 23 aa, Staphylococcus aureus
GKLEDDENRVEAAKRELEEETGY

SEQ ID NO: 1618600 - protein, 9 aa, Staphylococcus aureus
GKNGAGKST

SEQ ID NO: 1618601 - protein, 10 aa, Staphylococcus aureus
GKNTNQNPDA

SEQ ID NO: 1618602 - protein, 5 aa, Staphylococcus aureus
GKRLD

SEQ ID NO: 1618603 - protein, 7 aa, Staphylococcus aureus
GKSISTI

SEQ ID NO: 1618604 - protein, 6 aa, Staphylococcus aureus
GKSTAD

SEQ ID NO: 1618605 - protein, 5 aa, Staphylococcus aureus
GKVKN

SEQ ID NO: 1618606 - protein, 9 aa, Staphylococcus aureus
GKVNQAKQL

SEQ ID NO: 1618607 - protein, 10 aa, Staphylococcus aureus
GLAGFTASSV

SEQ ID NO: 1618608 - protein, 13 aa, Staphylococcus aureus
GLNKGKEYFGSGS

SEQ ID NO: 1618609 - protein, 4 aa, Staphylococcus aureus
GLPN

SEQ ID NO: 1618610 - protein, 9 aa, Staphylococcus aureus
GLPNDPEMT

SEQ ID NO: 1618611 - protein, 12 aa, Staphylococcus aureus
GNASDELKQYAD

SEQ ID NO: 1618612 - protein, 9 aa, Staphylococcus aureus
GNHELKDTN

SEQ ID NO: 1618613 - protein, 16 aa, Staphylococcus aureus
GNRNYNVPKQEGTATR

SEQ ID NO: 1618614 - protein, 6 aa, Staphylococcus aureus
GPNEDF

SEQ ID NO: 1618615 - protein, 5 aa, Staphylococcus aureus
GPTPQ

SEQ ID NO: 1618616 - protein, 10 aa, Staphylococcus aureus
GQKIETSKAT

SEQ ID NO: 1618617 - protein, 10 aa, Staphylococcus aureus
GQSRDIKQKQ

SEQ ID NO: 1618618 - protein, 10 aa, Staphylococcus aureus
GQSREIKQKQ

SEQ ID NO: 1618619 - protein, 5 aa, Staphylococcus aureus
GRPDL

SEQ ID NO: 1618620 - protein, 7 aa, Staphylococcus aureus
GSAAHQL

SEQ ID NO: 1618621 - protein, 10 aa, Staphylococcus aureus
GSAAKGYASL

SEQ ID NO: 1618622 - protein, 10 aa, Staphylococcus aureus
GSGGTYTGTA

SEQ ID NO: 1618623 - protein, 5 aa, Staphylococcus aureus
GSHGV

SEQ ID NO: 1618624 - protein, 6 aa, Staphylococcus aureus
GSKPDA

SEQ ID NO: 1618625 - protein, 17 aa, Staphylococcus aureus
GSKQELENQINEETSTL

SEQ ID NO: 1618626 - protein, 15 aa, Staphylococcus aureus
GSKQELENQINEETT

SEQ ID NO: 1618627 - protein, 10 aa, Staphylococcus aureus
GSYIEKDNQI

SEQ ID NO: 1618628 - protein, 8 aa, Staphylococcus aureus
GTDITTNG

SEQ ID NO: 1618629 - protein, 12 aa, Staphylococcus aureus
GTDQSLYNLTKE

SEQ ID NO: 1618630 - protein, 8 aa, Staphylococcus aureus
GTGELSPK

SEQ ID NO: 1618631 - protein, 10 aa, Staphylococcus aureus
GTKQNGYHED

SEQ ID NO: 1618632 - protein, 12 aa, Staphylococcus aureus
GTVASRRAQTLS

SEQ ID NO: 1618633 - protein, 6 aa, Staphylococcus aureus
GVNAPP

SEQ ID NO: 1618634 - protein, 5 aa, Staphylococcus aureus
HATDN

SEQ ID NO: 1618635 - protein, 9 aa, Staphylococcus aureus
HDTQRNESN

SEQ ID NO: 1618636 - protein, 12 aa, Staphylococcus aureus
HDVQEESSRRAI

SEQ ID NO: 1618637 - protein, 18 aa, Staphylococcus aureus
HEGINKDKDDEGSTINPT

SEQ ID NO: 1618638 - protein, 11 aa, Staphylococcus aureus
HEIQSKPKQKT

SEQ ID NO: 1618639 - protein, 15 aa, Staphylococcus aureus
HESGGNAGITQSSAL

SEQ ID NO: 1618640 - protein, 8 aa, Staphylococcus aureus
HGDQLENT

SEQ ID NO: 1618641 - protein, 8 aa, Staphylococcus aureus
HGGGHKRQ

SEQ ID NO: 1618642 - protein, 16 aa, Staphylococcus aureus
HHKRNNFKGERQNIEQ

SEQ ID NO: 1618643 - protein, 20 aa, Staphylococcus aureus
HIGGGTGASEGSKATTVTPG

SEQ ID NO: 1618644 - protein, 18 aa, Staphylococcus aureus
HIPNGDAYDMNAEASTYN

SEQ ID NO: 1618645 - protein, 9 aa, Staphylococcus aureus
HKRVDDETY

SEQ ID NO: 1618646 - protein, 8 aa, Staphylococcus aureus
HKSQGSEF

SEQ ID NO: 1618647 - protein, 8 aa, Staphylococcus aureus
HNDEQTPH

SEQ ID NO: 1618648 - protein, 8 aa, Staphylococcus aureus
HNDQSKKP

SEQ ID NO: 1618649 - protein, 8 aa, Staphylococcus aureus
HNPSENVG

SEQ ID NO: 1618650 - protein, 13 aa, Staphylococcus aureus
HPPVAKKEAAEKD

SEQ ID NO: 1618651 - protein, 10 aa, Staphylococcus aureus
HPRKSKCNCP

SEQ ID NO: 1618652 - protein, 7 aa, Staphylococcus aureus
HRKEFEK

SEQ ID NO: 1618653 - protein, 4 aa, Staphylococcus aureus
HRNQ

SEQ ID NO: 1618654 - protein, 5 aa, Staphylococcus aureus
HRQTG

SEQ ID NO: 1618655 - protein, 9 aa, Staphylococcus aureus
HSAKDGRVI

SEQ ID NO: 1618656 - protein, 10 aa, Staphylococcus aureus
HSDEGDASGL

SEQ ID NO: 1618657 - protein, 4 aa, Staphylococcus aureus
HSPT

SEQ ID NO: 1618658 - protein, 12 aa, Staphylococcus aureus
HVADKEQAHSCG

SEQ ID NO: 1618659 - protein, 21 aa, Staphylococcus aureus
IDAENKERQQSDDNYLASGST

SEQ ID NO: 1618660 - protein, 13 aa, Staphylococcus aureus
IDEQGVQCIFAIL

SEQ ID NO: 1618661 - protein, 4 aa, Staphylococcus aureus
IEDA

SEQ ID NO: 1618662 - protein, 4 aa, Staphylococcus aureus
IEDI

SEQ ID NO: 1618663 - protein, 12 aa, Staphylococcus aureus
IEKANKNSNSKD

SEQ ID NO: 1618664 - protein, 41 aa, Staphylococcus aureus
IEKETHKSKTHNIYSNNTNHRAKDSTTDYHKESFKTSEVPS

SEQ ID NO: 1618665 - protein, 8 aa, Staphylococcus aureus
IEPKGDQF

SEQ ID NO: 1618666 - protein, 20 aa, Staphylococcus aureus
IESAQQYNATTISTKWQKIL

SEQ ID NO: 1618667 - protein, 18 aa, Staphylococcus aureus
IGTIGDSVARGSHAKTNF

SEQ ID NO: 1618668 - protein, 12 aa, Staphylococcus aureus
IKDEEKEREKIR

SEQ ID NO: 1618669 - protein, 8 aa, Staphylococcus aureus
IKENRKQF

SEQ ID NO: 1618670 - protein, 11 aa, Staphylococcus aureus
IKNPNKKGHGE

SEQ ID NO: 1618671 - protein, 18 aa, Staphylococcus aureus
IKPLQNDKDSIIDYIKGA

SEQ ID NO: 1618672 - protein, 17 aa, Staphylococcus aureus
IKRKDNKITKDDSNVER

SEQ ID NO: 1618673 - protein, 11 aa, Staphylococcus aureus
IKSLSGGQRQR

SEQ ID NO: 1618674 - protein, 11 aa, Staphylococcus aureus
IKTNAKTTEVV

SEQ ID NO: 1618675 - protein, 12 aa, Staphylococcus aureus
ILSPGDKLYSQR

SEQ ID NO: 1618676 - protein, 31 aa, Staphylococcus aureus
INDYKDGDISYNPNVPSYSAEYQLSNNDYNV

SEQ ID NO: 1618677 - protein, 5 aa, Staphylococcus aureus
INGKF

SEQ ID NO: 1618678 - protein, 8 aa, Staphylococcus aureus
INNSEGGY

SEQ ID NO: 1618679 - protein, 4 aa, Staphylococcus aureus
INNY

SEQ ID NO: 1618680 - protein, 20 aa, Staphylococcus aureus
IPEKELNETKLKAKSLLEVR

SEQ ID NO: 1618681 - protein, 8 aa, Staphylococcus aureus
IPKEERPR

SEQ ID NO: 1618682 - protein, 4 aa, Staphylococcus aureus
IPTE

SEQ ID NO: 1618683 - protein, 9 aa, Staphylococcus aureus
IPTGDPVST

SEQ ID NO: 1618684 - protein, 26 aa, Staphylococcus aureus
IQGEIAKSDPRNNISRKKFHNSIIFN

SEQ ID NO: 1618685 - protein, 36 aa, Staphylococcus aureus
IQPATTTKDDAKQAIATKANERKAAIAQTQEITAEE

SEQ ID NO: 1618686 - protein, 10 aa, Staphylococcus aureus
IQQKEQPLES

SEQ ID NO: 1618687 - protein, 73 aa, Staphylococcus aureus
IQTQARVKPAADREVDNAYNTRKQEIQNSNTSTTEEKEAAYTQLDAKKQEARTNLDAANTNSAVTTAKDNGIA

SEQ ID NO: 1618688 - protein, 10 aa, Staphylococcus aureus
IRYKKTGDLQ

SEQ ID NO: 1618689 - protein, 7 aa, Staphylococcus aureus
ISEETYR

SEQ ID NO: 1618690 - protein, 6 aa, Staphylococcus aureus
ISQREA

SEQ ID NO: 1618691 - protein, 9 aa, Staphylococcus aureus
ISREEQDTF

SEQ ID NO: 1618692 - protein, 52 aa, Staphylococcus aureus
ITDSTQTKMDAYNEVKQAATARKAQNATVSNATDEEVAEADAAVDAAQTEGL

SEQ ID NO: 1618693 - protein, 14 aa, Staphylococcus aureus
ITETGLTAGQQILE

SEQ ID NO: 1618694 - protein, 11 aa, Staphylococcus aureus
ITISGSNKVSF

SEQ ID NO: 1618695 - protein, 5 aa, Staphylococcus aureus
ITPQR

SEQ ID NO: 1618696 - protein, 7 aa, Staphylococcus aureus
ITTTPDA

SEQ ID NO: 1618697 - protein, 5 aa, Staphylococcus aureus
KAAVT

SEQ ID NO: 1618698 - protein, 7 aa, Staphylococcus aureus
KADGATH

SEQ ID NO: 1618699 - protein, 6 aa, Staphylococcus aureus
KAEEAV

SEQ ID NO: 1618700 - protein, 9 aa, Staphylococcus aureus
KAKNDFSNK

SEQ ID NO: 1618701 - protein, 13 aa, Staphylococcus aureus
KALGSSEAKPYLD

SEQ ID NO: 1618702 - protein, 5 aa, Staphylococcus aureus
KANAE

SEQ ID NO: 1618703 - protein, 7 aa, Staphylococcus aureus
KAPKADW

SEQ ID NO: 1618704 - protein, 13 aa, Staphylococcus aureus
KAPNRDPRDEFDT

SEQ ID NO: 1618705 - protein, 6 aa, Staphylococcus aureus
KAQEVN

SEQ ID NO: 1618706 - protein, 6 aa, Staphylococcus aureus
KAQYAR

SEQ ID NO: 1618707 - protein, 10 aa, Staphylococcus aureus
KASERQAKNS

SEQ ID NO: 1618708 - protein, 11 aa, Staphylococcus aureus
KDAEKTNSSSI

SEQ ID NO: 1618709 - protein, 13 aa, Staphylococcus aureus
KDENGNDYPNWEE

SEQ ID NO: 1618710 - protein, 19 aa, Staphylococcus aureus
KDIESGTPTEVLTGENEGY

SEQ ID NO: 1618711 - protein, 9 aa, Staphylococcus aureus
KDSEENEVD

SEQ ID NO: 1618712 - protein, 9 aa, Staphylococcus aureus
KDSSGPYHK

SEQ ID NO: 1618713 - protein, 8 aa, Staphylococcus aureus
KEDAPVLN

SEQ ID NO: 1618714 - protein, 7 aa, Staphylococcus aureus
KEDATAF

SEQ ID NO: 1618715 - protein, 13 aa, Staphylococcus aureus
KEELRDEVDYGGV

SEQ ID NO: 1618716 - protein, 10 aa, Staphylococcus aureus
KELSDIQSNK

SEQ ID NO: 1618717 - protein, 11 aa, Staphylococcus aureus
KENGNKRTTVD

SEQ ID NO: 1618718 - protein, 7 aa, Staphylococcus aureus
KEPYDKH

SEQ ID NO: 1618719 - protein, 8 aa, Staphylococcus aureus
KERTDGLK

SEQ ID NO: 1618720 - protein, 82 aa, Staphylococcus aureus
KFKKEQKNDNKQSTQNNHQKSNNQNQNKGQQKDNKKNQQQNNKGNKGNKKNNRNNKKNNKNNKPQSQPAAPKEIPSKVTYQE

SEQ ID NO: 1618721 - protein, 12 aa, Staphylococcus aureus
KFNTRDKNRFKR

SEQ ID NO: 1618722 - protein, 25 aa, Staphylococcus aureus
KGDIDVTNDATGAMAKDAKSSNAGL

SEQ ID NO: 1618723 - protein, 12 aa, Staphylococcus aureus
KGDYPGDVTPAG

SEQ ID NO: 1618724 - protein, 15 aa, Staphylococcus aureus
KGFVESKENEQYDDL

SEQ ID NO: 1618725 - protein, 5 aa, Staphylococcus aureus
KGITM

SEQ ID NO: 1618726 - protein, 9 aa, Staphylococcus aureus
KGTAKGIGN

SEQ ID NO: 1618727 - protein, 6 aa, Staphylococcus aureus
KGVTND

SEQ ID NO: 1618728 - protein, 11 aa, Staphylococcus aureus
KGYAEENNKSF

SEQ ID NO: 1618729 - protein, 19 aa, Staphylococcus aureus
KGYQQYTAESQIRNATSAS

SEQ ID NO: 1618730 - protein, 7 aa, Staphylococcus aureus
KHIGGTN

SEQ ID NO: 1618731 - protein, 16 aa, Staphylococcus aureus
KIKNENANAASALTDV

SEQ ID NO: 1618732 - protein, 16 aa, Staphylococcus aureus
KIKNENANAATALTDV

SEQ ID NO: 1618733 - protein, 9 aa, Staphylococcus aureus
KKAEAREKS

SEQ ID NO: 1618734 - protein, 14 aa, Staphylococcus aureus
KKAQSTRVKKKGIS

SEQ ID NO: 1618735 - protein, 19 aa, Staphylococcus aureus
KKDEWTAYSDKVKSDLEVP

SEQ ID NO: 1618736 - protein, 6 aa, Staphylococcus aureus
KKENPE

SEQ ID NO: 1618737 - protein, 11 aa, Staphylococcus aureus
KKEQEQTTKSG

SEQ ID NO: 1618738 - protein, 14 aa, Staphylococcus aureus
KKERLKKTEKELLN

SEQ ID NO: 1618739 - protein, 8 aa, Staphylococcus aureus
KKERSLDN

SEQ ID NO: 1618740 - protein, 7 aa, Staphylococcus aureus
KKFPSNL

SEQ ID NO: 1618741 - protein, 10 aa, Staphylococcus aureus
KKGAGEKKVN

SEQ ID NO: 1618742 - protein, 8 aa, Staphylococcus aureus
KKKFDRAK

SEQ ID NO: 1618743 - protein, 12 aa, Staphylococcus aureus
KKKSNANQCPFH

SEQ ID NO: 1618744 - protein, 6 aa, Staphylococcus aureus
KKMESR

SEQ ID NO: 1618745 - protein, 16 aa, Staphylococcus aureus
KKNQSETNARYEEEQE

SEQ ID NO: 1618746 - protein, 6 aa, Staphylococcus aureus
KKQTLE

SEQ ID NO: 1618747 - protein, 8 aa, Staphylococcus aureus
KKTEATVI

SEQ ID NO: 1618748 - protein, 7 aa, Staphylococcus aureus
KKYTERL

SEQ ID NO: 1618749 - protein, 7 aa, Staphylococcus aureus
KLADETG

SEQ ID NO: 1618750 - protein, 13 aa, Staphylococcus aureus
KLIEDEKRLTQSL

SEQ ID NO: 1618751 - protein, 10 aa, Staphylococcus aureus
KLPSYEEQQK

SEQ ID NO: 1618752 - protein, 23 aa, Staphylococcus aureus
KLSKEGKESLTKTQQTLHQKQSD

SEQ ID NO: 1618753 - protein, 8 aa, Staphylococcus aureus
KNAIKNGC

SEQ ID NO: 1618754 - protein, 7 aa, Staphylococcus aureus
KNGVGKT

SEQ ID NO: 1618755 - protein, 9 aa, Staphylococcus aureus
KNHSSNRKR

SEQ ID NO: 1618756 - protein, 14 aa, Staphylococcus aureus
KNKDKVSLTMIDPH

SEQ ID NO: 1618757 - protein, 10 aa, Staphylococcus aureus
KNNKAKNIGV

SEQ ID NO: 1618758 - protein, 12 aa, Staphylococcus aureus
KNRQHETISHTT

SEQ ID NO: 1618759 - protein, 5 aa, Staphylococcus aureus
KNTQA

SEQ ID NO: 1618760 - protein, 7 aa, Staphylococcus aureus
KNTYGTG

SEQ ID NO: 1618761 - protein, 5 aa, Staphylococcus aureus
KNVSA

SEQ ID NO: 1618762 - protein, 16 aa, Staphylococcus aureus
KNYKPQNEKQVHAKQT

SEQ ID NO: 1618763 - protein, 5 aa, Staphylococcus aureus
KPIQQ

SEQ ID NO: 1618764 - protein, 7 aa, Staphylococcus aureus
KPNYAEL

SEQ ID NO: 1618765 - protein, 6 aa, Staphylococcus aureus
KQGNAV

SEQ ID NO: 1618766 - protein, 4 aa, Staphylococcus aureus
KQGW

SEQ ID NO: 1618767 - protein, 8 aa, Staphylococcus aureus
KQHRSSDL

SEQ ID NO: 1618768 - protein, 9 aa, Staphylococcus aureus
KQSDLPSGY

SEQ ID NO: 1618769 - protein, 10 aa, Staphylococcus aureus
KQYKSSDFKL

SEQ ID NO: 1618770 - protein, 9 aa, Staphylococcus aureus
KRIDSAEEI

SEQ ID NO: 1618771 - protein, 8 aa, Staphylococcus aureus
KRKGNLVT

SEQ ID NO: 1618772 - protein, 6 aa, Staphylococcus aureus
KRPMTR

SEQ ID NO: 1618773 - protein, 19 aa, Staphylococcus aureus
KRSQDVGITSNAASNVSDV

SEQ ID NO: 1618774 - protein, 6 aa, Staphylococcus aureus
KSAGLK

SEQ ID NO: 1618775 - protein, 10 aa, Staphylococcus aureus
KSCKEEALSK

SEQ ID NO: 1618776 - protein, 7 aa, Staphylococcus aureus
KSDNPRF

SEQ ID NO: 1618777 - protein, 15 aa, Staphylococcus aureus
KSGDSLMDNNTKQNL

SEQ ID NO: 1618778 - protein, 4 aa, Staphylococcus aureus
KSKS

SEQ ID NO: 1618779 - protein, 8 aa, Staphylococcus aureus
KSNPNGDL

SEQ ID NO: 1618780 - protein, 6 aa, Staphylococcus aureus
KSQEGV

SEQ ID NO: 1618781 - protein, 15 aa, Staphylococcus aureus
KSSMTTRALTSGSAI

SEQ ID NO: 1618782 - protein, 11 aa, Staphylococcus aureus
KSVDTTGAGDA

SEQ ID NO: 1618783 - protein, 7 aa, Staphylococcus aureus
KSVRHQL

SEQ ID NO: 1618784 - protein, 7 aa, Staphylococcus aureus
KTDKKYI

SEQ ID NO: 1618785 - protein, 9 aa, Staphylococcus aureus
KTGSYRSAT

SEQ ID NO: 1618786 - protein, 9 aa, Staphylococcus aureus
KTHTRSANM

SEQ ID NO: 1618787 - protein, 54 aa, Staphylococcus aureus
KTNKKDTHENEVESSDEEIYQSEDNHQEHKQNHEHVQDKDKEESKFKKLMKSLF

SEQ ID NO: 1618788 - protein, 16 aa, Staphylococcus aureus
KTSTGFAGGGATAEDV

SEQ ID NO: 1618789 - protein, 7 aa, Staphylococcus aureus
KTTQDAM

SEQ ID NO: 1618790 - protein, 16 aa, Staphylococcus aureus
KTYTSKDKKSQIEVRK

SEQ ID NO: 1618791 - protein, 4 aa, Staphylococcus aureus
KVEM

SEQ ID NO: 1618792 - protein, 8 aa, Staphylococcus aureus
KVKSDNQV

SEQ ID NO: 1618793 - protein, 6 aa, Staphylococcus aureus
KVQQSK

SEQ ID NO: 1618794 - protein, 13 aa, Staphylococcus aureus
KYAELKKNDTKHE

SEQ ID NO: 1618795 - protein, 5 aa, Staphylococcus aureus
KYDED

SEQ ID NO: 1618796 - protein, 9 aa, Staphylococcus aureus
KYEKQLNDI

SEQ ID NO: 1618797 - protein, 6 aa, Staphylococcus aureus
KYKSDT

SEQ ID NO: 1618798 - protein, 18 aa, Staphylococcus aureus
LAAETIERSMDEGDVAPY

SEQ ID NO: 1618799 - protein, 7 aa, Staphylococcus aureus
LANKGTK

SEQ ID NO: 1618800 - protein, 12 aa, Staphylococcus aureus
LDKTQTNTEVDE

SEQ ID NO: 1618801 - protein, 5 aa, Staphylococcus aureus
LDNNA

SEQ ID NO: 1618802 - protein, 7 aa, Staphylococcus aureus
LEIPTKP

SEQ ID NO: 1618803 - protein, 12 aa, Staphylococcus aureus
LERGKTVTKDID

SEQ ID NO: 1618804 - protein, 13 aa, Staphylococcus aureus
LEYEEKRQEEELL

SEQ ID NO: 1618805 - protein, 7 aa, Staphylococcus aureus
LGEDDEY

SEQ ID NO: 1618806 - protein, 11 aa, Staphylococcus aureus
LGRQTDGPYSD

SEQ ID NO: 1618807 - protein, 6 aa, Staphylococcus aureus
LKPVND

SEQ ID NO: 1618808 - protein, 21 aa, Staphylococcus aureus
LKQEPRANTQVAERILQEIRQ

SEQ ID NO: 1618809 - protein, 11 aa, Staphylococcus aureus
LKSKKADELLD

SEQ ID NO: 1618810 - protein, 8 aa, Staphylococcus aureus
LNDEENGQ

SEQ ID NO: 1618811 - protein, 4 aa, Staphylococcus aureus
LNEK

SEQ ID NO: 1618812 - protein, 15 aa, Staphylococcus aureus
LNNQSQQTKHQLKDV

SEQ ID NO: 1618813 - protein, 11 aa, Staphylococcus aureus
LPDDTQQITDI

SEQ ID NO: 1618814 - protein, 8 aa, Staphylococcus aureus
LPEDAGER

SEQ ID NO: 1618815 - protein, 75 aa, Staphylococcus aureus
LPKNDRSQRPARGKTIQAKTRGKSLDKSKSDDKGHKKKGKQRKGKNQRKNDKSGNSKHKPFYKDKSVKKKARRKK

SEQ ID NO: 1618816 - protein, 4 aa, Staphylococcus aureus
LPSS

SEQ ID NO: 1618817 - protein, 9 aa, Staphylococcus aureus
LPTKNDSDF

SEQ ID NO: 1618818 - protein, 4 aa, Staphylococcus aureus
LPVP

SEQ ID NO: 1618819 - protein, 7 aa, Staphylococcus aureus
LQKELGK

SEQ ID NO: 1618820 - protein, 10 aa, Staphylococcus aureus
LQKKQEFNGV

SEQ ID NO: 1618821 - protein, 9 aa, Staphylococcus aureus
LREVSGQPY

SEQ ID NO: 1618822 - protein, 6 aa, Staphylococcus aureus
LSEDNE

SEQ ID NO: 1618823 - protein, 8 aa, Staphylococcus aureus
LSEKSGEL

SEQ ID NO: 1618824 - protein, 9 aa, Staphylococcus aureus
LSERIQDES

SEQ ID NO: 1618825 - protein, 14 aa, Staphylococcus aureus
LSKEHGQVKEKYSG

SEQ ID NO: 1618826 - protein, 6 aa, Staphylococcus aureus
LSNEQE

SEQ ID NO: 1618827 - protein, 4 aa, Staphylococcus aureus
LSPV

SEQ ID NO: 1618828 - protein, 7 aa, Staphylococcus aureus
LTDNNDI

SEQ ID NO: 1618829 - protein, 8 aa, Staphylococcus aureus
LVPTTGKY

SEQ ID NO: 1618830 - protein, 6 aa, Staphylococcus aureus
LVTGKN

SEQ ID NO: 1618831 - protein, 16 aa, Staphylococcus aureus
LYGNQSRTTDNRGSVP

SEQ ID NO: 1618832 - protein, 12 aa, Staphylococcus aureus
LYNSRKKYKQDV

SEQ ID NO: 1618833 - protein, 4 aa, Staphylococcus aureus
MAEK

SEQ ID NO: 1618834 - protein, 6 aa, Staphylococcus aureus
MDPEQV

SEQ ID NO: 1618835 - protein, 17 aa, Staphylococcus aureus
MKEDKDRLSGEDTREGM

SEQ ID NO: 1618836 - protein, 10 aa, Staphylococcus aureus
MKQNAAGVDV

SEQ ID NO: 1618837 - protein, 19 aa, Staphylococcus aureus
MNDSTTEEQQAAKDKVDQA

SEQ ID NO: 1618838 - protein, 4 aa, Staphylococcus aureus
MPKQ

SEQ ID NO: 1618839 - protein, 12 aa, Staphylococcus aureus
MQEETLSQSKIG

SEQ ID NO: 1618840 - protein, 4 aa, Staphylococcus aureus
MSNT

SEQ ID NO: 1618841 - protein, 10 aa, Staphylococcus aureus
MSSTKNKIAG

SEQ ID NO: 1618842 - protein, 23 aa, Staphylococcus aureus
NADIDNAAANNDVDNAKTTNEAT

SEQ ID NO: 1618843 - protein, 5 aa, Staphylococcus aureus
NANID

SEQ ID NO: 1618844 - protein, 7 aa, Staphylococcus aureus
NAQKENI

SEQ ID NO: 1618845 - protein, 7 aa, Staphylococcus aureus
NAQPEVT

SEQ ID NO: 1618846 - protein, 5 aa, Staphylococcus aureus
NAREH

SEQ ID NO: 1618847 - protein, 14 aa, Staphylococcus aureus
NCDSRTVKKYYEAG

SEQ ID NO: 1618848 - protein, 8 aa, Staphylococcus aureus
NDDEWRKG

SEQ ID NO: 1618849 - protein, 8 aa, Staphylococcus aureus
NDEITTVE

SEQ ID NO: 1618850 - protein, 5 aa, Staphylococcus aureus
NDEKL

SEQ ID NO: 1618851 - protein, 7 aa, Staphylococcus aureus
NDKEADY

SEQ ID NO: 1618852 - protein, 4 aa, Staphylococcus aureus
NDTT

SEQ ID NO: 1618853 - protein, 7 aa, Staphylococcus aureus
NDYPTTK

SEQ ID NO: 1618854 - protein, 13 aa, Staphylococcus aureus
NEAVQEAGKISEG

SEQ ID NO: 1618855 - protein, 11 aa, Staphylococcus aureus
NEFGIKGKNDW

SEQ ID NO: 1618856 - protein, 11 aa, Staphylococcus aureus
NEGYEKAGPIH

SEQ ID NO: 1618857 - protein, 5 aa, Staphylococcus aureus
NEPQG

SEQ ID NO: 1618858 - protein, 11 aa, Staphylococcus aureus
NEQSDDPREIE

SEQ ID NO: 1618859 - protein, 6 aa, Staphylococcus aureus
NESIDT

SEQ ID NO: 1618860 - protein, 7 aa, Staphylococcus aureus
NESPQSD

SEQ ID NO: 1618861 - protein, 14 aa, Staphylococcus aureus
NETQDNVKQPAHYT

SEQ ID NO: 1618862 - protein, 8 aa, Staphylococcus aureus
NEVGEAAQ

SEQ ID NO: 1618863 - protein, 12 aa, Staphylococcus aureus
NFKPGDKLPNVT

SEQ ID NO: 1618864 - protein, 22 aa, Staphylococcus aureus
NGEEINDQPSNFKDRAKRFFKG

SEQ ID NO: 1618865 - protein, 5 aa, Staphylococcus aureus
NGENW

SEQ ID NO: 1618866 - protein, 4 aa, Staphylococcus aureus
NGEV

SEQ ID NO: 1618867 - protein, 31 aa, Staphylococcus aureus
NGGAPTASNESAASATNEEVAETPAAPAAVS

SEQ ID NO: 1618868 - protein, 39 aa, Staphylococcus aureus
NGGTTAQSDKQVQTQSTSVDRSSNQSSEDDSENSTIPVN

SEQ ID NO: 1618869 - protein, 6 aa, Staphylococcus aureus
NGKRDI

SEQ ID NO: 1618870 - protein, 12 aa, Staphylococcus aureus
NGLHQQKNFDGN

SEQ ID NO: 1618871 - protein, 12 aa, Staphylococcus aureus
NGNKRDKYESYI

SEQ ID NO: 1618872 - protein, 18 aa, Staphylococcus aureus
NHDLPHKSIDKSKGESYF

SEQ ID NO: 1618873 - protein, 21 aa, Staphylococcus aureus
NHKQQAKEKQDTGDSASEDVQ

SEQ ID NO: 1618874 - protein, 11 aa, Staphylococcus aureus
NHKTYKNLGKV

SEQ ID NO: 1618875 - protein, 7 aa, Staphylococcus aureus
NHTAEQS

SEQ ID NO: 1618876 - protein, 6 aa, Staphylococcus aureus
NHTSDL

SEQ ID NO: 1618877 - protein, 8 aa, Staphylococcus aureus
NIDRGRTD

SEQ ID NO: 1618878 - protein, 9 aa, Staphylococcus aureus
NIDTPKNID

SEQ ID NO: 1618879 - protein, 4 aa, Staphylococcus aureus
NIEA

SEQ ID NO: 1618880 - protein, 5 aa, Staphylococcus aureus
NIEAC

SEQ ID NO: 1618881 - protein, 8 aa, Staphylococcus aureus
NIKNQQYR

SEQ ID NO: 1618882 - protein, 6 aa, Staphylococcus aureus
NIPKES

SEQ ID NO: 1618883 - protein, 11 aa, Staphylococcus aureus
NIPNNLSSNFS

SEQ ID NO: 1618884 - protein, 5 aa, Staphylococcus aureus
NIVDD

SEQ ID NO: 1618885 - protein, 7 aa, Staphylococcus aureus
NKDEAAF

SEQ ID NO: 1618886 - protein, 6 aa, Staphylococcus aureus
NKEELE

SEQ ID NO: 1618887 - protein, 7 aa, Staphylococcus aureus
NKLEGQN

SEQ ID NO: 1618888 - protein, 6 aa, Staphylococcus aureus
NKMGDF

SEQ ID NO: 1618889 - protein, 9 aa, Staphylococcus aureus
NKNDKNYRV

SEQ ID NO: 1618890 - protein, 17 aa, Staphylococcus aureus
NKQTTAQGVTTEKDNGI

SEQ ID NO: 1618891 - protein, 6 aa, Staphylococcus aureus
NKTGHV

SEQ ID NO: 1618892 - protein, 4 aa, Staphylococcus aureus
NLLK

SEQ ID NO: 1618893 - protein, 8 aa, Staphylococcus aureus
NMNGTNYD

SEQ ID NO: 1618894 - protein, 15 aa, Staphylococcus aureus
NNDQNATNEEKEAAI

SEQ ID NO: 1618895 - protein, 4 aa, Staphylococcus aureus
NNHG

SEQ ID NO: 1618896 - protein, 35 aa, Staphylococcus aureus
NNSSQSLEGTFEGKASEAAQQSINKLKNNNENLKQ

SEQ ID NO: 1618897 - protein, 5 aa, Staphylococcus aureus
NPNNS

SEQ ID NO: 1618898 - protein, 8 aa, Staphylococcus aureus
NPSTQQRD

SEQ ID NO: 1618899 - protein, 14 aa, Staphylococcus aureus
NPTQNTYSKEEKQK

SEQ ID NO: 1618900 - protein, 11 aa, Staphylococcus aureus
NQHQEHSNQIE

SEQ ID NO: 1618901 - protein, 8 aa, Staphylococcus aureus
NQPAPPHH

SEQ ID NO: 1618902 - protein, 9 aa, Staphylococcus aureus
NQPEDKYGE

SEQ ID NO: 1618903 - protein, 34 aa, Staphylococcus aureus
NQRERKSRTNDDIDHERTRENYDLKNDKNIDYNE

SEQ ID NO: 1618904 - protein, 5 aa, Staphylococcus aureus
NQTQK

SEQ ID NO: 1618905 - protein, 26 aa, Staphylococcus aureus
NRDKPSEQDSAKDNSVDDQQLEQDRQ

SEQ ID NO: 1618906 - protein, 14 aa, Staphylococcus aureus
NRDNPAKLLPEEEE

SEQ ID NO: 1618907 - protein, 6 aa, Staphylococcus aureus
NRISKT

SEQ ID NO: 1618908 - protein, 15 aa, Staphylococcus aureus
NRRTDHYGADSLKNR

SEQ ID NO: 1618909 - protein, 22 aa, Staphylococcus aureus
NSARPSYSKKDSIEVGVFNHEK

SEQ ID NO: 1618910 - protein, 50 aa, Staphylococcus aureus
NSEDEDMLENTATNDTGASQTTIDDQVEAPMSSNASEEVTSDSTKTDTNV

SEQ ID NO: 1618911 - protein, 9 aa, Staphylococcus aureus
NSMQPSEAL

SEQ ID NO: 1618912 - protein, 5 aa, Staphylococcus aureus
NSNYN

SEQ ID NO: 1618913 - protein, 18 aa, Staphylococcus aureus
NTAVADASRITTNKDGYK

SEQ ID NO: 1618914 - protein, 6 aa, Staphylococcus aureus
NTENIQ

SEQ ID NO: 1618915 - protein, 15 aa, Staphylococcus aureus
NTHIGGKVNRHESDG

SEQ ID NO: 1618916 - protein, 9 aa, Staphylococcus aureus
NTKSDYKKI

SEQ ID NO: 1618917 - protein, 4 aa, Staphylococcus aureus
NTLE

SEQ ID NO: 1618918 - protein, 20 aa, Staphylococcus aureus
NTTKTTVTSTSVFPTKEAAQ

SEQ ID NO: 1618919 - protein, 7 aa, Staphylococcus aureus
NVKTIEH

SEQ ID NO: 1618920 - protein, 8 aa, Staphylococcus aureus
NVRQGLKQ

SEQ ID NO: 1618921 - protein, 14 aa, Staphylococcus aureus
NVTENDNANQSHSV

SEQ ID NO: 1618922 - protein, 9 aa, Staphylococcus aureus
NYSKAQAKK

SEQ ID NO: 1618923 - protein, 4 aa, Staphylococcus aureus
PEHM

SEQ ID NO: 1618924 - protein, 7 aa, Staphylococcus aureus
PENEQLD

SEQ ID NO: 1618925 - protein, 11 aa, Staphylococcus aureus
PEVKPSSEIYG

SEQ ID NO: 1618926 - protein, 4 aa, Staphylococcus aureus
PGAY

SEQ ID NO: 1618927 - protein, 7 aa, Staphylococcus aureus
PGDRKKV

SEQ ID NO: 1618928 - protein, 10 aa, Staphylococcus aureus
PGETEEEFQE

SEQ ID NO: 1618929 - protein, 7 aa, Staphylococcus aureus
PGHPPES

SEQ ID NO: 1618930 - protein, 10 aa, Staphylococcus aureus
PGIPGITSNG

SEQ ID NO: 1618931 - protein, 6 aa, Staphylococcus aureus
PHEGET

SEQ ID NO: 1618932 - protein, 19 aa, Staphylococcus aureus
PISTDNASWGGPQHKEILF

SEQ ID NO: 1618933 - protein, 28 aa, Staphylococcus aureus
PKKLENGRIPVSKSSEKVESDKQKYDKY

SEQ ID NO: 1618934 - protein, 13 aa, Staphylococcus aureus
PKKNENLQRGKEG

SEQ ID NO: 1618935 - protein, 9 aa, Staphylococcus aureus
PKRKKDEYR

SEQ ID NO: 1618936 - protein, 9 aa, Staphylococcus aureus
PKTPDNDNV

SEQ ID NO: 1618937 - protein, 8 aa, Staphylococcus aureus
PLESDSGN

SEQ ID NO: 1618938 - protein, 9 aa, Staphylococcus aureus
PPQPNGVSQ

SEQ ID NO: 1618939 - protein, 328 aa, Staphylococcus aureus
PQKDPNANDTNSGSDNNDATANSNANATPENTGQPNVTESTDNANADTSSTTTNNHNDAATGGTTATSTDNSATGNGTSDKSEVESTNNGTTDKSATETDNATPAESARNNNSTTATNENAPTGSTATVPTTNASTGAASSADSKDNASVNDSKQNAEVNNSAESQSTNGKVAQPKSENKAKDEKDGRDSTNQSMVESTTETLPSADITEPKVPSNTEKDKKESTTNQTDAGQLKSETNVASNEADKSEGNVDTDVSNKPSTSKPSEAKDKATSTEDSQKADMATSDKKDNQAAIGATADVNNKATQNDGANASPATVSNGSNSANQD

SEQ ID NO: 1618940 - protein, 4 aa, Staphylococcus aureus
PQNV

SEQ ID NO: 1618941 - protein, 14 aa, Staphylococcus aureus
PQSPVPINDHGDTV

SEQ ID NO: 1618942 - protein, 17 aa, Staphylococcus aureus
PQSTSDIDVDDDPREDL

SEQ ID NO: 1618943 - protein, 11 aa, Staphylococcus aureus
PRKGYDPTDER

SEQ ID NO: 1618944 - protein, 13 aa, Staphylococcus aureus
PSDQRGKTPNDPL

SEQ ID NO: 1618945 - protein, 5 aa, Staphylococcus aureus
PSEDC

SEQ ID NO: 1618946 - protein, 5 aa, Staphylococcus aureus
PSGQR

SEQ ID NO: 1618947 - protein, 6 aa, Staphylococcus aureus
PSGQRK

SEQ ID NO: 1618948 - protein, 5 aa, Staphylococcus aureus
PSGVG

SEQ ID NO: 1618949 - protein, 6 aa, Staphylococcus aureus
PTDADR

SEQ ID NO: 1618950 - protein, 8 aa, Staphylococcus aureus
PTKVTRSA

SEQ ID NO: 1618951 - protein, 5 aa, Staphylococcus aureus
PTQEQ

SEQ ID NO: 1618952 - protein, 10 aa, Staphylococcus aureus
PTVKPQAKQD

SEQ ID NO: 1618953 - protein, 5 aa, Staphylococcus aureus
PYKRT

SEQ ID NO: 1618954 - protein, 8 aa, Staphylococcus aureus
QAEKDGIS

SEQ ID NO: 1618955 - protein, 7 aa, Staphylococcus aureus
QAENVKN

SEQ ID NO: 1618956 - protein, 12 aa, Staphylococcus aureus
QAIPNINENSPP

SEQ ID NO: 1618957 - protein, 11 aa, Staphylococcus aureus
QDDGYRIGYGG

SEQ ID NO: 1618958 - protein, 9 aa, Staphylococcus aureus
QDVSEDKAN

SEQ ID NO: 1618959 - protein, 13 aa, Staphylococcus aureus
QEDDNSEAMNIED

SEQ ID NO: 1618960 - protein, 4 aa, Staphylococcus aureus
QEDG

SEQ ID NO: 1618961 - protein, 17 aa, Staphylococcus aureus
QEMRNSTDNMVSNAKNN

SEQ ID NO: 1618962 - protein, 5 aa, Staphylococcus aureus
QFDGT

SEQ ID NO: 1618963 - protein, 4 aa, Staphylococcus aureus
QFNP

SEQ ID NO: 1618964 - protein, 6 aa, Staphylococcus aureus
QFNRER

SEQ ID NO: 1618965 - protein, 8 aa, Staphylococcus aureus
QGEKYYQN

SEQ ID NO: 1618966 - protein, 8 aa, Staphylococcus aureus
QGIENLTD

SEQ ID NO: 1618967 - protein, 9 aa, Staphylococcus aureus
QGNMPPSAL

SEQ ID NO: 1618968 - protein, 5 aa, Staphylococcus aureus
QGPTT

SEQ ID NO: 1618969 - protein, 9 aa, Staphylococcus aureus
QKESQAKNI

SEQ ID NO: 1618970 - protein, 11 aa, Staphylococcus aureus
QKGTPIDENVS

SEQ ID NO: 1618971 - protein, 6 aa, Staphylococcus aureus
QKGTPV

SEQ ID NO: 1618972 - protein, 4 aa, Staphylococcus aureus
QKPT

SEQ ID NO: 1618973 - protein, 10 aa, Staphylococcus aureus
QKQQQKQRAL

SEQ ID NO: 1618974 - protein, 7 aa, Staphylococcus aureus
QKQYISK

SEQ ID NO: 1618975 - protein, 9 aa, Staphylococcus aureus
QKSPKDLRM

SEQ ID NO: 1618976 - protein, 6 aa, Staphylococcus aureus
QLEDED

SEQ ID NO: 1618977 - protein, 8 aa, Staphylococcus aureus
QLKKYRGK

SEQ ID NO: 1618978 - protein, 6 aa, Staphylococcus aureus
QLKPGY

SEQ ID NO: 1618979 - protein, 10 aa, Staphylococcus aureus
QLKPSEDSGA

SEQ ID NO: 1618980 - protein, 4 aa, Staphylococcus aureus
QLNW

SEQ ID NO: 1618981 - protein, 11 aa, Staphylococcus aureus
QLPQGAPTSPY

SEQ ID NO: 1618982 - protein, 6 aa, Staphylococcus aureus
QLRKGT

SEQ ID NO: 1618983 - protein, 5 aa, Staphylococcus aureus
QLRNG

SEQ ID NO: 1618984 - protein, 8 aa, Staphylococcus aureus
QLSDSEKL

SEQ ID NO: 1618985 - protein, 10 aa, Staphylococcus aureus
QNDYGASSIS

SEQ ID NO: 1618986 - protein, 5 aa, Staphylococcus aureus
QPQVG

SEQ ID NO: 1618987 - protein, 7 aa, Staphylococcus aureus
QQHHSSI

SEQ ID NO: 1618988 - protein, 8 aa, Staphylococcus aureus
QQHPEDEV

SEQ ID NO: 1618989 - protein, 12 aa, Staphylococcus aureus
QQPDKRSIDSSK

SEQ ID NO: 1618990 - protein, 7 aa, Staphylococcus aureus
QQRNGKV

SEQ ID NO: 1618991 - protein, 15 aa, Staphylococcus aureus
QQSSNIINDTGAGDV

SEQ ID NO: 1618992 - protein, 5 aa, Staphylococcus aureus
QQSYE

SEQ ID NO: 1618993 - protein, 7 aa, Staphylococcus aureus
QRYRKRG

SEQ ID NO: 1618994 - protein, 25 aa, Staphylococcus aureus
QSEDDIVTSSVKSNHPVAQKSNKTI

SEQ ID NO: 1618995 - protein, 7 aa, Staphylococcus aureus
QSELDRV

SEQ ID NO: 1618996 - protein, 57 aa, Staphylococcus aureus
QSEQGRNQHQNDIKPTSKQHQSNINPTSKQHQTNTNNNDNKDNNEKNVNNEKKKTTA

SEQ ID NO: 1618997 - protein, 10 aa, Staphylococcus aureus
QSVENAIRGA

SEQ ID NO: 1618998 - protein, 45 aa, Staphylococcus aureus
QTADATTEEKEQANQQVDAQLTQGNQNIENAKSIDDVNTAKDNAI

SEQ ID NO: 1618999 - protein, 10 aa, Staphylococcus aureus
QTAKSVEAQT

SEQ ID NO: 1619000 - protein, 4 aa, Staphylococcus aureus
QTGG

SEQ ID NO: 1619001 - protein, 5 aa, Staphylococcus aureus
QTIEN

SEQ ID NO: 1619002 - protein, 6 aa, Staphylococcus aureus
QTLQGT

SEQ ID NO: 1619003 - protein, 10 aa, Staphylococcus aureus
QTNSKQGATN

SEQ ID NO: 1619004 - protein, 29 aa, Staphylococcus aureus
RAVTPQNHVTHGPKDSMVRSEGKHSVSSH

SEQ ID NO: 1619005 - protein, 13 aa, Staphylococcus aureus
RDDRARVSVGARS

SEQ ID NO: 1619006 - protein, 11 aa, Staphylococcus aureus
RDFVTDKGGQC

SEQ ID NO: 1619007 - protein, 7 aa, Staphylococcus aureus
RDGRSLP

SEQ ID NO: 1619008 - protein, 5 aa, Staphylococcus aureus
REAGF

SEQ ID NO: 1619009 - protein, 22 aa, Staphylococcus aureus
REQNKEANQHAQQALYKFIKKN

SEQ ID NO: 1619010 - protein, 14 aa, Staphylococcus aureus
REVKKERSRDQGMS

SEQ ID NO: 1619011 - protein, 5 aa, Staphylococcus aureus
RFGNT

SEQ ID NO: 1619012 - protein, 20 aa, Staphylococcus aureus
RGELTQNGFTSLETSEEVSE

SEQ ID NO: 1619013 - protein, 14 aa, Staphylococcus aureus
RGGNHVTSQNPEVN

SEQ ID NO: 1619014 - protein, 6 aa, Staphylococcus aureus
RGQPSL

SEQ ID NO: 1619015 - protein, 5 aa, Staphylococcus aureus
RIATG

SEQ ID NO: 1619016 - protein, 20 aa, Staphylococcus aureus
RKQGGRHKGPPPFTKQDQKV

SEQ ID NO: 1619017 - protein, 4 aa, Staphylococcus aureus
RNDG

SEQ ID NO: 1619018 - protein, 7 aa, Staphylococcus aureus
RNTPNNT

SEQ ID NO: 1619019 - protein, 6 aa, Staphylococcus aureus
RPTELS

SEQ ID NO: 1619020 - protein, 9 aa, Staphylococcus aureus
RRNIQDTED

SEQ ID NO: 1619021 - protein, 9 aa, Staphylococcus aureus
RRPAPARLT

SEQ ID NO: 1619022 - protein, 8 aa, Staphylococcus aureus
RSKETGKI

SEQ ID NO: 1619023 - protein, 9 aa, Staphylococcus aureus
RTEGEQLAD

SEQ ID NO: 1619024 - protein, 10 aa, Staphylococcus aureus
RTEGEQLGDE

SEQ ID NO: 1619025 - protein, 14 aa, Staphylococcus aureus
RVEPLKEEAAIAKE

SEQ ID NO: 1619026 - protein, 13 aa, Staphylococcus aureus
RVYRPTDENDAYA

SEQ ID NO: 1619027 - protein, 14 aa, Staphylococcus aureus
RYDKSKLDLNDKES

SEQ ID NO: 1619028 - protein, 4 aa, Staphylococcus aureus
RYQR

SEQ ID NO: 1619029 - protein, 7 aa, Staphylococcus aureus
RYSPEKQ

SEQ ID NO: 1619030 - protein, 8 aa, Staphylococcus aureus
SADDIDKG

SEQ ID NO: 1619031 - protein, 58 aa, Staphylococcus aureus
SAQSPAIDKVTTEKRISELEHDKRKAVSAEEYKKADDIQKEIKSLQDKLENSNGEHTA

SEQ ID NO: 1619032 - protein, 8 aa, Staphylococcus aureus
SASKGSIQ

SEQ ID NO: 1619033 - protein, 6 aa, Staphylococcus aureus
SDANYR

SEQ ID NO: 1619034 - protein, 7 aa, Staphylococcus aureus
SDDGESI

SEQ ID NO: 1619035 - protein, 9 aa, Staphylococcus aureus
SDGRSKGAT

SEQ ID NO: 1619036 - protein, 9 aa, Staphylococcus aureus
SDIDDVSSI

SEQ ID NO: 1619037 - protein, 10 aa, Staphylococcus aureus
SDIKYKTSKN

SEQ ID NO: 1619038 - protein, 11 aa, Staphylococcus aureus
SDKEKYKTQAE

SEQ ID NO: 1619039 - protein, 17 aa, Staphylococcus aureus
SDSGEGNIEFISIKDIM

SEQ ID NO: 1619040 - protein, 4 aa, Staphylococcus aureus
SDSH

SEQ ID NO: 1619041 - protein, 14 aa, Staphylococcus aureus
SDSIDEAKEVSSKY

SEQ ID NO: 1619042 - protein, 4 aa, Staphylococcus aureus
SEDD

SEQ ID NO: 1619043 - protein, 7 aa, Staphylococcus aureus
SEEGNVD

SEQ ID NO: 1619044 - protein, 21 aa, Staphylococcus aureus
SEMTPAPDCGETSYQGNQRLQ

SEQ ID NO: 1619045 - protein, 12 aa, Staphylococcus aureus
SENKIKDIQIIT

SEQ ID NO: 1619046 - protein, 6 aa, Staphylococcus aureus
SFDDDK

SEQ ID NO: 1619047 - protein, 9 aa, Staphylococcus aureus
SFNKNSNKT

SEQ ID NO: 1619048 - protein, 9 aa, Staphylococcus aureus
SGMNKPDGL

SEQ ID NO: 1619049 - protein, 7 aa, Staphylococcus aureus
SGTGHLS

SEQ ID NO: 1619050 - protein, 4 aa, Staphylococcus aureus
SGWN

SEQ ID NO: 1619051 - protein, 14 aa, Staphylococcus aureus
SGYSGGHADNPTYE

SEQ ID NO: 1619052 - protein, 8 aa, Staphylococcus aureus
SGYTGEDG

SEQ ID NO: 1619053 - protein, 4 aa, Staphylococcus aureus
SIDI

SEQ ID NO: 1619054 - protein, 13 aa, Staphylococcus aureus
SIDPGSDNQYQKD

SEQ ID NO: 1619055 - protein, 5 aa, Staphylococcus aureus
SIELS

SEQ ID NO: 1619056 - protein, 5 aa, Staphylococcus aureus
SITSN

SEQ ID NO: 1619057 - protein, 7 aa, Staphylococcus aureus
SKRNGYQ

SEQ ID NO: 1619058 - protein, 7 aa, Staphylococcus aureus
SKRQLTN

SEQ ID NO: 1619059 - protein, 8 aa, Staphylococcus aureus
SKTEYLPQ

SEQ ID NO: 1619060 - protein, 7 aa, Staphylococcus aureus
SKTVSPG

SEQ ID NO: 1619061 - protein, 14 aa, Staphylococcus aureus
SLNDSNENIKALTK

SEQ ID NO: 1619062 - protein, 10 aa, Staphylococcus aureus
SLNSGTEAVE

SEQ ID NO: 1619063 - protein, 5 aa, Staphylococcus aureus
SLQLG

SEQ ID NO: 1619064 - protein, 26 aa, Staphylococcus aureus
SLTKDKELLDSDKLKDEYEQKKEKMN

SEQ ID NO: 1619065 - protein, 8 aa, Staphylococcus aureus
SLTTDPTM

SEQ ID NO: 1619066 - protein, 8 aa, Staphylococcus aureus
SMQPSEAL

SEQ ID NO: 1619067 - protein, 8 aa, Staphylococcus aureus
SMQPSEEL

SEQ ID NO: 1619068 - protein, 31 aa, Staphylococcus aureus
SNDSNLSSSHDVDESSTKQKHIKNKTTINHN

SEQ ID NO: 1619069 - protein, 10 aa, Staphylococcus aureus
SNFPREVKSH

SEQ ID NO: 1619070 - protein, 5 aa, Staphylococcus aureus
SNISK

SEQ ID NO: 1619071 - protein, 9 aa, Staphylococcus aureus
SNKGPFNDN

SEQ ID NO: 1619072 - protein, 10 aa, Staphylococcus aureus
SNLPGIGPVP

SEQ ID NO: 1619073 - protein, 41 aa, Staphylococcus aureus
SNQNEDTANENRPRTNQPDVATNQAVQTSKPMIRKGPNIKL

SEQ ID NO: 1619074 - protein, 26 aa, Staphylococcus aureus
SNQTNNRTINKNNISENLVDLLKLKE

SEQ ID NO: 1619075 - protein, 6 aa, Staphylococcus aureus
SNVTNR

SEQ ID NO: 1619076 - protein, 9 aa, Staphylococcus aureus
SPGPGHPLD

SEQ ID NO: 1619077 - protein, 6 aa, Staphylococcus aureus
SPNEIN

SEQ ID NO: 1619078 - protein, 7 aa, Staphylococcus aureus
SQKADRT

SEQ ID NO: 1619079 - protein, 5 aa, Staphylococcus aureus
SQLKE

SEQ ID NO: 1619080 - protein, 19 aa, Staphylococcus aureus
SQLNTNKTKKKNTANSSLE

SEQ ID NO: 1619081 - protein, 21 aa, Staphylococcus aureus
SQNEGKSVDALKNSTTSLKNN

SEQ ID NO: 1619082 - protein, 13 aa, Staphylococcus aureus
SSEVKKGESIKTA

SEQ ID NO: 1619083 - protein, 7 aa, Staphylococcus aureus
SSKMYGG

SEQ ID NO: 1619084 - protein, 7 aa, Staphylococcus aureus
STENKTY

SEQ ID NO: 1619085 - protein, 15 aa, Staphylococcus aureus
STFQETRDKSSNMID

SEQ ID NO: 1619086 - protein, 7 aa, Staphylococcus aureus
STGEKQR

SEQ ID NO: 1619087 - protein, 7 aa, Staphylococcus aureus
STKKLSD

SEQ ID NO: 1619088 - protein, 4 aa, Staphylococcus aureus
STKS

SEQ ID NO: 1619089 - protein, 12 aa, Staphylococcus aureus
STNDKKNRKEKI

SEQ ID NO: 1619090 - protein, 8 aa, Staphylococcus aureus
SVTPNRIS

SEQ ID NO: 1619091 - protein, 9 aa, Staphylococcus aureus
SWAKQTGNT

SEQ ID NO: 1619092 - protein, 9 aa, Staphylococcus aureus
SYDLPDEKV

SEQ ID NO: 1619093 - protein, 8 aa, Staphylococcus aureus
SYVNGEEQ

SEQ ID NO: 1619094 - protein, 12 aa, Staphylococcus aureus
TAEENNESSQEL

SEQ ID NO: 1619095 - protein, 6 aa, Staphylococcus aureus
TAVDYK

SEQ ID NO: 1619096 - protein, 8 aa, Staphylococcus aureus
TDPGFNSD

SEQ ID NO: 1619097 - protein, 17 aa, Staphylococcus aureus
TEKDDKLYGRGTTDMKG

SEQ ID NO: 1619098 - protein, 41 aa, Staphylococcus aureus
TESTVEETNIKQNIDDSVEQAEESKGHLQDEAIEETSDENV

SEQ ID NO: 1619099 - protein, 8 aa, Staphylococcus aureus
TEVAERPE

SEQ ID NO: 1619100 - protein, 9 aa, Staphylococcus aureus
TGDNSADIE

SEQ ID NO: 1619101 - protein, 7 aa, Staphylococcus aureus
TGGGIIE

SEQ ID NO: 1619102 - protein, 13 aa, Staphylococcus aureus
THKSNQVNENRIN

SEQ ID NO: 1619103 - protein, 5 aa, Staphylococcus aureus
TIDYA

SEQ ID NO: 1619104 - protein, 11 aa, Staphylococcus aureus
TIEKTSQNAVN

SEQ ID NO: 1619105 - protein, 6 aa, Staphylococcus aureus
TKAHEE

SEQ ID NO: 1619106 - protein, 6 aa, Staphylococcus aureus
TKDGTI

SEQ ID NO: 1619107 - protein, 17 aa, Staphylococcus aureus
TKEEAAQHFKDQDASTH

SEQ ID NO: 1619108 - protein, 6 aa, Staphylococcus aureus
TKEEYE

SEQ ID NO: 1619109 - protein, 10 aa, Staphylococcus aureus
TKGETSGHTQ

SEQ ID NO: 1619110 - protein, 6 aa, Staphylococcus aureus
TKKEAS

SEQ ID NO: 1619111 - protein, 5 aa, Staphylococcus aureus
TLETG

SEQ ID NO: 1619112 - protein, 11 aa, Staphylococcus aureus
TLINSNKANID

SEQ ID NO: 1619113 - protein, 8 aa, Staphylococcus aureus
TLNSPYDL

SEQ ID NO: 1619114 - protein, 5 aa, Staphylococcus aureus
TLPQD

SEQ ID NO: 1619115 - protein, 13 aa, Staphylococcus aureus
TLTKKGWSRIESK

SEQ ID NO: 1619116 - protein, 12 aa, Staphylococcus aureus
TMQNGNEDVKAQ

SEQ ID NO: 1619117 - protein, 9 aa, Staphylococcus aureus
TNDKESLHN

SEQ ID NO: 1619118 - protein, 7 aa, Staphylococcus aureus
TNEKRIK

SEQ ID NO: 1619119 - protein, 8 aa, Staphylococcus aureus
TNFATPGA

SEQ ID NO: 1619120 - protein, 6 aa, Staphylococcus aureus
TNIDDD

SEQ ID NO: 1619121 - protein, 10 aa, Staphylococcus aureus
TNKADISRRQ

SEQ ID NO: 1619122 - protein, 6 aa, Staphylococcus aureus
TNKFND

SEQ ID NO: 1619123 - protein, 39 aa, Staphylococcus aureus
TNTDKHQAKATSAQQGKENKAKQQAKTLPDTGMSHNDDL

SEQ ID NO: 1619124 - protein, 5 aa, Staphylococcus aureus
TPESD

SEQ ID NO: 1619125 - protein, 8 aa, Staphylococcus aureus
TPLNDRDS

SEQ ID NO: 1619126 - protein, 6 aa, Staphylococcus aureus
TPNEYR

SEQ ID NO: 1619127 - protein, 7 aa, Staphylococcus aureus
TQAQTKH

SEQ ID NO: 1619128 - protein, 12 aa, Staphylococcus aureus
TQKKHDAIAIFD

SEQ ID NO: 1619129 - protein, 4 aa, Staphylococcus aureus
TQLT

SEQ ID NO: 1619130 - protein, 5 aa, Staphylococcus aureus
TQNCE

SEQ ID NO: 1619131 - protein, 12 aa, Staphylococcus aureus
TRNKNNRKLSDI

SEQ ID NO: 1619132 - protein, 6 aa, Staphylococcus aureus
TSEGKL

SEQ ID NO: 1619133 - protein, 5 aa, Staphylococcus aureus
TSNHL

SEQ ID NO: 1619134 - protein, 10 aa, Staphylococcus aureus
TSPGYQSFNT

SEQ ID NO: 1619135 - protein, 12 aa, Staphylococcus aureus
TTAKSGNHSPVA

SEQ ID NO: 1619136 - protein, 9 aa, Staphylococcus aureus
TTGDKDVEI

SEQ ID NO: 1619137 - protein, 13 aa, Staphylococcus aureus
TTTFPNGNEDSTV

SEQ ID NO: 1619138 - protein, 9 aa, Staphylococcus aureus
TVQYENTSI

SEQ ID NO: 1619139 - protein, 5 aa, Staphylococcus aureus
TYRTA

SEQ ID NO: 1619140 - protein, 8 aa, Staphylococcus aureus
VADDDTSI

SEQ ID NO: 1619141 - protein, 10 aa, Staphylococcus aureus
VAEKKNAKIS

SEQ ID NO: 1619142 - protein, 6 aa, Staphylococcus aureus
VAPSPI

SEQ ID NO: 1619143 - protein, 14 aa, Staphylococcus aureus
VAPSYERGKNPFPK

SEQ ID NO: 1619144 - protein, 33 aa, Staphylococcus aureus
VDEHTQKSTKKASSTVEQTSTSKQNQPRNNGRF

SEQ ID NO: 1619145 - protein, 22 aa, Staphylococcus aureus
VDIPSYSVKPSQTISVREKSQK

SEQ ID NO: 1619146 - protein, 8 aa, Staphylococcus aureus
VDNSEGKV

SEQ ID NO: 1619147 - protein, 5 aa, Staphylococcus aureus
VDPEA

SEQ ID NO: 1619148 - protein, 6 aa, Staphylococcus aureus
VDPEEL

SEQ ID NO: 1619149 - protein, 6 aa, Staphylococcus aureus
VDPKLS

SEQ ID NO: 1619150 - protein, 9 aa, Staphylococcus aureus
VEAAERGAK

SEQ ID NO: 1619151 - protein, 6 aa, Staphylococcus aureus
VEATPN

SEQ ID NO: 1619152 - protein, 12 aa, Staphylococcus aureus
VEEGQGTLSDAV

SEQ ID NO: 1619153 - protein, 6 aa, Staphylococcus aureus
VEEGTV

SEQ ID NO: 1619154 - protein, 14 aa, Staphylococcus aureus
VEGTNKAIASTIDG

SEQ ID NO: 1619155 - protein, 9 aa, Staphylococcus aureus
VGNTKIKDA

SEQ ID NO: 1619156 - protein, 10 aa, Staphylococcus aureus
VHAQSSIDSM

SEQ ID NO: 1619157 - protein, 20 aa, Staphylococcus aureus
VKAYRDEDRVADDSNTPTFV

SEQ ID NO: 1619158 - protein, 16 aa, Staphylococcus aureus
VKEAPMPKEETAQLES

SEQ ID NO: 1619159 - protein, 8 aa, Staphylococcus aureus
VKLQDDLQ

SEQ ID NO: 1619160 - protein, 24 aa, Staphylococcus aureus
VKSPATSSSTAKSTEANPKPQSDE

SEQ ID NO: 1619161 - protein, 14 aa, Staphylococcus aureus
VNANDSTDHGNFNG

SEQ ID NO: 1619162 - protein, 7 aa, Staphylococcus aureus
VNDDSDI

SEQ ID NO: 1619163 - protein, 8 aa, Staphylococcus aureus
VNDKGDIK

SEQ ID NO: 1619164 - protein, 8 aa, Staphylococcus aureus
VNKGTEEF

SEQ ID NO: 1619165 - protein, 9 aa, Staphylococcus aureus
VNKSGKLIN

SEQ ID NO: 1619166 - protein, 18 aa, Staphylococcus aureus
VNKSSNPVSSISVSGGVA

SEQ ID NO: 1619167 - protein, 12 aa, Staphylococcus aureus
VNNQDELKNQSR

SEQ ID NO: 1619168 - protein, 5 aa, Staphylococcus aureus
VNPGK

SEQ ID NO: 1619169 - protein, 12 aa, Staphylococcus aureus
VNPVDTKQRQMK

SEQ ID NO: 1619170 - protein, 8 aa, Staphylococcus aureus
VNQAGSLV

SEQ ID NO: 1619171 - protein, 7 aa, Staphylococcus aureus
VNVKPDS

SEQ ID NO: 1619172 - protein, 5 aa, Staphylococcus aureus
VPGNK

SEQ ID NO: 1619173 - protein, 7 aa, Staphylococcus aureus
VPGSGMG

SEQ ID NO: 1619174 - protein, 17 aa, Staphylococcus aureus
VPQPQGKSATSPEEALA

SEQ ID NO: 1619175 - protein, 7 aa, Staphylococcus aureus
VPRGRGK

SEQ ID NO: 1619176 - protein, 23 aa, Staphylococcus aureus
VQSTDNNKTEAPKPTSDNHKTIN

SEQ ID NO: 1619177 - protein, 16 aa, Staphylococcus aureus
VSDLTTAKKIKTENLA

SEQ ID NO: 1619178 - protein, 7 aa, Staphylococcus aureus
VSKGKSI

SEQ ID NO: 1619179 - protein, 6 aa, Staphylococcus aureus
VTLGTS

SEQ ID NO: 1619180 - protein, 5 aa, Staphylococcus aureus
VTQAP

SEQ ID NO: 1619181 - protein, 7 aa, Staphylococcus aureus
VTQTDEY

SEQ ID NO: 1619182 - protein, 11 aa, Staphylococcus aureus
VYGGGTPNTKI

SEQ ID NO: 1619183 - protein, 13 aa, Staphylococcus aureus
WESYNDVKEHGQL

SEQ ID NO: 1619184 - protein, 6 aa, Staphylococcus aureus
YADAHE

SEQ ID NO: 1619185 - protein, 7 aa, Staphylococcus aureus
YATGTSQ

SEQ ID NO: 1619186 - protein, 24 aa, Staphylococcus aureus
YDQNANKVTFTSQGVTTARGTHTK

SEQ ID NO: 1619187 - protein, 5 aa, Staphylococcus aureus
YDQTI

SEQ ID NO: 1619188 - protein, 24 aa, Staphylococcus aureus
YEPKTTSKSERQLKEIYNNLLKQR

SEQ ID NO: 1619189 - protein, 4 aa, Staphylococcus aureus
YEQA

SEQ ID NO: 1619190 - protein, 8 aa, Staphylococcus aureus
YETPANLN

SEQ ID NO: 1619191 - protein, 12 aa, Staphylococcus aureus
YGENGPGDHGTV

SEQ ID NO: 1619192 - protein, 8 aa, Staphylococcus aureus
YHPHGDSS

SEQ ID NO: 1619193 - protein, 9 aa, Staphylococcus aureus
YHPHGDSSI

SEQ ID NO: 1619194 - protein, 13 aa, Staphylococcus aureus
YKAGKPTKSEQEK

SEQ ID NO: 1619195 - protein, 9 aa, Staphylococcus aureus
YKATEENKK

SEQ ID NO: 1619196 - protein, 9 aa, Staphylococcus aureus
YKKEDFAES

SEQ ID NO: 1619197 - protein, 10 aa, Staphylococcus aureus
YNGEGEFKAG

SEQ ID NO: 1619198 - protein, 7 aa, Staphylococcus aureus
YPETSYQ

SEQ ID NO: 1619199 - protein, 11 aa, Staphylococcus aureus
YPSSSNTQTAF

SEQ ID NO: 1619200 - protein, 6 aa, Staphylococcus aureus
YPYYTS

SEQ ID NO: 1619201 - protein, 7 aa, Staphylococcus aureus
YQPTTTQ

SEQ ID NO: 1619202 - protein, 7 aa, Staphylococcus aureus
YQQDEQN

SEQ ID NO: 1619203 - protein, 5 aa, Staphylococcus aureus
YRGKN

SEQ ID NO: 1619204 - protein, 15 aa, Staphylococcus aureus
YSKTGSHIVPFVSKE

SEQ ID NO: 1619205 - protein, 10 aa, Staphylococcus aureus
YTEDDKIDNG

SEQ ID NO: 1619206 - protein, 4 aa, Staphylococcus aureus
YTYS

SEQ ID NO: 1619207 - protein, 5 aa, Staphylococcus aureus
YYDDN

SEQ ID NO: 1619208 - protein, 33 aa, Staphylococcus aureus
AAHSNQSNQSMNNNDLTASKVNDNSDVSTNDYH

SEQ ID NO: 1619209 - protein, 7 aa, Staphylococcus aureus
AASEQND

SEQ ID NO: 1619210 - protein, 7 aa, Staphylococcus aureus
ADEEYRE

SEQ ID NO: 1619211 - protein, 10 aa, Staphylococcus aureus
ADSGAIGGSH

SEQ ID NO: 1619212 - protein, 8 aa, Staphylococcus aureus
ADTKKDIR

SEQ ID NO: 1619213 - protein, 10 aa, Staphylococcus aureus
AEKENASNKL

SEQ ID NO: 1619214 - protein, 8 aa, Staphylococcus aureus
AEKRNAKI

SEQ ID NO: 1619215 - protein, 5 aa, Staphylococcus aureus
AETDY

SEQ ID NO: 1619216 - protein, 6 aa, Staphylococcus aureus
AGFSTK

SEQ ID NO: 1619217 - protein, 8 aa, Staphylococcus aureus
AGNQDNWT

SEQ ID NO: 1619218 - protein, 20 aa, Staphylococcus aureus
AINDINQTAPATTAKAAALE

SEQ ID NO: 1619219 - protein, 6 aa, Staphylococcus aureus
AITPSK

SEQ ID NO: 1619220 - protein, 6 aa, Staphylococcus aureus
AKALGA

SEQ ID NO: 1619221 - protein, 14 aa, Staphylococcus aureus
AKDELATKAKEQKA

SEQ ID NO: 1619222 - protein, 6 aa, Staphylococcus aureus
AKSDLR

SEQ ID NO: 1619223 - protein, 8 aa, Staphylococcus aureus
AKTGKEAD

SEQ ID NO: 1619224 - protein, 15 aa, Staphylococcus aureus
AKVDKSSSYYHYYGD

SEQ ID NO: 1619225 - protein, 5 aa, Staphylococcus aureus
ALNQQ

SEQ ID NO: 1619226 - protein, 8 aa, Staphylococcus aureus
APNAQNTA

SEQ ID NO: 1619227 - protein, 15 aa, Staphylococcus aureus
APTQMDESDAFTESV

SEQ ID NO: 1619228 - protein, 8 aa, Staphylococcus aureus
AQDDKQFN

SEQ ID NO: 1619229 - protein, 12 aa, Staphylococcus aureus
AQNEEDASEVER

SEQ ID NO: 1619230 - protein, 4 aa, Staphylococcus aureus
AQRY

SEQ ID NO: 1619231 - protein, 5 aa, Staphylococcus aureus
ARAEK

SEQ ID NO: 1619232 - protein, 8 aa, Staphylococcus aureus
ARGPVSKG

SEQ ID NO: 1619233 - protein, 5 aa, Staphylococcus aureus
ASANN

SEQ ID NO: 1619234 - protein, 8 aa, Staphylococcus aureus
ASTNSART

SEQ ID NO: 1619235 - protein, 5 aa, Staphylococcus aureus
ATERH

SEQ ID NO: 1619236 - protein, 57 aa, Staphylococcus aureus
ATNKENDEVKSLTEEQGQDKLEDTHSEGSTQDVNDLAENAEVKKKPRKLSEADFDDD

SEQ ID NO: 1619237 - protein, 6 aa, Staphylococcus aureus
DAENRD

SEQ ID NO: 1619238 - protein, 74 aa, Staphylococcus aureus
DAQDDLKEKESQAYADGKISEEEQRAIQDAQAKLEEAKQNAELKARNAEKKANAYTDNKVKESTDAQRKTLTRY

SEQ ID NO: 1619239 - protein, 5 aa, Staphylococcus aureus
DCQKE

SEQ ID NO: 1619240 - protein, 42 aa, Staphylococcus aureus
DDELNDEDEPLIPKRGDSKKLKAEKKISVKKTKSSSKNSGKK

SEQ ID NO: 1619241 - protein, 6 aa, Staphylococcus aureus
DDNIKA

SEQ ID NO: 1619242 - protein, 14 aa, Staphylococcus aureus
DEGEVTASDITHDS

SEQ ID NO: 1619243 - protein, 4 aa, Staphylococcus aureus
DEIE

SEQ ID NO: 1619244 - protein, 4 aa, Staphylococcus aureus
DENI

SEQ ID NO: 1619245 - protein, 5 aa, Staphylococcus aureus
DEQGQ

SEQ ID NO: 1619246 - protein, 8 aa, Staphylococcus aureus
DGPKTIEK

SEQ ID NO: 1619247 - protein, 5 aa, Staphylococcus aureus
DHLSQ

SEQ ID NO: 1619248 - protein, 44 aa, Staphylococcus aureus
DIEKRPENKKAHNKRDNLQQQLDANEQKIEEGKRLQEEHGNELP

SEQ ID NO: 1619249 - protein, 9 aa, Staphylococcus aureus
DIPTKQAPK

SEQ ID NO: 1619250 - protein, 14 aa, Staphylococcus aureus
DKDTTSQIDSPKSN

SEQ ID NO: 1619251 - protein, 5 aa, Staphylococcus aureus
DKRDE

SEQ ID NO: 1619252 - protein, 16 aa, Staphylococcus aureus
DKTSSNDDNKYKSEPL

SEQ ID NO: 1619253 - protein, 5 aa, Staphylococcus aureus
DLDGQ

SEQ ID NO: 1619254 - protein, 12 aa, Staphylococcus aureus
DLRNGKTKIEDA

SEQ ID NO: 1619255 - protein, 7 aa, Staphylococcus aureus
DPATRKE

SEQ ID NO: 1619256 - protein, 18 aa, Staphylococcus aureus
DPETKERIYDRNSDTLDG

SEQ ID NO: 1619257 - protein, 9 aa, Staphylococcus aureus
DQGDPTGQK

SEQ ID NO: 1619258 - protein, 7 aa, Staphylococcus aureus
DQGLDIP

SEQ ID NO: 1619259 - protein, 8 aa, Staphylococcus aureus
DQTPSYKT

SEQ ID NO: 1619260 - protein, 7 aa, Staphylococcus aureus
DRDKEFD

SEQ ID NO: 1619261 - protein, 7 aa, Staphylococcus aureus
DRGKEFD

SEQ ID NO: 1619262 - protein, 6 aa, Staphylococcus aureus
DSGEYK

SEQ ID NO: 1619263 - protein, 5 aa, Staphylococcus aureus
DSYTN

SEQ ID NO: 1619264 - protein, 8 aa, Staphylococcus aureus
DYGKDNDI

SEQ ID NO: 1619265 - protein, 13 aa, Staphylococcus aureus
EAGMTKQQSSKRA

SEQ ID NO: 1619266 - protein, 10 aa, Staphylococcus aureus
EANRNKFDSN

SEQ ID NO: 1619267 - protein, 8 aa, Staphylococcus aureus
EAQGGGPL

SEQ ID NO: 1619268 - protein, 16 aa, Staphylococcus aureus
EARKIKPSIPEMGENG

SEQ ID NO: 1619269 - protein, 25 aa, Staphylococcus aureus
EDNVQDINETAAPLAYGDSELSRTG

SEQ ID NO: 1619270 - protein, 5 aa, Staphylococcus aureus
EDTPN

SEQ ID NO: 1619271 - protein, 13 aa, Staphylococcus aureus
EDTSESKAFADRD

SEQ ID NO: 1619272 - protein, 13 aa, Staphylococcus aureus
EEEGTMSKEDFKT

SEQ ID NO: 1619273 - protein, 5 aa, Staphylococcus aureus
EEKRC

SEQ ID NO: 1619274 - protein, 14 aa, Staphylococcus aureus
EELPSASDNDITEL

SEQ ID NO: 1619275 - protein, 14 aa, Staphylococcus aureus
EENKSLKSKISDLK

SEQ ID NO: 1619276 - protein, 4 aa, Staphylococcus aureus
EETS

SEQ ID NO: 1619277 - protein, 15 aa, Staphylococcus aureus
EEVEELQKEQPGSVF

SEQ ID NO: 1619278 - protein, 12 aa, Staphylococcus aureus
EEYLTDSSIKSR

SEQ ID NO: 1619279 - protein, 18 aa, Staphylococcus aureus
EGQGRQRANINGDVKTPK

SEQ ID NO: 1619280 - protein, 5 aa, Staphylococcus aureus
EHFTY

SEQ ID NO: 1619281 - protein, 6 aa, Staphylococcus aureus
EITNST

SEQ ID NO: 1619282 - protein, 5 aa, Staphylococcus aureus
EKANV

SEQ ID NO: 1619283 - protein, 7 aa, Staphylococcus aureus
EKESFTT

SEQ ID NO: 1619284 - protein, 14 aa, Staphylococcus aureus
EKFKNSDNEQVKNV

SEQ ID NO: 1619285 - protein, 13 aa, Staphylococcus aureus
EKFTSSAQNSDTI

SEQ ID NO: 1619286 - protein, 10 aa, Staphylococcus aureus
EKGKPTGEQT

SEQ ID NO: 1619287 - protein, 12 aa, Staphylococcus aureus
ELKKEKAQIENR

SEQ ID NO: 1619288 - protein, 5 aa, Staphylococcus aureus
ELNER

SEQ ID NO: 1619289 - protein, 5 aa, Staphylococcus aureus
ELQGR

SEQ ID NO: 1619290 - protein, 4 aa, Staphylococcus aureus
EMDG

SEQ ID NO: 1619291 - protein, 8 aa, Staphylococcus aureus
ENDSDEIV

SEQ ID NO: 1619292 - protein, 6 aa, Staphylococcus aureus
ENERNS

SEQ ID NO: 1619293 - protein, 6 aa, Staphylococcus aureus
ENGSIT

SEQ ID NO: 1619294 - protein, 10 aa, Staphylococcus aureus
ENGVEHEGEL

SEQ ID NO: 1619295 - protein, 7 aa, Staphylococcus aureus
ENKRKDI

SEQ ID NO: 1619296 - protein, 7 aa, Staphylococcus aureus
ENKYHDR

SEQ ID NO: 1619297 - protein, 9 aa, Staphylococcus aureus
ENRNSNVES

SEQ ID NO: 1619298 - protein, 10 aa, Staphylococcus aureus
ENYDSGNLSK

SEQ ID NO: 1619299 - protein, 7 aa, Staphylococcus aureus
EQERQEA

SEQ ID NO: 1619300 - protein, 17 aa, Staphylococcus aureus
EQHSTDGLSGLKSGIKE

SEQ ID NO: 1619301 - protein, 8 aa, Staphylococcus aureus
EQQPEIEG

SEQ ID NO: 1619302 - protein, 32 aa, Staphylococcus aureus
EQRQNTENKQEKTFSSEESNSKPFMAENQNDE

SEQ ID NO: 1619303 - protein, 6 aa, Staphylococcus aureus
ERALGS

SEQ ID NO: 1619304 - protein, 10 aa, Staphylococcus aureus
ERLKSSRKLD

SEQ ID NO: 1619305 - protein, 7 aa, Staphylococcus aureus
ERVGEQM

SEQ ID NO: 1619306 - protein, 8 aa, Staphylococcus aureus
ESGKKFYP

SEQ ID NO: 1619307 - protein, 5 aa, Staphylococcus aureus
ESMSD

SEQ ID NO: 1619308 - protein, 5 aa, Staphylococcus aureus
ESSNM

SEQ ID NO: 1619309 - protein, 6 aa, Staphylococcus aureus
ETNQEA

SEQ ID NO: 1619310 - protein, 17 aa, Staphylococcus aureus
ETNQEKFYNGSAGFQAG

SEQ ID NO: 1619311 - protein, 10 aa, Staphylococcus aureus
ETSNADQADP

SEQ ID NO: 1619312 - protein, 12 aa, Staphylococcus aureus
ETVSERSLADKA

SEQ ID NO: 1619313 - protein, 10 aa, Staphylococcus aureus
FDGEMKEDLE

SEQ ID NO: 1619314 - protein, 8 aa, Staphylococcus aureus
FGGGGDGS

SEQ ID NO: 1619315 - protein, 4 aa, Staphylococcus aureus
FGVP

SEQ ID NO: 1619316 - protein, 8 aa, Staphylococcus aureus
FNDDQSLN

SEQ ID NO: 1619317 - protein, 11 aa, Staphylococcus aureus
FNKAEKRKADT

SEQ ID NO: 1619318 - protein, 12 aa, Staphylococcus aureus
FTGEKNKKRKKK

SEQ ID NO: 1619319 - protein, 4 aa, Staphylococcus aureus
GEKR

SEQ ID NO: 1619320 - protein, 13 aa, Staphylococcus aureus
GFEPTKKRNRQSI

SEQ ID NO: 1619321 - protein, 20 aa, Staphylococcus aureus
GIPSKLSSGWSSAKSSVGYH

SEQ ID NO: 1619322 - protein, 17 aa, Staphylococcus aureus
GISGQFSTPSKLTPRDV

SEQ ID NO: 1619323 - protein, 9 aa, Staphylococcus aureus
GKAYAGGKY

SEQ ID NO: 1619324 - protein, 14 aa, Staphylococcus aureus
GKDNDNNLDHTMKW

SEQ ID NO: 1619325 - protein, 5 aa, Staphylococcus aureus
GKKLT

SEQ ID NO: 1619326 - protein, 6 aa, Staphylococcus aureus
GKPSLV

SEQ ID NO: 1619327 - protein, 9 aa, Staphylococcus aureus
GKVGYSAET

SEQ ID NO: 1619328 - protein, 6 aa, Staphylococcus aureus
GKYNEQ

SEQ ID NO: 1619329 - protein, 30 aa, Staphylococcus aureus
GNIGKKAGEFGATAKNTAHNIKKGAEEMVE

SEQ ID NO: 1619330 - protein, 6 aa, Staphylococcus aureus
GNKPFD

SEQ ID NO: 1619331 - protein, 10 aa, Staphylococcus aureus
GNKRISEATI

SEQ ID NO: 1619332 - protein, 5 aa, Staphylococcus aureus
GQNVK

SEQ ID NO: 1619333 - protein, 7 aa, Staphylococcus aureus
GTDPYSL

SEQ ID NO: 1619334 - protein, 14 aa, Staphylococcus aureus
GTGTNDTEKSIQAS

SEQ ID NO: 1619335 - protein, 5 aa, Staphylococcus aureus
GTNNA

SEQ ID NO: 1619336 - protein, 15 aa, Staphylococcus aureus
GTSNEAINPNNPLKS

SEQ ID NO: 1619337 - protein, 6 aa, Staphylococcus aureus
HAKPIE

SEQ ID NO: 1619338 - protein, 4 aa, Staphylococcus aureus
HYSP

SEQ ID NO: 1619339 - protein, 9 aa, Staphylococcus aureus
IARQDKDYA

SEQ ID NO: 1619340 - protein, 8 aa, Staphylococcus aureus
IDRKKDNK

SEQ ID NO: 1619341 - protein, 8 aa, Staphylococcus aureus
IEKKGRKE

SEQ ID NO: 1619342 - protein, 8 aa, Staphylococcus aureus
IEPKGNQF

SEQ ID NO: 1619343 - protein, 9 aa, Staphylococcus aureus
IGDDQYGND

SEQ ID NO: 1619344 - protein, 6 aa, Staphylococcus aureus
IGGSGN

SEQ ID NO: 1619345 - protein, 11 aa, Staphylococcus aureus
IGSGSASRSIY

SEQ ID NO: 1619346 - protein, 9 aa, Staphylococcus aureus
INGKFTKAH

SEQ ID NO: 1619347 - protein, 22 aa, Staphylococcus aureus
INNGVDNSDVDDALTQGKATID

SEQ ID NO: 1619348 - protein, 6 aa, Staphylococcus aureus
IPNGTE

SEQ ID NO: 1619349 - protein, 10 aa, Staphylococcus aureus
IPPKKDGGTE

SEQ ID NO: 1619350 - protein, 8 aa, Staphylococcus aureus
IPTGDTVS

SEQ ID NO: 1619351 - protein, 25 aa, Staphylococcus aureus
IPTLSTGTLAGKGVATDNSGALTQP

SEQ ID NO: 1619352 - protein, 12 aa, Staphylococcus aureus
IPTNKKNITAQE

SEQ ID NO: 1619353 - protein, 50 aa, Staphylococcus aureus
IQATPDATDEEKQAAETEANTENAKANQAITAATTNAEVDEAKTNAEAAI

SEQ ID NO: 1619354 - protein, 11 aa, Staphylococcus aureus
IQNRSRTTKVI

SEQ ID NO: 1619355 - protein, 14 aa, Staphylococcus aureus
IREPEADSPVQNGP

SEQ ID NO: 1619356 - protein, 24 aa, Staphylococcus aureus
ISELTQEKSEIEVSRSIEKSNKHL

SEQ ID NO: 1619357 - protein, 20 aa, Staphylococcus aureus
ISENENKNFADRKQQLSEGF

SEQ ID NO: 1619358 - protein, 8 aa, Staphylococcus aureus
ISESTLNT

SEQ ID NO: 1619359 - protein, 4 aa, Staphylococcus aureus
ISQS

SEQ ID NO: 1619360 - protein, 27 aa, Staphylococcus aureus
ITDQAKQGITDATTTAEVEKAKAQGLE

SEQ ID NO: 1619361 - protein, 4 aa, Staphylococcus aureus
ITKG

SEQ ID NO: 1619362 - protein, 9 aa, Staphylococcus aureus
KADKDRDNE

SEQ ID NO: 1619363 - protein, 5 aa, Staphylococcus aureus
KAKNY

SEQ ID NO: 1619364 - protein, 4 aa, Staphylococcus aureus
KALG

SEQ ID NO: 1619365 - protein, 9 aa, Staphylococcus aureus
KASPKLDKN

SEQ ID NO: 1619366 - protein, 5 aa, Staphylococcus aureus
KDEDM

SEQ ID NO: 1619367 - protein, 11 aa, Staphylococcus aureus
KDEDTESIGYG

SEQ ID NO: 1619368 - protein, 9 aa, Staphylococcus aureus
KDEEGNYYK

SEQ ID NO: 1619369 - protein, 6 aa, Staphylococcus aureus
KDEKHR

SEQ ID NO: 1619370 - protein, 11 aa, Staphylococcus aureus
KDENSEDYPHW

SEQ ID NO: 1619371 - protein, 15 aa, Staphylococcus aureus
KDHTSENNLKMAILK

SEQ ID NO: 1619372 - protein, 22 aa, Staphylococcus aureus
KDKINEYTGSNNEEKKENEDKE

SEQ ID NO: 1619373 - protein, 8 aa, Staphylococcus aureus
KDNDFTVN

SEQ ID NO: 1619374 - protein, 13 aa, Staphylococcus aureus
KDYKTEKSLNIRQ

SEQ ID NO: 1619375 - protein, 7 aa, Staphylococcus aureus
KEEIDQS

SEQ ID NO: 1619376 - protein, 7 aa, Staphylococcus aureus
KEPREHT

SEQ ID NO: 1619377 - protein, 13 aa, Staphylococcus aureus
KETGEITESTEKA

SEQ ID NO: 1619378 - protein, 7 aa, Staphylococcus aureus
KFSQQTR

SEQ ID NO: 1619379 - protein, 20 aa, Staphylococcus aureus
KGDNVHDAQRDAYEKVSQIQ

SEQ ID NO: 1619380 - protein, 4 aa, Staphylococcus aureus
KGQL

SEQ ID NO: 1619381 - protein, 12 aa, Staphylococcus aureus
KGSIEGFGLGLT

SEQ ID NO: 1619382 - protein, 6 aa, Staphylococcus aureus
KGSQGG

SEQ ID NO: 1619383 - protein, 10 aa, Staphylococcus aureus
KGYQKLATEQ

SEQ ID NO: 1619384 - protein, 11 aa, Staphylococcus aureus
KHSNPSQFKNT

SEQ ID NO: 1619385 - protein, 5 aa, Staphylococcus aureus
KIHST

SEQ ID NO: 1619386 - protein, 13 aa, Staphylococcus aureus
KKADTSDKKEFRN

SEQ ID NO: 1619387 - protein, 11 aa, Staphylococcus aureus
KKAFDGRGNYT

SEQ ID NO: 1619388 - protein, 8 aa, Staphylococcus aureus
KKDHHSRR

SEQ ID NO: 1619389 - protein, 10 aa, Staphylococcus aureus
KKSLSDTKSL

SEQ ID NO: 1619390 - protein, 7 aa, Staphylococcus aureus
KLALTQS

SEQ ID NO: 1619391 - protein, 15 aa, Staphylococcus aureus
KLGETLSKDLYGKEI

SEQ ID NO: 1619392 - protein, 5 aa, Staphylococcus aureus
KLPSY

SEQ ID NO: 1619393 - protein, 7 aa, Staphylococcus aureus
KLSNDKY

SEQ ID NO: 1619394 - protein, 8 aa, Staphylococcus aureus
KLTDYQNK

SEQ ID NO: 1619395 - protein, 40 aa, Staphylococcus aureus
KNESRFKGAKGDKGEPGQPGAKGEAGKKGEQGAPGKNGTV

SEQ ID NO: 1619396 - protein, 7 aa, Staphylococcus aureus
KNESSAC

SEQ ID NO: 1619397 - protein, 5 aa, Staphylococcus aureus
KNMQS

SEQ ID NO: 1619398 - protein, 8 aa, Staphylococcus aureus
KNPLTPKE

SEQ ID NO: 1619399 - protein, 6 aa, Staphylococcus aureus
KNRTQV

SEQ ID NO: 1619400 - protein, 9 aa, Staphylococcus aureus
KQKKKEYHD

SEQ ID NO: 1619401 - protein, 6 aa, Staphylococcus aureus
KQLGTA

SEQ ID NO: 1619402 - protein, 9 aa, Staphylococcus aureus
KQQSYNAND

SEQ ID NO: 1619403 - protein, 10 aa, Staphylococcus aureus
KRDAKKENPI

SEQ ID NO: 1619404 - protein, 5 aa, Staphylococcus aureus
KRLPR

SEQ ID NO: 1619405 - protein, 39 aa, Staphylococcus aureus
KRTDASQVDGQDDTSEDDDNESEKADSKSADSESKGGAY

SEQ ID NO: 1619406 - protein, 8 aa, Staphylococcus aureus
KRTINENE

SEQ ID NO: 1619407 - protein, 5 aa, Staphylococcus aureus
KSPYV

SEQ ID NO: 1619408 - protein, 4 aa, Staphylococcus aureus
KSTY

SEQ ID NO: 1619409 - protein, 8 aa, Staphylococcus aureus
KTQNSGFR

SEQ ID NO: 1619410 - protein, 5 aa, Staphylococcus aureus
KVDKS

SEQ ID NO: 1619411 - protein, 9 aa, Staphylococcus aureus
KVEKAVDEH

SEQ ID NO: 1619412 - protein, 5 aa, Staphylococcus aureus
KVSGK

SEQ ID NO: 1619413 - protein, 10 aa, Staphylococcus aureus
KYIGTEKPML

SEQ ID NO: 1619414 - protein, 9 aa, Staphylococcus aureus
LAKSDKIRK

SEQ ID NO: 1619415 - protein, 21 aa, Staphylococcus aureus
LDGSTKSFNPVPLNEKNEENY

SEQ ID NO: 1619416 - protein, 9 aa, Staphylococcus aureus
LDNGTTFAA

SEQ ID NO: 1619417 - protein, 8 aa, Staphylococcus aureus
LDPGEQKR

SEQ ID NO: 1619418 - protein, 8 aa, Staphylococcus aureus
LEYSETNS

SEQ ID NO: 1619419 - protein, 6 aa, Staphylococcus aureus
LGGITR

SEQ ID NO: 1619420 - protein, 9 aa, Staphylococcus aureus
LKAKGDYET

SEQ ID NO: 1619421 - protein, 4 aa, Staphylococcus aureus
LKKD

SEQ ID NO: 1619422 - protein, 12 aa, Staphylococcus aureus
LKNQQNEDKPLF

SEQ ID NO: 1619423 - protein, 7 aa, Staphylococcus aureus
LKNSTIH

SEQ ID NO: 1619424 - protein, 49 aa, Staphylococcus aureus
LKPVQSKQAASESKTATQNTPSSSTDSQESNTNAYKTNNMTSNNVENNQ

SEQ ID NO: 1619425 - protein, 4 aa, Staphylococcus aureus
LKSE

SEQ ID NO: 1619426 - protein, 5 aa, Staphylococcus aureus
LLTSN

SEQ ID NO: 1619427 - protein, 4 aa, Staphylococcus aureus
LNSS

SEQ ID NO: 1619428 - protein, 8 aa, Staphylococcus aureus
LNTEQHRQ

SEQ ID NO: 1619429 - protein, 11 aa, Staphylococcus aureus
LNYTQDPNTEK

SEQ ID NO: 1619430 - protein, 6 aa, Staphylococcus aureus
LQKNNE

SEQ ID NO: 1619431 - protein, 15 aa, Staphylococcus aureus
LRHTSKKLSTILKGD

SEQ ID NO: 1619432 - protein, 9 aa, Staphylococcus aureus
LRKKTGAGM

SEQ ID NO: 1619433 - protein, 11 aa, Staphylococcus aureus
LRSESSSRFEK

SEQ ID NO: 1619434 - protein, 9 aa, Staphylococcus aureus
LSKETSELK

SEQ ID NO: 1619435 - protein, 8 aa, Staphylococcus aureus
LSNGERYD

SEQ ID NO: 1619436 - protein, 8 aa, Staphylococcus aureus
LSQQFTEA

SEQ ID NO: 1619437 - protein, 6 aa, Staphylococcus aureus
LTPENL

SEQ ID NO: 1619438 - protein, 7 aa, Staphylococcus aureus
LTQDPYS

SEQ ID NO: 1619439 - protein, 34 aa, Staphylococcus aureus
LTQQGSNQSAEQSAQAFQQAAQRQQGQQGGNGNY

SEQ ID NO: 1619440 - protein, 7 aa, Staphylococcus aureus
LTTKDAI

SEQ ID NO: 1619441 - protein, 12 aa, Staphylococcus aureus
LYQKGETHSGND

SEQ ID NO: 1619442 - protein, 8 aa, Staphylococcus aureus
MANRTGHT

SEQ ID NO: 1619443 - protein, 17 aa, Staphylococcus aureus
MDNSNKSTDYLKQSDEF

SEQ ID NO: 1619444 - protein, 48 aa, Staphylococcus aureus
MEKTEVDSEYATTDNEEHIQEQSNQDKSYFDSESIGNQSGGVRQREPL

SEQ ID NO: 1619445 - protein, 4 aa, Staphylococcus aureus
MNRA

SEQ ID NO: 1619446 - protein, 18 aa, Staphylococcus aureus
MSTDGSDKSGQISVTVTN

SEQ ID NO: 1619447 - protein, 6 aa, Staphylococcus aureus
MTPPPV

SEQ ID NO: 1619448 - protein, 27 aa, Staphylococcus aureus
NAGKLVSDRDRKTTKRNAKDDTGKSTS

SEQ ID NO: 1619449 - protein, 22 aa, Staphylococcus aureus
NATQAVDENNSELNQVGTSTKA

SEQ ID NO: 1619450 - protein, 9 aa, Staphylococcus aureus
NDEGKQYKH

SEQ ID NO: 1619451 - protein, 12 aa, Staphylococcus aureus
NEGKLKVSFDYI

SEQ ID NO: 1619452 - protein, 9 aa, Staphylococcus aureus
NEGYSDSKT

SEQ ID NO: 1619453 - protein, 7 aa, Staphylococcus aureus
NEIEKVT

SEQ ID NO: 1619454 - protein, 15 aa, Staphylococcus aureus
NEKEITNELIRKIAF

SEQ ID NO: 1619455 - protein, 4 aa, Staphylococcus aureus
NETA

SEQ ID NO: 1619456 - protein, 11 aa, Staphylococcus aureus
NGASRADSGTV

SEQ ID NO: 1619457 - protein, 9 aa, Staphylococcus aureus
NGDNTRYNT

SEQ ID NO: 1619458 - protein, 9 aa, Staphylococcus aureus
NGETQVGEV

SEQ ID NO: 1619459 - protein, 31 aa, Staphylococcus aureus
NGGAPTASNESAASATSEEVAETPAAPAAVS

SEQ ID NO: 1619460 - protein, 7 aa, Staphylococcus aureus
NGPLEGI

SEQ ID NO: 1619461 - protein, 7 aa, Staphylococcus aureus
NGPQTPH

SEQ ID NO: 1619462 - protein, 4 aa, Staphylococcus aureus
NGVS

SEQ ID NO: 1619463 - protein, 7 aa, Staphylococcus aureus
NKGGMTS

SEQ ID NO: 1619464 - protein, 4 aa, Staphylococcus aureus
NKKQ

SEQ ID NO: 1619465 - protein, 6 aa, Staphylococcus aureus
NKQTLT

SEQ ID NO: 1619466 - protein, 5 aa, Staphylococcus aureus
NKRID

SEQ ID NO: 1619467 - protein, 22 aa, Staphylococcus aureus
NLSNPSKAAENLKSKVASIAKS

SEQ ID NO: 1619468 - protein, 7 aa, Staphylococcus aureus
NMNGTNY

SEQ ID NO: 1619469 - protein, 15 aa, Staphylococcus aureus
NNHIGGKVNRHESDG

SEQ ID NO: 1619470 - protein, 9 aa, Staphylococcus aureus
NNISGNEWQ

SEQ ID NO: 1619471 - protein, 14 aa, Staphylococcus aureus
NNPTGRSLTNEQKK

SEQ ID NO: 1619472 - protein, 5 aa, Staphylococcus aureus
NNQAS

SEQ ID NO: 1619473 - protein, 5 aa, Staphylococcus aureus
NNTEL

SEQ ID NO: 1619474 - protein, 8 aa, Staphylococcus aureus
NPAKNDGL

SEQ ID NO: 1619475 - protein, 9 aa, Staphylococcus aureus
NQPLNDADV

SEQ ID NO: 1619476 - protein, 6 aa, Staphylococcus aureus
NQQLEE

SEQ ID NO: 1619477 - protein, 4 aa, Staphylococcus aureus
NQTN

SEQ ID NO: 1619478 - protein, 14 aa, Staphylococcus aureus
NRDNPAELLPEEEE

SEQ ID NO: 1619479 - protein, 4 aa, Staphylococcus aureus
NRGN

SEQ ID NO: 1619480 - protein, 5 aa, Staphylococcus aureus
NRSDI

SEQ ID NO: 1619481 - protein, 5 aa, Staphylococcus aureus
NSDEL

SEQ ID NO: 1619482 - protein, 11 aa, Staphylococcus aureus
NSGNIPKSISQ

SEQ ID NO: 1619483 - protein, 7 aa, Staphylococcus aureus
NSMRETN

SEQ ID NO: 1619484 - protein, 9 aa, Staphylococcus aureus
NSNIDPDTI

SEQ ID NO: 1619485 - protein, 21 aa, Staphylococcus aureus
NSQNEAIEKAGKALVDSGAVT

SEQ ID NO: 1619486 - protein, 6 aa, Staphylococcus aureus
NTAANY

SEQ ID NO: 1619487 - protein, 5 aa, Staphylococcus aureus
NTEYE

SEQ ID NO: 1619488 - protein, 10 aa, Staphylococcus aureus
NTKVSTLSSS

SEQ ID NO: 1619489 - protein, 18 aa, Staphylococcus aureus
NTRDASGGADDTREGTVM

SEQ ID NO: 1619490 - protein, 11 aa, Staphylococcus aureus
NVEGSTKIGAK

SEQ ID NO: 1619491 - protein, 4 aa, Staphylococcus aureus
NVND

SEQ ID NO: 1619492 - protein, 11 aa, Staphylococcus aureus
NVNQRQNGQRN

SEQ ID NO: 1619493 - protein, 8 aa, Staphylococcus aureus
NYPSEDNK

SEQ ID NO: 1619494 - protein, 5 aa, Staphylococcus aureus
PDHTL

SEQ ID NO: 1619495 - protein, 20 aa, Staphylococcus aureus
PEEKVNQFKPKEENKPKTIE

SEQ ID NO: 1619496 - protein, 4 aa, Staphylococcus aureus
PGDI

SEQ ID NO: 1619497 - protein, 7 aa, Staphylococcus aureus
PKDNSPV

SEQ ID NO: 1619498 - protein, 4 aa, Staphylococcus aureus
PKGQ

SEQ ID NO: 1619499 - protein, 8 aa, Staphylococcus aureus
PKLSRKPY

SEQ ID NO: 1619500 - protein, 11 aa, Staphylococcus aureus
PKNKNIQTQQK

SEQ ID NO: 1619501 - protein, 34 aa, Staphylococcus aureus
PKNKYKSDIQSAIDETAKYPVKDTDFMTDDEEKN

SEQ ID NO: 1619502 - protein, 7 aa, Staphylococcus aureus
PKSIGVG

SEQ ID NO: 1619503 - protein, 9 aa, Staphylococcus aureus
PKSLNPKDA

SEQ ID NO: 1619504 - protein, 9 aa, Staphylococcus aureus
PPKAGKTSL

SEQ ID NO: 1619505 - protein, 15 aa, Staphylococcus aureus
PQSPVPINDHGDTVP

SEQ ID NO: 1619506 - protein, 14 aa, Staphylococcus aureus
PQSPVPINDRGDTV

SEQ ID NO: 1619507 - protein, 8 aa, Staphylococcus aureus
PRVKPKPK

SEQ ID NO: 1619508 - protein, 4 aa, Staphylococcus aureus
PSII

SEQ ID NO: 1619509 - protein, 9 aa, Staphylococcus aureus
PSNKEQQKI

SEQ ID NO: 1619510 - protein, 8 aa, Staphylococcus aureus
PTKNAASH

SEQ ID NO: 1619511 - protein, 9 aa, Staphylococcus aureus
PTRYNQPSI

SEQ ID NO: 1619512 - protein, 8 aa, Staphylococcus aureus
QADKQSDV

SEQ ID NO: 1619513 - protein, 26 aa, Staphylococcus aureus
QDEDYKYDEKTKSVHLTEQGADKAER

SEQ ID NO: 1619514 - protein, 14 aa, Staphylococcus aureus
QDEVDYQTERSEQL

SEQ ID NO: 1619515 - protein, 13 aa, Staphylococcus aureus
QEIENEKISTTSI

SEQ ID NO: 1619516 - protein, 4 aa, Staphylococcus aureus
QERQ

SEQ ID NO: 1619517 - protein, 4 aa, Staphylococcus aureus
QESI

SEQ ID NO: 1619518 - protein, 8 aa, Staphylococcus aureus
QGPPGVGK

SEQ ID NO: 1619519 - protein, 31 aa, Staphylococcus aureus
QGTSKEAINPNNPLKSSGFGDDWLQNAKLMN

SEQ ID NO: 1619520 - protein, 9 aa, Staphylococcus aureus
QKPHYTNKL

SEQ ID NO: 1619521 - protein, 11 aa, Staphylococcus aureus
QLDQQNSNVNT

SEQ ID NO: 1619522 - protein, 11 aa, Staphylococcus aureus
QLKPKEKLTGR

SEQ ID NO: 1619523 - protein, 17 aa, Staphylococcus aureus
QLTQPEVYNNPQKANEL

SEQ ID NO: 1619524 - protein, 8 aa, Staphylococcus aureus
QQSYNAND

SEQ ID NO: 1619525 - protein, 11 aa, Staphylococcus aureus
QSINTAKNTIK

SEQ ID NO: 1619526 - protein, 8 aa, Staphylococcus aureus
QSPEKNRI

SEQ ID NO: 1619527 - protein, 8 aa, Staphylococcus aureus
QSQGRDNV

SEQ ID NO: 1619528 - protein, 5 aa, Staphylococcus aureus
QSTMP

SEQ ID NO: 1619529 - protein, 9 aa, Staphylococcus aureus
QTESKGQND

SEQ ID NO: 1619530 - protein, 19 aa, Staphylococcus aureus
QVDEYNDNGNKNKKGASDL

SEQ ID NO: 1619531 - protein, 11 aa, Staphylococcus aureus
RATQKRTQNQG

SEQ ID NO: 1619532 - protein, 11 aa, Staphylococcus aureus
RDSIYDYKTGN

SEQ ID NO: 1619533 - protein, 7 aa, Staphylococcus aureus
REETTGK

SEQ ID NO: 1619534 - protein, 29 aa, Staphylococcus aureus
RGERTINDAAKHNRNEKTGASPYEGIRTC

SEQ ID NO: 1619535 - protein, 23 aa, Staphylococcus aureus
RGIDHSEVKSTRVRKSVGTERTF

SEQ ID NO: 1619536 - protein, 9 aa, Staphylococcus aureus
RGPNKENFE

SEQ ID NO: 1619537 - protein, 8 aa, Staphylococcus aureus
RHQREKEL

SEQ ID NO: 1619538 - protein, 4 aa, Staphylococcus aureus
RLDD

SEQ ID NO: 1619539 - protein, 19 aa, Staphylococcus aureus
RLSPKGKTRFETKASHQAQ

SEQ ID NO: 1619540 - protein, 12 aa, Staphylococcus aureus
RNKINKSSNDEY

SEQ ID NO: 1619541 - protein, 5 aa, Staphylococcus aureus
RNNQT

SEQ ID NO: 1619542 - protein, 20 aa, Staphylococcus aureus
RPKKTTRIGKPYYKTDNLLQ

SEQ ID NO: 1619543 - protein, 4 aa, Staphylococcus aureus
RRQH

SEQ ID NO: 1619544 - protein, 13 aa, Staphylococcus aureus
RSRKRDKSGRLNG

SEQ ID NO: 1619545 - protein, 6 aa, Staphylococcus aureus
RTEEQT

SEQ ID NO: 1619546 - protein, 5 aa, Staphylococcus aureus
RTEQP

SEQ ID NO: 1619547 - protein, 7 aa, Staphylococcus aureus
SAGPIRT

SEQ ID NO: 1619548 - protein, 9 aa, Staphylococcus aureus
SAKHVEKCQ

SEQ ID NO: 1619549 - protein, 7 aa, Staphylococcus aureus
SASQPTV

SEQ ID NO: 1619550 - protein, 6 aa, Staphylococcus aureus
SAVPDH

SEQ ID NO: 1619551 - protein, 10 aa, Staphylococcus aureus
SDEYNGPDMT

SEQ ID NO: 1619552 - protein, 14 aa, Staphylococcus aureus
SDKATNSSKEYRFE

SEQ ID NO: 1619553 - protein, 16 aa, Staphylococcus aureus
SDLRPKTKRRKQNEYH

SEQ ID NO: 1619554 - protein, 7 aa, Staphylococcus aureus
SDSSEQK

SEQ ID NO: 1619555 - protein, 10 aa, Staphylococcus aureus
SEAGQAKGYR

SEQ ID NO: 1619556 - protein, 13 aa, Staphylococcus aureus
SEATKNEDSVTGS

SEQ ID NO: 1619557 - protein, 6 aa, Staphylococcus aureus
SEGKQF

SEQ ID NO: 1619558 - protein, 10 aa, Staphylococcus aureus
SETKNLTKAS

SEQ ID NO: 1619559 - protein, 8 aa, Staphylococcus aureus
SEVEKNGY

SEQ ID NO: 1619560 - protein, 11 aa, Staphylococcus aureus
SEVNDEDGRIE

SEQ ID NO: 1619561 - protein, 10 aa, Staphylococcus aureus
SGATEDLDDE

SEQ ID NO: 1619562 - protein, 8 aa, Staphylococcus aureus
SGNRSTKA

SEQ ID NO: 1619563 - protein, 7 aa, Staphylococcus aureus
SGTGKSI

SEQ ID NO: 1619564 - protein, 10 aa, Staphylococcus aureus
SGYRNEEDNF

SEQ ID NO: 1619565 - protein, 15 aa, Staphylococcus aureus
SHKKISKKEANNLAK

SEQ ID NO: 1619566 - protein, 4 aa, Staphylococcus aureus
SIEQ

SEQ ID NO: 1619567 - protein, 7 aa, Staphylococcus aureus
SITESKV

SEQ ID NO: 1619568 - protein, 6 aa, Staphylococcus aureus
SKNPDN

SEQ ID NO: 1619569 - protein, 11 aa, Staphylococcus aureus
SKQEVADTKAK

SEQ ID NO: 1619570 - protein, 7 aa, Staphylococcus aureus
SKTISEL

SEQ ID NO: 1619571 - protein, 6 aa, Staphylococcus aureus
SNNNEQ

SEQ ID NO: 1619572 - protein, 12 aa, Staphylococcus aureus
SNQYSASAEYCG

SEQ ID NO: 1619573 - protein, 14 aa, Staphylococcus aureus
SQAHSENKIHRDIS

SEQ ID NO: 1619574 - protein, 11 aa, Staphylococcus aureus
SQEKGRDATID

SEQ ID NO: 1619575 - protein, 13 aa, Staphylococcus aureus
SQFKSGERQLPNF

SEQ ID NO: 1619576 - protein, 5 aa, Staphylococcus aureus
SQGEI

SEQ ID NO: 1619577 - protein, 16 aa, Staphylococcus aureus
SQIEETESDFDREKLQ

SEQ ID NO: 1619578 - protein, 5 aa, Staphylococcus aureus
SRAAR

SEQ ID NO: 1619579 - protein, 5 aa, Staphylococcus aureus
SRDEG

SEQ ID NO: 1619580 - protein, 4 aa, Staphylococcus aureus
SRYP

SEQ ID NO: 1619581 - protein, 10 aa, Staphylococcus aureus
SSEHTQPITD

SEQ ID NO: 1619582 - protein, 8 aa, Staphylococcus aureus
SSETSAKI

SEQ ID NO: 1619583 - protein, 6 aa, Staphylococcus aureus
SSQLNS

SEQ ID NO: 1619584 - protein, 17 aa, Staphylococcus aureus
STDNASWRGPNKEKLDS

SEQ ID NO: 1619585 - protein, 16 aa, Staphylococcus aureus
STEVVETARDSLVIGI

SEQ ID NO: 1619586 - protein, 6 aa, Staphylococcus aureus
STFGSR

SEQ ID NO: 1619587 - protein, 5 aa, Staphylococcus aureus
STGLA

SEQ ID NO: 1619588 - protein, 4 aa, Staphylococcus aureus
STYV

SEQ ID NO: 1619589 - protein, 7 aa, Staphylococcus aureus
SYADKEC

SEQ ID NO: 1619590 - protein, 15 aa, Staphylococcus aureus
SYYQEAGRAGRDGLK

SEQ ID NO: 1619591 - protein, 10 aa, Staphylococcus aureus
TEESKRFTDF

SEQ ID NO: 1619592 - protein, 10 aa, Staphylococcus aureus
TEKDPNIREQ

SEQ ID NO: 1619593 - protein, 8 aa, Staphylococcus aureus
TESSNTGI

SEQ ID NO: 1619594 - protein, 23 aa, Staphylococcus aureus
TFDSNEDASVQNYENKASDDYYD

SEQ ID NO: 1619595 - protein, 8 aa, Staphylococcus aureus
TFDTNGVG

SEQ ID NO: 1619596 - protein, 5 aa, Staphylococcus aureus
TGESY

SEQ ID NO: 1619597 - protein, 5 aa, Staphylococcus aureus
TGKDS

SEQ ID NO: 1619598 - protein, 11 aa, Staphylococcus aureus
TGLENPNSPTQ

SEQ ID NO: 1619599 - protein, 8 aa, Staphylococcus aureus
TGNHNNDR

SEQ ID NO: 1619600 - protein, 16 aa, Staphylococcus aureus
TGPNPHYNSNPSKGGV

SEQ ID NO: 1619601 - protein, 12 aa, Staphylococcus aureus
TGQSSTGKSTAA

SEQ ID NO: 1619602 - protein, 11 aa, Staphylococcus aureus
TKDNYTKDNTI

SEQ ID NO: 1619603 - protein, 7 aa, Staphylococcus aureus
TKGNVTG

SEQ ID NO: 1619604 - protein, 7 aa, Staphylococcus aureus
TKQTDWG

SEQ ID NO: 1619605 - protein, 28 aa, Staphylococcus aureus
TKTSESLITDDESSGYNNTREKDEDYFK

SEQ ID NO: 1619606 - protein, 4 aa, Staphylococcus aureus
TLTN

SEQ ID NO: 1619607 - protein, 6 aa, Staphylococcus aureus
TNEGNV

SEQ ID NO: 1619608 - protein, 6 aa, Staphylococcus aureus
TPLDQK

SEQ ID NO: 1619609 - protein, 4 aa, Staphylococcus aureus
TPNM

SEQ ID NO: 1619610 - protein, 5 aa, Staphylococcus aureus
TQWPV

SEQ ID NO: 1619611 - protein, 8 aa, Staphylococcus aureus
TRHDADTI

SEQ ID NO: 1619612 - protein, 4 aa, Staphylococcus aureus
TSFI

SEQ ID NO: 1619613 - protein, 9 aa, Staphylococcus aureus
TYRSRSDDG

SEQ ID NO: 1619614 - protein, 6 aa, Staphylococcus aureus
VAEGTS

SEQ ID NO: 1619615 - protein, 11 aa, Staphylococcus aureus
VAGNPTKGTEN

SEQ ID NO: 1619616 - protein, 7 aa, Staphylococcus aureus
VAGNQNN

SEQ ID NO: 1619617 - protein, 10 aa, Staphylococcus aureus
VEAAKQAAKA

SEQ ID NO: 1619618 - protein, 27 aa, Staphylococcus aureus
VGEDTASSKVHEQHTTNVKVRDIGDDK

SEQ ID NO: 1619619 - protein, 10 aa, Staphylococcus aureus
VGRPPTQRNW

SEQ ID NO: 1619620 - protein, 27 aa, Staphylococcus aureus
VKEDADEENEDEQSTVSEDGTEQQREA

SEQ ID NO: 1619621 - protein, 6 aa, Staphylococcus aureus
VKNSIQ

SEQ ID NO: 1619622 - protein, 16 aa, Staphylococcus aureus
VNANYQKAKSSVKDVE

SEQ ID NO: 1619623 - protein, 10 aa, Staphylococcus aureus
VPANNSEGGY

SEQ ID NO: 1619624 - protein, 13 aa, Staphylococcus aureus
VPDKNATSEDSEE

SEQ ID NO: 1619625 - protein, 4 aa, Staphylococcus aureus
VPEY

SEQ ID NO: 1619626 - protein, 5 aa, Staphylococcus aureus
VQKKE

SEQ ID NO: 1619627 - protein, 7 aa, Staphylococcus aureus
VQTFENE

SEQ ID NO: 1619628 - protein, 6 aa, Staphylococcus aureus
VSQNNG

SEQ ID NO: 1619629 - protein, 4 aa, Staphylococcus aureus
VTTH

SEQ ID NO: 1619630 - protein, 7 aa, Staphylococcus aureus
YDEKQEV

SEQ ID NO: 1619631 - protein, 5 aa, Staphylococcus aureus
YELSQ

SEQ ID NO: 1619632 - protein, 4 aa, Staphylococcus aureus
YENS

SEQ ID NO: 1619633 - protein, 5 aa, Staphylococcus aureus
YGDDV

SEQ ID NO: 1619634 - protein, 12 aa, Staphylococcus aureus
YGVSPNNYKNKT

SEQ ID NO: 1619635 - protein, 10 aa, Staphylococcus aureus
YKDRKTFAES

SEQ ID NO: 1619636 - protein, 53 aa, Staphylococcus aureus
YKKGDDVVNKPIPKTDKQKAEENNGAQQQTSMSQQSNPFESSGQFGYDDQDLA

SEQ ID NO: 1619637 - protein, 5 aa, Staphylococcus aureus
YLDSG

SEQ ID NO: 1619638 - protein, 10 aa, Staphylococcus aureus
YNGKDKDVAP

SEQ ID NO: 1619639 - protein, 7 aa, Staphylococcus aureus
YNNNQIQ

SEQ ID NO: 1619640 - protein, 7 aa, Staphylococcus aureus
YNTIKDK

SEQ ID NO: 1619641 - protein, 9 aa, Staphylococcus aureus
YREETMSGA

SEQ ID NO: 1619642 - protein, 4 aa, Staphylococcus aureus
YRSS

SEQ ID NO: 1619643 - protein, 13 aa, Staphylococcus aureus
YSVTGNKNTAISD

SEQ ID NO: 1619644 - protein, 6 aa, Staphylococcus aureus
YTPKPA

SEQ ID NO: 1619645 - protein, 14 aa, Staphylococcus aureus
YVGEDKKNKKPPYK

SEQ ID NO: 1619646 - protein, 8 aa, Staphylococcus aureus
ADDEPEYQ

SEQ ID NO: 1619647 - protein, 7 aa, Staphylococcus aureus
ADDIDKG

SEQ ID NO: 1619648 - protein, 6 aa, Staphylococcus aureus
AENDNA

SEQ ID NO: 1619649 - protein, 13 aa, Staphylococcus aureus
AESPNTNDNSVTI

SEQ ID NO: 1619650 - protein, 14 aa, Staphylococcus aureus
AGARGLLDQESNDF

SEQ ID NO: 1619651 - protein, 8 aa, Staphylococcus aureus
AGYDSEQN

SEQ ID NO: 1619652 - protein, 11 aa, Staphylococcus aureus
AKDQTQINDKI

SEQ ID NO: 1619653 - protein, 6 aa, Staphylococcus aureus
AKQTDF

SEQ ID NO: 1619654 - protein, 24 aa, Staphylococcus aureus
ANPPYSAKWTADSKFENDERFSGY

SEQ ID NO: 1619655 - protein, 14 aa, Staphylococcus aureus
APIAKQNATKGYGA

SEQ ID NO: 1619656 - protein, 8 aa, Staphylococcus aureus
APKLNSKQ

SEQ ID NO: 1619657 - protein, 4 aa, Staphylococcus aureus
AQDQ

SEQ ID NO: 1619658 - protein, 7 aa, Staphylococcus aureus
ARANDLA

SEQ ID NO: 1619659 - protein, 5 aa, Staphylococcus aureus
ARIEK

SEQ ID NO: 1619660 - protein, 14 aa, Staphylococcus aureus
ARTEAGRAMSQAGL

SEQ ID NO: 1619661 - protein, 7 aa, Staphylococcus aureus
ASDKDGL

SEQ ID NO: 1619662 - protein, 4 aa, Staphylococcus aureus
ASID

SEQ ID NO: 1619663 - protein, 37 aa, Staphylococcus aureus
ATVKPKANQAIDAKAQETKESIDQSDQLTAEEKTAAL

SEQ ID NO: 1619664 - protein, 6 aa, Staphylococcus aureus
AVAGKF

SEQ ID NO: 1619665 - protein, 84 aa, Staphylococcus aureus
AVTDAKNNITAATDNNGVDTAKDAGKNSIQSTQPATAVKSNAKNEVDQAVTTQNQAIDNTTGATTEEKNAAKDLVSKAKEKAYQ

SEQ ID NO: 1619666 - protein, 6 aa, Staphylococcus aureus
DDAPCV

SEQ ID NO: 1619667 - protein, 9 aa, Staphylococcus aureus
DEGGGSSIP

SEQ ID NO: 1619668 - protein, 10 aa, Staphylococcus aureus
DENATQEDYK

SEQ ID NO: 1619669 - protein, 7 aa, Staphylococcus aureus
DENYDYG

SEQ ID NO: 1619670 - protein, 5 aa, Staphylococcus aureus
DEVKV

SEQ ID NO: 1619671 - protein, 11 aa, Staphylococcus aureus
DFSESSEDYGV

SEQ ID NO: 1619672 - protein, 5 aa, Staphylococcus aureus
DGGFD

SEQ ID NO: 1619673 - protein, 9 aa, Staphylococcus aureus
DGTNPALNI

SEQ ID NO: 1619674 - protein, 13 aa, Staphylococcus aureus
DIDTHATSNNEDF

SEQ ID NO: 1619675 - protein, 4 aa, Staphylococcus aureus
DKEL

SEQ ID NO: 1619676 - protein, 20 aa, Staphylococcus aureus
DKGSFDPFPNSPRQDQKNPL

SEQ ID NO: 1619677 - protein, 9 aa, Staphylococcus aureus
DKPEQFRET

SEQ ID NO: 1619678 - protein, 15 aa, Staphylococcus aureus
DKQSGRKDNRSGYRQ

SEQ ID NO: 1619679 - protein, 9 aa, Staphylococcus aureus
DKVKADVQD

SEQ ID NO: 1619680 - protein, 5 aa, Staphylococcus aureus
DNEPF

SEQ ID NO: 1619681 - protein, 4 aa, Staphylococcus aureus
DQPY

SEQ ID NO: 1619682 - protein, 15 aa, Staphylococcus aureus
DRTDLSSDKSVDSET

SEQ ID NO: 1619683 - protein, 5 aa, Staphylococcus aureus
DSTDF

SEQ ID NO: 1619684 - protein, 12 aa, Staphylococcus aureus
DTTKADALTGED

SEQ ID NO: 1619685 - protein, 5 aa, Staphylococcus aureus
DVDKN

SEQ ID NO: 1619686 - protein, 5 aa, Staphylococcus aureus
DVSAG

SEQ ID NO: 1619687 - protein, 10 aa, Staphylococcus aureus
DVTTKYHNGQ

SEQ ID NO: 1619688 - protein, 8 aa, Staphylococcus aureus
EDQKLKER

SEQ ID NO: 1619689 - protein, 17 aa, Staphylococcus aureus
EDTEVNRTTTKKALTAG

SEQ ID NO: 1619690 - protein, 11 aa, Staphylococcus aureus
EEKTTQEFSKR

SEQ ID NO: 1619691 - protein, 5 aa, Staphylococcus aureus
EESHI

SEQ ID NO: 1619692 - protein, 5 aa, Staphylococcus aureus
EFGPM

SEQ ID NO: 1619693 - protein, 14 aa, Staphylococcus aureus
EHNEDTERLFFIAK

SEQ ID NO: 1619694 - protein, 11 aa, Staphylococcus aureus
EKANSGHPGLP

SEQ ID NO: 1619695 - protein, 20 aa, Staphylococcus aureus
EKEGRDAANVAQEKAEKEGK

SEQ ID NO: 1619696 - protein, 7 aa, Staphylococcus aureus
EKGIYKG

SEQ ID NO: 1619697 - protein, 7 aa, Staphylococcus aureus
EKLNRIR

SEQ ID NO: 1619698 - protein, 18 aa, Staphylococcus aureus
EKVTDNRHSKGANFHNDD

SEQ ID NO: 1619699 - protein, 9 aa, Staphylococcus aureus
EKVVDANKQ

SEQ ID NO: 1619700 - protein, 11 aa, Staphylococcus aureus
ELEQSNASPNV

SEQ ID NO: 1619701 - protein, 7 aa, Staphylococcus aureus
ENGYPIT

SEQ ID NO: 1619702 - protein, 10 aa, Staphylococcus aureus
ENVQDGSKDI

SEQ ID NO: 1619703 - protein, 4 aa, Staphylococcus aureus
EPTT

SEQ ID NO: 1619704 - protein, 16 aa, Staphylococcus aureus
EQDEADYQTERSEQLG

SEQ ID NO: 1619705 - protein, 14 aa, Staphylococcus aureus
EREGKYRVENNTEM

SEQ ID NO: 1619706 - protein, 7 aa, Staphylococcus aureus
ERWGPRT

SEQ ID NO: 1619707 - protein, 4 aa, Staphylococcus aureus
ESKP

SEQ ID NO: 1619708 - protein, 12 aa, Staphylococcus aureus
EVRKKLRGQYAK

SEQ ID NO: 1619709 - protein, 9 aa, Staphylococcus aureus
EVRPTENQI

SEQ ID NO: 1619710 - protein, 12 aa, Staphylococcus aureus
FEQTNQSLKSYK

SEQ ID NO: 1619711 - protein, 6 aa, Staphylococcus aureus
FKDNDL

SEQ ID NO: 1619712 - protein, 7 aa, Staphylococcus aureus
FKENGDW

SEQ ID NO: 1619713 - protein, 6 aa, Staphylococcus aureus
FNEEQG

SEQ ID NO: 1619714 - protein, 16 aa, Staphylococcus aureus
FPPSTSKFSTSRHHQM

SEQ ID NO: 1619715 - protein, 4 aa, Staphylococcus aureus
FRPD

SEQ ID NO: 1619716 - protein, 17 aa, Staphylococcus aureus
FRTQEDSASSKAEEKFA

SEQ ID NO: 1619717 - protein, 9 aa, Staphylococcus aureus
FTAEEGNEL

SEQ ID NO: 1619718 - protein, 14 aa, Staphylococcus aureus
GDGDLKGSSVGSKE

SEQ ID NO: 1619719 - protein, 8 aa, Staphylococcus aureus
GDNSADIE

SEQ ID NO: 1619720 - protein, 20 aa, Staphylococcus aureus
GFGSPNKAGTNGVHGAPLGE

SEQ ID NO: 1619721 - protein, 4 aa, Staphylococcus aureus
GGIA

SEQ ID NO: 1619722 - protein, 13 aa, Staphylococcus aureus
GGLPNKEPQIQEK

SEQ ID NO: 1619723 - protein, 9 aa, Staphylococcus aureus
GGLTGSNEV

SEQ ID NO: 1619724 - protein, 14 aa, Staphylococcus aureus
GGYSREKANELLKD

SEQ ID NO: 1619725 - protein, 9 aa, Staphylococcus aureus
GINEPAPEL

SEQ ID NO: 1619726 - protein, 8 aa, Staphylococcus aureus
GKNWPQKN

SEQ ID NO: 1619727 - protein, 9 aa, Staphylococcus aureus
GKSYTDSDT

SEQ ID NO: 1619728 - protein, 52 aa, Staphylococcus aureus
GKTVNGKTNNGKTVNGKSHTTNNNSTNNDLTNNNNTNNEGSILSGNPTVSSI

SEQ ID NO: 1619729 - protein, 10 aa, Staphylococcus aureus
GNSELTLSGE

SEQ ID NO: 1619730 - protein, 21 aa, Staphylococcus aureus
GPNIEGDEKSAYNNVQVGGAP

SEQ ID NO: 1619731 - protein, 5 aa, Staphylococcus aureus
GSKDR

SEQ ID NO: 1619732 - protein, 6 aa, Staphylococcus aureus
GYKTDG

SEQ ID NO: 1619733 - protein, 11 aa, Staphylococcus aureus
GYTKEEQKMID

SEQ ID NO: 1619734 - protein, 14 aa, Staphylococcus aureus
HATAREGKYAGQER

SEQ ID NO: 1619735 - protein, 11 aa, Staphylococcus aureus
HDLEPKKNEFE

SEQ ID NO: 1619736 - protein, 24 aa, Staphylococcus aureus
HHSDESIHPNDDVNKSQSSNDTFP

SEQ ID NO: 1619737 - protein, 4 aa, Staphylococcus aureus
HPRM

SEQ ID NO: 1619738 - protein, 11 aa, Staphylococcus aureus
HQTINSKEENL

SEQ ID NO: 1619739 - protein, 4 aa, Staphylococcus aureus
HRDE

SEQ ID NO: 1619740 - protein, 18 aa, Staphylococcus aureus
HRESPQSVEVAAEKQHTI

SEQ ID NO: 1619741 - protein, 13 aa, Staphylococcus aureus
HTDDDEKADEDGF

SEQ ID NO: 1619742 - protein, 5 aa, Staphylococcus aureus
IAAGA

SEQ ID NO: 1619743 - protein, 10 aa, Staphylococcus aureus
IEAGGNTAYN

SEQ ID NO: 1619744 - protein, 15 aa, Staphylococcus aureus
IEATTTAQDLDRVKN

SEQ ID NO: 1619745 - protein, 6 aa, Staphylococcus aureus
IEEQDY

SEQ ID NO: 1619746 - protein, 19 aa, Staphylococcus aureus
IETKDIDGNTSFENEQTSY

SEQ ID NO: 1619747 - protein, 8 aa, Staphylococcus aureus
IGRTEPEW

SEQ ID NO: 1619748 - protein, 18 aa, Staphylococcus aureus
IGTPISTGNASWRGPNIE

SEQ ID NO: 1619749 - protein, 7 aa, Staphylococcus aureus
IKEDDEK

SEQ ID NO: 1619750 - protein, 4 aa, Staphylococcus aureus
INAR

SEQ ID NO: 1619751 - protein, 31 aa, Staphylococcus aureus; identical to SEQ ID NO: 1570835

SEQ ID NO: 1619752 - protein, 8 aa, Staphylococcus aureus
INGNFTKA

SEQ ID NO: 1619753 - protein, 5 aa, Staphylococcus aureus
IPGSL

SEQ ID NO: 1619754 - protein, 4 aa, Staphylococcus aureus
IPTR

SEQ ID NO: 1619755 - protein, 6 aa, Staphylococcus aureus
ISRKNK

SEQ ID NO: 1619756 - protein, 72 aa, Staphylococcus aureus
ITPDANVKPQAKQAIADKVQAQETAIDANNGATTEEKTAAKQQVQTEKTTADTAIDGAHSNAEVEAAKNAEI

SEQ ID NO: 1619757 - protein, 26 aa, Staphylococcus aureus
IVADGGNSEGGAGAKYQGAKHPNEKV

SEQ ID NO: 1619758 - protein, 12 aa, Staphylococcus aureus
IVTETSEEELKQ

SEQ ID NO: 1619759 - protein, 14 aa, Staphylococcus aureus
KAANPKHGVKTKEL

SEQ ID NO: 1619760 - protein, 6 aa, Staphylococcus aureus
KAKGVD

SEQ ID NO: 1619761 - protein, 5 aa, Staphylococcus aureus
KANAA

SEQ ID NO: 1619762 - protein, 6 aa, Staphylococcus aureus
KAPRFK

SEQ ID NO: 1619763 - protein, 8 aa, Staphylococcus aureus
KDGDPRAK

SEQ ID NO: 1619764 - protein, 13 aa, Staphylococcus aureus
KDISEEDANYASG

SEQ ID NO: 1619765 - protein, 17 aa, Staphylococcus aureus
KEGFRDEEFDKGDKGTW

SEQ ID NO: 1619766 - protein, 11 aa, Staphylococcus aureus
KEPKNRHTYPT

SEQ ID NO: 1619767 - protein, 6 aa, Staphylococcus aureus
KERPHY

SEQ ID NO: 1619768 - protein, 8 aa, Staphylococcus aureus
KGENRETV

SEQ ID NO: 1619769 - protein, 14 aa, Staphylococcus aureus
KGYREAFKSNQPLS

SEQ ID NO: 1619770 - protein, 8 aa, Staphylococcus aureus
KIEEKNEY

SEQ ID NO: 1619771 - protein, 6 aa, Staphylococcus aureus
KIPSET

SEQ ID NO: 1619772 - protein, 6 aa, Staphylococcus aureus
KITHED

SEQ ID NO: 1619773 - protein, 18 aa, Staphylococcus aureus
KKAQEVGNEIGEKLTSEE

SEQ ID NO: 1619774 - protein, 7 aa, Staphylococcus aureus
KKGYEGK

SEQ ID NO: 1619775 - protein, 10 aa, Staphylococcus aureus
KKQKQNLTDR

SEQ ID NO: 1619776 - protein, 4 aa, Staphylococcus aureus
KLDS

SEQ ID NO: 1619777 - protein, 14 aa, Staphylococcus aureus
KLNLTTRPTLKSIE

SEQ ID NO: 1619778 - protein, 7 aa, Staphylococcus aureus
KMSEDLT

SEQ ID NO: 1619779 - protein, 23 aa, Staphylococcus aureus
KNAENLKSPEKIKEEINKKKNTK

SEQ ID NO: 1619780 - protein, 10 aa, Staphylococcus aureus
KNKAETEKYR

SEQ ID NO: 1619781 - protein, 16 aa, Staphylococcus aureus
KNYSEEALATKSINAN

SEQ ID NO: 1619782 - protein, 12 aa, Staphylococcus aureus
KQIADDKLRKEI

SEQ ID NO: 1619783 - protein, 14 aa, Staphylococcus aureus
KRKKTIDKYSYSAT

SEQ ID NO: 1619784 - protein, 8 aa, Staphylococcus aureus
KSARNKAQ

SEQ ID NO: 1619785 - protein, 12 aa, Staphylococcus aureus
KSLAKGSATTFD

SEQ ID NO: 1619786 - protein, 5 aa, Staphylococcus aureus
KTKSK

SEQ ID NO: 1619787 - protein, 8 aa, Staphylococcus aureus
KVLNTGEK

SEQ ID NO: 1619788 - protein, 8 aa, Staphylococcus aureus
KVNQPEDV

SEQ ID NO: 1619789 - protein, 12 aa, Staphylococcus aureus
KVTAGEAGGITQ

SEQ ID NO: 1619790 - protein, 5 aa, Staphylococcus aureus
KYGYD

SEQ ID NO: 1619791 - protein, 11 aa, Staphylococcus aureus
LGGRQNQTDHA

SEQ ID NO: 1619792 - protein, 9 aa, Staphylococcus aureus
LGIGGDGDP

SEQ ID NO: 1619793 - protein, 6 aa, Staphylococcus aureus
LGITRK

SEQ ID NO: 1619794 - protein, 4 aa, Staphylococcus aureus
LGRN

SEQ ID NO: 1619795 - protein, 10 aa, Staphylococcus aureus
LGSLPTTTLG

SEQ ID NO: 1619796 - protein, 5 aa, Staphylococcus aureus
LNFGN

SEQ ID NO: 1619797 - protein, 9 aa, Staphylococcus aureus
LPKPKGARD

SEQ ID NO: 1619798 - protein, 9 aa, Staphylococcus aureus
LPKTNSGKI

SEQ ID NO: 1619799 - protein, 8 aa, Staphylococcus aureus
LPTGGGKS

SEQ ID NO: 1619800 - protein, 8 aa, Staphylococcus aureus
LRADKKVD

SEQ ID NO: 1619801 - protein, 15 aa, Staphylococcus aureus
LRDTETIKNKMKNNT

SEQ ID NO: 1619802 - protein, 12 aa, Staphylococcus aureus
LSESQRKKYRGK

SEQ ID NO: 1619803 - protein, 48 aa, Staphylococcus aureus
MEKPEVDSEYATTDNEEHIQEQSNQDKSYFDSESIGNQSGGVRQREPL

SEQ ID NO: 1619804 - protein, 7 aa, Staphylococcus aureus
MHGPELP

SEQ ID NO: 1619805 - protein, 4 aa, Staphylococcus aureus
MKPP

SEQ ID NO: 1619806 - protein, 15 aa, Staphylococcus aureus
NDFEKGKNQNHLSDA

SEQ ID NO: 1619807 - protein, 4 aa, Staphylococcus aureus
NDVN

SEQ ID NO: 1619808 - protein, 8 aa, Staphylococcus aureus
NENKKEIN

SEQ ID NO: 1619809 - protein, 5 aa, Staphylococcus aureus
NGEQI

SEQ ID NO: 1619810 - protein, 30 aa, Staphylococcus aureus
NGGAPTASNESAASATSEEVAETPAAPAAV

SEQ ID NO: 1619811 - protein, 5 aa, Staphylococcus aureus
NHGGK

SEQ ID NO: 1619812 - protein, 4 aa, Staphylococcus aureus
NHPQ

SEQ ID NO: 1619813 - protein, 9 aa, Staphylococcus aureus
NIERYTNQG

SEQ ID NO: 1619814 - protein, 16 aa, Staphylococcus aureus
NIPTADYKEVERKKDA

SEQ ID NO: 1619815 - protein, 12 aa, Staphylococcus aureus
NKIQNETKKITF

SEQ ID NO: 1619816 - protein, 12 aa, Staphylococcus aureus
NNFDPKSKDEIN

SEQ ID NO: 1619817 - protein, 6 aa, Staphylococcus aureus
NTEEID

SEQ ID NO: 1619818 - protein, 6 aa, Staphylococcus aureus
NVTDEF

SEQ ID NO: 1619819 - protein, 9 aa, Staphylococcus aureus
PDAGKTTLT

SEQ ID NO: 1619820 - protein, 11 aa, Staphylococcus aureus
PDKDKTLNEGA

SEQ ID NO: 1619821 - protein, 6 aa, Staphylococcus aureus
PDVPSM

SEQ ID NO: 1619822 - protein, 20 aa, Staphylococcus aureus
PEGPILNPDTKYDSHGVYSG

SEQ ID NO: 1619823 - protein, 11 aa, Staphylococcus aureus
PKEYGGEGATI

SEQ ID NO: 1619824 - protein, 7 aa, Staphylococcus aureus
PNTENFE

SEQ ID NO: 1619825 - protein, 9 aa, Staphylococcus aureus
PQDTESYTH

SEQ ID NO: 1619826 - protein, 16 aa, Staphylococcus aureus
PTGNDSGGDKLLPKTL

SEQ ID NO: 1619827 - protein, 8 aa, Staphylococcus aureus
PVGYTEQP

SEQ ID NO: 1619828 - protein, 19 aa, Staphylococcus aureus
QAPANYYPEDEYGGYIEPE

SEQ ID NO: 1619829 - protein, 6 aa, Staphylococcus aureus
QDYQEK

SEQ ID NO: 1619830 - protein, 4 aa, Staphylococcus aureus
QESL

SEQ ID NO: 1619831 - protein, 5 aa, Staphylococcus aureus
QGVSV

SEQ ID NO: 1619832 - protein, 6 aa, Staphylococcus aureus
QHAEDV

SEQ ID NO: 1619833 - protein, 4 aa, Staphylococcus aureus
QHQD

SEQ ID NO: 1619834 - protein, 9 aa, Staphylococcus aureus
QKADPSMKY

SEQ ID NO: 1619835 - protein, 12 aa, Staphylococcus aureus
QKGAKATKAGEE

SEQ ID NO: 1619836 - protein, 7 aa, Staphylococcus aureus
QMKPQDT

SEQ ID NO: 1619837 - protein, 8 aa, Staphylococcus aureus
QNNPFGKG

SEQ ID NO: 1619838 - protein, 19 aa, Staphylococcus aureus
QSAASLSDFESSAKSWVET

SEQ ID NO: 1619839 - protein, 5 aa, Staphylococcus aureus
QSTSK

SEQ ID NO: 1619840 - protein, 5 aa, Staphylococcus aureus
QTTTN

SEQ ID NO: 1619841 - protein, 9 aa, Staphylococcus aureus
QVGDGPQQR

SEQ ID NO: 1619842 - protein, 10 aa, Staphylococcus aureus
QYEGDIPDYP

SEQ ID NO: 1619843 - protein, 9 aa, Staphylococcus aureus
RAKNDEKYI

SEQ ID NO: 1619844 - protein, 25 aa, Staphylococcus aureus
REDQKKKSDKYAKEQEETARRNREN

SEQ ID NO: 1619845 - protein, 4 aa, Staphylococcus aureus
REGE

SEQ ID NO: 1619846 - protein, 8 aa, Staphylococcus aureus
RESETDKV

SEQ ID NO: 1619847 - protein, 12 aa, Staphylococcus aureus
RGANGEAGEIGK

SEQ ID NO: 1619848 - protein, 8 aa, Staphylococcus aureus
RKDKDGTL

SEQ ID NO: 1619849 - protein, 4 aa, Staphylococcus aureus
RKPS

SEQ ID NO: 1619850 - protein, 11 aa, Staphylococcus aureus
RLTDSGTVVSG

SEQ ID NO: 1619851 - protein, 4 aa, Staphylococcus aureus
RNNG

SEQ ID NO: 1619852 - protein, 8 aa, Staphylococcus aureus
RPTSSGFE

SEQ ID NO: 1619853 - protein, 14 aa, Staphylococcus aureus
RQMSRGNPKKSHTW

SEQ ID NO: 1619854 - protein, 7 aa, Staphylococcus aureus
RTEGLKK

SEQ ID NO: 1619855 - protein, 4 aa, Staphylococcus aureus
SADE

SEQ ID NO: 1619856 - protein, 5 aa, Staphylococcus aureus
SAHRT

SEQ ID NO: 1619857 - protein, 13 aa, Staphylococcus aureus
SETIDTPVQTLDQ

SEQ ID NO: 1619858 - protein, 8 aa, Staphylococcus aureus
SETSSKLD

SEQ ID NO: 1619859 - protein, 7 aa, Staphylococcus aureus
SGCGKST

SEQ ID NO: 1619860 - protein, 7 aa, Staphylococcus aureus
SGEGYSK

SEQ ID NO: 1619861 - protein, 6 aa, Staphylococcus aureus
SGKEPQ

SEQ ID NO: 1619862 - protein, 7 aa, Staphylococcus aureus
SGLNTAL

SEQ ID NO: 1619863 - protein, 5 aa, Staphylococcus aureus
SHHDN

SEQ ID NO: 1619864 - protein, 5 aa, Staphylococcus aureus
SIEAM

SEQ ID NO: 1619865 - protein, 4 aa, Staphylococcus aureus
SIPL

SEQ ID NO: 1619866 - protein, 21 aa, Staphylococcus aureus
SIRSYNASGVEDIGLKDGDSL

SEQ ID NO: 1619867 - protein, 5 aa, Staphylococcus aureus
SISPG

SEQ ID NO: 1619868 - protein, 5 aa, Staphylococcus aureus
SKTFP

SEQ ID NO: 1619869 - protein, 6 aa, Staphylococcus aureus
SLKGSA

SEQ ID NO: 1619870 - protein, 5 aa, Staphylococcus aureus
SLNPT

SEQ ID NO: 1619871 - protein, 8 aa, Staphylococcus aureus
SNSEYERE

SEQ ID NO: 1619872 - protein, 6 aa, Staphylococcus aureus
SNYDEV

SEQ ID NO: 1619873 - protein, 13 aa, Staphylococcus aureus
SPPKDGNDKNRKR

SEQ ID NO: 1619874 - protein, 4 aa, Staphylococcus aureus
SQQE

SEQ ID NO: 1619875 - protein, 25 aa, Staphylococcus aureus
SSAGRIAARARGRYGGRPEKLNKQD

SEQ ID NO: 1619876 - protein, 13 aa, Staphylococcus aureus
SSDGAQLSTDASE

SEQ ID NO: 1619877 - protein, 7 aa, Staphylococcus aureus
SSPYETG

SEQ ID NO: 1619878 - protein, 11 aa, Staphylococcus aureus
STDNASWRGPN

SEQ ID NO: 1619879 - protein, 13 aa, Staphylococcus aureus
SYNHPEADIGPRI

SEQ ID NO: 1619880 - protein, 9 aa, Staphylococcus aureus
TEHNGQSIQ

SEQ ID NO: 1619881 - protein, 7 aa, Staphylococcus aureus
TGGCPHT

SEQ ID NO: 1619882 - protein, 7 aa, Staphylococcus aureus
TGSNTVS

SEQ ID NO: 1619883 - protein, 11 aa, Staphylococcus aureus
TINNKDNSYNQ

SEQ ID NO: 1619884 - protein, 16 aa, Staphylococcus aureus
TKEEAAQHFKDQDAAT

SEQ ID NO: 1619885 - protein, 8 aa, Staphylococcus aureus
TPFQHREP

SEQ ID NO: 1619886 - protein, 5 aa, Staphylococcus aureus
TQNQC

SEQ ID NO: 1619887 - protein, 7 aa, Staphylococcus aureus
TTNSEVD

SEQ ID NO: 1619888 - protein, 5 aa, Staphylococcus aureus
VDPEE

SEQ ID NO: 1619889 - protein, 4 aa, Staphylococcus aureus
VDPI

SEQ ID NO: 1619890 - protein, 10 aa, Staphylococcus aureus
VEEDTSKSLR

SEQ ID NO: 1619891 - protein, 16 aa, Staphylococcus aureus
VETTELSSDDHHTTVR

SEQ ID NO: 1619892 - protein, 6 aa, Staphylococcus aureus
VGQTHR

SEQ ID NO: 1619893 - protein, 8 aa, Staphylococcus aureus
VKDSTETE

SEQ ID NO: 1619894 - protein, 11 aa, Staphylococcus aureus
VNPEDNDLDQG

SEQ ID NO: 1619895 - protein, 4 aa, Staphylococcus aureus
VSEQ

SEQ ID NO: 1619896 - protein, 4 aa, Staphylococcus aureus
VSFK

SEQ ID NO: 1619897 - protein, 6 aa, Staphylococcus aureus
VSKGNA

SEQ ID NO: 1619898 - protein, 7 aa, Staphylococcus aureus
VTGHSAE

SEQ ID NO: 1619899 - protein, 10 aa, Staphylococcus aureus
VTTRKDGNKH

SEQ ID NO: 1619900 - protein, 17 aa, Staphylococcus aureus
YDTSNETVVPKESPSNI

SEQ ID NO: 1619901 - protein, 9 aa, Staphylococcus aureus
YGSPEENYQ

SEQ ID NO: 1619902 - protein, 7 aa, Staphylococcus aureus
YKETEAK

SEQ ID NO: 1619903 - protein, 6 aa, Staphylococcus aureus
YKKEIS

SEQ ID NO: 1619904 - protein, 10 aa, Staphylococcus aureus
YNIPTKKAPK

SEQ ID NO: 1619905 - protein, 4 aa, Staphylococcus aureus
YNQT

SEQ ID NO: 1619906 - protein, 10 aa, Staphylococcus aureus
YQRGSIENAN

SEQ ID NO: 1619907 - protein, 4 aa, Staphylococcus aureus
YQRR

SEQ ID NO: 1619908 - protein, 7 aa, Staphylococcus aureus
YRGYDSA

SEQ ID NO: 1619909 - protein, 6 aa, Staphylococcus aureus
YSKEVP

SEQ ID NO: 1619910 - protein, 7 aa, Staphylococcus aureus
YYEGKTK

SEQ ID NO: 1619911 - protein, 8 aa, Staphylococcus aureus
ADKNHSHT

SEQ ID NO: 1619912 - protein, 5 aa, Staphylococcus aureus
AEDGG

SEQ ID NO: 1619913 - protein, 7 aa, Staphylococcus aureus
AEGDLQP

SEQ ID NO: 1619914 - protein, 4 aa, Staphylococcus aureus
AFKN

SEQ ID NO: 1619915 - protein, 5 aa, Staphylococcus aureus
AKEGY

SEQ ID NO: 1619916 - protein, 21 aa, Staphylococcus aureus
AKLQEKAKNQMKEMIESDKIK

SEQ ID NO: 1619917 - protein, 12 aa, Staphylococcus aureus
AKSNKQGGLSNE

SEQ ID NO: 1619918 - protein, 7 aa, Staphylococcus aureus
AKVAKKI

SEQ ID NO: 1619919 - protein, 13 aa, Staphylococcus aureus
AKYKNHPKETNEK

SEQ ID NO: 1619920 - protein, 62 aa, Staphylococcus aureus
ANPVKKPAGKTELDQAAADKKTQIEQTPNASQQEINDAKQEVDAALNQAKTNIDQSSTNEYV

SEQ ID NO: 1619921 - protein, 22 aa, Staphylococcus aureus
ARERKKSDERIKDAKENNDSNE

SEQ ID NO: 1619922 - protein, 4 aa, Staphylococcus aureus
ASDT

SEQ ID NO: 1619923 - protein, 5 aa, Staphylococcus aureus
ATDPA

SEQ ID NO: 1619924 - protein, 7 aa, Staphylococcus aureus
ATRSALN

SEQ ID NO: 1619925 - protein, 18 aa, Staphylococcus aureus
CNTKGLAISGGDVGGSKN

SEQ ID NO: 1619926 - protein, 6 aa, Staphylococcus aureus
DAPEGM

SEQ ID NO: 1619927 - protein, 15 aa, Staphylococcus aureus
DDETLENLNNESIDT

SEQ ID NO: 1619928 - protein, 15 aa, Staphylococcus aureus
DDPKEVDDRQTWEKA

SEQ ID NO: 1619929 - protein, 6 aa, Staphylococcus aureus
DERFPS

SEQ ID NO: 1619930 - protein, 8 aa, Staphylococcus aureus
DESDELNH

SEQ ID NO: 1619931 - protein, 10 aa, Staphylococcus aureus
DEVKSYSDDV

SEQ ID NO: 1619932 - protein, 8 aa, Staphylococcus aureus
DGEDNVKI

SEQ ID NO: 1619933 - protein, 6 aa, Staphylococcus aureus
DHQGTS

SEQ ID NO: 1619934 - protein, 7 aa, Staphylococcus aureus
DISEGEK

SEQ ID NO: 1619935 - protein, 17 aa, Staphylococcus aureus
DKIAEAEAAGADYVGEA

SEQ ID NO: 1619936 - protein, 12 aa, Staphylococcus aureus
DKIGDNQLETNS

SEQ ID NO: 1619937 - protein, 12 aa, Staphylococcus aureus
DKSKLDLNDKES

SEQ ID NO: 1619938 - protein, 9 aa, Staphylococcus aureus
DKSRKLTHN

SEQ ID NO: 1619939 - protein, 6 aa, Staphylococcus aureus
DNDPDY

SEQ ID NO: 1619940 - protein, 10 aa, Staphylococcus aureus
DNVKQPAHYT

SEQ ID NO: 1619941 - protein, 8 aa, Staphylococcus aureus
DQAKQRKK

SEQ ID NO: 1619942 - protein, 8 aa, Staphylococcus aureus
DQAPSTKV

SEQ ID NO: 1619943 - protein, 19 aa, Staphylococcus aureus
DQISSGSVIANGQELNKLN

SEQ ID NO: 1619944 - protein, 5 aa, Staphylococcus aureus
DQNKK

SEQ ID NO: 1619945 - protein, 7 aa, Staphylococcus aureus
DQNLERQ

SEQ ID NO: 1619946 - protein, 5 aa, Staphylococcus aureus
DSIDD

SEQ ID NO: 1619947 - protein, 8 aa, Staphylococcus aureus
DSNMSQKK

SEQ ID NO: 1619948 - protein, 9 aa, Staphylococcus aureus
DSTDGVQRG

SEQ ID NO: 1619949 - protein, 5 aa, Staphylococcus aureus
DTGVS

SEQ ID NO: 1619950 - protein, 15 aa, Staphylococcus aureus
DTLDEKTKQALQQSY

SEQ ID NO: 1619951 - protein, 9 aa, Staphylococcus aureus
DTPQRIGSM

SEQ ID NO: 1619952 - protein, 18 aa, Staphylococcus aureus
DTTEIQNAALPNNKVESL

SEQ ID NO: 1619953 - protein, 10 aa, Staphylococcus aureus
DVKEKTQQRL

SEQ ID NO: 1619954 - protein, 6 aa, Staphylococcus aureus
DVTAKT

SEQ ID NO: 1619955 - protein, 17 aa, Staphylococcus aureus
EDLSQDEIEELRNILNK

SEQ ID NO: 1619956 - protein, 12 aa, Staphylococcus aureus
EEKYNEALSRDD

SEQ ID NO: 1619957 - protein, 4 aa, Staphylococcus aureus
EELS

SEQ ID NO: 1619958 - protein, 8 aa, Staphylococcus aureus
EENNPDSL

SEQ ID NO: 1619959 - protein, 4 aa, Staphylococcus aureus
EETR

SEQ ID NO: 1619960 - protein, 7 aa, Staphylococcus aureus
EGQENQL

SEQ ID NO: 1619961 - protein, 5 aa, Staphylococcus aureus
EKLHS

SEQ ID NO: 1619962 - protein, 12 aa, Staphylococcus aureus
ELKTNKTSTEGD

SEQ ID NO: 1619963 - protein, 12 aa, Staphylococcus aureus
ELNDKENRRDQM

SEQ ID NO: 1619964 - protein, 4 aa, Staphylococcus aureus
ENGL

SEQ ID NO: 1619965 - protein, 11 aa, Staphylococcus aureus
ENGQVNEQGLK

SEQ ID NO: 1619966 - protein, 4 aa, Staphylococcus aureus
ENHY

SEQ ID NO: 1619967 - protein, 9 aa, Staphylococcus aureus
ENKKPNHHY

SEQ ID NO: 1619968 - protein, 6 aa, Staphylococcus aureus
ENYDYG

SEQ ID NO: 1619969 - protein, 13 aa, Staphylococcus aureus
EPQSDDQNMNETR

SEQ ID NO: 1619970 - protein, 13 aa, Staphylococcus aureus
EQLEEQNSKGDNV

SEQ ID NO: 1619971 - protein, 32 aa, Staphylococcus aureus
EQRQNTENNQEKTFSSEESNSKSFMAENQNDE

SEQ ID NO: 1619972 - protein, 8 aa, Staphylococcus aureus
ERDNQPHT

SEQ ID NO: 1619973 - protein, 4 aa, Staphylococcus aureus
ERQI

SEQ ID NO: 1619974 - protein, 5 aa, Staphylococcus aureus
ESEID

SEQ ID NO: 1619975 - protein, 20 aa, Staphylococcus aureus
ESIHPNDDVNESQSSNDTFP

SEQ ID NO: 1619976 - protein, 11 aa, Staphylococcus aureus
ESISQKYDEIA

SEQ ID NO: 1619977 - protein, 16 aa, Staphylococcus aureus
ESKSGGKSGDFQRQSN

SEQ ID NO: 1619978 - protein, 4 aa, Staphylococcus aureus
ESTA

SEQ ID NO: 1619979 - protein, 4 aa, Staphylococcus aureus
ETLY

SEQ ID NO: 1619980 - protein, 4 aa, Staphylococcus aureus
EVPN

SEQ ID NO: 1619981 - protein, 9 aa, Staphylococcus aureus
EVTGKDASQ

SEQ ID NO: 1619982 - protein, 6 aa, Staphylococcus aureus
FDTEKQ

SEQ ID NO: 1619983 - protein, 7 aa, Staphylococcus aureus
FKPNTNE

SEQ ID NO: 1619984 - protein, 14 aa, Staphylococcus aureus
FNNKSLSDKYKNKN

SEQ ID NO: 1619985 - protein, 6 aa, Staphylococcus aureus
FPADDI

SEQ ID NO: 1619986 - protein, 5 aa, Staphylococcus aureus
FQEEA

SEQ ID NO: 1619987 - protein, 19 aa, Staphylococcus aureus
FSKNENISLKGEETKTGDV

SEQ ID NO: 1619988 - protein, 25 aa, Staphylococcus aureus
FTRSSIKGQTKQDKVEFQNDDVEGN

SEQ ID NO: 1619989 - protein, 8 aa, Staphylococcus aureus
FVPGEKAT

SEQ ID NO: 1619990 - protein, 4 aa, Staphylococcus aureus
FYQR

SEQ ID NO: 1619991 - protein, 18 aa, Staphylococcus aureus
GAFEPFPNSPRQDENNPL

SEQ ID NO: 1619992 - protein, 7 aa, Staphylococcus aureus
GARSVTS

SEQ ID NO: 1619993 - protein, 4 aa, Staphylococcus aureus
GEDH

SEQ ID NO: 1619994 - protein, 28 aa, Staphylococcus aureus
GEIRNGESGSDQKLTSGQVESLIQEPKK

SEQ ID NO: 1619995 - protein, 13 aa, Staphylococcus aureus
GEKYPETKDEKSQ

SEQ ID NO: 1619996 - protein, 21 aa, Staphylococcus aureus
GFGSPNKAGTNGVHGAPLGEV

SEQ ID NO: 1619997 - protein, 12 aa, Staphylococcus aureus
GGAPTQRNWNPN

SEQ ID NO: 1619998 - protein, 8 aa, Staphylococcus aureus
GGQTDSKR

SEQ ID NO: 1619999 - protein, 14 aa, Staphylococcus aureus
GIAYSESESKKDYK

SEQ ID NO: 1620000 - protein, 5 aa, Staphylococcus aureus
GIPKK

SEQ ID NO: 1620001 - protein, 4 aa, Staphylococcus aureus
GKQG

SEQ ID NO: 1620002 - protein, 27 aa, Staphylococcus aureus
GKVDQAKQLAAKTAKDIEACQKQTQQL

SEQ ID NO: 1620003 - protein, 17 aa, Staphylococcus aureus
GKVTKVDGNQNSVSFVP

SEQ ID NO: 1620004 - protein, 6 aa, Staphylococcus aureus
GLNKPN

SEQ ID NO: 1620005 - protein, 6 aa, Staphylococcus aureus
GLTQKE

SEQ ID NO: 1620006 - protein, 5 aa, Staphylococcus aureus
GNMEN

SEQ ID NO: 1620007 - protein, 6 aa, Staphylococcus aureus
GPIPTH

SEQ ID NO: 1620008 - protein, 5 aa, Staphylococcus aureus
GPNIE

SEQ ID NO: 1620009 - protein, 10 aa, Staphylococcus aureus
GSGPAGLAAA

SEQ ID NO: 1620010 - protein, 15 aa, Staphylococcus aureus
GSKQELENQINEETS

SEQ ID NO: 1620011 - protein, 4 aa, Staphylococcus aureus
GTAN

SEQ ID NO: 1620012 - protein, 29 aa, Staphylococcus aureus
GTGPQHREIGTPISTGNGSWRGPNTEKLE

SEQ ID NO: 1620013 - protein, 4 aa, Staphylococcus aureus
GTLT

SEQ ID NO: 1620014 - protein, 22 aa, Staphylococcus aureus
GVKSKTGEAFSKMGRNANHFGG

SEQ ID NO: 1620015 - protein, 4 aa, Staphylococcus aureus
HGST

SEQ ID NO: 1620016 - protein, 18 aa, Staphylococcus aureus
HLTEEQRQQFEAEGRQPS

SEQ ID NO: 1620017 - protein, 22 aa, Staphylococcus aureus
HTQSEDSRCGAGHDRKIRAEQM

SEQ ID NO: 1620018 - protein, 11 aa, Staphylococcus aureus
IAKDTSKEEMQ

SEQ ID NO: 1620019 - protein, 27 aa, Staphylococcus aureus
IDKNKESLQKAKGIAGEKASEYFNKAM

SEQ ID NO: 1620020 - protein, 5 aa, Staphylococcus aureus
IDNEE

SEQ ID NO: 1620021 - protein, 5 aa, Staphylococcus aureus
IDPNY

SEQ ID NO: 1620022 - protein, 9 aa, Staphylococcus aureus
IKGGDNNRY

SEQ ID NO: 1620023 - protein, 5 aa, Staphylococcus aureus
INPAT

SEQ ID NO: 1620024 - protein, 6 aa, Staphylococcus aureus
INQLNK

SEQ ID NO: 1620025 - protein, 6 aa, Staphylococcus aureus
IPVYGT

SEQ ID NO: 1620026 - protein, 4 aa, Staphylococcus aureus
IQDE

SEQ ID NO: 1620027 - protein, 5 aa, Staphylococcus aureus
IQGAE

SEQ ID NO: 1620028 - protein, 4 aa, Staphylococcus aureus
ITGA

SEQ ID NO: 1620029 - protein, 7 aa, Staphylococcus aureus
KAEKPIE

SEQ ID NO: 1620030 - protein, 8 aa, Staphylococcus aureus
KATFGTKN

SEQ ID NO: 1620031 - protein, 6 aa, Staphylococcus aureus
KAYATY

SEQ ID NO: 1620032 - protein, 8 aa, Staphylococcus aureus
KDDPNARV

SEQ ID NO: 1620033 - protein, 8 aa, Staphylococcus aureus
KDGFKNKG

SEQ ID NO: 1620034 - protein, 10 aa, Staphylococcus aureus
KDKTAQFQEK

SEQ ID NO: 1620035 - protein, 13 aa, Staphylococcus aureus
KDRNSFSKTDHDA

SEQ ID NO: 1620036 - protein, 8 aa, Staphylococcus aureus
KEKPKEFE

SEQ ID NO: 1620037 - protein, 6 aa, Staphylococcus aureus
KENGIN

SEQ ID NO: 1620038 - protein, 19 aa, Staphylococcus aureus
KEQRGPLDGDYEHNDNNRI

SEQ ID NO: 1620039 - protein, 6 aa, Staphylococcus aureus
KGAYIR

SEQ ID NO: 1620040 - protein, 11 aa, Staphylococcus aureus
KGLPNGQEGIE

SEQ ID NO: 1620041 - protein, 7 aa, Staphylococcus aureus
KIDTEPP

SEQ ID NO: 1620042 - protein, 13 aa, Staphylococcus aureus
KIKYRNNSYAYDT

SEQ ID NO: 1620043 - protein, 5 aa, Staphylococcus aureus
KKDFD

SEQ ID NO: 1620044 - protein, 5 aa, Staphylococcus aureus
KKNNI

SEQ ID NO: 1620045 - protein, 8 aa, Staphylococcus aureus
KKPYAKHI

SEQ ID NO: 1620046 - protein, 13 aa, Staphylococcus aureus
KLSQKQIAEAHQK

SEQ ID NO: 1620047 - protein, 8 aa, Staphylococcus aureus
KNNKPLSI

SEQ ID NO: 1620048 - protein, 7 aa, Staphylococcus aureus
KNNPASK

SEQ ID NO: 1620049 - protein, 7 aa, Staphylococcus aureus
KNQNDIY

SEQ ID NO: 1620050 - protein, 25 aa, Staphylococcus aureus
KNQSVAEAIRNASDSIQKVGEEFNQ

SEQ ID NO: 1620051 - protein, 10 aa, Staphylococcus aureus
KNRKIENNDI

SEQ ID NO: 1620052 - protein, 7 aa, Staphylococcus aureus
KQGYIGA

SEQ ID NO: 1620053 - protein, 9 aa, Staphylococcus aureus
KQYTYGKGL

SEQ ID NO: 1620054 - protein, 17 aa, Staphylococcus aureus
KRNIDKEKKMLEENGDL

SEQ ID NO: 1620055 - protein, 16 aa, Staphylococcus aureus
KSDIDTTYKDDNDITS

SEQ ID NO: 1620056 - protein, 5 aa, Staphylococcus aureus
KSELN

SEQ ID NO: 1620057 - protein, 6 aa, Staphylococcus aureus
KSLRET

SEQ ID NO: 1620058 - protein, 4 aa, Staphylococcus aureus
KSPL

SEQ ID NO: 1620059 - protein, 7 aa, Staphylococcus aureus
KSRKGNL

SEQ ID NO: 1620060 - protein, 4 aa, Staphylococcus aureus
KSVG

SEQ ID NO: 1620061 - protein, 4 aa, Staphylococcus aureus
KTLG

SEQ ID NO: 1620062 - protein, 9 aa, Staphylococcus aureus
KTYKNDTVT

SEQ ID NO: 1620063 - protein, 12 aa, Staphylococcus aureus
KVGNSGNSTEPH

SEQ ID NO: 1620064 - protein, 12 aa, Staphylococcus aureus
KYPDNKKTDDVE

SEQ ID NO: 1620065 - protein, 5 aa, Staphylococcus aureus
LASAA

SEQ ID NO: 1620066 - protein, 8 aa, Staphylococcus aureus
LDQESNDF

SEQ ID NO: 1620067 - protein, 4 aa, Staphylococcus aureus
LGVK

SEQ ID NO: 1620068 - protein, 22 aa, Staphylococcus aureus
LIERSKTDRYQKKHSSKGQSKL

SEQ ID NO: 1620069 - protein, 10 aa, Staphylococcus aureus
LKDAKKIEHN

SEQ ID NO: 1620070 - protein, 6 aa, Staphylococcus aureus
LKFPSD

SEQ ID NO: 1620071 - protein, 9 aa, Staphylococcus aureus
LKSSNKSIE

SEQ ID NO: 1620072 - protein, 11 aa, Staphylococcus aureus
LNDKGHTVSRR

SEQ ID NO: 1620073 - protein, 6 aa, Staphylococcus aureus
LPANRN

SEQ ID NO: 1620074 - protein, 8 aa, Staphylococcus aureus
LPASNIKK

SEQ ID NO: 1620075 - protein, 4 aa, Staphylococcus aureus
LPDK

SEQ ID NO: 1620076 - protein, 6 aa, Staphylococcus aureus
LQERSK

SEQ ID NO: 1620077 - protein, 16 aa, Staphylococcus aureus
LQGKEYQLEKNNGEHH

SEQ ID NO: 1620078 - protein, 10 aa, Staphylococcus aureus
LQKGEPVRTT

SEQ ID NO: 1620079 - protein, 7 aa, Staphylococcus aureus
LTPSPLG

SEQ ID NO: 1620080 - protein, 9 aa, Staphylococcus aureus
MANQTGHTR

SEQ ID NO: 1620081 - protein, 12 aa, Staphylococcus aureus
MEDGLHPNEKGH

SEQ ID NO: 1620082 - protein, 33 aa, Staphylococcus aureus
MQEISSELQQSEQSKQKQLGTTLQNLAKQNRII

SEQ ID NO: 1620083 - protein, 9 aa, Staphylococcus aureus
NAESDTANY

SEQ ID NO: 1620084 - protein, 12 aa, Staphylococcus aureus
NAPEEKERGITI

SEQ ID NO: 1620085 - protein, 35 aa, Staphylococcus aureus
NARQSPLTGGDSFNHSTKNKPQNLAEIARQKRIIK

SEQ ID NO: 1620086 - protein, 5 aa, Staphylococcus aureus
NDDNV

SEQ ID NO: 1620087 - protein, 9 aa, Staphylococcus aureus
NDVPGAESI

SEQ ID NO: 1620088 - protein, 10 aa, Staphylococcus aureus
NEDLANASKD

SEQ ID NO: 1620089 - protein, 20 aa, Staphylococcus aureus
NEDTKIATIQQRNNFKPGQE

SEQ ID NO: 1620090 - protein, 6 aa, Staphylococcus aureus
NETVEA

SEQ ID NO: 1620091 - protein, 8 aa, Staphylococcus aureus
NFDTPEKL

SEQ ID NO: 1620092 - protein, 7 aa, Staphylococcus aureus
NFPGKEE

SEQ ID NO: 1620093 - protein, 4 aa, Staphylococcus aureus
NFPS

SEQ ID NO: 1620094 - protein, 10 aa, Staphylococcus aureus
NGRGKTSLAR

SEQ ID NO: 1620095 - protein, 9 aa, Staphylococcus aureus
NGSNGPKAR

SEQ ID NO: 1620096 - protein, 7 aa, Staphylococcus aureus
NHDESSE

SEQ ID NO: 1620097 - protein, 5 aa, Staphylococcus aureus
NIEGL

SEQ ID NO: 1620098 - protein, 9 aa, Staphylococcus aureus
NIPTQKAPK

SEQ ID NO: 1620099 - protein, 5 aa, Staphylococcus aureus
NKALR

SEQ ID NO: 1620100 - protein, 8 aa, Staphylococcus aureus
NNAQGDLG

SEQ ID NO: 1620101 - protein, 9 aa, Staphylococcus aureus
NNISTGEQI

SEQ ID NO: 1620102 - protein, 16 aa, Staphylococcus aureus
NQANEQPEYQEHQDNF

SEQ ID NO: 1620103 - protein, 21 aa, Staphylococcus aureus
NQLGGKSNSGEGGEDAKRYEV

SEQ ID NO: 1620104 - protein, 5 aa, Staphylococcus aureus
NRDNH

SEQ ID NO: 1620105 - protein, 6 aa, Staphylococcus aureus
NREGRR

SEQ ID NO: 1620106 - protein, 14 aa, Staphylococcus aureus
NSDLAQKSNQPEIE

SEQ ID NO: 1620107 - protein, 4 aa, Staphylococcus aureus
NSDY

SEQ ID NO: 1620108 - protein, 6 aa, Staphylococcus aureus
NSMNQD

SEQ ID NO: 1620109 - protein, 10 aa, Staphylococcus aureus
NTKVTSQEVR

SEQ ID NO: 1620110 - protein, 13 aa, Staphylococcus aureus
NTLETFDATDPEV

SEQ ID NO: 1620111 - protein, 9 aa, Staphylococcus aureus
NTNKCSTSS

SEQ ID NO: 1620112 - protein, 5 aa, Staphylococcus aureus
NTNNY

SEQ ID NO: 1620113 - protein, 9 aa, Staphylococcus aureus
NVRQGLKQS

SEQ ID NO: 1620114 - protein, 21 aa, Staphylococcus aureus
NWNGKGWTNGVAQPGWGPETV

SEQ ID NO: 1620115 - protein, 5 aa, Staphylococcus aureus
PEDKR

SEQ ID NO: 1620116 - protein, 6 aa, Staphylococcus aureus
PEIDED

SEQ ID NO: 1620117 - protein, 5 aa, Staphylococcus aureus
PGGDF

SEQ ID NO: 1620118 - protein, 11 aa, Staphylococcus aureus
PGKVGYSTETV

SEQ ID NO: 1620119 - protein, 4 aa, Staphylococcus aureus
PKYD

SEQ ID NO: 1620120 - protein, 10 aa, Staphylococcus aureus
PNINGSNTCD

SEQ ID NO: 1620121 - protein, 5 aa, Staphylococcus aureus
PNTTF

SEQ ID NO: 1620122 - protein, 4 aa, Staphylococcus aureus
PSLS

SEQ ID NO: 1620123 - protein, 5 aa, Staphylococcus aureus
PSTLS

SEQ ID NO: 1620124 - protein, 9 aa, Staphylococcus aureus
PTDKSYQLS

SEQ ID NO: 1620125 - protein, 9 aa, Staphylococcus aureus
PTNFDDPRH

SEQ ID NO: 1620126 - protein, 11 aa, Staphylococcus aureus
QALNEGKPENI

SEQ ID NO: 1620127 - protein, 7 aa, Staphylococcus aureus
QATTQGV

SEQ ID NO: 1620128 - protein, 9 aa, Staphylococcus aureus
QDDKYKDVN

SEQ ID NO: 1620129 - protein, 4 aa, Staphylococcus aureus
QDVA

SEQ ID NO: 1620130 - protein, 4 aa, Staphylococcus aureus
QEVE

SEQ ID NO: 1620131 - protein, 5 aa, Staphylococcus aureus
QGTSV

SEQ ID NO: 1620132 - protein, 13 aa, Staphylococcus aureus
QKSVEESLGDSID

SEQ ID NO: 1620133 - protein, 15 aa, Staphylococcus aureus
QNEVTHRNYDKTANF

SEQ ID NO: 1620134 - protein, 4 aa, Staphylococcus aureus
QNIE

SEQ ID NO: 1620135 - protein, 5 aa, Staphylococcus aureus
QREDS

SEQ ID NO: 1620136 - protein, 7 aa, Staphylococcus aureus
QRVGNYK

SEQ ID NO: 1620137 - protein, 5 aa, Staphylococcus aureus
QSIAE

SEQ ID NO: 1620138 - protein, 5 aa, Staphylococcus aureus
QTANT

SEQ ID NO: 1620139 - protein, 9 aa, Staphylococcus aureus
QVSKLDKKI

SEQ ID NO: 1620140 - protein, 8 aa, Staphylococcus aureus
RAKEGITD

SEQ ID NO: 1620141 - protein, 22 aa, Staphylococcus aureus
RDMRQAGKKYNKSSEKRGKLDV

SEQ ID NO: 1620142 - protein, 5 aa, Staphylococcus aureus
RESHN

SEQ ID NO: 1620143 - protein, 31 aa, Staphylococcus aureus
RGASNKINHLSDEQKAKGIIGASAGNHAQGV

SEQ ID NO: 1620144 - protein, 9 aa, Staphylococcus aureus
RGKRSTDDI

SEQ ID NO: 1620145 - protein, 8 aa, Staphylococcus aureus
RGVTPRGD

SEQ ID NO: 1620146 - protein, 7 aa, Staphylococcus aureus
RSNPSHG

SEQ ID NO: 1620147 - protein, 4 aa, Staphylococcus aureus
RTYS

SEQ ID NO: 1620148 - protein, 11 aa, Staphylococcus aureus
RYYTGRRDENV

SEQ ID NO: 1620149 - protein, 9 aa, Staphylococcus aureus
SCRSQMAEG

SEQ ID NO: 1620150 - protein, 6 aa, Staphylococcus aureus
SDRFQG

SEQ ID NO: 1620151 - protein, 4 aa, Staphylococcus aureus
SDTT

SEQ ID NO: 1620152 - protein, 7 aa, Staphylococcus aureus
SELPEMG

SEQ ID NO: 1620153 - protein, 6 aa, Staphylococcus aureus
SFKNYS

SEQ ID NO: 1620154 - protein, 6 aa, Staphylococcus aureus
SGEVNG

SEQ ID NO: 1620155 - protein, 5 aa, Staphylococcus aureus
SKDRI

SEQ ID NO: 1620156 - protein, 8 aa, Staphylococcus aureus
SKEDATAF

SEQ ID NO: 1620157 - protein, 7 aa, Staphylococcus aureus
SKEHRKT

SEQ ID NO: 1620158 - protein, 7 aa, Staphylococcus aureus
SLRDTQI

SEQ ID NO: 1620159 - protein, 6 aa, Staphylococcus aureus
SMPDDE

SEQ ID NO: 1620160 - protein, 6 aa, Staphylococcus aureus
SNFEEA

SEQ ID NO: 1620161 - protein, 4 aa, Staphylococcus aureus
SQDH

SEQ ID NO: 1620162 - protein, 12 aa, Staphylococcus aureus
SQISEEQETSTT

SEQ ID NO: 1620163 - protein, 9 aa, Staphylococcus aureus
SRKSQKDIV

SEQ ID NO: 1620164 - protein, 4 aa, Staphylococcus aureus
SRPI

SEQ ID NO: 1620165 - protein, 11 aa, Staphylococcus aureus
STDNASWGGTT

SEQ ID NO: 1620166 - protein, 19 aa, Staphylococcus aureus
STDNASWGGTTIKKYFFYR

SEQ ID NO: 1620167 - protein, 11 aa, Staphylococcus aureus
SYKQEKTPVNV

SEQ ID NO: 1620168 - protein, 4 aa, Staphylococcus aureus
TACT

SEQ ID NO: 1620169 - protein, 9 aa, Staphylococcus aureus
TAVSNGKLS

SEQ ID NO: 1620170 - protein, 9 aa, Staphylococcus aureus
TDGIEQPGW

SEQ ID NO: 1620171 - protein, 6 aa, Staphylococcus aureus
TENYVN

SEQ ID NO: 1620172 - protein, 4 aa, Staphylococcus aureus
TERI

SEQ ID NO: 1620173 - protein, 9 aa, Staphylococcus aureus
TGKINQNLS

SEQ ID NO: 1620174 - protein, 11 aa, Staphylococcus aureus
TGNEMSNNKKI

SEQ ID NO: 1620175 - protein, 7 aa, Staphylococcus aureus
TKDSDDM

SEQ ID NO: 1620176 - protein, 10 aa, Staphylococcus aureus
TKTGKPQYQK

SEQ ID NO: 1620177 - protein, 9 aa, Staphylococcus aureus
TKVYGDQNS

SEQ ID NO: 1620178 - protein, 13 aa, Staphylococcus aureus
TNLSGTAEKPRLN

SEQ ID NO: 1620179 - protein, 7 aa, Staphylococcus aureus
TNQTGHV

SEQ ID NO: 1620180 - protein, 5 aa, Staphylococcus aureus
TPIPR

SEQ ID NO: 1620181 - protein, 10 aa, Staphylococcus aureus
TPNLPEAEEI

SEQ ID NO: 1620182 - protein, 11 aa, Staphylococcus aureus
TSSEHTQPITD

SEQ ID NO: 1620183 - protein, 10 aa, Staphylococcus aureus
TVNNGDTIAT

SEQ ID NO: 1620184 - protein, 8 aa, Staphylococcus aureus
TVSGNDTT

SEQ ID NO: 1620185 - protein, 6 aa, Staphylococcus aureus
VASEDT

SEQ ID NO: 1620186 - protein, 14 aa, Staphylococcus aureus
VDRPQDTEEDYGDD

SEQ ID NO: 1620187 - protein, 15 aa, Staphylococcus aureus
VHYSKTGAHIVPYID

SEQ ID NO: 1620188 - protein, 7 aa, Staphylococcus aureus
VKEVEGA

SEQ ID NO: 1620189 - protein, 4 aa, Staphylococcus aureus
VKPD

SEQ ID NO: 1620190 - protein, 6 aa, Staphylococcus aureus
VKTPYK

SEQ ID NO: 1620191 - protein, 34 aa, Staphylococcus aureus
VNENKKKYGFESTTEDKQKKGSDNINFESKSDAQ

SEQ ID NO: 1620192 - protein, 9 aa, Staphylococcus aureus
VNESKETAI

SEQ ID NO: 1620193 - protein, 10 aa, Staphylococcus aureus
VPYKSKNPGC

SEQ ID NO: 1620194 - protein, 21 aa, Staphylococcus aureus
VQKGVSVTDGAYPEKEEQGTL

SEQ ID NO: 1620195 - protein, 14 aa, Staphylococcus aureus
VSKQRKAREYVGNG

SEQ ID NO: 1620196 - protein, 12 aa, Staphylococcus aureus
VYDNESTSIAQY

SEQ ID NO: 1620197 - protein, 23 aa, Staphylococcus aureus
VYGNNKRKMQRGFSTKREAKRAE

SEQ ID NO: 1620198 - protein, 5 aa, Staphylococcus aureus
YEIRE

SEQ ID NO: 1620199 - protein, 6 aa, Staphylococcus aureus
YGGGYG

SEQ ID NO: 1620200 - protein, 5 aa, Staphylococcus aureus
YITNE

SEQ ID NO: 1620201 - protein, 7 aa, Staphylococcus aureus
YKPQTID

SEQ ID NO: 1620202 - protein, 7 aa, Staphylococcus aureus
YKYTEAE

SEQ ID NO: 1620203 - protein, 26 aa, Staphylococcus aureus
YNEKKKEFGKNWEDAQKAGKAVGEDL

SEQ ID NO: 1620204 - protein, 4 aa, Staphylococcus aureus
YNPA

SEQ ID NO: 1620205 - protein, 8 aa, Staphylococcus aureus
YPNPEKAI

SEQ ID NO: 1620206 - protein, 18 aa, Staphylococcus aureus
YPPYDKGEPFYAYYKNLK

SEQ ID NO: 1620207 - protein, 19 aa, Staphylococcus aureus
YQNTGTFNHQDNLSDEEKE

SEQ ID NO: 1620208 - protein, 8 aa, Staphylococcus aureus
YSDKNDVM

SEQ ID NO: 1620209 - protein, 20 aa, Staphylococcus aureus
YSKEHAKETIRKTNGAIRSA

SEQ ID NO: 1620210 - protein, 8 aa, Staphylococcus aureus
YSNSPTKL

SEQ ID NO: 1620211 - protein, 5 aa, Staphylococcus aureus
YTYSS

SEQ ID NO: 1620212 - protein, 9 aa, Staphylococcus aureus
YVESETYKK

SEQ ID NO: 1620213 - protein, 11 aa, Staphylococcus aureus
AADDEESSQEL

SEQ ID NO: 1620214 - protein, 6 aa, Staphylococcus aureus
AATRNK

SEQ ID NO: 1620215 - protein, 16 aa, Staphylococcus aureus
ADKLPSKDHPDYADLE

SEQ ID NO: 1620216 - protein, 5 aa, Staphylococcus aureus
ADNAF

SEQ ID NO: 1620217 - protein, 9 aa, Staphylococcus aureus
ADQKSAFNN

SEQ ID NO: 1620218 - protein, 14 aa, Staphylococcus aureus
AEELEEQKKKEEAI

SEQ ID NO: 1620219 - protein, 5 aa, Staphylococcus aureus
AERVK

SEQ ID NO: 1620220 - protein, 8 aa, Staphylococcus aureus
AGDNLNSQ

SEQ ID NO: 1620221 - protein, 4 aa, Staphylococcus aureus
AIPH

SEQ ID NO: 1620222 - protein, 5 aa, Staphylococcus aureus
AKAQQ

SEQ ID NO: 1620223 - protein, 7 aa, Staphylococcus aureus
AKEGITD

SEQ ID NO: 1620224 - protein, 10 aa, Staphylococcus aureus
AKSNRPGVLD

SEQ ID NO: 1620225 - protein, 4 aa, Staphylococcus aureus
AKVE

SEQ ID NO: 1620226 - protein, 6 aa, Staphylococcus aureus
ALESQK

SEQ ID NO: 1620227 - protein, 7 aa, Staphylococcus aureus
AQAVKTF

SEQ ID NO: 1620228 - protein, 5 aa, Staphylococcus aureus
AQEHN

SEQ ID NO: 1620229 - protein, 16 aa, Staphylococcus aureus
AQNRLRKQKQRENNRK

SEQ ID NO: 1620230 - protein, 21 aa, Staphylococcus aureus
AQRLRSQKQIKQTSSDNQLKQ

SEQ ID NO: 1620231 - protein, 19 aa, Staphylococcus aureus
ASTSNRNFEGRQGKGARTH

SEQ ID NO: 1620232 - protein, 20 aa, Staphylococcus aureus
ATRALNNDELEKAEKLEQEI

SEQ ID NO: 1620233 - protein, 6 aa, Staphylococcus aureus
AVNQTN

SEQ ID NO: 1620234 - protein, 12 aa, Staphylococcus aureus
DAFDSDEHAQPN

SEQ ID NO: 1620235 - protein, 20 aa, Staphylococcus aureus
DALQQQVNSQVDDSHYTTAS

SEQ ID NO: 1620236 - protein, 4 aa, Staphylococcus aureus
DDEI

SEQ ID NO: 1620237 - protein, 51 aa, Staphylococcus aureus
DDEVVNKPEPKTDEMKQKEQQANGKQTPMSQQSNPFANANGPIEINDDDLP

SEQ ID NO: 1620238 - protein, 8 aa, Staphylococcus aureus
DDKNKLDK

SEQ ID NO: 1620239 - protein, 13 aa, Staphylococcus aureus
DDSERGEGDLGLE

SEQ ID NO: 1620240 - protein, 6 aa, Staphylococcus aureus
DEDVRQ

SEQ ID NO: 1620241 - protein, 16 aa, Staphylococcus aureus
DEGWRSRSNDSPVCTG

SEQ ID NO: 1620242 - protein, 5 aa, Staphylococcus aureus
DELKQ

SEQ ID NO: 1620243 - protein, 11 aa, Staphylococcus aureus
DGKSKKPTFND

SEQ ID NO: 1620244 - protein, 19 aa, Staphylococcus aureus
DGTLSSKIVTTNNKSLDKV

SEQ ID NO: 1620245 - protein, 25 aa, Staphylococcus aureus
DHQSDESIHPNDDVNKSQSSNDTFP

SEQ ID NO: 1620246 - protein, 5 aa, Staphylococcus aureus
DHSSI

SEQ ID NO: 1620247 - protein, 17 aa, Staphylococcus aureus
DKEQKIKNEKYWGTIEW

SEQ ID NO: 1620248 - protein, 8 aa, Staphylococcus aureus
DKFGTTSW

SEQ ID NO: 1620249 - protein, 12 aa, Staphylococcus aureus
DKFQSDKDYHYQ

SEQ ID NO: 1620250 - protein, 9 aa, Staphylococcus aureus
DKKKKVKDF

SEQ ID NO: 1620251 - protein, 15 aa, Staphylococcus aureus
DLEKGQYLKSGKRVE

SEQ ID NO: 1620252 - protein, 7 aa, Staphylococcus aureus
DNLNSFN

SEQ ID NO: 1620253 - protein, 5 aa, Staphylococcus aureus
DNPRQ

SEQ ID NO: 1620254 - protein, 4 aa, Staphylococcus aureus
DNVN

SEQ ID NO: 1620255 - protein, 7 aa, Staphylococcus aureus
DPQASIG

SEQ ID NO: 1620256 - protein, 4 aa, Staphylococcus aureus
DSAQ

SEQ ID NO: 1620257 - protein, 10 aa, Staphylococcus aureus
DSQEEVQDET

SEQ ID NO: 1620258 - protein, 8 aa, Staphylococcus aureus
DSQFEDTK

SEQ ID NO: 1620259 - protein, 8 aa, Staphylococcus aureus
DTAEQTKL

SEQ ID NO: 1620260 - protein, 4 aa, Staphylococcus aureus
DTEA

SEQ ID NO: 1620261 - protein, 4 aa, Staphylococcus aureus
DTSK

SEQ ID NO: 1620262 - protein, 11 aa, Staphylococcus aureus
DTTSKKGAHEK

SEQ ID NO: 1620263 - protein, 6 aa, Staphylococcus aureus
DVSQGS

SEQ ID NO: 1620264 - protein, 6 aa, Staphylococcus aureus
DYHQKH

SEQ ID NO: 1620265 - protein, 4 aa, Staphylococcus aureus
EAPH

SEQ ID NO: 1620266 - protein, 5 aa, Staphylococcus aureus
EAVEA

SEQ ID NO: 1620267 - protein, 7 aa, Staphylococcus aureus
EDDKSKK

SEQ ID NO: 1620268 - protein, 7 aa, Staphylococcus aureus
EDFSERG

SEQ ID NO: 1620269 - protein, 11 aa, Staphylococcus aureus
EEAKNDPDKVL

SEQ ID NO: 1620270 - protein, 8 aa, Staphylococcus aureus
EEHTGQPM

SEQ ID NO: 1620271 - protein, 9 aa, Staphylococcus aureus
EELEENPEL

SEQ ID NO: 1620272 - protein, 10 aa, Staphylococcus aureus
EGSSKKDDQV

SEQ ID NO: 1620273 - protein, 10 aa, Staphylococcus aureus
EHEQDGEKTY

SEQ ID NO: 1620274 - protein, 6 aa, Staphylococcus aureus
EKANEI

SEQ ID NO: 1620275 - protein, 9 aa, Staphylococcus aureus
EKERQEAQL

SEQ ID NO: 1620276 - protein, 6 aa, Staphylococcus aureus
EKGFTP

SEQ ID NO: 1620277 - protein, 4 aa, Staphylococcus aureus
EKLQ

SEQ ID NO: 1620278 - protein, 8 aa, Staphylococcus aureus
EKQETIKS

SEQ ID NO: 1620279 - protein, 7 aa, Staphylococcus aureus
EKSNKHL

SEQ ID NO: 1620280 - protein, 25 aa, Staphylococcus aureus
ELEETCSTTVNGVEYDSGLNNASRI

SEQ ID NO: 1620281 - protein, 12 aa, Staphylococcus aureus
ELKTNKTNTEGD

SEQ ID NO: 1620282 - protein, 25 aa, Staphylococcus aureus
ELRQAHDKINKADKMDNPDMEKPAD

SEQ ID NO: 1620283 - protein, 10 aa, Staphylococcus aureus
ENMTEAQRQK

SEQ ID NO: 1620284 - protein, 9 aa, Staphylococcus aureus
ENPNSKKVV

SEQ ID NO: 1620285 - protein, 11 aa, Staphylococcus aureus
ENYDSGNVSKI

SEQ ID NO: 1620286 - protein, 5 aa, Staphylococcus aureus
EQDGV

SEQ ID NO: 1620287 - protein, 17 aa, Staphylococcus aureus
EQLRSEKQLNEMRSEAR

SEQ ID NO: 1620288 - protein, 6 aa, Staphylococcus aureus
EQMSEE

SEQ ID NO: 1620289 - protein, 17 aa, Staphylococcus aureus
ESQSGYKISKNSGVPYQ

SEQ ID NO: 1620290 - protein, 12 aa, Staphylococcus aureus
ETRDDAVGEAYD

SEQ ID NO: 1620291 - protein, 6 aa, Staphylococcus aureus
EYEANS

SEQ ID NO: 1620292 - protein, 14 aa, Staphylococcus aureus
FDGDNKKVRDAKES

SEQ ID NO: 1620293 - protein, 6 aa, Staphylococcus aureus
FDGENI

SEQ ID NO: 1620294 - protein, 9 aa, Staphylococcus aureus
FGCGSSREH

SEQ ID NO: 1620295 - protein, 6 aa, Staphylococcus aureus
FSSSSA

SEQ ID NO: 1620296 - protein, 10 aa, Staphylococcus aureus
GDEQSIEQSL

SEQ ID NO: 1620297 - protein, 10 aa, Staphylococcus aureus
GDIKGSSVGY

SEQ ID NO: 1620298 - protein, 5 aa, Staphylococcus aureus
GDQHR

SEQ ID NO: 1620299 - protein, 18 aa, Staphylococcus aureus
GEVDKAGNRISSFGKFSA

SEQ ID NO: 1620300 - protein, 5 aa, Staphylococcus aureus
GIQSQ

SEQ ID NO: 1620301 - protein, 18 aa, Staphylococcus aureus
GKASSRGVVSTASYEARK

SEQ ID NO: 1620302 - protein, 14 aa, Staphylococcus aureus
GKEVKMSKRTGNAI

SEQ ID NO: 1620303 - protein, 9 aa, Staphylococcus aureus
GKSYTESDT

SEQ ID NO: 1620304 - protein, 6 aa, Staphylococcus aureus
GLSDGA

SEQ ID NO: 1620305 - protein, 12 aa, Staphylococcus aureus
GNASDELKQYAN

SEQ ID NO: 1620306 - protein, 9 aa, Staphylococcus aureus
GNVKAYTEQ

SEQ ID NO: 1620307 - protein, 8 aa, Staphylococcus aureus
GPQAPHDI

SEQ ID NO: 1620308 - protein, 5 aa, Staphylococcus aureus
GPSDF

SEQ ID NO: 1620309 - protein, 13 aa, Staphylococcus aureus
GQSPRLATTHPAN

SEQ ID NO: 1620310 - protein, 8 aa, Staphylococcus aureus
GQTGKGKS

SEQ ID NO: 1620311 - protein, 15 aa, Staphylococcus aureus
GRGTVATGRVERGQI

SEQ ID NO: 1620312 - protein, 14 aa, Staphylococcus aureus
GRTKSGTLELETDD

SEQ ID NO: 1620313 - protein, 17 aa, Staphylococcus aureus
GTIGDSVARGSHAKTNF

SEQ ID NO: 1620314 - protein, 7 aa, Staphylococcus aureus
GTKKEVK

SEQ ID NO: 1620315 - protein, 4 aa, Staphylococcus aureus
GTRE

SEQ ID NO: 1620316 - protein, 11 aa, Staphylococcus aureus
GTTEGNRNNAL

SEQ ID NO: 1620317 - protein, 5 aa, Staphylococcus aureus
GYHED

SEQ ID NO: 1620318 - protein, 17 aa, Staphylococcus aureus
HANDNDKSNLKKIRVLK

SEQ ID NO: 1620319 - protein, 8 aa, Staphylococcus aureus
HARREMTE

SEQ ID NO: 1620320 - protein, 28 aa, Staphylococcus aureus
HEADTDTEDTMDGSYNTGGSVESTMSGT

SEQ ID NO: 1620321 - protein, 11 aa, Staphylococcus aureus
HEDERESRFAN

SEQ ID NO: 1620322 - protein, 14 aa, Staphylococcus aureus
HEFKEARKGDIKHS

SEQ ID NO: 1620323 - protein, 6 aa, Staphylococcus aureus
HEIETK

SEQ ID NO: 1620324 - protein, 9 aa, Staphylococcus aureus
HERKNKMAE

SEQ ID NO: 1620325 - protein, 4 aa, Staphylococcus aureus
HHPW

SEQ ID NO: 1620326 - protein, 7 aa, Staphylococcus aureus
HKNSVER

SEQ ID NO: 1620327 - protein, 5 aa, Staphylococcus aureus
HQKQA

SEQ ID NO: 1620328 - protein, 14 aa, Staphylococcus aureus
HSLDRNNSIQNEAR

SEQ ID NO: 1620329 - protein, 12 aa, Staphylococcus aureus
HVSETNIKSQEK

SEQ ID NO: 1620330 - protein, 18 aa, Staphylococcus aureus
IANNTKRHQSVSKLSSQP

SEQ ID NO: 1620331 - protein, 10 aa, Staphylococcus aureus
IDDEKVKKEI

SEQ ID NO: 1620332 - protein, 8 aa, Staphylococcus aureus
IDQTTKHY

SEQ ID NO: 1620333 - protein, 11 aa, Staphylococcus aureus
IEEECKEKKKI

SEQ ID NO: 1620334 - protein, 5 aa, Staphylococcus aureus
IEEEK

SEQ ID NO: 1620335 - protein, 4 aa, Staphylococcus aureus
IERK

SEQ ID NO: 1620336 - protein, 6 aa, Staphylococcus aureus
IGEGSV

SEQ ID NO: 1620337 - protein, 10 aa, Staphylococcus aureus
IGGQVNDTAG

SEQ ID NO: 1620338 - protein, 5 aa, Staphylococcus aureus
IGPAD

SEQ ID NO: 1620339 - protein, 15 aa, Staphylococcus aureus
IGRSTTTEDQTGDTL

SEQ ID NO: 1620340 - protein, 8 aa, Staphylococcus aureus
IKASNRRS

SEQ ID NO: 1620341 - protein, 9 aa, Staphylococcus aureus
IKPSDRLKA

SEQ ID NO: 1620342 - protein, 11 aa, Staphylococcus aureus
INPEKQNRHSL

SEQ ID NO: 1620343 - protein, 10 aa, Staphylococcus aureus
INPPNNRYNL

SEQ ID NO: 1620344 - protein, 13 aa, Staphylococcus aureus
IQASTDVKTNARA

SEQ ID NO: 1620345 - protein, 9 aa, Staphylococcus aureus
IRTRNGRKE

SEQ ID NO: 1620346 - protein, 21 aa, Staphylococcus aureus
ISENENKNFADRKKQLSEGFK

SEQ ID NO: 1620347 - protein, 8 aa, Staphylococcus aureus
ISKDFDDE

SEQ ID NO: 1620348 - protein, 8 aa, Staphylococcus aureus
ITGVEKAQ

SEQ ID NO: 1620349 - protein, 16 aa, Staphylococcus aureus
KAGKTLAKYAASTGQH

SEQ ID NO: 1620350 - protein, 6 aa, Staphylococcus aureus
KAQQKE

SEQ ID NO: 1620351 - protein, 10 aa, Staphylococcus aureus
KASRIRQIAS

SEQ ID NO: 1620352 - protein, 6 aa, Staphylococcus aureus
KAVNEA

SEQ ID NO: 1620353 - protein, 9 aa, Staphylococcus aureus
KDIDNGVYD

SEQ ID NO: 1620354 - protein, 4 aa, Staphylococcus aureus
KDKL

SEQ ID NO: 1620355 - protein, 7 aa, Staphylococcus aureus
KDPLTNK

SEQ ID NO: 1620356 - protein, 13 aa, Staphylococcus aureus
KDTTSQINSSKSN

SEQ ID NO: 1620357 - protein, 9 aa, Staphylococcus aureus
KEATAETNS

SEQ ID NO: 1620358 - protein, 12 aa, Staphylococcus aureus
KEERYSRNPKLA

SEQ ID NO: 1620359 - protein, 5 aa, Staphylococcus aureus
KEGKM

SEQ ID NO: 1620360 - protein, 9 aa, Staphylococcus aureus
KELNTRYDK

SEQ ID NO: 1620361 - protein, 8 aa, Staphylococcus aureus
KENENEVY

SEQ ID NO: 1620362 - protein, 11 aa, Staphylococcus aureus
KENKSQTYTHK

SEQ ID NO: 1620363 - protein, 4 aa, Staphylococcus aureus
KEPT

SEQ ID NO: 1620364 - protein, 7 aa, Staphylococcus aureus
KEVSPEE

SEQ ID NO: 1620365 - protein, 7 aa, Staphylococcus aureus
KGDEIAK

SEQ ID NO: 1620366 - protein, 8 aa, Staphylococcus aureus
KGDEVRFD

SEQ ID NO: 1620367 - protein, 16 aa, Staphylococcus aureus
KGKGTLDGQGKAFAEA

SEQ ID NO: 1620368 - protein, 6 aa, Staphylococcus aureus
KGKSYA

SEQ ID NO: 1620369 - protein, 6 aa, Staphylococcus aureus
KGLVDK

SEQ ID NO: 1620370 - protein, 4 aa, Staphylococcus aureus
KGNY

SEQ ID NO: 1620371 - protein, 29 aa, Staphylococcus aureus
KGSTGSTSSGFEKEGKKLEVKKAKSLDDI

SEQ ID NO: 1620372 - protein, 8 aa, Staphylococcus aureus
KHSNNAIS

SEQ ID NO: 1620373 - protein, 9 aa, Staphylococcus aureus
KHSPEVNLG

SEQ ID NO: 1620374 - protein, 14 aa, Staphylococcus aureus
KIETKRTAKSFKDI

SEQ ID NO: 1620375 - protein, 14 aa, Staphylococcus aureus
KITANQEKTPVKAN

SEQ ID NO: 1620376 - protein, 6 aa, Staphylococcus aureus
KKIETE

SEQ ID NO: 1620377 - protein, 7 aa, Staphylococcus aureus
KKMNRQK

SEQ ID NO: 1620378 - protein, 9 aa, Staphylococcus aureus
KKRGNMKEY

SEQ ID NO: 1620379 - protein, 7 aa, Staphylococcus aureus
KLKATGY

SEQ ID NO: 1620380 - protein, 7 aa, Staphylococcus aureus
KMESKSD

SEQ ID NO: 1620381 - protein, 6 aa, Staphylococcus aureus
KNEEWD

SEQ ID NO: 1620382 - protein, 49 aa, Staphylococcus aureus
KNKVRSKIKNKVKPGYKKKFKQEVEKMKRQERKQFSKQQNRQKRKQNKK

SEQ ID NO: 1620383 - protein, 7 aa, Staphylococcus aureus
KNNPDSK

SEQ ID NO: 1620384 - protein, 4 aa, Staphylococcus aureus
KPFV

SEQ ID NO: 1620385 - protein, 5 aa, Staphylococcus aureus
KPNYE

SEQ ID NO: 1620386 - protein, 10 aa, Staphylococcus aureus
KQGGVSKEIP

SEQ ID NO: 1620387 - protein, 10 aa, Staphylococcus aureus
KQGMPSAKKR

SEQ ID NO: 1620388 - protein, 14 aa, Staphylococcus aureus
KQPLPSPKIYDNDT

SEQ ID NO: 1620389 - protein, 10 aa, Staphylococcus aureus
KQYKDSDFKL

SEQ ID NO: 1620390 - protein, 7 aa, Staphylococcus aureus
KQYSRNE

SEQ ID NO: 1620391 - protein, 13 aa, Staphylococcus aureus
KRMEEKKIPEDLD

SEQ ID NO: 1620392 - protein, 5 aa, Staphylococcus aureus
KRNES

SEQ ID NO: 1620393 - protein, 4 aa, Staphylococcus aureus
KRYT

SEQ ID NO: 1620394 - protein, 12 aa, Staphylococcus aureus
KSIEQLSDNYEQ

SEQ ID NO: 1620395 - protein, 5 aa, Staphylococcus aureus
KSNLQ

SEQ ID NO: 1620396 - protein, 9 aa, Staphylococcus aureus
KSSYRGPEI

SEQ ID NO: 1620397 - protein, 8 aa, Staphylococcus aureus
KSYNHGDV

SEQ ID NO: 1620398 - protein, 10 aa, Staphylococcus aureus
KTELNKRKSA

SEQ ID NO: 1620399 - protein, 14 aa, Staphylococcus aureus
KTHTPLSQLPEGSI

SEQ ID NO: 1620400 - protein, 8 aa, Staphylococcus aureus
KTKPGIDK

SEQ ID NO: 1620401 - protein, 4 aa, Staphylococcus aureus
KTSG

SEQ ID NO: 1620402 - protein, 22 aa, Staphylococcus aureus
KVKPDGNKEYIKKDENRRKTDG

SEQ ID NO: 1620403 - protein, 9 aa, Staphylococcus aureus
KVQYNGETI

SEQ ID NO: 1620404 - protein, 4 aa, Staphylococcus aureus
KYAT

SEQ ID NO: 1620405 - protein, 20 aa, Staphylococcus aureus
KYGGTSISDYRHADGKTGEM

SEQ ID NO: 1620406 - protein, 6 aa, Staphylococcus aureus
LDIPPE

SEQ ID NO: 1620407 - protein, 8 aa, Staphylococcus aureus
LDPEVANQ

SEQ ID NO: 1620408 - protein, 13 aa, Staphylococcus aureus
LGLPDSPGVPEGI

SEQ ID NO: 1620409 - protein, 8 aa, Staphylococcus aureus
LGQKGNNT

SEQ ID NO: 1620410 - protein, 17 aa, Staphylococcus aureus
LKGSANTLKRNLPKVIY

SEQ ID NO: 1620411 - protein, 9 aa, Staphylococcus aureus
LKNSDYNVE

SEQ ID NO: 1620412 - protein, 4 aa, Staphylococcus aureus
LKPT

SEQ ID NO: 1620413 - protein, 49 aa, Staphylococcus aureus
LKPVQSKQAVSESKPASQAAPSSRSDSQESNTNAYKTNNMTSNNVENNQ

SEQ ID NO: 1620414 - protein, 8 aa, Staphylococcus aureus
LNDDFETS

SEQ ID NO: 1620415 - protein, 7 aa, Staphylococcus aureus
LPERDEN

SEQ ID NO: 1620416 - protein, 10 aa, Staphylococcus aureus
LQQRPKETLD

SEQ ID NO: 1620417 - protein, 15 aa, Staphylococcus aureus
LRHTSKKLATILKGD

SEQ ID NO: 1620418 - protein, 8 aa, Staphylococcus aureus
MPDSPMSK

SEQ ID NO: 1620419 - protein, 9 aa, Staphylococcus aureus
MQEGQESKY

SEQ ID NO: 1620420 - protein, 12 aa, Staphylococcus aureus
NAIKGEKPISSG

SEQ ID NO: 1620421 - protein, 18 aa, Staphylococcus aureus
NDKDDRQVTVQDVKKVDK

SEQ ID NO: 1620422 - protein, 25 aa, Staphylococcus aureus
NDKEFKEGMQRARKELDYTANSNTV

SEQ ID NO: 1620423 - protein, 9 aa, Staphylococcus aureus
NEAITTDND

SEQ ID NO: 1620424 - protein, 4 aa, Staphylococcus aureus
NEER

SEQ ID NO: 1620425 - protein, 4 aa, Staphylococcus aureus
NEIT

SEQ ID NO: 1620426 - protein, 15 aa, Staphylococcus aureus
NELGADKLSTIKEEH

SEQ ID NO: 1620427 - protein, 8 aa, Staphylococcus aureus
NFGSAKDI

SEQ ID NO: 1620428 - protein, 6 aa, Staphylococcus aureus
NGDSME

SEQ ID NO: 1620429 - protein, 6 aa, Staphylococcus aureus
NGIKQG

SEQ ID NO: 1620430 - protein, 7 aa, Staphylococcus aureus
NKASEFT

SEQ ID NO: 1620431 - protein, 8 aa, Staphylococcus aureus
NKGGMTSS

SEQ ID NO: 1620432 - protein, 15 aa, Staphylococcus aureus
NKGRIGAKEGPDAIK

SEQ ID NO: 1620433 - protein, 13 aa, Staphylococcus aureus
NKTDSKEEQIKKS

SEQ ID NO: 1620434 - protein, 10 aa, Staphylococcus aureus
NNGKPIRETT

SEQ ID NO: 1620435 - protein, 10 aa, Staphylococcus aureus
NNKDTSFSIK

SEQ ID NO: 1620436 - protein, 5 aa, Staphylococcus aureus
NNQHY

SEQ ID NO: 1620437 - protein, 13 aa, Staphylococcus aureus
NNTLNQAKQYVDG

SEQ ID NO: 1620438 - protein, 6 aa, Staphylococcus aureus
NRTSYF

SEQ ID NO: 1620439 - protein, 11 aa, Staphylococcus aureus
NSNLETRNNPE

SEQ ID NO: 1620440 - protein, 8 aa, Staphylococcus aureus
NSNVPSYD

SEQ ID NO: 1620441 - protein, 4 aa, Staphylococcus aureus
NTSL

SEQ ID NO: 1620442 - protein, 8 aa, Staphylococcus aureus
NVARKNKD

SEQ ID NO: 1620443 - protein, 11 aa, Staphylococcus aureus
PAYKDTDVKPA

SEQ ID NO: 1620444 - protein, 10 aa, Staphylococcus aureus
PEESDTVNTH

SEQ ID NO: 1620445 - protein, 5 aa, Staphylococcus aureus
PEFPR

SEQ ID NO: 1620446 - protein, 5 aa, Staphylococcus aureus
PEGEY

SEQ ID NO: 1620447 - protein, 20 aa, Staphylococcus aureus
PFSKNENISLKGEETKTGDV

SEQ ID NO: 1620448 - protein, 6 aa, Staphylococcus aureus
PGGDFT

SEQ ID NO: 1620449 - protein, 8 aa, Staphylococcus aureus
PINQQDHK

SEQ ID NO: 1620450 - protein, 6 aa, Staphylococcus aureus
PKYPDI

SEQ ID NO: 1620451 - protein, 6 aa, Staphylococcus aureus
PKYTGQ

SEQ ID NO: 1620452 - protein, 9 aa, Staphylococcus aureus
PLKSGQEQF

SEQ ID NO: 1620453 - protein, 16 aa, Staphylococcus aureus
PLSNNPDAVDGKDPTV

SEQ ID NO: 1620454 - protein, 6 aa, Staphylococcus aureus
PNQTIN

SEQ ID NO: 1620455 - protein, 4 aa, Staphylococcus aureus
PRLN

SEQ ID NO: 1620456 - protein, 5 aa, Staphylococcus aureus
PSDQI

SEQ ID NO: 1620457 - protein, 6 aa, Staphylococcus aureus
PSEDCP

SEQ ID NO: 1620458 - protein, 4 aa, Staphylococcus aureus
PTED

SEQ ID NO: 1620459 - protein, 8 aa, Staphylococcus aureus
PTFHDPNK

SEQ ID NO: 1620460 - protein, 27 aa, Staphylococcus aureus
PYHPEKSTPAPKPEDDSDDNEKNNKKV

SEQ ID NO: 1620461 - protein, 4 aa, Staphylococcus aureus
QEIS

SEQ ID NO: 1620462 - protein, 5 aa, Staphylococcus aureus
QGQIQ

SEQ ID NO: 1620463 - protein, 12 aa, Staphylococcus aureus
QIDKNNSTDNSH

SEQ ID NO: 1620464 - protein, 5 aa, Staphylococcus aureus
QKRDL

SEQ ID NO: 1620465 - protein, 8 aa, Staphylococcus aureus
QKSQEDAY

SEQ ID NO: 1620466 - protein, 8 aa, Staphylococcus aureus
QNLSNNAD

SEQ ID NO: 1620467 - protein, 9 aa, Staphylococcus aureus
QNRETGERK

SEQ ID NO: 1620468 - protein, 12 aa, Staphylococcus aureus
QQALKSSSKVEH

SEQ ID NO: 1620469 - protein, 23 aa, Staphylococcus aureus
QQDPPKNKTRQAYEDVIEWVGPK

SEQ ID NO: 1620470 - protein, 10 aa, Staphylococcus aureus
QRLSQSPHKM

SEQ ID NO: 1620471 - protein, 4 aa, Staphylococcus aureus
QSQA

SEQ ID NO: 1620472 - protein, 7 aa, Staphylococcus aureus
QTLKDPD

SEQ ID NO: 1620473 - protein, 5 aa, Staphylococcus aureus
QVESD

SEQ ID NO: 1620474 - protein, 11 aa, Staphylococcus aureus
QYETPNDESAK

SEQ ID NO: 1620475 - protein, 5 aa, Staphylococcus aureus
QYQAS

SEQ ID NO: 1620476 - protein, 10 aa, Staphylococcus aureus
RAIENENDTY

SEQ ID NO: 1620477 - protein, 5 aa, Staphylococcus aureus
RFKNQ

SEQ ID NO: 1620478 - protein, 7 aa, Staphylococcus aureus
RGGGSIE

SEQ ID NO: 1620479 - protein, 15 aa, Staphylococcus aureus
RGGVGADGITGDGAG

SEQ ID NO: 1620480 - protein, 7 aa, Staphylococcus aureus
RISPING

SEQ ID NO: 1620481 - protein, 4 aa, Staphylococcus aureus
RITT

SEQ ID NO: 1620482 - protein, 4 aa, Staphylococcus aureus
RKDR

SEQ ID NO: 1620483 - protein, 4 aa, Staphylococcus aureus
RKEE

SEQ ID NO: 1620484 - protein, 4 aa, Staphylococcus aureus
RKEI

SEQ ID NO: 1620485 - protein, 13 aa, Staphylococcus aureus
RNDIQGGSLKTDS

SEQ ID NO: 1620486 - protein, 12 aa, Staphylococcus aureus
RQDNQYNGRPLN

SEQ ID NO: 1620487 - protein, 6 aa, Staphylococcus aureus
RQNGST

SEQ ID NO: 1620488 - protein, 9 aa, Staphylococcus aureus
RRDAFEQKK

SEQ ID NO: 1620489 - protein, 5 aa, Staphylococcus aureus
RSEEM

SEQ ID NO: 1620490 - protein, 7 aa, Staphylococcus aureus
RSTTPLS

SEQ ID NO: 1620491 - protein, 12 aa, Staphylococcus aureus
RVTNGSGKYPVV

SEQ ID NO: 1620492 - protein, 7 aa, Staphylococcus aureus
RYHSSNM

SEQ ID NO: 1620493 - protein, 5 aa, Staphylococcus aureus
SAKEM

SEQ ID NO: 1620494 - protein, 4 aa, Staphylococcus aureus
SAQD

SEQ ID NO: 1620495 - protein, 9 aa, Staphylococcus aureus
SASPQASGG

SEQ ID NO: 1620496 - protein, 9 aa, Staphylococcus aureus
SDITKTRGL

SEQ ID NO: 1620497 - protein, 17 aa, Staphylococcus aureus
SDRITVDDTATQLSKDL

SEQ ID NO: 1620498 - protein, 8 aa, Staphylococcus aureus
SEEDKTLE

SEQ ID NO: 1620499 - protein, 8 aa, Staphylococcus aureus
SEENHKLK

SEQ ID NO: 1620500 - protein, 7 aa, Staphylococcus aureus
SEENSRI

SEQ ID NO: 1620501 - protein, 12 aa, Staphylococcus aureus
SEIEAEGDIETG

SEQ ID NO: 1620502 - protein, 11 aa, Staphylococcus aureus
SEINKSDENLS

SEQ ID NO: 1620503 - protein, 8 aa, Staphylococcus aureus
SGAGHLSA

SEQ ID NO: 1620504 - protein, 6 aa, Staphylococcus aureus
SISERE

SEQ ID NO: 1620505 - protein, 8 aa, Staphylococcus aureus
SKEENSEL

SEQ ID NO: 1620506 - protein, 7 aa, Staphylococcus aureus
SKIDPDN

SEQ ID NO: 1620507 - protein, 7 aa, Staphylococcus aureus
SKKAQFS

SEQ ID NO: 1620508 - protein, 14 aa, Staphylococcus aureus
SKNVNDHTEQKNGL

SEQ ID NO: 1620509 - protein, 9 aa, Staphylococcus aureus
SKTTSLDPV

SEQ ID NO: 1620510 - protein, 7 aa, Staphylococcus aureus
SKVNKDD

SEQ ID NO: 1620511 - protein, 9 aa, Staphylococcus aureus
SNKNYTKEE

SEQ ID NO: 1620512 - protein, 6 aa, Staphylococcus aureus
SPKMYG

SEQ ID NO: 1620513 - protein, 14 aa, Staphylococcus aureus
SPTTNIKAVGNADV

SEQ ID NO: 1620514 - protein, 8 aa, Staphylococcus aureus
SQDSYKNK

SEQ ID NO: 1620515 - protein, 9 aa, Staphylococcus aureus
SQEVGKGDF

SEQ ID NO: 1620516 - protein, 16 aa, Staphylococcus aureus
SRNKAAGIKVTTANTT

SEQ ID NO: 1620517 - protein, 5 aa, Staphylococcus aureus
SRPDK

SEQ ID NO: 1620518 - protein, 10 aa, Staphylococcus aureus
SSKGEEELEE

SEQ ID NO: 1620519 - protein, 21 aa, Staphylococcus aureus
STDNASWRGPNIEAGGKSVYN

SEQ ID NO: 1620520 - protein, 18 aa, Staphylococcus aureus
STGRKHTHITRAKSNQRF

SEQ ID NO: 1620521 - protein, 12 aa, Staphylococcus aureus
STLIDSNKANID

SEQ ID NO: 1620522 - protein, 4 aa, Staphylococcus aureus
SVSY

SEQ ID NO: 1620523 - protein, 9 aa, Staphylococcus aureus
SYTNNASFP

SEQ ID NO: 1620524 - protein, 7 aa, Staphylococcus aureus
TDEDSVD

SEQ ID NO: 1620525 - protein, 13 aa, Staphylococcus aureus
TEKQSGKSIENRP

SEQ ID NO: 1620526 - protein, 6 aa, Staphylococcus aureus
TELGAS

SEQ ID NO: 1620527 - protein, 7 aa, Staphylococcus aureus
TEQQCQD

SEQ ID NO: 1620528 - protein, 18 aa, Staphylococcus aureus
TERPEGVEAGTSRVIGTD

SEQ ID NO: 1620529 - protein, 17 aa, Staphylococcus aureus
TGESNRLKDYKTEKSLN

SEQ ID NO: 1620530 - protein, 19 aa, Staphylococcus aureus
TGEVDKAGNRISSFGKFST

SEQ ID NO: 1620531 - protein, 4 aa, Staphylococcus aureus
TKDE

SEQ ID NO: 1620532 - protein, 17 aa, Staphylococcus aureus
TKEEAAQHFKDQDAATH

SEQ ID NO: 1620533 - protein, 10 aa, Staphylococcus aureus
TKETQQEINK

SEQ ID NO: 1620534 - protein, 24 aa, Staphylococcus aureus
TKKERTMQNKESIKKERFNENTAE

SEQ ID NO: 1620535 - protein, 8 aa, Staphylococcus aureus
TKQYEEKH

SEQ ID NO: 1620536 - protein, 6 aa, Staphylococcus aureus
TLTIDE

SEQ ID NO: 1620537 - protein, 6 aa, Staphylococcus aureus
TRPTPF

SEQ ID NO: 1620538 - protein, 5 aa, Staphylococcus aureus
TSSRQ

SEQ ID NO: 1620539 - protein, 8 aa, Staphylococcus aureus
TSTPNEVK

SEQ ID NO: 1620540 - protein, 6 aa, Staphylococcus aureus
TTQDKA

SEQ ID NO: 1620541 - protein, 4 aa, Staphylococcus aureus
TTVP

SEQ ID NO: 1620542 - protein, 7 aa, Staphylococcus aureus
TTVPDVG

SEQ ID NO: 1620543 - protein, 7 aa, Staphylococcus aureus
TVQYENA

SEQ ID NO: 1620544 - protein, 14 aa, Staphylococcus aureus
VDSRTILDSGGAER

SEQ ID NO: 1620545 - protein, 22 aa, Staphylococcus aureus
VGPNTEAGEKSAYKNVQVGGAP

SEQ ID NO: 1620546 - protein, 11 aa, Staphylococcus aureus
VGPTPPDQDHQ

SEQ ID NO: 1620547 - protein, 11 aa, Staphylococcus aureus
VKDKEEDTYRG

SEQ ID NO: 1620548 - protein, 29 aa, Staphylococcus aureus
VKGNSTTNWQKSKLTDDYGKAIESSEQSI

SEQ ID NO: 1620549 - protein, 11 aa, Staphylococcus aureus
VKITEEDSDSL

SEQ ID NO: 1620550 - protein, 7 aa, Staphylococcus aureus
VNGDSME

SEQ ID NO: 1620551 - protein, 5 aa, Staphylococcus aureus
VQGEN

SEQ ID NO: 1620552 - protein, 10 aa, Staphylococcus aureus
VSTNNSEGGY

SEQ ID NO: 1620553 - protein, 11 aa, Staphylococcus aureus
WTNKDKIEGSL

SEQ ID NO: 1620554 - protein, 6 aa, Staphylococcus aureus
YGPSDF

SEQ ID NO: 1620555 - protein, 10 aa, Staphylococcus aureus
YISENTGYPF

SEQ ID NO: 1620556 - protein, 20 aa, Staphylococcus aureus
YLGPTGSQMGKKETTKDTAR

SEQ ID NO: 1620557 - protein, 11 aa, Staphylococcus aureus
YNQIDKEKENL

SEQ ID NO: 1620558 - protein, 5 aa, Staphylococcus aureus
YRKEV

SEQ ID NO: 1620559 - protein, 6 aa, Staphylococcus aureus
YSPTGT

SEQ ID NO: 1620560 - protein, 10 aa, Staphylococcus aureus
YSQNQVTRQL

SEQ ID NO: 1620561 - protein, 12 aa, Staphylococcus aureus
YTDSKYNIAPDE

SEQ ID NO: 1620562 - protein, 6 aa, Staphylococcus aureus
AAEQVK

SEQ ID NO: 1620563 - protein, 13 aa, Staphylococcus aureus
AEKKAPGAKLQGD

SEQ ID NO: 1620564 - protein, 6 aa, Staphylococcus aureus
AGVGER

SEQ ID NO: 1620565 - protein, 5 aa, Staphylococcus aureus
AIQGN

SEQ ID NO: 1620566 - protein, 8 aa, Staphylococcus aureus
AKADIKAA

SEQ ID NO: 1620567 - protein, 4 aa, Staphylococcus aureus
AKDI

SEQ ID NO: 1620568 - protein, 6 aa, Staphylococcus aureus
AKDIDK

SEQ ID NO: 1620569 - protein, 14 aa, Staphylococcus aureus
ALKGEDNGRSIVDK

SEQ ID NO: 1620570 - protein, 19 aa, Staphylococcus aureus
ANKSRSKWDNISSTAWSNA

SEQ ID NO: 1620571 - protein, 9 aa, Staphylococcus aureus
APKNHNHDE

SEQ ID NO: 1620572 - protein, 13 aa, Staphylococcus aureus
APKSKKEVKQCLV

SEQ ID NO: 1620573 - protein, 4 aa, Staphylococcus aureus
ASTS

SEQ ID NO: 1620574 - protein, 12 aa, Staphylococcus aureus
ASTSNTPHIGEQ

SEQ ID NO: 1620575 - protein, 12 aa, Staphylococcus aureus
ATKSAQQKLQDN

SEQ ID NO: 1620576 - protein, 17 aa, Staphylococcus aureus
CDQQTRKFNSDASKEEG

SEQ ID NO: 1620577 - protein, 6 aa, Staphylococcus aureus
CSTPLE

SEQ ID NO: 1620578 - protein, 5 aa, Staphylococcus aureus
DDEQH

SEQ ID NO: 1620579 - protein, 5 aa, Staphylococcus aureus
DDGGG

SEQ ID NO: 1620580 - protein, 8 aa, Staphylococcus aureus
DDTEEGDL

SEQ ID NO: 1620581 - protein, 9 aa, Staphylococcus aureus
DEAQGDENK

SEQ ID NO: 1620582 - protein, 13 aa, Staphylococcus aureus
DEPTGALDSKTSK

SEQ ID NO: 1620583 - protein, 14 aa, Staphylococcus aureus
DEPTGALDSKTSKA

SEQ ID NO: 1620584 - protein, 7 aa, Staphylococcus aureus
DERSDIQ

SEQ ID NO: 1620585 - protein, 4 aa, Staphylococcus aureus
DEVS

SEQ ID NO: 1620586 - protein, 7 aa, Staphylococcus aureus
DGKYNKK

SEQ ID NO: 1620587 - protein, 7 aa, Staphylococcus aureus
DHNSEDD

SEQ ID NO: 1620588 - protein, 12 aa, Staphylococcus aureus
DIQDELEKGTSY

SEQ ID NO: 1620589 - protein, 4 aa, Staphylococcus aureus
DITS

SEQ ID NO: 1620590 - protein, 5 aa, Staphylococcus aureus
DLGTE

SEQ ID NO: 1620591 - protein, 5 aa, Staphylococcus aureus
DLREN

SEQ ID NO: 1620592 - protein, 5 aa, Staphylococcus aureus
DNENN

SEQ ID NO: 1620593 - protein, 7 aa, Staphylococcus aureus
DNKNSLG

SEQ ID NO: 1620594 - protein, 10 aa, Staphylococcus aureus
DNNTPKDQAV

SEQ ID NO: 1620595 - protein, 11 aa, Staphylococcus aureus
DNSDSNSASID

SEQ ID NO: 1620596 - protein, 8 aa, Staphylococcus aureus
DRAKSRAN

SEQ ID NO: 1620597 - protein, 4 aa, Staphylococcus aureus
DRGG

SEQ ID NO: 1620598 - protein, 8 aa, Staphylococcus aureus
DSSIGTGS

SEQ ID NO: 1620599 - protein, 6 aa, Staphylococcus aureus
DSYTNG

SEQ ID NO: 1620600 - protein, 15 aa, Staphylococcus aureus
DTANSEVVGKHGEKV

SEQ ID NO: 1620601 - protein, 35 aa, Staphylococcus aureus
DTATNDRQSINPQEATFTEEYQNSNQQQKKIQPIE

SEQ ID NO: 1620602 - protein, 4 aa, Staphylococcus aureus
DTIE

SEQ ID NO: 1620603 - protein, 12 aa, Staphylococcus aureus
DVEVDKGTDALQ

SEQ ID NO: 1620604 - protein, 5 aa, Staphylococcus aureus
DYFDE

SEQ ID NO: 1620605 - protein, 12 aa, Staphylococcus aureus
DYSEEIKETGID

SEQ ID NO: 1620606 - protein, 4 aa, Staphylococcus aureus
EAVT

SEQ ID NO: 1620607 - protein, 5 aa, Staphylococcus aureus
EDETA

SEQ ID NO: 1620608 - protein, 17 aa, Staphylococcus aureus
EDPKNRIDISSNKKAKP

SEQ ID NO: 1620609 - protein, 5 aa, Staphylococcus aureus
EENPT

SEQ ID NO: 1620610 - protein, 9 aa, Staphylococcus aureus
EERGGGRQR

SEQ ID NO: 1620611 - protein, 6 aa, Staphylococcus aureus
EFEYDD

SEQ ID NO: 1620612 - protein, 5 aa, Staphylococcus aureus
EGNEI

SEQ ID NO: 1620613 - protein, 6 aa, Staphylococcus aureus
EIDDAQ

SEQ ID NO: 1620614 - protein, 27 aa, Staphylococcus aureus
ENGAITSHTIDKDGVKISGDKVDITAN

SEQ ID NO: 1620615 - protein, 8 aa, Staphylococcus aureus
ENGKRFPS

SEQ ID NO: 1620616 - protein, 13 aa, Staphylococcus aureus
EPKNSNDTQQDLY

SEQ ID NO: 1620617 - protein, 4 aa, Staphylococcus aureus
EQGT

SEQ ID NO: 1620618 - protein, 5 aa, Staphylococcus aureus
EQNAL

SEQ ID NO: 1620619 - protein, 9 aa, Staphylococcus aureus
EQNLQNEEY

SEQ ID NO: 1620620 - protein, 4 aa, Staphylococcus aureus
ERGM

SEQ ID NO: 1620621 - protein, 5 aa, Staphylococcus aureus
ERTRS

SEQ ID NO: 1620622 - protein, 11 aa, Staphylococcus aureus
ESNNPSHYPQV

SEQ ID NO: 1620623 - protein, 4 aa, Staphylococcus aureus
ESYC

SEQ ID NO: 1620624 - protein, 5 aa, Staphylococcus aureus
ETPAT

SEQ ID NO: 1620625 - protein, 4 aa, Staphylococcus aureus
EYPG

SEQ ID NO: 1620626 - protein, 15 aa, Staphylococcus aureus
FADKGYAKAIDEEQL

SEQ ID NO: 1620627 - protein, 7 aa, Staphylococcus aureus
FKANQTE

SEQ ID NO: 1620628 - protein, 8 aa, Staphylococcus aureus
FKSDIAKS

SEQ ID NO: 1620629 - protein, 13 aa, Staphylococcus aureus
FKSSKDANGAISD

SEQ ID NO: 1620630 - protein, 6 aa, Staphylococcus aureus
FVPEPG

SEQ ID NO: 1620631 - protein, 18 aa, Staphylococcus aureus
GAEGMTSEAVDGRSNAYE

SEQ ID NO: 1620632 - protein, 20 aa, Staphylococcus aureus
GAYSNDPGAVANGENERDFN

SEQ ID NO: 1620633 - protein, 9 aa, Staphylococcus aureus
GEKDRLQKQ

SEQ ID NO: 1620634 - protein, 4 aa, Staphylococcus aureus
GGSG

SEQ ID NO: 1620635 - protein, 10 aa, Staphylococcus aureus
GKVGYSAETV

SEQ ID NO: 1620636 - protein, 8 aa, Staphylococcus aureus
GLPNDPEM

SEQ ID NO: 1620637 - protein, 6 aa, Staphylococcus aureus
GLQDKN

SEQ ID NO: 1620638 - protein, 9 aa, Staphylococcus aureus
GNGIGSDGH

SEQ ID NO: 1620639 - protein, 7 aa, Staphylococcus aureus
GNGLSEY

SEQ ID NO: 1620640 - protein, 7 aa, Staphylococcus aureus
GPSNKSY

SEQ ID NO: 1620641 - protein, 4 aa, Staphylococcus aureus
GSWN

SEQ ID NO: 1620642 - protein, 14 aa, Staphylococcus aureus
GTEPAKGNSLTKKS

SEQ ID NO: 1620643 - protein, 4 aa, Staphylococcus aureus
GYGQ

SEQ ID NO: 1620644 - protein, 7 aa, Staphylococcus aureus
HEKTDKP

SEQ ID NO: 1620645 - protein, 19 aa, Staphylococcus aureus
HKQYANENYNDLRRRNDPE

SEQ ID NO: 1620646 - protein, 9 aa, Staphylococcus aureus
HNDDEQNVE

SEQ ID NO: 1620647 - protein, 11 aa, Staphylococcus aureus
HRNYDKTANFA

SEQ ID NO: 1620648 - protein, 4 aa, Staphylococcus aureus
HSIG

SEQ ID NO: 1620649 - protein, 10 aa, Staphylococcus aureus
IDQSASVEDA

SEQ ID NO: 1620650 - protein, 4 aa, Staphylococcus aureus
IEPL

SEQ ID NO: 1620651 - protein, 4 aa, Staphylococcus aureus
IEQE

SEQ ID NO: 1620652 - protein, 5 aa, Staphylococcus aureus
IERNS

SEQ ID NO: 1620653 - protein, 5 aa, Staphylococcus aureus
IGPKK

SEQ ID NO: 1620654 - protein, 17 aa, Staphylococcus aureus
IGSPIPTDNASWRGPNI

SEQ ID NO: 1620655 - protein, 9 aa, Staphylococcus aureus
IKGGNANRY

SEQ ID NO: 1620656 - protein, 15 aa, Staphylococcus aureus
INNNAQAICKVLKSY

SEQ ID NO: 1620657 - protein, 5 aa, Staphylococcus aureus
INREK

SEQ ID NO: 1620658 - protein, 16 aa, Staphylococcus aureus
IPANTEPIRGGTDGSQ

SEQ ID NO: 1620659 - protein, 10 aa, Staphylococcus aureus
IRESDTDKVA

SEQ ID NO: 1620660 - protein, 13 aa, Staphylococcus aureus
ITANQEKTPVKAN

SEQ ID NO: 1620661 - protein, 6 aa, Staphylococcus aureus
ITGRTK

SEQ ID NO: 1620662 - protein, 11 aa, Staphylococcus aureus
ITNYSEKGMRE

SEQ ID NO: 1620663 - protein, 7 aa, Staphylococcus aureus
KADRKQF

SEQ ID NO: 1620664 - protein, 12 aa, Staphylococcus aureus
KASLQADQSESN

SEQ ID NO: 1620665 - protein, 13 aa, Staphylococcus aureus
KDTTSQINSPKSN

SEQ ID NO: 1620666 - protein, 5 aa, Staphylococcus aureus
KDVSR

SEQ ID NO: 1620667 - protein, 4 aa, Staphylococcus aureus
KEDK

SEQ ID NO: 1620668 - protein, 22 aa, Staphylococcus aureus
KEGEFSRQNVTNALETVKDGYA

SEQ ID NO: 1620669 - protein, 6 aa, Staphylococcus aureus
KEIKQE

SEQ ID NO: 1620670 - protein, 17 aa, Staphylococcus aureus
KELQRKKIRDTNIGKDL

SEQ ID NO: 1620671 - protein, 7 aa, Staphylococcus aureus
KESNSYK

SEQ ID NO: 1620672 - protein, 9 aa, Staphylococcus aureus
KEYENEKPI

SEQ ID NO: 1620673 - protein, 6 aa, Staphylococcus aureus
KHGNQI

SEQ ID NO: 1620674 - protein, 10 aa, Staphylococcus aureus
KHSPEVNLGT

SEQ ID NO: 1620675 - protein, 12 aa, Staphylococcus aureus
KIETPNVKTAQE

SEQ ID NO: 1620676 - protein, 4 aa, Staphylococcus aureus
KIKT

SEQ ID NO: 1620677 - protein, 6 aa, Staphylococcus aureus
KKFTES

SEQ ID NO: 1620678 - protein, 8 aa, Staphylococcus aureus
KKRDNHSA

SEQ ID NO: 1620679 - protein, 13 aa, Staphylococcus aureus
KKYEGKDQETIDN

SEQ ID NO: 1620680 - protein, 10 aa, Staphylococcus aureus
KLNDNTPTTL

SEQ ID NO: 1620681 - protein, 7 aa, Staphylococcus aureus
KNEPTHI

SEQ ID NO: 1620682 - protein, 7 aa, Staphylococcus aureus
KNVSVGK

SEQ ID NO: 1620683 - protein, 8 aa, Staphylococcus aureus
KQTPAHHT

SEQ ID NO: 1620684 - protein, 19 aa, Staphylococcus aureus
KRNIDKEKKMLEENGDLIE

SEQ ID NO: 1620685 - protein, 15 aa, Staphylococcus aureus
KSDVEKTLNKPKRVT

SEQ ID NO: 1620686 - protein, 9 aa, Staphylococcus aureus
KSETPPFSI

SEQ ID NO: 1620687 - protein, 8 aa, Staphylococcus aureus
KSYTKSDV

SEQ ID NO: 1620688 - protein, 5 aa, Staphylococcus aureus
KYATQ

SEQ ID NO: 1620689 - protein, 23 aa, Staphylococcus aureus
LADKQSELKRIEANNSASNENKI

SEQ ID NO: 1620690 - protein, 7 aa, Staphylococcus aureus
LASSGNY

SEQ ID NO: 1620691 - protein, 19 aa, Staphylococcus aureus
LDKNEYEAEPPLFFFSGSL

SEQ ID NO: 1620692 - protein, 11 aa, Staphylococcus aureus
LEQKSKRDKIN

SEQ ID NO: 1620693 - protein, 9 aa, Staphylococcus aureus
LEQRDKEIT

SEQ ID NO: 1620694 - protein, 9 aa, Staphylococcus aureus
LISGSSTVY

SEQ ID NO: 1620695 - protein, 8 aa, Staphylococcus aureus
LKEAIERS

SEQ ID NO: 1620696 - protein, 6 aa, Staphylococcus aureus
LKPIKG

SEQ ID NO: 1620697 - protein, 16 aa, Staphylococcus aureus
LKRGERGSDRKHIETA

SEQ ID NO: 1620698 - protein, 7 aa, Staphylococcus aureus
LNRNPDN

SEQ ID NO: 1620699 - protein, 12 aa, Staphylococcus aureus
LPAEQVSEVREK

SEQ ID NO: 1620700 - protein, 9 aa, Staphylococcus aureus
LPKNPRGSV

SEQ ID NO: 1620701 - protein, 7 aa, Staphylococcus aureus
LSDREKA

SEQ ID NO: 1620702 - protein, 5 aa, Staphylococcus aureus
LSNKK

SEQ ID NO: 1620703 - protein, 18 aa, Staphylococcus aureus
LSNNSVKIDTPFKDNSLD

SEQ ID NO: 1620704 - protein, 15 aa, Staphylococcus aureus
LSSATVDQLKDYDGV

SEQ ID NO: 1620705 - protein, 34 aa, Staphylococcus aureus
LTQQGGNHSAEQSAQAFQQAAQRQQGQQGGNGNY

SEQ ID NO: 1620706 - protein, 15 aa, Staphylococcus aureus
MEVPSSAKRDLENEN

SEQ ID NO: 1620707 - protein, 35 aa, Staphylococcus aureus
MNDQLKKDEKNGDITEDELRSGTEDVQKATDNSIK

SEQ ID NO: 1620708 - protein, 33 aa, Staphylococcus aureus
MQEISSELQQSEQSKQKQYGTTLQNLAKQNRII

SEQ ID NO: 1620709 - protein, 9 aa, Staphylococcus aureus
MTEANGQSI

SEQ ID NO: 1620710 - protein, 5 aa, Staphylococcus aureus
NATIK

SEQ ID NO: 1620711 - protein, 4 aa, Staphylococcus aureus
NDGE

SEQ ID NO: 1620712 - protein, 9 aa, Staphylococcus aureus
NDSATKGIQ

SEQ ID NO: 1620713 - protein, 8 aa, Staphylococcus aureus
NEKWPGTI

SEQ ID NO: 1620714 - protein, 6 aa, Staphylococcus aureus
NENDYH

SEQ ID NO: 1620715 - protein, 22 aa, Staphylococcus aureus
NGDGINEVKDARVDNTGYDHKT

SEQ ID NO: 1620716 - protein, 4 aa, Staphylococcus aureus
NGTV

SEQ ID NO: 1620717 - protein, 10 aa, Staphylococcus aureus
NHENSYSKNY

SEQ ID NO: 1620718 - protein, 16 aa, Staphylococcus aureus
NHHSNHTNHQKTEFNN

SEQ ID NO: 1620719 - protein, 8 aa, Staphylococcus aureus
NIDADVPT

SEQ ID NO: 1620720 - protein, 6 aa, Staphylococcus aureus
NIGLEP

SEQ ID NO: 1620721 - protein, 10 aa, Staphylococcus aureus
NISKTANKIQ

SEQ ID NO: 1620722 - protein, 9 aa, Staphylococcus aureus
NKKIGEPLT

SEQ ID NO: 1620723 - protein, 16 aa, Staphylococcus aureus
NKKIQKLENQLEEERQ

SEQ ID NO: 1620724 - protein, 4 aa, Staphylococcus aureus
NKLS

SEQ ID NO: 1620725 - protein, 18 aa, Staphylococcus aureus
NKPKMSAQAVGGAVGSNP

SEQ ID NO: 1620726 - protein, 15 aa, Staphylococcus aureus
NNTDEQDRLINLVMK

SEQ ID NO: 1620727 - protein, 9 aa, Staphylococcus aureus
NPKQKGNKV

SEQ ID NO: 1620728 - protein, 4 aa, Staphylococcus aureus
NRGP

SEQ ID NO: 1620729 - protein, 4 aa, Staphylococcus aureus
NSFD

SEQ ID NO: 1620730 - protein, 11 aa, Staphylococcus aureus
NSGQISEDKAK

SEQ ID NO: 1620731 - protein, 9 aa, Staphylococcus aureus
NTINADKAI

SEQ ID NO: 1620732 - protein, 16 aa, Staphylococcus aureus
NTLSEVQKPKENNSLL

SEQ ID NO: 1620733 - protein, 8 aa, Staphylococcus aureus
NTQGINDD

SEQ ID NO: 1620734 - protein, 12 aa, Staphylococcus aureus
NTSRTPGDHFGR

SEQ ID NO: 1620735 - protein, 6 aa, Staphylococcus aureus
NVRQGL

SEQ ID NO: 1620736 - protein, 7 aa, Staphylococcus aureus
NYRGSQC

SEQ ID NO: 1620737 - protein, 4 aa, Staphylococcus aureus
PADD

SEQ ID NO: 1620738 - protein, 12 aa, Staphylococcus aureus
PAGDGWDSNPFE

SEQ ID NO: 1620739 - protein, 4 aa, Staphylococcus aureus
PEGT

SEQ ID NO: 1620740 - protein, 7 aa, Staphylococcus aureus
PKDKNFK

SEQ ID NO: 1620741 - protein, 5 aa, Staphylococcus aureus
PKTAS

SEQ ID NO: 1620742 - protein, 5 aa, Staphylococcus aureus
PNAMQ

SEQ ID NO: 1620743 - protein, 4 aa, Staphylococcus aureus
PNIN

SEQ ID NO: 1620744 - protein, 10 aa, Staphylococcus aureus
PNQTVSSPDK

SEQ ID NO: 1620745 - protein, 19 aa, Staphylococcus aureus
PNSTGNASWRGPNKEKLDS

SEQ ID NO: 1620746 - protein, 4 aa, Staphylococcus aureus
PQHT

SEQ ID NO: 1620747 - protein, 4 aa, Staphylococcus aureus
PTGT

SEQ ID NO: 1620748 - protein, 4 aa, Staphylococcus aureus
QAEG

SEQ ID NO: 1620749 - protein, 5 aa, Staphylococcus aureus
QALTQ

SEQ ID NO: 1620750 - protein, 8 aa, Staphylococcus aureus
QATAETNS

SEQ ID NO: 1620751 - protein, 34 aa, Staphylococcus aureus
QDGTATYVHQSEDDIVTSSVKSNHPVAPSSNQSI

SEQ ID NO: 1620752 - protein, 13 aa, Staphylococcus aureus
QDKEPIKPNPDLS

SEQ ID NO: 1620753 - protein, 6 aa, Staphylococcus aureus
QFPTGA

SEQ ID NO: 1620754 - protein, 5 aa, Staphylococcus aureus
QHHAA

SEQ ID NO: 1620755 - protein, 7 aa, Staphylococcus aureus
QITPSDV

SEQ ID NO: 1620756 - protein, 5 aa, Staphylococcus aureus
QLENH

SEQ ID NO: 1620757 - protein, 5 aa, Staphylococcus aureus
QNKKM

SEQ ID NO: 1620758 - protein, 22 aa, Staphylococcus aureus
QNWNGKGWTNGVAQPGWGPETV

SEQ ID NO: 1620759 - protein, 9 aa, Staphylococcus aureus
QREGSSTNN

SEQ ID NO: 1620760 - protein, 11 aa, Staphylococcus aureus
QRGKHYGATWQ

SEQ ID NO: 1620761 - protein, 8 aa, Staphylococcus aureus
QSTGSITA

SEQ ID NO: 1620762 - protein, 5 aa, Staphylococcus aureus
QTISQ

SEQ ID NO: 1620763 - protein, 11 aa, Staphylococcus aureus
QTLKSQSHNNI

SEQ ID NO: 1620764 - protein, 14 aa, Staphylococcus aureus
QTQQNKQDVPEFDN

SEQ ID NO: 1620765 - protein, 37 aa, Staphylococcus aureus
QVQQTRGQSQYSNNKPVKDNPFANANGPIEIDDNDLP

SEQ ID NO: 1620766 - protein, 37 aa, Staphylococcus aureus
QVQQTRGQSQYSNNKPVKDNPFANANGPIELNDDDLP

SEQ ID NO: 1620767 - protein, 14 aa, Staphylococcus aureus
REKQKKHSSKIQRK

SEQ ID NO: 1620768 - protein, 15 aa, Staphylococcus aureus
RETHPNVDEEVATQF

SEQ ID NO: 1620769 - protein, 13 aa, Staphylococcus aureus
RGEAETTQSDSGM

SEQ ID NO: 1620770 - protein, 6 aa, Staphylococcus aureus
RGLNKP

SEQ ID NO: 1620771 - protein, 15 aa, Staphylococcus aureus
RGNENQLQKQIDFWL

SEQ ID NO: 1620772 - protein, 9 aa, Staphylococcus aureus
RISNPEDAA

SEQ ID NO: 1620773 - protein, 5 aa, Staphylococcus aureus
RITTT

SEQ ID NO: 1620774 - protein, 37 aa, Staphylococcus aureus
RKEDIDKKQQAPASTQTTQQASAKEEKKYNQYPTKPV

SEQ ID NO: 1620775 - protein, 7 aa, Staphylococcus aureus
RSNDNNE

SEQ ID NO: 1620776 - protein, 14 aa, Staphylococcus aureus
RSTETIQSRFTNGP

SEQ ID NO: 1620777 - protein, 4 aa, Staphylococcus aureus
RVTT

SEQ ID NO: 1620778 - protein, 4 aa, Staphylococcus aureus
SDNL

SEQ ID NO: 1620779 - protein, 8 aa, Staphylococcus aureus
SEAGRTDN

SEQ ID NO: 1620780 - protein, 6 aa, Staphylococcus aureus
SEDDRH

SEQ ID NO: 1620781 - protein, 6 aa, Staphylococcus aureus
SEKTAE

SEQ ID NO: 1620782 - protein, 12 aa, Staphylococcus aureus
SEQTMQQNHANL

SEQ ID NO: 1620783 - protein, 8 aa, Staphylococcus aureus
SIKNQGNR

SEQ ID NO: 1620784 - protein, 8 aa, Staphylococcus aureus
SINTTPEA

SEQ ID NO: 1620785 - protein, 9 aa, Staphylococcus aureus
SISQKYDEI

SEQ ID NO: 1620786 - protein, 8 aa, Staphylococcus aureus
SKYGPDIE

SEQ ID NO: 1620787 - protein, 11 aa, Staphylococcus aureus
SLSTKGCPYDN

SEQ ID NO: 1620788 - protein, 11 aa, Staphylococcus aureus
SNEDKSSLHRY

SEQ ID NO: 1620789 - protein, 6 aa, Staphylococcus aureus
SNIGKR

SEQ ID NO: 1620790 - protein, 9 aa, Staphylococcus aureus
SNRKNKPLK

SEQ ID NO: 1620791 - protein, 7 aa, Staphylococcus aureus
SQGVKKG

SEQ ID NO: 1620792 - protein, 6 aa, Staphylococcus aureus
SREGRY

SEQ ID NO: 1620793 - protein, 5 aa, Staphylococcus aureus
SRENA

SEQ ID NO: 1620794 - protein, 9 aa, Staphylococcus aureus
SSHLTEREK

SEQ ID NO: 1620795 - protein, 4 aa, Staphylococcus aureus
SSIE

SEQ ID NO: 1620796 - protein, 11 aa, Staphylococcus aureus
SSKALPPEEDE

SEQ ID NO: 1620797 - protein, 7 aa, Staphylococcus aureus
SSNLKRG

SEQ ID NO: 1620798 - protein, 4 aa, Staphylococcus aureus
STEE

SEQ ID NO: 1620799 - protein, 17 aa, Staphylococcus aureus
STKIDIDTSDIPINEPY

SEQ ID NO: 1620800 - protein, 7 aa, Staphylococcus aureus
STKSYKD

SEQ ID NO: 1620801 - protein, 11 aa, Staphylococcus aureus
STNPDVSIPKE

SEQ ID NO: 1620802 - protein, 7 aa, Staphylococcus aureus
SVSESKV

SEQ ID NO: 1620803 - protein, 12 aa, Staphylococcus aureus
TDKPDEFVPLRH

SEQ ID NO: 1620804 - protein, 9 aa, Staphylococcus aureus
TDPLTGKYK

SEQ ID NO: 1620805 - protein, 4 aa, Staphylococcus aureus
TEEE

SEQ ID NO: 1620806 - protein, 17 aa, Staphylococcus aureus
TEKDGKLYGRGTTDMKG

SEQ ID NO: 1620807 - protein, 16 aa, Staphylococcus aureus
TGGEPSDTKKFVTENQ

SEQ ID NO: 1620808 - protein, 6 aa, Staphylococcus aureus
TIDELK

SEQ ID NO: 1620809 - protein, 4 aa, Staphylococcus aureus
TIPP

SEQ ID NO: 1620810 - protein, 6 aa, Staphylococcus aureus
TKPDID

SEQ ID NO: 1620811 - protein, 9 aa, Staphylococcus aureus
TNSSNLSEP

SEQ ID NO: 1620812 - protein, 10 aa, Staphylococcus aureus
TQNEHRPTNT

SEQ ID NO: 1620813 - protein, 8 aa, Staphylococcus aureus
TQSTGNVT

SEQ ID NO: 1620814 - protein, 11 aa, Staphylococcus aureus
TRPSATNKRKE

SEQ ID NO: 1620815 - protein, 4 aa, Staphylococcus aureus
TRST

SEQ ID NO: 1620816 - protein, 4 aa, Staphylococcus aureus
TSDK

SEQ ID NO: 1620817 - protein, 8 aa, Staphylococcus aureus
TTARDNQT

SEQ ID NO: 1620818 - protein, 5 aa, Staphylococcus aureus
TTGNH

SEQ ID NO: 1620819 - protein, 6 aa, Staphylococcus aureus
VATTKT

SEQ ID NO: 1620820 - protein, 6 aa, Staphylococcus aureus
VDPNAI

SEQ ID NO: 1620821 - protein, 17 aa, Staphylococcus aureus
VDSPTVRVGGEAQASFN

SEQ ID NO: 1620822 - protein, 18 aa, Staphylococcus aureus
VEEQADEVQKVKRSENGV

SEQ ID NO: 1620823 - protein, 4 aa, Staphylococcus aureus
VETS

SEQ ID NO: 1620824 - protein, 6 aa, Staphylococcus aureus
VFDDES

SEQ ID NO: 1620825 - protein, 4 aa, Staphylococcus aureus
VKDK

SEQ ID NO: 1620826 - protein, 8 aa, Staphylococcus aureus
VKEVEGAD

SEQ ID NO: 1620827 - protein, 8 aa, Staphylococcus aureus
VKIGNSAR

SEQ ID NO: 1620828 - protein, 10 aa, Staphylococcus aureus
VKKEQRKKEL

SEQ ID NO: 1620829 - protein, 9 aa, Staphylococcus aureus
VKTEKSHDQ

SEQ ID NO: 1620830 - protein, 10 aa, Staphylococcus aureus
VPGNNELKDT

SEQ ID NO: 1620831 - protein, 4 aa, Staphylococcus aureus
VPTM

SEQ ID NO: 1620832 - protein, 7 aa, Staphylococcus aureus
VSDDAKA

SEQ ID NO: 1620833 - protein, 4 aa, Staphylococcus aureus
VTAS

SEQ ID NO: 1620834 - protein, 5 aa, Staphylococcus aureus
VTNNN

SEQ ID NO: 1620835 - protein, 12 aa, Staphylococcus aureus
VTQGKIKTSKYV

SEQ ID NO: 1620836 - protein, 5 aa, Staphylococcus aureus
VTTHT

SEQ ID NO: 1620837 - protein, 27 aa, Staphylococcus aureus
WPTSSREESKTKRLADKQGDPEEKPGI

SEQ ID NO: 1620838 - protein, 4 aa, Staphylococcus aureus
YENN

SEQ ID NO: 1620839 - protein, 8 aa, Staphylococcus aureus
YENNYDRG

SEQ ID NO: 1620840 - protein, 9 aa, Staphylococcus aureus
YEPATSGTV

SEQ ID NO: 1620841 - protein, 34 aa, Staphylococcus aureus
YESYKKSLDKNKSTLKQQSKSYTTVRKKNGLSYK

SEQ ID NO: 1620842 - protein, 12 aa, Staphylococcus aureus
YKGSKEEALSKV

SEQ ID NO: 1620843 - protein, 9 aa, Staphylococcus aureus
YKKPRTVNY

SEQ ID NO: 1620844 - protein, 6 aa, Staphylococcus aureus
YKQGTH

SEQ ID NO: 1620845 - protein, 10 aa, Staphylococcus aureus
YKRKLERDYK

SEQ ID NO: 1620846 - protein, 7 aa, Staphylococcus aureus
YQGQGYG

SEQ ID NO: 1620847 - protein, 5 aa, Staphylococcus aureus
YREPH

SEQ ID NO: 1620848 - protein, 4 aa, Staphylococcus aureus
YSND

SEQ ID NO: 1620849 - protein, 11 aa, Staphylococcus aureus
YSSDTSKTDSI

SEQ ID NO: 1620850 - protein, 10 aa, Staphylococcus aureus
YTRSITNGRL

SEQ ID NO: 1620851 - protein, 6 aa, Staphylococcus aureus
AAEGHT

SEQ ID NO: 1620852 - protein, 5 aa, Staphylococcus aureus
AAIQT

SEQ ID NO: 1620853 - protein, 19 aa, Staphylococcus aureus
AARDSGAAITAKHRGRVEH

SEQ ID NO: 1620854 - protein, 9 aa, Staphylococcus aureus
AASLEKKNV

SEQ ID NO: 1620855 - protein, 5 aa, Staphylococcus aureus
ADGHT

SEQ ID NO: 1620856 - protein, 5 aa, Staphylococcus aureus
AEGEQ

SEQ ID NO: 1620857 - protein, 11 aa, Staphylococcus aureus
AESMSDKELEQ

SEQ ID NO: 1620858 - protein, 11 aa, Staphylococcus aureus
AEWDPEYGDRH

SEQ ID NO: 1620859 - protein, 6 aa, Staphylococcus aureus
AFPQGV

SEQ ID NO: 1620860 - protein, 5 aa, Staphylococcus aureus
AGIRL

SEQ ID NO: 1620861 - protein, 5 aa, Staphylococcus aureus
AGSNS

SEQ ID NO: 1620862 - protein, 10 aa, Staphylococcus aureus
AGTQEKVKAQ

SEQ ID NO: 1620863 - protein, 6 aa, Staphylococcus aureus
AGTTRD

SEQ ID NO: 1620864 - protein, 4 aa, Staphylococcus aureus
AIQT

SEQ ID NO: 1620865 - protein, 8 aa, Staphylococcus aureus
AIRQGQNK

SEQ ID NO: 1620866 - protein, 6 aa, Staphylococcus aureus
AKANHG

SEQ ID NO: 1620867 - protein, 14 aa, Staphylococcus aureus
AKEAGIYELLLTVN

SEQ ID NO: 1620868 - protein, 10 aa, Staphylococcus aureus
ALTENDNPEE

SEQ ID NO: 1620869 - protein, 12 aa, Staphylococcus aureus
ANKEKPKYNEPL

SEQ ID NO: 1620870 - protein, 8 aa, Staphylococcus aureus
APTKNAAS

SEQ ID NO: 1620871 - protein, 10 aa, Staphylococcus aureus
AQKGRDLPLE

SEQ ID NO: 1620872 - protein, 5 aa, Staphylococcus aureus
ARADN

SEQ ID NO: 1620873 - protein, 4 aa, Staphylococcus aureus
ARLT

SEQ ID NO: 1620874 - protein, 4 aa, Staphylococcus aureus
ARSK

SEQ ID NO: 1620875 - protein, 4 aa, Staphylococcus aureus
ASAE

SEQ ID NO: 1620876 - protein, 8 aa, Staphylococcus aureus
ASETLKDI

SEQ ID NO: 1620877 - protein, 9 aa, Staphylococcus aureus
ASNIDTSKG

SEQ ID NO: 1620878 - protein, 5 aa, Staphylococcus aureus
ASQNK

SEQ ID NO: 1620879 - protein, 7 aa, Staphylococcus aureus
ATDISSI

SEQ ID NO: 1620880 - protein, 7 aa, Staphylococcus aureus
AVDTEGV

SEQ ID NO: 1620881 - protein, 11 aa, Staphylococcus aureus
AVEESKSQFKD

SEQ ID NO: 1620882 - protein, 8 aa, Staphylococcus aureus
AVTDEPSK

SEQ ID NO: 1620883 - protein, 8 aa, Staphylococcus aureus
AYKEAEKL

SEQ ID NO: 1620884 - protein, 8 aa, Staphylococcus aureus
AYKSAKGW

SEQ ID NO: 1620885 - protein, 4 aa, Staphylococcus aureus
CGVE

SEQ ID NO: 1620886 - protein, 25 aa, Staphylococcus aureus
CYGNATKSAVHAGYSEKTAYSQGQR

SEQ ID NO: 1620887 - protein, 17 aa, Staphylococcus aureus
DATKQLSATTEPSGQKV

SEQ ID NO: 1620888 - protein, 8 aa, Staphylococcus aureus
DAVPNNAP

SEQ ID NO: 1620889 - protein, 10 aa, Staphylococcus aureus
DDFKNAAQGA

SEQ ID NO: 1620890 - protein, 11 aa, Staphylococcus aureus
DDKGNQKVNPA

SEQ ID NO: 1620891 - protein, 8 aa, Staphylococcus aureus
DDKNKLDN

SEQ ID NO: 1620892 - protein, 10 aa, Staphylococcus aureus
DDVKKEIKSL

SEQ ID NO: 1620893 - protein, 14 aa, Staphylococcus aureus
DEKEDDDPYMEFVS

SEQ ID NO: 1620894 - protein, 5 aa, Staphylococcus aureus
DENAF

SEQ ID NO: 1620895 - protein, 6 aa, Staphylococcus aureus
DEYENL

SEQ ID NO: 1620896 - protein, 8 aa, Staphylococcus aureus
DGAKWGQF

SEQ ID NO: 1620897 - protein, 7 aa, Staphylococcus aureus
DGAYPDE

SEQ ID NO: 1620898 - protein, 7 aa, Staphylococcus aureus
DGSISKH

SEQ ID NO: 1620899 - protein, 5 aa, Staphylococcus aureus
DHKQH

SEQ ID NO: 1620900 - protein, 5 aa, Staphylococcus aureus
DIDFD

SEQ ID NO: 1620901 - protein, 10 aa, Staphylococcus aureus
DIQNGKEEIN

SEQ ID NO: 1620902 - protein, 12 aa, Staphylococcus aureus
DKHSTGGVGDTT

SEQ ID NO: 1620903 - protein, 5 aa, Staphylococcus aureus
DKSYI

SEQ ID NO: 1620904 - protein, 7 aa, Staphylococcus aureus
DLTEEEF

SEQ ID NO: 1620905 - protein, 6 aa, Staphylococcus aureus
DMANYR

SEQ ID NO: 1620906 - protein, 6 aa, Staphylococcus aureus
DNGYVK

SEQ ID NO: 1620907 - protein, 9 aa, Staphylococcus aureus
DNKEISSYT

SEQ ID NO: 1620908 - protein, 7 aa, Staphylococcus aureus
DNKGLDA

SEQ ID NO: 1620909 - protein, 9 aa, Staphylococcus aureus
DNPHTKAQP

SEQ ID NO: 1620910 - protein, 5 aa, Staphylococcus aureus
DNVNE

SEQ ID NO: 1620911 - protein, 4 aa, Staphylococcus aureus
DQIK

SEQ ID NO: 1620912 - protein, 11 aa, Staphylococcus aureus
DQLGQRPGAGA

SEQ ID NO: 1620913 - protein, 4 aa, Staphylococcus aureus
DQNL

SEQ ID NO: 1620914 - protein, 7 aa, Staphylococcus aureus
DSEEFSK

SEQ ID NO: 1620915 - protein, 10 aa, Staphylococcus aureus
DSHDTNEGYS

SEQ ID NO: 1620916 - protein, 18 aa, Staphylococcus aureus
DSIKRKDNKITKDDSNIE

SEQ ID NO: 1620917 - protein, 7 aa, Staphylococcus aureus
DSRTTKV

SEQ ID NO: 1620918 - protein, 5 aa, Staphylococcus aureus
DTPAT

SEQ ID NO: 1620919 - protein, 6 aa, Staphylococcus aureus
DVDKNI

SEQ ID NO: 1620920 - protein, 4 aa, Staphylococcus aureus
DYSY

SEQ ID NO: 1620921 - protein, 6 aa, Staphylococcus aureus
EAGIGK

SEQ ID NO: 1620922 - protein, 9 aa, Staphylococcus aureus
EASKNGKTW

SEQ ID NO: 1620923 - protein, 33 aa, Staphylococcus aureus
EDEMDDDDDIPAQTDDQEELNDPEDEQVEEEIN

SEQ ID NO: 1620924 - protein, 6 aa, Staphylococcus aureus
EDGQVQ

SEQ ID NO: 1620925 - protein, 4 aa, Staphylococcus aureus
EDVA

SEQ ID NO: 1620926 - protein, 19 aa, Staphylococcus aureus
EEDQLNVDNSQYKEIKGVK

SEQ ID NO: 1620927 - protein, 12 aa, Staphylococcus aureus
EENGAIKHNKEL

SEQ ID NO: 1620928 - protein, 17 aa, Staphylococcus aureus
EESDVKDLTEEKYNQDY

SEQ ID NO: 1620929 - protein, 9 aa, Staphylococcus aureus
EESNGIKAE

SEQ ID NO: 1620930 - protein, 99 aa, Staphylococcus aureus
EESQDDNQLENEQVDQSTSSSVSEVSDITEESEETTHPNNTSGQQDNDDQQKDLQPSFSNQNEDTANENRPRTNQQDVATNQAVQTSKPMIRKGPNIKL

SEQ ID NO: 1620931 - protein, 4 aa, Staphylococcus aureus
EESY

SEQ ID NO: 1620932 - protein, 9 aa, Staphylococcus aureus
EGNTSGYLS

SEQ ID NO: 1620933 - protein, 18 aa, Staphylococcus aureus
EGRRATGVTYKKNGKLHT

SEQ ID NO: 1620934 - protein, 10 aa, Staphylococcus aureus
EGTIKSEAYR

SEQ ID NO: 1620935 - protein, 17 aa, Staphylococcus aureus
EIEKQETELSDDELQEA

SEQ ID NO: 1620936 - protein, 9 aa, Staphylococcus aureus
EKDEKNTAH

SEQ ID NO: 1620937 - protein, 8 aa, Staphylococcus aureus
EKERKVYE

SEQ ID NO: 1620938 - protein, 8 aa, Staphylococcus aureus
EKYTDEQV

SEQ ID NO: 1620939 - protein, 7 aa, Staphylococcus aureus
ELETKRE

SEQ ID NO: 1620940 - protein, 11 aa, Staphylococcus aureus
ENLTSKTALKK

SEQ ID NO: 1620941 - protein, 5 aa, Staphylococcus aureus
ENRDF

SEQ ID NO: 1620942 - protein, 29 aa, Staphylococcus aureus
EPFKDGKVTDQETMDKELQSRLKKSLKQS

SEQ ID NO: 1620943 - protein, 7 aa, Staphylococcus aureus
EPYKKTN

SEQ ID NO: 1620944 - protein, 8 aa, Staphylococcus aureus
EQIETQDE

SEQ ID NO: 1620945 - protein, 20 aa, Staphylococcus aureus
ERANKKGLRIAGTDSDLNDL

SEQ ID NO: 1620946 - protein, 9 aa, Staphylococcus aureus
ERDKIEAEY

SEQ ID NO: 1620947 - protein, 22 aa, Staphylococcus aureus
ERESKEREMARQRRKEAELRRK

SEQ ID NO: 1620948 - protein, 17 aa, Staphylococcus aureus
ESDSSLRSEDKGDDMST

SEQ ID NO: 1620949 - protein, 5 aa, Staphylococcus aureus
ESGTP

SEQ ID NO: 1620950 - protein, 13 aa, Staphylococcus aureus
ESHPLQDEDQVQG

SEQ ID NO: 1620951 - protein, 10 aa, Staphylococcus aureus
ESIGGSNQVE

SEQ ID NO: 1620952 - protein, 7 aa, Staphylococcus aureus
ESKKDVY

SEQ ID NO: 1620953 - protein, 9 aa, Staphylococcus aureus
ESKKTILGH

SEQ ID NO: 1620954 - protein, 18 aa, Staphylococcus aureus
ESQGNLELPNDYSPSNAM

SEQ ID NO: 1620955 - protein, 4 aa, Staphylococcus aureus
ESVK

SEQ ID NO: 1620956 - protein, 10 aa, Staphylococcus aureus
ETIDTPVQTL

SEQ ID NO: 1620957 - protein, 5 aa, Staphylococcus aureus
ETTVQ

SEQ ID NO: 1620958 - protein, 12 aa, Staphylococcus aureus
EYQDVSSTNSNL

SEQ ID NO: 1620959 - protein, 6 aa, Staphylococcus aureus
FKQEVE

SEQ ID NO: 1620960 - protein, 7 aa, Staphylococcus aureus
FPKTASA

SEQ ID NO: 1620961 - protein, 11 aa, Staphylococcus aureus
FSDGANAANLA

SEQ ID NO: 1620962 - protein, 10 aa, Staphylococcus aureus
FSKGEKSDLS

SEQ ID NO: 1620963 - protein, 9 aa, Staphylococcus aureus
GASTTATKV

SEQ ID NO: 1620964 - protein, 9 aa, Staphylococcus aureus
GATVQEEVG

SEQ ID NO: 1620965 - protein, 5 aa, Staphylococcus aureus
GCSYR

SEQ ID NO: 1620966 - protein, 5 aa, Staphylococcus aureus
GEDFD

SEQ ID NO: 1620967 - protein, 4 aa, Staphylococcus aureus
GETY

SEQ ID NO: 1620968 - protein, 6 aa, Staphylococcus aureus
GFQYTS

SEQ ID NO: 1620969 - protein, 4 aa, Staphylococcus aureus
GGGY

SEQ ID NO: 1620970 - protein, 12 aa, Staphylococcus aureus
GGYSREKANELL

SEQ ID NO: 1620971 - protein, 7 aa, Staphylococcus aureus
GIIGDGN

SEQ ID NO: 1620972 - protein, 12 aa, Staphylococcus aureus
GKIEKNETEKEA

SEQ ID NO: 1620973 - protein, 4 aa, Staphylococcus aureus
GKPG

SEQ ID NO: 1620974 - protein, 10 aa, Staphylococcus aureus
GKTPHSSHKK

SEQ ID NO: 1620975 - protein, 15 aa, Staphylococcus aureus
GKTVTIGGSTKGSGM

SEQ ID NO: 1620976 - protein, 8 aa, Staphylococcus aureus
GLEGKKKI

SEQ ID NO: 1620977 - protein, 10 aa, Staphylococcus aureus
GLKKHTRDAL

SEQ ID NO: 1620978 - protein, 24 aa, Staphylococcus aureus
GMQKSITQLGDQFNRKAQAKELND

SEQ ID NO: 1620979 - protein, 4 aa, Staphylococcus aureus
GNIT

SEQ ID NO: 1620980 - protein, 5 aa, Staphylococcus aureus
GNRNE

SEQ ID NO: 1620981 - protein, 19 aa, Staphylococcus aureus
GNVSNNYPKKITEDSTTRD

SEQ ID NO: 1620982 - protein, 6 aa, Staphylococcus aureus
GPKPQH

SEQ ID NO: 1620983 - protein, 4 aa, Staphylococcus aureus
GRHN

SEQ ID NO: 1620984 - protein, 11 aa, Staphylococcus aureus
GRLTAEDKKEI

SEQ ID NO: 1620985 - protein, 10 aa, Staphylococcus aureus
GRNKEKLQNV

SEQ ID NO: 1620986 - protein, 7 aa, Staphylococcus aureus
GRSYQDI

SEQ ID NO: 1620987 - protein, 7 aa, Staphylococcus aureus
GRYKTNK

SEQ ID NO: 1620988 - protein, 12 aa, Staphylococcus aureus
GSRGSKKSKTTA

SEQ ID NO: 1620989 - protein, 6 aa, Staphylococcus aureus
GSTLPE

SEQ ID NO: 1620990 - protein, 16 aa, Staphylococcus aureus
GTGGNSGWSIIEGKEV

SEQ ID NO: 1620991 - protein, 4 aa, Staphylococcus aureus
GTGI

SEQ ID NO: 1620992 - protein, 6 aa, Staphylococcus aureus
GTKNVS

SEQ ID NO: 1620993 - protein, 21 aa, Staphylococcus aureus
GTSNEAINPNNPLKSSGFGDD

SEQ ID NO: 1620994 - protein, 7 aa, Staphylococcus aureus
GVGKGQR

SEQ ID NO: 1620995 - protein, 11 aa, Staphylococcus aureus
GYPTNENDLKK

SEQ ID NO: 1620996 - protein, 5 aa, Staphylococcus aureus
HDSYE

SEQ ID NO: 1620997 - protein, 14 aa, Staphylococcus aureus
HKADYEDENVEVEK

SEQ ID NO: 1620998 - protein, 7 aa, Staphylococcus aureus
HLKNSGG

SEQ ID NO: 1620999 - protein, 24 aa, Staphylococcus aureus
HNSTWDPQSNSIAKYNYPNGKPEH

SEQ ID NO: 1621000 - protein, 5 aa, Staphylococcus aureus
IAQES

SEQ ID NO: 1621001 - protein, 9 aa, Staphylococcus aureus
IDASNKASI

SEQ ID NO: 1621002 - protein, 5 aa, Staphylococcus aureus
IDENN

SEQ ID NO: 1621003 - protein, 6 aa, Staphylococcus aureus
IEAPGY

SEQ ID NO: 1621004 - protein, 30 aa, Staphylococcus aureus
IESTAKDVQTAKSSANKDSVTVKGKAPNTL

SEQ ID NO: 1621005 - protein, 4 aa, Staphylococcus aureus
IFET

SEQ ID NO: 1621006 - protein, 18 aa, Staphylococcus aureus
IFSNPSNKKTEDYISGRF

SEQ ID NO: 1621007 - protein, 14 aa, Staphylococcus aureus
IKQRSERQKQRNIA

SEQ ID NO: 1621008 - protein, 10 aa, Staphylococcus aureus
IKTTGNKPDL

SEQ ID NO: 1621009 - protein, 6 aa, Staphylococcus aureus
INEEQP

SEQ ID NO: 1621010 - protein, 10 aa, Staphylococcus aureus
INNKVGKNDI

SEQ ID NO: 1621011 - protein, 8 aa, Staphylococcus aureus
INQAQQLG

SEQ ID NO: 1621012 - protein, 20 aa, Staphylococcus aureus
INTKEDFKATIERSDSCAVP

SEQ ID NO: 1621013 - protein, 6 aa, Staphylococcus aureus
IPDSEF

SEQ ID NO: 1621014 - protein, 14 aa, Staphylococcus aureus
IQNHESKLNENSKA

SEQ ID NO: 1621015 - protein, 21 aa, Staphylococcus aureus
IQSKFNDSYVKENTVKGRPKI

SEQ ID NO: 1621016 - protein, 12 aa, Staphylococcus aureus
IREKTDVRKTDI

SEQ ID NO: 1621017 - protein, 8 aa, Staphylococcus aureus
IRPPYKSN

SEQ ID NO: 1621018 - protein, 10 aa, Staphylococcus aureus
IVEGDSPEEL

SEQ ID NO: 1621019 - protein, 7 aa, Staphylococcus aureus
KDGFKNK

SEQ ID NO: 1621020 - protein, 6 aa, Staphylococcus aureus
KDGITE

SEQ ID NO: 1621021 - protein, 6 aa, Staphylococcus aureus
KDHIKG

SEQ ID NO: 1621022 - protein, 18 aa, Staphylococcus aureus
KDLESGTPTEVLTGENEG

SEQ ID NO: 1621023 - protein, 9 aa, Staphylococcus aureus
KDSTVENGQ

SEQ ID NO: 1621024 - protein, 11 aa, Staphylococcus aureus
KEMKKTEKVEV

SEQ ID NO: 1621025 - protein, 10 aa, Staphylococcus aureus
KEPTPIQKDS

SEQ ID NO: 1621026 - protein, 6 aa, Staphylococcus aureus
KEQVSI

SEQ ID NO: 1621027 - protein, 6 aa, Staphylococcus aureus
KFAGKA

SEQ ID NO: 1621028 - protein, 13 aa, Staphylococcus aureus
KFETNFSTDTTNE

SEQ ID NO: 1621029 - protein, 13 aa, Staphylococcus aureus
KFNANKSKELETI

SEQ ID NO: 1621030 - protein, 4 aa, Staphylococcus aureus
KGAK

SEQ ID NO: 1621031 - protein, 4 aa, Staphylococcus aureus
KGIE

SEQ ID NO: 1621032 - protein, 16 aa, Staphylococcus aureus
KGNEIKEDAKEEQIKK

SEQ ID NO: 1621033 - protein, 15 aa, Staphylococcus aureus
KGNNNTNDSAGDERI

SEQ ID NO: 1621034 - protein, 7 aa, Staphylococcus aureus
KHRNDKN

SEQ ID NO: 1621035 - protein, 18 aa, Staphylococcus aureus
KINPSKTIIEDEKDNNIF

SEQ ID NO: 1621036 - protein, 6 aa, Staphylococcus aureus
KISYEQ

SEQ ID NO: 1621037 - protein, 14 aa, Staphylococcus aureus
KKQAAKDEIDQLQA

SEQ ID NO: 1621038 - protein, 7 aa, Staphylococcus aureus
KKSELRP

SEQ ID NO: 1621039 - protein, 7 aa, Staphylococcus aureus
KKTNVLE

SEQ ID NO: 1621040 - protein, 5 aa, Staphylococcus aureus
KLRDE

SEQ ID NO: 1621041 - protein, 24 aa, Staphylococcus aureus
KMKRQERKQFSKQQNRQKRKQNKK

SEQ ID NO: 1621042 - protein, 6 aa, Staphylococcus aureus
KNEDPW

SEQ ID NO: 1621043 - protein, 4 aa, Staphylococcus aureus
KNKD

SEQ ID NO: 1621044 - protein, 6 aa, Staphylococcus aureus
KNKQAY

SEQ ID NO: 1621045 - protein, 7 aa, Staphylococcus aureus
KNTDIEY

SEQ ID NO: 1621046 - protein, 20 aa, Staphylococcus aureus
KNVSNANPNHTVILDDIPLE

SEQ ID NO: 1621047 - protein, 12 aa, Staphylococcus aureus
KNYDQISSIEEQ

SEQ ID NO: 1621048 - protein, 15 aa, Staphylococcus aureus
KNYKEGYLTESDGKL

SEQ ID NO: 1621049 - protein, 6 aa, Staphylococcus aureus
KPSQDT

SEQ ID NO: 1621050 - protein, 10 aa, Staphylococcus aureus
KRKNGASKNI

SEQ ID NO: 1621051 - protein, 10 aa, Staphylococcus aureus
KRTTTYDVES

SEQ ID NO: 1621052 - protein, 7 aa, Staphylococcus aureus
KSDQDLS

SEQ ID NO: 1621053 - protein, 28 aa, Staphylococcus aureus
KSKSPTVNDLPERDLSQQISDYDQYGAN

SEQ ID NO: 1621054 - protein, 7 aa, Staphylococcus aureus
KSKTYDD

SEQ ID NO: 1621055 - protein, 16 aa, Staphylococcus aureus
KSLNPNIKIYDVLYIS

SEQ ID NO: 1621056 - protein, 23 aa, Staphylococcus aureus
KSVSDFRGGMPSEGGFGVTVATL

SEQ ID NO: 1621057 - protein, 9 aa, Staphylococcus aureus
KSYTKSDVI

SEQ ID NO: 1621058 - protein, 12 aa, Staphylococcus aureus
KSYVNGKYMLKR

SEQ ID NO: 1621059 - protein, 7 aa, Staphylococcus aureus
KTRPELQ

SEQ ID NO: 1621060 - protein, 8 aa, Staphylococcus aureus
KVKSDDQV

SEQ ID NO: 1621061 - protein, 6 aa, Staphylococcus aureus
KVPEDW

SEQ ID NO: 1621062 - protein, 6 aa, Staphylococcus aureus
KVTSGY

SEQ ID NO: 1621063 - protein, 6 aa, Staphylococcus aureus
KWDQTT

SEQ ID NO: 1621064 - protein, 28 aa, Staphylococcus aureus
LAEGNATVTATAGKQTDTVQITVQSNLE

SEQ ID NO: 1621065 - protein, 9 aa, Staphylococcus aureus
LAESQDDLE

SEQ ID NO: 1621066 - protein, 10 aa, Staphylococcus aureus
LAGANKEDIS

SEQ ID NO: 1621067 - protein, 7 aa, Staphylococcus aureus
LAPAGNL

SEQ ID NO: 1621068 - protein, 13 aa, Staphylococcus aureus
LEDKEDEKQGEVS

SEQ ID NO: 1621069 - protein, 9 aa, Staphylococcus aureus
LHENQSDYN

SEQ ID NO: 1621070 - protein, 9 aa, Staphylococcus aureus
LHTNQGSNH

SEQ ID NO: 1621071 - protein, 14 aa, Staphylococcus aureus
LIDPSSEAKDFNRP

SEQ ID NO: 1621072 - protein, 4 aa, Staphylococcus aureus
LKDD

SEQ ID NO: 1621073 - protein, 12 aa, Staphylococcus aureus
LKDKPNMPQKSQ

SEQ ID NO: 1621074 - protein, 5 aa, Staphylococcus aureus
LKNSD

SEQ ID NO: 1621075 - protein, 7 aa, Staphylococcus aureus
LNKKTEN

SEQ ID NO: 1621076 - protein, 10 aa, Staphylococcus aureus
LNSGNRNERL

SEQ ID NO: 1621077 - protein, 4 aa, Staphylococcus aureus
LPDN

SEQ ID NO: 1621078 - protein, 5 aa, Staphylococcus aureus
LPNLE

SEQ ID NO: 1621079 - protein, 7 aa, Staphylococcus aureus
LQDDKQI

SEQ ID NO: 1621080 - protein, 8 aa, Staphylococcus aureus
LQSDEKVT

SEQ ID NO: 1621081 - protein, 18 aa, Staphylococcus aureus
LQTQYDKEASIKYGHTKA

SEQ ID NO: 1621082 - protein, 4 aa, Staphylococcus aureus
LSEA

SEQ ID NO: 1621083 - protein, 13 aa, Staphylococcus aureus
LTSNAIKAGDDGF

SEQ ID NO: 1621084 - protein, 9 aa, Staphylococcus aureus
NAKRISSTI

SEQ ID NO: 1621085 - protein, 4 aa, Staphylococcus aureus
NALE

SEQ ID NO: 1621086 - protein, 8 aa, Staphylococcus aureus
NDDNTTVF

SEQ ID NO: 1621087 - protein, 7 aa, Staphylococcus aureus
NDLGTEI

SEQ ID NO: 1621088 - protein, 11 aa, Staphylococcus aureus
NDMYEKEGAKI

SEQ ID NO: 1621089 - protein, 10 aa, Staphylococcus aureus
NDTENNDMND

SEQ ID NO: 1621090 - protein, 6 aa, Staphylococcus aureus
NEATVY

SEQ ID NO: 1621091 - protein, 6 aa, Staphylococcus aureus
NEDITI

SEQ ID NO: 1621092 - protein, 7 aa, Staphylococcus aureus
NEENPNA

SEQ ID NO: 1621093 - protein, 6 aa, Staphylococcus aureus
NEIRNF

SEQ ID NO: 1621094 - protein, 8 aa, Staphylococcus aureus
NEYDDTDK

SEQ ID NO: 1621095 - protein, 17 aa, Staphylococcus aureus
NFVPTAAGLASSASAYA

SEQ ID NO: 1621096 - protein, 14 aa, Staphylococcus aureus
NGISLNKSKKRKKI

SEQ ID NO: 1621097 - protein, 8 aa, Staphylococcus aureus
NGSLDKKL

SEQ ID NO: 1621098 - protein, 6 aa, Staphylococcus aureus
NIQSST

SEQ ID NO: 1621099 - protein, 7 aa, Staphylococcus aureus
NKAEFPE

SEQ ID NO: 1621100 - protein, 15 aa, Staphylococcus aureus
NKDISIKQSSHLKDT

SEQ ID NO: 1621101 - protein, 4 aa, Staphylococcus aureus
NKET

SEQ ID NO: 1621102 - protein, 7 aa, Staphylococcus aureus
NKKLTNE

SEQ ID NO: 1621103 - protein, 7 aa, Staphylococcus aureus
NKLDSQR

SEQ ID NO: 1621104 - protein, 13 aa, Staphylococcus aureus
NLDSEIQRGEVTQ

SEQ ID NO: 1621105 - protein, 6 aa, Staphylococcus aureus
NLDSRV

SEQ ID NO: 1621106 - protein, 9 aa, Staphylococcus aureus
NLKGSSVGY

SEQ ID NO: 1621107 - protein, 11 aa, Staphylococcus aureus
NNFPDYEYSRH

SEQ ID NO: 1621108 - protein, 6 aa, Staphylococcus aureus
NNNDPY

SEQ ID NO: 1621109 - protein, 15 aa, Staphylococcus aureus
NNPTGRSLTNEQKKN

SEQ ID NO: 1621110 - protein, 4 aa, Staphylococcus aureus
NNQP

SEQ ID NO: 1621111 - protein, 6 aa, Staphylococcus aureus
NPCPES

SEQ ID NO: 1621112 - protein, 10 aa, Staphylococcus aureus
NPKLSGNKRF

SEQ ID NO: 1621113 - protein, 5 aa, Staphylococcus aureus
NPRRA

SEQ ID NO: 1621114 - protein, 14 aa, Staphylococcus aureus
NPSKFEDAEDIAKE

SEQ ID NO: 1621115 - protein, 11 aa, Staphylococcus aureus
NQKRSNIRKTI

SEQ ID NO: 1621116 - protein, 7 aa, Staphylococcus aureus
NQLSQDS

SEQ ID NO: 1621117 - protein, 15 aa, Staphylococcus aureus
NQMPQSQITQPTHQV

SEQ ID NO: 1621118 - protein, 8 aa, Staphylococcus aureus
NSFSKNNQ

SEQ ID NO: 1621119 - protein, 7 aa, Staphylococcus aureus
NTGELSV

SEQ ID NO: 1621120 - protein, 4 aa, Staphylococcus aureus
NTIG

SEQ ID NO: 1621121 - protein, 13 aa, Staphylococcus aureus
NTPFANTKKHARD

SEQ ID NO: 1621122 - protein, 5 aa, Staphylococcus aureus
NVDKR

SEQ ID NO: 1621123 - protein, 5 aa, Staphylococcus aureus
NYFTE

SEQ ID NO: 1621124 - protein, 9 aa, Staphylococcus aureus
PAPGHTPGT

SEQ ID NO: 1621125 - protein, 16 aa, Staphylococcus aureus
PESNKQVLESFVKDVF

SEQ ID NO: 1621126 - protein, 7 aa, Staphylococcus aureus
PINQQDH

SEQ ID NO: 1621127 - protein, 4 aa, Staphylococcus aureus
PKGN

SEQ ID NO: 1621128 - protein, 6 aa, Staphylococcus aureus
PKYPRN

SEQ ID NO: 1621129 - protein, 8 aa, Staphylococcus aureus
PLTNEDKQ

SEQ ID NO: 1621130 - protein, 7 aa, Staphylococcus aureus
PQSKNDH

SEQ ID NO: 1621131 - protein, 22 aa, Staphylococcus aureus
PQVSSKADASSSYLTEKERNLG

SEQ ID NO: 1621132 - protein, 13 aa, Staphylococcus aureus
PSSIGAKLANPDK

SEQ ID NO: 1621133 - protein, 17 aa, Staphylococcus aureus
PSVDTAQKYKLNDRDKE

SEQ ID NO: 1621134 - protein, 8 aa, Staphylococcus aureus
PTEDESRE

SEQ ID NO: 1621135 - protein, 15 aa, Staphylococcus aureus
PTGNDSGGDKLLPKT

SEQ ID NO: 1621136 - protein, 5 aa, Staphylococcus aureus
PTQSI

SEQ ID NO: 1621137 - protein, 10 aa, Staphylococcus aureus
PTSIEGELPE

SEQ ID NO: 1621138 - protein, 6 aa, Staphylococcus aureus
PTSYTK

SEQ ID NO: 1621139 - protein, 17 aa, Staphylococcus aureus
QASEINADGIGRDASTL

SEQ ID NO: 1621140 - protein, 9 aa, Staphylococcus aureus
QDGLTQNDI

SEQ ID NO: 1621141 - protein, 4 aa, Staphylococcus aureus
QDKV

SEQ ID NO: 1621142 - protein, 10 aa, Staphylococcus aureus
QDKVSGIDDK

SEQ ID NO: 1621143 - protein, 10 aa, Staphylococcus aureus
QDNLQSQDIR

SEQ ID NO: 1621144 - protein, 9 aa, Staphylococcus aureus
QDVTEGPSV

SEQ ID NO: 1621145 - protein, 14 aa, Staphylococcus aureus
QEIENEKISTTSIR

SEQ ID NO: 1621146 - protein, 6 aa, Staphylococcus aureus
QGKGKA

SEQ ID NO: 1621147 - protein, 15 aa, Staphylococcus aureus
QHKAVRAQQNGEFDS

SEQ ID NO: 1621148 - protein, 6 aa, Staphylococcus aureus
QIGPLT

SEQ ID NO: 1621149 - protein, 15 aa, Staphylococcus aureus
QKDKDTGEYTNEPVD

SEQ ID NO: 1621150 - protein, 7 aa, Staphylococcus aureus
QKGTGKF

SEQ ID NO: 1621151 - protein, 13 aa, Staphylococcus aureus
QNLDKNNVGEYQT

SEQ ID NO: 1621152 - protein, 7 aa, Staphylococcus aureus
QPNFTET

SEQ ID NO: 1621153 - protein, 20 aa, Staphylococcus aureus
QQCKRDGKLTTYDKSKHKSL

SEQ ID NO: 1621154 - protein, 12 aa, Staphylococcus aureus
QQVLEEENNQYD

SEQ ID NO: 1621155 - protein, 14 aa, Staphylococcus aureus
QSAMPKAKGTTSNK

SEQ ID NO: 1621156 - protein, 5 aa, Staphylococcus aureus
QTSDV

SEQ ID NO: 1621157 - protein, 5 aa, Staphylococcus aureus
RAKEE

SEQ ID NO: 1621158 - protein, 7 aa, Staphylococcus aureus
RARGEAI

SEQ ID NO: 1621159 - protein, 7 aa, Staphylococcus aureus
RDITTNG

SEQ ID NO: 1621160 - protein, 9 aa, Staphylococcus aureus
RDNEGEAFR

SEQ ID NO: 1621161 - protein, 6 aa, Staphylococcus aureus
RERNDN

SEQ ID NO: 1621162 - protein, 11 aa, Staphylococcus aureus
RGLRKSSNKEY

SEQ ID NO: 1621163 - protein, 9 aa, Staphylococcus aureus
RHATRKRNY

SEQ ID NO: 1621164 - protein, 7 aa, Staphylococcus aureus
RKGTTLP

SEQ ID NO: 1621165 - protein, 8 aa, Staphylococcus aureus
RKKGYGKR

SEQ ID NO: 1621166 - protein, 29 aa, Staphylococcus aureus
RLAEQKATDAENVEKEEAITKATDNTTID

SEQ ID NO: 1621167 - protein, 21 aa, Staphylococcus aureus
RNDSTTKNNNIGETEDVLNRT

SEQ ID NO: 1621168 - protein, 5 aa, Staphylococcus aureus
RNIKA

SEQ ID NO: 1621169 - protein, 8 aa, Staphylococcus aureus
RNNNTNVP

SEQ ID NO: 1621170 - protein, 7 aa, Staphylococcus aureus
RNSTGRN

SEQ ID NO: 1621171 - protein, 4 aa, Staphylococcus aureus
RPED

SEQ ID NO: 1621172 - protein, 4 aa, Staphylococcus aureus
RPKK

SEQ ID NO: 1621173 - protein, 38 aa, Staphylococcus aureus
RPPYSKDTSKPSSTDTSSASKANDSTITGEAKKPQFKE

SEQ ID NO: 1621174 - protein, 9 aa, Staphylococcus aureus
RQGGYGRGR

SEQ ID NO: 1621175 - protein, 6 aa, Staphylococcus aureus
RRDGTF

SEQ ID NO: 1621176 - protein, 11 aa, Staphylococcus aureus
RRKPITSSLRE

SEQ ID NO: 1621177 - protein, 7 aa, Staphylococcus aureus
RSMSSGQ

SEQ ID NO: 1621178 - protein, 7 aa, Staphylococcus aureus
RTHNDEL

SEQ ID NO: 1621179 - protein, 6 aa, Staphylococcus aureus
RTPDYN

SEQ ID NO: 1621180 - protein, 6 aa, Staphylococcus aureus
SAENEI

SEQ ID NO: 1621181 - protein, 6 aa, Staphylococcus aureus
SDESQI

SEQ ID NO: 1621182 - protein, 7 aa, Staphylococcus aureus
SDETTQN

SEQ ID NO: 1621183 - protein, 5 aa, Staphylococcus aureus
SDGRG

SEQ ID NO: 1621184 - protein, 4 aa, Staphylococcus aureus
SELV

SEQ ID NO: 1621185 - protein, 13 aa, Staphylococcus aureus
SESTTYGDARNKL

SEQ ID NO: 1621186 - protein, 5 aa, Staphylococcus aureus
SEVDS

SEQ ID NO: 1621187 - protein, 4 aa, Staphylococcus aureus
SGNI

SEQ ID NO: 1621188 - protein, 27 aa, Staphylococcus aureus
SINEKDGKVGSVTLTSTKDGSEETHEA

SEQ ID NO: 1621189 - protein, 5 aa, Staphylococcus aureus
SIREE

SEQ ID NO: 1621190 - protein, 7 aa, Staphylococcus aureus
SKEDKFD

SEQ ID NO: 1621191 - protein, 5 aa, Staphylococcus aureus
SKEEQ

SEQ ID NO: 1621192 - protein, 7 aa, Staphylococcus aureus
SKKYEDI

SEQ ID NO: 1621193 - protein, 9 aa, Staphylococcus aureus
SMAQQAGGY

SEQ ID NO: 1621194 - protein, 5 aa, Staphylococcus aureus
SMSSG

SEQ ID NO: 1621195 - protein, 8 aa, Staphylococcus aureus
SNGSNYDK

SEQ ID NO: 1621196 - protein, 6 aa, Staphylococcus aureus
SNISQR

SEQ ID NO: 1621197 - protein, 6 aa, Staphylococcus aureus
SNPNNS

SEQ ID NO: 1621198 - protein, 11 aa, Staphylococcus aureus
SNTNKQSTYTD

SEQ ID NO: 1621199 - protein, 18 aa, Staphylococcus aureus
SPANDVKGNQPLSGELGK

SEQ ID NO: 1621200 - protein, 10 aa, Staphylococcus aureus
SPEPSYMPGY

SEQ ID NO: 1621201 - protein, 6 aa, Staphylococcus aureus
SPGFAQ

SEQ ID NO: 1621202 - protein, 8 aa, Staphylococcus aureus
SPITKQNY

SEQ ID NO: 1621203 - protein, 22 aa, Staphylococcus aureus
SPLRKADDAVTLDTTGKTIEEV

SEQ ID NO: 1621204 - protein, 12 aa, Staphylococcus aureus
SPPEVTTRRTHG

SEQ ID NO: 1621205 - protein, 6 aa, Staphylococcus aureus
SPRQIA

SEQ ID NO: 1621206 - protein, 9 aa, Staphylococcus aureus
SQIEKDTGH

SEQ ID NO: 1621207 - protein, 41 aa, Staphylococcus aureus
SQIQEKQEELDKLKEKDGTSENNQQSVEVNEARTYRNQANI

SEQ ID NO: 1621208 - protein, 6 aa, Staphylococcus aureus
SQLPES

SEQ ID NO: 1621209 - protein, 9 aa, Staphylococcus aureus
SSDREKSIQ

SEQ ID NO: 1621210 - protein, 7 aa, Staphylococcus aureus
SSGTSVL

SEQ ID NO: 1621211 - protein, 17 aa, Staphylococcus aureus
SSHVTGYDKKGSTTGRD

SEQ ID NO: 1621212 - protein, 12 aa, Staphylococcus aureus
SSRGEQNMEPVE

SEQ ID NO: 1621213 - protein, 8 aa, Staphylococcus aureus
SSTAWSNA

SEQ ID NO: 1621214 - protein, 28 aa, Staphylococcus aureus
STGTMDKVREREKDSSGTTNIDDIDWDN

SEQ ID NO: 1621215 - protein, 6 aa, Staphylococcus aureus
STNSLV

SEQ ID NO: 1621216 - protein, 13 aa, Staphylococcus aureus
STSAYNGNDTEGL

SEQ ID NO: 1621217 - protein, 6 aa, Staphylococcus aureus
SVTTKA

SEQ ID NO: 1621218 - protein, 8 aa, Staphylococcus aureus
TAGLTGTV

SEQ ID NO: 1621219 - protein, 8 aa, Staphylococcus aureus
TDHGSDFT

SEQ ID NO: 1621220 - protein, 6 aa, Staphylococcus aureus
TDPDGH

SEQ ID NO: 1621221 - protein, 9 aa, Staphylococcus aureus
TDQKVSELK

SEQ ID NO: 1621222 - protein, 11 aa, Staphylococcus aureus
TEDAIQNGADE

SEQ ID NO: 1621223 - protein, 15 aa, Staphylococcus aureus
TEGKGGKVWDTDGKQ

SEQ ID NO: 1621224 - protein, 5 aa, Staphylococcus aureus
TEMGL

SEQ ID NO: 1621225 - protein, 11 aa, Staphylococcus aureus
TFTPEQQKKVD

SEQ ID NO: 1621226 - protein, 15 aa, Staphylococcus aureus
TGETYSNIELIKSLS

SEQ ID NO: 1621227 - protein, 6 aa, Staphylococcus aureus
TGGFAK

SEQ ID NO: 1621228 - protein, 6 aa, Staphylococcus aureus
THFTDE

SEQ ID NO: 1621229 - protein, 5 aa, Staphylococcus aureus
TIERK

SEQ ID NO: 1621230 - protein, 8 aa, Staphylococcus aureus
TKKGEEIL

SEQ ID NO: 1621231 - protein, 18 aa, Staphylococcus aureus
TKKNAAGEYVLTGEKWGY

SEQ ID NO: 1621232 - protein, 14 aa, Staphylococcus aureus
TKTGDYKENPDTGK

SEQ ID NO: 1621233 - protein, 5 aa, Staphylococcus aureus
TMDDT

SEQ ID NO: 1621234 - protein, 5 aa, Staphylococcus aureus
TNDVT

SEQ ID NO: 1621235 - protein, 10 aa, Staphylococcus aureus
TNEVQRRGVA

SEQ ID NO: 1621236 - protein, 5 aa, Staphylococcus aureus
TNISE

SEQ ID NO: 1621237 - protein, 8 aa, Staphylococcus aureus
TQASVSDL

SEQ ID NO: 1621238 - protein, 20 aa, Staphylococcus aureus
TQAVDENNSELNQMGTSTKA

SEQ ID NO: 1621239 - protein, 6 aa, Staphylococcus aureus
TQPKNA

SEQ ID NO: 1621240 - protein, 12 aa, Staphylococcus aureus
TRQNEKDDAIKN

SEQ ID NO: 1621241 - protein, 5 aa, Staphylococcus aureus
TSNER

SEQ ID NO: 1621242 - protein, 12 aa, Staphylococcus aureus
TSPDFNASNVKP

SEQ ID NO: 1621243 - protein, 5 aa, Staphylococcus aureus
TSTSI

SEQ ID NO: 1621244 - protein, 4 aa, Staphylococcus aureus
TTED

SEQ ID NO: 1621245 - protein, 9 aa, Staphylococcus aureus
TTEYDTSSQ

SEQ ID NO: 1621246 - protein, 7 aa, Staphylococcus aureus
TTGEKEK

SEQ ID NO: 1621247 - protein, 10 aa, Staphylococcus aureus
TTSEGIQSES

SEQ ID NO: 1621248 - protein, 6 aa, Staphylococcus aureus
TVGIDP

SEQ ID NO: 1621249 - protein, 19 aa, Staphylococcus aureus
TVSVTRNKNNVRSQKDAQL

SEQ ID NO: 1621250 - protein, 9 aa, Staphylococcus aureus
VDKELNGLK

SEQ ID NO: 1621251 - protein, 5 aa, Staphylococcus aureus
VEGAD

SEQ ID NO: 1621252 - protein, 5 aa, Staphylococcus aureus
VENGN

SEQ ID NO: 1621253 - protein, 5 aa, Staphylococcus aureus
VEVDG

SEQ ID NO: 1621254 - protein, 16 aa, Staphylococcus aureus
VGERLNAEIGSKAYGS

SEQ ID NO: 1621255 - protein, 13 aa, Staphylococcus aureus
VGPQHRSWRKVSL

SEQ ID NO: 1621256 - protein, 6 aa, Staphylococcus aureus
VITPEL

SEQ ID NO: 1621257 - protein, 12 aa, Staphylococcus aureus
VKEESDKAKLTL

SEQ ID NO: 1621258 - protein, 8 aa, Staphylococcus aureus
VKGFPKEQ

SEQ ID NO: 1621259 - protein, 5 aa, Staphylococcus aureus
VKHQT

SEQ ID NO: 1621260 - protein, 8 aa, Staphylococcus aureus
VKKATADA

SEQ ID NO: 1621261 - protein, 9 aa, Staphylococcus aureus
VKKSERKKM

SEQ ID NO: 1621262 - protein, 9 aa, Staphylococcus aureus
VKTDRHTSE

SEQ ID NO: 1621263 - protein, 4 aa, Staphylococcus aureus
VNGK

SEQ ID NO: 1621264 - protein, 12 aa, Staphylococcus aureus
VNTSTKEGYITK

SEQ ID NO: 1621265 - protein, 7 aa, Staphylococcus aureus
VRHGEKK

SEQ ID NO: 1621266 - protein, 22 aa, Staphylococcus aureus
VRLTEGKYDSEEKMSRSAEESI

SEQ ID NO: 1621267 - protein, 11 aa, Staphylococcus aureus
VSNGDTTSSSH

SEQ ID NO: 1621268 - protein, 8 aa, Staphylococcus aureus
VSPYPGSK

SEQ ID NO: 1621269 - protein, 6 aa, Staphylococcus aureus
VTDEQV

SEQ ID NO: 1621270 - protein, 14 aa, Staphylococcus aureus
VTEGQTYASVTSTG

SEQ ID NO: 1621271 - protein, 17 aa, Staphylococcus aureus
VTEQEEYKNKQEEYENN

SEQ ID NO: 1621272 - protein, 13 aa, Staphylococcus aureus
VTFSSKAQKQLKQ

SEQ ID NO: 1621273 - protein, 20 aa, Staphylococcus aureus
VVQSGRNDLTLNGKKVSGAA

SEQ ID NO: 1621274 - protein, 12 aa, Staphylococcus aureus
WATEKYSRQQHA

SEQ ID NO: 1621275 - protein, 11 aa, Staphylococcus aureus
WDGDDEELDKA

SEQ ID NO: 1621276 - protein, 19 aa, Staphylococcus aureus
WKKAQEVGNEIGEKLTSEE

SEQ ID NO: 1621277 - protein, 8 aa, Staphylococcus aureus
YAADPDNF

SEQ ID NO: 1621278 - protein, 9 aa, Staphylococcus aureus
YATPTSELP

SEQ ID NO: 1621279 - protein, 13 aa, Staphylococcus aureus
YDGEELNKSLSDM

SEQ ID NO: 1621280 - protein, 14 aa, Staphylococcus aureus
YEKENSEHFNVEIA

SEQ ID NO: 1621281 - protein, 6 aa, Staphylococcus aureus
YEKREQ

SEQ ID NO: 1621282 - protein, 6 aa, Staphylococcus aureus
YGSSKE

SEQ ID NO: 1621283 - protein, 7 aa, Staphylococcus aureus
YHDKRSA

SEQ ID NO: 1621284 - protein, 12 aa, Staphylococcus aureus
YIESEIRPFNTK

SEQ ID NO: 1621285 - protein, 5 aa, Staphylococcus aureus
YKKNG

SEQ ID NO: 1621286 - protein, 13 aa, Staphylococcus aureus
YNDFDADGNVKEM

SEQ ID NO: 1621287 - protein, 4 aa, Staphylococcus aureus
YNGT

SEQ ID NO: 1621288 - protein, 7 aa, Staphylococcus aureus
YNQGSLD

SEQ ID NO: 1621289 - protein, 8 aa, Staphylococcus aureus
YPKGTDFA

SEQ ID NO: 1621290 - protein, 12 aa, Staphylococcus aureus
YSELKQQDTKHE

SEQ ID NO: 1621291 - protein, 18 aa, Staphylococcus aureus
YSKQNSETARKHSKDMAN

SEQ ID NO: 1621292 - protein, 7 aa, Staphylococcus aureus
YSRETME

SEQ ID NO: 1621293 - protein, 12 aa, Staphylococcus aureus
YTELENEKPIDV

SEQ ID NO: 1621294 - protein, 4 aa, Staphylococcus aureus
YTKT

SEQ ID NO: 1621295 - protein, 5 aa, Staphylococcus aureus
YYPQG

SEQ ID NO: 1621296 - protein, 54 aa, Staphylococcus aureus
AANANVDNAVTEANNHIETANSQNEVDQAKTTGEASIDQVTPTVNKKATARNEI

SEQ ID NO: 1621297 - protein, 4 aa, Staphylococcus aureus
AANT

SEQ ID NO: 1621298 - protein, 10 aa, Staphylococcus aureus
ADYGAGGDRV

SEQ ID NO: 1621299 - protein, 6 aa, Staphylococcus aureus
AETPEV

SEQ ID NO: 1621300 - protein, 10 aa, Staphylococcus aureus
AFTKEEADKL

SEQ ID NO: 1621301 - protein, 5 aa, Staphylococcus aureus
AGGSL

SEQ ID NO: 1621302 - protein, 7 aa, Staphylococcus aureus
AGNAVAE

SEQ ID NO: 1621303 - protein, 6 aa, Staphylococcus aureus
AGNSLN

SEQ ID NO: 1621304 - protein, 4 aa, Staphylococcus aureus
AGRE

SEQ ID NO: 1621305 - protein, 5 aa, Staphylococcus aureus
AGVTD

SEQ ID NO: 1621306 - protein, 8 aa, Staphylococcus aureus
AKAKDGAS

SEQ ID NO: 1621307 - protein, 4 aa, Staphylococcus aureus
AKAL

SEQ ID NO: 1621308 - protein, 38 aa, Staphylococcus aureus
AKDAPEKADIGTLEKPGQDGVDDGSSFDESTYTSSKSG

SEQ ID NO: 1621309 - protein, 10 aa, Staphylococcus aureus
AKDCESRSEN

SEQ ID NO: 1621310 - protein, 8 aa, Staphylococcus aureus
AQAVKTFD

SEQ ID NO: 1621311 - protein, 11 aa, Staphylococcus aureus
AQEQANNYGHS

SEQ ID NO: 1621312 - protein, 5 aa, Staphylococcus aureus
ARNNG

SEQ ID NO: 1621313 - protein, 10 aa, Staphylococcus aureus
ASHKEEKNPY

SEQ ID NO: 1621314 - protein, 5 aa, Staphylococcus aureus
ASKTF

SEQ ID NO: 1621315 - protein, 9 aa, Staphylococcus aureus
ASQNGKNYQ

SEQ ID NO: 1621316 - protein, 7 aa, Staphylococcus aureus
ASTNGRK

SEQ ID NO: 1621317 - protein, 20 aa, Staphylococcus aureus
ATKTKEEKKQYKQLSVEDKR

SEQ ID NO: 1621318 - protein, 9 aa, Staphylococcus aureus
ATNNHTPFE

SEQ ID NO: 1621319 - protein, 20 aa, Staphylococcus aureus
ATVSNESSASSNTVKPVASA

SEQ ID NO: 1621320 - protein, 14 aa, Staphylococcus aureus
ATYGKDPETKGEYW

SEQ ID NO: 1621321 - protein, 6 aa, Staphylococcus aureus
CKTYKD

SEQ ID NO: 1621322 - protein, 22 aa, Staphylococcus aureus
DAADSAPSFGDRKTYQMDPANR

SEQ ID NO: 1621323 - protein, 10 aa, Staphylococcus aureus
DADKPSSPCG

SEQ ID NO: 1621324 - protein, 7 aa, Staphylococcus aureus
DAENQDF

SEQ ID NO: 1621325 - protein, 26 aa, Staphylococcus aureus
DDAEDGNLINTSDEDKTTDEEEKAHS

SEQ ID NO: 1621326 - protein, 5 aa, Staphylococcus aureus
DDETI

SEQ ID NO: 1621327 - protein, 9 aa, Staphylococcus aureus
DDGPKTIEK

SEQ ID NO: 1621328 - protein, 10 aa, Staphylococcus aureus
DDYNVDRGAY

SEQ ID NO: 1621329 - protein, 8 aa, Staphylococcus aureus
DEDNYNRP

SEQ ID NO: 1621330 - protein, 4 aa, Staphylococcus aureus
DENY

SEQ ID NO: 1621331 - protein, 7 aa, Staphylococcus aureus
DEQVGDF

SEQ ID NO: 1621332 - protein, 7 aa, Staphylococcus aureus
DESRNYT

SEQ ID NO: 1621333 - protein, 8 aa, Staphylococcus aureus
DGTQVTRQ

SEQ ID NO: 1621334 - protein, 16 aa, Staphylococcus aureus
DKSSHQEVHENNSAYE

SEQ ID NO: 1621335 - protein, 12 aa, Staphylococcus aureus
DKVTNYKPSPDG

SEQ ID NO: 1621336 - protein, 7 aa, Staphylococcus aureus
DNKPLKK

SEQ ID NO: 1621337 - protein, 16 aa, Staphylococcus aureus
DPKNRIDISSNKKAKP

SEQ ID NO: 1621338 - protein, 4 aa, Staphylococcus aureus
DRNK

SEQ ID NO: 1621339 - protein, 15 aa, Staphylococcus aureus
DRTDLSSDKSVDSEI

SEQ ID NO: 1621340 - protein, 7 aa, Staphylococcus aureus
DSDDKNI

SEQ ID NO: 1621341 - protein, 19 aa, Staphylococcus aureus
DSIKRKDNKITKDDSNVER

SEQ ID NO: 1621342 - protein, 13 aa, Staphylococcus aureus
DTENEWETGAGTR

SEQ ID NO: 1621343 - protein, 5 aa, Staphylococcus aureus
DTIAE

SEQ ID NO: 1621344 - protein, 9 aa, Staphylococcus aureus
DVKNTYGTG

SEQ ID NO: 1621345 - protein, 35 aa, Staphylococcus aureus
DYESYKKSLDKNKSTLKQHSKSSTTVRKKNGLSYK

SEQ ID NO: 1621346 - protein, 5 aa, Staphylococcus aureus
EATRI

SEQ ID NO: 1621347 - protein, 24 aa, Staphylococcus aureus
EDQKKKSDKYAKEQEETARRNREN

SEQ ID NO: 1621348 - protein, 15 aa, Staphylococcus aureus
EDSDGMTHNHTKRYP

SEQ ID NO: 1621349 - protein, 6 aa, Staphylococcus aureus
EDYERV

SEQ ID NO: 1621350 - protein, 26 aa, Staphylococcus aureus
EEATFGGGKSIRDGMAQNPRVTRDDV

SEQ ID NO: 1621351 - protein, 8 aa, Staphylococcus aureus
EEETDGNN

SEQ ID NO: 1621352 - protein, 8 aa, Staphylococcus aureus
EEFEEKKK

SEQ ID NO: 1621353 - protein, 4 aa, Staphylococcus aureus
EENI

SEQ ID NO: 1621354 - protein, 14 aa, Staphylococcus aureus
EGLNSEDKDENGKI

SEQ ID NO: 1621355 - protein, 18 aa, Staphylococcus aureus
EGMSKRSASYFGSDESSF

SEQ ID NO: 1621356 - protein, 5 aa, Staphylococcus aureus
EGQDI

SEQ ID NO: 1621357 - protein, 4 aa, Staphylococcus aureus
EHAG

SEQ ID NO: 1621358 - protein, 10 aa, Staphylococcus aureus
EIEAEGDIET

SEQ ID NO: 1621359 - protein, 13 aa, Staphylococcus aureus
EKDEYSGEDKSED

SEQ ID NO: 1621360 - protein, 4 aa, Staphylococcus aureus
EKIE

SEQ ID NO: 1621361 - protein, 6 aa, Staphylococcus aureus
EKLTKI

SEQ ID NO: 1621362 - protein, 11 aa, Staphylococcus aureus
ELKNGKIKDDD

SEQ ID NO: 1621363 - protein, 10 aa, Staphylococcus aureus
EMEPDEGSYK

SEQ ID NO: 1621364 - protein, 16 aa, Staphylococcus aureus
ENAESINSTYEHQTTY

SEQ ID NO: 1621365 - protein, 20 aa, Staphylococcus aureus
ENEGRDAANAAQEKAEKEGK

SEQ ID NO: 1621366 - protein, 16 aa, Staphylococcus aureus
ENKDFSDRANEELKKY

SEQ ID NO: 1621367 - protein, 8 aa, Staphylococcus aureus
ENKQDVFK

SEQ ID NO: 1621368 - protein, 5 aa, Staphylococcus aureus
ENVDG

SEQ ID NO: 1621369 - protein, 14 aa, Staphylococcus aureus
ENYKEDEVSYNPEV

SEQ ID NO: 1621370 - protein, 6 aa, Staphylococcus aureus
EPFSNE

SEQ ID NO: 1621371 - protein, 13 aa, Staphylococcus aureus
EQGEDISTKKMSD

SEQ ID NO: 1621372 - protein, 14 aa, Staphylococcus aureus
EQIDNASWTITIQK

SEQ ID NO: 1621373 - protein, 4 aa, Staphylococcus aureus
EQKH

SEQ ID NO: 1621374 - protein, 7 aa, Staphylococcus aureus
EQNNNGL

SEQ ID NO: 1621375 - protein, 4 aa, Staphylococcus aureus
ERNY

SEQ ID NO: 1621376 - protein, 6 aa, Staphylococcus aureus
ESHGQF

SEQ ID NO: 1621377 - protein, 12 aa, Staphylococcus aureus
ESSSNDKFKEGD

SEQ ID NO: 1621378 - protein, 9 aa, Staphylococcus aureus
ETEENTVLK

SEQ ID NO: 1621379 - protein, 6 aa, Staphylococcus aureus
ETEKYP

SEQ ID NO: 1621380 - protein, 24 aa, Staphylococcus aureus
FAKGQKGSSAMPHKRNPIGSENIT

SEQ ID NO: 1621381 - protein, 6 aa, Staphylococcus aureus
FANKDK

SEQ ID NO: 1621382 - protein, 9 aa, Staphylococcus aureus
FDQDNDGKW

SEQ ID NO: 1621383 - protein, 4 aa, Staphylococcus aureus
FEKD

SEQ ID NO: 1621384 - protein, 4 aa, Staphylococcus aureus
FGPM

SEQ ID NO: 1621385 - protein, 4 aa, Staphylococcus aureus
FHDT

SEQ ID NO: 1621386 - protein, 12 aa, Staphylococcus aureus
FKKPTTNYNGSL

SEQ ID NO: 1621387 - protein, 6 aa, Staphylococcus aureus
FNAGAT

SEQ ID NO: 1621388 - protein, 11 aa, Staphylococcus aureus
FSTKGEGRGLG

SEQ ID NO: 1621389 - protein, 6 aa, Staphylococcus aureus
GADRPL

SEQ ID NO: 1621390 - protein, 10 aa, Staphylococcus aureus
GASGKSNYNG

SEQ ID NO: 1621391 - protein, 8 aa, Staphylococcus aureus
GATGGVGS

SEQ ID NO: 1621392 - protein, 4 aa, Staphylococcus aureus
GDNA

SEQ ID NO: 1621393 - protein, 13 aa, Staphylococcus aureus
GEKYPEAKDEKSQ

SEQ ID NO: 1621394 - protein, 8 aa, Staphylococcus aureus
GENLESRG

SEQ ID NO: 1621395 - protein, 15 aa, Staphylococcus aureus
GGLRNSLDVDDNNVP

SEQ ID NO: 1621396 - protein, 9 aa, Staphylococcus aureus
GINEPEPEL

SEQ ID NO: 1621397 - protein, 7 aa, Staphylococcus aureus
GKLARGI

SEQ ID NO: 1621398 - protein, 4 aa, Staphylococcus aureus
GKTY

SEQ ID NO: 1621399 - protein, 22 aa, Staphylococcus aureus
GLDGSTKSFNPVPLNEKNEENY

SEQ ID NO: 1621400 - protein, 8 aa, Staphylococcus aureus
GNAPAKLT

SEQ ID NO: 1621401 - protein, 6 aa, Staphylococcus aureus
GNIEKD

SEQ ID NO: 1621402 - protein, 22 aa, Staphylococcus aureus
GQHTDDYDATETIDASGKVVSP

SEQ ID NO: 1621403 - protein, 7 aa, Staphylococcus aureus
GQPKPIF

SEQ ID NO: 1621404 - protein, 8 aa, Staphylococcus aureus
GQVDASDI

SEQ ID NO: 1621405 - protein, 10 aa, Staphylococcus aureus
GRPETQRKTV

SEQ ID NO: 1621406 - protein, 6 aa, Staphylococcus aureus
GTEKGF

SEQ ID NO: 1621407 - protein, 10 aa, Staphylococcus aureus
GTGIDEESAI

SEQ ID NO: 1621408 - protein, 6 aa, Staphylococcus aureus
GTYDQV

SEQ ID NO: 1621409 - protein, 22 aa, Staphylococcus aureus
GVKTKTGEAFSKMGRNANHFGG

SEQ ID NO: 1621410 - protein, 8 aa, Staphylococcus aureus
GYAYESGG

SEQ ID NO: 1621411 - protein, 28 aa, Staphylococcus aureus
HAETENDYQNAQQYSEQKPSVDSTQTEI

SEQ ID NO: 1621412 - protein, 5 aa, Staphylococcus aureus
HEKGH

SEQ ID NO: 1621413 - protein, 4 aa, Staphylococcus aureus
HNPQ

SEQ ID NO: 1621414 - protein, 8 aa, Staphylococcus aureus
HPGQSGFS

SEQ ID NO: 1621415 - protein, 26 aa, Staphylococcus aureus
HQTPKQYRGDRPAITENQQSAQHDYH

SEQ ID NO: 1621416 - protein, 5 aa, Staphylococcus aureus
HSTDE

SEQ ID NO: 1621417 - protein, 10 aa, Staphylococcus aureus
HTDENGNATH

SEQ ID NO: 1621418 - protein, 8 aa, Staphylococcus aureus
IADTPGFS

SEQ ID NO: 1621419 - protein, 9 aa, Staphylococcus aureus
IDQGVKGSD

SEQ ID NO: 1621420 - protein, 9 aa, Staphylococcus aureus
IGHSNGKQL

SEQ ID NO: 1621421 - protein, 15 aa, Staphylococcus aureus
IKDVEEALQGTKMTR

SEQ ID NO: 1621422 - protein, 11 aa, Staphylococcus aureus
IKNGSKTSRIT

SEQ ID NO: 1621423 - protein, 7 aa, Staphylococcus aureus
INEDTQN

SEQ ID NO: 1621424 - protein, 4 aa, Staphylococcus aureus
INER

SEQ ID NO: 1621425 - protein, 18 aa, Staphylococcus aureus
INGRQIDAPSSKPSADKI

SEQ ID NO: 1621426 - protein, 6 aa, Staphylococcus aureus
INTTTA

SEQ ID NO: 1621427 - protein, 5 aa, Staphylococcus aureus
IPDSE

SEQ ID NO: 1621428 - protein, 5 aa, Staphylococcus aureus
IPNSE

SEQ ID NO: 1621429 - protein, 14 aa, Staphylococcus aureus
IQELEQERNALESK

SEQ ID NO: 1621430 - protein, 14 aa, Staphylococcus aureus
IQNHESKMNEDSKA

SEQ ID NO: 1621431 - protein, 9 aa, Staphylococcus aureus
IRGSYDSPE

SEQ ID NO: 1621432 - protein, 21 aa, Staphylococcus aureus
ISESIKSAKEKKYSKSNPYQA

SEQ ID NO: 1621433 - protein, 9 aa, Staphylococcus aureus
ISESTLNTI

SEQ ID NO: 1621434 - protein, 8 aa, Staphylococcus aureus
ISKPTYAR

SEQ ID NO: 1621435 - protein, 4 aa, Staphylococcus aureus
ISTI

SEQ ID NO: 1621436 - protein, 10 aa, Staphylococcus aureus
ITLSDGKVKP

SEQ ID NO: 1621437 - protein, 5 aa, Staphylococcus aureus
ITRTG

SEQ ID NO: 1621438 - protein, 16 aa, Staphylococcus aureus
KAIQELKQERNALESK

SEQ ID NO: 1621439 - protein, 16 aa, Staphylococcus aureus
KANNNSNDSAGDERIT

SEQ ID NO: 1621440 - protein, 29 aa, Staphylococcus aureus
KAQGVSVAPVQKSSKKPARGIQKSKNAFS

SEQ ID NO: 1621441 - protein, 11 aa, Staphylococcus aureus
KASTETDYFEP

SEQ ID NO: 1621442 - protein, 11 aa, Staphylococcus aureus
KDENGEEYPEW

SEQ ID NO: 1621443 - protein, 10 aa, Staphylococcus aureus
KEDGTHRRFP

SEQ ID NO: 1621444 - protein, 8 aa, Staphylococcus aureus
KEDSNEII

SEQ ID NO: 1621445 - protein, 10 aa, Staphylococcus aureus
KEGEFSRQNV

SEQ ID NO: 1621446 - protein, 8 aa, Staphylococcus aureus
KELQKRNE

SEQ ID NO: 1621447 - protein, 8 aa, Staphylococcus aureus
KELSKKGY

SEQ ID NO: 1621448 - protein, 5 aa, Staphylococcus aureus
KENIK

SEQ ID NO: 1621449 - protein, 5 aa, Staphylococcus aureus
KGIKG

SEQ ID NO: 1621450 - protein, 10 aa, Staphylococcus aureus
KGWTSPAKAI

SEQ ID NO: 1621451 - protein, 5 aa, Staphylococcus aureus
KIEYK

SEQ ID NO: 1621452 - protein, 5 aa, Staphylococcus aureus
KITNH

SEQ ID NO: 1621453 - protein, 7 aa, Staphylococcus aureus
KKGLEND

SEQ ID NO: 1621454 - protein, 5 aa, Staphylococcus aureus
KKGYK

SEQ ID NO: 1621455 - protein, 5 aa, Staphylococcus aureus
KKKIN

SEQ ID NO: 1621456 - protein, 25 aa, Staphylococcus aureus
KKYKAEDQLRAGKTQYVETGKDTAT

SEQ ID NO: 1621457 - protein, 4 aa, Staphylococcus aureus
KLAS

SEQ ID NO: 1621458 - protein, 8 aa, Staphylococcus aureus
KLDEETAE

SEQ ID NO: 1621459 - protein, 15 aa, Staphylococcus aureus
KLERQRKKEAELRRK

SEQ ID NO: 1621460 - protein, 16 aa, Staphylococcus aureus
KLSEKDRLKTYKKTES

SEQ ID NO: 1621461 - protein, 6 aa, Staphylococcus aureus
KLTDHG

SEQ ID NO: 1621462 - protein, 5 aa, Staphylococcus aureus
KNTIN

SEQ ID NO: 1621463 - protein, 11 aa, Staphylococcus aureus
KNWTKTKNVDT

SEQ ID NO: 1621464 - protein, 18 aa, Staphylococcus aureus
KNYNNGDVSINENVPSYD

SEQ ID NO: 1621465 - protein, 5 aa, Staphylococcus aureus
KQHYT

SEQ ID NO: 1621466 - protein, 9 aa, Staphylococcus aureus
KQISKTSEI

SEQ ID NO: 1621467 - protein, 7 aa, Staphylococcus aureus
KRAENGV

SEQ ID NO: 1621468 - protein, 7 aa, Staphylococcus aureus
KRHPQYS

SEQ ID NO: 1621469 - protein, 6 aa, Staphylococcus aureus
KRLGPY

SEQ ID NO: 1621470 - protein, 8 aa, Staphylococcus aureus
KRTTTYDV

SEQ ID NO: 1621471 - protein, 14 aa, Staphylococcus aureus
KSGTGKTTLATREN

SEQ ID NO: 1621472 - protein, 8 aa, Staphylococcus aureus
KSKGIKGI

SEQ ID NO: 1621473 - protein, 6 aa, Staphylococcus aureus
KSKYAK

SEQ ID NO: 1621474 - protein, 6 aa, Staphylococcus aureus
KSLKDW

SEQ ID NO: 1621475 - protein, 7 aa, Staphylococcus aureus
KSLKGWT

SEQ ID NO: 1621476 - protein, 10 aa, Staphylococcus aureus
KSPKISDQNK

SEQ ID NO: 1621477 - protein, 6 aa, Staphylococcus aureus
KSYTSE

SEQ ID NO: 1621478 - protein, 7 aa, Staphylococcus aureus
KTEVESK

SEQ ID NO: 1621479 - protein, 7 aa, Staphylococcus aureus
KTGTYRE

SEQ ID NO: 1621480 - protein, 11 aa, Staphylococcus aureus
KTKSGKVRPWR

SEQ ID NO: 1621481 - protein, 7 aa, Staphylococcus aureus
KYDKKDR

SEQ ID NO: 1621482 - protein, 6 aa, Staphylococcus aureus
KYKKYK

SEQ ID NO: 1621483 - protein, 7 aa, Staphylococcus aureus
KYLSEQN

SEQ ID NO: 1621484 - protein, 9 aa, Staphylococcus aureus
KYSKEQLRT

SEQ ID NO: 1621485 - protein, 4 aa, Staphylococcus aureus
LDKL

SEQ ID NO: 1621486 - protein, 6 aa, Staphylococcus aureus
LEEAHK

SEQ ID NO: 1621487 - protein, 10 aa, Staphylococcus aureus
LELENEQLKR

SEQ ID NO: 1621488 - protein, 12 aa, Staphylococcus aureus
LGDSQQDIASLG

SEQ ID NO: 1621489 - protein, 7 aa, Staphylococcus aureus
LGEDGEY

SEQ ID NO: 1621490 - protein, 10 aa, Staphylococcus aureus
LGSSNSYSKY

SEQ ID NO: 1621491 - protein, 9 aa, Staphylococcus aureus
LKEDAPENV

SEQ ID NO: 1621492 - protein, 4 aa, Staphylococcus aureus
LNDW

SEQ ID NO: 1621493 - protein, 12 aa, Staphylococcus aureus
LNEKNWTNAFLI

SEQ ID NO: 1621494 - protein, 21 aa, Staphylococcus aureus
LNGAKKGVGGYKYGAKDIPPD

SEQ ID NO: 1621495 - protein, 7 aa, Staphylococcus aureus
LNPAKNQ

SEQ ID NO: 1621496 - protein, 12 aa, Staphylococcus aureus
LNPKARQKWILK

SEQ ID NO: 1621497 - protein, 10 aa, Staphylococcus aureus
LNSTDDASLL

SEQ ID NO: 1621498 - protein, 6 aa, Staphylococcus aureus
LSAKAK

SEQ ID NO: 1621499 - protein, 11 aa, Staphylococcus aureus
MKTEKKPTKNV

SEQ ID NO: 1621500 - protein, 12 aa, Staphylococcus aureus
MNDGQKSINSGV

SEQ ID NO: 1621501 - protein, 6 aa, Staphylococcus aureus
MPSGTN

SEQ ID NO: 1621502 - protein, 9 aa, Staphylococcus aureus
MQEGQEAKY

SEQ ID NO: 1621503 - protein, 5 aa, Staphylococcus aureus
MQQDL

SEQ ID NO: 1621504 - protein, 9 aa, Staphylococcus aureus
MSNNENYHA

SEQ ID NO: 1621505 - protein, 11 aa, Staphylococcus aureus
NAVKEGKAKIN

SEQ ID NO: 1621506 - protein, 4 aa, Staphylococcus aureus
NDLK

SEQ ID NO: 1621507 - protein, 15 aa, Staphylococcus aureus
NGGTHDNPDGTIAPK

SEQ ID NO: 1621508 - protein, 8 aa, Staphylococcus aureus
NGKPRNEI

SEQ ID NO: 1621509 - protein, 16 aa, Staphylococcus aureus
NGVQDNSIGSTKESQF

SEQ ID NO: 1621510 - protein, 4 aa, Staphylococcus aureus
NHTW

SEQ ID NO: 1621511 - protein, 11 aa, Staphylococcus aureus
NIASPSTTDLI

SEQ ID NO: 1621512 - protein, 9 aa, Staphylococcus aureus
NKDNDFTVN

SEQ ID NO: 1621513 - protein, 8 aa, Staphylococcus aureus
NKDTGISY

SEQ ID NO: 1621514 - protein, 8 aa, Staphylococcus aureus
NKKENQWN

SEQ ID NO: 1621515 - protein, 9 aa, Staphylococcus aureus
NKPSLTERM

SEQ ID NO: 1621516 - protein, 10 aa, Staphylococcus aureus
NNKLRDLGTK

SEQ ID NO: 1621517 - protein, 9 aa, Staphylococcus aureus
NNPGIKNAS

SEQ ID NO: 1621518 - protein, 14 aa, Staphylococcus aureus
NNQNQQTKHQLKDV

SEQ ID NO: 1621519 - protein, 7 aa, Staphylococcus aureus
NNTTITY

SEQ ID NO: 1621520 - protein, 14 aa, Staphylococcus aureus
NPDTYADDNEISRE

SEQ ID NO: 1621521 - protein, 5 aa, Staphylococcus aureus
NPENI

SEQ ID NO: 1621522 - protein, 8 aa, Staphylococcus aureus
NQKPSYKT

SEQ ID NO: 1621523 - protein, 4 aa, Staphylococcus aureus
NQLN

SEQ ID NO: 1621524 - protein, 7 aa, Staphylococcus aureus
NRPMTRN

SEQ ID NO: 1621525 - protein, 27 aa, Staphylococcus aureus
NRSLNTNNLTGKVNVNSKELKNYSVEK

SEQ ID NO: 1621526 - protein, 10 aa, Staphylococcus aureus
NSGNIPKSIS

SEQ ID NO: 1621527 - protein, 11 aa, Staphylococcus aureus
NSGQITEDKAK

SEQ ID NO: 1621528 - protein, 6 aa, Staphylococcus aureus
NTGYKG

SEQ ID NO: 1621529 - protein, 12 aa, Staphylococcus aureus
NYPRGVSTNGTV

SEQ ID NO: 1621530 - protein, 4 aa, Staphylococcus aureus
PDLA

SEQ ID NO: 1621531 - protein, 9 aa, Staphylococcus aureus
PDVRDGLKP

SEQ ID NO: 1621532 - protein, 14 aa, Staphylococcus aureus
PGSISQSRSSMEES

SEQ ID NO: 1621533 - protein, 5 aa, Staphylococcus aureus
PKGAV

SEQ ID NO: 1621534 - protein, 12 aa, Staphylococcus aureus
PLASTSRALEPS

SEQ ID NO: 1621535 - protein, 9 aa, Staphylococcus aureus
PLTPKTKGL

SEQ ID NO: 1621536 - protein, 12 aa, Staphylococcus aureus
PMGSPRPRFRNT

SEQ ID NO: 1621537 - protein, 11 aa, Staphylococcus aureus
PNINGSNTCDE

SEQ ID NO: 1621538 - protein, 6 aa, Staphylococcus aureus
PPLSYS

SEQ ID NO: 1621539 - protein, 8 aa, Staphylococcus aureus
PRGGSDIT

SEQ ID NO: 1621540 - protein, 7 aa, Staphylococcus aureus
PTEMPFS

SEQ ID NO: 1621541 - protein, 7 aa, Staphylococcus aureus
PTNQTSL

SEQ ID NO: 1621542 - protein, 12 aa, Staphylococcus aureus
PTSFKSKDIRPF

SEQ ID NO: 1621543 - protein, 18 aa, Staphylococcus aureus
QAPANYYPEDEYGGYIEP

SEQ ID NO: 1621544 - protein, 9 aa, Staphylococcus aureus
QAPKSKKIT

SEQ ID NO: 1621545 - protein, 34 aa, Staphylococcus aureus
QDGTATYVHQSEDDIVTSSVKSNHPVAQKSNKTI

SEQ ID NO: 1621546 - protein, 8 aa, Staphylococcus aureus
QDSGEIKL

SEQ ID NO: 1621547 - protein, 14 aa, Staphylococcus aureus
QEEFDKKKQQLLDI

SEQ ID NO: 1621548 - protein, 12 aa, Staphylococcus aureus
QFSNSTKSDLEN

SEQ ID NO: 1621549 - protein, 17 aa, Staphylococcus aureus
QGGGQEYGVRSGTVNLP

SEQ ID NO: 1621550 - protein, 11 aa, Staphylococcus aureus
QIETTSSTLEK

SEQ ID NO: 1621551 - protein, 4 aa, Staphylococcus aureus
QIGR

SEQ ID NO: 1621552 - protein, 12 aa, Staphylococcus aureus
QIKESEQRQRKE

SEQ ID NO: 1621553 - protein, 9 aa, Staphylococcus aureus
QIPEEEHKD

SEQ ID NO: 1621554 - protein, 4 aa, Staphylococcus aureus
QLEN

SEQ ID NO: 1621555 - protein, 13 aa, Staphylococcus aureus
QNNNIKNKNFSNP

SEQ ID NO: 1621556 - protein, 10 aa, Staphylococcus aureus
QRAENNQKIY

SEQ ID NO: 1621557 - protein, 10 aa, Staphylococcus aureus
QSFGNRNTQN

SEQ ID NO: 1621558 - protein, 29 aa, Staphylococcus aureus
QTNLGSSDLGISGVNSGVASKNINFSNPS

SEQ ID NO: 1621559 - protein, 6 aa, Staphylococcus aureus
QTTEVS

SEQ ID NO: 1621560 - protein, 7 aa, Staphylococcus aureus
QVPGTDA

SEQ ID NO: 1621561 - protein, 9 aa, Staphylococcus aureus
QYQDDDKDV

SEQ ID NO: 1621562 - protein, 14 aa, Staphylococcus aureus
RAESPNTNDNSVTI

SEQ ID NO: 1621563 - protein, 6 aa, Staphylococcus aureus
REYPGL

SEQ ID NO: 1621564 - protein, 5 aa, Staphylococcus aureus
RKRVK

SEQ ID NO: 1621565 - protein, 9 aa, Staphylococcus aureus
RNTRTAKGN

SEQ ID NO: 1621566 - protein, 6 aa, Staphylococcus aureus
RQQEIN

SEQ ID NO: 1621567 - protein, 7 aa, Staphylococcus aureus
RRECENC

SEQ ID NO: 1621568 - protein, 4 aa, Staphylococcus aureus
RSEA

SEQ ID NO: 1621569 - protein, 10 aa, Staphylococcus aureus
RSNKGETETV

SEQ ID NO: 1621570 - protein, 4 aa, Staphylococcus aureus
RTFS

SEQ ID NO: 1621571 - protein, 11 aa, Staphylococcus aureus
RTGSEGAPEIK

SEQ ID NO: 1621572 - protein, 4 aa, Staphylococcus aureus
SAGS

SEQ ID NO: 1621573 - protein, 13 aa, Staphylococcus aureus
SDETSNVPSVESH

SEQ ID NO: 1621574 - protein, 5 aa, Staphylococcus aureus
SDNDM

SEQ ID NO: 1621575 - protein, 6 aa, Staphylococcus aureus
SELTKV

SEQ ID NO: 1621576 - protein, 14 aa, Staphylococcus aureus
SGYGTSNFASGRYG

SEQ ID NO: 1621577 - protein, 14 aa, Staphylococcus aureus
SIGLTGKEAEETLD

SEQ ID NO: 1621578 - protein, 10 aa, Staphylococcus aureus
SKLETGKNAL

SEQ ID NO: 1621579 - protein, 10 aa, Staphylococcus aureus
SKRDSAKAKM

SEQ ID NO: 1621580 - protein, 16 aa, Staphylococcus aureus
SLNDPQKTALKDQVTA

SEQ ID NO: 1621581 - protein, 4 aa, Staphylococcus aureus
SMEP

SEQ ID NO: 1621582 - protein, 5 aa, Staphylococcus aureus
SNVSY

SEQ ID NO: 1621583 - protein, 10 aa, Staphylococcus aureus
SPAKAKTIEK

SEQ ID NO: 1621584 - protein, 9 aa, Staphylococcus aureus
SPKYDKKLP

SEQ ID NO: 1621585 - protein, 11 aa, Staphylococcus aureus
SPLPSHQSNEW

SEQ ID NO: 1621586 - protein, 7 aa, Staphylococcus aureus
SQDPTTV

SEQ ID NO: 1621587 - protein, 18 aa, Staphylococcus aureus
SQMTQNSDFNEEKKVSTR

SEQ ID NO: 1621588 - protein, 7 aa, Staphylococcus aureus
SQSSIRN

SEQ ID NO: 1621589 - protein, 6 aa, Staphylococcus aureus
SRAARL

SEQ ID NO: 1621590 - protein, 17 aa, Staphylococcus aureus
SRTNGLKLTPRENGFES

SEQ ID NO: 1621591 - protein, 12 aa, Staphylococcus aureus
SRYTANNDVDTI

SEQ ID NO: 1621592 - protein, 5 aa, Staphylococcus aureus
SSLER

SEQ ID NO: 1621593 - protein, 12 aa, Staphylococcus aureus
STDNASWRGPNI

SEQ ID NO: 1621594 - protein, 14 aa, Staphylococcus aureus
SVNQQGNDIGEKYR

SEQ ID NO: 1621595 - protein, 14 aa, Staphylococcus aureus
SVNQQGNDIGQKYR

SEQ ID NO: 1621596 - protein, 7 aa, Staphylococcus aureus
TAGSPID

SEQ ID NO: 1621597 - protein, 13 aa, Staphylococcus aureus
TATQTSATQAVTA

SEQ ID NO: 1621598 - protein, 4 aa, Staphylococcus aureus
TDKA

SEQ ID NO: 1621599 - protein, 5 aa, Staphylococcus aureus
TEEQA

SEQ ID NO: 1621600 - protein, 15 aa, Staphylococcus aureus
TEGSALDKEAYDRAT

SEQ ID NO: 1621601 - protein, 5 aa, Staphylococcus aureus
TGDGP

SEQ ID NO: 1621602 - protein, 9 aa, Staphylococcus aureus
TGPSKGGHV

SEQ ID NO: 1621603 - protein, 6 aa, Staphylococcus aureus
TGRSDE

SEQ ID NO: 1621604 - protein, 9 aa, Staphylococcus aureus
TGTNLQDEA

SEQ ID NO: 1621605 - protein, 7 aa, Staphylococcus aureus
TIPEDRE

SEQ ID NO: 1621606 - protein, 14 aa, Staphylococcus aureus
TKDPELRSAPNGVN

SEQ ID NO: 1621607 - protein, 13 aa, Staphylococcus aureus
TKLNNTFSDTTTY

SEQ ID NO: 1621608 - protein, 5 aa, Staphylococcus aureus
TQEIT

SEQ ID NO: 1621609 - protein, 6 aa, Staphylococcus aureus
TQTDEY

SEQ ID NO: 1621610 - protein, 6 aa, Staphylococcus aureus
TSNTIN

SEQ ID NO: 1621611 - protein, 6 aa, Staphylococcus aureus
TVRNYT

SEQ ID NO: 1621612 - protein, 5 aa, Staphylococcus aureus
TYGQR

SEQ ID NO: 1621613 - protein, 7 aa, Staphylococcus aureus
TYKPTGQ

SEQ ID NO: 1621614 - protein, 7 aa, Staphylococcus aureus
VAGAEEI

SEQ ID NO: 1621615 - protein, 9 aa, Staphylococcus aureus
VAKESGLDV

SEQ ID NO: 1621616 - protein, 8 aa, Staphylococcus aureus
VANKTTSM

SEQ ID NO: 1621617 - protein, 10 aa, Staphylococcus aureus
VATAEATKDL

SEQ ID NO: 1621618 - protein, 33 aa, Staphylococcus aureus
VDEHTQKSTKKASATVEQTSTAKQNQPRNNGRF

SEQ ID NO: 1621619 - protein, 17 aa, Staphylococcus aureus
VDEKQTKAEIINTFESL

SEQ ID NO: 1621620 - protein, 7 aa, Staphylococcus aureus
VDRNDIE

SEQ ID NO: 1621621 - protein, 15 aa, Staphylococcus aureus
VEETSNNALNQAKQY

SEQ ID NO: 1621622 - protein, 13 aa, Staphylococcus aureus
VETQRSKDNVEEV

SEQ ID NO: 1621623 - protein, 19 aa, Staphylococcus aureus
VGVSSEEIKEAIESSFKDT

SEQ ID NO: 1621624 - protein, 6 aa, Staphylococcus aureus
VIEQGP

SEQ ID NO: 1621625 - protein, 14 aa, Staphylococcus aureus
VKEDEAAKHPKLGA

SEQ ID NO: 1621626 - protein, 6 aa, Staphylococcus aureus
VKESDG

SEQ ID NO: 1621627 - protein, 9 aa, Staphylococcus aureus
VNVGNKKDY

SEQ ID NO: 1621628 - protein, 7 aa, Staphylococcus aureus
VSTRPGH

SEQ ID NO: 1621629 - protein, 4 aa, Staphylococcus aureus
VTNS

SEQ ID NO: 1621630 - protein, 13 aa, Staphylococcus aureus
VYWSPSSESSLAE

SEQ ID NO: 1621631 - protein, 23 aa, Staphylococcus aureus
WDGGDEGLDKAVKDVSNDNPNHT

SEQ ID NO: 1621632 - protein, 4 aa, Staphylococcus aureus
YDDL

SEQ ID NO: 1621633 - protein, 10 aa, Staphylococcus aureus
YDIPTKKAPK

SEQ ID NO: 1621634 - protein, 10 aa, Staphylococcus aureus
YDIPTNKAPK

SEQ ID NO: 1621635 - protein, 8 aa, Staphylococcus aureus
YEHEETIN

SEQ ID NO: 1621636 - protein, 8 aa, Staphylococcus aureus
YELSQEEL

SEQ ID NO: 1621637 - protein, 12 aa, Staphylococcus aureus
YGGGSSGKSHGV

SEQ ID NO: 1621638 - protein, 9 aa, Staphylococcus aureus
YKPTERQLK

SEQ ID NO: 1621639 - protein, 16 aa, Staphylococcus aureus
YKTPGLSKAASDIITQ

SEQ ID NO: 1621640 - protein, 11 aa, Staphylococcus aureus
YQPIGSSQPSL

SEQ ID NO: 1621641 - protein, 10 aa, Staphylococcus aureus
YQSKPRKEVK

SEQ ID NO: 1621642 - protein, 21 aa, Staphylococcus aureus
YRRPASDRKISIRGARSNNLK

SEQ ID NO: 1621643 - protein, 12 aa, Staphylococcus aureus
YTENTPKSYDPM

SEQ ID NO: 1621644 - protein, 6 aa, Staphylococcus aureus
YTSYTQ

SEQ ID NO: 1621645 - protein, 5 aa, Staphylococcus aureus
YVQKS

SEQ ID NO: 1621646 - protein, 12 aa, Staphylococcus aureus
AAGQGDDTDKHA

SEQ ID NO: 1621647 - protein, 8 aa, Staphylococcus aureus
AASGPASD

SEQ ID NO: 1621648 - protein, 5 aa, Staphylococcus aureus
ADVPV

SEQ ID NO: 1621649 - protein, 7 aa, Staphylococcus aureus
AEPPVHD

SEQ ID NO: 1621650 - protein, 17 aa, Staphylococcus aureus
AESKEEAERKYEAQVKR

SEQ ID NO: 1621651 - protein, 7 aa, Staphylococcus aureus
AGAGFPS

SEQ ID NO: 1621652 - protein, 9 aa, Staphylococcus aureus
AGYGSESNY

SEQ ID NO: 1621653 - protein, 7 aa, Staphylococcus aureus
AHPEFGD

SEQ ID NO: 1621654 - protein, 5 aa, Staphylococcus aureus
AKELK

SEQ ID NO: 1621655 - protein, 8 aa, Staphylococcus aureus
AKETSIAN

SEQ ID NO: 1621656 - protein, 5 aa, Staphylococcus aureus
AKSGV

SEQ ID NO: 1621657 - protein, 12 aa, Staphylococcus aureus
AKYIGTEKPMLK

SEQ ID NO: 1621658 - protein, 7 aa, Staphylococcus aureus
ANIGLEP

SEQ ID NO: 1621659 - protein, 20 aa, Staphylococcus aureus
APANYYPEDEYGGYDEYGGY

SEQ ID NO: 1621660 - protein, 11 aa, Staphylococcus aureus
AQDKQTAGNSL

SEQ ID NO: 1621661 - protein, 5 aa, Staphylococcus aureus
AQKHM

SEQ ID NO: 1621662 - protein, 11 aa, Staphylococcus aureus
AQPGEESSNVW

SEQ ID NO: 1621663 - protein, 4 aa, Staphylococcus aureus
AREN

SEQ ID NO: 1621664 - protein, 10 aa, Staphylococcus aureus
ARIQDYGETS

SEQ ID NO: 1621665 - protein, 10 aa, Staphylococcus aureus
ARSAGQEVEF

SEQ ID NO: 1621666 - protein, 21 aa, Staphylococcus aureus
ARTKDIEIPRDKIAKARHAVM

SEQ ID NO: 1621667 - protein, 8 aa, Staphylococcus aureus
ASFAGHNK

SEQ ID NO: 1621668 - protein, 14 aa, Staphylococcus aureus
ASKFEGLGKGDTRL

SEQ ID NO: 1621669 - protein, 25 aa, Staphylococcus aureus
ASNVSDVGKAFPGQPSIAHDSNIEG

SEQ ID NO: 1621670 - protein, 7 aa, Staphylococcus aureus
ASPEFED

SEQ ID NO: 1621671 - protein, 6 aa, Staphylococcus aureus
ASPENN

SEQ ID NO: 1621672 - protein, 4 aa, Staphylococcus aureus
ASQG

SEQ ID NO: 1621673 - protein, 8 aa, Staphylococcus aureus
ASSKYQGK

SEQ ID NO: 1621674 - protein, 4 aa, Staphylococcus aureus
ATGT

SEQ ID NO: 1621675 - protein, 19 aa, Staphylococcus aureus
ATKARNKQLTAEDMQGGTF

SEQ ID NO: 1621676 - protein, 13 aa, Staphylococcus aureus
AVESRGKVTLNEK

SEQ ID NO: 1621677 - protein, 5 aa, Staphylococcus aureus
AYNNV

SEQ ID NO: 1621678 - protein, 19 aa, Staphylococcus aureus
AYTNEEDGAAKYLAKHFLA

SEQ ID NO: 1621679 - protein, 21 aa, Staphylococcus aureus
DAADSAPSFGDRKTYQMDPAN

SEQ ID NO: 1621680 - protein, 5 aa, Staphylococcus aureus
DAKTK

SEQ ID NO: 1621681 - protein, 7 aa, Staphylococcus aureus
DATGHTV

SEQ ID NO: 1621682 - protein, 4 aa, Staphylococcus aureus
DATI

SEQ ID NO: 1621683 - protein, 7 aa, Staphylococcus aureus
DDENLDR

SEQ ID NO: 1621684 - protein, 6 aa, Staphylococcus aureus
DDLSYN

SEQ ID NO: 1621685 - protein, 9 aa, Staphylococcus aureus
DDPAGKPWS

SEQ ID NO: 1621686 - protein, 21 aa, Staphylococcus aureus
DELKQVNANYQKAKSSVKDVE

SEQ ID NO: 1621687 - protein, 8 aa, Staphylococcus aureus
DGPTLNDC

SEQ ID NO: 1621688 - protein, 51 aa, Staphylococcus aureus
DISGSQSDESTQGEEAKREDVPANLNDNDSDIEEKSEETEPKKGFWSRLFG

SEQ ID NO: 1621689 - protein, 17 aa, Staphylococcus aureus
DKEGYRDGEFEKDDKGT

SEQ ID NO: 1621690 - protein, 7 aa, Staphylococcus aureus
DKKYTNK

SEQ ID NO: 1621691 - protein, 14 aa, Staphylococcus aureus
DKQSGRKDNRSGYR

SEQ ID NO: 1621692 - protein, 28 aa, Staphylococcus aureus
DLAPKATNNKEYTINTEIGNNGNFGASL

SEQ ID NO: 1621693 - protein, 7 aa, Staphylococcus aureus
DMNTGEE

SEQ ID NO: 1621694 - protein, 10 aa, Staphylococcus aureus
DNPEKIKSIK

SEQ ID NO: 1621695 - protein, 4 aa, Staphylococcus aureus
DNSK

SEQ ID NO: 1621696 - protein, 8 aa, Staphylococcus aureus
DNSKFDNC

SEQ ID NO: 1621697 - protein, 10 aa, Staphylococcus aureus
DPTPSIKTYD

SEQ ID NO: 1621698 - protein, 7 aa, Staphylococcus aureus
DQCPTSV

SEQ ID NO: 1621699 - protein, 5 aa, Staphylococcus aureus
DRIQG

SEQ ID NO: 1621700 - protein, 6 aa, Staphylococcus aureus
DSSFIT

SEQ ID NO: 1621701 - protein, 11 aa, Staphylococcus aureus
DTFSPKEGKKI

SEQ ID NO: 1621702 - protein, 8 aa, Staphylococcus aureus
DTQDYSDL

SEQ ID NO: 1621703 - protein, 9 aa, Staphylococcus aureus
DVDNEKDAL

SEQ ID NO: 1621704 - protein, 11 aa, Staphylococcus aureus
DVKDYDNARKY

SEQ ID NO: 1621705 - protein, 22 aa, Staphylococcus aureus
DVTAYTNEEDGAAKYLAEHFLA

SEQ ID NO: 1621706 - protein, 7 aa, Staphylococcus aureus
DWKESHR

SEQ ID NO: 1621707 - protein, 5 aa, Staphylococcus aureus
DWPES

SEQ ID NO: 1621708 - protein, 9 aa, Staphylococcus aureus
EAEQVHDDL

SEQ ID NO: 1621709 - protein, 10 aa, Staphylococcus aureus
EAESLEEAEI

SEQ ID NO: 1621710 - protein, 12 aa, Staphylococcus aureus
EAINKTQNVGYK

SEQ ID NO: 1621711 - protein, 9 aa, Staphylococcus aureus
EDKKLKQKI

SEQ ID NO: 1621712 - protein, 16 aa, Staphylococcus aureus
EDTEVNRTTTKKALTA

SEQ ID NO: 1621713 - protein, 18 aa, Staphylococcus aureus
EDTKGKVTLKKEKETEII

SEQ ID NO: 1621714 - protein, 4 aa, Staphylococcus aureus
EEEG

SEQ ID NO: 1621715 - protein, 12 aa, Staphylococcus aureus
EEKYNEALSRDN

SEQ ID NO: 1621716 - protein, 16 aa, Staphylococcus aureus
EENTDEQDRLINLVMK

SEQ ID NO: 1621717 - protein, 16 aa, Staphylococcus aureus
EERRQELSERAKRAFG

SEQ ID NO: 1621718 - protein, 17 aa, Staphylococcus aureus
EETYQSRLAKKTPTKSG

SEQ ID NO: 1621719 - protein, 6 aa, Staphylococcus aureus
EEYTAA

SEQ ID NO: 1621720 - protein, 11 aa, Staphylococcus aureus
EGASKGPVETF

SEQ ID NO: 1621721 - protein, 10 aa, Staphylococcus aureus
EGQTLGRLSS

SEQ ID NO: 1621722 - protein, 8 aa, Staphylococcus aureus
EHANNTID

SEQ ID NO: 1621723 - protein, 4 aa, Staphylococcus aureus
EKDG

SEQ ID NO: 1621724 - protein, 23 aa, Staphylococcus aureus
EKNCGYSPQETTKNVKKLKRYRN

SEQ ID NO: 1621725 - protein, 7 aa, Staphylococcus aureus
EKQETGN

SEQ ID NO: 1621726 - protein, 15 aa, Staphylococcus aureus
ELMSPPKGFATAGRL

SEQ ID NO: 1621727 - protein, 10 aa, Staphylococcus aureus
ENEKKDKELN

SEQ ID NO: 1621728 - protein, 5 aa, Staphylococcus aureus
ENEKL

SEQ ID NO: 1621729 - protein, 51 aa, Staphylococcus aureus
ENGLSANGFSENGKTENRKGRTTNNNSTNNDLTNNNNTNNDGSILSGNPTV

SEQ ID NO: 1621730 - protein, 11 aa, Staphylococcus aureus
ENGVEHEGELD

SEQ ID NO: 1621731 - protein, 19 aa, Staphylococcus aureus
ENITSNAATELPLTQRYFL

SEQ ID NO: 1621732 - protein, 14 aa, Staphylococcus aureus
ENKDANGQQHAPGW

SEQ ID NO: 1621733 - protein, 16 aa, Staphylococcus aureus
ENRDTGIETEGSVDGG

SEQ ID NO: 1621734 - protein, 21 aa, Staphylococcus aureus
EPTVHGGGQEYGVRSGTVNLP

SEQ ID NO: 1621735 - protein, 8 aa, Staphylococcus aureus
ERYKGGLR

SEQ ID NO: 1621736 - protein, 18 aa, Staphylococcus aureus
ESFDKGNYGTDNKQVQKH

SEQ ID NO: 1621737 - protein, 4 aa, Staphylococcus aureus
ESGT

SEQ ID NO: 1621738 - protein, 31 aa, Staphylococcus aureus; identical to SEQ ID NO: 1563238

SEQ ID NO: 1621739 - protein, 7 aa, Staphylococcus aureus
ESSKEIN

SEQ ID NO: 1621740 - protein, 5 aa, Staphylococcus aureus
ESTDA

SEQ ID NO: 1621741 - protein, 9 aa, Staphylococcus aureus
ETLAENSGV

SEQ ID NO: 1621742 - protein, 13 aa, Staphylococcus aureus
EVSRTSQSEGMHG

SEQ ID NO: 1621743 - protein, 4 aa, Staphylococcus aureus
FEDT

SEQ ID NO: 1621744 - protein, 12 aa, Staphylococcus aureus
FEKREKEIPFED

SEQ ID NO: 1621745 - protein, 5 aa, Staphylococcus aureus
FKGAD

SEQ ID NO: 1621746 - protein, 21 aa, Staphylococcus aureus
FTDADQGKKDAYTNAVTNAQG

SEQ ID NO: 1621747 - protein, 12 aa, Staphylococcus aureus
GAPTRAVEQGGK

SEQ ID NO: 1621748 - protein, 13 aa, Staphylococcus aureus
GAQTERSKRNFPV

SEQ ID NO: 1621749 - protein, 5 aa, Staphylococcus aureus
GDYDG

SEQ ID NO: 1621750 - protein, 7 aa, Staphylococcus aureus
GGGGDGS

SEQ ID NO: 1621751 - protein, 11 aa, Staphylococcus aureus
GIDENTTSHHL

SEQ ID NO: 1621752 - protein, 4 aa, Staphylococcus aureus
GIPL

SEQ ID NO: 1621753 - protein, 9 aa, Staphylococcus aureus
GIQRRIDNG

SEQ ID NO: 1621754 - protein, 8 aa, Staphylococcus aureus
GKFPDRKN

SEQ ID NO: 1621755 - protein, 6 aa, Staphylococcus aureus
GKPALD

SEQ ID NO: 1621756 - protein, 13 aa, Staphylococcus aureus
GKRTTSPKTANKI

SEQ ID NO: 1621757 - protein, 8 aa, Staphylococcus aureus
GNGTATDE

SEQ ID NO: 1621758 - protein, 5 aa, Staphylococcus aureus
GNINR

SEQ ID NO: 1621759 - protein, 6 aa, Staphylococcus aureus
GNKNIL

SEQ ID NO: 1621760 - protein, 5 aa, Staphylococcus aureus
GNSDR

SEQ ID NO: 1621761 - protein, 8 aa, Staphylococcus aureus
GPNTENFE

SEQ ID NO: 1621762 - protein, 10 aa, Staphylococcus aureus
GPNTGGKTVT

SEQ ID NO: 1621763 - protein, 8 aa, Staphylococcus aureus
GPRPERPE

SEQ ID NO: 1621764 - protein, 8 aa, Staphylococcus aureus
GQSIQQGA

SEQ ID NO: 1621765 - protein, 9 aa, Staphylococcus aureus
GRDITDDIA

SEQ ID NO: 1621766 - protein, 16 aa, Staphylococcus aureus
GRGPNIEAGGKSAYNN

SEQ ID NO: 1621767 - protein, 6 aa, Staphylococcus aureus
GSISLS

SEQ ID NO: 1621768 - protein, 6 aa, Staphylococcus aureus
GTTDEF

SEQ ID NO: 1621769 - protein, 20 aa, Staphylococcus aureus
GTVHSPSPVDVKAGEYEDCK

SEQ ID NO: 1621770 - protein, 9 aa, Staphylococcus aureus
GVDKNDIEI

SEQ ID NO: 1621771 - protein, 8 aa, Staphylococcus aureus
GVDNAADR

SEQ ID NO: 1621772 - protein, 6 aa, Staphylococcus aureus
GYPPDL

SEQ ID NO: 1621773 - protein, 19 aa, Staphylococcus aureus
HGESGLDGPKLPSTPSRQA

SEQ ID NO: 1621774 - protein, 23 aa, Staphylococcus aureus
HPKKDRAAYEARQAIPNINENSP

SEQ ID NO: 1621775 - protein, 10 aa, Staphylococcus aureus
HSSEMTGEEH

SEQ ID NO: 1621776 - protein, 6 aa, Staphylococcus aureus
HSSNIK

SEQ ID NO: 1621777 - protein, 6 aa, Staphylococcus aureus
IADNAD

SEQ ID NO: 1621778 - protein, 24 aa, Staphylococcus aureus
IARGEPQEAYSKKYDHLNDEVEKE

SEQ ID NO: 1621779 - protein, 7 aa, Staphylococcus aureus
IARPAAS

SEQ ID NO: 1621780 - protein, 28 aa, Staphylococcus aureus
IDDENATKQTQKYRDAEQSKKTAYDQAV

SEQ ID NO: 1621781 - protein, 7 aa, Staphylococcus aureus
IDGNDDS

SEQ ID NO: 1621782 - protein, 29 aa, Staphylococcus aureus
IKAQQAREAARKAREDARSGKKNKRKDTL

SEQ ID NO: 1621783 - protein, 5 aa, Staphylococcus aureus
IKEAN

SEQ ID NO: 1621784 - protein, 5 aa, Staphylococcus aureus
IKNRS

SEQ ID NO: 1621785 - protein, 12 aa, Staphylococcus aureus
INATNNPNMDAN

SEQ ID NO: 1621786 - protein, 9 aa, Staphylococcus aureus
INNNDTPSN

SEQ ID NO: 1621787 - protein, 9 aa, Staphylococcus aureus
IPDRKTGLE

SEQ ID NO: 1621788 - protein, 5 aa, Staphylococcus aureus
IQGSQ

SEQ ID NO: 1621789 - protein, 8 aa, Staphylococcus aureus
IQNGAEEI

SEQ ID NO: 1621790 - protein, 9 aa, Staphylococcus aureus
ISKKEKEQI

SEQ ID NO: 1621791 - protein, 4 aa, Staphylococcus aureus
ISRE

SEQ ID NO: 1621792 - protein, 17 aa, Staphylococcus aureus
ITKSKQLTEESYANRPL

SEQ ID NO: 1621793 - protein, 19 aa, Staphylococcus aureus
KAGKDIPGAELKVTESLVI

SEQ ID NO: 1621794 - protein, 8 aa, Staphylococcus aureus
KAKKGRKI

SEQ ID NO: 1621795 - protein, 9 aa, Staphylococcus aureus
KASSEVYGK

SEQ ID NO: 1621796 - protein, 12 aa, Staphylococcus aureus
KDRNSYSKTDYD

SEQ ID NO: 1621797 - protein, 10 aa, Staphylococcus aureus
KEGLTEEEIE

SEQ ID NO: 1621798 - protein, 4 aa, Staphylococcus aureus
KEIE

SEQ ID NO: 1621799 - protein, 14 aa, Staphylococcus aureus
KEIEASNATDQDKL

SEQ ID NO: 1621800 - protein, 14 aa, Staphylococcus aureus
KEISSVPENNLQEP

SEQ ID NO: 1621801 - protein, 6 aa, Staphylococcus aureus
KEITQK

SEQ ID NO: 1621802 - protein, 8 aa, Staphylococcus aureus
KEKHGPDA

SEQ ID NO: 1621803 - protein, 11 aa, Staphylococcus aureus
KELDDTPLAKR

SEQ ID NO: 1621804 - protein, 16 aa, Staphylococcus aureus
KELQRKKIRDTNIGKE

SEQ ID NO: 1621805 - protein, 10 aa, Staphylococcus aureus
KEPDNPYDEN

SEQ ID NO: 1621806 - protein, 7 aa, Staphylococcus aureus
KEQDTNT

SEQ ID NO: 1621807 - protein, 4 aa, Staphylococcus aureus
KFPL

SEQ ID NO: 1621808 - protein, 6 aa, Staphylococcus aureus
KGDFTQ

SEQ ID NO: 1621809 - protein, 6 aa, Staphylococcus aureus
KGNELK

SEQ ID NO: 1621810 - protein, 20 aa, Staphylococcus aureus
KGREKAYPSELSGGQKQRVG

SEQ ID NO: 1621811 - protein, 5 aa, Staphylococcus aureus
KGRLQ

SEQ ID NO: 1621812 - protein, 7 aa, Staphylococcus aureus
KGSQGGI

SEQ ID NO: 1621813 - protein, 10 aa, Staphylococcus aureus
KGYSDETSYA

SEQ ID NO: 1621814 - protein, 23 aa, Staphylococcus aureus
KIAKSDPRNNISRKKFHNSIIFN

SEQ ID NO: 1621815 - protein, 9 aa, Staphylococcus aureus
KIKKYKKQI

SEQ ID NO: 1621816 - protein, 20 aa, Staphylococcus aureus
KIQPTGTNQLERMKYDESYW

SEQ ID NO: 1621817 - protein, 7 aa, Staphylococcus aureus
KKEAATY

SEQ ID NO: 1621818 - protein, 14 aa, Staphylococcus aureus
KKLSEPETKNIYSQ

SEQ ID NO: 1621819 - protein, 12 aa, Staphylococcus aureus
KKNNVEVTTSKE

SEQ ID NO: 1621820 - protein, 9 aa, Staphylococcus aureus
KKRQPQYSV

SEQ ID NO: 1621821 - protein, 4 aa, Staphylococcus aureus
KKTA

SEQ ID NO: 1621822 - protein, 5 aa, Staphylococcus aureus
KMDND

SEQ ID NO: 1621823 - protein, 7 aa, Staphylococcus aureus
KMREAET

SEQ ID NO: 1621824 - protein, 4 aa, Staphylococcus aureus
KMST

SEQ ID NO: 1621825 - protein, 20 aa, Staphylococcus aureus
KNAEKNGAQWADKDDDRITN

SEQ ID NO: 1621826 - protein, 25 aa, Staphylococcus aureus
KNDNETLESEDMSNFGRSPAGIDGK

SEQ ID NO: 1621827 - protein, 15 aa, Staphylococcus aureus
KNGKQSQKEAQRRLN

SEQ ID NO: 1621828 - protein, 7 aa, Staphylococcus aureus
KNIDQRE

SEQ ID NO: 1621829 - protein, 7 aa, Staphylococcus aureus
KNPYDEH

SEQ ID NO: 1621830 - protein, 18 aa, Staphylococcus aureus
KPSINTKKPFYDDINPIE

SEQ ID NO: 1621831 - protein, 8 aa, Staphylococcus aureus
KPTINTKK

SEQ ID NO: 1621832 - protein, 15 aa, Staphylococcus aureus
KQAPKSYVDEAENRN

SEQ ID NO: 1621833 - protein, 8 aa, Staphylococcus aureus
KQGYIGTE

SEQ ID NO: 1621834 - protein, 7 aa, Staphylococcus aureus
KQIRQKL

SEQ ID NO: 1621835 - protein, 14 aa, Staphylococcus aureus
KQTTNPTMDPNTIQ

SEQ ID NO: 1621836 - protein, 13 aa, Staphylococcus aureus
KRGGLGKKKNRRT

SEQ ID NO: 1621837 - protein, 14 aa, Staphylococcus aureus
KRIQKQVKHKSQRH

SEQ ID NO: 1621838 - protein, 6 aa, Staphylococcus aureus
KRLSRE

SEQ ID NO: 1621839 - protein, 7 aa, Staphylococcus aureus
KSFNSRH

SEQ ID NO: 1621840 - protein, 8 aa, Staphylococcus aureus
KSKRQLTN

SEQ ID NO: 1621841 - protein, 7 aa, Staphylococcus aureus
KTSIRNE

SEQ ID NO: 1621842 - protein, 5 aa, Staphylococcus aureus
KVNEL

SEQ ID NO: 1621843 - protein, 7 aa, Staphylococcus aureus
KYDNGEF

SEQ ID NO: 1621844 - protein, 5 aa, Staphylococcus aureus
KYGYK

SEQ ID NO: 1621845 - protein, 4 aa, Staphylococcus aureus
KYPR

SEQ ID NO: 1621846 - protein, 8 aa, Staphylococcus aureus
LDEGAITK

SEQ ID NO: 1621847 - protein, 7 aa, Staphylococcus aureus
LGARKGE

SEQ ID NO: 1621848 - protein, 4 aa, Staphylococcus aureus
LGGE

SEQ ID NO: 1621849 - protein, 18 aa, Staphylococcus aureus
LGPSDEGNDRLKQQFSSN

SEQ ID NO: 1621850 - protein, 13 aa, Staphylococcus aureus
LKDQKENGAPRRT

SEQ ID NO: 1621851 - protein, 5 aa, Staphylococcus aureus
LKKDY

SEQ ID NO: 1621852 - protein, 5 aa, Staphylococcus aureus
LKPSG

SEQ ID NO: 1621853 - protein, 4 aa, Staphylococcus aureus
LKQG

SEQ ID NO: 1621854 - protein, 12 aa, Staphylococcus aureus
LKRELNQTQSAF

SEQ ID NO: 1621855 - protein, 5 aa, Staphylococcus aureus
LKSHG

SEQ ID NO: 1621856 - protein, 10 aa, Staphylococcus aureus
LNENNKYPGL

SEQ ID NO: 1621857 - protein, 9 aa, Staphylococcus aureus
LNQPQRDAL

SEQ ID NO: 1621858 - protein, 12 aa, Staphylococcus aureus
LPNEDKPAFGQK

SEQ ID NO: 1621859 - protein, 10 aa, Staphylococcus aureus
LPNGETSTRE

SEQ ID NO: 1621860 - protein, 6 aa, Staphylococcus aureus
LQDDIG

SEQ ID NO: 1621861 - protein, 9 aa, Staphylococcus aureus
LQESDSISN

SEQ ID NO: 1621862 - protein, 9 aa, Staphylococcus aureus
LSGAGNGIK

SEQ ID NO: 1621863 - protein, 8 aa, Staphylococcus aureus
LSGGEQQR

SEQ ID NO: 1621864 - protein, 11 aa, Staphylococcus aureus
LSNYSPETRNI

SEQ ID NO: 1621865 - protein, 23 aa, Staphylococcus aureus
LTDEEKEKISYTNGAKLLGLSPN

SEQ ID NO: 1621866 - protein, 10 aa, Staphylococcus aureus
LTEEEISNET

SEQ ID NO: 1621867 - protein, 4 aa, Staphylococcus aureus
LTEN

SEQ ID NO: 1621868 - protein, 9 aa, Staphylococcus aureus
LTENAEDRL

SEQ ID NO: 1621869 - protein, 16 aa, Staphylococcus aureus
LTGTSEDDAGKTFREN

SEQ ID NO: 1621870 - protein, 7 aa, Staphylococcus aureus
LTPGRQH

SEQ ID NO: 1621871 - protein, 4 aa, Staphylococcus aureus
MGIG

SEQ ID NO: 1621872 - protein, 4 aa, Staphylococcus aureus
MNNS

SEQ ID NO: 1621873 - protein, 6 aa, Staphylococcus aureus
NARPEI

SEQ ID NO: 1621874 - protein, 8 aa, Staphylococcus aureus
NARPEIQA

SEQ ID NO: 1621875 - protein, 7 aa, Staphylococcus aureus
NASDLLS

SEQ ID NO: 1621876 - protein, 4 aa, Staphylococcus aureus
NASL

SEQ ID NO: 1621877 - protein, 19 aa, Staphylococcus aureus
NDAQKQALTTQVEQAPDIA

SEQ ID NO: 1621878 - protein, 14 aa, Staphylococcus aureus
NDEEQSKFAHSAKT

SEQ ID NO: 1621879 - protein, 5 aa, Staphylococcus aureus
NDEFT

SEQ ID NO: 1621880 - protein, 5 aa, Staphylococcus aureus
NDIEI

SEQ ID NO: 1621881 - protein, 5 aa, Staphylococcus aureus
NDNQL

SEQ ID NO: 1621882 - protein, 5 aa, Staphylococcus aureus
NDYRF

SEQ ID NO: 1621883 - protein, 9 aa, Staphylococcus aureus
NEAKHGNKL

SEQ ID NO: 1621884 - protein, 6 aa, Staphylococcus aureus
NFNSDD

SEQ ID NO: 1621885 - protein, 6 aa, Staphylococcus aureus
NGGKYK

SEQ ID NO: 1621886 - protein, 12 aa, Staphylococcus aureus
NGIQDQNTIKQG

SEQ ID NO: 1621887 - protein, 8 aa, Staphylococcus aureus
NHHSPQNS

SEQ ID NO: 1621888 - protein, 11 aa, Staphylococcus aureus
NIASPSTTELI

SEQ ID NO: 1621889 - protein, 8 aa, Staphylococcus aureus
NIKNGSVH

SEQ ID NO: 1621890 - protein, 8 aa, Staphylococcus aureus
NINYEDKT

SEQ ID NO: 1621891 - protein, 7 aa, Staphylococcus aureus
NKEISSY

SEQ ID NO: 1621892 - protein, 5 aa, Staphylococcus aureus
NKNQL

SEQ ID NO: 1621893 - protein, 15 aa, Staphylococcus aureus
NKQTGQNANQTEVEQ

SEQ ID NO: 1621894 - protein, 15 aa, Staphylococcus aureus
NKQTGSNSDKAAVDR

SEQ ID NO: 1621895 - protein, 4 aa, Staphylococcus aureus
NLKN

SEQ ID NO: 1621896 - protein, 11 aa, Staphylococcus aureus
NNEKCTKTRKQ

SEQ ID NO: 1621897 - protein, 9 aa, Staphylococcus aureus
NNSNGFESL

SEQ ID NO: 1621898 - protein, 9 aa, Staphylococcus aureus
NPKNDGMNI

SEQ ID NO: 1621899 - protein, 15 aa, Staphylococcus aureus
NQANGTNANQSQVEA

SEQ ID NO: 1621900 - protein, 6 aa, Staphylococcus aureus
NQINQA

SEQ ID NO: 1621901 - protein, 6 aa, Staphylococcus aureus
NSDGTN

SEQ ID NO: 1621902 - protein, 8 aa, Staphylococcus aureus
NSKTNKKI

SEQ ID NO: 1621903 - protein, 7 aa, Staphylococcus aureus
NTPTCTT

SEQ ID NO: 1621904 - protein, 17 aa, Staphylococcus aureus
NVDGVYSADPKVNKDAV

SEQ ID NO: 1621905 - protein, 34 aa, Staphylococcus aureus
NVKTSAKNQKNPPVPAGYTPDKNNVPYKKETGYY

SEQ ID NO: 1621906 - protein, 13 aa, Staphylococcus aureus
NVSQQSLNTEPNE

SEQ ID NO: 1621907 - protein, 7 aa, Staphylococcus aureus
PDTDAIS

SEQ ID NO: 1621908 - protein, 5 aa, Staphylococcus aureus
PEEDL

SEQ ID NO: 1621909 - protein, 12 aa, Staphylococcus aureus
PKKNGPLGNSPI

SEQ ID NO: 1621910 - protein, 11 aa, Staphylococcus aureus
PNNQNCTPSRE

SEQ ID NO: 1621911 - protein, 15 aa, Staphylococcus aureus
PPKSWSKKKKTQAIG

SEQ ID NO: 1621912 - protein, 18 aa, Staphylococcus aureus
PQAPGQIDVTDLKAQVTL

SEQ ID NO: 1621913 - protein, 4 aa, Staphylococcus aureus
PRDE

SEQ ID NO: 1621914 - protein, 5 aa, Staphylococcus aureus
PSEIT

SEQ ID NO: 1621915 - protein, 5 aa, Staphylococcus aureus
PSYPY

SEQ ID NO: 1621916 - protein, 10 aa, Staphylococcus aureus
PTKKGKGSVV

SEQ ID NO: 1621917 - protein, 4 aa, Staphylococcus aureus
PVDE

SEQ ID NO: 1621918 - protein, 64 aa, Staphylococcus aureus
QAERYVGDSSLNDDSDLTDNSTEASQLHTNEIEDEAVSNDENKKASIQNEDTDDTHVDESPYNY

SEQ ID NO: 1621919 - protein, 7 aa, Staphylococcus aureus
QAHRPQF

SEQ ID NO: 1621920 - protein, 8 aa, Staphylococcus aureus
QCGSGLES

SEQ ID NO: 1621921 - protein, 8 aa, Staphylococcus aureus
QDDSLNDA

SEQ ID NO: 1621922 - protein, 10 aa, Staphylococcus aureus
QDKDQVKQSV

SEQ ID NO: 1621923 - protein, 10 aa, Staphylococcus aureus
QEVDSYRTAT

SEQ ID NO: 1621924 - protein, 16 aa, Staphylococcus aureus
QGLNTSYETAEKVKHQ

SEQ ID NO: 1621925 - protein, 12 aa, Staphylococcus aureus
QHQVPGISGSVK

SEQ ID NO: 1621926 - protein, 5 aa, Staphylococcus aureus
QIGRQ

SEQ ID NO: 1621927 - protein, 9 aa, Staphylococcus aureus
QKGEPVRTT

SEQ ID NO: 1621928 - protein, 6 aa, Staphylococcus aureus
QKLTKQ

SEQ ID NO: 1621929 - protein, 8 aa, Staphylococcus aureus
QKNVTKEK

SEQ ID NO: 1621930 - protein, 7 aa, Staphylococcus aureus
QKTEQPQ

SEQ ID NO: 1621931 - protein, 4 aa, Staphylococcus aureus
QNEA

SEQ ID NO: 1621932 - protein, 7 aa, Staphylococcus aureus
QNGSNNV

SEQ ID NO: 1621933 - protein, 183 aa, Staphylococcus aureus
QNQLTSKIDSNSESLKAIQTSQEAIQEAQASQAKALAESTNKVEKNAVTEDKADSKDSKVAGVNTSTDAKTDTKAENAGDGTATKVDKEDQISATEAIEKASVEQSKNDNAAETSNKEATVDAEAQHDAEQQVAEAHAEASKQATSNDSLEAKAENDSTASQSEMSEPKPQEEKKGFFARLFN

SEQ ID NO: 1621934 - protein, 10 aa, Staphylococcus aureus
QNWNNGGWRK

SEQ ID NO: 1621935 - protein, 4 aa, Staphylococcus aureus
QPTA

SEQ ID NO: 1621936 - protein, 7 aa, Staphylococcus aureus
QQKEKEG

SEQ ID NO: 1621937 - protein, 7 aa, Staphylococcus aureus
QSGQYNN

SEQ ID NO: 1621938 - protein, 5 aa, Staphylococcus aureus
QTFGN

SEQ ID NO: 1621939 - protein, 28 aa, Staphylococcus aureus
QVTTAKNALNGDANVRQAKSDAKANLGT

SEQ ID NO: 1621940 - protein, 4 aa, Staphylococcus aureus
RAAE

SEQ ID NO: 1621941 - protein, 6 aa, Staphylococcus aureus
RAGMQS

SEQ ID NO: 1621942 - protein, 4 aa, Staphylococcus aureus
RARA

SEQ ID NO: 1621943 - protein, 13 aa, Staphylococcus aureus
RARGEAIKGIKGV

SEQ ID NO: 1621944 - protein, 14 aa, Staphylococcus aureus
RASTSEKSKRLYQA

SEQ ID NO: 1621945 - protein, 8 aa, Staphylococcus aureus
RENPDLSQ

SEQ ID NO: 1621946 - protein, 5 aa, Staphylococcus aureus
RGEES

SEQ ID NO: 1621947 - protein, 7 aa, Staphylococcus aureus
RKENNVN

SEQ ID NO: 1621948 - protein, 8 aa, Staphylococcus aureus
RKHNQDTK

SEQ ID NO: 1621949 - protein, 11 aa, Staphylococcus aureus
RKLPGLSERER

SEQ ID NO: 1621950 - protein, 5 aa, Staphylococcus aureus
RNIPN

SEQ ID NO: 1621951 - protein, 7 aa, Staphylococcus aureus
RNNNPEL

SEQ ID NO: 1621952 - protein, 4 aa, Staphylococcus aureus
RNPA

SEQ ID NO: 1621953 - protein, 8 aa, Staphylococcus aureus
RNTRKPVI

SEQ ID NO: 1621954 - protein, 5 aa, Staphylococcus aureus
RRGEI

SEQ ID NO: 1621955 - protein, 9 aa, Staphylococcus aureus
RSNPPQEIQ

SEQ ID NO: 1621956 - protein, 5 aa, Staphylococcus aureus
RSPQH

SEQ ID NO: 1621957 - protein, 30 aa, Staphylococcus aureus
RSYEKQPQKDYDPQLEKEREDFLKQLELNW

SEQ ID NO: 1621958 - protein, 5 aa, Staphylococcus aureus
RTPEN

SEQ ID NO: 1621959 - protein, 8 aa, Staphylococcus aureus
RVRARKKV

SEQ ID NO: 1621960 - protein, 4 aa, Staphylococcus aureus
SADD

SEQ ID NO: 1621961 - protein, 11 aa, Staphylococcus aureus
SAKMGPASDPM

SEQ ID NO: 1621962 - protein, 7 aa, Staphylococcus aureus
SCRSQMA

SEQ ID NO: 1621963 - protein, 9 aa, Staphylococcus aureus
SDEGKDEFN

SEQ ID NO: 1621964 - protein, 14 aa, Staphylococcus aureus
SDGYSREDRETTLN

SEQ ID NO: 1621965 - protein, 17 aa, Staphylococcus aureus
SDKGEGNIEFISIKDIM

SEQ ID NO: 1621966 - protein, 15 aa, Staphylococcus aureus
SDNGYVSNTSGFTKQ

SEQ ID NO: 1621967 - protein, 13 aa, Staphylococcus aureus
SDSNNDRSNPGKK

SEQ ID NO: 1621968 - protein, 4 aa, Staphylococcus aureus
SDYS

SEQ ID NO: 1621969 - protein, 5 aa, Staphylococcus aureus
SECGF

SEQ ID NO: 1621970 - protein, 9 aa, Staphylococcus aureus
SEDKAFPRL

SEQ ID NO: 1621971 - protein, 18 aa, Staphylococcus aureus
SEESEVKDLTEEKYNQDY

SEQ ID NO: 1621972 - protein, 5 aa, Staphylococcus aureus
SESYE

SEQ ID NO: 1621973 - protein, 12 aa, Staphylococcus aureus
SEYKDTYLFRLI

SEQ ID NO: 1621974 - protein, 13 aa, Staphylococcus aureus
SGAHGKARQITES

SEQ ID NO: 1621975 - protein, 12 aa, Staphylococcus aureus
SIQQTANELNTA

SEQ ID NO: 1621976 - protein, 15 aa, Staphylococcus aureus
SKANGSNASQTEVEQ

SEQ ID NO: 1621977 - protein, 6 aa, Staphylococcus aureus
SKQPKL

SEQ ID NO: 1621978 - protein, 9 aa, Staphylococcus aureus
SLSGGEQQR

SEQ ID NO: 1621979 - protein, 10 aa, Staphylococcus aureus
SMDDRKNSLT

SEQ ID NO: 1621980 - protein, 21 aa, Staphylococcus aureus
SMQPPATKEEKEEIPSKPQID

SEQ ID NO: 1621981 - protein, 23 aa, Staphylococcus aureus
SNDLDEETITSLKAQGAKVDSWG

SEQ ID NO: 1621982 - protein, 29 aa, Staphylococcus aureus
SNKITGDSKEEQIKKSFAKSLDKYPTENL

SEQ ID NO: 1621983 - protein, 7 aa, Staphylococcus aureus
SNLDSGE

SEQ ID NO: 1621984 - protein, 12 aa, Staphylococcus aureus
SNPTQTAEQRRE

SEQ ID NO: 1621985 - protein, 4 aa, Staphylococcus aureus
SNQQ

SEQ ID NO: 1621986 - protein, 5 aa, Staphylococcus aureus
SNYRL

SEQ ID NO: 1621987 - protein, 17 aa, Staphylococcus aureus
SQIEETESDFDREKLQE

SEQ ID NO: 1621988 - protein, 5 aa, Staphylococcus aureus
SQNTG

SEQ ID NO: 1621989 - protein, 13 aa, Staphylococcus aureus
SRITESKKDIHQE

SEQ ID NO: 1621990 - protein, 7 aa, Staphylococcus aureus
SRKVHSD

SEQ ID NO: 1621991 - protein, 5 aa, Staphylococcus aureus
SRQQF

SEQ ID NO: 1621992 - protein, 6 aa, Staphylococcus aureus
SSASGM

SEQ ID NO: 1621993 - protein, 10 aa, Staphylococcus aureus
SSGLSEKERN

SEQ ID NO: 1621994 - protein, 9 aa, Staphylococcus aureus
SSSNIPNDI

SEQ ID NO: 1621995 - protein, 5 aa, Staphylococcus aureus
SSTTI

SEQ ID NO: 1621996 - protein, 6 aa, Staphylococcus aureus
SSYRDN

SEQ ID NO: 1621997 - protein, 21 aa, Staphylococcus aureus
STDNASWGRGPNTKAGGKSAY

SEQ ID NO: 1621998 - protein, 4 aa, Staphylococcus aureus
STIG

SEQ ID NO: 1621999 - protein, 4 aa, Staphylococcus aureus
STIK

SEQ ID NO: 1622000 - protein, 10 aa, Staphylococcus aureus
STNPAENEGK

SEQ ID NO: 1622001 - protein, 11 aa, Staphylococcus aureus
STQGLHNRGSF

SEQ ID NO: 1622002 - protein, 5 aa, Staphylococcus aureus
STSSN

SEQ ID NO: 1622003 - protein, 29 aa, Staphylococcus aureus
STVTTTKQALNGDRKVTDAKNNANQTLST

SEQ ID NO: 1622004 - protein, 9 aa, Staphylococcus aureus
SVGDTIQRG

SEQ ID NO: 1622005 - protein, 7 aa, Staphylococcus aureus
SYKEQGL

SEQ ID NO: 1622006 - protein, 10 aa, Staphylococcus aureus
SYYDSKGNID

SEQ ID NO: 1622007 - protein, 17 aa, Staphylococcus aureus
TAIPQPKVDSSTVTPGE

SEQ ID NO: 1622008 - protein, 7 aa, Staphylococcus aureus
TARQRGK

SEQ ID NO: 1622009 - protein, 9 aa, Staphylococcus aureus
TDNKVELPN

SEQ ID NO: 1622010 - protein, 5 aa, Staphylococcus aureus
TEHRV

SEQ ID NO: 1622011 - protein, 10 aa, Staphylococcus aureus
TEKQRQQQAE

SEQ ID NO: 1622012 - protein, 8 aa, Staphylococcus aureus
TFEERQRS

SEQ ID NO: 1622013 - protein, 10 aa, Staphylococcus aureus
TFKEEGHEPW

SEQ ID NO: 1622014 - protein, 6 aa, Staphylococcus aureus
TGKPGM

SEQ ID NO: 1622015 - protein, 8 aa, Staphylococcus aureus
TGSNTVSV

SEQ ID NO: 1622016 - protein, 7 aa, Staphylococcus aureus
THTGGFS

SEQ ID NO: 1622017 - protein, 12 aa, Staphylococcus aureus
TIKQTAQDLNQA

SEQ ID NO: 1622018 - protein, 14 aa, Staphylococcus aureus
TKKDKNKLYHFLKE

SEQ ID NO: 1622019 - protein, 7 aa, Staphylococcus aureus
TKSLKSI

SEQ ID NO: 1622020 - protein, 12 aa, Staphylococcus aureus
TLGRGGSDTTAV

SEQ ID NO: 1622021 - protein, 24 aa, Staphylococcus aureus
TMAGDDPTRYRTSDEDAEWEKKDP

SEQ ID NO: 1622022 - protein, 8 aa, Staphylococcus aureus
TNEFGTAP

SEQ ID NO: 1622023 - protein, 28 aa, Staphylococcus aureus
TNLGSSELGISGVNSGVASKNINFSNPS

SEQ ID NO: 1622024 - protein, 12 aa, Staphylococcus aureus
TNSYKKDASQKF

SEQ ID NO: 1622025 - protein, 7 aa, Staphylococcus aureus
TPFKDNS

SEQ ID NO: 1622026 - protein, 14 aa, Staphylococcus aureus
TPGCAKTGSFNSFC

SEQ ID NO: 1622027 - protein, 19 aa, Staphylococcus aureus
TPSVKTNDYDFEEDDTNIT

SEQ ID NO: 1622028 - protein, 4 aa, Staphylococcus aureus
TPTR

SEQ ID NO: 1622029 - protein, 6 aa, Staphylococcus aureus
TQAESY

SEQ ID NO: 1622030 - protein, 9 aa, Staphylococcus aureus
TQSQGDVRN

SEQ ID NO: 1622031 - protein, 11 aa, Staphylococcus aureus
TRDTKERGRSM

SEQ ID NO: 1622032 - protein, 31 aa, Staphylococcus aureus
TRKQQIKKSNASLQDEKDVANDKIGKIETKA

SEQ ID NO: 1622033 - protein, 8 aa, Staphylococcus aureus
TRNGANLQ

SEQ ID NO: 1622034 - protein, 8 aa, Staphylococcus aureus
TSAERGKI

SEQ ID NO: 1622035 - protein, 5 aa, Staphylococcus aureus
TTANR

SEQ ID NO: 1622036 - protein, 34 aa, Staphylococcus aureus; identical to SEQ ID NO: 1563881

SEQ ID NO: 1622037 - protein, 7 aa, Staphylococcus aureus
TTDPGMG

SEQ ID NO: 1622038 - protein, 5 aa, Staphylococcus aureus
TTKDI

SEQ ID NO: 1622039 - protein, 14 aa, Staphylococcus aureus
TVEDSIGNNQSDYE

SEQ ID NO: 1622040 - protein, 16 aa, Staphylococcus aureus
TVEQTKQNAQNVNTAM

SEQ ID NO: 1622041 - protein, 4 aa, Staphylococcus aureus
TYSE

SEQ ID NO: 1622042 - protein, 8 aa, Staphylococcus aureus
VDKSGAWY

SEQ ID NO: 1622043 - protein, 5 aa, Staphylococcus aureus
VENGE

SEQ ID NO: 1622044 - protein, 6 aa, Staphylococcus aureus
VGSKNV

SEQ ID NO: 1622045 - protein, 10 aa, Staphylococcus aureus
VKKESRSNTL

SEQ ID NO: 1622046 - protein, 11 aa, Staphylococcus aureus
VKQNAQNLNNA

SEQ ID NO: 1622047 - protein, 5 aa, Staphylococcus aureus
VNAPP

SEQ ID NO: 1622048 - protein, 9 aa, Staphylococcus aureus
VNKNPETIA

SEQ ID NO: 1622049 - protein, 12 aa, Staphylococcus aureus
VNPELRGQKLGR

SEQ ID NO: 1622050 - protein, 7 aa, Staphylococcus aureus
VPTSFSD

SEQ ID NO: 1622051 - protein, 7 aa, Staphylococcus aureus
VQAQTKQ

SEQ ID NO: 1622052 - protein, 4 aa, Staphylococcus aureus
VQNG

SEQ ID NO: 1622053 - protein, 9 aa, Staphylococcus aureus
VRASNGNKK

SEQ ID NO: 1622054 - protein, 4 aa, Staphylococcus aureus
VSEP

SEQ ID NO: 1622055 - protein, 6 aa, Staphylococcus aureus
VSQPTV

SEQ ID NO: 1622056 - protein, 17 aa, Staphylococcus aureus
VSTLEDVQNKNVPPTYS

SEQ ID NO: 1622057 - protein, 15 aa, Staphylococcus aureus
VTQGKIKTSKYVKKE

SEQ ID NO: 1622058 - protein, 13 aa, Staphylococcus aureus
VTSGTQSPSSGKS

SEQ ID NO: 1622059 - protein, 19 aa, Staphylococcus aureus
YDKEGYRDGEFKKGDKGTW

SEQ ID NO: 1622060 - protein, 12 aa, Staphylococcus aureus
YDLPKRGGNPKG

SEQ ID NO: 1622061 - protein, 7 aa, Staphylococcus aureus
YEGRRKE

SEQ ID NO: 1622062 - protein, 15 aa, Staphylococcus aureus
YGATSGKAFINGSAG

SEQ ID NO: 1622063 - protein, 10 aa, Staphylococcus aureus
YGGTYGPDIE

SEQ ID NO: 1622064 - protein, 4 aa, Staphylococcus aureus
YKDT

SEQ ID NO: 1622065 - protein, 6 aa, Staphylococcus aureus
YNQMQK

SEQ ID NO: 1622066 - protein, 10 aa, Staphylococcus aureus
YRNKKGPDYT

SEQ ID NO: 1622067 - protein, 10 aa, Staphylococcus aureus
YRSGYNAAKG

SEQ ID NO: 1622068 - protein, 8 aa, Staphylococcus aureus
YSDSGMNG

SEQ ID NO: 1622069 - protein, 4 aa, Staphylococcus aureus
YTGG

SEQ ID NO: 1622070 - protein, 11 aa, Staphylococcus aureus
AAETGKPVEEV

SEQ ID NO: 1622071 - protein, 24 aa, Staphylococcus aureus
AASEASSTTSVDLANRSRSLTEEN

SEQ ID NO: 1622072 - protein, 5 aa, Staphylococcus aureus
AASEE

SEQ ID NO: 1622073 - protein, 7 aa, Staphylococcus aureus
ADENRAK

SEQ ID NO: 1622074 - protein, 11 aa, Staphylococcus aureus
AEEVPPGGAKT

SEQ ID NO: 1622075 - protein, 17 aa, Staphylococcus aureus
AEKFSEDSEDGRKGAMP

SEQ ID NO: 1622076 - protein, 6 aa, Staphylococcus aureus
AERLGL

SEQ ID NO: 1622077 - protein, 16 aa, Staphylococcus aureus
AETIERSMDEGDIAPY

SEQ ID NO: 1622078 - protein, 10 aa, Staphylococcus aureus
AFTKQQADNL

SEQ ID NO: 1622079 - protein, 8 aa, Staphylococcus aureus
AGAPTVEY

SEQ ID NO: 1622080 - protein, 4 aa, Staphylococcus aureus
AGDG

SEQ ID NO: 1622081 - protein, 4 aa, Staphylococcus aureus
AGDR

SEQ ID NO: 1622082 - protein, 5 aa, Staphylococcus aureus
AGFDP

SEQ ID NO: 1622083 - protein, 5 aa, Staphylococcus aureus
AGIGE

SEQ ID NO: 1622084 - protein, 34 aa, Staphylococcus aureus; identical to SEQ ID NO: 1563286

SEQ ID NO: 1622085 - protein, 5 aa, Staphylococcus aureus
AIEDA

SEQ ID NO: 1622086 - protein, 7 aa, Staphylococcus aureus
AIQGNAP

SEQ ID NO: 1622087 - protein, 10 aa, Staphylococcus aureus
AKDNANTAID

SEQ ID NO: 1622088 - protein, 8 aa, Staphylococcus aureus
AKKYKGNI

SEQ ID NO: 1622089 - protein, 9 aa, Staphylococcus aureus
AKNKAEELA

SEQ ID NO: 1622090 - protein, 11 aa, Staphylococcus aureus
AKQNANTAIDG

SEQ ID NO: 1622091 - protein, 6 aa, Staphylococcus aureus
AMTGYQ

SEQ ID NO: 1622092 - protein, 9 aa, Staphylococcus aureus
ANDSEYGLA

SEQ ID NO: 1622093 - protein, 7 aa, Staphylococcus aureus
ANLTSDD

SEQ ID NO: 1622094 - protein, 8 aa, Staphylococcus aureus
ANPKTTNV

SEQ ID NO: 1622095 - protein, 15 aa, Staphylococcus aureus
APNMAKSEDKEMTKA

SEQ ID NO: 1622096 - protein, 4 aa, Staphylococcus aureus
AQDE

SEQ ID NO: 1622097 - protein, 6 aa, Staphylococcus aureus
AQNNSA

SEQ ID NO: 1622098 - protein, 23 aa, Staphylococcus aureus
ARERKKSDERIKNAKENNDSNEV

SEQ ID NO: 1622099 - protein, 11 aa, Staphylococcus aureus
ARLQNYKNRSI

SEQ ID NO: 1622100 - protein, 5 aa, Staphylococcus aureus
ARPEY

SEQ ID NO: 1622101 - protein, 12 aa, Staphylococcus aureus
ARRRRKGRKVLS

SEQ ID NO: 1622102 - protein, 9 aa, Staphylococcus aureus
ATKYTDAST

SEQ ID NO: 1622103 - protein, 57 aa, Staphylococcus aureus
ATNKENEEVKSLTEEQGQDKLEDTHSEGSTQDANDLAENAEVKKKPRKLSEADFDDD

SEQ ID NO: 1622104 - protein, 8 aa, Staphylococcus aureus
ATNPLSGE

SEQ ID NO: 1622105 - protein, 7 aa, Staphylococcus aureus
ATPDNSI

SEQ ID NO: 1622106 - protein, 7 aa, Staphylococcus aureus
ATQLNQS

SEQ ID NO: 1622107 - protein, 10 aa, Staphylococcus aureus
AVKEGKAKIN

SEQ ID NO: 1622108 - protein, 20 aa, Staphylococcus aureus
AYHRPTSPDYTVGTEPLTQQ

SEQ ID NO: 1622109 - protein, 15 aa, Staphylococcus aureus
AYNPTDRKKLEPQDI

SEQ ID NO: 1622110 - protein, 14 aa, Staphylococcus aureus
CREGQKRYKASLKE

SEQ ID NO: 1622111 - protein, 7 aa, Staphylococcus aureus
DADGVTA

SEQ ID NO: 1622112 - protein, 9 aa, Staphylococcus aureus
DADRLSNSD

SEQ ID NO: 1622113 - protein, 25 aa, Staphylococcus aureus
DAPKTQEYAVTESQVNNIDKTVDNE

SEQ ID NO: 1622114 - protein, 11 aa, Staphylococcus aureus
DAQKQSFESQI

SEQ ID NO: 1622115 - protein, 7 aa, Staphylococcus aureus
DDDTMRA

SEQ ID NO: 1622116 - protein, 7 aa, Staphylococcus aureus
DDEEEAA

SEQ ID NO: 1622117 - protein, 8 aa, Staphylococcus aureus
DDESDKIE

SEQ ID NO: 1622118 - protein, 11 aa, Staphylococcus aureus
DDIPDRKTGLE

SEQ ID NO: 1622119 - protein, 9 aa, Staphylococcus aureus
DEELDPNGV

SEQ ID NO: 1622120 - protein, 7 aa, Staphylococcus aureus
DEGAITK

SEQ ID NO: 1622121 - protein, 4 aa, Staphylococcus aureus
DEMA

SEQ ID NO: 1622122 - protein, 10 aa, Staphylococcus aureus
DENAEKNEKL

SEQ ID NO: 1622123 - protein, 6 aa, Staphylococcus aureus
DERSRD

SEQ ID NO: 1622124 - protein, 7 aa, Staphylococcus aureus
DESLTEQ

SEQ ID NO: 1622125 - protein, 10 aa, Staphylococcus aureus
DGANGSTSSL

SEQ ID NO: 1622126 - protein, 7 aa, Staphylococcus aureus
DGGYKGE

SEQ ID NO: 1622127 - protein, 6 aa, Staphylococcus aureus
DGTIPP

SEQ ID NO: 1622128 - protein, 12 aa, Staphylococcus aureus
DGTMAKGQDLQK

SEQ ID NO: 1622129 - protein, 10 aa, Staphylococcus aureus
DGTRTSREKL

SEQ ID NO: 1622130 - protein, 4 aa, Staphylococcus aureus
DHSS

SEQ ID NO: 1622131 - protein, 11 aa, Staphylococcus aureus
DIEKRESLNLD

SEQ ID NO: 1622132 - protein, 12 aa, Staphylococcus aureus
DISKNHNEKKYR

SEQ ID NO: 1622133 - protein, 6 aa, Staphylococcus aureus
DKGDID

SEQ ID NO: 1622134 - protein, 7 aa, Staphylococcus aureus
DKQEVDH

SEQ ID NO: 1622135 - protein, 9 aa, Staphylococcus aureus
DKSKPTGQQ

SEQ ID NO: 1622136 - protein, 4 aa, Staphylococcus aureus
DLRG

SEQ ID NO: 1622137 - protein, 8 aa, Staphylococcus aureus
DLSGGEKA

SEQ ID NO: 1622138 - protein, 14 aa, Staphylococcus aureus
DNGEALEKYHQMRG

SEQ ID NO: 1622139 - protein, 8 aa, Staphylococcus aureus
DNQGKAQS

SEQ ID NO: 1622140 - protein, 4 aa, Staphylococcus aureus
DNQT

SEQ ID NO: 1622141 - protein, 13 aa, Staphylococcus aureus
DNYEADNPENQQL

SEQ ID NO: 1622142 - protein, 7 aa, Staphylococcus aureus
DPEISEA

SEQ ID NO: 1622143 - protein, 6 aa, Staphylococcus aureus
DPEQFA

SEQ ID NO: 1622144 - protein, 14 aa, Staphylococcus aureus
DPKYGPKKTLDIGG

SEQ ID NO: 1622145 - protein, 8 aa, Staphylococcus aureus
DPTPAIKT

SEQ ID NO: 1622146 - protein, 9 aa, Staphylococcus aureus
DPTPAIKTY

SEQ ID NO: 1622147 - protein, 36 aa, Staphylococcus aureus
DQIEKAKQNISAAGYQPGEEESQPSENSVDFNRDGD

SEQ ID NO: 1622148 - protein, 9 aa, Staphylococcus aureus
DQSASVEDA

SEQ ID NO: 1622149 - protein, 11 aa, Staphylococcus aureus
DQSVDETDERS

SEQ ID NO: 1622150 - protein, 7 aa, Staphylococcus aureus
DRDETMN

SEQ ID NO: 1622151 - protein, 13 aa, Staphylococcus aureus
DRLPTNEGDKRRQ

SEQ ID NO: 1622152 - protein, 16 aa, Staphylococcus aureus
DSTRISDTAKVEAKQY

SEQ ID NO: 1622153 - protein, 7 aa, Staphylococcus aureus
DTIKDQV

SEQ ID NO: 1622154 - protein, 7 aa, Staphylococcus aureus
DTNECTT

SEQ ID NO: 1622155 - protein, 8 aa, Staphylococcus aureus
DTPTTSEQ

SEQ ID NO: 1622156 - protein, 6 aa, Staphylococcus aureus
DTYDNT

SEQ ID NO: 1622157 - protein, 8 aa, Staphylococcus aureus
EASTEIDD

SEQ ID NO: 1622158 - protein, 18 aa, Staphylococcus aureus
EDATLTTLQASDASGQPV

SEQ ID NO: 1622159 - protein, 24 aa, Staphylococcus aureus
EDDKTFSDGMKNSKKQLKDKSRPY

SEQ ID NO: 1622160 - protein, 11 aa, Staphylococcus aureus
EDEAAKAYNNA

SEQ ID NO: 1622161 - protein, 10 aa, Staphylococcus aureus
EDHDNELTKE

SEQ ID NO: 1622162 - protein, 7 aa, Staphylococcus aureus
EDSSIEA

SEQ ID NO: 1622163 - protein, 53 aa, Staphylococcus aureus
EDSSMNEIEKNNAEITENVQNEAAESEQNVEEKTIENVNPKKQTEKVSTLSKR

SEQ ID NO: 1622164 - protein, 16 aa, Staphylococcus aureus
EEFNTKIESSEYRESL

SEQ ID NO: 1622165 - protein, 6 aa, Staphylococcus aureus
EEHEPW

SEQ ID NO: 1622166 - protein, 24 aa, Staphylococcus aureus
EEKSYGYSPQETTKNVKKLKRYRN

SEQ ID NO: 1622167 - protein, 7 aa, Staphylococcus aureus
EGDPVPV

SEQ ID NO: 1622168 - protein, 9 aa, Staphylococcus aureus
EGEKNHKGF

SEQ ID NO: 1622169 - protein, 13 aa, Staphylococcus aureus
EGPGLTKKMNKGI

SEQ ID NO: 1622170 - protein, 16 aa, Staphylococcus aureus
EKAESINSTYEHQTSY

SEQ ID NO: 1622171 - protein, 48 aa, Staphylococcus aureus
EKEENDVEPYGEKEVRKSNVQKFENRTSRSSKIERPEVRKSNTNDTDF

SEQ ID NO: 1622172 - protein, 11 aa, Staphylococcus aureus
EKGSASGESKV

SEQ ID NO: 1622173 - protein, 4 aa, Staphylococcus aureus
EKGV

SEQ ID NO: 1622174 - protein, 14 aa, Staphylococcus aureus
EKQARRIGESRHEA

SEQ ID NO: 1622175 - protein, 8 aa, Staphylococcus aureus
EKSVKKYE

SEQ ID NO: 1622176 - protein, 8 aa, Staphylococcus aureus
EKVPDDWR

SEQ ID NO: 1622177 - protein, 7 aa, Staphylococcus aureus
EMEQERT

SEQ ID NO: 1622178 - protein, 17 aa, Staphylococcus aureus
ENADKRRQYKKENEELD

SEQ ID NO: 1622179 - protein, 16 aa, Staphylococcus aureus
ENANNSGLKQNKIDKQ

SEQ ID NO: 1622180 - protein, 14 aa, Staphylococcus aureus
ENEIAKEKDGTSVS

SEQ ID NO: 1622181 - protein, 9 aa, Staphylococcus aureus
ENTDPKAGI

SEQ ID NO: 1622182 - protein, 5 aa, Staphylococcus aureus
EPALR

SEQ ID NO: 1622183 - protein, 17 aa, Staphylococcus aureus
EPESFDQPVDKLIIYQA

SEQ ID NO: 1622184 - protein, 7 aa, Staphylococcus aureus
EQEQPTY

SEQ ID NO: 1622185 - protein, 14 aa, Staphylococcus aureus
EQIDKGDSGTEDKI

SEQ ID NO: 1622186 - protein, 8 aa, Staphylococcus aureus
EQNANTLN

SEQ ID NO: 1622187 - protein, 7 aa, Staphylococcus aureus
EQNELPH

SEQ ID NO: 1622188 - protein, 12 aa, Staphylococcus aureus
ERVNGNPMKPKT

SEQ ID NO: 1622189 - protein, 16 aa, Staphylococcus aureus
ESKESDTQTNLNTGSK

SEQ ID NO: 1622190 - protein, 4 aa, Staphylococcus aureus
ESSK

SEQ ID NO: 1622191 - protein, 12 aa, Staphylococcus aureus
ESSMKPSNSEKM

SEQ ID NO: 1622192 - protein, 13 aa, Staphylococcus aureus
ETISRRALENTDL

SEQ ID NO: 1622193 - protein, 31 aa, Staphylococcus aureus; identical to SEQ ID NO: 1563555

SEQ ID NO: 1622194 - protein, 16 aa, Staphylococcus aureus
ETTGKKRKKLEMKLVK

SEQ ID NO: 1622195 - protein, 6 aa, Staphylococcus aureus
EVKPKH

SEQ ID NO: 1622196 - protein, 9 aa, Staphylococcus aureus
EVVERPSSV

SEQ ID NO: 1622197 - protein, 6 aa, Staphylococcus aureus
EWQTTR

SEQ ID NO: 1622198 - protein, 9 aa, Staphylococcus aureus
EYKRNKQKK

SEQ ID NO: 1622199 - protein, 6 aa, Staphylococcus aureus
FDDDNI

SEQ ID NO: 1622200 - protein, 6 aa, Staphylococcus aureus
FDKAYT

SEQ ID NO: 1622201 - protein, 20 aa, Staphylococcus aureus
FESGEWSQETAEKRGKKVRA

SEQ ID NO: 1622202 - protein, 8 aa, Staphylococcus aureus
FNSDEFNG

SEQ ID NO: 1622203 - protein, 8 aa, Staphylococcus aureus
FSASGQNR

SEQ ID NO: 1622204 - protein, 8 aa, Staphylococcus aureus
FSKEENYN

SEQ ID NO: 1622205 - protein, 14 aa, Staphylococcus aureus
FTKQAEKQKPTLGE

SEQ ID NO: 1622206 - protein, 9 aa, Staphylococcus aureus
GADVYDKKK

SEQ ID NO: 1622207 - protein, 7 aa, Staphylococcus aureus
GAGYHRN

SEQ ID NO: 1622208 - protein, 10 aa, Staphylococcus aureus
GASPAVPEIP

SEQ ID NO: 1622209 - protein, 16 aa, Staphylococcus aureus
GDMPKAPRKNRNLITL

SEQ ID NO: 1622210 - protein, 11 aa, Staphylococcus aureus
GDSDEDTEQNL

SEQ ID NO: 1622211 - protein, 38 aa, Staphylococcus aureus
GDSEDTVQTEHVGEDTASSKVHEQHTTNVKVRDIGDDK

SEQ ID NO: 1622212 - protein, 4 aa, Staphylococcus aureus
GEEI

SEQ ID NO: 1622213 - protein, 4 aa, Staphylococcus aureus
GEES

SEQ ID NO: 1622214 - protein, 6 aa, Staphylococcus aureus
GEYEEE

SEQ ID NO: 1622215 - protein, 6 aa, Staphylococcus aureus
GGAAFS

SEQ ID NO: 1622216 - protein, 12 aa, Staphylococcus aureus
GGFYKQDETIEY

SEQ ID NO: 1622217 - protein, 5 aa, Staphylococcus aureus
GGKTQ

SEQ ID NO: 1622218 - protein, 7 aa, Staphylococcus aureus
GGYLDGD

SEQ ID NO: 1622219 - protein, 10 aa, Staphylococcus aureus
GIQRRIDNGT

SEQ ID NO: 1622220 - protein, 9 aa, Staphylococcus aureus
GKRDVQGAK

SEQ ID NO: 1622221 - protein, 4 aa, Staphylococcus aureus
GMNK

SEQ ID NO: 1622222 - protein, 9 aa, Staphylococcus aureus
GNPFGGGKI

SEQ ID NO: 1622223 - protein, 29 aa, Staphylococcus aureus
GNVKETVGNVTDNKELEKEGQQDKVIGKA

SEQ ID NO: 1622224 - protein, 10 aa, Staphylococcus aureus
GNVPGDKGIE

SEQ ID NO: 1622225 - protein, 9 aa, Staphylococcus aureus
GPNKEKLDS

SEQ ID NO: 1622226 - protein, 8 aa, Staphylococcus aureus
GPPLEGAK

SEQ ID NO: 1622227 - protein, 5 aa, Staphylococcus aureus
GQAIS

SEQ ID NO: 1622228 - protein, 32 aa, Staphylococcus aureus
GRQETTYQVATDNAQDNRDNQQLNQNTATTNM

SEQ ID NO: 1622229 - protein, 14 aa, Staphylococcus aureus
GSIVNTSSFSGQAA

SEQ ID NO: 1622230 - protein, 5 aa, Staphylococcus aureus
GSKHD

SEQ ID NO: 1622231 - protein, 29 aa, Staphylococcus aureus
GVETGGDLKTAYADGGPIESGNTDGEGKI

SEQ ID NO: 1622232 - protein, 10 aa, Staphylococcus aureus
GVEVKSDEEE

SEQ ID NO: 1622233 - protein, 11 aa, Staphylococcus aureus
GVKKSERKKML

SEQ ID NO: 1622234 - protein, 8 aa, Staphylococcus aureus
GVNSARDN

SEQ ID NO: 1622235 - protein, 19 aa, Staphylococcus aureus
GYKAYEEENDSYDTQEEYK

SEQ ID NO: 1622236 - protein, 32 aa, Staphylococcus aureus; identical to SEQ ID NO: 1565237

SEQ ID NO: 1622237 - protein, 5 aa, Staphylococcus aureus
HETTG

SEQ ID NO: 1622238 - protein, 15 aa, Staphylococcus aureus
HGAENVDSITDEQSA

SEQ ID NO: 1622239 - protein, 6 aa, Staphylococcus aureus
HKPDAY

SEQ ID NO: 1622240 - protein, 16 aa, Staphylococcus aureus
HNQMPQSQITQPTHQV

SEQ ID NO: 1622241 - protein, 4 aa, Staphylococcus aureus
HPRG

SEQ ID NO: 1622242 - protein, 6 aa, Staphylococcus aureus
HSINNT

SEQ ID NO: 1622243 - protein, 21 aa, Staphylococcus aureus
IANTTPSDLLKSSKLKEAGIR

SEQ ID NO: 1622244 - protein, 8 aa, Staphylococcus aureus
IDDPEQFA

SEQ ID NO: 1622245 - protein, 18 aa, Staphylococcus aureus
IDEKIEKNYKGKRKIRTD

SEQ ID NO: 1622246 - protein, 15 aa, Staphylococcus aureus
IDGVTSAEVNLENGQ

SEQ ID NO: 1622247 - protein, 12 aa, Staphylococcus aureus
IDKTAEAKEQVN

SEQ ID NO: 1622248 - protein, 4 aa, Staphylococcus aureus
IEGI

SEQ ID NO: 1622249 - protein, 12 aa, Staphylococcus aureus
IEKAKKNSNSKD

SEQ ID NO: 1622250 - protein, 19 aa, Staphylococcus aureus
IERTKTDRYQKKHSYRGQS

SEQ ID NO: 1622251 - protein, 8 aa, Staphylococcus aureus
IESRANKA

SEQ ID NO: 1622252 - protein, 5 aa, Staphylococcus aureus
IETDE

SEQ ID NO: 1622253 - protein, 24 aa, Staphylococcus aureus
IGTPISTDNASWGRTSIKKYFFFS

SEQ ID NO: 1622254 - protein, 12 aa, Staphylococcus aureus
IKPVSKEGTERL

SEQ ID NO: 1622255 - protein, 12 aa, Staphylococcus aureus
IKQNADALNNAM

SEQ ID NO: 1622256 - protein, 6 aa, Staphylococcus aureus
ILPTND

SEQ ID NO: 1622257 - protein, 12 aa, Staphylococcus aureus
INGERNIRRILN

SEQ ID NO: 1622258 - protein, 11 aa, Staphylococcus aureus
INNDKNNAIAE

SEQ ID NO: 1622259 - protein, 17 aa, Staphylococcus aureus
INQTGNPTLDKSQVEQL

SEQ ID NO: 1622260 - protein, 6 aa, Staphylococcus aureus
INTNNV

SEQ ID NO: 1622261 - protein, 6 aa, Staphylococcus aureus
IPDSEL

SEQ ID NO: 1622262 - protein, 15 aa, Staphylococcus aureus
IPTADYKEVERKKDA

SEQ ID NO: 1622263 - protein, 21 aa, Staphylococcus aureus
IQNEDCTQIRKQTRKKRTEIK

SEQ ID NO: 1622264 - protein, 15 aa, Staphylococcus aureus
IQNHESKLNENSKTL

SEQ ID NO: 1622265 - protein, 10 aa, Staphylococcus aureus
IQVNGQNITS

SEQ ID NO: 1622266 - protein, 21 aa, Staphylococcus aureus
IRSEATKEDKYQVYDVILAGV

SEQ ID NO: 1622267 - protein, 9 aa, Staphylococcus aureus
ISASKSSLQ

SEQ ID NO: 1622268 - protein, 15 aa, Staphylococcus aureus
ISGTPNANVDPQQVA

SEQ ID NO: 1622269 - protein, 16 aa, Staphylococcus aureus
ISKRNSTGNASWGGTT

SEQ ID NO: 1622270 - protein, 12 aa, Staphylococcus aureus
ISTNPDVSIPKE

SEQ ID NO: 1622271 - protein, 39 aa, Staphylococcus aureus
ITDKYGESYTSKRKASGKQGDQDAHEAIRPSSTMRTPDD

SEQ ID NO: 1622272 - protein, 12 aa, Staphylococcus aureus
IYSQNQVTRQLG

SEQ ID NO: 1622273 - protein, 8 aa, Staphylococcus aureus
KAAANIGD

SEQ ID NO: 1622274 - protein, 6 aa, Staphylococcus aureus
KAMGGI

SEQ ID NO: 1622275 - protein, 8 aa, Staphylococcus aureus
KANENGAK

SEQ ID NO: 1622276 - protein, 12 aa, Staphylococcus aureus
KAQQESYSPYSQ

SEQ ID NO: 1622277 - protein, 6 aa, Staphylococcus aureus
KAQQIN

SEQ ID NO: 1622278 - protein, 21 aa, Staphylococcus aureus
KASSENFGEESDDAKNSIKVA

SEQ ID NO: 1622279 - protein, 11 aa, Staphylococcus aureus
KCNNEAELKEG

SEQ ID NO: 1622280 - protein, 9 aa, Staphylococcus aureus
KDDDNGTDY

SEQ ID NO: 1622281 - protein, 5 aa, Staphylococcus aureus
KDIEN

SEQ ID NO: 1622282 - protein, 9 aa, Staphylococcus aureus
KDLSKKGYL

SEQ ID NO: 1622283 - protein, 6 aa, Staphylococcus aureus
KDNGLK

SEQ ID NO: 1622284 - protein, 7 aa, Staphylococcus aureus
KDNQPHT

SEQ ID NO: 1622285 - protein, 8 aa, Staphylococcus aureus
KDPEGNKY

SEQ ID NO: 1622286 - protein, 6 aa, Staphylococcus aureus
KDQSQT

SEQ ID NO: 1622287 - protein, 5 aa, Staphylococcus aureus
KEDKI

SEQ ID NO: 1622288 - protein, 5 aa, Staphylococcus aureus
KEEEP

SEQ ID NO: 1622289 - protein, 15 aa, Staphylococcus aureus
KEEITADSAEQKSIA

SEQ ID NO: 1622290 - protein, 5 aa, Staphylococcus aureus
KEELK

SEQ ID NO: 1622291 - protein, 5 aa, Staphylococcus aureus
KEFSN

SEQ ID NO: 1622292 - protein, 25 aa, Staphylococcus aureus
KEGHVGKSDQVDTQTPMNPTTNYGI

SEQ ID NO: 1622293 - protein, 4 aa, Staphylococcus aureus
KELE

SEQ ID NO: 1622294 - protein, 9 aa, Staphylococcus aureus
KELSKKGYL

SEQ ID NO: 1622295 - protein, 6 aa, Staphylococcus aureus
KEMIGD

SEQ ID NO: 1622296 - protein, 7 aa, Staphylococcus aureus
KENLEEA

SEQ ID NO: 1622297 - protein, 13 aa, Staphylococcus aureus
KEREGKYQVEVKE

SEQ ID NO: 1622298 - protein, 5 aa, Staphylococcus aureus
KETEI

SEQ ID NO: 1622299 - protein, 24 aa, Staphylococcus aureus
KETTANKLRSAVKPVKQDKLSKGK

SEQ ID NO: 1622300 - protein, 19 aa, Staphylococcus aureus
KEVVENAKNKITDAIDKLK

SEQ ID NO: 1622301 - protein, 6 aa, Staphylococcus aureus
KEYRAT

SEQ ID NO: 1622302 - protein, 18 aa, Staphylococcus aureus
KFDDYSERKSKYEEQKSI

SEQ ID NO: 1622303 - protein, 5 aa, Staphylococcus aureus
KGDFT

SEQ ID NO: 1622304 - protein, 20 aa, Staphylococcus aureus
KGDNVQDAQRDAYKKVSQIQ

SEQ ID NO: 1622305 - protein, 6 aa, Staphylococcus aureus
KGVTDD

SEQ ID NO: 1622306 - protein, 9 aa, Staphylococcus aureus
KGWTSPAKA

SEQ ID NO: 1622307 - protein, 20 aa, Staphylococcus aureus
KGYTSYAPQYEGHAAPPDEI

SEQ ID NO: 1622308 - protein, 7 aa, Staphylococcus aureus
KHLDEEE

SEQ ID NO: 1622309 - protein, 6 aa, Staphylococcus aureus
KIGTSK

SEQ ID NO: 1622310 - protein, 20 aa, Staphylococcus aureus
KIQPTGTDQLERMKYDESYW

SEQ ID NO: 1622311 - protein, 7 aa, Staphylococcus aureus
KKGNLTK

SEQ ID NO: 1622312 - protein, 12 aa, Staphylococcus aureus
KKLQEKNKFPKN

SEQ ID NO: 1622313 - protein, 6 aa, Staphylococcus aureus
KKPGNY

SEQ ID NO: 1622314 - protein, 6 aa, Staphylococcus aureus
KKQKSG

SEQ ID NO: 1622315 - protein, 6 aa, Staphylococcus aureus
KKTKNL

SEQ ID NO: 1622316 - protein, 7 aa, Staphylococcus aureus
KKTYDIG

SEQ ID NO: 1622317 - protein, 15 aa, Staphylococcus aureus
KLERERKKEAELRRK

SEQ ID NO: 1622318 - protein, 13 aa, Staphylococcus aureus
KLKEKEERSAIVE

SEQ ID NO: 1622319 - protein, 7 aa, Staphylococcus aureus
KLKGNSY

SEQ ID NO: 1622320 - protein, 11 aa, Staphylococcus aureus
KMNNSDKNVKK

SEQ ID NO: 1622321 - protein, 14 aa, Staphylococcus aureus
KMTKKERQKTIDNI

SEQ ID NO: 1622322 - protein, 21 aa, Staphylococcus aureus
KNDGYTSDKSRQTLSEKETYL

SEQ ID NO: 1622323 - protein, 8 aa, Staphylococcus aureus
KNDSNTED

SEQ ID NO: 1622324 - protein, 11 aa, Staphylococcus aureus
KNGTPEEKAEI

SEQ ID NO: 1622325 - protein, 7 aa, Staphylococcus aureus
KNNNVKN

SEQ ID NO: 1622326 - protein, 10 aa, Staphylococcus aureus
KNPPTREQLE

SEQ ID NO: 1622327 - protein, 6 aa, Staphylococcus aureus
KNQERL

SEQ ID NO: 1622328 - protein, 17 aa, Staphylococcus aureus
KNSMTTEYGRGTGAYGD

SEQ ID NO: 1622329 - protein, 19 aa, Staphylococcus aureus
KNYQDGNITTNENVPSYEA

SEQ ID NO: 1622330 - protein, 17 aa, Staphylococcus aureus
KPDYQDKSYLRIYGEVV

SEQ ID NO: 1622331 - protein, 4 aa, Staphylococcus aureus
KPTI

SEQ ID NO: 1622332 - protein, 8 aa, Staphylococcus aureus
KPTKRQLK

SEQ ID NO: 1622333 - protein, 7 aa, Staphylococcus aureus
KQGYDLK

SEQ ID NO: 1622334 - protein, 5 aa, Staphylococcus aureus
KQQEV

SEQ ID NO: 1622335 - protein, 13 aa, Staphylococcus aureus
KQTKQTPSDNQLK

SEQ ID NO: 1622336 - protein, 11 aa, Staphylococcus aureus
KRGKSPLNPNN

SEQ ID NO: 1622337 - protein, 8 aa, Staphylococcus aureus
KRNIDKEK

SEQ ID NO: 1622338 - protein, 11 aa, Staphylococcus aureus
KRNSPTSHSIN

SEQ ID NO: 1622339 - protein, 9 aa, Staphylococcus aureus
KSGHRGTVE

SEQ ID NO: 1622340 - protein, 12 aa, Staphylococcus aureus
KSNESTTQQQYK

SEQ ID NO: 1622341 - protein, 11 aa, Staphylococcus aureus
KSRTGTTGQTQ

SEQ ID NO: 1622342 - protein, 6 aa, Staphylococcus aureus
KSTYSK

SEQ ID NO: 1622343 - protein, 12 aa, Staphylococcus aureus
KTGSLTGFGGTI

SEQ ID NO: 1622344 - protein, 5 aa, Staphylococcus aureus
KTVKS

SEQ ID NO: 1622345 - protein, 20 aa, Staphylococcus aureus
KVAEERQLKTNEVYNIYHQI

SEQ ID NO: 1622346 - protein, 10 aa, Staphylococcus aureus
KVEQNGKSTS

SEQ ID NO: 1622347 - protein, 7 aa, Staphylococcus aureus
KVNGKRF

SEQ ID NO: 1622348 - protein, 8 aa, Staphylococcus aureus
KVNRIQGD

SEQ ID NO: 1622349 - protein, 13 aa, Staphylococcus aureus
KVSSSSTIISATD

SEQ ID NO: 1622350 - protein, 9 aa, Staphylococcus aureus
KYQKNNTEF

SEQ ID NO: 1622351 - protein, 16 aa, Staphylococcus aureus
LADGSMKRYEALKRIE

SEQ ID NO: 1622352 - protein, 15 aa, Staphylococcus aureus
LDADESKRNAYTQAV

SEQ ID NO: 1622353 - protein, 5 aa, Staphylococcus aureus
LDCSE

SEQ ID NO: 1622354 - protein, 8 aa, Staphylococcus aureus
LDTEEGKR

SEQ ID NO: 1622355 - protein, 15 aa, Staphylococcus aureus
LEQAGAKDVSADFRR

SEQ ID NO: 1622356 - protein, 7 aa, Staphylococcus aureus
LGKPEEV

SEQ ID NO: 1622357 - protein, 7 aa, Staphylococcus aureus
LGPKPQH

SEQ ID NO: 1622358 - protein, 4 aa, Staphylococcus aureus
LGTI

SEQ ID NO: 1622359 - protein, 27 aa, Staphylococcus aureus
LKDGDRNSHAQRTVGGEDRLPDDDGGH

SEQ ID NO: 1622360 - protein, 9 aa, Staphylococcus aureus
LKEAIERSA

SEQ ID NO: 1622361 - protein, 10 aa, Staphylococcus aureus
LKKNQTSINK

SEQ ID NO: 1622362 - protein, 49 aa, Staphylococcus aureus
LKPVQSKQAVSERMPASQATPSSRSDSQESNTNAYKTNNMTSNNVENNQ

SEQ ID NO: 1622363 - protein, 12 aa, Staphylococcus aureus
LKQNANKQQVDQ

SEQ ID NO: 1622364 - protein, 9 aa, Staphylococcus aureus
LKQQADTIL

SEQ ID NO: 1622365 - protein, 11 aa, Staphylococcus aureus
LKTSGNPKFKK

SEQ ID NO: 1622366 - protein, 8 aa, Staphylococcus aureus
LKTSKTPK

SEQ ID NO: 1622367 - protein, 10 aa, Staphylococcus aureus
LKVSTTPDAS

SEQ ID NO: 1622368 - protein, 7 aa, Staphylococcus aureus
LLGEPND

SEQ ID NO: 1622369 - protein, 8 aa, Staphylococcus aureus
LNEKEKRI

SEQ ID NO: 1622370 - protein, 13 aa, Staphylococcus aureus
LNEPNTDDTGKIK

SEQ ID NO: 1622371 - protein, 12 aa, Staphylococcus aureus
LNQGAKPSGIGK

SEQ ID NO: 1622372 - protein, 9 aa, Staphylococcus aureus
LPDKNNDWI

SEQ ID NO: 1622373 - protein, 13 aa, Staphylococcus aureus
LQNDKDHAKQTVS

SEQ ID NO: 1622374 - protein, 4 aa, Staphylococcus aureus
LQNY

SEQ ID NO: 1622375 - protein, 8 aa, Staphylococcus aureus
LSNQPKNA

SEQ ID NO: 1622376 - protein, 4 aa, Staphylococcus aureus
LSNV

SEQ ID NO: 1622377 - protein, 11 aa, Staphylococcus aureus
LSSNDKKNYTG

SEQ ID NO: 1622378 - protein, 14 aa, Staphylococcus aureus
LTEQQAKEKGYDVK

SEQ ID NO: 1622379 - protein, 12 aa, Staphylococcus aureus
LTKKGWSRMDSK

SEQ ID NO: 1622380 - protein, 21 aa, Staphylococcus aureus
LTPAQQQALENQINNATTRDK

SEQ ID NO: 1622381 - protein, 11 aa, Staphylococcus aureus
LTPRERKQQMK

SEQ ID NO: 1622382 - protein, 4 aa, Staphylococcus aureus
LTSK

SEQ ID NO: 1622383 - protein, 4 aa, Staphylococcus aureus
LTYD

SEQ ID NO: 1622384 - protein, 6 aa, Staphylococcus aureus
LWPQPG

SEQ ID NO: 1622385 - protein, 9 aa, Staphylococcus aureus
MESSNFKNK

SEQ ID NO: 1622386 - protein, 9 aa, Staphylococcus aureus
MKVKSDDQV

SEQ ID NO: 1622387 - protein, 10 aa, Staphylococcus aureus
MNAKRISNTI

SEQ ID NO: 1622388 - protein, 20 aa, Staphylococcus aureus
MNNDNESTDYLKQTDQLSNQ

SEQ ID NO: 1622389 - protein, 10 aa, Staphylococcus aureus
MRDSNDNSLK

SEQ ID NO: 1622390 - protein, 22 aa, Staphylococcus aureus
MSQNEGKSVDALKNSTASLKNN

SEQ ID NO: 1622391 - protein, 29 aa, Staphylococcus aureus
MTAHSSDDDDQYRTKEEREALKKADCNEK

SEQ ID NO: 1622392 - protein, 9 aa, Staphylococcus aureus
NAAPTRTEV

SEQ ID NO: 1622393 - protein, 11 aa, Staphylococcus aureus
NADKSKLSGVE

SEQ ID NO: 1622394 - protein, 5 aa, Staphylococcus aureus
NAIQD

SEQ ID NO: 1622395 - protein, 11 aa, Staphylococcus aureus
NAKHNLTNSEI

SEQ ID NO: 1622396 - protein, 4 aa, Staphylococcus aureus
NAQR

SEQ ID NO: 1622397 - protein, 16 aa, Staphylococcus aureus
NASDNYDDNVERLWER

SEQ ID NO: 1622398 - protein, 12 aa, Staphylococcus aureus
NDQGIHKRGAEI

SEQ ID NO: 1622399 - protein, 7 aa, Staphylococcus aureus
NEDEGKY

SEQ ID NO: 1622400 - protein, 6 aa, Staphylococcus aureus
NEFNKR

SEQ ID NO: 1622401 - protein, 7 aa, Staphylococcus aureus
NEGEGKR

SEQ ID NO: 1622402 - protein, 5 aa, Staphylococcus aureus
NELNA

SEQ ID NO: 1622403 - protein, 5 aa, Staphylococcus aureus
NFSRN

SEQ ID NO: 1622404 - protein, 30 aa, Staphylococcus aureus; identical to SEQ ID NO: 1563971

SEQ ID NO: 1622405 - protein, 21 aa, Staphylococcus aureus
NGLAQNNPFTGLQTSTGAADL

SEQ ID NO: 1622406 - protein, 8 aa, Staphylococcus aureus
NGYEYKDG

SEQ ID NO: 1622407 - protein, 5 aa, Staphylococcus aureus
NHTSD

SEQ ID NO: 1622408 - protein, 10 aa, Staphylococcus aureus
NHVDSEDKLT

SEQ ID NO: 1622409 - protein, 19 aa, Staphylococcus aureus
NINYEDKTLDIDGTINWIT

SEQ ID NO: 1622410 - protein, 13 aa, Staphylococcus aureus
NITKTGNGNSKIT

SEQ ID NO: 1622411 - protein, 8 aa, Staphylococcus aureus
NKLNNSFD

SEQ ID NO: 1622412 - protein, 16 aa, Staphylococcus aureus
NKNSGSNLDKAAVENA

SEQ ID NO: 1622413 - protein, 4 aa, Staphylococcus aureus
NKQI

SEQ ID NO: 1622414 - protein, 12 aa, Staphylococcus aureus
NKQSGTNEVQAQ

SEQ ID NO: 1622415 - protein, 16 aa, Staphylococcus aureus
NKQTGGNTSKADVDNA

SEQ ID NO: 1622416 - protein, 9 aa, Staphylococcus aureus
NKRADGKHH

SEQ ID NO: 1622417 - protein, 17 aa, Staphylococcus aureus
NKRAEQTQKWQCKYFFE

SEQ ID NO: 1622418 - protein, 5 aa, Staphylococcus aureus
NKRGY

SEQ ID NO: 1622419 - protein, 9 aa, Staphylococcus aureus
NLGSNDKLN

SEQ ID NO: 1622420 - protein, 16 aa, Staphylococcus aureus
NLNNAQKGAVTGNINQ

SEQ ID NO: 1622421 - protein, 16 aa, Staphylococcus aureus
NLNQAQRDEYSKQITQ

SEQ ID NO: 1622422 - protein, 4 aa, Staphylococcus aureus
NLNS

SEQ ID NO: 1622423 - protein, 19 aa, Staphylococcus aureus
NNAQQDGFKGRIDQSNDLN

SEQ ID NO: 1622424 - protein, 18 aa, Staphylococcus aureus
NNAQRTAANAEVDQAPNL

SEQ ID NO: 1622425 - protein, 7 aa, Staphylococcus aureus
NNDKVNN

SEQ ID NO: 1622426 - protein, 9 aa, Staphylococcus aureus
NNEGKQYKH

SEQ ID NO: 1622427 - protein, 16 aa, Staphylococcus aureus
NNRFKYDNSRGNRNEN

SEQ ID NO: 1622428 - protein, 4 aa, Staphylococcus aureus
NNRG

SEQ ID NO: 1622429 - protein, 4 aa, Staphylococcus aureus
NNRK

SEQ ID NO: 1622430 - protein, 10 aa, Staphylococcus aureus
NNSQATNKRL

SEQ ID NO: 1622431 - protein, 15 aa, Staphylococcus aureus
NNTDEQDKLMNLVMK

SEQ ID NO: 1622432 - protein, 5 aa, Staphylococcus aureus
NPVID

SEQ ID NO: 1622433 - protein, 12 aa, Staphylococcus aureus
NQAKENDKNYPG

SEQ ID NO: 1622434 - protein, 10 aa, Staphylococcus aureus
NQIDKEKENL

SEQ ID NO: 1622435 - protein, 4 aa, Staphylococcus aureus
NQQH

SEQ ID NO: 1622436 - protein, 15 aa, Staphylococcus aureus
NQSEMNDDDELEVGE

SEQ ID NO: 1622437 - protein, 10 aa, Staphylococcus aureus
NSDNTNVNDI

SEQ ID NO: 1622438 - protein, 4 aa, Staphylococcus aureus
NSEI

SEQ ID NO: 1622439 - protein, 11 aa, Staphylococcus aureus
NSGKDYKHLEK

SEQ ID NO: 1622440 - protein, 5 aa, Staphylococcus aureus
NSIER

SEQ ID NO: 1622441 - protein, 16 aa, Staphylococcus aureus
NSLSSSKIKNLAKEND

SEQ ID NO: 1622442 - protein, 5 aa, Staphylococcus aureus
NSQGK

SEQ ID NO: 1622443 - protein, 11 aa, Staphylococcus aureus
NSVDDEDSEIG

SEQ ID NO: 1622444 - protein, 11 aa, Staphylococcus aureus
NTAEGAEDNLP

SEQ ID NO: 1622445 - protein, 7 aa, Staphylococcus aureus
NTDQAAS

SEQ ID NO: 1622446 - protein, 6 aa, Staphylococcus aureus
NTKTNK

SEQ ID NO: 1622447 - protein, 28 aa, Staphylococcus aureus
NVNPSLRDATVNNYKPQNEKQVQAKQTA

SEQ ID NO: 1622448 - protein, 10 aa, Staphylococcus aureus
NYEKNQNALP

SEQ ID NO: 1622449 - protein, 39 aa, Staphylococcus aureus
NYKDTHSYKDRLNAQQKVNTLSAGHQKRFNKQINKVYNG

SEQ ID NO: 1622450 - protein, 12 aa, Staphylococcus aureus
NYPRDVSTNGTV

SEQ ID NO: 1622451 - protein, 12 aa, Staphylococcus aureus
PADAKPSSNPGE

SEQ ID NO: 1622452 - protein, 9 aa, Staphylococcus aureus
PAETDLDPV

SEQ ID NO: 1622453 - protein, 5 aa, Staphylococcus aureus
PASLG

SEQ ID NO: 1622454 - protein, 8 aa, Staphylococcus aureus
PCHGTGKS

SEQ ID NO: 1622455 - protein, 8 aa, Staphylococcus aureus
PDGKERFE

SEQ ID NO: 1622456 - protein, 6 aa, Staphylococcus aureus
PEYEPM

SEQ ID NO: 1622457 - protein, 6 aa, Staphylococcus aureus
PGKMTE

SEQ ID NO: 1622458 - protein, 10 aa, Staphylococcus aureus
PGNHELKDTN

SEQ ID NO: 1622459 - protein, 5 aa, Staphylococcus aureus
PHNFP

SEQ ID NO: 1622460 - protein, 4 aa, Staphylococcus aureus
PKGA

SEQ ID NO: 1622461 - protein, 12 aa, Staphylococcus aureus
PKNSNDTQQDLY

SEQ ID NO: 1622462 - protein, 5 aa, Staphylococcus aureus
PKSAI

SEQ ID NO: 1622463 - protein, 5 aa, Staphylococcus aureus
PKYDD

SEQ ID NO: 1622464 - protein, 4 aa, Staphylococcus aureus
PNDS

SEQ ID NO: 1622465 - protein, 5 aa, Staphylococcus aureus
PNTDA

SEQ ID NO: 1622466 - protein, 4 aa, Staphylococcus aureus
PPTK

SEQ ID NO: 1622467 - protein, 9 aa, Staphylococcus aureus
PSDQRGKTL

SEQ ID NO: 1622468 - protein, 12 aa, Staphylococcus aureus
PSGVGKTELAKE

SEQ ID NO: 1622469 - protein, 7 aa, Staphylococcus aureus
PTEYGTL

SEQ ID NO: 1622470 - protein, 8 aa, Staphylococcus aureus
PTNGEPIK

SEQ ID NO: 1622471 - protein, 8 aa, Staphylococcus aureus
QALNGDER

SEQ ID NO: 1622472 - protein, 16 aa, Staphylococcus aureus
QAPTDKAIQRIDEPDK

SEQ ID NO: 1622473 - protein, 4 aa, Staphylococcus aureus
QATF

SEQ ID NO: 1622474 - protein, 8 aa, Staphylococcus aureus
QEGGHTIE

SEQ ID NO: 1622475 - protein, 5 aa, Staphylococcus aureus
QEKSE

SEQ ID NO: 1622476 - protein, 8 aa, Staphylococcus aureus
QETQKSGA

SEQ ID NO: 1622477 - protein, 6 aa, Staphylococcus aureus
QEVDSI

SEQ ID NO: 1622478 - protein, 9 aa, Staphylococcus aureus
QGASGQARN

SEQ ID NO: 1622479 - protein, 29 aa, Staphylococcus aureus
QGIADKDQTKANGNFVNADTDKQNAYNNA

SEQ ID NO: 1622480 - protein, 34 aa, Staphylococcus aureus; identical to SEQ ID NO: 1563333

SEQ ID NO: 1622481 - protein, 4 aa, Staphylococcus aureus
QGVS

SEQ ID NO: 1622482 - protein, 8 aa, Staphylococcus aureus
QHNTNNAK

SEQ ID NO: 1622483 - protein, 7 aa, Staphylococcus aureus
QHPESSV

SEQ ID NO: 1622484 - protein, 11 aa, Staphylococcus aureus
QIKGSTEISAK

SEQ ID NO: 1622485 - protein, 9 aa, Staphylococcus aureus
QITQPTHQV

SEQ ID NO: 1622486 - protein, 14 aa, Staphylococcus aureus
QKGKHYGATWQDKE

SEQ ID NO: 1622487 - protein, 44 aa, Staphylococcus aureus
QKIKNNDFTRKNLTTEGNKTRWSKAKCNNSSKYKGVSWDKKNNN

SEQ ID NO: 1622488 - protein, 7 aa, Staphylococcus aureus
QKRDLSH

SEQ ID NO: 1622489 - protein, 6 aa, Staphylococcus aureus
QLPRED

SEQ ID NO: 1622490 - protein, 12 aa, Staphylococcus aureus
QNGINDQNTVKQ

SEQ ID NO: 1622491 - protein, 10 aa, Staphylococcus aureus
QPEDVENAPT

SEQ ID NO: 1622492 - protein, 6 aa, Staphylococcus aureus
QPENRK

SEQ ID NO: 1622493 - protein, 6 aa, Staphylococcus aureus
QPIGEN

SEQ ID NO: 1622494 - protein, 13 aa, Staphylococcus aureus
QQIQANSQVPQSV

SEQ ID NO: 1622495 - protein, 13 aa, Staphylococcus aureus
QQKEKESSYENPQ

SEQ ID NO: 1622496 - protein, 22 aa, Staphylococcus aureus
QQSTTVAEAQGNEQKANNVDAA

SEQ ID NO: 1622497 - protein, 5 aa, Staphylococcus aureus
QRAES

SEQ ID NO: 1622498 - protein, 11 aa, Staphylococcus aureus
QRSDCTTCGDV

SEQ ID NO: 1622499 - protein, 13 aa, Staphylococcus aureus
QSMETKELNSKEK

SEQ ID NO: 1622500 - protein, 5 aa, Staphylococcus aureus
QTATE

SEQ ID NO: 1622501 - protein, 8 aa, Staphylococcus aureus
QTFDQGEA

SEQ ID NO: 1622502 - protein, 24 aa, Staphylococcus aureus
QTFDSNDGTTVQNYENKASDDYYD

SEQ ID NO: 1622503 - protein, 10 aa, Staphylococcus aureus
QTGHSKVSGI

SEQ ID NO: 1622504 - protein, 4 aa, Staphylococcus aureus
QTQK

SEQ ID NO: 1622505 - protein, 17 aa, Staphylococcus aureus
QVDSYNDDKNSNLNGAA

SEQ ID NO: 1622506 - protein, 12 aa, Staphylococcus aureus
QVSERTRLGQSQ

SEQ ID NO: 1622507 - protein, 18 aa, Staphylococcus aureus
QYEENECKKQEQLNEEIN

SEQ ID NO: 1622508 - protein, 8 aa, Staphylococcus aureus
QYGKEAVS

SEQ ID NO: 1622509 - protein, 5 aa, Staphylococcus aureus
RAQTS

SEQ ID NO: 1622510 - protein, 43 aa, Staphylococcus aureus
RAVTPQNHVTHGPKDSMVRSEGKHSISSHEMNSSKYVESPNYT

SEQ ID NO: 1622511 - protein, 4 aa, Staphylococcus aureus
RDDD

SEQ ID NO: 1622512 - protein, 33 aa, Staphylococcus aureus; identical to SEQ ID NO: 1564182

SEQ ID NO: 1622513 - protein, 16 aa, Staphylococcus aureus
RDSIRANAIAPGTIET

SEQ ID NO: 1622514 - protein, 11 aa, Staphylococcus aureus
REDKADNRAID

SEQ ID NO: 1622515 - protein, 9 aa, Staphylococcus aureus
REDTPNTLI

SEQ ID NO: 1622516 - protein, 10 aa, Staphylococcus aureus
REGEDEQTAI

SEQ ID NO: 1622517 - protein, 10 aa, Staphylococcus aureus
REVESKYTAD

SEQ ID NO: 1622518 - protein, 13 aa, Staphylococcus aureus
RGGKTDYSPNAMS

SEQ ID NO: 1622519 - protein, 7 aa, Staphylococcus aureus
RGTVGGT

SEQ ID NO: 1622520 - protein, 28 aa, Staphylococcus aureus
RIHNKRQPQMSKIDKSRQYVRREKTPKW

SEQ ID NO: 1622521 - protein, 12 aa, Staphylococcus aureus
RISWGTSDQNLS

SEQ ID NO: 1622522 - protein, 13 aa, Staphylococcus aureus
RISWGTSDQNLSK

SEQ ID NO: 1622523 - protein, 16 aa, Staphylococcus aureus
RKKNIESKTKVIKSLG

SEQ ID NO: 1622524 - protein, 5 aa, Staphylococcus aureus
RMLEE

SEQ ID NO: 1622525 - protein, 9 aa, Staphylococcus aureus
RNKPELPTV

SEQ ID NO: 1622526 - protein, 15 aa, Staphylococcus aureus
RNNIVGDGYDSVNYG

SEQ ID NO: 1622527 - protein, 24 aa, Staphylococcus aureus
RQQEPPKNKTRQAYEDVIEWVGPK

SEQ ID NO: 1622528 - protein, 5 aa, Staphylococcus aureus
RQSRV

SEQ ID NO: 1622529 - protein, 5 aa, Staphylococcus aureus
RRERR

SEQ ID NO: 1622530 - protein, 7 aa, Staphylococcus aureus
RSGSAIN

SEQ ID NO: 1622531 - protein, 29 aa, Staphylococcus aureus
RSNPLNKSFEKSGASEKLKSTLSEKAKKK

SEQ ID NO: 1622532 - protein, 4 aa, Staphylococcus aureus
RTRE

SEQ ID NO: 1622533 - protein, 12 aa, Staphylococcus aureus
RTTGEASAKCHE

SEQ ID NO: 1622534 - protein, 15 aa, Staphylococcus aureus
RYDKTKLDLNDKESF

SEQ ID NO: 1622535 - protein, 14 aa, Staphylococcus aureus
RYEESGPTNGSCCN

SEQ ID NO: 1622536 - protein, 9 aa, Staphylococcus aureus
SAAKGYASL

SEQ ID NO: 1622537 - protein, 13 aa, Staphylococcus aureus
SAGVKTGKKGEVL

SEQ ID NO: 1622538 - protein, 18 aa, Staphylococcus aureus
SASASASAGINGNITGER

SEQ ID NO: 1622539 - protein, 4 aa, Staphylococcus aureus
SASK

SEQ ID NO: 1622540 - protein, 47 aa, Staphylococcus aureus; identical to SEQ ID NO: 1564006

SEQ ID NO: 1622541 - protein, 11 aa, Staphylococcus aureus
SDAQKRSNATN

SEQ ID NO: 1622542 - protein, 10 aa, Staphylococcus aureus
SDASSEISQT

SEQ ID NO: 1622543 - protein, 7 aa, Staphylococcus aureus
SDNGENI

SEQ ID NO: 1622544 - protein, 12 aa, Staphylococcus aureus
SEAKRKEATQKY

SEQ ID NO: 1622545 - protein, 4 aa, Staphylococcus aureus
SEND

SEQ ID NO: 1622546 - protein, 9 aa, Staphylococcus aureus
SENTGYPFV

SEQ ID NO: 1622547 - protein, 7 aa, Staphylococcus aureus
SETSSKL

SEQ ID NO: 1622548 - protein, 6 aa, Staphylococcus aureus
SFQETT

SEQ ID NO: 1622549 - protein, 22 aa, Staphylococcus aureus
SGAHGKARQITESIDPNHYYPN

SEQ ID NO: 1622550 - protein, 5 aa, Staphylococcus aureus
SGDSM

SEQ ID NO: 1622551 - protein, 5 aa, Staphylococcus aureus
SGKEP

SEQ ID NO: 1622552 - protein, 7 aa, Staphylococcus aureus
SGKEVKN

SEQ ID NO: 1622553 - protein, 7 aa, Staphylococcus aureus
SGKHAFS

SEQ ID NO: 1622554 - protein, 8 aa, Staphylococcus aureus
SGMDTGEI

SEQ ID NO: 1622555 - protein, 18 aa, Staphylococcus aureus
SGNVDSNRLRTGTMTEKD

SEQ ID NO: 1622556 - protein, 15 aa, Staphylococcus aureus
SHKKISKKEANKLAK

SEQ ID NO: 1622557 - protein, 7 aa, Staphylococcus aureus
SHTTEQA

SEQ ID NO: 1622558 - protein, 7 aa, Staphylococcus aureus
SIENEDC

SEQ ID NO: 1622559 - protein, 22 aa, Staphylococcus aureus
SKGSLAGVDGRLQTRSYENKVG

SEQ ID NO: 1622560 - protein, 7 aa, Staphylococcus aureus
SKTSKVI

SEQ ID NO: 1622561 - protein, 8 aa, Staphylococcus aureus
SKTSKVIE

SEQ ID NO: 1622562 - protein, 5 aa, Staphylococcus aureus
SLEPW

SEQ ID NO: 1622563 - protein, 10 aa, Staphylococcus aureus
SLKTNDVNDN

SEQ ID NO: 1622564 - protein, 10 aa, Staphylococcus aureus
SNKAKETKKR

SEQ ID NO: 1622565 - protein, 9 aa, Staphylococcus aureus
SNKKIGEPL

SEQ ID NO: 1622566 - protein, 9 aa, Staphylococcus aureus
SNKNGTNYD

SEQ ID NO: 1622567 - protein, 11 aa, Staphylococcus aureus
SNNEKEALEEK

SEQ ID NO: 1622568 - protein, 4 aa, Staphylococcus aureus
SNSF

SEQ ID NO: 1622569 - protein, 4 aa, Staphylococcus aureus
SPQH

SEQ ID NO: 1622570 - protein, 7 aa, Staphylococcus aureus
SPSAAQD

SEQ ID NO: 1622571 - protein, 15 aa, Staphylococcus aureus
SQLNTNKTKKKNMAN

SEQ ID NO: 1622572 - protein, 28 aa, Staphylococcus aureus
SQVTNAKGALNGNHNLEQAKSNANTTIN

SEQ ID NO: 1622573 - protein, 5 aa, Staphylococcus aureus
SRAEA

SEQ ID NO: 1622574 - protein, 8 aa, Staphylococcus aureus
SRCSGTGA

SEQ ID NO: 1622575 - protein, 17 aa, Staphylococcus aureus
SRKEGGKIFGSGSRAPI

SEQ ID NO: 1622576 - protein, 6 aa, Staphylococcus aureus
SRKIHS

SEQ ID NO: 1622577 - protein, 9 aa, Staphylococcus aureus
SRNKAPKAL

SEQ ID NO: 1622578 - protein, 14 aa, Staphylococcus aureus
SSDGEAKKYGFDKK

SEQ ID NO: 1622579 - protein, 5 aa, Staphylococcus aureus
SSREN

SEQ ID NO: 1622580 - protein, 13 aa, Staphylococcus aureus
STGLKDKNNNEIY

SEQ ID NO: 1622581 - protein, 18 aa, Staphylococcus aureus
STGRKHTHITRAKSNQSF

SEQ ID NO: 1622582 - protein, 6 aa, Staphylococcus aureus
STIGEK

SEQ ID NO: 1622583 - protein, 10 aa, Staphylococcus aureus
STLTTRQSEI

SEQ ID NO: 1622584 - protein, 5 aa, Staphylococcus aureus
SYQDG

SEQ ID NO: 1622585 - protein, 10 aa, Staphylococcus aureus
TAQLKGKDDM

SEQ ID NO: 1622586 - protein, 9 aa, Staphylococcus aureus
TARGEHTEV

SEQ ID NO: 1622587 - protein, 14 aa, Staphylococcus aureus
TCENKENKNEVSRA

SEQ ID NO: 1622588 - protein, 15 aa, Staphylococcus aureus
TDEIKPSGTGESPLA

SEQ ID NO: 1622589 - protein, 5 aa, Staphylococcus aureus
TDPTI

SEQ ID NO: 1622590 - protein, 9 aa, Staphylococcus aureus
TEESNRFTD

SEQ ID NO: 1622591 - protein, 18 aa, Staphylococcus aureus
TERIQTSKPEYAQAEMEA

SEQ ID NO: 1622592 - protein, 6 aa, Staphylococcus aureus
TESQQQ

SEQ ID NO: 1622593 - protein, 4 aa, Staphylococcus aureus
TGED

SEQ ID NO: 1622594 - protein, 11 aa, Staphylococcus aureus
TGRKPNTETLN

SEQ ID NO: 1622595 - protein, 5 aa, Staphylococcus aureus
TIDHP

SEQ ID NO: 1622596 - protein, 8 aa, Staphylococcus aureus
TISDQNEI

SEQ ID NO: 1622597 - protein, 52 aa, Staphylococcus aureus
TKELPNSQFQNNEFGSSRTVNLSGQELPNSQSNDTELNNTNYIENEDNDTYD

SEQ ID NO: 1622598 - protein, 4 aa, Staphylococcus aureus
TKEP

SEQ ID NO: 1622599 - protein, 8 aa, Staphylococcus aureus
TKPGSEDL

SEQ ID NO: 1622600 - protein, 28 aa, Staphylococcus aureus
TKSPYNTSTSGKPLVEGAEEKGNVVTDT

SEQ ID NO: 1622601 - protein, 4 aa, Staphylococcus aureus
TKVE

SEQ ID NO: 1622602 - protein, 9 aa, Staphylococcus aureus
TLSQQFTEA

SEQ ID NO: 1622603 - protein, 11 aa, Staphylococcus aureus
TMNDQNSLRTY

SEQ ID NO: 1622604 - protein, 12 aa, Staphylococcus aureus
TMTQSTDKIDNA

SEQ ID NO: 1622605 - protein, 31 aa, Staphylococcus aureus
TNDKVDTTRLPNPSPIQQSNKVYSEPSNEIE

SEQ ID NO: 1622606 - protein, 6 aa, Staphylococcus aureus
TNPDHP

SEQ ID NO: 1622607 - protein, 14 aa, Staphylococcus aureus
TNQLEEQNNDSDNL

SEQ ID NO: 1622608 - protein, 7 aa, Staphylococcus aureus
TNSGEVY

SEQ ID NO: 1622609 - protein, 19 aa, Staphylococcus aureus
TNSYKKDASHKFSHQMEDV

SEQ ID NO: 1622610 - protein, 9 aa, Staphylococcus aureus
TQANTALNG

SEQ ID NO: 1622611 - protein, 51 aa, Staphylococcus aureus; identical to SEQ ID NO: 1563879

SEQ ID NO: 1622612 - protein, 10 aa, Staphylococcus aureus
TRGDYKPTNK

SEQ ID NO: 1622613 - protein, 6 aa, Staphylococcus aureus
TRGNEN

SEQ ID NO: 1622614 - protein, 14 aa, Staphylococcus aureus
TRHHDSDLKRGQRQ

SEQ ID NO: 1622615 - protein, 6 aa, Staphylococcus aureus
TRRDSA

SEQ ID NO: 1622616 - protein, 9 aa, Staphylococcus aureus
TRSITNGRL

SEQ ID NO: 1622617 - protein, 12 aa, Staphylococcus aureus
TSALPGRKTGSL

SEQ ID NO: 1622618 - protein, 13 aa, Staphylococcus aureus
TSDGVSPRPIPGV

SEQ ID NO: 1622619 - protein, 11 aa, Staphylococcus aureus
TSGSKINSEAE

SEQ ID NO: 1622620 - protein, 8 aa, Staphylococcus aureus
TSLENNKP

SEQ ID NO: 1622621 - protein, 24 aa, Staphylococcus aureus
TSLNGPQKAKLKEQVGQATTLPNV

SEQ ID NO: 1622622 - protein, 14 aa, Staphylococcus aureus
TSNAQARRIFEVEK

SEQ ID NO: 1622623 - protein, 5 aa, Staphylococcus aureus
TSPYT

SEQ ID NO: 1622624 - protein, 5 aa, Staphylococcus aureus
TSTSA

SEQ ID NO: 1622625 - protein, 8 aa, Staphylococcus aureus
TTNNSPNL

SEQ ID NO: 1622626 - protein, 24 aa, Staphylococcus aureus
TVDKIKSNGDNAKAYNVDNASEQQ

SEQ ID NO: 1622627 - protein, 11 aa, Staphylococcus aureus
TVYKEGTATEI

SEQ ID NO: 1622628 - protein, 16 aa, Staphylococcus aureus
TWQSNQARQNNSQSYG

SEQ ID NO: 1622629 - protein, 27 aa, Staphylococcus aureus
VADGGNSEGGAGAKYQGAKHPNEKVVA

SEQ ID NO: 1622630 - protein, 28 aa, Staphylococcus aureus
VAEGTSVITATSTDGSDKSGQISVTVTN

SEQ ID NO: 1622631 - protein, 21 aa, Staphylococcus aureus
VDPTTYEASGGSDDTREGTVM

SEQ ID NO: 1622632 - protein, 4 aa, Staphylococcus aureus
VDRE

SEQ ID NO: 1622633 - protein, 8 aa, Staphylococcus aureus
VENGNTKL

SEQ ID NO: 1622634 - protein, 5 aa, Staphylococcus aureus
VEPST

SEQ ID NO: 1622635 - protein, 22 aa, Staphylococcus aureus
VGNPQDEATQMGSQTGKDQLDK

SEQ ID NO: 1622636 - protein, 7 aa, Staphylococcus aureus
VIPAEQG

SEQ ID NO: 1622637 - protein, 8 aa, Staphylococcus aureus
VKLQDELQ

SEQ ID NO: 1622638 - protein, 5 aa, Staphylococcus aureus
VKNIS

SEQ ID NO: 1622639 - protein, 24 aa, Staphylococcus aureus
VKSPATSSSAGKSSEVNPKPQSDE

SEQ ID NO: 1622640 - protein, 5 aa, Staphylococcus aureus
VPGPV

SEQ ID NO: 1622641 - protein, 5 aa, Staphylococcus aureus
VQTGG

SEQ ID NO: 1622642 - protein, 4 aa, Staphylococcus aureus
VREA

SEQ ID NO: 1622643 - protein, 5 aa, Staphylococcus aureus
VSDED

SEQ ID NO: 1622644 - protein, 12 aa, Staphylococcus aureus
VSKGGYLGETLF

SEQ ID NO: 1622645 - protein, 9 aa, Staphylococcus aureus
VSNEDAAHA

SEQ ID NO: 1622646 - protein, 7 aa, Staphylococcus aureus
VSSGNDS

SEQ ID NO: 1622647 - protein, 6 aa, Staphylococcus aureus
VSVADK

SEQ ID NO: 1622648 - protein, 42 aa, Staphylococcus aureus
VTSRDSHATEEDKELDKELERDKEKDIDKNLSSNNSATDVTH

SEQ ID NO: 1622649 - protein, 13 aa, Staphylococcus aureus
WADDDQDTSDLAY

SEQ ID NO: 1622650 - protein, 6 aa, Staphylococcus aureus
WDEKKA

SEQ ID NO: 1622651 - protein, 32 aa, Staphylococcus aureus
WDGDDEELDKTVKDVSNANPNHTVIVDDIPLE

SEQ ID NO: 1622652 - protein, 8 aa, Staphylococcus aureus
YAQTAEQF

SEQ ID NO: 1622653 - protein, 9 aa, Staphylococcus aureus
YDKKISDDC

SEQ ID NO: 1622654 - protein, 7 aa, Staphylococcus aureus
YDVQKKE

SEQ ID NO: 1622655 - protein, 4 aa, Staphylococcus aureus
YEAT

SEQ ID NO: 1622656 - protein, 11 aa, Staphylococcus aureus
YGHSQLPSDGL

SEQ ID NO: 1622657 - protein, 12 aa, Staphylococcus aureus
YKESIKASTPSG

SEQ ID NO: 1622658 - protein, 12 aa, Staphylococcus aureus
YNKNRKKYTQQK

SEQ ID NO: 1622659 - protein, 9 aa, Staphylococcus aureus
YSGNSQRPT

SEQ ID NO: 1622660 - protein, 9 aa, Staphylococcus aureus
YSSDLSKGF

SEQ ID NO: 1622661 - protein, 5 aa, Staphylococcus aureus
YSTKQ

SEQ ID NO: 1622662 - protein, 10 aa, Staphylococcus aureus
AAQNAAKQHL

SEQ ID NO: 1622663 - protein, 15 aa, Staphylococcus aureus
ADSEGRETEGSVDGG

SEQ ID NO: 1622664 - protein, 14 aa, Staphylococcus aureus
ADSKFENDERFSGY

SEQ ID NO: 1622665 - protein, 6 aa, Staphylococcus aureus
ADYGEI

SEQ ID NO: 1622666 - protein, 11 aa, Staphylococcus aureus
AEFKPKQIEDF

SEQ ID NO: 1622667 - protein, 4 aa, Staphylococcus aureus
AGDK

SEQ ID NO: 1622668 - protein, 9 aa, Staphylococcus aureus
AGNQDNWSY

SEQ ID NO: 1622669 - protein, 12 aa, Staphylococcus aureus
AHGQNMTKAQVE

SEQ ID NO: 1622670 - protein, 11 aa, Staphylococcus aureus
AHNETDIADNA

SEQ ID NO: 1622671 - protein, 11 aa, Staphylococcus aureus
AIPNINENSPP

SEQ ID NO: 1622672 - protein, 6 aa, Staphylococcus aureus
AKIEKY

SEQ ID NO: 1622673 - protein, 4 aa, Staphylococcus aureus
AKND

SEQ ID NO: 1622674 - protein, 7 aa, Staphylococcus aureus
AKNTNIN

SEQ ID NO: 1622675 - protein, 8 aa, Staphylococcus aureus
AKRTGKTI

SEQ ID NO: 1622676 - protein, 9 aa, Staphylococcus aureus
ALDANDRPL

SEQ ID NO: 1622677 - protein, 13 aa, Staphylococcus aureus
ALGTSPRMTFIKH

SEQ ID NO: 1622678 - protein, 13 aa, Staphylococcus aureus
ALNNKSDEYGIKR

SEQ ID NO: 1622679 - protein, 5 aa, Staphylococcus aureus
ANKRY

SEQ ID NO: 1622680 - protein, 13 aa, Staphylococcus aureus
ANLQGTSIKGITK

SEQ ID NO: 1622681 - protein, 10 aa, Staphylococcus aureus
ANPPYSAKWT

SEQ ID NO: 1622682 - protein, 10 aa, Staphylococcus aureus
APAEKQTKLR

SEQ ID NO: 1622683 - protein, 4 aa, Staphylococcus aureus
APRM

SEQ ID NO: 1622684 - protein, 10 aa, Staphylococcus aureus
AQLTEQKDGL

SEQ ID NO: 1622685 - protein, 12 aa, Staphylococcus aureus
AQYDSEDKQQDV

SEQ ID NO: 1622686 - protein, 7 aa, Staphylococcus aureus
ARKQGKS

SEQ ID NO: 1622687 - protein, 12 aa, Staphylococcus aureus
ARQKELDDLNNS

SEQ ID NO: 1622688 - protein, 5 aa, Staphylococcus aureus
ATDIE

SEQ ID NO: 1622689 - protein, 10 aa, Staphylococcus aureus
ATEQPSDTRA

SEQ ID NO: 1622690 - protein, 6 aa, Staphylococcus aureus
ATPPKQ

SEQ ID NO: 1622691 - protein, 7 aa, Staphylococcus aureus
CATKTQN

SEQ ID NO: 1622692 - protein, 7 aa, Staphylococcus aureus
CESQQRE

SEQ ID NO: 1622693 - protein, 7 aa, Staphylococcus aureus
CGSQQRE

SEQ ID NO: 1622694 - protein, 19 aa, Staphylococcus aureus
CKPDPNFSSVQSANPEDHH

SEQ ID NO: 1622695 - protein, 8 aa, Staphylococcus aureus
CPSLPTNV

SEQ ID NO: 1622696 - protein, 4 aa, Staphylococcus aureus
DAAY

SEQ ID NO: 1622697 - protein, 14 aa, Staphylococcus aureus
DDGGGEVFFNYTKQ

SEQ ID NO: 1622698 - protein, 6 aa, Staphylococcus aureus
DDQIKA

SEQ ID NO: 1622699 - protein, 26 aa, Staphylococcus aureus
DEILEQKESKIEEKQQQVDAKESSVQ

SEQ ID NO: 1622700 - protein, 16 aa, Staphylococcus aureus
DEKGEHKHTTDRKGHG

SEQ ID NO: 1622701 - protein, 5 aa, Staphylococcus aureus
DENEF

SEQ ID NO: 1622702 - protein, 4 aa, Staphylococcus aureus
DEPF

SEQ ID NO: 1622703 - protein, 12 aa, Staphylococcus aureus
DGIDSVKKSTEK

SEQ ID NO: 1622704 - protein, 17 aa, Staphylococcus aureus
DGIDSVKKSTEKAVDSV

SEQ ID NO: 1622705 - protein, 9 aa, Staphylococcus aureus
DGKPAYNNV

SEQ ID NO: 1622706 - protein, 5 aa, Staphylococcus aureus
DGTNE

SEQ ID NO: 1622707 - protein, 15 aa, Staphylococcus aureus
DKKGYSRSKEKEYPV

SEQ ID NO: 1622708 - protein, 13 aa, Staphylococcus aureus
DKMNTKTVTTANG

SEQ ID NO: 1622709 - protein, 17 aa, Staphylococcus aureus
DKVQGNAIAKAEAEQLK

SEQ ID NO: 1622710 - protein, 13 aa, Staphylococcus aureus
DLTQAKAGAKVGV

SEQ ID NO: 1622711 - protein, 22 aa, Staphylococcus aureus
DNKINTVKPNYNGKSTSEYGVF

SEQ ID NO: 1622712 - protein, 10 aa, Staphylococcus aureus
DQIKNQNDIY

SEQ ID NO: 1622713 - protein, 7 aa, Staphylococcus aureus
DQTPSYK

SEQ ID NO: 1622714 - protein, 11 aa, Staphylococcus aureus
DQTTSPTLDPT

SEQ ID NO: 1622715 - protein, 9 aa, Staphylococcus aureus
DRPKAKMPS

SEQ ID NO: 1622716 - protein, 10 aa, Staphylococcus aureus
DSNESEKMTK

SEQ ID NO: 1622717 - protein, 10 aa, Staphylococcus aureus
DSREQFEQRT

SEQ ID NO: 1622718 - protein, 10 aa, Staphylococcus aureus
DSYIEKDNQM

SEQ ID NO: 1622719 - protein, 6 aa, Staphylococcus aureus
DTFGTH

SEQ ID NO: 1622720 - protein, 4 aa, Staphylococcus aureus
DTHR

SEQ ID NO: 1622721 - protein, 14 aa, Staphylococcus aureus
DTPDIGYNTVVLSE

SEQ ID NO: 1622722 - protein, 33 aa, Staphylococcus aureus; identical to SEQ ID NO: 1565658

SEQ ID NO: 1622723 - protein, 14 aa, Staphylococcus aureus
EAESLDEAENEAHD

SEQ ID NO: 1622724 - protein, 4 aa, Staphylococcus aureus
EAEV

SEQ ID NO: 1622725 - protein, 4 aa, Staphylococcus aureus
EAFH

SEQ ID NO: 1622726 - protein, 8 aa, Staphylococcus aureus
EANPDVLT

SEQ ID NO: 1622727 - protein, 12 aa, Staphylococcus aureus
EATESKGTQLKA

SEQ ID NO: 1622728 - protein, 8 aa, Staphylococcus aureus
EDGPGDHD

SEQ ID NO: 1622729 - protein, 10 aa, Staphylococcus aureus
EDKVSEEFPD

SEQ ID NO: 1622730 - protein, 14 aa, Staphylococcus aureus
EDNRLKKRNYKTNI

SEQ ID NO: 1622731 - protein, 7 aa, Staphylococcus aureus
EEKQKVI

SEQ ID NO: 1622732 - protein, 14 aa, Staphylococcus aureus
EENLERKSDLLDKK

SEQ ID NO: 1622733 - protein, 6 aa, Staphylococcus aureus
EEQDKH

SEQ ID NO: 1622734 - protein, 5 aa, Staphylococcus aureus
EEQQK

SEQ ID NO: 1622735 - protein, 14 aa, Staphylococcus aureus
EEYTGNVTEDNEET

SEQ ID NO: 1622736 - protein, 10 aa, Staphylococcus aureus
EFDQLGQENY

SEQ ID NO: 1622737 - protein, 9 aa, Staphylococcus aureus
EGDESFPIE

SEQ ID NO: 1622738 - protein, 10 aa, Staphylococcus aureus
EGFEKAGPIH

SEQ ID NO: 1622739 - protein, 8 aa, Staphylococcus aureus
EGQDNQLL

SEQ ID NO: 1622740 - protein, 11 aa, Staphylococcus aureus
EIENSDDAWSE

SEQ ID NO: 1622741 - protein, 9 aa, Staphylococcus aureus
EKDDTNLSN

SEQ ID NO: 1622742 - protein, 5 aa, Staphylococcus aureus
EKDRN

SEQ ID NO: 1622743 - protein, 9 aa, Staphylococcus aureus
EKERKVYEE

SEQ ID NO: 1622744 - protein, 5 aa, Staphylococcus aureus
EKKNV

SEQ ID NO: 1622745 - protein, 12 aa, Staphylococcus aureus
ELDQEKSSIAQP

SEQ ID NO: 1622746 - protein, 9 aa, Staphylococcus aureus
ELKGWSQEE

SEQ ID NO: 1622747 - protein, 5 aa, Staphylococcus aureus
ENEQH

SEQ ID NO: 1622748 - protein, 8 aa, Staphylococcus aureus
ENGTATDE

SEQ ID NO: 1622749 - protein, 41 aa, Staphylococcus aureus
ENHSSGKRQTIQPKAKPFAKRGFSQRTTSTKKQVSSSDWNV

SEQ ID NO: 1622750 - protein, 15 aa, Staphylococcus aureus
ENTDERDRLINLVMR

SEQ ID NO: 1622751 - protein, 11 aa, Staphylococcus aureus
ENTIKADELDD

SEQ ID NO: 1622752 - protein, 4 aa, Staphylococcus aureus
EPFP

SEQ ID NO: 1622753 - protein, 15 aa, Staphylococcus aureus
EPQSDDQNMNETRLS

SEQ ID NO: 1622754 - protein, 10 aa, Staphylococcus aureus
EPSNGLDPYG

SEQ ID NO: 1622755 - protein, 5 aa, Staphylococcus aureus
EQATF

SEQ ID NO: 1622756 - protein, 32 aa, Staphylococcus aureus
EQRQNTENNQEKTFSSEESNSKPFMEENQNDE

SEQ ID NO: 1622757 - protein, 7 aa, Staphylococcus aureus
EREGKYQ

SEQ ID NO: 1622758 - protein, 7 aa, Staphylococcus aureus
ERKDGTF

SEQ ID NO: 1622759 - protein, 5 aa, Staphylococcus aureus
ESADA

SEQ ID NO: 1622760 - protein, 6 aa, Staphylococcus aureus
ESDTDT

SEQ ID NO: 1622761 - protein, 4 aa, Staphylococcus aureus
ESFS

SEQ ID NO: 1622762 - protein, 8 aa, Staphylococcus aureus
ESSTATAS

SEQ ID NO: 1622763 - protein, 7 aa, Staphylococcus aureus
ETDEETM

SEQ ID NO: 1622764 - protein, 8 aa, Staphylococcus aureus
ETEENTVL

SEQ ID NO: 1622765 - protein, 17 aa, Staphylococcus aureus
EVDKAGNRISSFGNFSA

SEQ ID NO: 1622766 - protein, 15 aa, Staphylococcus aureus
EVGEGDSTKSGGRKP

SEQ ID NO: 1622767 - protein, 8 aa, Staphylococcus aureus
EVKEQTSN

SEQ ID NO: 1622768 - protein, 4 aa, Staphylococcus aureus
EVPH

SEQ ID NO: 1622769 - protein, 13 aa, Staphylococcus aureus
EYIESEIRPFNTK

SEQ ID NO: 1622770 - protein, 12 aa, Staphylococcus aureus
EYNNKKNNSSLL

SEQ ID NO: 1622771 - protein, 38 aa, Staphylococcus aureus
FDTSTNTRQNVDAQEKTYTTNPVNINRDQEETKETEIQ

SEQ ID NO: 1622772 - protein, 10 aa, Staphylococcus aureus
FDTTQTSGEF

SEQ ID NO: 1622773 - protein, 9 aa, Staphylococcus aureus
FFTTGNGDG

SEQ ID NO: 1622774 - protein, 10 aa, Staphylococcus aureus
FPNGSQSINV

SEQ ID NO: 1622775 - protein, 16 aa, Staphylococcus aureus
FSETQHEAEVKGSDNK

SEQ ID NO: 1622776 - protein, 16 aa, Staphylococcus aureus
FSVSSDKEQHIFSTYH

SEQ ID NO: 1622777 - protein, 10 aa, Staphylococcus aureus
FTAEEGNELA

SEQ ID NO: 1622778 - protein, 16 aa, Staphylococcus aureus
FYDDNRPIEYGVHSKD

SEQ ID NO: 1622779 - protein, 5 aa, Staphylococcus aureus
GANDY

SEQ ID NO: 1622780 - protein, 11 aa, Staphylococcus aureus
GDFDGQQTFAE

SEQ ID NO: 1622781 - protein, 17 aa, Staphylococcus aureus
GDIKDVEEALQGTKMTR

SEQ ID NO: 1622782 - protein, 4 aa, Staphylococcus aureus
GEQY

SEQ ID NO: 1622783 - protein, 7 aa, Staphylococcus aureus
GFEGKKK

SEQ ID NO: 1622784 - protein, 5 aa, Staphylococcus aureus
GFQYT

SEQ ID NO: 1622785 - protein, 4 aa, Staphylococcus aureus
GGFS

SEQ ID NO: 1622786 - protein, 7 aa, Staphylococcus aureus
GGNAGVI

SEQ ID NO: 1622787 - protein, 10 aa, Staphylococcus aureus
GGYDLTPQQK

SEQ ID NO: 1622788 - protein, 7 aa, Staphylococcus aureus
GHEHSKH

SEQ ID NO: 1622789 - protein, 7 aa, Staphylococcus aureus
GHTYSGQ

SEQ ID NO: 1622790 - protein, 11 aa, Staphylococcus aureus
GIPDNAKYEQV

SEQ ID NO: 1622791 - protein, 17 aa, Staphylococcus aureus
GISGQFSAPSKLPPRDV

SEQ ID NO: 1622792 - protein, 6 aa, Staphylococcus aureus
GKGHEK

SEQ ID NO: 1622793 - protein, 16 aa, Staphylococcus aureus
GKPQKVITDQAPSTKV

SEQ ID NO: 1622794 - protein, 8 aa, Staphylococcus aureus
GKTFPNVP

SEQ ID NO: 1622795 - protein, 14 aa, Staphylococcus aureus
GMTPGTYSKKENGH

SEQ ID NO: 1622796 - protein, 9 aa, Staphylococcus aureus
GNPMQGSRI

SEQ ID NO: 1622797 - protein, 11 aa, Staphylococcus aureus
GNVTAKELSES

SEQ ID NO: 1622798 - protein, 12 aa, Staphylococcus aureus
GQDGGRNAITPE

SEQ ID NO: 1622799 - protein, 4 aa, Staphylococcus aureus
GSAI

SEQ ID NO: 1622800 - protein, 8 aa, Staphylococcus aureus
GSNPINSS

SEQ ID NO: 1622801 - protein, 11 aa, Staphylococcus aureus
GSQYRVSDNPF

SEQ ID NO: 1622802 - protein, 7 aa, Staphylococcus aureus
GSSSVKT

SEQ ID NO: 1622803 - protein, 5 aa, Staphylococcus aureus
GTENE

SEQ ID NO: 1622804 - protein, 22 aa, Staphylococcus aureus
GTHTDDYDATGTIDASGKVVSP

SEQ ID NO: 1622805 - protein, 5 aa, Staphylococcus aureus
GYNRD

SEQ ID NO: 1622806 - protein, 11 aa, Staphylococcus aureus
HAITNDSDFEQ

SEQ ID NO: 1622807 - protein, 14 aa, Staphylococcus aureus
HDRGVKGQKETIKS

SEQ ID NO: 1622808 - protein, 9 aa, Staphylococcus aureus
HEDNENEVY

SEQ ID NO: 1622809 - protein, 16 aa, Staphylococcus aureus
HESGGNAGITQSSSLR

SEQ ID NO: 1622810 - protein, 7 aa, Staphylococcus aureus
HGGSRLK

SEQ ID NO: 1622811 - protein, 50 aa, Staphylococcus aureus
HKGITKAKKDDSSNEDVLKRDDKLSEEIESGPEDREVETPKKGFWSRLFG

SEQ ID NO: 1622812 - protein, 9 aa, Staphylococcus aureus
HLEQPQKYK

SEQ ID NO: 1622813 - protein, 11 aa, Staphylococcus aureus
HNTPTFKAEPG

SEQ ID NO: 1622814 - protein, 21 aa, Staphylococcus aureus
IANTTSSDLLKSSKLKEAGIR

SEQ ID NO: 1622815 - protein, 4 aa, Staphylococcus aureus
IATD

SEQ ID NO: 1622816 - protein, 28 aa, Staphylococcus aureus
IDGVTSAEVNLENGQVSVQYDDSKVAVS

SEQ ID NO: 1622817 - protein, 19 aa, Staphylococcus aureus
IDKKSGILDDPNEFSEDPN

SEQ ID NO: 1622818 - protein, 8 aa, Staphylococcus aureus
IDSKTSKL

SEQ ID NO: 1622819 - protein, 41 aa, Staphylococcus aureus
IEKETHKPKTHNMYSNNTNHRAKDSTPDYHKESFKTSEVPS

SEQ ID NO: 1622820 - protein, 11 aa, Staphylococcus aureus
IETNGKNMESR

SEQ ID NO: 1622821 - protein, 8 aa, Staphylococcus aureus
IGDDQYGN

SEQ ID NO: 1622822 - protein, 6 aa, Staphylococcus aureus
IGPEAS

SEQ ID NO: 1622823 - protein, 6 aa, Staphylococcus aureus
IKNSIG

SEQ ID NO: 1622824 - protein, 5 aa, Staphylococcus aureus
IKREK

SEQ ID NO: 1622825 - protein, 31 aa, Staphylococcus aureus
INDYKDGDISYNPNVPSYSAKYQLSNDDYNV

SEQ ID NO: 1622826 - protein, 5 aa, Staphylococcus aureus
INENT

SEQ ID NO: 1622827 - protein, 6 aa, Staphylococcus aureus
INNKSI

SEQ ID NO: 1622828 - protein, 10 aa, Staphylococcus aureus
INNNDTSSDL

SEQ ID NO: 1622829 - protein, 7 aa, Staphylococcus aureus
INTKEDF

SEQ ID NO: 1622830 - protein, 11 aa, Staphylococcus aureus
IRKAIEKNNYD

SEQ ID NO: 1622831 - protein, 6 aa, Staphylococcus aureus
IRRSKD

SEQ ID NO: 1622832 - protein, 11 aa, Staphylococcus aureus
ISELTQEKSEI

SEQ ID NO: 1622833 - protein, 8 aa, Staphylococcus aureus
ISGQGTLA

SEQ ID NO: 1622834 - protein, 12 aa, Staphylococcus aureus
ISGSKSKRPGLD

SEQ ID NO: 1622835 - protein, 6 aa, Staphylococcus aureus
ISGTPD

SEQ ID NO: 1622836 - protein, 10 aa, Staphylococcus aureus
KAAQDISEDY

SEQ ID NO: 1622837 - protein, 5 aa, Staphylococcus aureus
KALPE

SEQ ID NO: 1622838 - protein, 7 aa, Staphylococcus aureus
KASANIF

SEQ ID NO: 1622839 - protein, 13 aa, Staphylococcus aureus
KATIERSDSCAVP

SEQ ID NO: 1622840 - protein, 4 aa, Staphylococcus aureus
KDQE

SEQ ID NO: 1622841 - protein, 4 aa, Staphylococcus aureus
KDTL

SEQ ID NO: 1622842 - protein, 15 aa, Staphylococcus aureus
KDTTLNDSKTYTDTK

SEQ ID NO: 1622843 - protein, 7 aa, Staphylococcus aureus
KEITEET

SEQ ID NO: 1622844 - protein, 11 aa, Staphylococcus aureus
KENVKGRAGSI

SEQ ID NO: 1622845 - protein, 5 aa, Staphylococcus aureus
KEQGL

SEQ ID NO: 1622846 - protein, 18 aa, Staphylococcus aureus
KFDDYSERKNKYEEQKSI

SEQ ID NO: 1622847 - protein, 5 aa, Staphylococcus aureus
KFPSN

SEQ ID NO: 1622848 - protein, 5 aa, Staphylococcus aureus
KGAYS

SEQ ID NO: 1622849 - protein, 12 aa, Staphylococcus aureus
KGFATYKGKDSL

SEQ ID NO: 1622850 - protein, 9 aa, Staphylococcus aureus
KGNIERKKH

SEQ ID NO: 1622851 - protein, 6 aa, Staphylococcus aureus
KGNINR

SEQ ID NO: 1622852 - protein, 11 aa, Staphylococcus aureus
KGYGAKDIPYA

SEQ ID NO: 1622853 - protein, 20 aa, Staphylococcus aureus
KGYQDENNKALKSVRKQTRH

SEQ ID NO: 1622854 - protein, 6 aa, Staphylococcus aureus
KIPDSK

SEQ ID NO: 1622855 - protein, 14 aa, Staphylococcus aureus
KKADTSDKKEFRNK

SEQ ID NO: 1622856 - protein, 12 aa, Staphylococcus aureus
KKGYQKLNGDEA

SEQ ID NO: 1622857 - protein, 9 aa, Staphylococcus aureus
KLKDTNKLR

SEQ ID NO: 1622858 - protein, 13 aa, Staphylococcus aureus
KLKEKEERPAIVE

SEQ ID NO: 1622859 - protein, 12 aa, Staphylococcus aureus
KLSPGGEKTHDD

SEQ ID NO: 1622860 - protein, 45 aa, Staphylococcus aureus
KLTEDEPKLNGLAGNLDKKMNPELYSEQEQQQEQQKNQKRDRGMH

SEQ ID NO: 1622861 - protein, 16 aa, Staphylococcus aureus
KMKTSEKQAKKAQNMI

SEQ ID NO: 1622862 - protein, 5 aa, Staphylococcus aureus
KMNDN

SEQ ID NO: 1622863 - protein, 8 aa, Staphylococcus aureus
KNKRNSIA

SEQ ID NO: 1622864 - protein, 8 aa, Staphylococcus aureus
KNLSETTL

SEQ ID NO: 1622865 - protein, 6 aa, Staphylococcus aureus
KPIDAN

SEQ ID NO: 1622866 - protein, 6 aa, Staphylococcus aureus
KPNEHT

SEQ ID NO: 1622867 - protein, 9 aa, Staphylococcus aureus
KPNSPSTNK

SEQ ID NO: 1622868 - protein, 4 aa, Staphylococcus aureus
KPSY

SEQ ID NO: 1622869 - protein, 6 aa, Staphylococcus aureus
KPTDVH

SEQ ID NO: 1622870 - protein, 6 aa, Staphylococcus aureus
KPYRFT

SEQ ID NO: 1622871 - protein, 5 aa, Staphylococcus aureus
KQGTI

SEQ ID NO: 1622872 - protein, 5 aa, Staphylococcus aureus
KQKNI

SEQ ID NO: 1622873 - protein, 8 aa, Staphylococcus aureus
KQNANTAI

SEQ ID NO: 1622874 - protein, 10 aa, Staphylococcus aureus
KQNEKINAKV

SEQ ID NO: 1622875 - protein, 8 aa, Staphylococcus aureus
KREAPPLV

SEQ ID NO: 1622876 - protein, 11 aa, Staphylococcus aureus
KRLSSAAESLN

SEQ ID NO: 1622877 - protein, 13 aa, Staphylococcus aureus
KRNIDKEKRMLEE

SEQ ID NO: 1622878 - protein, 20 aa, Staphylococcus aureus
KRNSPTSHSINHSQLVEIDK

SEQ ID NO: 1622879 - protein, 16 aa, Staphylococcus aureus
KRTNVSSKVDTIKSLG

SEQ ID NO: 1622880 - protein, 9 aa, Staphylococcus aureus
KSETDAHEA

SEQ ID NO: 1622881 - protein, 6 aa, Staphylococcus aureus
KSFDTN

SEQ ID NO: 1622882 - protein, 6 aa, Staphylococcus aureus
KSITQR

SEQ ID NO: 1622883 - protein, 16 aa, Staphylococcus aureus
KSTFQETHDKSSNMID

SEQ ID NO: 1622884 - protein, 16 aa, Staphylococcus aureus
KSVKSTKSDPSKELKA

SEQ ID NO: 1622885 - protein, 9 aa, Staphylococcus aureus
KTPYVSTGK

SEQ ID NO: 1622886 - protein, 4 aa, Staphylococcus aureus
KVKE

SEQ ID NO: 1622887 - protein, 7 aa, Staphylococcus aureus
KVPDDWR

SEQ ID NO: 1622888 - protein, 7 aa, Staphylococcus aureus
KYAAQGK

SEQ ID NO: 1622889 - protein, 12 aa, Staphylococcus aureus
KYQQRNNKDENL

SEQ ID NO: 1622890 - protein, 5 aa, Staphylococcus aureus
KYQTR

SEQ ID NO: 1622891 - protein, 6 aa, Staphylococcus aureus
KYRKEG

SEQ ID NO: 1622892 - protein, 6 aa, Staphylococcus aureus
KYTEHK

SEQ ID NO: 1622893 - protein, 6 aa, Staphylococcus aureus
LDEQGR

SEQ ID NO: 1622894 - protein, 9 aa, Staphylococcus aureus
LDGDTRGGV

SEQ ID NO: 1622895 - protein, 5 aa, Staphylococcus aureus
LDKKI

SEQ ID NO: 1622896 - protein, 6 aa, Staphylococcus aureus
LEAQGD

SEQ ID NO: 1622897 - protein, 13 aa, Staphylococcus aureus
LEEKEDEKQGEVS

SEQ ID NO: 1622898 - protein, 8 aa, Staphylococcus aureus
LEQQGQRD

SEQ ID NO: 1622899 - protein, 6 aa, Staphylococcus aureus
LGGEGN

SEQ ID NO: 1622900 - protein, 12 aa, Staphylococcus aureus
LGTSPRMTFIKH

SEQ ID NO: 1622901 - protein, 4 aa, Staphylococcus aureus
LKDI

SEQ ID NO: 1622902 - protein, 4 aa, Staphylococcus aureus
LKDT

SEQ ID NO: 1622903 - protein, 9 aa, Staphylococcus aureus
LKGNSKKIE

SEQ ID NO: 1622904 - protein, 12 aa, Staphylococcus aureus
LKGSKKDGYKPA

SEQ ID NO: 1622905 - protein, 6 aa, Staphylococcus aureus
LKSGEG

SEQ ID NO: 1622906 - protein, 6 aa, Staphylococcus aureus
LMKNNK

SEQ ID NO: 1622907 - protein, 11 aa, Staphylococcus aureus
LNDANKLSKYN

SEQ ID NO: 1622908 - protein, 8 aa, Staphylococcus aureus
LNKPKRVT

SEQ ID NO: 1622909 - protein, 34 aa, Staphylococcus aureus; identical to SEQ ID NO: 1565572

SEQ ID NO: 1622910 - protein, 17 aa, Staphylococcus aureus
LPKKSKTIEDIEKEEAK

SEQ ID NO: 1622911 - protein, 5 aa, Staphylococcus aureus
LQGRP

SEQ ID NO: 1622912 - protein, 19 aa, Staphylococcus aureus
LQNEEDNEECEEEYEEYKE

SEQ ID NO: 1622913 - protein, 6 aa, Staphylococcus aureus
LRKITK

SEQ ID NO: 1622914 - protein, 8 aa, Staphylococcus aureus
LRKITKSD

SEQ ID NO: 1622915 - protein, 11 aa, Staphylococcus aureus
LSDKTEKISQH

SEQ ID NO: 1622916 - protein, 4 aa, Staphylococcus aureus
MGDN

SEQ ID NO: 1622917 - protein, 10 aa, Staphylococcus aureus
MKVKSDDQVV

SEQ ID NO: 1622918 - protein, 5 aa, Staphylococcus aureus
MSNNG

SEQ ID NO: 1622919 - protein, 14 aa, Staphylococcus aureus
MTNHGGDGEKGEEA

SEQ ID NO: 1622920 - protein, 16 aa, Staphylococcus aureus
NAIQTTEATAEAQQTA

SEQ ID NO: 1622921 - protein, 8 aa, Staphylococcus aureus
NAKPLKEN

SEQ ID NO: 1622922 - protein, 19 aa, Staphylococcus aureus
NALNGDQNLANAKDKANAF

SEQ ID NO: 1622923 - protein, 4 aa, Staphylococcus aureus
NALS

SEQ ID NO: 1622924 - protein, 33 aa, Staphylococcus aureus; identical to SEQ ID NO: 1565723

SEQ ID NO: 1622925 - protein, 4 aa, Staphylococcus aureus
NATD

SEQ ID NO: 1622926 - protein, 9 aa, Staphylococcus aureus
NAYKSAKGW

SEQ ID NO: 1622927 - protein, 22 aa, Staphylococcus aureus
NDFSKESTAETIERHSDPDSGI

SEQ ID NO: 1622928 - protein, 24 aa, Staphylococcus aureus
NDKEFKEGMERARKEVNYAANTDA

SEQ ID NO: 1622929 - protein, 7 aa, Staphylococcus aureus
NDTATGT

SEQ ID NO: 1622930 - protein, 6 aa, Staphylococcus aureus
NDTVRA

SEQ ID NO: 1622931 - protein, 8 aa, Staphylococcus aureus
NEATFQPK

SEQ ID NO: 1622932 - protein, 18 aa, Staphylococcus aureus
NEIPKAKIDANKDVDKQV

SEQ ID NO: 1622933 - protein, 6 aa, Staphylococcus aureus
NENRAY

SEQ ID NO: 1622934 - protein, 7 aa, Staphylococcus aureus
NEPMTAQ

SEQ ID NO: 1622935 - protein, 7 aa, Staphylococcus aureus
NFNKSKH

SEQ ID NO: 1622936 - protein, 7 aa, Staphylococcus aureus
NGSATYQ

SEQ ID NO: 1622937 - protein, 11 aa, Staphylococcus aureus
NHCNEKTINVD

SEQ ID NO: 1622938 - protein, 7 aa, Staphylococcus aureus
NHNQAAE

SEQ ID NO: 1622939 - protein, 5 aa, Staphylococcus aureus
NIDDT

SEQ ID NO: 1622940 - protein, 6 aa, Staphylococcus aureus
NKALAQ

SEQ ID NO: 1622941 - protein, 17 aa, Staphylococcus aureus
NKGKRIASLTKEGKILR

SEQ ID NO: 1622942 - protein, 9 aa, Staphylococcus aureus
NKMDNKALS

SEQ ID NO: 1622943 - protein, 7 aa, Staphylococcus aureus
NKSGQLI

SEQ ID NO: 1622944 - protein, 9 aa, Staphylococcus aureus
NKTTDPTLA

SEQ ID NO: 1622945 - protein, 6 aa, Staphylococcus aureus
NKVHPN

SEQ ID NO: 1622946 - protein, 6 aa, Staphylococcus aureus
NMADTQ

SEQ ID NO: 1622947 - protein, 9 aa, Staphylococcus aureus
NNNDQATEI

SEQ ID NO: 1622948 - protein, 8 aa, Staphylococcus aureus
NNNEDGIG

SEQ ID NO: 1622949 - protein, 7 aa, Staphylococcus aureus
NNNTINR

SEQ ID NO: 1622950 - protein, 6 aa, Staphylococcus aureus
NPPNGC

SEQ ID NO: 1622951 - protein, 15 aa, Staphylococcus aureus
NQKEHSAIQSTPINR

SEQ ID NO: 1622952 - protein, 5 aa, Staphylococcus aureus
NQTGH

SEQ ID NO: 1622953 - protein, 29 aa, Staphylococcus aureus
NRKPITATEEDLDDNNRARSAKLRVAEIL

SEQ ID NO: 1622954 - protein, 8 aa, Staphylococcus aureus
NSDTTVKP

SEQ ID NO: 1622955 - protein, 12 aa, Staphylococcus aureus
NTIGEIAQNNNL

SEQ ID NO: 1622956 - protein, 7 aa, Staphylococcus aureus
NTSTKNL

SEQ ID NO: 1622957 - protein, 10 aa, Staphylococcus aureus
NVKQTAQELN

SEQ ID NO: 1622958 - protein, 18 aa, Staphylococcus aureus
NVKTSAKNQKNPPVPAGY

SEQ ID NO: 1622959 - protein, 20 aa, Staphylococcus aureus
NVVGEGSKSISNHISPKKWS

SEQ ID NO: 1622960 - protein, 9 aa, Staphylococcus aureus
PAIEPSNGV

SEQ ID NO: 1622961 - protein, 10 aa, Staphylococcus aureus
PANYSPENAM

SEQ ID NO: 1622962 - protein, 8 aa, Staphylococcus aureus
PEANPKIG

SEQ ID NO: 1622963 - protein, 15 aa, Staphylococcus aureus
PKNKYPDSIEDSTAK

SEQ ID NO: 1622964 - protein, 9 aa, Staphylococcus aureus
PNHKHTTVQ

SEQ ID NO: 1622965 - protein, 5 aa, Staphylococcus aureus
PTDVH

SEQ ID NO: 1622966 - protein, 10 aa, Staphylococcus aureus
PTKPIADDKL

SEQ ID NO: 1622967 - protein, 24 aa, Staphylococcus aureus
PTLSTGTLAGKGVATDNSGALTQP

SEQ ID NO: 1622968 - protein, 8 aa, Staphylococcus aureus
QAESNYKC

SEQ ID NO: 1622969 - protein, 12 aa, Staphylococcus aureus
QAHKEADNIKKE

SEQ ID NO: 1622970 - protein, 6 aa, Staphylococcus aureus
QDGSIA

SEQ ID NO: 1622971 - protein, 5 aa, Staphylococcus aureus
QDSNA

SEQ ID NO: 1622972 - protein, 12 aa, Staphylococcus aureus
QENGKTSFEPAD

SEQ ID NO: 1622973 - protein, 4 aa, Staphylococcus aureus
QEQV

SEQ ID NO: 1622974 - protein, 4 aa, Staphylococcus aureus
QGLL

SEQ ID NO: 1622975 - protein, 4 aa, Staphylococcus aureus
QGLS

SEQ ID NO: 1622976 - protein, 13 aa, Staphylococcus aureus
QKFSKGKNISINP

SEQ ID NO: 1622977 - protein, 11 aa, Staphylococcus aureus
QLKGGDKEPYR

SEQ ID NO: 1622978 - protein, 8 aa, Staphylococcus aureus
QMDDNDIE

SEQ ID NO: 1622979 - protein, 7 aa, Staphylococcus aureus
QNGAEEI

SEQ ID NO: 1622980 - protein, 28 aa, Staphylococcus aureus
QNVNSTKTALNGDAKLNEAKAAAKQTLG

SEQ ID NO: 1622981 - protein, 7 aa, Staphylococcus aureus
QPTYIKT

SEQ ID NO: 1622982 - protein, 28 aa, Staphylococcus aureus
QSDDPDEPGGDGKKRDPDNKENDEGTEI

SEQ ID NO: 1622983 - protein, 8 aa, Staphylococcus aureus
QSEFSGRR

SEQ ID NO: 1622984 - protein, 5 aa, Staphylococcus aureus
QSTIT

SEQ ID NO: 1622985 - protein, 6 aa, Staphylococcus aureus
QTLKDP

SEQ ID NO: 1622986 - protein, 26 aa, Staphylococcus aureus
QVNTTKAALNGTQNLEKAKQHANTAI

SEQ ID NO: 1622987 - protein, 27 aa, Staphylococcus aureus
QVTSTKDALNGDAKLAEAKAAAKQNLG

SEQ ID NO: 1622988 - protein, 7 aa, Staphylococcus aureus
RDVKDAD

SEQ ID NO: 1622989 - protein, 5 aa, Staphylococcus aureus
RGYQS

SEQ ID NO: 1622990 - protein, 7 aa, Staphylococcus aureus
RKITKSD

SEQ ID NO: 1622991 - protein, 4 aa, Staphylococcus aureus
RKKA

SEQ ID NO: 1622992 - protein, 13 aa, Staphylococcus aureus
RNHLTECVSIFNI

SEQ ID NO: 1622993 - protein, 8 aa, Staphylococcus aureus
RNNEEYQK

SEQ ID NO: 1622994 - protein, 7 aa, Staphylococcus aureus
RNRDKQI

SEQ ID NO: 1622995 - protein, 15 aa, Staphylococcus aureus
RQSVSKWESAKNYPS

SEQ ID NO: 1622996 - protein, 8 aa, Staphylococcus aureus
RQTENEVQ

SEQ ID NO: 1622997 - protein, 12 aa, Staphylococcus aureus
RRDELAEKIYLL

SEQ ID NO: 1622998 - protein, 8 aa, Staphylococcus aureus
RRNRYNKA

SEQ ID NO: 1622999 - protein, 9 aa, Staphylococcus aureus
RSNPELSKG

SEQ ID NO: 1623000 - protein, 15 aa, Staphylococcus aureus
RSSTLKANSKAASID

SEQ ID NO: 1623001 - protein, 6 aa, Staphylococcus aureus
RTNEDF

SEQ ID NO: 1623002 - protein, 9 aa, Staphylococcus aureus
RVDKGEHKL

SEQ ID NO: 1623003 - protein, 7 aa, Staphylococcus aureus
RVKQGAD

SEQ ID NO: 1623004 - protein, 7 aa, Staphylococcus aureus
RYSQSSL

SEQ ID NO: 1623005 - protein, 7 aa, Staphylococcus aureus
SAKENIN

SEQ ID NO: 1623006 - protein, 8 aa, Staphylococcus aureus
SDDAWSET

SEQ ID NO: 1623007 - protein, 9 aa, Staphylococcus aureus
SDDDTYTKF

SEQ ID NO: 1623008 - protein, 6 aa, Staphylococcus aureus
SDKSVK

SEQ ID NO: 1623009 - protein, 12 aa, Staphylococcus aureus
SEAKRKKATQKY

SEQ ID NO: 1623010 - protein, 6 aa, Staphylococcus aureus
SEKPTL

SEQ ID NO: 1623011 - protein, 19 aa, Staphylococcus aureus
SENNNRDEVKKGKELIEAT

SEQ ID NO: 1623012 - protein, 6 aa, Staphylococcus aureus
SESDKK

SEQ ID NO: 1623013 - protein, 4 aa, Staphylococcus aureus
SFGY

SEQ ID NO: 1623014 - protein, 7 aa, Staphylococcus aureus
SFQHREP

SEQ ID NO: 1623015 - protein, 12 aa, Staphylococcus aureus
SGAHGKARQITE

SEQ ID NO: 1623016 - protein, 32 aa, Staphylococcus aureus; identical to SEQ ID NO: 1564439

SEQ ID NO: 1623017 - protein, 5 aa, Staphylococcus aureus
SGYSQ

SEQ ID NO: 1623018 - protein, 6 aa, Staphylococcus aureus
SISPGM

SEQ ID NO: 1623019 - protein, 10 aa, Staphylococcus aureus
SKDKGQETTL

SEQ ID NO: 1623020 - protein, 6 aa, Staphylococcus aureus
SKEESI

SEQ ID NO: 1623021 - protein, 9 aa, Staphylococcus aureus
SKEKIKSSL

SEQ ID NO: 1623022 - protein, 23 aa, Staphylococcus aureus
SKINQANNIPNNARKSPMYHSPI

SEQ ID NO: 1623023 - protein, 10 aa, Staphylococcus aureus
SKSNKPGVLD

SEQ ID NO: 1623024 - protein, 5 aa, Staphylococcus aureus
SLKKI

SEQ ID NO: 1623025 - protein, 5 aa, Staphylococcus aureus
SLKKY

SEQ ID NO: 1623026 - protein, 15 aa, Staphylococcus aureus
SLQDKLENSNGEHTA

SEQ ID NO: 1623027 - protein, 4 aa, Staphylococcus aureus
SMRP

SEQ ID NO: 1623028 - protein, 9 aa, Staphylococcus aureus
SNRTLESKE

SEQ ID NO: 1623029 - protein, 17 aa, Staphylococcus aureus
SQGNLELPNDYSPSNAM

SEQ ID NO: 1623030 - protein, 5 aa, Staphylococcus aureus
SQQRL

SEQ ID NO: 1623031 - protein, 7 aa, Staphylococcus aureus
SQSTVST

SEQ ID NO: 1623032 - protein, 10 aa, Staphylococcus aureus
SRNKAAGIKV

SEQ ID NO: 1623033 - protein, 25 aa, Staphylococcus aureus
SSAGRIAARARGRYGGRPEKLNQKD

SEQ ID NO: 1623034 - protein, 8 aa, Staphylococcus aureus
SSKENKKY

SEQ ID NO: 1623035 - protein, 10 aa, Staphylococcus aureus
STKIAQTVEE

SEQ ID NO: 1623036 - protein, 7 aa, Staphylococcus aureus
STSYTQQ

SEQ ID NO: 1623037 - protein, 7 aa, Staphylococcus aureus
SVAENDT

SEQ ID NO: 1623038 - protein, 10 aa, Staphylococcus aureus
SVGDTIQRGG

SEQ ID NO: 1623039 - protein, 7 aa, Staphylococcus aureus
TADLEKN

SEQ ID NO: 1623040 - protein, 13 aa, Staphylococcus aureus
TAINDKSGTLASQ

SEQ ID NO: 1623041 - protein, 5 aa, Staphylococcus aureus
TDEND

SEQ ID NO: 1623042 - protein, 9 aa, Staphylococcus aureus
TDKQYQKYP

SEQ ID NO: 1623043 - protein, 6 aa, Staphylococcus aureus
TDQAAS

SEQ ID NO: 1623044 - protein, 8 aa, Staphylococcus aureus
TDVTNSHD

SEQ ID NO: 1623045 - protein, 7 aa, Staphylococcus aureus
TEGHEPW

SEQ ID NO: 1623046 - protein, 6 aa, Staphylococcus aureus
TEPSSD

SEQ ID NO: 1623047 - protein, 6 aa, Staphylococcus aureus
TEQQCQ

SEQ ID NO: 1623048 - protein, 10 aa, Staphylococcus aureus
TETKTLEANE

SEQ ID NO: 1623049 - protein, 8 aa, Staphylococcus aureus
TGGGIIES

SEQ ID NO: 1623050 - protein, 12 aa, Staphylococcus aureus
TGGKELTQEQIE

SEQ ID NO: 1623051 - protein, 8 aa, Staphylococcus aureus
TGPSKGGH

SEQ ID NO: 1623052 - protein, 16 aa, Staphylococcus aureus
TKASGQNVDKAAVEQA

SEQ ID NO: 1623053 - protein, 9 aa, Staphylococcus aureus
TKGYPPSVR

SEQ ID NO: 1623054 - protein, 5 aa, Staphylococcus aureus
TLAGL

SEQ ID NO: 1623055 - protein, 5 aa, Staphylococcus aureus
TLKDE

SEQ ID NO: 1623056 - protein, 10 aa, Staphylococcus aureus
TMNDQNSLRT

SEQ ID NO: 1623057 - protein, 5 aa, Staphylococcus aureus
TNEND

SEQ ID NO: 1623058 - protein, 5 aa, Staphylococcus aureus
TPENL

SEQ ID NO: 1623059 - protein, 7 aa, Staphylococcus aureus
TQSSSID

SEQ ID NO: 1623060 - protein, 20 aa, Staphylococcus aureus
TRKGKVHYSKTGAHIVPYID

SEQ ID NO: 1623061 - protein, 8 aa, Staphylococcus aureus
TSHEDDDL

SEQ ID NO: 1623062 - protein, 7 aa, Staphylococcus aureus
TSTKSVL

SEQ ID NO: 1623063 - protein, 10 aa, Staphylococcus aureus
TTEGNRNNAL

SEQ ID NO: 1623064 - protein, 6 aa, Staphylococcus aureus
TTKKSP

SEQ ID NO: 1623065 - protein, 4 aa, Staphylococcus aureus
TTVV

SEQ ID NO: 1623066 - protein, 12 aa, Staphylococcus aureus
VGGAPTQKLAES

SEQ ID NO: 1623067 - protein, 4 aa, Staphylococcus aureus
VGHW

SEQ ID NO: 1623068 - protein, 22 aa, Staphylococcus aureus
VGRKGGVFGTTQGLQQKYGEDR

SEQ ID NO: 1623069 - protein, 6 aa, Staphylococcus aureus
VKPETK

SEQ ID NO: 1623070 - protein, 10 aa, Staphylococcus aureus
VKYKTKNGKI

SEQ ID NO: 1623071 - protein, 25 aa, Staphylococcus aureus
VNAAKQALNGNANVQHAKDEATALI

SEQ ID NO: 1623072 - protein, 17 aa, Staphylococcus aureus
VNKSTLSRYENGSRKIP

SEQ ID NO: 1623073 - protein, 14 aa, Staphylococcus aureus
VPSNNKSNSNNSTL

SEQ ID NO: 1623074 - protein, 7 aa, Staphylococcus aureus
VPSSPSF

SEQ ID NO: 1623075 - protein, 14 aa, Staphylococcus aureus
VTAAKNKATSLNTA

SEQ ID NO: 1623076 - protein, 11 aa, Staphylococcus aureus
VTKNEDSVTGS

SEQ ID NO: 1623077 - protein, 8 aa, Staphylococcus aureus
VTRGNNNQ

SEQ ID NO: 1623078 - protein, 9 aa, Staphylococcus aureus
WGNVQGQVS

SEQ ID NO: 1623079 - protein, 21 aa, Staphylococcus aureus
WPKKPNKKRQTKYFGGKVKSD

SEQ ID NO: 1623080 - protein, 5 aa, Staphylococcus aureus
WVDED

SEQ ID NO: 1623081 - protein, 21 aa, Staphylococcus aureus
YDEAYTSYQKGGFHEKEHKEL

SEQ ID NO: 1623082 - protein, 17 aa, Staphylococcus aureus
YDTTPVERDEVTAATTA

SEQ ID NO: 1623083 - protein, 9 aa, Staphylococcus aureus
YEVGEQASP

SEQ ID NO: 1623084 - protein, 7 aa, Staphylococcus aureus
YGKDDEI

SEQ ID NO: 1623085 - protein, 12 aa, Staphylococcus aureus
YKNGTPEEKAEI

SEQ ID NO: 1623086 - protein, 6 aa, Staphylococcus aureus
YKNLTN

SEQ ID NO: 1623087 - protein, 6 aa, Staphylococcus aureus
YKTSQK

SEQ ID NO: 1623088 - protein, 8 aa, Staphylococcus aureus
YNDGVPDY

SEQ ID NO: 1623089 - protein, 27 aa, Staphylococcus aureus
YNEKKKKFGKNWEDAQKAGKAVGEDLS

SEQ ID NO: 1623090 - protein, 10 aa, Staphylococcus aureus
YSLTQKGKKL

SEQ ID NO: 1623091 - protein, 16 aa, Staphylococcus aureus
YSTDLESNNDPEKWSV

SEQ ID NO: 1623092 - protein, 13 aa, Staphylococcus aureus
YTDSKYNIAPDEL

SEQ ID NO: 1623093 - protein, 6 aa, Staphylococcus aureus
YYDPER

SEQ ID NO: 1623094 - protein, 5 aa, Staphylococcus aureus
YYEEN

SEQ ID NO: 1623095 - protein, 5 aa, Staphylococcus aureus
YYEQG

SEQ ID NO: 1623096 - protein, 8 aa, Staphylococcus aureus
AAKRRNMQ

SEQ ID NO: 1623097 - protein, 5 aa, Staphylococcus aureus
ADESY

SEQ ID NO: 1623098 - protein, 9 aa, Staphylococcus aureus
ADHTSESTV

SEQ ID NO: 1623099 - protein, 14 aa, Staphylococcus aureus
AEERKNEKLEKENI

SEQ ID NO: 1623100 - protein, 14 aa, Staphylococcus aureus
AEERKNKKLEKENI

SEQ ID NO: 1623101 - protein, 21 aa, Staphylococcus aureus
AFTKEEADKLYQPIGSSQPSL

SEQ ID NO: 1623102 - protein, 7 aa, Staphylococcus aureus
AGKGEAV

SEQ ID NO: 1623103 - protein, 12 aa, Staphylococcus aureus
AIQTAQELNTAM

SEQ ID NO: 1623104 - protein, 11 aa, Staphylococcus aureus
AKLKEAIERSA

SEQ ID NO: 1623105 - protein, 9 aa, Staphylococcus aureus
AKQQANNRL

SEQ ID NO: 1623106 - protein, 6 aa, Staphylococcus aureus
ALAEGG

SEQ ID NO: 1623107 - protein, 15 aa, Staphylococcus aureus
ALSAARPGARKETLE

SEQ ID NO: 1623108 - protein, 28 aa, Staphylococcus aureus
ANSRISDLENKAQAYSRTFDEQKRYMDE

SEQ ID NO: 1623109 - protein, 28 aa, Staphylococcus aureus
APKPLAGLNGESHDFTTTHQSPTTSNHT

SEQ ID NO: 1623110 - protein, 5 aa, Staphylococcus aureus
APYTA

SEQ ID NO: 1623111 - protein, 5 aa, Staphylococcus aureus
ARSGD

SEQ ID NO: 1623112 - protein, 11 aa, Staphylococcus aureus
ASAHPSNFRQQ

SEQ ID NO: 1623113 - protein, 4 aa, Staphylococcus aureus
ASIN

SEQ ID NO: 1623114 - protein, 5 aa, Staphylococcus aureus
ASINK

SEQ ID NO: 1623115 - protein, 6 aa, Staphylococcus aureus
ASPEFE

SEQ ID NO: 1623116 - protein, 15 aa, Staphylococcus aureus
ATEEMKARRNKVSEE

SEQ ID NO: 1623117 - protein, 7 aa, Staphylococcus aureus
ATLAGEV

SEQ ID NO: 1623118 - protein, 6 aa, Staphylococcus aureus
ATNQPL

SEQ ID NO: 1623119 - protein, 4 aa, Staphylococcus aureus
ATYD

SEQ ID NO: 1623120 - protein, 7 aa, Staphylococcus aureus
AVNKGYT

SEQ ID NO: 1623121 - protein, 24 aa, Staphylococcus aureus
AVNQAKDNLHGDQKLADDKQHAVT

SEQ ID NO: 1623122 - protein, 10 aa, Staphylococcus aureus
CKKQKIEDTL

SEQ ID NO: 1623123 - protein, 12 aa, Staphylococcus aureus
CNKELEKKASAW

SEQ ID NO: 1623124 - protein, 9 aa, Staphylococcus aureus
CRKDKDGKL

SEQ ID NO: 1623125 - protein, 7 aa, Staphylococcus aureus
DAKEGNI

SEQ ID NO: 1623126 - protein, 5 aa, Staphylococcus aureus
DAMPN

SEQ ID NO: 1623127 - protein, 24 aa, Staphylococcus aureus
DDAEDGNLINTSDEDKTTDEEKKH

SEQ ID NO: 1623128 - protein, 4 aa, Staphylococcus aureus
DDED

SEQ ID NO: 1623129 - protein, 7 aa, Staphylococcus aureus
DDNTTVF

SEQ ID NO: 1623130 - protein, 5 aa, Staphylococcus aureus
DERSR

SEQ ID NO: 1623131 - protein, 6 aa, Staphylococcus aureus
DETTVQ

SEQ ID NO: 1623132 - protein, 6 aa, Staphylococcus aureus
DGAEDI

SEQ ID NO: 1623133 - protein, 4 aa, Staphylococcus aureus
DGTM

SEQ ID NO: 1623134 - protein, 7 aa, Staphylococcus aureus
DHEVEGS

SEQ ID NO: 1623135 - protein, 7 aa, Staphylococcus aureus
DKDENLI

SEQ ID NO: 1623136 - protein, 16 aa, Staphylococcus aureus
DKEGYRDGEFKKGDKG

SEQ ID NO: 1623137 - protein, 8 aa, Staphylococcus aureus
DKFKYDND

SEQ ID NO: 1623138 - protein, 11 aa, Staphylococcus aureus
DKQKNKKTPVV

SEQ ID NO: 1623139 - protein, 4 aa, Staphylococcus aureus
DKVD

SEQ ID NO: 1623140 - protein, 5 aa, Staphylococcus aureus
DKVTQ

SEQ ID NO: 1623141 - protein, 12 aa, Staphylococcus aureus
DLRNGKTKLEDA

SEQ ID NO: 1623142 - protein, 6 aa, Staphylococcus aureus
DNENRR

SEQ ID NO: 1623143 - protein, 6 aa, Staphylococcus aureus
DNEPFH

SEQ ID NO: 1623144 - protein, 7 aa, Staphylococcus aureus
DNPEEAV

SEQ ID NO: 1623145 - protein, 4 aa, Staphylococcus aureus
DNRQ

SEQ ID NO: 1623146 - protein, 7 aa, Staphylococcus aureus
DNRTTKV

SEQ ID NO: 1623147 - protein, 4 aa, Staphylococcus aureus
DQLR

SEQ ID NO: 1623148 - protein, 9 aa, Staphylococcus aureus
DSETTRTAV

SEQ ID NO: 1623149 - protein, 10 aa, Staphylococcus aureus
DSFPKQEKLT

SEQ ID NO: 1623150 - protein, 10 aa, Staphylococcus aureus
DSPLDIESTE

SEQ ID NO: 1623151 - protein, 20 aa, Staphylococcus aureus
DSTARATWYPDDSNDEYTKY

SEQ ID NO: 1623152 - protein, 4 aa, Staphylococcus aureus
DTPE

SEQ ID NO: 1623153 - protein, 6 aa, Staphylococcus aureus
DTRSIT

SEQ ID NO: 1623154 - protein, 9 aa, Staphylococcus aureus
DVDDEKETL

SEQ ID NO: 1623155 - protein, 9 aa, Staphylococcus aureus
DVEENHTET

SEQ ID NO: 1623156 - protein, 13 aa, Staphylococcus aureus
DVTQARDEVGKSI

SEQ ID NO: 1623157 - protein, 8 aa, Staphylococcus aureus
EAGEQATF

SEQ ID NO: 1623158 - protein, 4 aa, Staphylococcus aureus
EANY

SEQ ID NO: 1623159 - protein, 5 aa, Staphylococcus aureus
EDDVD

SEQ ID NO: 1623160 - protein, 6 aa, Staphylococcus aureus
EDENIG

SEQ ID NO: 1623161 - protein, 5 aa, Staphylococcus aureus
EDFSD

SEQ ID NO: 1623162 - protein, 5 aa, Staphylococcus aureus
EEELS

SEQ ID NO: 1623163 - protein, 8 aa, Staphylococcus aureus
EEGNRRPL

SEQ ID NO: 1623164 - protein, 9 aa, Staphylococcus aureus
EEIGVNRDT

SEQ ID NO: 1623165 - protein, 15 aa, Staphylococcus aureus
EEKGYIRRDPTKPRA

SEQ ID NO: 1623166 - protein, 14 aa, Staphylococcus aureus
EELNENLKTIHDAR

SEQ ID NO: 1623167 - protein, 6 aa, Staphylococcus aureus
EEPNYK

SEQ ID NO: 1623168 - protein, 19 aa, Staphylococcus aureus
EESSYTTEQVFGVSGGVQI

SEQ ID NO: 1623169 - protein, 63 aa, Staphylococcus aureus
EEVEVPDKQQQVNEAPAKEQSQQTTKQNAIKSVPQKSASRYTTTSEERNNRMSNYSKNNSRNV

SEQ ID NO: 1623170 - protein, 7 aa, Staphylococcus aureus
EGLEDKL

SEQ ID NO: 1623171 - protein, 7 aa, Staphylococcus aureus
EGVSTSE

SEQ ID NO: 1623172 - protein, 6 aa, Staphylococcus aureus
EIQETG

SEQ ID NO: 1623173 - protein, 14 aa, Staphylococcus aureus
EKAVDENYKEYRAT

SEQ ID NO: 1623174 - protein, 16 aa, Staphylococcus aureus
EKEKEAKEKVDKTAKE

SEQ ID NO: 1623175 - protein, 10 aa, Staphylococcus aureus
EKGYKENEDK

SEQ ID NO: 1623176 - protein, 17 aa, Staphylococcus aureus
EKRTNNVVKKSDWDKGD

SEQ ID NO: 1623177 - protein, 6 aa, Staphylococcus aureus
EKSNDW

SEQ ID NO: 1623178 - protein, 12 aa, Staphylococcus aureus
EKYPETKDEKSQ

SEQ ID NO: 1623179 - protein, 7 aa, Staphylococcus aureus
ELGGKSP

SEQ ID NO: 1623180 - protein, 5 aa, Staphylococcus aureus
ELNES

SEQ ID NO: 1623181 - protein, 14 aa, Staphylococcus aureus
ENAYDEERKQLNDA

SEQ ID NO: 1623182 - protein, 6 aa, Staphylococcus aureus
ENCDDK

SEQ ID NO: 1623183 - protein, 8 aa, Staphylococcus aureus
ENDDEVQH

SEQ ID NO: 1623184 - protein, 8 aa, Staphylococcus aureus
ENDSDQIV

SEQ ID NO: 1623185 - protein, 4 aa, Staphylococcus aureus
ENEF

SEQ ID NO: 1623186 - protein, 10 aa, Staphylococcus aureus
ENEKKYQYTG

SEQ ID NO: 1623187 - protein, 12 aa, Staphylococcus aureus
ENHNKKQKNAPA

SEQ ID NO: 1623188 - protein, 18 aa, Staphylococcus aureus
EQLEEQNKVTSIDGYKES

SEQ ID NO: 1623189 - protein, 19 aa, Staphylococcus aureus
EQTEAELRERRSELQRQET

SEQ ID NO: 1623190 - protein, 14 aa, Staphylococcus aureus
ESKSGYGLDRENEL

SEQ ID NO: 1623191 - protein, 10 aa, Staphylococcus aureus
ESRLTEDENV

SEQ ID NO: 1623192 - protein, 5 aa, Staphylococcus aureus
ESTVR

SEQ ID NO: 1623193 - protein, 4 aa, Staphylococcus aureus
ETLQ

SEQ ID NO: 1623194 - protein, 7 aa, Staphylococcus aureus
EVTEETK

SEQ ID NO: 1623195 - protein, 11 aa, Staphylococcus aureus
EYREKKTIERL

SEQ ID NO: 1623196 - protein, 5 aa, Staphylococcus aureus
FAPSG

SEQ ID NO: 1623197 - protein, 4 aa, Staphylococcus aureus
FDGK

SEQ ID NO: 1623198 - protein, 4 aa, Staphylococcus aureus
FDSK

SEQ ID NO: 1623199 - protein, 15 aa, Staphylococcus aureus
FDYKGDGAYTSGQHP

SEQ ID NO: 1623200 - protein, 9 aa, Staphylococcus aureus
FENDSDEIV

SEQ ID NO: 1623201 - protein, 21 aa, Staphylococcus aureus
FESGEWSQETAEKRGKKVRAI

SEQ ID NO: 1623202 - protein, 6 aa, Staphylococcus aureus
FGGGYG

SEQ ID NO: 1623203 - protein, 8 aa, Staphylococcus aureus
FGTEGNRN

SEQ ID NO: 1623204 - protein, 14 aa, Staphylococcus aureus
FKDERDEYKKQRDE

SEQ ID NO: 1623205 - protein, 10 aa, Staphylococcus aureus
FNKKKQKIDA

SEQ ID NO: 1623206 - protein, 4 aa, Staphylococcus aureus
FTID

SEQ ID NO: 1623207 - protein, 8 aa, Staphylococcus aureus
GAENPSVD

SEQ ID NO: 1623208 - protein, 8 aa, Staphylococcus aureus
GAHNNTLG

SEQ ID NO: 1623209 - protein, 8 aa, Staphylococcus aureus
GANSNITY

SEQ ID NO: 1623210 - protein, 20 aa, Staphylococcus aureus
GDIKDVEEALQGTKMTREDL

SEQ ID NO: 1623211 - protein, 4 aa, Staphylococcus aureus
GDSE

SEQ ID NO: 1623212 - protein, 10 aa, Staphylococcus aureus
GDSVDQGGQH

SEQ ID NO: 1623213 - protein, 12 aa, Staphylococcus aureus
GDYIAPSTSTFK

SEQ ID NO: 1623214 - protein, 19 aa, Staphylococcus aureus
GEGAYRGSQPLKPLNDSNL

SEQ ID NO: 1623215 - protein, 17 aa, Staphylococcus aureus
GFGHKDTTKTAGSKRKI

SEQ ID NO: 1623216 - protein, 12 aa, Staphylococcus aureus
GGSSQSQDMYQD

SEQ ID NO: 1623217 - protein, 8 aa, Staphylococcus aureus
GINEPARE

SEQ ID NO: 1623218 - protein, 20 aa, Staphylococcus aureus
GIPSKLSSSWSSAKSSVGYH

SEQ ID NO: 1623219 - protein, 5 aa, Staphylococcus aureus
GIRHQ

SEQ ID NO: 1623220 - protein, 7 aa, Staphylococcus aureus
GIRTHGD

SEQ ID NO: 1623221 - protein, 11 aa, Staphylococcus aureus
GITNPSDEQGI

SEQ ID NO: 1623222 - protein, 10 aa, Staphylococcus aureus
GKPDKKNYRK

SEQ ID NO: 1623223 - protein, 8 aa, Staphylococcus aureus
GKPDPVRG

SEQ ID NO: 1623224 - protein, 10 aa, Staphylococcus aureus
GLTQEEAINE

SEQ ID NO: 1623225 - protein, 72 aa, Staphylococcus aureus
GQQRPTSIPTLAPKEEKETNIKNANKLKSDTEAAKNDEAKRSLNTHNHKSVSQEVSEQQKADYERKAEERKA

SEQ ID NO: 1623226 - protein, 10 aa, Staphylococcus aureus
GQRTDIKSEQ

SEQ ID NO: 1623227 - protein, 8 aa, Staphylococcus aureus
GQVGRQNY

SEQ ID NO: 1623228 - protein, 8 aa, Staphylococcus aureus
GREGRNIR

SEQ ID NO: 1623229 - protein, 15 aa, Staphylococcus aureus
GSTNPSEASPGSIRG

SEQ ID NO: 1623230 - protein, 14 aa, Staphylococcus aureus
GTKNTAEAAKNAEV

SEQ ID NO: 1623231 - protein, 7 aa, Staphylococcus aureus
GTNPEMG

SEQ ID NO: 1623232 - protein, 9 aa, Staphylococcus aureus
GVEATTQIK

SEQ ID NO: 1623233 - protein, 5 aa, Staphylococcus aureus
GVNIG

SEQ ID NO: 1623234 - protein, 7 aa, Staphylococcus aureus
GVPSDQW

SEQ ID NO: 1623235 - protein, 7 aa, Staphylococcus aureus
GYSDNQP

SEQ ID NO: 1623236 - protein, 7 aa, Staphylococcus aureus
HAGGSLA

SEQ ID NO: 1623237 - protein, 8 aa, Staphylococcus aureus
HAQQQALT

SEQ ID NO: 1623238 - protein, 6 aa, Staphylococcus aureus
HDANEP

SEQ ID NO: 1623239 - protein, 13 aa, Staphylococcus aureus
HDQPRRVSTWGDD

SEQ ID NO: 1623240 - protein, 20 aa, Staphylococcus aureus
HEESPGETVELDGKQYKEYF

SEQ ID NO: 1623241 - protein, 17 aa, Staphylococcus aureus
HEYEKRKDNDKGKTFNY

SEQ ID NO: 1623242 - protein, 7 aa, Staphylococcus aureus
HGDVEPT

SEQ ID NO: 1623243 - protein, 6 aa, Staphylococcus aureus
HGLSKG

SEQ ID NO: 1623244 - protein, 9 aa, Staphylococcus aureus
HKKKQTIDA

SEQ ID NO: 1623245 - protein, 24 aa, Staphylococcus aureus
HPKKDRAAYEARQAIPNINENSPP

SEQ ID NO: 1623246 - protein, 6 aa, Staphylococcus aureus
HSGGHS

SEQ ID NO: 1623247 - protein, 18 aa, Staphylococcus aureus
HVEKKSGKFVKPKAMGGI

SEQ ID NO: 1623248 - protein, 12 aa, Staphylococcus aureus
IDKEEFKKEDDY

SEQ ID NO: 1623249 - protein, 27 aa, Staphylococcus aureus
IDKNKESLQKAKEIAGEKASEYFNKAM

SEQ ID NO: 1623250 - protein, 6 aa, Staphylococcus aureus
IEANAN

SEQ ID NO: 1623251 - protein, 8 aa, Staphylococcus aureus
IEEGGPVT

SEQ ID NO: 1623252 - protein, 5 aa, Staphylococcus aureus
IEKGY

SEQ ID NO: 1623253 - protein, 16 aa, Staphylococcus aureus
IKGKRQNSLKITGIEF

SEQ ID NO: 1623254 - protein, 8 aa, Staphylococcus aureus
IKKEDSLK

SEQ ID NO: 1623255 - protein, 18 aa, Staphylococcus aureus
IKQYGTPLPVKEAKDDEY

SEQ ID NO: 1623256 - protein, 6 aa, Staphylococcus aureus
INESDV

SEQ ID NO: 1623257 - protein, 9 aa, Staphylococcus aureus
INFSNPSGT

SEQ ID NO: 1623258 - protein, 10 aa, Staphylococcus aureus
INGTPNATLT

SEQ ID NO: 1623259 - protein, 10 aa, Staphylococcus aureus
INNDKNNAIA

SEQ ID NO: 1623260 - protein, 14 aa, Staphylococcus aureus
INRDQEETKETEIQ

SEQ ID NO: 1623261 - protein, 5 aa, Staphylococcus aureus
IPFNN

SEQ ID NO: 1623262 - protein, 6 aa, Staphylococcus aureus
IQGEAG

SEQ ID NO: 1623263 - protein, 8 aa, Staphylococcus aureus
IQPKSVTA

SEQ ID NO: 1623264 - protein, 6 aa, Staphylococcus aureus
IQRTAD

SEQ ID NO: 1623265 - protein, 12 aa, Staphylococcus aureus
ISGAKSKRPGLD

SEQ ID NO: 1623266 - protein, 23 aa, Staphylococcus aureus
ISPLRKADDAVTLDTTGKSIEEV

SEQ ID NO: 1623267 - protein, 23 aa, Staphylococcus aureus
ISRQLTKEKHDQVSGYKQKTEYH

SEQ ID NO: 1623268 - protein, 22 aa, Staphylococcus aureus
ISTNPDVSIPKERGLLPGNGAI

SEQ ID NO: 1623269 - protein, 12 aa, Staphylococcus aureus
ITGLENPNSPTQ

SEQ ID NO: 1623270 - protein, 4 aa, Staphylococcus aureus
ITTA

SEQ ID NO: 1623271 - protein, 5 aa, Staphylococcus aureus
KAKQF

SEQ ID NO: 1623272 - protein, 6 aa, Staphylococcus aureus
KAQQDM

SEQ ID NO: 1623273 - protein, 9 aa, Staphylococcus aureus
KAVNPPNVM

SEQ ID NO: 1623274 - protein, 5 aa, Staphylococcus aureus
KDAME

SEQ ID NO: 1623275 - protein, 7 aa, Staphylococcus aureus
KDHLSAE

SEQ ID NO: 1623276 - protein, 5 aa, Staphylococcus aureus
KDKQA

SEQ ID NO: 1623277 - protein, 5 aa, Staphylococcus aureus
KEFAQ

SEQ ID NO: 1623278 - protein, 16 aa, Staphylococcus aureus
KEGFRDQEFEKGDKGT

SEQ ID NO: 1623279 - protein, 8 aa, Staphylococcus aureus
KEHANRYP

SEQ ID NO: 1623280 - protein, 6 aa, Staphylococcus aureus
KEINAD

SEQ ID NO: 1623281 - protein, 17 aa, Staphylococcus aureus
KELQRKKIRDTNIGKEL

SEQ ID NO: 1623282 - protein, 13 aa, Staphylococcus aureus
KFNASKSKELETI

SEQ ID NO: 1623283 - protein, 6 aa, Staphylococcus aureus
KGRAYL

SEQ ID NO: 1623284 - protein, 10 aa, Staphylococcus aureus
KGTVKAVDET

SEQ ID NO: 1623285 - protein, 5 aa, Staphylococcus aureus
KHGNQ

SEQ ID NO: 1623286 - protein, 5 aa, Staphylococcus aureus
KHKGK

SEQ ID NO: 1623287 - protein, 17 aa, Staphylococcus aureus
KHSTNRYTYHEGSTAGG

SEQ ID NO: 1623288 - protein, 16 aa, Staphylococcus aureus
KIARSSLTSMAQNDSE

SEQ ID NO: 1623289 - protein, 4 aa, Staphylococcus aureus
KIEE

SEQ ID NO: 1623290 - protein, 7 aa, Staphylococcus aureus
KIKGEID

SEQ ID NO: 1623291 - protein, 4 aa, Staphylococcus aureus
KKDH

SEQ ID NO: 1623292 - protein, 8 aa, Staphylococcus aureus
KKIGEEAK

SEQ ID NO: 1623293 - protein, 9 aa, Staphylococcus aureus
KKIPSPKLA

SEQ ID NO: 1623294 - protein, 4 aa, Staphylococcus aureus
KKLS

SEQ ID NO: 1623295 - protein, 9 aa, Staphylococcus aureus
KKSFNTSHD

SEQ ID NO: 1623296 - protein, 8 aa, Staphylococcus aureus
KKYGENET

SEQ ID NO: 1623297 - protein, 11 aa, Staphylococcus aureus
KLELKSGSRIS

SEQ ID NO: 1623298 - protein, 5 aa, Staphylococcus aureus
KLNNS

SEQ ID NO: 1623299 - protein, 7 aa, Staphylococcus aureus
KLTDHGE

SEQ ID NO: 1623300 - protein, 8 aa, Staphylococcus aureus
KNDATKKS

SEQ ID NO: 1623301 - protein, 6 aa, Staphylococcus aureus
KNDTNW

SEQ ID NO: 1623302 - protein, 4 aa, Staphylococcus aureus
KNFD

SEQ ID NO: 1623303 - protein, 12 aa, Staphylococcus aureus
KNNRPLSISSEH

SEQ ID NO: 1623304 - protein, 15 aa, Staphylococcus aureus
KNNVPYKKEQGNYTV

SEQ ID NO: 1623305 - protein, 7 aa, Staphylococcus aureus
KNQIEDE

SEQ ID NO: 1623306 - protein, 4 aa, Staphylococcus aureus
KNQL

SEQ ID NO: 1623307 - protein, 35 aa, Staphylococcus aureus; identical to SEQ ID NO: 1564130

SEQ ID NO: 1623308 - protein, 15 aa, Staphylococcus aureus
KPNEDDRDGEVPYHS

SEQ ID NO: 1623309 - protein, 6 aa, Staphylococcus aureus
KPRNDE

SEQ ID NO: 1623310 - protein, 7 aa, Staphylococcus aureus
KQGYIGT

SEQ ID NO: 1623311 - protein, 14 aa, Staphylococcus aureus
KQTGPNTAKTAVEQ

SEQ ID NO: 1623312 - protein, 5 aa, Staphylococcus aureus
KRAIL

SEQ ID NO: 1623313 - protein, 4 aa, Staphylococcus aureus
KREK

SEQ ID NO: 1623314 - protein, 12 aa, Staphylococcus aureus
KRSLKTKEEAVN

SEQ ID NO: 1623315 - protein, 10 aa, Staphylococcus aureus
KRVTAQGNTI

SEQ ID NO: 1623316 - protein, 8 aa, Staphylococcus aureus
KSGCGKST

SEQ ID NO: 1623317 - protein, 8 aa, Staphylococcus aureus
KSIRGSDV

SEQ ID NO: 1623318 - protein, 18 aa, Staphylococcus aureus
KSKTNTRGIQRENKNYEN

SEQ ID NO: 1623319 - protein, 6 aa, Staphylococcus aureus
KTLDID

SEQ ID NO: 1623320 - protein, 10 aa, Staphylococcus aureus
KTSGSKLTTL

SEQ ID NO: 1623321 - protein, 7 aa, Staphylococcus aureus
KTVKDNM

SEQ ID NO: 1623322 - protein, 6 aa, Staphylococcus aureus
KVDPKN

SEQ ID NO: 1623323 - protein, 16 aa, Staphylococcus aureus
KVNRAKKDLAKQNPMD

SEQ ID NO: 1623324 - protein, 5 aa, Staphylococcus aureus
LAPDE

SEQ ID NO: 1623325 - protein, 16 aa, Staphylococcus aureus
LGALTDRNGLRPGRYT

SEQ ID NO: 1623326 - protein, 10 aa, Staphylococcus aureus
LGEDETLAKR

SEQ ID NO: 1623327 - protein, 5 aa, Staphylococcus aureus
LHDSL

SEQ ID NO: 1623328 - protein, 7 aa, Staphylococcus aureus
LKDKSME

SEQ ID NO: 1623329 - protein, 11 aa, Staphylococcus aureus
LKNQQNEDKTL

SEQ ID NO: 1623330 - protein, 8 aa, Staphylococcus aureus
LKQQADTI

SEQ ID NO: 1623331 - protein, 10 aa, Staphylococcus aureus
LKTARTNADV

SEQ ID NO: 1623332 - protein, 18 aa, Staphylococcus aureus
LPDIDEGDANDKSQNNQS

SEQ ID NO: 1623333 - protein, 14 aa, Staphylococcus aureus
LPITKSELEEQESK

SEQ ID NO: 1623334 - protein, 7 aa, Staphylococcus aureus
LRDPNYR

SEQ ID NO: 1623335 - protein, 6 aa, Staphylococcus aureus
LSDDTR

SEQ ID NO: 1623336 - protein, 5 aa, Staphylococcus aureus
LSESD

SEQ ID NO: 1623337 - protein, 9 aa, Staphylococcus aureus
LSPINDKND

SEQ ID NO: 1623338 - protein, 7 aa, Staphylococcus aureus
LSRETGV

SEQ ID NO: 1623339 - protein, 16 aa, Staphylococcus aureus
LSSATVDQLKDYDGVT

SEQ ID NO: 1623340 - protein, 23 aa, Staphylococcus aureus
LSVGNKAKGIIKQATTKKEAVIK

SEQ ID NO: 1623341 - protein, 6 aa, Staphylococcus aureus
LTEAQA

SEQ ID NO: 1623342 - protein, 7 aa, Staphylococcus aureus
MKKRARK

SEQ ID NO: 1623343 - protein, 5 aa, Staphylococcus aureus
MNRAA

SEQ ID NO: 1623344 - protein, 11 aa, Staphylococcus aureus
MTATSDNKHKS

SEQ ID NO: 1623345 - protein, 6 aa, Staphylococcus aureus
NACKDT

SEQ ID NO: 1623346 - protein, 4 aa, Staphylococcus aureus
NAKS

SEQ ID NO: 1623347 - protein, 33 aa, Staphylococcus aureus; identical to SEQ ID NO: 1565724

SEQ ID NO: 1623348 - protein, 33 aa, Staphylococcus aureus; identical to SEQ ID NO: 1565905

SEQ ID NO: 1623349 - protein, 7 aa, Staphylococcus aureus
NDETHRT

SEQ ID NO: 1623350 - protein, 7 aa, Staphylococcus aureus
NDKVRLD

SEQ ID NO: 1623351 - protein, 4 aa, Staphylococcus aureus
NDVA

SEQ ID NO: 1623352 - protein, 4 aa, Staphylococcus aureus
NEAD

SEQ ID NO: 1623353 - protein, 18 aa, Staphylococcus aureus
NENLSARSIEKRTTEYNT

SEQ ID NO: 1623354 - protein, 12 aa, Staphylococcus aureus
NEQSHQDDSFSD

SEQ ID NO: 1623355 - protein, 7 aa, Staphylococcus aureus
NETEKDA

SEQ ID NO: 1623356 - protein, 19 aa, Staphylococcus aureus
NFTDADPEKQTAYNNAVTA

SEQ ID NO: 1623357 - protein, 5 aa, Staphylococcus aureus
NGDHN

SEQ ID NO: 1623358 - protein, 6 aa, Staphylococcus aureus
NGGKYT

SEQ ID NO: 1623359 - protein, 10 aa, Staphylococcus aureus
NGKEVSPEEL

SEQ ID NO: 1623360 - protein, 34 aa, Staphylococcus aureus
NHSSGKRQTIQPKAKPFAKRGFSQRTTSTKKQVL

SEQ ID NO: 1623361 - protein, 10 aa, Staphylococcus aureus
NIGTPNDLPG

SEQ ID NO: 1623362 - protein, 11 aa, Staphylococcus aureus
NIVNGSPNVIT

SEQ ID NO: 1623363 - protein, 15 aa, Staphylococcus aureus
NKDFSDRANEELKKY

SEQ ID NO: 1623364 - protein, 15 aa, Staphylococcus aureus
NKDHGANKDKQAVEQ

SEQ ID NO: 1623365 - protein, 7 aa, Staphylococcus aureus
NKKTNHY

SEQ ID NO: 1623366 - protein, 7 aa, Staphylococcus aureus
NKPTSRQ

SEQ ID NO: 1623367 - protein, 6 aa, Staphylococcus aureus
NKTSSM

SEQ ID NO: 1623368 - protein, 10 aa, Staphylococcus aureus
NNAKKKPFTI

SEQ ID NO: 1623369 - protein, 14 aa, Staphylococcus aureus
NNDEQFFKKKYQAQ

SEQ ID NO: 1623370 - protein, 27 aa, Staphylococcus aureus
NNPTINKGNVTSATQAVTSSKNALDGV

SEQ ID NO: 1623371 - protein, 14 aa, Staphylococcus aureus
NNTLETFDATDPEV

SEQ ID NO: 1623372 - protein, 11 aa, Staphylococcus aureus
NPELRGQKLGR

SEQ ID NO: 1623373 - protein, 10 aa, Staphylococcus aureus
NPSKSTAKEM

SEQ ID NO: 1623374 - protein, 13 aa, Staphylococcus aureus
NQIEKQESRHETT

SEQ ID NO: 1623375 - protein, 7 aa, Staphylococcus aureus
NQKLTKQ

SEQ ID NO: 1623376 - protein, 28 aa, Staphylococcus aureus
NQNTESTSAISKASYEVENANNNGLSKR

SEQ ID NO: 1623377 - protein, 16 aa, Staphylococcus aureus
NQYSYQADKVGLASDN

SEQ ID NO: 1623378 - protein, 4 aa, Staphylococcus aureus
NRTS

SEQ ID NO: 1623379 - protein, 50 aa, Staphylococcus aureus
NSEDEEMLENTATNDTGASQTTIDDQVEAPMSSNDSEEVMSDSTKTDTNV

SEQ ID NO: 1623380 - protein, 4 aa, Staphylococcus aureus
NSFR

SEQ ID NO: 1623381 - protein, 5 aa, Staphylococcus aureus
NSIKS

SEQ ID NO: 1623382 - protein, 15 aa, Staphylococcus aureus
NSKTTEEKREAYAQD

SEQ ID NO: 1623383 - protein, 26 aa, Staphylococcus aureus
NSSNDLNQAQKDALKQQVQNATTVAG

SEQ ID NO: 1623384 - protein, 10 aa, Staphylococcus aureus
NSWTGSPGSL

SEQ ID NO: 1623385 - protein, 7 aa, Staphylococcus aureus
NVRQGLK

SEQ ID NO: 1623386 - protein, 17 aa, Staphylococcus aureus
NYINADDNLKANYDNAI

SEQ ID NO: 1623387 - protein, 15 aa, Staphylococcus aureus
PANTEPIRGGTDGSQ

SEQ ID NO: 1623388 - protein, 4 aa, Staphylococcus aureus
PAQI

SEQ ID NO: 1623389 - protein, 7 aa, Staphylococcus aureus
PDNQPIF

SEQ ID NO: 1623390 - protein, 9 aa, Staphylococcus aureus
PDPKTNQPM

SEQ ID NO: 1623391 - protein, 5 aa, Staphylococcus aureus
PFNKE

SEQ ID NO: 1623392 - protein, 7 aa, Staphylococcus aureus
PINDEDV

SEQ ID NO: 1623393 - protein, 11 aa, Staphylococcus aureus
PNESKAATKIA

SEQ ID NO: 1623394 - protein, 10 aa, Staphylococcus aureus
PNKGEKSTTL

SEQ ID NO: 1623395 - protein, 12 aa, Staphylococcus aureus
PVTNFEQANKSD

SEQ ID NO: 1623396 - protein, 9 aa, Staphylococcus aureus
PYKRPLSNM

SEQ ID NO: 1623397 - protein, 26 aa, Staphylococcus aureus
QAATTKKSDAKAEIAQKASERKTAIE

SEQ ID NO: 1623398 - protein, 9 aa, Staphylococcus aureus
QAATTLNDA

SEQ ID NO: 1623399 - protein, 4 aa, Staphylococcus aureus
QAFD

SEQ ID NO: 1623400 - protein, 32 aa, Staphylococcus aureus; identical to SEQ ID NO: 1565152

SEQ ID NO: 1623401 - protein, 11 aa, Staphylococcus aureus
QAIPNINENSP

SEQ ID NO: 1623402 - protein, 7 aa, Staphylococcus aureus
QAKDQMD

SEQ ID NO: 1623403 - protein, 11 aa, Staphylococcus aureus
QAKENDKNYPG

SEQ ID NO: 1623404 - protein, 15 aa, Staphylococcus aureus
QAPTDKAIQRIDEPD

SEQ ID NO: 1623405 - protein, 9 aa, Staphylococcus aureus
QCQDDDKDV

SEQ ID NO: 1623406 - protein, 5 aa, Staphylococcus aureus
QDATI

SEQ ID NO: 1623407 - protein, 29 aa, Staphylococcus aureus
QELEKRDAEAKREKLRSNALGKAQELNLP

SEQ ID NO: 1623408 - protein, 15 aa, Staphylococcus aureus
QETKTFQTSLNPSIA

SEQ ID NO: 1623409 - protein, 7 aa, Staphylococcus aureus
QGKPALD

SEQ ID NO: 1623410 - protein, 4 aa, Staphylococcus aureus
QIAR

SEQ ID NO: 1623411 - protein, 13 aa, Staphylococcus aureus
QIVTEEKDDNHGS

SEQ ID NO: 1623412 - protein, 41 aa, Staphylococcus aureus
QKGVESKFKSSGRDVKESRNQDLDPSNVKSIEEMAKEINIR

SEQ ID NO: 1623413 - protein, 6 aa, Staphylococcus aureus
QNATSS

SEQ ID NO: 1623414 - protein, 9 aa, Staphylococcus aureus
QNDETYTTM

SEQ ID NO: 1623415 - protein, 36 aa, Staphylococcus aureus; identical to SEQ ID NO: 1565941

SEQ ID NO: 1623416 - protein, 31 aa, Staphylococcus aureus; identical to SEQ ID NO: 1566089

SEQ ID NO: 1623417 - protein, 6 aa, Staphylococcus aureus
QQDLKN

SEQ ID NO: 1623418 - protein, 18 aa, Staphylococcus aureus
QQGRNEGVGKAKITRGYN

SEQ ID NO: 1623419 - protein, 16 aa, Staphylococcus aureus
QRPEVKKNLKSRSMGT

SEQ ID NO: 1623420 - protein, 10 aa, Staphylococcus aureus
QRVDNENDKQ

SEQ ID NO: 1623421 - protein, 9 aa, Staphylococcus aureus
QSEDAKERI

SEQ ID NO: 1623422 - protein, 8 aa, Staphylococcus aureus
QSGQRITT

SEQ ID NO: 1623423 - protein, 34 aa, Staphylococcus aureus; identical to SEQ ID NO: 1565154

SEQ ID NO: 1623424 - protein, 13 aa, Staphylococcus aureus
QSVQTNGQSLNNA

SEQ ID NO: 1623425 - protein, 27 aa, Staphylococcus aureus
QSVTSTENALNGDANLQRAKTEATQAI

SEQ ID NO: 1623426 - protein, 5 aa, Staphylococcus aureus
QTAGT

SEQ ID NO: 1623427 - protein, 13 aa, Staphylococcus aureus
QTDSRLSSDIFKE

SEQ ID NO: 1623428 - protein, 27 aa, Staphylococcus aureus
QVTDAKNGLNGEAKLATEKQNAKDAVN

SEQ ID NO: 1623429 - protein, 7 aa, Staphylococcus aureus
RDITTNS

SEQ ID NO: 1623430 - protein, 6 aa, Staphylococcus aureus
RGANDY

SEQ ID NO: 1623431 - protein, 14 aa, Staphylococcus aureus
RGGLPNKEPQIQEK

SEQ ID NO: 1623432 - protein, 6 aa, Staphylococcus aureus
RIPQND

SEQ ID NO: 1623433 - protein, 28 aa, Staphylococcus aureus
RKIGKTEATVQRYESGNIKNLKNDTIES

SEQ ID NO: 1623434 - protein, 6 aa, Staphylococcus aureus
RLEEEG

SEQ ID NO: 1623435 - protein, 4 aa, Staphylococcus aureus
RLNT

SEQ ID NO: 1623436 - protein, 10 aa, Staphylococcus aureus
RLTDSGTIVS

SEQ ID NO: 1623437 - protein, 8 aa, Staphylococcus aureus
RNSRTKYK

SEQ ID NO: 1623438 - protein, 4 aa, Staphylococcus aureus
RQNS

SEQ ID NO: 1623439 - protein, 5 aa, Staphylococcus aureus
RSLKE

SEQ ID NO: 1623440 - protein, 29 aa, Staphylococcus aureus
RSNPINKSFEKPGASENLKSTLSEKAKKK

SEQ ID NO: 1623441 - protein, 26 aa, Staphylococcus aureus
RSSAGRIAARARGRYGGRPEKLNKQD

SEQ ID NO: 1623442 - protein, 7 aa, Staphylococcus aureus
RTDEETA

SEQ ID NO: 1623443 - protein, 7 aa, Staphylococcus aureus
RTKPSYP

SEQ ID NO: 1623444 - protein, 6 aa, Staphylococcus aureus
RTLNGE

SEQ ID NO: 1623445 - protein, 6 aa, Staphylococcus aureus
RTSYGQ

SEQ ID NO: 1623446 - protein, 10 aa, Staphylococcus aureus
SAARELASRG

SEQ ID NO: 1623447 - protein, 4 aa, Staphylococcus aureus
SEGM

SEQ ID NO: 1623448 - protein, 11 aa, Staphylococcus aureus
SESQLKKYRGK

SEQ ID NO: 1623449 - protein, 5 aa, Staphylococcus aureus
SFDTN

SEQ ID NO: 1623450 - protein, 5 aa, Staphylococcus aureus
SFGYG

SEQ ID NO: 1623451 - protein, 15 aa, Staphylococcus aureus
SGKSLKKSEKQNESL

SEQ ID NO: 1623452 - protein, 6 aa, Staphylococcus aureus
SIPNKE

SEQ ID NO: 1623453 - protein, 7 aa, Staphylococcus aureus
SIQNNKQ

SEQ ID NO: 1623454 - protein, 10 aa, Staphylococcus aureus
SITDAQKNNL

SEQ ID NO: 1623455 - protein, 15 aa, Staphylococcus aureus
SKANGGNATQTEVEQ

SEQ ID NO: 1623456 - protein, 14 aa, Staphylococcus aureus
SKQSKNEKIRETAR

SEQ ID NO: 1623457 - protein, 8 aa, Staphylococcus aureus
SKSKAGQI

SEQ ID NO: 1623458 - protein, 6 aa, Staphylococcus aureus
SLPSSF

SEQ ID NO: 1623459 - protein, 16 aa, Staphylococcus aureus
SLQGSINDKDATLRNQ

SEQ ID NO: 1623460 - protein, 4 aa, Staphylococcus aureus
SLSA

SEQ ID NO: 1623461 - protein, 5 aa, Staphylococcus aureus
SNEGL

SEQ ID NO: 1623462 - protein, 7 aa, Staphylococcus aureus
SNKFKGV

SEQ ID NO: 1623463 - protein, 8 aa, Staphylococcus aureus
SQSTVSTH

SEQ ID NO: 1623464 - protein, 16 aa, Staphylococcus aureus
SRTIQNMEKDSTNIKD

SEQ ID NO: 1623465 - protein, 17 aa, Staphylococcus aureus
SSDLTEAETQEAQKIKA

SEQ ID NO: 1623466 - protein, 7 aa, Staphylococcus aureus
SSIGTGS

SEQ ID NO: 1623467 - protein, 23 aa, Staphylococcus aureus
STDNASWRGPNTEADEKSAYNNV

SEQ ID NO: 1623468 - protein, 19 aa, Staphylococcus aureus
SVYGKQSMQAKSDRALNEA

SEQ ID NO: 1623469 - protein, 8 aa, Staphylococcus aureus
SYVNGKEQ

SEQ ID NO: 1623470 - protein, 6 aa, Staphylococcus aureus
TAENEQ

SEQ ID NO: 1623471 - protein, 11 aa, Staphylococcus aureus
TAENVKNGNIS

SEQ ID NO: 1623472 - protein, 5 aa, Staphylococcus aureus
TAKEL

SEQ ID NO: 1623473 - protein, 34 aa, Staphylococcus aureus; identical to SEQ ID NO: 1565776

SEQ ID NO: 1623474 - protein, 10 aa, Staphylococcus aureus
TDKQYQKYPK

SEQ ID NO: 1623475 - protein, 5 aa, Staphylococcus aureus
TESNL

SEQ ID NO: 1623476 - protein, 9 aa, Staphylococcus aureus
TFKEEGLEP

SEQ ID NO: 1623477 - protein, 16 aa, Staphylococcus aureus
TGGLRNSLDVDDNNVP

SEQ ID NO: 1623478 - protein, 13 aa, Staphylococcus aureus
TGVSDELGGQGVG

SEQ ID NO: 1623479 - protein, 4 aa, Staphylococcus aureus
TISQ

SEQ ID NO: 1623480 - protein, 9 aa, Staphylococcus aureus
TKSKVRRER

SEQ ID NO: 1623481 - protein, 7 aa, Staphylococcus aureus
TLANASN

SEQ ID NO: 1623482 - protein, 11 aa, Staphylococcus aureus
TLKANEKQLQK

SEQ ID NO: 1623483 - protein, 14 aa, Staphylococcus aureus
TLPKPQGENSSKVE

SEQ ID NO: 1623484 - protein, 12 aa, Staphylococcus aureus
TLSDNNKYDDYK

SEQ ID NO: 1623485 - protein, 8 aa, Staphylococcus aureus
TNAQKEAL

SEQ ID NO: 1623486 - protein, 8 aa, Staphylococcus aureus
TPGHTPES

SEQ ID NO: 1623487 - protein, 11 aa, Staphylococcus aureus
TPIPRTKPQAK

SEQ ID NO: 1623488 - protein, 6 aa, Staphylococcus aureus
TPQEGR

SEQ ID NO: 1623489 - protein, 18 aa, Staphylococcus aureus
TPSVKTNDYDFEEDDTNI

SEQ ID NO: 1623490 - protein, 9 aa, Staphylococcus aureus
TRRAQEGYY

SEQ ID NO: 1623491 - protein, 7 aa, Staphylococcus aureus
TTSQYNP

SEQ ID NO: 1623492 - protein, 5 aa, Staphylococcus aureus
TTTQC

SEQ ID NO: 1623493 - protein, 17 aa, Staphylococcus aureus
VDEKQTKAEIINAFESL

SEQ ID NO: 1623494 - protein, 11 aa, Staphylococcus aureus
VEEDTSKSLRD

SEQ ID NO: 1623495 - protein, 8 aa, Staphylococcus aureus
VERQTQQQ

SEQ ID NO: 1623496 - protein, 6 aa, Staphylococcus aureus
VERSER

SEQ ID NO: 1623497 - protein, 10 aa, Staphylococcus aureus
VGESGAGKST

SEQ ID NO: 1623498 - protein, 26 aa, Staphylococcus aureus
VGGAPTQRISKRNSTNNASWGWSQYR

SEQ ID NO: 1623499 - protein, 5 aa, Staphylococcus aureus
VGTQT

SEQ ID NO: 1623500 - protein, 4 aa, Staphylococcus aureus
VINP

SEQ ID NO: 1623501 - protein, 8 aa, Staphylococcus aureus
VKDQETAV

SEQ ID NO: 1623502 - protein, 30 aa, Staphylococcus aureus
VKGNSTTNWQKSKLTDDYGKAIESSEQSID

SEQ ID NO: 1623503 - protein, 29 aa, Staphylococcus aureus
VKGNSTTNWQKSKLTDDYGKAIESYEQSI

SEQ ID NO: 1623504 - protein, 17 aa, Staphylococcus aureus
VNGTASLDPEKQDDNLQ

SEQ ID NO: 1623505 - protein, 10 aa, Staphylococcus aureus
VNISGAKNSA

SEQ ID NO: 1623506 - protein, 9 aa, Staphylococcus aureus
VPKATDDFR

SEQ ID NO: 1623507 - protein, 16 aa, Staphylococcus aureus
VRKRNPEQSEEQKRIS

SEQ ID NO: 1623508 - protein, 22 aa, Staphylococcus aureus
VSEPSKKPTTPPTYTETTTQLP

SEQ ID NO: 1623509 - protein, 10 aa, Staphylococcus aureus
VTLSDGKVKP

SEQ ID NO: 1623510 - protein, 24 aa, Staphylococcus aureus
VYGNNKRKMKRGFERKKDAKLAES

SEQ ID NO: 1623511 - protein, 6 aa, Staphylococcus aureus
WAPTQK

SEQ ID NO: 1623512 - protein, 32 aa, Staphylococcus aureus
WDGDDEDLDKTVQEVSNANPNHTVIVDDIPLE

SEQ ID NO: 1623513 - protein, 5 aa, Staphylococcus aureus
WKKNT

SEQ ID NO: 1623514 - protein, 13 aa, Staphylococcus aureus
YATHTRSSIGGFK

SEQ ID NO: 1623515 - protein, 8 aa, Staphylococcus aureus
YDQTISEY

SEQ ID NO: 1623516 - protein, 7 aa, Staphylococcus aureus
YEETGAK

SEQ ID NO: 1623517 - protein, 4 aa, Staphylococcus aureus
YEHT

SEQ ID NO: 1623518 - protein, 9 aa, Staphylococcus aureus
YESKKDVYK

SEQ ID NO: 1623519 - protein, 17 aa, Staphylococcus aureus
YETSNETVVPKESPSNI

SEQ ID NO: 1623520 - protein, 11 aa, Staphylococcus aureus
YGPQKGADAKM

SEQ ID NO: 1623521 - protein, 16 aa, Staphylococcus aureus
YGSDGAQLSTDASELA

SEQ ID NO: 1623522 - protein, 8 aa, Staphylococcus aureus
YKEAGAEI

SEQ ID NO: 1623523 - protein, 11 aa, Staphylococcus aureus
YKETEKITNSQ

SEQ ID NO: 1623524 - protein, 11 aa, Staphylococcus aureus
YNAKGNLEALG

SEQ ID NO: 1623525 - protein, 10 aa, Staphylococcus aureus
YNGGGEFKAG

SEQ ID NO: 1623526 - protein, 12 aa, Staphylococcus aureus
YRDPEDKEKYFD

SEQ ID NO: 1623527 - protein, 4 aa, Staphylococcus aureus
YRSI

SEQ ID NO: 1623528 - protein, 12 aa, Staphylococcus aureus
AAKGGNAKQIME

SEQ ID NO: 1623529 - protein, 11 aa, Staphylococcus aureus
AALPNNKVESL

SEQ ID NO: 1623530 - protein, 9 aa, Staphylococcus aureus
AASGEELGA

SEQ ID NO: 1623531 - protein, 8 aa, Staphylococcus aureus
ADDLRPLD

SEQ ID NO: 1623532 - protein, 5 aa, Staphylococcus aureus
ADLSP

SEQ ID NO: 1623533 - protein, 8 aa, Staphylococcus aureus
AEDPSGRM

SEQ ID NO: 1623534 - protein, 9 aa, Staphylococcus aureus
AEHNQGPAF

SEQ ID NO: 1623535 - protein, 11 aa, Staphylococcus aureus
AEKENASNKLE

SEQ ID NO: 1623536 - protein, 10 aa, Staphylococcus aureus
AEQSEEGLES

SEQ ID NO: 1623537 - protein, 63 aa, Staphylococcus aureus
AERYVGDSSLNDDSDLTDNSTEASQLHTNEIEDEAVSNDENKKASIQNEDTDDTHVDESPYNY

SEQ ID NO: 1623538 - protein, 7 aa, Staphylococcus aureus
AESFDDQ

SEQ ID NO: 1623539 - protein, 13 aa, Staphylococcus aureus
AESKEEAERKYEA

SEQ ID NO: 1623540 - protein, 8 aa, Staphylococcus aureus
AESLEEAE

SEQ ID NO: 1623541 - protein, 12 aa, Staphylococcus aureus
AGIKGEKAGTAL

SEQ ID NO: 1623542 - protein, 6 aa, Staphylococcus aureus
AGQDAK

SEQ ID NO: 1623543 - protein, 6 aa, Staphylococcus aureus
AGRGYR

SEQ ID NO: 1623544 - protein, 4 aa, Staphylococcus aureus
AGTS

SEQ ID NO: 1623545 - protein, 6 aa, Staphylococcus aureus
AGVPSA

SEQ ID NO: 1623546 - protein, 14 aa, Staphylococcus aureus
AGYSTKGKSDNYID

SEQ ID NO: 1623547 - protein, 42 aa, Staphylococcus aureus
AHEKKKADEYAREKAEEAAKEAAKLAKMNKDQKDEYEREQME

SEQ ID NO: 1623548 - protein, 5 aa, Staphylococcus aureus
AIEPK

SEQ ID NO: 1623549 - protein, 42 aa, Staphylococcus aureus; identical to SEQ ID NO: 1566143

SEQ ID NO: 1623550 - protein, 4 aa, Staphylococcus aureus
AKDR

SEQ ID NO: 1623551 - protein, 7 aa, Staphylococcus aureus
AKDSGHL

SEQ ID NO: 1623552 - protein, 9 aa, Staphylococcus aureus
AKEALGDKE

SEQ ID NO: 1623553 - protein, 8 aa, Staphylococcus aureus
AKEFSNDA

SEQ ID NO: 1623554 - protein, 4 aa, Staphylococcus aureus
AKTQ

SEQ ID NO: 1623555 - protein, 10 aa, Staphylococcus aureus
ALGKSPQEQL

SEQ ID NO: 1623556 - protein, 11 aa, Staphylococcus aureus
APAEKQTRLSN

SEQ ID NO: 1623557 - protein, 13 aa, Staphylococcus aureus
APMGSPRPRFRNT

SEQ ID NO: 1623558 - protein, 16 aa, Staphylococcus aureus
APPGYIGHDEGGQLTE

SEQ ID NO: 1623559 - protein, 14 aa, Staphylococcus aureus
AQTSSKANTDVRGL

SEQ ID NO: 1623560 - protein, 6 aa, Staphylococcus aureus
ARDNQT

SEQ ID NO: 1623561 - protein, 6 aa, Staphylococcus aureus
ARIEKY

SEQ ID NO: 1623562 - protein, 9 aa, Staphylococcus aureus
ARKDDGKNE

SEQ ID NO: 1623563 - protein, 5 aa, Staphylococcus aureus
ARKNS

SEQ ID NO: 1623564 - protein, 11 aa, Staphylococcus aureus
ARLEEEKRRRE

SEQ ID NO: 1623565 - protein, 19 aa, Staphylococcus aureus
ASDEDYQKLTKSIRFIYRR

SEQ ID NO: 1623566 - protein, 8 aa, Staphylococcus aureus
ASGAVSGL

SEQ ID NO: 1623567 - protein, 12 aa, Staphylococcus aureus
ASRPASEPLQGY

SEQ ID NO: 1623568 - protein, 6 aa, Staphylococcus aureus
ASSTAE

SEQ ID NO: 1623569 - protein, 38 aa, Staphylococcus aureus
ATDAPEKTDIGTLEKPGQDGVDDGSSFDESTYTSSKSG

SEQ ID NO: 1623570 - protein, 10 aa, Staphylococcus aureus
ATSGGGGKGM

SEQ ID NO: 1623571 - protein, 10 aa, Staphylococcus aureus
ATTDAKKEKA

SEQ ID NO: 1623572 - protein, 4 aa, Staphylococcus aureus
AVDQ

SEQ ID NO: 1623573 - protein, 7 aa, Staphylococcus aureus
AVYTDDE

SEQ ID NO: 1623574 - protein, 4 aa, Staphylococcus aureus
CAER

SEQ ID NO: 1623575 - protein, 19 aa, Staphylococcus aureus
DADEQKRNAYNQAVSNAET

SEQ ID NO: 1623576 - protein, 7 aa, Staphylococcus aureus
DAKVDRR

SEQ ID NO: 1623577 - protein, 9 aa, Staphylococcus aureus
DASETLKDI

SEQ ID NO: 1623578 - protein, 13 aa, Staphylococcus aureus
DDLRDAGSNVYAE

SEQ ID NO: 1623579 - protein, 7 aa, Staphylococcus aureus
DDNNEKS

SEQ ID NO: 1623580 - protein, 7 aa, Staphylococcus aureus
DDRRGPH

SEQ ID NO: 1623581 - protein, 5 aa, Staphylococcus aureus
DDTEQ

SEQ ID NO: 1623582 - protein, 11 aa, Staphylococcus aureus
DDTNYQTNNEK

SEQ ID NO: 1623583 - protein, 5 aa, Staphylococcus aureus
DEGGE

SEQ ID NO: 1623584 - protein, 7 aa, Staphylococcus aureus
DEIRNEA

SEQ ID NO: 1623585 - protein, 11 aa, Staphylococcus aureus
DEKTTQEFSKR

SEQ ID NO: 1623586 - protein, 12 aa, Staphylococcus aureus
DEPTAALDTENA

SEQ ID NO: 1623587 - protein, 6 aa, Staphylococcus aureus
DEQVGD

SEQ ID NO: 1623588 - protein, 6 aa, Staphylococcus aureus
DGNSAI

SEQ ID NO: 1623589 - protein, 7 aa, Staphylococcus aureus
DGPQQRE

SEQ ID NO: 1623590 - protein, 11 aa, Staphylococcus aureus
DGSGFNRGVTG

SEQ ID NO: 1623591 - protein, 8 aa, Staphylococcus aureus
DKDKTSAL

SEQ ID NO: 1623592 - protein, 22 aa, Staphylococcus aureus
DKEFKEGMQRARKELNYTANTD

SEQ ID NO: 1623593 - protein, 8 aa, Staphylococcus aureus
DKEGNFSE

SEQ ID NO: 1623594 - protein, 7 aa, Staphylococcus aureus
DLGDRFQ

SEQ ID NO: 1623595 - protein, 7 aa, Staphylococcus aureus
DNKMNNQ

SEQ ID NO: 1623596 - protein, 15 aa, Staphylococcus aureus
DNQITEITSSKRYGL

SEQ ID NO: 1623597 - protein, 12 aa, Staphylococcus aureus
DNVDVENKTLEI

SEQ ID NO: 1623598 - protein, 8 aa, Staphylococcus aureus
DPNSTYIQ

SEQ ID NO: 1623599 - protein, 5 aa, Staphylococcus aureus
DQDRQ

SEQ ID NO: 1623600 - protein, 4 aa, Staphylococcus aureus
DQKH

SEQ ID NO: 1623601 - protein, 6 aa, Staphylococcus aureus
DQTGNR

SEQ ID NO: 1623602 - protein, 9 aa, Staphylococcus aureus
DRAEEARAS

SEQ ID NO: 1623603 - protein, 8 aa, Staphylococcus aureus
DRKSKVNN

SEQ ID NO: 1623604 - protein, 6 aa, Staphylococcus aureus
DRLNTH

SEQ ID NO: 1623605 - protein, 13 aa, Staphylococcus aureus
DSKLSANGFSRFL

SEQ ID NO: 1623606 - protein, 6 aa, Staphylococcus aureus
DSKLTN

SEQ ID NO: 1623607 - protein, 7 aa, Staphylococcus aureus
DSLEKID

SEQ ID NO: 1623608 - protein, 4 aa, Staphylococcus aureus
DTGE

SEQ ID NO: 1623609 - protein, 6 aa, Staphylococcus aureus
DTKATL

SEQ ID NO: 1623610 - protein, 12 aa, Staphylococcus aureus
DTKLNEVIKNLI

SEQ ID NO: 1623611 - protein, 6 aa, Staphylococcus aureus
DTNEEY

SEQ ID NO: 1623612 - protein, 10 aa, Staphylococcus aureus
DVKANDKDGF

SEQ ID NO: 1623613 - protein, 5 aa, Staphylococcus aureus
DVQAS

SEQ ID NO: 1623614 - protein, 35 aa, Staphylococcus aureus
DYESYKKSLDKNKSTLKQQSKSSTTVRKKNGLSYK

SEQ ID NO: 1623615 - protein, 14 aa, Staphylococcus aureus
EAENQGIKGKDATP

SEQ ID NO: 1623616 - protein, 9 aa, Staphylococcus aureus
EAHSEKDAL

SEQ ID NO: 1623617 - protein, 8 aa, Staphylococcus aureus
EAKESHQR

SEQ ID NO: 1623618 - protein, 5 aa, Staphylococcus aureus
EASEM

SEQ ID NO: 1623619 - protein, 8 aa, Staphylococcus aureus
EASLDQTY

SEQ ID NO: 1623620 - protein, 11 aa, Staphylococcus aureus
EAVSNTGTQLN

SEQ ID NO: 1623621 - protein, 12 aa, Staphylococcus aureus
EDGKIRNSNGPM

SEQ ID NO: 1623622 - protein, 5 aa, Staphylococcus aureus
EDIGL

SEQ ID NO: 1623623 - protein, 4 aa, Staphylococcus aureus
EDNG

SEQ ID NO: 1623624 - protein, 8 aa, Staphylococcus aureus
EDNHYNRE

SEQ ID NO: 1623625 - protein, 7 aa, Staphylococcus aureus
EDNKNGY

SEQ ID NO: 1623626 - protein, 5 aa, Staphylococcus aureus
EDNTS

SEQ ID NO: 1623627 - protein, 7 aa, Staphylococcus aureus
EDPNLKK

SEQ ID NO: 1623628 - protein, 7 aa, Staphylococcus aureus
EDTNLKK

SEQ ID NO: 1623629 - protein, 6 aa, Staphylococcus aureus
EEKDKF

SEQ ID NO: 1623630 - protein, 6 aa, Staphylococcus aureus
EEQPWN

SEQ ID NO: 1623631 - protein, 10 aa, Staphylococcus aureus
EERKGNKGAI

SEQ ID NO: 1623632 - protein, 7 aa, Staphylococcus aureus
EFKEQEV

SEQ ID NO: 1623633 - protein, 5 aa, Staphylococcus aureus
EGGDI

SEQ ID NO: 1623634 - protein, 5 aa, Staphylococcus aureus
EGIPT

SEQ ID NO: 1623635 - protein, 13 aa, Staphylococcus aureus
EGLKKTLTTKRSR

SEQ ID NO: 1623636 - protein, 4 aa, Staphylococcus aureus
EGNV

SEQ ID NO: 1623637 - protein, 7 aa, Staphylococcus aureus
EGQNVKY

SEQ ID NO: 1623638 - protein, 6 aa, Staphylococcus aureus
EIKDVG

SEQ ID NO: 1623639 - protein, 6 aa, Staphylococcus aureus
EIPTKP

SEQ ID NO: 1623640 - protein, 6 aa, Staphylococcus aureus
EIQPKT

SEQ ID NO: 1623641 - protein, 12 aa, Staphylococcus aureus
EKEMKQAAKDLD

SEQ ID NO: 1623642 - protein, 7 aa, Staphylococcus aureus
EKFTGQS

SEQ ID NO: 1623643 - protein, 5 aa, Staphylococcus aureus
EKQGM

SEQ ID NO: 1623644 - protein, 6 aa, Staphylococcus aureus
EKRVSA

SEQ ID NO: 1623645 - protein, 8 aa, Staphylococcus aureus
EKSPSGTG

SEQ ID NO: 1623646 - protein, 7 aa, Staphylococcus aureus
EKVNEEI

SEQ ID NO: 1623647 - protein, 10 aa, Staphylococcus aureus
EKVSGKELEK

SEQ ID NO: 1623648 - protein, 11 aa, Staphylococcus aureus
ELELENEQLKR

SEQ ID NO: 1623649 - protein, 10 aa, Staphylococcus aureus
EMSNQDELDQ

SEQ ID NO: 1623650 - protein, 30 aa, Staphylococcus aureus
ENLGKKAGDFGSKAKNTAHNIKKGAEEMVE

SEQ ID NO: 1623651 - protein, 6 aa, Staphylococcus aureus
ENTDNL

SEQ ID NO: 1623652 - protein, 14 aa, Staphylococcus aureus
ENTKTLRDKNENWE

SEQ ID NO: 1623653 - protein, 7 aa, Staphylococcus aureus
ENTPSFV

SEQ ID NO: 1623654 - protein, 9 aa, Staphylococcus aureus
EPELQDEQP

SEQ ID NO: 1623655 - protein, 4 aa, Staphylococcus aureus
EPID

SEQ ID NO: 1623656 - protein, 4 aa, Staphylococcus aureus
EQEN

SEQ ID NO: 1623657 - protein, 7 aa, Staphylococcus aureus
EQGLDIP

SEQ ID NO: 1623658 - protein, 6 aa, Staphylococcus aureus
EQPATM

SEQ ID NO: 1623659 - protein, 5 aa, Staphylococcus aureus
EQSKY

SEQ ID NO: 1623660 - protein, 6 aa, Staphylococcus aureus
ERGLTE

SEQ ID NO: 1623661 - protein, 10 aa, Staphylococcus aureus
ERVGHSDYKT

SEQ ID NO: 1623662 - protein, 11 aa, Staphylococcus aureus
ESAKDVGIEKE

SEQ ID NO: 1623663 - protein, 16 aa, Staphylococcus aureus
ESDSSLRSEDKGDDMS

SEQ ID NO: 1623664 - protein, 6 aa, Staphylococcus aureus
ESLRKV

SEQ ID NO: 1623665 - protein, 4 aa, Staphylococcus aureus
ESVQ

SEQ ID NO: 1623666 - protein, 6 aa, Staphylococcus aureus
ETGKER

SEQ ID NO: 1623667 - protein, 14 aa, Staphylococcus aureus
ETTELSSDNHHTTV

SEQ ID NO: 1623668 - protein, 15 aa, Staphylococcus aureus
EVKRRGDMEEDPSYK

SEQ ID NO: 1623669 - protein, 5 aa, Staphylococcus aureus
EVPTR

SEQ ID NO: 1623670 - protein, 28 aa, Staphylococcus aureus
EWPTSSKEESKTKRLADKQGDPEEKPGI

SEQ ID NO: 1623671 - protein, 17 aa, Staphylococcus aureus
EYDEDGVYKETQGKQNN

SEQ ID NO: 1623672 - protein, 11 aa, Staphylococcus aureus
EYFTNRDDTTL

SEQ ID NO: 1623673 - protein, 14 aa, Staphylococcus aureus
FAGSEATLKTGQNL

SEQ ID NO: 1623674 - protein, 11 aa, Staphylococcus aureus
FEANPDELTKE

SEQ ID NO: 1623675 - protein, 4 aa, Staphylococcus aureus
FEND

SEQ ID NO: 1623676 - protein, 4 aa, Staphylococcus aureus
FGMT

SEQ ID NO: 1623677 - protein, 12 aa, Staphylococcus aureus
FKPYGSAYGHGV

SEQ ID NO: 1623678 - protein, 18 aa, Staphylococcus aureus
FLDPNKASSLLSSGFSPD

SEQ ID NO: 1623679 - protein, 8 aa, Staphylococcus aureus
FRGHDGPI

SEQ ID NO: 1623680 - protein, 7 aa, Staphylococcus aureus
GAKTFEQ

SEQ ID NO: 1623681 - protein, 10 aa, Staphylococcus aureus
GATNNHTPFE

SEQ ID NO: 1623682 - protein, 7 aa, Staphylococcus aureus
GDDQKQK

SEQ ID NO: 1623683 - protein, 4 aa, Staphylococcus aureus
GEAI

SEQ ID NO: 1623684 - protein, 6 aa, Staphylococcus aureus
GEDERQ

SEQ ID NO: 1623685 - protein, 8 aa, Staphylococcus aureus
GERPQHSE

SEQ ID NO: 1623686 - protein, 10 aa, Staphylococcus aureus
GESGCGKSTL

SEQ ID NO: 1623687 - protein, 10 aa, Staphylococcus aureus
GGEGGTGATF

SEQ ID NO: 1623688 - protein, 15 aa, Staphylococcus aureus
GGGGHLTNAATQLKG

SEQ ID NO: 1623689 - protein, 14 aa, Staphylococcus aureus
GGLRNSLDVDDNNV

SEQ ID NO: 1623690 - protein, 4 aa, Staphylococcus aureus
GGRE

SEQ ID NO: 1623691 - protein, 7 aa, Staphylococcus aureus
GHDHSKH

SEQ ID NO: 1623692 - protein, 8 aa, Staphylococcus aureus
GHTDEKTT

SEQ ID NO: 1623693 - protein, 23 aa, Staphylococcus aureus
GIGGAYKNNQGHIDNGELHKANE

SEQ ID NO: 1623694 - protein, 10 aa, Staphylococcus aureus
GKDAETGKYK

SEQ ID NO: 1623695 - protein, 5 aa, Staphylococcus aureus
GKDRN

SEQ ID NO: 1623696 - protein, 8 aa, Staphylococcus aureus
GKKGSVSG

SEQ ID NO: 1623697 - protein, 27 aa, Staphylococcus aureus
GKPTSYKTLPNRYKDVPEIGQPMEPNV

SEQ ID NO: 1623698 - protein, 9 aa, Staphylococcus aureus
GKSLSELAG

SEQ ID NO: 1623699 - protein, 5 aa, Staphylococcus aureus
GLKPV

SEQ ID NO: 1623700 - protein, 5 aa, Staphylococcus aureus
GLTDY

SEQ ID NO: 1623701 - protein, 9 aa, Staphylococcus aureus
GMGYTGSHD

SEQ ID NO: 1623702 - protein, 25 aa, Staphylococcus aureus
GMQKSITQLGDQFNRKAQAKELNDH

SEQ ID NO: 1623703 - protein, 7 aa, Staphylococcus aureus
GNGGNIA

SEQ ID NO: 1623704 - protein, 8 aa, Staphylococcus aureus
GNGPQVGS

SEQ ID NO: 1623705 - protein, 7 aa, Staphylococcus aureus
GNGRTKS

SEQ ID NO: 1623706 - protein, 7 aa, Staphylococcus aureus
GNKTAKV

SEQ ID NO: 1623707 - protein, 21 aa, Staphylococcus aureus
GNQMTSDAFAEGGNSGSPVFN

SEQ ID NO: 1623708 - protein, 7 aa, Staphylococcus aureus
GPNGAGH

SEQ ID NO: 1623709 - protein, 15 aa, Staphylococcus aureus
GPNTEADEKSAYNNV

SEQ ID NO: 1623710 - protein, 6 aa, Staphylococcus aureus
GQAISK

SEQ ID NO: 1623711 - protein, 9 aa, Staphylococcus aureus
GQTGKGKSF

SEQ ID NO: 1623712 - protein, 16 aa, Staphylococcus aureus
GRALDDKDKEIREKDD

SEQ ID NO: 1623713 - protein, 6 aa, Staphylococcus aureus
GRIHPG

SEQ ID NO: 1623714 - protein, 18 aa, Staphylococcus aureus
GRLSAKEVVGNKKALTEF

SEQ ID NO: 1623715 - protein, 12 aa, Staphylococcus aureus
GSGDIKGSSVGY

SEQ ID NO: 1623716 - protein, 4 aa, Staphylococcus aureus
GSIP

SEQ ID NO: 1623717 - protein, 4 aa, Staphylococcus aureus
GSKH

SEQ ID NO: 1623718 - protein, 8 aa, Staphylococcus aureus
GSSYTYGE

SEQ ID NO: 1623719 - protein, 6 aa, Staphylococcus aureus
GTENEY

SEQ ID NO: 1623720 - protein, 12 aa, Staphylococcus aureus
GTGNLKGSSVGY

SEQ ID NO: 1623721 - protein, 27 aa, Staphylococcus aureus
GTVDTPKEDGVDDGSDIPVAPNTLGKS

SEQ ID NO: 1623722 - protein, 9 aa, Staphylococcus aureus
GVSSPTEIT

SEQ ID NO: 1623723 - protein, 7 aa, Staphylococcus aureus
HANSGKY

SEQ ID NO: 1623724 - protein, 7 aa, Staphylococcus aureus
HARGDAN

SEQ ID NO: 1623725 - protein, 9 aa, Staphylococcus aureus
HEPNHNLNK

SEQ ID NO: 1623726 - protein, 7 aa, Staphylococcus aureus
HGAKYRE

SEQ ID NO: 1623727 - protein, 19 aa, Staphylococcus aureus
HKADYEDENVEVEKNNVCF

SEQ ID NO: 1623728 - protein, 6 aa, Staphylococcus aureus
HKDHTQ

SEQ ID NO: 1623729 - protein, 4 aa, Staphylococcus aureus
HKGK

SEQ ID NO: 1623730 - protein, 15 aa, Staphylococcus aureus
HNQMPQSQITQPTHQ

SEQ ID NO: 1623731 - protein, 5 aa, Staphylococcus aureus
HPHGD

SEQ ID NO: 1623732 - protein, 9 aa, Staphylococcus aureus
HQDEQQEKI

SEQ ID NO: 1623733 - protein, 5 aa, Staphylococcus aureus
HSDGD

SEQ ID NO: 1623734 - protein, 7 aa, Staphylococcus aureus
HSQQEYP

SEQ ID NO: 1623735 - protein, 5 aa, Staphylococcus aureus
HSSNI

SEQ ID NO: 1623736 - protein, 6 aa, Staphylococcus aureus
HTIKDG

SEQ ID NO: 1623737 - protein, 4 aa, Staphylococcus aureus
HTPT

SEQ ID NO: 1623738 - protein, 12 aa, Staphylococcus aureus
HVEKKSGKFVKP

SEQ ID NO: 1623739 - protein, 13 aa, Staphylococcus aureus
IAAIDGGKSIDTS

SEQ ID NO: 1623740 - protein, 12 aa, Staphylococcus aureus
ICGSDTSRYKKM

SEQ ID NO: 1623741 - protein, 4 aa, Staphylococcus aureus
IDPK

SEQ ID NO: 1623742 - protein, 9 aa, Staphylococcus aureus
IEEKSQNIS

SEQ ID NO: 1623743 - protein, 10 aa, Staphylococcus aureus
IEKDSDDLDG

SEQ ID NO: 1623744 - protein, 5 aa, Staphylococcus aureus
IGATT

SEQ ID NO: 1623745 - protein, 6 aa, Staphylococcus aureus
IGEDEP

SEQ ID NO: 1623746 - protein, 9 aa, Staphylococcus aureus
IGNNPGTTM

SEQ ID NO: 1623747 - protein, 6 aa, Staphylococcus aureus
IGPADD

SEQ ID NO: 1623748 - protein, 9 aa, Staphylococcus aureus
IGPKETLNT

SEQ ID NO: 1623749 - protein, 9 aa, Staphylococcus aureus
IKADRKQFN

SEQ ID NO: 1623750 - protein, 8 aa, Staphylococcus aureus
IKGSSVGY

SEQ ID NO: 1623751 - protein, 11 aa, Staphylococcus aureus
IKKTLEESGVD

SEQ ID NO: 1623752 - protein, 17 aa, Staphylococcus aureus
IKPPITGAGIQMRFKKL

SEQ ID NO: 1623753 - protein, 9 aa, Staphylococcus aureus
ILPKGTGYI

SEQ ID NO: 1623754 - protein, 11 aa, Staphylococcus aureus
INDGEKDYEVE

SEQ ID NO: 1623755 - protein, 17 aa, Staphylococcus aureus
INQTNNPTLDKAQVEQL

SEQ ID NO: 1623756 - protein, 9 aa, Staphylococcus aureus
INTPKQLPV

SEQ ID NO: 1623757 - protein, 8 aa, Staphylococcus aureus
IQGPKARD

SEQ ID NO: 1623758 - protein, 6 aa, Staphylococcus aureus
IQPDHR

SEQ ID NO: 1623759 - protein, 4 aa, Staphylococcus aureus
IQTF

SEQ ID NO: 1623760 - protein, 10 aa, Staphylococcus aureus
IREGASYHER

SEQ ID NO: 1623761 - protein, 9 aa, Staphylococcus aureus
IRKGPNIKL

SEQ ID NO: 1623762 - protein, 12 aa, Staphylococcus aureus
IRRDGDAKENGN

SEQ ID NO: 1623763 - protein, 8 aa, Staphylococcus aureus
ISADDYRK

SEQ ID NO: 1623764 - protein, 5 aa, Staphylococcus aureus
ISDSE

SEQ ID NO: 1623765 - protein, 6 aa, Staphylococcus aureus
ISESEF

SEQ ID NO: 1623766 - protein, 12 aa, Staphylococcus aureus
ISGDSKKKHQNF

SEQ ID NO: 1623767 - protein, 16 aa, Staphylococcus aureus
ISNSGFKRKSDAKHHA

SEQ ID NO: 1623768 - protein, 23 aa, Staphylococcus aureus
ISPLRKADDAVTLDTTGKTIEEV

SEQ ID NO: 1623769 - protein, 8 aa, Staphylococcus aureus
ISYTNNAT

SEQ ID NO: 1623770 - protein, 13 aa, Staphylococcus aureus
ITEKSSEAMAEDK

SEQ ID NO: 1623771 - protein, 13 aa, Staphylococcus aureus
IYPRPKTDSSEDI

SEQ ID NO: 1623772 - protein, 8 aa, Staphylococcus aureus
KADRKQFN

SEQ ID NO: 1623773 - protein, 6 aa, Staphylococcus aureus
KAFAEV

SEQ ID NO: 1623774 - protein, 9 aa, Staphylococcus aureus
KAGRTISEE

SEQ ID NO: 1623775 - protein, 12 aa, Staphylococcus aureus
KALSSALDKTVG

SEQ ID NO: 1623776 - protein, 8 aa, Staphylococcus aureus
KANATQAI

SEQ ID NO: 1623777 - protein, 7 aa, Staphylococcus aureus
KANPAAI

SEQ ID NO: 1623778 - protein, 18 aa, Staphylococcus aureus
KARDEKVSEYGIEQADGT

SEQ ID NO: 1623779 - protein, 7 aa, Staphylococcus aureus
KARKEVD

SEQ ID NO: 1623780 - protein, 7 aa, Staphylococcus aureus
KASDANH

SEQ ID NO: 1623781 - protein, 5 aa, Staphylococcus aureus
KAYEG

SEQ ID NO: 1623782 - protein, 5 aa, Staphylococcus aureus
KCSAC

SEQ ID NO: 1623783 - protein, 12 aa, Staphylococcus aureus
KCSNEAELKEGI

SEQ ID NO: 1623784 - protein, 14 aa, Staphylococcus aureus
KDEERKKKRATNQR

SEQ ID NO: 1623785 - protein, 9 aa, Staphylococcus aureus
KDHANELNH

SEQ ID NO: 1623786 - protein, 5 aa, Staphylococcus aureus
KDRRI

SEQ ID NO: 1623787 - protein, 9 aa, Staphylococcus aureus
KDSLQSQDI

SEQ ID NO: 1623788 - protein, 6 aa, Staphylococcus aureus
KDTDGQ

SEQ ID NO: 1623789 - protein, 6 aa, Staphylococcus aureus
KDWGKR

SEQ ID NO: 1623790 - protein, 6 aa, Staphylococcus aureus
KDYDGV

SEQ ID NO: 1623791 - protein, 6 aa, Staphylococcus aureus
KEHGQL

SEQ ID NO: 1623792 - protein, 10 aa, Staphylococcus aureus
KEKESEIDVA

SEQ ID NO: 1623793 - protein, 32 aa, Staphylococcus aureus; identical to SEQ ID NO: 1566199

SEQ ID NO: 1623794 - protein, 31 aa, Staphylococcus aureus
KELKEKALSDGQISENERKEIEKLENQRRDI

SEQ ID NO: 1623795 - protein, 22 aa, Staphylococcus aureus
KENYNKYIQGQKQRVIFENGHF

SEQ ID NO: 1623796 - protein, 10 aa, Staphylococcus aureus
KESGGIEADA

SEQ ID NO: 1623797 - protein, 12 aa, Staphylococcus aureus
KETTKTSKSYRT

SEQ ID NO: 1623798 - protein, 7 aa, Staphylococcus aureus
KFANKDK

SEQ ID NO: 1623799 - protein, 5 aa, Staphylococcus aureus
KFDKN

SEQ ID NO: 1623800 - protein, 9 aa, Staphylococcus aureus
KGLAKAGTW

SEQ ID NO: 1623801 - protein, 8 aa, Staphylococcus aureus
KGNTTEAL

SEQ ID NO: 1623802 - protein, 4 aa, Staphylococcus aureus
KIDP

SEQ ID NO: 1623803 - protein, 20 aa, Staphylococcus aureus
KKAREMGATTKFSASDSAEA

SEQ ID NO: 1623804 - protein, 4 aa, Staphylococcus aureus
KKEF

SEQ ID NO: 1623805 - protein, 7 aa, Staphylococcus aureus
KKGIEFD

SEQ ID NO: 1623806 - protein, 6 aa, Staphylococcus aureus
KKHDGI

SEQ ID NO: 1623807 - protein, 12 aa, Staphylococcus aureus
KKKASQTNNPLE

SEQ ID NO: 1623808 - protein, 8 aa, Staphylococcus aureus
KKKKINKH

SEQ ID NO: 1623809 - protein, 7 aa, Staphylococcus aureus
KKLTERQ

SEQ ID NO: 1623810 - protein, 13 aa, Staphylococcus aureus
KKPVTKNAGNHEI

SEQ ID NO: 1623811 - protein, 8 aa, Staphylococcus aureus
KKSFNSRH

SEQ ID NO: 1623812 - protein, 10 aa, Staphylococcus aureus
KLKGDTVKFT

SEQ ID NO: 1623813 - protein, 13 aa, Staphylococcus aureus
KLKRELNQTQSAF

SEQ ID NO: 1623814 - protein, 6 aa, Staphylococcus aureus
KLLSED

SEQ ID NO: 1623815 - protein, 12 aa, Staphylococcus aureus
KLNDANKLSKYN

SEQ ID NO: 1623816 - protein, 25 aa, Staphylococcus aureus
KLQAKAEAERVSSLPKSAQTLSANQ

SEQ ID NO: 1623817 - protein, 17 aa, Staphylococcus aureus
KLRTTKEEFNASKRTLS

SEQ ID NO: 1623818 - protein, 13 aa, Staphylococcus aureus
KLSEPETKKIYSQ

SEQ ID NO: 1623819 - protein, 7 aa, Staphylococcus aureus
KNAITAL

SEQ ID NO: 1623820 - protein, 4 aa, Staphylococcus aureus
KNAK

SEQ ID NO: 1623821 - protein, 8 aa, Staphylococcus aureus
KNDATPTI

SEQ ID NO: 1623822 - protein, 6 aa, Staphylococcus aureus
KNDKSL

SEQ ID NO: 1623823 - protein, 5 aa, Staphylococcus aureus
KNEAD

SEQ ID NO: 1623824 - protein, 12 aa, Staphylococcus aureus
KNGKQSQKEAQR

SEQ ID NO: 1623825 - protein, 13 aa, Staphylococcus aureus
KNIEQSLKAGHTS

SEQ ID NO: 1623826 - protein, 8 aa, Staphylococcus aureus
KNKDGETG

SEQ ID NO: 1623827 - protein, 7 aa, Staphylococcus aureus
KNKETII

SEQ ID NO: 1623828 - protein, 9 aa, Staphylococcus aureus
KNNTSRREY

SEQ ID NO: 1623829 - protein, 13 aa, Staphylococcus aureus
KNVTSGANPVGLR

SEQ ID NO: 1623830 - protein, 18 aa, Staphylococcus aureus
KNYSNGDVSINENVPSYD

SEQ ID NO: 1623831 - protein, 8 aa, Staphylococcus aureus
KPESTRTQ

SEQ ID NO: 1623832 - protein, 15 aa, Staphylococcus aureus
KPLPKKAGRNNQGKL

SEQ ID NO: 1623833 - protein, 12 aa, Staphylococcus aureus
KPPINQSEVNNT

SEQ ID NO: 1623834 - protein, 13 aa, Staphylococcus aureus
KQHGPNTAQNAVE

SEQ ID NO: 1623835 - protein, 7 aa, Staphylococcus aureus
KRASEEL

SEQ ID NO: 1623836 - protein, 21 aa, Staphylococcus aureus
KSFKEKFSKDMKDGYKSLSDD

SEQ ID NO: 1623837 - protein, 9 aa, Staphylococcus aureus
KSMQIQNDL

SEQ ID NO: 1623838 - protein, 8 aa, Staphylococcus aureus
KSSSSNKS

SEQ ID NO: 1623839 - protein, 12 aa, Staphylococcus aureus
KTDITNKQISTH

SEQ ID NO: 1623840 - protein, 9 aa, Staphylococcus aureus
KTEKQGKNK

SEQ ID NO: 1623841 - protein, 14 aa, Staphylococcus aureus
KTQGANTPKQDVEA

SEQ ID NO: 1623842 - protein, 28 aa, Staphylococcus aureus
KVDQVNTDKAQPNYTEASTDKKEAVDQA

SEQ ID NO: 1623843 - protein, 4 aa, Staphylococcus aureus
KVGQ

SEQ ID NO: 1623844 - protein, 7 aa, Staphylococcus aureus
KVGWKDS

SEQ ID NO: 1623845 - protein, 14 aa, Staphylococcus aureus
KVKATSGATGEEFE

SEQ ID NO: 1623846 - protein, 28 aa, Staphylococcus aureus
KVNDTNQALNGNQKLADAKQAAKTNLGT

SEQ ID NO: 1623847 - protein, 12 aa, Staphylococcus aureus
KYDDEKALNQLG

SEQ ID NO: 1623848 - protein, 5 aa, Staphylococcus aureus
KYGTQ

SEQ ID NO: 1623849 - protein, 6 aa, Staphylococcus aureus
KYQDTA

SEQ ID NO: 1623850 - protein, 11 aa, Staphylococcus aureus
KYQLTNDDYNV

SEQ ID NO: 1623851 - protein, 6 aa, Staphylococcus aureus
KYTEAE

SEQ ID NO: 1623852 - protein, 11 aa, Staphylococcus aureus
LAASGKLVTPD

SEQ ID NO: 1623853 - protein, 15 aa, Staphylococcus aureus
LAQTGRLSSVDPNLQ

SEQ ID NO: 1623854 - protein, 6 aa, Staphylococcus aureus
LDGTNE

SEQ ID NO: 1623855 - protein, 9 aa, Staphylococcus aureus
LESPTDKKV

SEQ ID NO: 1623856 - protein, 4 aa, Staphylococcus aureus
LGPT

SEQ ID NO: 1623857 - protein, 6 aa, Staphylococcus aureus
LHQSKQ

SEQ ID NO: 1623858 - protein, 7 aa, Staphylococcus aureus
LKGANTI

SEQ ID NO: 1623859 - protein, 4 aa, Staphylococcus aureus
LKNS

SEQ ID NO: 1623860 - protein, 28 aa, Staphylococcus aureus
LKQRDEENAQLQSQMEQAQRSEEIARKQ

SEQ ID NO: 1623861 - protein, 5 aa, Staphylococcus aureus
LQKNN

SEQ ID NO: 1623862 - protein, 8 aa, Staphylococcus aureus
LSESYDGV

SEQ ID NO: 1623863 - protein, 25 aa, Staphylococcus aureus
LSLSEKSLKRTPSFSVNRPGEETGV

SEQ ID NO: 1623864 - protein, 5 aa, Staphylococcus aureus
LSQGK

SEQ ID NO: 1623865 - protein, 7 aa, Staphylococcus aureus
LSQMTSS

SEQ ID NO: 1623866 - protein, 7 aa, Staphylococcus aureus
LSVGGDL

SEQ ID NO: 1623867 - protein, 10 aa, Staphylococcus aureus
LTDNDKNNID

SEQ ID NO: 1623868 - protein, 7 aa, Staphylococcus aureus
LTPPGNL

SEQ ID NO: 1623869 - protein, 7 aa, Staphylococcus aureus
LTPPRQK

SEQ ID NO: 1623870 - protein, 8 aa, Staphylococcus aureus
LTPPRQSN

SEQ ID NO: 1623871 - protein, 26 aa, Staphylococcus aureus
MGAKTGTGTYGAETYSQYNLPDNAAK

SEQ ID NO: 1623872 - protein, 4 aa, Staphylococcus aureus
MKNN

SEQ ID NO: 1623873 - protein, 10 aa, Staphylococcus aureus
MNAKRISSTI

SEQ ID NO: 1623874 - protein, 10 aa, Staphylococcus aureus
MNDVEPKNRD

SEQ ID NO: 1623875 - protein, 4 aa, Staphylococcus aureus
MPEE

SEQ ID NO: 1623876 - protein, 8 aa, Staphylococcus aureus
MPNSKLNR

SEQ ID NO: 1623877 - protein, 19 aa, Staphylococcus aureus
MSADEDGDNRDIEEKRDAL

SEQ ID NO: 1623878 - protein, 9 aa, Staphylococcus aureus
NADTDGLAG

SEQ ID NO: 1623879 - protein, 21 aa, Staphylococcus aureus
NAETLNKASRAINRATKLDNA

SEQ ID NO: 1623880 - protein, 8 aa, Staphylococcus aureus
NAKKATGY

SEQ ID NO: 1623881 - protein, 11 aa, Staphylococcus aureus
NALQDKTETLN

SEQ ID NO: 1623882 - protein, 44 aa, Staphylococcus aureus; identical to SEQ ID NO: 1564149

SEQ ID NO: 1623883 - protein, 6 aa, Staphylococcus aureus
NDDEFY

SEQ ID NO: 1623884 - protein, 8 aa, Staphylococcus aureus
NDDEQTKV

SEQ ID NO: 1623885 - protein, 12 aa, Staphylococcus aureus
NDETTKEEKKEN

SEQ ID NO: 1623886 - protein, 5 aa, Staphylococcus aureus
NDKEQ

SEQ ID NO: 1623887 - protein, 8 aa, Staphylococcus aureus
NDKKTEVN

SEQ ID NO: 1623888 - protein, 9 aa, Staphylococcus aureus
NDPELNGSL

SEQ ID NO: 1623889 - protein, 6 aa, Staphylococcus aureus
NDPKNF

SEQ ID NO: 1623890 - protein, 4 aa, Staphylococcus aureus
NDYG

SEQ ID NO: 1623891 - protein, 4 aa, Staphylococcus aureus
NEIR

SEQ ID NO: 1623892 - protein, 14 aa, Staphylococcus aureus
NELGADKLSTIKEE

SEQ ID NO: 1623893 - protein, 19 aa, Staphylococcus aureus
NEQLDEQNKVTSIDGYKES

SEQ ID NO: 1623894 - protein, 26 aa, Staphylococcus aureus
NEQTATLDNNAINQAATTVNTTKAAL

SEQ ID NO: 1623895 - protein, 4 aa, Staphylococcus aureus
NGET

SEQ ID NO: 1623896 - protein, 13 aa, Staphylococcus aureus
NIIPNSTGAAKAI

SEQ ID NO: 1623897 - protein, 13 aa, Staphylococcus aureus
NIKGNSEETSTVS

SEQ ID NO: 1623898 - protein, 6 aa, Staphylococcus aureus
NIRSTE

SEQ ID NO: 1623899 - protein, 14 aa, Staphylococcus aureus
NITKTGNGNSKITS

SEQ ID NO: 1623900 - protein, 4 aa, Staphylococcus aureus
NKAN

SEQ ID NO: 1623901 - protein, 7 aa, Staphylococcus aureus
NKDEGKY

SEQ ID NO: 1623902 - protein, 9 aa, Staphylococcus aureus
NKEISSYQI

SEQ ID NO: 1623903 - protein, 11 aa, Staphylococcus aureus
NKGWTSPAKAI

SEQ ID NO: 1623904 - protein, 7 aa, Staphylococcus aureus
NKKEDLE

SEQ ID NO: 1623905 - protein, 7 aa, Staphylococcus aureus
NKNEVED

SEQ ID NO: 1623906 - protein, 25 aa, Staphylococcus aureus
NKPTDNNSDVSYSTNRNRAREFNGM

SEQ ID NO: 1623907 - protein, 4 aa, Staphylococcus aureus
NKRG

SEQ ID NO: 1623908 - protein, 10 aa, Staphylococcus aureus
NKSRAKWDNI

SEQ ID NO: 1623909 - protein, 14 aa, Staphylococcus aureus
NLERRTKNKYRDKL

SEQ ID NO: 1623910 - protein, 10 aa, Staphylococcus aureus
NLQNTLEQNT

SEQ ID NO: 1623911 - protein, 5 aa, Staphylococcus aureus
NLSNR

SEQ ID NO: 1623912 - protein, 7 aa, Staphylococcus aureus
NLTPDDL

SEQ ID NO: 1623913 - protein, 5 aa, Staphylococcus aureus
NMTNK

SEQ ID NO: 1623914 - protein, 34 aa, Staphylococcus aureus; identical to SEQ ID NO: 1566895

SEQ ID NO: 1623915 - protein, 6 aa, Staphylococcus aureus
NNFNSE

SEQ ID NO: 1623916 - protein, 13 aa, Staphylococcus aureus
NNTIGEIAQNNNL

SEQ ID NO: 1623917 - protein, 16 aa, Staphylococcus aureus
NQMPHSQITQSTHQVT

SEQ ID NO: 1623918 - protein, 6 aa, Staphylococcus aureus
NQTGHV

SEQ ID NO: 1623919 - protein, 6 aa, Staphylococcus aureus
NRDNHT

SEQ ID NO: 1623920 - protein, 12 aa, Staphylococcus aureus
NRGVERTNKSAV

SEQ ID NO: 1623921 - protein, 5 aa, Staphylococcus aureus
NRTSY

SEQ ID NO: 1623922 - protein, 6 aa, Staphylococcus aureus
NSASFY

SEQ ID NO: 1623923 - protein, 20 aa, Staphylococcus aureus
NSEEPSSWSTDHCFSNAALS

SEQ ID NO: 1623924 - protein, 10 aa, Staphylococcus aureus
NSGKDYKHLE

SEQ ID NO: 1623925 - protein, 34 aa, Staphylococcus aureus; identical to SEQ ID NO: 1566671

SEQ ID NO: 1623926 - protein, 47 aa, Staphylococcus aureus; identical to SEQ ID NO: 1566905

SEQ ID NO: 1623927 - protein, 33 aa, Staphylococcus aureus; identical to SEQ ID NO: 1564663

SEQ ID NO: 1623928 - protein, 10 aa, Staphylococcus aureus
NSPSCGSQEI

SEQ ID NO: 1623929 - protein, 5 aa, Staphylococcus aureus
NTAKS

SEQ ID NO: 1623930 - protein, 10 aa, Staphylococcus aureus
NTEIKGRHDL

SEQ ID NO: 1623931 - protein, 9 aa, Staphylococcus aureus
NTGEGGLSE

SEQ ID NO: 1623932 - protein, 19 aa, Staphylococcus aureus
NVKTSAKNQKNPPVPAGYT

SEQ ID NO: 1623933 - protein, 29 aa, Staphylococcus aureus
NWKGTNTKDKWTDRSSERYKIDWEKEEMT

SEQ ID NO: 1623934 - protein, 4 aa, Staphylococcus aureus
NYSE

SEQ ID NO: 1623935 - protein, 4 aa, Staphylococcus aureus
NYSY

SEQ ID NO: 1623936 - protein, 12 aa, Staphylococcus aureus
PADKKTDSVPGE

SEQ ID NO: 1623937 - protein, 6 aa, Staphylococcus aureus
PEREIG

SEQ ID NO: 1623938 - protein, 7 aa, Staphylococcus aureus
PGVPKGK

SEQ ID NO: 1623939 - protein, 37 aa, Staphylococcus aureus
PKNNNQQPNNNYHQQRQTQTGNNPFDNTTAITDDDLP

SEQ ID NO: 1623940 - protein, 11 aa, Staphylococcus aureus
PKNSNDTQQDL

SEQ ID NO: 1623941 - protein, 7 aa, Staphylococcus aureus
PKSVTDD

SEQ ID NO: 1623942 - protein, 5 aa, Staphylococcus aureus
PKVAT

SEQ ID NO: 1623943 - protein, 8 aa, Staphylococcus aureus
PLEENRKN

SEQ ID NO: 1623944 - protein, 11 aa, Staphylococcus aureus
PRPKTDSSEDI

SEQ ID NO: 1623945 - protein, 11 aa, Staphylococcus aureus
PTDVTNKEEVD

SEQ ID NO: 1623946 - protein, 13 aa, Staphylococcus aureus
PTGMEITAEGEQL

SEQ ID NO: 1623947 - protein, 4 aa, Staphylococcus aureus
PVNS

SEQ ID NO: 1623948 - protein, 10 aa, Staphylococcus aureus
QDEPNEQAEK

SEQ ID NO: 1623949 - protein, 11 aa, Staphylococcus aureus
QEIGNSMKNVG

SEQ ID NO: 1623950 - protein, 12 aa, Staphylococcus aureus
QELKNGKLKDDD

SEQ ID NO: 1623951 - protein, 4 aa, Staphylococcus aureus
QFNA

SEQ ID NO: 1623952 - protein, 12 aa, Staphylococcus aureus
QGAKTRGGHMEA

SEQ ID NO: 1623953 - protein, 32 aa, Staphylococcus aureus; identical to SEQ ID NO: 1566255

SEQ ID NO: 1623954 - protein, 11 aa, Staphylococcus aureus
QGVGKSTAVSK

SEQ ID NO: 1623955 - protein, 16 aa, Staphylococcus aureus
QIATAKQNIDQATKLQ

SEQ ID NO: 1623956 - protein, 6 aa, Staphylococcus aureus
QIEGTE

SEQ ID NO: 1623957 - protein, 13 aa, Staphylococcus aureus
QILPPKTESSIGK

SEQ ID NO: 1623958 - protein, 13 aa, Staphylococcus aureus
QIVTEEKDDNHGA

SEQ ID NO: 1623959 - protein, 9 aa, Staphylococcus aureus
QKAQPTGID

SEQ ID NO: 1623960 - protein, 17 aa, Staphylococcus aureus
QKLSEPETKKSIVKEKL

SEQ ID NO: 1623961 - protein, 4 aa, Staphylococcus aureus
QKNH

SEQ ID NO: 1623962 - protein, 6 aa, Staphylococcus aureus
QLGQKP

SEQ ID NO: 1623963 - protein, 20 aa, Staphylococcus aureus
QNLNGDQRLQDAKDKAIQSI

SEQ ID NO: 1623964 - protein, 14 aa, Staphylococcus aureus
QNNKQKHPFKLGEE

SEQ ID NO: 1623965 - protein, 17 aa, Staphylococcus aureus
QNRSHSLEQSLKEGYSQ

SEQ ID NO: 1623966 - protein, 6 aa, Staphylococcus aureus
QPVGQS

SEQ ID NO: 1623967 - protein, 4 aa, Staphylococcus aureus
QQTY

SEQ ID NO: 1623968 - protein, 6 aa, Staphylococcus aureus
QQWEPS

SEQ ID NO: 1623969 - protein, 14 aa, Staphylococcus aureus
QSAIKAGYNANSAH

SEQ ID NO: 1623970 - protein, 15 aa, Staphylococcus aureus
QSAIKAGYSANSAHV

SEQ ID NO: 1623971 - protein, 7 aa, Staphylococcus aureus
QSFGTPT

SEQ ID NO: 1623972 - protein, 20 aa, Staphylococcus aureus
QSFTKAAENLYTSQPSISRD

SEQ ID NO: 1623973 - protein, 8 aa, Staphylococcus aureus
QSGMSYGA

SEQ ID NO: 1623974 - protein, 26 aa, Staphylococcus aureus
QSVTSAKNALNGDQNVTNAKNAAKHA

SEQ ID NO: 1623975 - protein, 22 aa, Staphylococcus aureus
QTNLGSSELGISGVNSGVASKN

SEQ ID NO: 1623976 - protein, 5 aa, Staphylococcus aureus
QTQKQ

SEQ ID NO: 1623977 - protein, 24 aa, Staphylococcus aureus
QVNSSKTALNGDENLATAKLNAKT

SEQ ID NO: 1623978 - protein, 14 aa, Staphylococcus aureus
QVTQAKGDLNGNHN

SEQ ID NO: 1623979 - protein, 26 aa, Staphylococcus aureus
QYERELNQATQELKDMQREQKALNTA

SEQ ID NO: 1623980 - protein, 6 aa, Staphylococcus aureus
QYTKSS

SEQ ID NO: 1623981 - protein, 8 aa, Staphylococcus aureus
RDDQPQQH

SEQ ID NO: 1623982 - protein, 10 aa, Staphylococcus aureus
RDGETALHPS

SEQ ID NO: 1623983 - protein, 13 aa, Staphylococcus aureus
RDGQVTAEAQGIA

SEQ ID NO: 1623984 - protein, 10 aa, Staphylococcus aureus
RDIEARDQYD

SEQ ID NO: 1623985 - protein, 13 aa, Staphylococcus aureus
RELSGPVATSYTV

SEQ ID NO: 1623986 - protein, 6 aa, Staphylococcus aureus
RFPTER

SEQ ID NO: 1623987 - protein, 5 aa, Staphylococcus aureus
RFSPE

SEQ ID NO: 1623988 - protein, 16 aa, Staphylococcus aureus
RGKDFGEENVVGPNDN

SEQ ID NO: 1623989 - protein, 7 aa, Staphylococcus aureus
RGNMDAS

SEQ ID NO: 1623990 - protein, 12 aa, Staphylococcus aureus
RGNYNLGGEQSG

SEQ ID NO: 1623991 - protein, 13 aa, Staphylococcus aureus
RGVESRQDKRPML

SEQ ID NO: 1623992 - protein, 9 aa, Staphylococcus aureus
RIENADDNF

SEQ ID NO: 1623993 - protein, 10 aa, Staphylococcus aureus
RIPQNDNTRY

SEQ ID NO: 1623994 - protein, 4 aa, Staphylococcus aureus
RKGN

SEQ ID NO: 1623995 - protein, 14 aa, Staphylococcus aureus
RKQKGKTASEISKQ

SEQ ID NO: 1623996 - protein, 4 aa, Staphylococcus aureus
RLNQ

SEQ ID NO: 1623997 - protein, 9 aa, Staphylococcus aureus
RNGKPETKY

SEQ ID NO: 1623998 - protein, 7 aa, Staphylococcus aureus
RNGSMKA

SEQ ID NO: 1623999 - protein, 15 aa, Staphylococcus aureus
RNKAAGIKVTTANTT

SEQ ID NO: 1624000 - protein, 5 aa, Staphylococcus aureus
RPDLD

SEQ ID NO: 1624001 - protein, 5 aa, Staphylococcus aureus
RRDSA

SEQ ID NO: 1624002 - protein, 14 aa, Staphylococcus aureus
RSKRKSLPFTENDE

SEQ ID NO: 1624003 - protein, 5 aa, Staphylococcus aureus
RTAHR

SEQ ID NO: 1624004 - protein, 6 aa, Staphylococcus aureus
RTHGSG

SEQ ID NO: 1624005 - protein, 15 aa, Staphylococcus aureus
RTIQNMEKDSTNIKD

SEQ ID NO: 1624006 - protein, 4 aa, Staphylococcus aureus
RVEN

SEQ ID NO: 1624007 - protein, 6 aa, Staphylococcus aureus
SAKENI

SEQ ID NO: 1624008 - protein, 11 aa, Staphylococcus aureus
SAPKEKSDDGL

SEQ ID NO: 1624009 - protein, 7 aa, Staphylococcus aureus
SAQYSKN

SEQ ID NO: 1624010 - protein, 8 aa, Staphylococcus aureus
SATLPTQL

SEQ ID NO: 1624011 - protein, 4 aa, Staphylococcus aureus
SDAM

SEQ ID NO: 1624012 - protein, 6 aa, Staphylococcus aureus
SEENNR

SEQ ID NO: 1624013 - protein, 4 aa, Staphylococcus aureus
SELL

SEQ ID NO: 1624014 - protein, 6 aa, Staphylococcus aureus
SENAGD

SEQ ID NO: 1624015 - protein, 4 aa, Staphylococcus aureus
SGIE

SEQ ID NO: 1624016 - protein, 9 aa, Staphylococcus aureus
SGNIPKSIS

SEQ ID NO: 1624017 - protein, 6 aa, Staphylococcus aureus
SHRPLG

SEQ ID NO: 1624018 - protein, 23 aa, Staphylococcus aureus
SINNAQKRDLTTKIDQATTVSGV

SEQ ID NO: 1624019 - protein, 14 aa, Staphylococcus aureus
SISEENAKNNDFTL

SEQ ID NO: 1624020 - protein, 6 aa, Staphylococcus aureus
SKDNVD

SEQ ID NO: 1624021 - protein, 7 aa, Staphylococcus aureus
SKNTVSR

SEQ ID NO: 1624022 - protein, 13 aa, Staphylococcus aureus
SLSSEAEYQRGYG

SEQ ID NO: 1624023 - protein, 8 aa, Staphylococcus aureus
SLTSDGEK

SEQ ID NO: 1624024 - protein, 7 aa, Staphylococcus aureus
SNISDTD

SEQ ID NO: 1624025 - protein, 6 aa, Staphylococcus aureus
SNKFKG

SEQ ID NO: 1624026 - protein, 6 aa, Staphylococcus aureus
SNLQRK

SEQ ID NO: 1624027 - protein, 4 aa, Staphylococcus aureus
SNLY

SEQ ID NO: 1624028 - protein, 6 aa, Staphylococcus aureus
SNNAIS

SEQ ID NO: 1624029 - protein, 8 aa, Staphylococcus aureus
SNTAEFGD

SEQ ID NO: 1624030 - protein, 5 aa, Staphylococcus aureus
SPTGT

SEQ ID NO: 1624031 - protein, 4 aa, Staphylococcus aureus
SQPE

SEQ ID NO: 1624032 - protein, 5 aa, Staphylococcus aureus
SRTQI

SEQ ID NO: 1624033 - protein, 19 aa, Staphylococcus aureus
SSATRVSSVDTVKQNAQHL

SEQ ID NO: 1624034 - protein, 8 aa, Staphylococcus aureus
SSATVDQL

SEQ ID NO: 1624035 - protein, 8 aa, Staphylococcus aureus
SSNLKRGE

SEQ ID NO: 1624036 - protein, 8 aa, Staphylococcus aureus
SSSAWSNA

SEQ ID NO: 1624037 - protein, 5 aa, Staphylococcus aureus
SSVKE

SEQ ID NO: 1624038 - protein, 6 aa, Staphylococcus aureus
STLTPY

SEQ ID NO: 1624039 - protein, 7 aa, Staphylococcus aureus
STYKQAQ

SEQ ID NO: 1624040 - protein, 6 aa, Staphylococcus aureus
SVGYKE

SEQ ID NO: 1624041 - protein, 15 aa, Staphylococcus aureus
SVNQIPGSGAAGGMG

SEQ ID NO: 1624042 - protein, 15 aa, Staphylococcus aureus
SVNQQGNDIGEKYRT

SEQ ID NO: 1624043 - protein, 5 aa, Staphylococcus aureus
SWNPV

SEQ ID NO: 1624044 - protein, 8 aa, Staphylococcus aureus
SYTKSDVI

SEQ ID NO: 1624045 - protein, 29 aa, Staphylococcus aureus
SYTNNASFPAYHRPTSPDYTVGTEPLTQQ

SEQ ID NO: 1624046 - protein, 5 aa, Staphylococcus aureus
TAAEG

SEQ ID NO: 1624047 - protein, 10 aa, Staphylococcus aureus
TAGMDVSGRE

SEQ ID NO: 1624048 - protein, 10 aa, Staphylococcus aureus
TATSDNKHKS

SEQ ID NO: 1624049 - protein, 10 aa, Staphylococcus aureus
TDDRKLRESA

SEQ ID NO: 1624050 - protein, 18 aa, Staphylococcus aureus
TDNASWGGTTIKKYFFYR

SEQ ID NO: 1624051 - protein, 6 aa, Staphylococcus aureus
TDNGLD

SEQ ID NO: 1624052 - protein, 6 aa, Staphylococcus aureus
TDPTIS

SEQ ID NO: 1624053 - protein, 13 aa, Staphylococcus aureus
TENQQPLKTTNVD

SEQ ID NO: 1624054 - protein, 5 aa, Staphylococcus aureus
TEYGT

SEQ ID NO: 1624055 - protein, 7 aa, Staphylococcus aureus
TFKGDEV

SEQ ID NO: 1624056 - protein, 4 aa, Staphylococcus aureus
TGAM

SEQ ID NO: 1624057 - protein, 7 aa, Staphylococcus aureus
TGGSGMV

SEQ ID NO: 1624058 - protein, 16 aa, Staphylococcus aureus
TGMIGDPSGKSEERVL

SEQ ID NO: 1624059 - protein, 10 aa, Staphylococcus aureus
TIASNDKFNA

SEQ ID NO: 1624060 - protein, 9 aa, Staphylococcus aureus
TIKDPDGNL

SEQ ID NO: 1624061 - protein, 9 aa, Staphylococcus aureus
TINQKAQAL

SEQ ID NO: 1624062 - protein, 15 aa, Staphylococcus aureus
TKESDYGLRVHLEYK

SEQ ID NO: 1624063 - protein, 8 aa, Staphylococcus aureus
TKGPEIRT

SEQ ID NO: 1624064 - protein, 9 aa, Staphylococcus aureus
TKPDSDELN

SEQ ID NO: 1624065 - protein, 8 aa, Staphylococcus aureus
TKPGSDDL

SEQ ID NO: 1624066 - protein, 9 aa, Staphylococcus aureus
TKPGSEDLN

SEQ ID NO: 1624067 - protein, 8 aa, Staphylococcus aureus
TLQQPTAH

SEQ ID NO: 1624068 - protein, 4 aa, Staphylococcus aureus
TNGD

SEQ ID NO: 1624069 - protein, 11 aa, Staphylococcus aureus
TNKADISRRQQ

SEQ ID NO: 1624070 - protein, 36 aa, Staphylococcus aureus; identical to SEQ ID NO: 1566968

SEQ ID NO: 1624071 - protein, 29 aa, Staphylococcus aureus
TPAERNNPDTLNVSRKKRIAKGSGRSLQE

SEQ ID NO: 1624072 - protein, 6 aa, Staphylococcus aureus
TPITQI

SEQ ID NO: 1624073 - protein, 18 aa, Staphylococcus aureus
TPKNNQDLTELNSYGKSD

SEQ ID NO: 1624074 - protein, 4 aa, Staphylococcus aureus
TPTI

SEQ ID NO: 1624075 - protein, 7 aa, Staphylococcus aureus
TQNDDTM

SEQ ID NO: 1624076 - protein, 11 aa, Staphylococcus aureus
TRADKGTRKIE

SEQ ID NO: 1624077 - protein, 32 aa, Staphylococcus aureus
TRKQQIKKSNASLQDEKDVANDKIGKIETKAI

SEQ ID NO: 1624078 - protein, 4 aa, Staphylococcus aureus
TRQK

SEQ ID NO: 1624079 - protein, 25 aa, Staphylococcus aureus
TTMNQAKDALNGDEKLAQAKQDAIA

SEQ ID NO: 1624080 - protein, 13 aa, Staphylococcus aureus
TTRGDGLSDYPKN

SEQ ID NO: 1624081 - protein, 5 aa, Staphylococcus aureus
TTTVD

SEQ ID NO: 1624082 - protein, 5 aa, Staphylococcus aureus
TVGID

SEQ ID NO: 1624083 - protein, 15 aa, Staphylococcus aureus
VDENDPAFNNPSKPI

SEQ ID NO: 1624084 - protein, 12 aa, Staphylococcus aureus
VEPYKTINSPNR

SEQ ID NO: 1624085 - protein, 7 aa, Staphylococcus aureus
VESNNSD

SEQ ID NO: 1624086 - protein, 15 aa, Staphylococcus aureus
VETTELSSDNHHTTV

SEQ ID NO: 1624087 - protein, 7 aa, Staphylococcus aureus
VGEGTEN

SEQ ID NO: 1624088 - protein, 20 aa, Staphylococcus aureus
VIQSGRNDLTLNGKKVSGAA

SEQ ID NO: 1624089 - protein, 8 aa, Staphylococcus aureus
VKSFPSNK

SEQ ID NO: 1624090 - protein, 12 aa, Staphylococcus aureus
VKTAKNALNGDA

SEQ ID NO: 1624091 - protein, 13 aa, Staphylococcus aureus
VNADNVKIQEDAS

SEQ ID NO: 1624092 - protein, 16 aa, Staphylococcus aureus
VNADSTKQNVYTTKVT

SEQ ID NO: 1624093 - protein, 27 aa, Staphylococcus aureus
VNEAKQALNGNDNVQRAKDAAKQVITN

SEQ ID NO: 1624094 - protein, 25 aa, Staphylococcus aureus
VQNAQSKANTAESNAKLYTDDKFNK

SEQ ID NO: 1624095 - protein, 23 aa, Staphylococcus aureus
VQSTDSNKTEAPKPTSDNHKTIN

SEQ ID NO: 1624096 - protein, 10 aa, Staphylococcus aureus
VSDEGKDEFN

SEQ ID NO: 1624097 - protein, 12 aa, Staphylococcus aureus
VSEGERNSTLAS

SEQ ID NO: 1624098 - protein, 32 aa, Staphylococcus aureus; identical to SEQ ID NO: 1566984

SEQ ID NO: 1624099 - protein, 13 aa, Staphylococcus aureus
VTGAHGKTSTTGL

SEQ ID NO: 1624100 - protein, 16 aa, Staphylococcus aureus
VTGKTLRENNEGKEIK

SEQ ID NO: 1624101 - protein, 25 aa, Staphylococcus aureus
VTKKEKTRNPANPFTTSTLQQEAAR

SEQ ID NO: 1624102 - protein, 10 aa, Staphylococcus aureus
VVPKESPSNI

SEQ ID NO: 1624103 - protein, 4 aa, Staphylococcus aureus
WKGT

SEQ ID NO: 1624104 - protein, 9 aa, Staphylococcus aureus
YAPSLANVQ

SEQ ID NO: 1624105 - protein, 12 aa, Staphylococcus aureus
YDLPKRGSNPKG

SEQ ID NO: 1624106 - protein, 5 aa, Staphylococcus aureus
YDQDE

SEQ ID NO: 1624107 - protein, 6 aa, Staphylococcus aureus
YDQTIS

SEQ ID NO: 1624108 - protein, 6 aa, Staphylococcus aureus
YDSSKE

SEQ ID NO: 1624109 - protein, 5 aa, Staphylococcus aureus
YEGET

SEQ ID NO: 1624110 - protein, 6 aa, Staphylococcus aureus
YHPSYK

SEQ ID NO: 1624111 - protein, 12 aa, Staphylococcus aureus
YKDEISANPKYE

SEQ ID NO: 1624112 - protein, 8 aa, Staphylococcus aureus
YKEYQATE

SEQ ID NO: 1624113 - protein, 8 aa, Staphylococcus aureus
YKKEGKSQ

SEQ ID NO: 1624114 - protein, 20 aa, Staphylococcus aureus
YKTPGLSKAASDIITQAGRE

SEQ ID NO: 1624115 - protein, 9 aa, Staphylococcus aureus
YNKQHVNEE

SEQ ID NO: 1624116 - protein, 4 aa, Staphylococcus aureus
YPQT

SEQ ID NO: 1624117 - protein, 11 aa, Staphylococcus aureus
YPRNSIDTKEY

SEQ ID NO: 1624118 - protein, 8 aa, Staphylococcus aureus
YPRPDTGL

SEQ ID NO: 1624119 - protein, 9 aa, Staphylococcus aureus
YREKETIER

SEQ ID NO: 1624120 - protein, 9 aa, Staphylococcus aureus
YSSNSKDET

SEQ ID NO: 1624121 - protein, 4 aa, Staphylococcus aureus
YSYA

SEQ ID NO: 1624122 - protein, 13 aa, Staphylococcus aureus
YTNSKYNIAPDEL

SEQ ID NO: 1624123 - protein, 7 aa, Staphylococcus aureus
YTRQSDV

SEQ ID NO: 1624124 - protein, 7 aa, Staphylococcus aureus
YTRRDSK

SEQ ID NO: 1624125 - protein, 11 aa, Staphylococcus aureus
YYNPNNNKKKY

SEQ ID NO: 1624126 - protein, 55 aa, Staphylococcus aureus
AAANANVDNAVTEANNHIETANSQNEVDQAKTTGEASIDQVTPTVNKKATARNEI

SEQ ID NO: 1624127 - protein, 9 aa, Staphylococcus aureus
AAEKAGIEG

SEQ ID NO: 1624128 - protein, 5 aa, Staphylococcus aureus
AAEQV

SEQ ID NO: 1624129 - protein, 22 aa, Staphylococcus aureus
AAESITDPTNGSNANKDAVDQA

SEQ ID NO: 1624130 - protein, 17 aa, Staphylococcus aureus
AAETIERSMDEGDIAPY

SEQ ID NO: 1624131 - protein, 32 aa, Staphylococcus aureus; identical to SEQ ID NO: 1565804

SEQ ID NO: 1624132 - protein, 16 aa, Staphylococcus aureus
AANERKYREIIKKELA

SEQ ID NO: 1624133 - protein, 8 aa, Staphylococcus aureus
AANGVGTR

SEQ ID NO: 1624134 - protein, 12 aa, Staphylococcus aureus
ADASAKEIARTD

SEQ ID NO: 1624135 - protein, 5 aa, Staphylococcus aureus
ADDET

SEQ ID NO: 1624136 - protein, 11 aa, Staphylococcus aureus
ADGLAKSSRNV

SEQ ID NO: 1624137 - protein, 8 aa, Staphylococcus aureus
ADISPGTR

SEQ ID NO: 1624138 - protein, 8 aa, Staphylococcus aureus
AEGDLQPV

SEQ ID NO: 1624139 - protein, 12 aa, Staphylococcus aureus
AEGYARVSGKTG

SEQ ID NO: 1624140 - protein, 47 aa, Staphylococcus aureus; identical to SEQ ID NO: 1564038

SEQ ID NO: 1624141 - protein, 7 aa, Staphylococcus aureus
AFKDENL

SEQ ID NO: 1624142 - protein, 10 aa, Staphylococcus aureus
AFTKQQADSL

SEQ ID NO: 1624143 - protein, 8 aa, Staphylococcus aureus
AGKFEETP

SEQ ID NO: 1624144 - protein, 7 aa, Staphylococcus aureus
AGKTTLT

SEQ ID NO: 1624145 - protein, 12 aa, Staphylococcus aureus
AIEGINNKIKLI

SEQ ID NO: 1624146 - protein, 8 aa, Staphylococcus aureus
AIEKNNYD

SEQ ID NO: 1624147 - protein, 10 aa, Staphylococcus aureus
AIEKPTARKT

SEQ ID NO: 1624148 - protein, 26 aa, Staphylococcus aureus
AIQDESSYQVDGSTFRNYDTKSHGTV

SEQ ID NO: 1624149 - protein, 7 aa, Staphylococcus aureus
AITDDNF

SEQ ID NO: 1624150 - protein, 17 aa, Staphylococcus aureus
AITRPKEITKRFVQVME

SEQ ID NO: 1624151 - protein, 9 aa, Staphylococcus aureus
AKDVGIDKE

SEQ ID NO: 1624152 - protein, 8 aa, Staphylococcus aureus
AKEANDAN

SEQ ID NO: 1624153 - protein, 7 aa, Staphylococcus aureus
AKEEYKK

SEQ ID NO: 1624154 - protein, 5 aa, Staphylococcus aureus
AKGGD

SEQ ID NO: 1624155 - protein, 8 aa, Staphylococcus aureus
AKNKELKG

SEQ ID NO: 1624156 - protein, 8 aa, Staphylococcus aureus
ALATQNHN

SEQ ID NO: 1624157 - protein, 23 aa, Staphylococcus aureus
ANDLNQAQKDALKQQVDAAQTVA

SEQ ID NO: 1624158 - protein, 10 aa, Staphylococcus aureus
ANGGTYNNAH

SEQ ID NO: 1624159 - protein, 6 aa, Staphylococcus aureus
ANTELQ

SEQ ID NO: 1624160 - protein, 11 aa, Staphylococcus aureus
APLKNGHEDMA

SEQ ID NO: 1624161 - protein, 5 aa, Staphylococcus aureus
APPQL

SEQ ID NO: 1624162 - protein, 12 aa, Staphylococcus aureus
APTSNTPHIGEQ

SEQ ID NO: 1624163 - protein, 14 aa, Staphylococcus aureus
AQAKTNATNTINNA

SEQ ID NO: 1624164 - protein, 4 aa, Staphylococcus aureus
AQEQ

SEQ ID NO: 1624165 - protein, 22 aa, Staphylococcus aureus
AQQDVDQEKAKDLEKKMRESSF

SEQ ID NO: 1624166 - protein, 4 aa, Staphylococcus aureus
AREH

SEQ ID NO: 1624167 - protein, 7 aa, Staphylococcus aureus
ARKYSLE

SEQ ID NO: 1624168 - protein, 5 aa, Staphylococcus aureus
ARPEH

SEQ ID NO: 1624169 - protein, 6 aa, Staphylococcus aureus
ARQHEM

SEQ ID NO: 1624170 - protein, 7 aa, Staphylococcus aureus
ARQTIQD

SEQ ID NO: 1624171 - protein, 24 aa, Staphylococcus aureus
ASSLTGDNAKIPNHKDITDQLDYE

SEQ ID NO: 1624172 - protein, 9 aa, Staphylococcus aureus
ATDAPSFKD

SEQ ID NO: 1624173 - protein, 7 aa, Staphylococcus aureus
ATPDNTI

SEQ ID NO: 1624174 - protein, 24 aa, Staphylococcus aureus
AVTAAKKALNGEEKLNNRKSEALQ

SEQ ID NO: 1624175 - protein, 27 aa, Staphylococcus aureus
AVTRAKAALNGADNLRNAKTSATNTIN

SEQ ID NO: 1624176 - protein, 8 aa, Staphylococcus aureus
AYNDAPKY

SEQ ID NO: 1624177 - protein, 7 aa, Staphylococcus aureus
CKTYKDM

SEQ ID NO: 1624178 - protein, 13 aa, Staphylococcus aureus
CSRSIKGTKPIFK

SEQ ID NO: 1624179 - protein, 14 aa, Staphylococcus aureus
DAGYSGAKKDRPAL

SEQ ID NO: 1624180 - protein, 18 aa, Staphylococcus aureus
DAQKANLTSQIERGTTVA

SEQ ID NO: 1624181 - protein, 16 aa, Staphylococcus aureus
DAQKQALKGQIDQSPE

SEQ ID NO: 1624182 - protein, 9 aa, Staphylococcus aureus
DDEAQSQFN

SEQ ID NO: 1624183 - protein, 7 aa, Staphylococcus aureus
DDGSEFK

SEQ ID NO: 1624184 - protein, 23 aa, Staphylococcus aureus
DDKTFSDGMKNSKKQLKDKSRPY

SEQ ID NO: 1624185 - protein, 5 aa, Staphylococcus aureus
DDMPG

SEQ ID NO: 1624186 - protein, 9 aa, Staphylococcus aureus
DDMTTSAPG

SEQ ID NO: 1624187 - protein, 6 aa, Staphylococcus aureus
DDSFSE

SEQ ID NO: 1624188 - protein, 21 aa, Staphylococcus aureus
DEAVDKAKQALDKSTGQNLTA

SEQ ID NO: 1624189 - protein, 5 aa, Staphylococcus aureus
DEIER

SEQ ID NO: 1624190 - protein, 11 aa, Staphylococcus aureus
DEKEMTKNKDL

SEQ ID NO: 1624191 - protein, 8 aa, Staphylococcus aureus
DEKPAYNN

SEQ ID NO: 1624192 - protein, 10 aa, Staphylococcus aureus
DELGNKNGLE

SEQ ID NO: 1624193 - protein, 8 aa, Staphylococcus aureus
DENGEMES

SEQ ID NO: 1624194 - protein, 6 aa, Staphylococcus aureus
DEVHPE

SEQ ID NO: 1624195 - protein, 7 aa, Staphylococcus aureus
DGEIDKQ

SEQ ID NO: 1624196 - protein, 12 aa, Staphylococcus aureus
DGKQSPLFLLVY

SEQ ID NO: 1624197 - protein, 5 aa, Staphylococcus aureus
DGSYN

SEQ ID NO: 1624198 - protein, 5 aa, Staphylococcus aureus
DGVTI

SEQ ID NO: 1624199 - protein, 51 aa, Staphylococcus aureus
DISGSQSDESTQGEEAKKEDVPANLNDNDSDIEEKSEETEPKKGFWSRLFG

SEQ ID NO: 1624200 - protein, 6 aa, Staphylococcus aureus
DITTMK

SEQ ID NO: 1624201 - protein, 11 aa, Staphylococcus aureus
DKELSDIQSKK

SEQ ID NO: 1624202 - protein, 5 aa, Staphylococcus aureus
DKKHL

SEQ ID NO: 1624203 - protein, 8 aa, Staphylococcus aureus
DKLARKAK

SEQ ID NO: 1624204 - protein, 15 aa, Staphylococcus aureus
DKQWQRQVETNSRVK

SEQ ID NO: 1624205 - protein, 7 aa, Staphylococcus aureus
DKRERYF

SEQ ID NO: 1624206 - protein, 19 aa, Staphylococcus aureus
DKSISNYRINQDTDVSYGG

SEQ ID NO: 1624207 - protein, 15 aa, Staphylococcus aureus
DKTAGTNDNKAAVEQ

SEQ ID NO: 1624208 - protein, 8 aa, Staphylococcus aureus
DKTTTLAS

SEQ ID NO: 1624209 - protein, 4 aa, Staphylococcus aureus
DKYQ

SEQ ID NO: 1624210 - protein, 25 aa, Staphylococcus aureus
DLKPDEVASNTSDNNQQSNDSETTK

SEQ ID NO: 1624211 - protein, 7 aa, Staphylococcus aureus
DNGANDY

SEQ ID NO: 1624212 - protein, 28 aa, Staphylococcus aureus
DNLKHQVEQAQNVAGVNGVKDKGNTLNT

SEQ ID NO: 1624213 - protein, 38 aa, Staphylococcus aureus; identical to SEQ ID NO: 1566012

SEQ ID NO: 1624214 - protein, 32 aa, Staphylococcus aureus; identical to SEQ ID NO: 1566163

SEQ ID NO: 1624215 - protein, 6 aa, Staphylococcus aureus
DQDRQR

SEQ ID NO: 1624216 - protein, 12 aa, Staphylococcus aureus
DQYTNDNRQLDQ

SEQ ID NO: 1624217 - protein, 4 aa, Staphylococcus aureus
DRTQ

SEQ ID NO: 1624218 - protein, 10 aa, Staphylococcus aureus
DRVGHSDYKT

SEQ ID NO: 1624219 - protein, 14 aa, Staphylococcus aureus
DSEIEKWQQQKDSN

SEQ ID NO: 1624220 - protein, 7 aa, Staphylococcus aureus
DSKTGGL

SEQ ID NO: 1624221 - protein, 13 aa, Staphylococcus aureus
DTAEQTKSNVEAF

SEQ ID NO: 1624222 - protein, 6 aa, Staphylococcus aureus
DTIKDQ

SEQ ID NO: 1624223 - protein, 9 aa, Staphylococcus aureus
DVKADDKDG

SEQ ID NO: 1624224 - protein, 22 aa, Staphylococcus aureus
DVNSATSQVNAAKTALNGDNNL

SEQ ID NO: 1624225 - protein, 9 aa, Staphylococcus aureus
EAKKGTSLR

SEQ ID NO: 1624226 - protein, 9 aa, Staphylococcus aureus
EALGDADVS

SEQ ID NO: 1624227 - protein, 7 aa, Staphylococcus aureus
EDGTEDI

SEQ ID NO: 1624228 - protein, 8 aa, Staphylococcus aureus
EEAEQIQK

SEQ ID NO: 1624229 - protein, 5 aa, Staphylococcus aureus
EEEYE

SEQ ID NO: 1624230 - protein, 9 aa, Staphylococcus aureus
EEISKRDEQ

SEQ ID NO: 1624231 - protein, 22 aa, Staphylococcus aureus
EGDIGPSEVLGGSASEFSPTQL

SEQ ID NO: 1624232 - protein, 5 aa, Staphylococcus aureus
EGEEY

SEQ ID NO: 1624233 - protein, 15 aa, Staphylococcus aureus
EGGTTVTDEGSDVEI

SEQ ID NO: 1624234 - protein, 17 aa, Staphylococcus aureus
EGINKDKDDEGSTINPT

SEQ ID NO: 1624235 - protein, 10 aa, Staphylococcus aureus
EGKAWNPDNA

SEQ ID NO: 1624236 - protein, 6 aa, Staphylococcus aureus
EGKDCK

SEQ ID NO: 1624237 - protein, 14 aa, Staphylococcus aureus
EGKGGKVWDTDGKQ

SEQ ID NO: 1624238 - protein, 7 aa, Staphylococcus aureus
EGNEVKQ

SEQ ID NO: 1624239 - protein, 4 aa, Staphylococcus aureus
EIDT

SEQ ID NO: 1624240 - protein, 13 aa, Staphylococcus aureus
EISPVSGGDVNEA

SEQ ID NO: 1624241 - protein, 7 aa, Staphylococcus aureus
EISSYQI

SEQ ID NO: 1624242 - protein, 6 aa, Staphylococcus aureus
EKEQRE

SEQ ID NO: 1624243 - protein, 6 aa, Staphylococcus aureus
EKESLE

SEQ ID NO: 1624244 - protein, 14 aa, Staphylococcus aureus
EKESVKGRTGSIAK

SEQ ID NO: 1624245 - protein, 9 aa, Staphylococcus aureus
EKPGIKGKE

SEQ ID NO: 1624246 - protein, 18 aa, Staphylococcus aureus
EKTQINDSENESSDLRKA

SEQ ID NO: 1624247 - protein, 14 aa, Staphylococcus aureus
ELNKKADFHKNSEK

SEQ ID NO: 1624248 - protein, 19 aa, Staphylococcus aureus
ELQNSTIRSIETEVKNPGF

SEQ ID NO: 1624249 - protein, 9 aa, Staphylococcus aureus
ELSTTNNRR

SEQ ID NO: 1624250 - protein, 4 aa, Staphylococcus aureus
ENDT

SEQ ID NO: 1624251 - protein, 8 aa, Staphylococcus aureus
ENEDKRQA

SEQ ID NO: 1624252 - protein, 8 aa, Staphylococcus aureus
ENEDVSKD

SEQ ID NO: 1624253 - protein, 35 aa, Staphylococcus aureus
ENHSSGKRQTIQPKAKPFAKRGFSQRTTSTKKQVL

SEQ ID NO: 1624254 - protein, 12 aa, Staphylococcus aureus
ENLTSKTALKKN

SEQ ID NO: 1624255 - protein, 5 aa, Staphylococcus aureus
EPKPQ

SEQ ID NO: 1624256 - protein, 7 aa, Staphylococcus aureus
EPSNTFE

SEQ ID NO: 1624257 - protein, 19 aa, Staphylococcus aureus
EQEANEKQENALSDYYSFK

SEQ ID NO: 1624258 - protein, 5 aa, Staphylococcus aureus
EQEES

SEQ ID NO: 1624259 - protein, 4 aa, Staphylococcus aureus
EQTD

SEQ ID NO: 1624260 - protein, 12 aa, Staphylococcus aureus
EQVSKLDKKISD

SEQ ID NO: 1624261 - protein, 36 aa, Staphylococcus aureus; identical to SEQ ID NO: 1566803

SEQ ID NO: 1624262 - protein, 5 aa, Staphylococcus aureus
ERARA

SEQ ID NO: 1624263 - protein, 5 aa, Staphylococcus aureus
ESDYS

SEQ ID NO: 1624264 - protein, 8 aa, Staphylococcus aureus
ESGDTHTV

SEQ ID NO: 1624265 - protein, 10 aa, Staphylococcus aureus
ESIGKPLPNR

SEQ ID NO: 1624266 - protein, 30 aa, Staphylococcus aureus; identical to SEQ ID NO: 1565841

SEQ ID NO: 1624267 - protein, 10 aa, Staphylococcus aureus
ESISQKYDEI

SEQ ID NO: 1624268 - protein, 8 aa, Staphylococcus aureus
ESQGDKAV

SEQ ID NO: 1624269 - protein, 9 aa, Staphylococcus aureus
ESTLSDSEG

SEQ ID NO: 1624270 - protein, 8 aa, Staphylococcus aureus
ETLKNRER

SEQ ID NO: 1624271 - protein, 7 aa, Staphylococcus aureus
ETVKNKL

SEQ ID NO: 1624272 - protein, 10 aa, Staphylococcus aureus
EVKPSSEVYG

SEQ ID NO: 1624273 - protein, 8 aa, Staphylococcus aureus
EVNTPLSK

SEQ ID NO: 1624274 - protein, 8 aa, Staphylococcus aureus
EVSDTVDS

SEQ ID NO: 1624275 - protein, 8 aa, Staphylococcus aureus
EVYDTTSA

SEQ ID NO: 1624276 - protein, 22 aa, Staphylococcus aureus
EYRRPASDRKISIRGARSNNLK

SEQ ID NO: 1624277 - protein, 10 aa, Staphylococcus aureus
FDDEDNKIEI

SEQ ID NO: 1624278 - protein, 10 aa, Staphylococcus aureus
FDDNGEKKAR

SEQ ID NO: 1624279 - protein, 4 aa, Staphylococcus aureus
FDGN

SEQ ID NO: 1624280 - protein, 7 aa, Staphylococcus aureus
FETEQEA

SEQ ID NO: 1624281 - protein, 8 aa, Staphylococcus aureus
FGKDGERV

SEQ ID NO: 1624282 - protein, 7 aa, Staphylococcus aureus
FGNDDER

SEQ ID NO: 1624283 - protein, 8 aa, Staphylococcus aureus
FNPETGEF

SEQ ID NO: 1624284 - protein, 11 aa, Staphylococcus aureus
FNSADGTINDL

SEQ ID NO: 1624285 - protein, 20 aa, Staphylococcus aureus
FPETSGIGIKPVSKEGTERL

SEQ ID NO: 1624286 - protein, 16 aa, Staphylococcus aureus
FPPPTSKFSTSQHNQM

SEQ ID NO: 1624287 - protein, 6 aa, Staphylococcus aureus
FQHREP

SEQ ID NO: 1624288 - protein, 4 aa, Staphylococcus aureus
FSET

SEQ ID NO: 1624289 - protein, 16 aa, Staphylococcus aureus
FSETQHETEVKGSGNK

SEQ ID NO: 1624290 - protein, 9 aa, Staphylococcus aureus
FSGKLARGI

SEQ ID NO: 1624291 - protein, 10 aa, Staphylococcus aureus
FSKGGKSDLS

SEQ ID NO: 1624292 - protein, 13 aa, Staphylococcus aureus
FSSDKFGSAPSGV

SEQ ID NO: 1624293 - protein, 20 aa, Staphylococcus aureus
FTDADEAKRNAYTNAVTQAE

SEQ ID NO: 1624294 - protein, 33 aa, Staphylococcus aureus; identical to SEQ ID NO: 1566179

SEQ ID NO: 1624295 - protein, 5 aa, Staphylococcus aureus
FVPNE

SEQ ID NO: 1624296 - protein, 5 aa, Staphylococcus aureus
GADRP

SEQ ID NO: 1624297 - protein, 5 aa, Staphylococcus aureus
GALEQ

SEQ ID NO: 1624298 - protein, 13 aa, Staphylococcus aureus
GAVTDDYYKEKSY

SEQ ID NO: 1624299 - protein, 7 aa, Staphylococcus aureus
GDVPSYP

SEQ ID NO: 1624300 - protein, 14 aa, Staphylococcus aureus
GEKDRLQKKVSHKN

SEQ ID NO: 1624301 - protein, 16 aa, Staphylococcus aureus
GEQEELEQKRDTYKKR

SEQ ID NO: 1624302 - protein, 9 aa, Staphylococcus aureus
GESGAGKST

SEQ ID NO: 1624303 - protein, 18 aa, Staphylococcus aureus
GEVDKAGNRISSFGKFST

SEQ ID NO: 1624304 - protein, 4 aa, Staphylococcus aureus
GFEN

SEQ ID NO: 1624305 - protein, 4 aa, Staphylococcus aureus
GGAK

SEQ ID NO: 1624306 - protein, 8 aa, Staphylococcus aureus
GGAPTQRN

SEQ ID NO: 1624307 - protein, 16 aa, Staphylococcus aureus
GGDPTATGMGGESIYG

SEQ ID NO: 1624308 - protein, 22 aa, Staphylococcus aureus
GGNYTNTSPDKQGAYTDAYNAA

SEQ ID NO: 1624309 - protein, 8 aa, Staphylococcus aureus
GGYLDGDR

SEQ ID NO: 1624310 - protein, 5 aa, Staphylococcus aureus
GHGYR

SEQ ID NO: 1624311 - protein, 7 aa, Staphylococcus aureus
GHSLGGR

SEQ ID NO: 1624312 - protein, 4 aa, Staphylococcus aureus
GIND

SEQ ID NO: 1624313 - protein, 10 aa, Staphylococcus aureus
GINTDGDALK

SEQ ID NO: 1624314 - protein, 11 aa, Staphylococcus aureus
GIQANAGTLNE

SEQ ID NO: 1624315 - protein, 4 aa, Staphylococcus aureus
GITR

SEQ ID NO: 1624316 - protein, 6 aa, Staphylococcus aureus
GKEHGT

SEQ ID NO: 1624317 - protein, 9 aa, Staphylococcus aureus
GKGIPDSSV

SEQ ID NO: 1624318 - protein, 4 aa, Staphylococcus aureus
GKKG

SEQ ID NO: 1624319 - protein, 5 aa, Staphylococcus aureus
GKQSA

SEQ ID NO: 1624320 - protein, 4 aa, Staphylococcus aureus
GKSL

SEQ ID NO: 1624321 - protein, 5 aa, Staphylococcus aureus
GLGRT

SEQ ID NO: 1624322 - protein, 7 aa, Staphylococcus aureus
GLKDAME

SEQ ID NO: 1624323 - protein, 35 aa, Staphylococcus aureus; identical to SEQ ID NO: 1565533

SEQ ID NO: 1624324 - protein, 7 aa, Staphylococcus aureus
GLNQQQQ

SEQ ID NO: 1624325 - protein, 4 aa, Staphylococcus aureus
GNDD

SEQ ID NO: 1624326 - protein, 7 aa, Staphylococcus aureus
GNEPDDI

SEQ ID NO: 1624327 - protein, 4 aa, Staphylococcus aureus
GNGF

SEQ ID NO: 1624328 - protein, 4 aa, Staphylococcus aureus
GNRM

SEQ ID NO: 1624329 - protein, 13 aa, Staphylococcus aureus
GNVTGDDSGKIGG

SEQ ID NO: 1624330 - protein, 12 aa, Staphylococcus aureus
GPQHRSWRKVSL

SEQ ID NO: 1624331 - protein, 21 aa, Staphylococcus aureus
GQDETQLREQMKDDAEQRVKT

SEQ ID NO: 1624332 - protein, 5 aa, Staphylococcus aureus
GRALA

SEQ ID NO: 1624333 - protein, 7 aa, Staphylococcus aureus
GRGGDQV

SEQ ID NO: 1624334 - protein, 13 aa, Staphylococcus aureus
GRLSKNGLRAKRQ

SEQ ID NO: 1624335 - protein, 7 aa, Staphylococcus aureus
GRSYKDI

SEQ ID NO: 1624336 - protein, 6 aa, Staphylococcus aureus
GSKEQL

SEQ ID NO: 1624337 - protein, 6 aa, Staphylococcus aureus
GSKGVR

SEQ ID NO: 1624338 - protein, 21 aa, Staphylococcus aureus
GSKTGSGANANRVTINKIVGW

SEQ ID NO: 1624339 - protein, 6 aa, Staphylococcus aureus
GSNTCD

SEQ ID NO: 1624340 - protein, 4 aa, Staphylococcus aureus
GSRH

SEQ ID NO: 1624341 - protein, 9 aa, Staphylococcus aureus
GTLKNNTDL

SEQ ID NO: 1624342 - protein, 12 aa, Staphylococcus aureus
GTPYKESDIEPY

SEQ ID NO: 1624343 - protein, 9 aa, Staphylococcus aureus
GVEHTATEL

SEQ ID NO: 1624344 - protein, 15 aa, Staphylococcus aureus
GVQDNSIGSTKESQF

SEQ ID NO: 1624345 - protein, 6 aa, Staphylococcus aureus
GVTGIK

SEQ ID NO: 1624346 - protein, 7 aa, Staphylococcus aureus
HARREMT

SEQ ID NO: 1624347 - protein, 35 aa, Staphylococcus aureus; identical to SEQ ID NO: 1566602

SEQ ID NO: 1624348 - protein, 5 aa, Staphylococcus aureus
HFANT

SEQ ID NO: 1624349 - protein, 12 aa, Staphylococcus aureus
HFGDVDKEKETL

SEQ ID NO: 1624350 - protein, 10 aa, Staphylococcus aureus
HKDDKEVKDY

SEQ ID NO: 1624351 - protein, 8 aa, Staphylococcus aureus
HNDDEQNV

SEQ ID NO: 1624352 - protein, 9 aa, Staphylococcus aureus
HPEAANKNS

SEQ ID NO: 1624353 - protein, 10 aa, Staphylococcus aureus
HPKAAEDRKN

SEQ ID NO: 1624354 - protein, 4 aa, Staphylococcus aureus
HQFP

SEQ ID NO: 1624355 - protein, 8 aa, Staphylococcus aureus
HQKNDIEK

SEQ ID NO: 1624356 - protein, 28 aa, Staphylococcus aureus
HREEKQQTSSGEMKTPYEMTNKEREEFK

SEQ ID NO: 1624357 - protein, 6 aa, Staphylococcus aureus
HRVTDT

SEQ ID NO: 1624358 - protein, 6 aa, Staphylococcus aureus
HSPSIT

SEQ ID NO: 1624359 - protein, 6 aa, Staphylococcus aureus
HTDDEV

SEQ ID NO: 1624360 - protein, 12 aa, Staphylococcus aureus
HTHGDGKSLKGS

SEQ ID NO: 1624361 - protein, 20 aa, Staphylococcus aureus
HVETKDIDGNTSFENEQTSY

SEQ ID NO: 1624362 - protein, 34 aa, Staphylococcus aureus; identical to SEQ ID NO: 1566834

SEQ ID NO: 1624363 - protein, 24 aa, Staphylococcus aureus
IANKDQTKASENYIDADPTNKTAF

SEQ ID NO: 1624364 - protein, 8 aa, Staphylococcus aureus
IAQYKKGG

SEQ ID NO: 1624365 - protein, 8 aa, Staphylococcus aureus
IDDNVANS

SEQ ID NO: 1624366 - protein, 23 aa, Staphylococcus aureus
IDESKSGMVPRSRLNDKNTEIEE

SEQ ID NO: 1624367 - protein, 9 aa, Staphylococcus aureus
IEGQKTGSF

SEQ ID NO: 1624368 - protein, 18 aa, Staphylococcus aureus
IENANDNNLDNEKIRGQI

SEQ ID NO: 1624369 - protein, 5 aa, Staphylococcus aureus
IESAV

SEQ ID NO: 1624370 - protein, 10 aa, Staphylococcus aureus
IETTSSTLEK

SEQ ID NO: 1624371 - protein, 7 aa, Staphylococcus aureus
IKDAESK

SEQ ID NO: 1624372 - protein, 4 aa, Staphylococcus aureus
IKEQ

SEQ ID NO: 1624373 - protein, 6 aa, Staphylococcus aureus
IKGNAS

SEQ ID NO: 1624374 - protein, 8 aa, Staphylococcus aureus
IKKNSSQN

SEQ ID NO: 1624375 - protein, 8 aa, Staphylococcus aureus
INDTATGT

SEQ ID NO: 1624376 - protein, 47 aa, Staphylococcus aureus; identical to SEQ ID NO: 1566614

SEQ ID NO: 1624377 - protein, 24 aa, Staphylococcus aureus
IPKKAQTRNEFQAKRNNYLEDSEV

SEQ ID NO: 1624378 - protein, 14 aa, Staphylococcus aureus
IQGEGGVNIPPKGY

SEQ ID NO: 1624379 - protein, 10 aa, Staphylococcus aureus
IREPGSYARV

SEQ ID NO: 1624380 - protein, 5 aa, Staphylococcus aureus
IRPGE

SEQ ID NO: 1624381 - protein, 28 aa, Staphylococcus aureus
ISSSISTDNASWRGPNTEAGEKSAYNSV

SEQ ID NO: 1624382 - protein, 9 aa, Staphylococcus aureus
ISYTNNATF

SEQ ID NO: 1624383 - protein, 8 aa, Staphylococcus aureus
ITDSNGKM

SEQ ID NO: 1624384 - protein, 6 aa, Staphylococcus aureus
ITKNKV

SEQ ID NO: 1624385 - protein, 12 aa, Staphylococcus aureus
ITNYSEKGMREI

SEQ ID NO: 1624386 - protein, 10 aa, Staphylococcus aureus
IVDKSGAWYS

SEQ ID NO: 1624387 - protein, 12 aa, Staphylococcus aureus
IVTEEKDDNHGS

SEQ ID NO: 1624388 - protein, 8 aa, Staphylococcus aureus
KADTELNT

SEQ ID NO: 1624389 - protein, 6 aa, Staphylococcus aureus
KAEQYK

SEQ ID NO: 1624390 - protein, 5 aa, Staphylococcus aureus
KAGTE

SEQ ID NO: 1624391 - protein, 8 aa, Staphylococcus aureus
KAITSQSD

SEQ ID NO: 1624392 - protein, 15 aa, Staphylococcus aureus
KAKKQGLEDLESADQ

SEQ ID NO: 1624393 - protein, 10 aa, Staphylococcus aureus
KAPNTSSTIV

SEQ ID NO: 1624394 - protein, 6 aa, Staphylococcus aureus
KARYAD

SEQ ID NO: 1624395 - protein, 13 aa, Staphylococcus aureus
KATFDNYNPTNEQ

SEQ ID NO: 1624396 - protein, 4 aa, Staphylococcus aureus
KATM

SEQ ID NO: 1624397 - protein, 13 aa, Staphylococcus aureus
KDIEVGGGIRTKS

SEQ ID NO: 1624398 - protein, 11 aa, Staphylococcus aureus
KDKKSLTGQYL

SEQ ID NO: 1624399 - protein, 4 aa, Staphylococcus aureus
KDSG

SEQ ID NO: 1624400 - protein, 6 aa, Staphylococcus aureus
KDVPAS

SEQ ID NO: 1624401 - protein, 11 aa, Staphylococcus aureus
KEERYSRNPKL

SEQ ID NO: 1624402 - protein, 15 aa, Staphylococcus aureus
KEISEPVPKKSELRP

SEQ ID NO: 1624403 - protein, 7 aa, Staphylococcus aureus
KEKWSEE

SEQ ID NO: 1624404 - protein, 9 aa, Staphylococcus aureus
KELQKRNET

SEQ ID NO: 1624405 - protein, 6 aa, Staphylococcus aureus
KENIKQ

SEQ ID NO: 1624406 - protein, 8 aa, Staphylococcus aureus
KESGTTLK

SEQ ID NO: 1624407 - protein, 15 aa, Staphylococcus aureus
KETMNAISADPKGVP

SEQ ID NO: 1624408 - protein, 8 aa, Staphylococcus aureus
KEVSPEEL

SEQ ID NO: 1624409 - protein, 17 aa, Staphylococcus aureus
KFANPSITDVVEAIRNG

SEQ ID NO: 1624410 - protein, 8 aa, Staphylococcus aureus
KHTPKNKE

SEQ ID NO: 1624411 - protein, 28 aa, Staphylococcus aureus
KIEEQIPTSALHKSDNAYTRELIEKQLS

SEQ ID NO: 1624412 - protein, 11 aa, Staphylococcus aureus
KIEETDQLPNF

SEQ ID NO: 1624413 - protein, 14 aa, Staphylococcus aureus
KIGSGKTTFATRDK

SEQ ID NO: 1624414 - protein, 13 aa, Staphylococcus aureus
KITSNSEETSAIS

SEQ ID NO: 1624415 - protein, 8 aa, Staphylococcus aureus
KKEDLEPW

SEQ ID NO: 1624416 - protein, 24 aa, Staphylococcus aureus
KKEETHESRKVEKELPNTGSEGMD

SEQ ID NO: 1624417 - protein, 4 aa, Staphylococcus aureus
KKEI

SEQ ID NO: 1624418 - protein, 20 aa, Staphylococcus aureus
KKFSDKGSRIYRMEAKFHSQ

SEQ ID NO: 1624419 - protein, 5 aa, Staphylococcus aureus
KKFSR

SEQ ID NO: 1624420 - protein, 6 aa, Staphylococcus aureus
KKGDYS

SEQ ID NO: 1624421 - protein, 10 aa, Staphylococcus aureus
KKGGKGGVDL

SEQ ID NO: 1624422 - protein, 18 aa, Staphylococcus aureus
KKKEVGLTQEEAKEQTAL

SEQ ID NO: 1624423 - protein, 14 aa, Staphylococcus aureus
KKNNGSWNFNPQSA

SEQ ID NO: 1624424 - protein, 29 aa, Staphylococcus aureus
KKNNVEVTTSKELLSSATVDQLKDYDGVT

SEQ ID NO: 1624425 - protein, 13 aa, Staphylococcus aureus
KKQERKDNADAEV

SEQ ID NO: 1624426 - protein, 20 aa, Staphylococcus aureus
KKQKNLPSATSAKGGFALVL

SEQ ID NO: 1624427 - protein, 8 aa, Staphylococcus aureus
KKRDGKHH

SEQ ID NO: 1624428 - protein, 10 aa, Staphylococcus aureus
KKSFNTSHDT

SEQ ID NO: 1624429 - protein, 9 aa, Staphylococcus aureus
KKSGETKSV

SEQ ID NO: 1624430 - protein, 15 aa, Staphylococcus aureus
KLERKRKKEAELRRK

SEQ ID NO: 1624431 - protein, 18 aa, Staphylococcus aureus
KMKAEKSKQQDNNESAVD

SEQ ID NO: 1624432 - protein, 4 aa, Staphylococcus aureus
KNDE

SEQ ID NO: 1624433 - protein, 6 aa, Staphylococcus aureus
KNDYRF

SEQ ID NO: 1624434 - protein, 10 aa, Staphylococcus aureus
KNEISNHSNQ

SEQ ID NO: 1624435 - protein, 6 aa, Staphylococcus aureus
KNGKAE

SEQ ID NO: 1624436 - protein, 16 aa, Staphylococcus aureus
KNGNISSTDNVPSYDA

SEQ ID NO: 1624437 - protein, 11 aa, Staphylococcus aureus
KNKSKKPTFND

SEQ ID NO: 1624438 - protein, 18 aa, Staphylococcus aureus
KNNPQKTNPFLKLHENKK

SEQ ID NO: 1624439 - protein, 15 aa, Staphylococcus aureus
KNNVPYKKEAGNYTV

SEQ ID NO: 1624440 - protein, 10 aa, Staphylococcus aureus
KNQGGDKTVI

SEQ ID NO: 1624441 - protein, 14 aa, Staphylococcus aureus
KNTKNKNACNIDEG

SEQ ID NO: 1624442 - protein, 17 aa, Staphylococcus aureus
KNYKPQNEKQVQAKQTA

SEQ ID NO: 1624443 - protein, 7 aa, Staphylococcus aureus
KPAITKS

SEQ ID NO: 1624444 - protein, 6 aa, Staphylococcus aureus
KPIQTI

SEQ ID NO: 1624445 - protein, 6 aa, Staphylococcus aureus
KPKKLK

SEQ ID NO: 1624446 - protein, 37 aa, Staphylococcus aureus; identical to SEQ ID NO: 1566209

SEQ ID NO: 1624447 - protein, 13 aa, Staphylococcus aureus
KQPLPSPKIYDND

SEQ ID NO: 1624448 - protein, 7 aa, Staphylococcus aureus
KQTATSL

SEQ ID NO: 1624449 - protein, 7 aa, Staphylococcus aureus
KQYGENS

SEQ ID NO: 1624450 - protein, 13 aa, Staphylococcus aureus
KRELAYTRYTWPK

SEQ ID NO: 1624451 - protein, 16 aa, Staphylococcus aureus
KRSQSIQTDFAHRVFL

SEQ ID NO: 1624452 - protein, 6 aa, Staphylococcus aureus
KSDVDE

SEQ ID NO: 1624453 - protein, 4 aa, Staphylococcus aureus
KSEI

SEQ ID NO: 1624454 - protein, 11 aa, Staphylococcus aureus
KSIGRKAQEAY

SEQ ID NO: 1624455 - protein, 5 aa, Staphylococcus aureus
KSKNI

SEQ ID NO: 1624456 - protein, 6 aa, Staphylococcus aureus
KSLYSK

SEQ ID NO: 1624457 - protein, 20 aa, Staphylococcus aureus
KSQLRRSATTQALKKTTTNA

SEQ ID NO: 1624458 - protein, 6 aa, Staphylococcus aureus
KSREKF

SEQ ID NO: 1624459 - protein, 20 aa, Staphylococcus aureus
KSSDTSEKPKEDSKETQIKK

SEQ ID NO: 1624460 - protein, 9 aa, Staphylococcus aureus
KSSTIYSAT

SEQ ID NO: 1624461 - protein, 5 aa, Staphylococcus aureus
KSTIE

SEQ ID NO: 1624462 - protein, 10 aa, Staphylococcus aureus
KTEKKPTKNV

SEQ ID NO: 1624463 - protein, 4 aa, Staphylococcus aureus
KTGE

SEQ ID NO: 1624464 - protein, 16 aa, Staphylococcus aureus
KTGKHFKHNTAKSKDF

SEQ ID NO: 1624465 - protein, 19 aa, Staphylococcus aureus
KTHAKSTLSKLKKKGKIEM

SEQ ID NO: 1624466 - protein, 6 aa, Staphylococcus aureus
KTKKKA

SEQ ID NO: 1624467 - protein, 17 aa, Staphylococcus aureus
KTLYATPDYELIQKMKQ

SEQ ID NO: 1624468 - protein, 7 aa, Staphylococcus aureus
KTTENKL

SEQ ID NO: 1624469 - protein, 9 aa, Staphylococcus aureus
KVEASANRY

SEQ ID NO: 1624470 - protein, 16 aa, Staphylococcus aureus
KVEKAVDENYKEYRAT

SEQ ID NO: 1624471 - protein, 21 aa, Staphylococcus aureus
KVKPDGNKEYIKKDENRRKTD

SEQ ID NO: 1624472 - protein, 19 aa, Staphylococcus aureus
KVRATKAKDDNNASAIAND

SEQ ID NO: 1624473 - protein, 23 aa, Staphylococcus aureus
KVTQAKNDLNGNTNLATTKQNVQ

SEQ ID NO: 1624474 - protein, 13 aa, Staphylococcus aureus
LAGSEAAYQLSER

SEQ ID NO: 1624475 - protein, 22 aa, Staphylococcus aureus
LAIEPAATMAEGAQKIVKLVKE

SEQ ID NO: 1624476 - protein, 11 aa, Staphylococcus aureus
LAPGGQKTHDD

SEQ ID NO: 1624477 - protein, 20 aa, Staphylococcus aureus
LATKARNKQLTTEDMQGGTF

SEQ ID NO: 1624478 - protein, 12 aa, Staphylococcus aureus
LDKLGNELKKIM

SEQ ID NO: 1624479 - protein, 9 aa, Staphylococcus aureus
LEAGTQYRG

SEQ ID NO: 1624480 - protein, 12 aa, Staphylococcus aureus
LGKSAPKREDIE

SEQ ID NO: 1624481 - protein, 11 aa, Staphylococcus aureus
LIEDEKRLTQS

SEQ ID NO: 1624482 - protein, 4 aa, Staphylococcus aureus
LKAG

SEQ ID NO: 1624483 - protein, 6 aa, Staphylococcus aureus
LKPSGW

SEQ ID NO: 1624484 - protein, 5 aa, Staphylococcus aureus
LLSED

SEQ ID NO: 1624485 - protein, 7 aa, Staphylococcus aureus
LNPERSN

SEQ ID NO: 1624486 - protein, 14 aa, Staphylococcus aureus
LQTNGGALSSSQQK

SEQ ID NO: 1624487 - protein, 13 aa, Staphylococcus aureus
LREGKNIKKMDII

SEQ ID NO: 1624488 - protein, 4 aa, Staphylococcus aureus
LREK

SEQ ID NO: 1624489 - protein, 5 aa, Staphylococcus aureus
LSQSG

SEQ ID NO: 1624490 - protein, 9 aa, Staphylococcus aureus
LSSKNKKHY

SEQ ID NO: 1624491 - protein, 6 aa, Staphylococcus aureus
LTENYE

SEQ ID NO: 1624492 - protein, 6 aa, Staphylococcus aureus
LTKETH

SEQ ID NO: 1624493 - protein, 6 aa, Staphylococcus aureus
LTSPVA

SEQ ID NO: 1624494 - protein, 6 aa, Staphylococcus aureus
MNAKAE

SEQ ID NO: 1624495 - protein, 5 aa, Staphylococcus aureus
MQYES

SEQ ID NO: 1624496 - protein, 5 aa, Staphylococcus aureus
MQYSQ

SEQ ID NO: 1624497 - protein, 30 aa, Staphylococcus aureus
MTAHSSDDDDQYRTKEERETLKKADCNEKF

SEQ ID NO: 1624498 - protein, 14 aa, Staphylococcus aureus
NADDYDRLINLVMK

SEQ ID NO: 1624499 - protein, 13 aa, Staphylococcus aureus
NADEPVKLNDDTL

SEQ ID NO: 1624500 - protein, 17 aa, Staphylococcus aureus
NADTDKQTAYTTAVNEA

SEQ ID NO: 1624501 - protein, 15 aa, Staphylococcus aureus
NAESINSTYEHQTTY

SEQ ID NO: 1624502 - protein, 9 aa, Staphylococcus aureus
NATQPHLNN

SEQ ID NO: 1624503 - protein, 20 aa, Staphylococcus aureus
NATQVTGVQSVKDNATNLDN

SEQ ID NO: 1624504 - protein, 6 aa, Staphylococcus aureus
NDGVPR

SEQ ID NO: 1624505 - protein, 4 aa, Staphylococcus aureus
NDSA

SEQ ID NO: 1624506 - protein, 4 aa, Staphylococcus aureus
NEET

SEQ ID NO: 1624507 - protein, 8 aa, Staphylococcus aureus
NEGKQYKH

SEQ ID NO: 1624508 - protein, 31 aa, Staphylococcus aureus; identical to SEQ ID NO: 1566071

SEQ ID NO: 1624509 - protein, 10 aa, Staphylococcus aureus
NEKLNEDSTL

SEQ ID NO: 1624510 - protein, 8 aa, Staphylococcus aureus
NENDRSRQ

SEQ ID NO: 1624511 - protein, 12 aa, Staphylococcus aureus
NEQSKLHSSANL

SEQ ID NO: 1624512 - protein, 7 aa, Staphylococcus aureus
NETEKEA

SEQ ID NO: 1624513 - protein, 5 aa, Staphylococcus aureus
NETKV

SEQ ID NO: 1624514 - protein, 12 aa, Staphylococcus aureus
NGAFTGETSPVA

SEQ ID NO: 1624515 - protein, 22 aa, Staphylococcus aureus
NGDGINEVKDARIDNTGYGHKT

SEQ ID NO: 1624516 - protein, 20 aa, Staphylococcus aureus
NGKKAAISAGYSKKTAESLA

SEQ ID NO: 1624517 - protein, 15 aa, Staphylococcus aureus
NGVQDNSIGSTNESQ

SEQ ID NO: 1624518 - protein, 4 aa, Staphylococcus aureus
NHKT

SEQ ID NO: 1624519 - protein, 9 aa, Staphylococcus aureus
NIAEKNKRK

SEQ ID NO: 1624520 - protein, 4 aa, Staphylococcus aureus
NIDI

SEQ ID NO: 1624521 - protein, 19 aa, Staphylococcus aureus
NKATSNQDVSQVQTAGNHA

SEQ ID NO: 1624522 - protein, 9 aa, Staphylococcus aureus
NKDVTDDYK

SEQ ID NO: 1624523 - protein, 5 aa, Staphylococcus aureus
NKLTR

SEQ ID NO: 1624524 - protein, 5 aa, Staphylococcus aureus
NKPEY

SEQ ID NO: 1624525 - protein, 15 aa, Staphylococcus aureus
NKSTGTNVSKDQVEA

SEQ ID NO: 1624526 - protein, 15 aa, Staphylococcus aureus
NKTSGGNTPKADVER

SEQ ID NO: 1624527 - protein, 6 aa, Staphylococcus aureus
NKVPGV

SEQ ID NO: 1624528 - protein, 13 aa, Staphylococcus aureus
NLERRTKNKYRDK

SEQ ID NO: 1624529 - protein, 33 aa, Staphylococcus aureus; identical to SEQ ID NO: 1566079

SEQ ID NO: 1624530 - protein, 6 aa, Staphylococcus aureus
NLPNEH

SEQ ID NO: 1624531 - protein, 16 aa, Staphylococcus aureus
NLTGGFGSEGASTLTQ

SEQ ID NO: 1624532 - protein, 9 aa, Staphylococcus aureus
NNADTVSDV

SEQ ID NO: 1624533 - protein, 33 aa, Staphylococcus aureus; identical to SEQ ID NO: 1566666

SEQ ID NO: 1624534 - protein, 7 aa, Staphylococcus aureus
NNGQGHA

SEQ ID NO: 1624535 - protein, 14 aa, Staphylococcus aureus
NNQIEKQESRHETT

SEQ ID NO: 1624536 - protein, 5 aa, Staphylococcus aureus
NNTNW

SEQ ID NO: 1624537 - protein, 5 aa, Staphylococcus aureus
NPAPL

SEQ ID NO: 1624538 - protein, 15 aa, Staphylococcus aureus
NPGSISQSRSSMEES

SEQ ID NO: 1624539 - protein, 7 aa, Staphylococcus aureus
NPNTKKV

SEQ ID NO: 1624540 - protein, 14 aa, Staphylococcus aureus
NQDKRIGPDPKKFE

SEQ ID NO: 1624541 - protein, 5 aa, Staphylococcus aureus
NQTSH

SEQ ID NO: 1624542 - protein, 13 aa, Staphylococcus aureus
NQVNTTKAALNGV

SEQ ID NO: 1624543 - protein, 15 aa, Staphylococcus aureus
NRNQATDPHPTGSSL

SEQ ID NO: 1624544 - protein, 9 aa, Staphylococcus aureus
NSEDSYLRS

SEQ ID NO: 1624545 - protein, 33 aa, Staphylococcus aureus; identical to SEQ ID NO: 1565300

SEQ ID NO: 1624546 - protein, 10 aa, Staphylococcus aureus
NSKYKAPLGK

SEQ ID NO: 1624547 - protein, 4 aa, Staphylococcus aureus
NSND

SEQ ID NO: 1624548 - protein, 17 aa, Staphylococcus aureus
NSTPGMKTRYEHEETIN

SEQ ID NO: 1624549 - protein, 8 aa, Staphylococcus aureus
NTKTTKGY

SEQ ID NO: 1624550 - protein, 9 aa, Staphylococcus aureus
NTQQTKDIS

SEQ ID NO: 1624551 - protein, 9 aa, Staphylococcus aureus
NTSSGDVYY

SEQ ID NO: 1624552 - protein, 12 aa, Staphylococcus aureus
NTYNNQTAMTEQ

SEQ ID NO: 1624553 - protein, 28 aa, Staphylococcus aureus
NVQRAKNDLNGNQNVANAKTTAKNALNN

SEQ ID NO: 1624554 - protein, 8 aa, Staphylococcus aureus
NWGPYDRD

SEQ ID NO: 1624555 - protein, 21 aa, Staphylococcus aureus
NYEKANENGSTLKGGDEDESG

SEQ ID NO: 1624556 - protein, 10 aa, Staphylococcus aureus
NYSEESNAKV

SEQ ID NO: 1624557 - protein, 8 aa, Staphylococcus aureus
PAIEPSNG

SEQ ID NO: 1624558 - protein, 15 aa, Staphylococcus aureus
PDSFSDGGKFNNVES

SEQ ID NO: 1624559 - protein, 20 aa, Staphylococcus aureus
PEHDEKHRENKSKMKKSEKQ

SEQ ID NO: 1624560 - protein, 5 aa, Staphylococcus aureus
PEKNR

SEQ ID NO: 1624561 - protein, 7 aa, Staphylococcus aureus
PFNNESP

SEQ ID NO: 1624562 - protein, 26 aa, Staphylococcus aureus
PGIRPKGASQNDQHRITTPEEARQLG

SEQ ID NO: 1624563 - protein, 14 aa, Staphylococcus aureus
PIQASTDVKTNARA

SEQ ID NO: 1624564 - protein, 6 aa, Staphylococcus aureus
PKGIDP

SEQ ID NO: 1624565 - protein, 20 aa, Staphylococcus aureus
PKKPSKKRKTKYFGGKVKSG

SEQ ID NO: 1624566 - protein, 7 aa, Staphylococcus aureus
PLNNQPA

SEQ ID NO: 1624567 - protein, 5 aa, Staphylococcus aureus
PLPLG

SEQ ID NO: 1624568 - protein, 7 aa, Staphylococcus aureus
PLTNEDK

SEQ ID NO: 1624569 - protein, 14 aa, Staphylococcus aureus
PNGTMGQRWEEGKK

SEQ ID NO: 1624570 - protein, 12 aa, Staphylococcus aureus
PNLGVPSEQDIN

SEQ ID NO: 1624571 - protein, 16 aa, Staphylococcus aureus
PNLNQTQKTALKDQVS

SEQ ID NO: 1624572 - protein, 12 aa, Staphylococcus aureus
PNVDVSEENPDE

SEQ ID NO: 1624573 - protein, 5 aa, Staphylococcus aureus
PPMGP

SEQ ID NO: 1624574 - protein, 4 aa, Staphylococcus aureus
PPNF

SEQ ID NO: 1624575 - protein, 6 aa, Staphylococcus aureus
PPNVTG

SEQ ID NO: 1624576 - protein, 7 aa, Staphylococcus aureus
PQKSTYK

SEQ ID NO: 1624577 - protein, 5 aa, Staphylococcus aureus
PQVPN

SEQ ID NO: 1624578 - protein, 6 aa, Staphylococcus aureus
PSFARN

SEQ ID NO: 1624579 - protein, 14 aa, Staphylococcus aureus
PSIKASEGIADKST

SEQ ID NO: 1624580 - protein, 6 aa, Staphylococcus aureus
PSKASS

SEQ ID NO: 1624581 - protein, 6 aa, Staphylococcus aureus
PSPQPI

SEQ ID NO: 1624582 - protein, 5 aa, Staphylococcus aureus
PTSYT

SEQ ID NO: 1624583 - protein, 7 aa, Staphylococcus aureus
PVSTPAD

SEQ ID NO: 1624584 - protein, 64 aa, Staphylococcus aureus
QAERYVGDSSLNDDSDLTDNSTDASQLHTNGIENETVSNDENKQASIQNEDTNDTHVDESPYNY

SEQ ID NO: 1624585 - protein, 7 aa, Staphylococcus aureus
QAKERRS

SEQ ID NO: 1624586 - protein, 17 aa, Staphylococcus aureus
QAPSLAKEDEKEGAKAG

SEQ ID NO: 1624587 - protein, 26 aa, Staphylococcus aureus
QAVTTAKDNLHGDQKLARDQQQAVTT

SEQ ID NO: 1624588 - protein, 4 aa, Staphylococcus aureus
QDLT

SEQ ID NO: 1624589 - protein, 7 aa, Staphylococcus aureus
QDNGHEY

SEQ ID NO: 1624590 - protein, 4 aa, Staphylococcus aureus
QDVP

SEQ ID NO: 1624591 - protein, 5 aa, Staphylococcus aureus
QEQME

SEQ ID NO: 1624592 - protein, 6 aa, Staphylococcus aureus
QEYSKD

SEQ ID NO: 1624593 - protein, 4 aa, Staphylococcus aureus
QGET

SEQ ID NO: 1624594 - protein, 16 aa, Staphylococcus aureus
QGGGQEYGVRSGTVNL

SEQ ID NO: 1624595 - protein, 7 aa, Staphylococcus aureus
QIDAQEA

SEQ ID NO: 1624596 - protein, 8 aa, Staphylococcus aureus
QIKTNLKS

SEQ ID NO: 1624597 - protein, 4 aa, Staphylococcus aureus
QKNG

SEQ ID NO: 1624598 - protein, 10 aa, Staphylococcus aureus
QLHTNQGSNH

SEQ ID NO: 1624599 - protein, 24 aa, Staphylococcus aureus
QLPNLDDGGADGAQQQERSNNKES

SEQ ID NO: 1624600 - protein, 4 aa, Staphylococcus aureus
QNGI

SEQ ID NO: 1624601 - protein, 35 aa, Staphylococcus aureus; identical to SEQ ID NO: 1566682

SEQ ID NO: 1624602 - protein, 183 aa, Staphylococcus aureus
QNQLTTKIDSNSESLKAIQTSQEAIQEAQASQAKVLAESSNKVENNTATDEKAESKDSKVAGVNTSTDAKTDTKAENAGDGTATKVDKEDQISATEAIEKASVEQSKNDKAAETSNKEATVDAEAQHDAEQQVAEAHAEASKQATSNDSLEAKAENDSTASQSEMSEPKPQEEKKGFFARLFN

SEQ ID NO: 1624603 - protein, 7 aa, Staphylococcus aureus
QPTEQRL

SEQ ID NO: 1624604 - protein, 8 aa, Staphylococcus aureus
QPTYIKTD

SEQ ID NO: 1624605 - protein, 5 aa, Staphylococcus aureus
QQDLQ

SEQ ID NO: 1624606 - protein, 17 aa, Staphylococcus aureus
QRIQEASIADPANAHLK

SEQ ID NO: 1624607 - protein, 4 aa, Staphylococcus aureus
QSFN

SEQ ID NO: 1624608 - protein, 20 aa, Staphylococcus aureus
QSKFNDSYVKENTVKGRPKI

SEQ ID NO: 1624609 - protein, 12 aa, Staphylococcus aureus
QVSATASELNTA

SEQ ID NO: 1624610 - protein, 8 aa, Staphylococcus aureus
QYSSAGSF

SEQ ID NO: 1624611 - protein, 17 aa, Staphylococcus aureus
RDDTMDDIINQGDIVFY

SEQ ID NO: 1624612 - protein, 5 aa, Staphylococcus aureus
RDNQT

SEQ ID NO: 1624613 - protein, 32 aa, Staphylococcus aureus; identical to SEQ ID NO: 1566928

SEQ ID NO: 1624614 - protein, 7 aa, Staphylococcus aureus
RENEQSY

SEQ ID NO: 1624615 - protein, 6 aa, Staphylococcus aureus
RENGQE

SEQ ID NO: 1624616 - protein, 10 aa, Staphylococcus aureus
RGDLPSSFPK

SEQ ID NO: 1624617 - protein, 5 aa, Staphylococcus aureus
RGESF

SEQ ID NO: 1624618 - protein, 7 aa, Staphylococcus aureus
RGNKQMK

SEQ ID NO: 1624619 - protein, 8 aa, Staphylococcus aureus
RGSGTRVY

SEQ ID NO: 1624620 - protein, 6 aa, Staphylococcus aureus
RGYQSP

SEQ ID NO: 1624621 - protein, 9 aa, Staphylococcus aureus
RKATKQQTN

SEQ ID NO: 1624622 - protein, 59 aa, Staphylococcus aureus
RKEQNDTTDKDKTSNENNDSTNNSDSSNQQQPATDQNLNQNQGGTQQAPQASNNQNGVV

SEQ ID NO: 1624623 - protein, 6 aa, Staphylococcus aureus
RKERAR

SEQ ID NO: 1624624 - protein, 9 aa, Staphylococcus aureus
RKGYNLDDD

SEQ ID NO: 1624625 - protein, 6 aa, Staphylococcus aureus
RKIKTD

SEQ ID NO: 1624626 - protein, 8 aa, Staphylococcus aureus
RKQTSGNF

SEQ ID NO: 1624627 - protein, 4 aa, Staphylococcus aureus
RKSR

SEQ ID NO: 1624628 - protein, 5 aa, Staphylococcus aureus
RNDRY

SEQ ID NO: 1624629 - protein, 8 aa, Staphylococcus aureus
RPSVGKTG

SEQ ID NO: 1624630 - protein, 4 aa, Staphylococcus aureus
RQQE

SEQ ID NO: 1624631 - protein, 9 aa, Staphylococcus aureus
RTGSRTFDA

SEQ ID NO: 1624632 - protein, 11 aa, Staphylococcus aureus
RTKEISEKNKK

SEQ ID NO: 1624633 - protein, 6 aa, Staphylococcus aureus
RTLKTD

SEQ ID NO: 1624634 - protein, 5 aa, Staphylococcus aureus
RVPND

SEQ ID NO: 1624635 - protein, 8 aa, Staphylococcus aureus
RVSEKEKI

SEQ ID NO: 1624636 - protein, 8 aa, Staphylococcus aureus
RYDGGNQL

SEQ ID NO: 1624637 - protein, 8 aa, Staphylococcus aureus
SAHRTPKT

SEQ ID NO: 1624638 - protein, 6 aa, Staphylococcus aureus
SAREHL

SEQ ID NO: 1624639 - protein, 7 aa, Staphylococcus aureus
SAVESAL

SEQ ID NO: 1624640 - protein, 11 aa, Staphylococcus aureus
SAYNGNDTEGL

SEQ ID NO: 1624641 - protein, 9 aa, Staphylococcus aureus
SDAQKQSIT

SEQ ID NO: 1624642 - protein, 14 aa, Staphylococcus aureus
SDESSNVPSVESHQ

SEQ ID NO: 1624643 - protein, 11 aa, Staphylococcus aureus
SDIDDVSSIDT

SEQ ID NO: 1624644 - protein, 24 aa, Staphylococcus aureus
SDLENKAQAYSRTFDEQKRYMDEK

SEQ ID NO: 1624645 - protein, 12 aa, Staphylococcus aureus
SDLKNDSDQYAQ

SEQ ID NO: 1624646 - protein, 5 aa, Staphylococcus aureus
SDSDP

SEQ ID NO: 1624647 - protein, 7 aa, Staphylococcus aureus
SDTYDNN

SEQ ID NO: 1624648 - protein, 7 aa, Staphylococcus aureus
SEARERG

SEQ ID NO: 1624649 - protein, 7 aa, Staphylococcus aureus
SEENNRI

SEQ ID NO: 1624650 - protein, 8 aa, Staphylococcus aureus
SEKTNSTI

SEQ ID NO: 1624651 - protein, 11 aa, Staphylococcus aureus
SELTKTAGADF

SEQ ID NO: 1624652 - protein, 5 aa, Staphylococcus aureus
SEVDQ

SEQ ID NO: 1624653 - protein, 16 aa, Staphylococcus aureus
SEVTQAQNNADALNTA

SEQ ID NO: 1624654 - protein, 6 aa, Staphylococcus aureus
SGEKNH

SEQ ID NO: 1624655 - protein, 6 aa, Staphylococcus aureus
SGGRDF

SEQ ID NO: 1624656 - protein, 5 aa, Staphylococcus aureus
SGKGH

SEQ ID NO: 1624657 - protein, 9 aa, Staphylococcus aureus
SGKKEDDIR

SEQ ID NO: 1624658 - protein, 11 aa, Staphylococcus aureus
SGRAPKEKQSI

SEQ ID NO: 1624659 - protein, 15 aa, Staphylococcus aureus
SGTTGLPKAYYRDED

SEQ ID NO: 1624660 - protein, 4 aa, Staphylococcus aureus
SHYD

SEQ ID NO: 1624661 - protein, 10 aa, Staphylococcus aureus
SIAENEGVND

SEQ ID NO: 1624662 - protein, 34 aa, Staphylococcus aureus; identical to SEQ ID NO: 1566942

SEQ ID NO: 1624663 - protein, 22 aa, Staphylococcus aureus
SINNAQKEALKSQIDSATTVAG

SEQ ID NO: 1624664 - protein, 13 aa, Staphylococcus aureus
SISKGQKLTEKDK

SEQ ID NO: 1624665 - protein, 8 aa, Staphylococcus aureus
SKENLNYD

SEQ ID NO: 1624666 - protein, 6 aa, Staphylococcus aureus
SKNADN

SEQ ID NO: 1624667 - protein, 11 aa, Staphylococcus aureus
SKNKGQSYGGS

SEQ ID NO: 1624668 - protein, 7 aa, Staphylococcus aureus
SKRENSH

SEQ ID NO: 1624669 - protein, 6 aa, Staphylococcus aureus
SKSWDG

SEQ ID NO: 1624670 - protein, 7 aa, Staphylococcus aureus
SKYGPDI

SEQ ID NO: 1624671 - protein, 10 aa, Staphylococcus aureus
SLAGISGKKI

SEQ ID NO: 1624672 - protein, 4 aa, Staphylococcus aureus
SLGS

SEQ ID NO: 1624673 - protein, 5 aa, Staphylococcus aureus
SNEVE

SEQ ID NO: 1624674 - protein, 12 aa, Staphylococcus aureus
SNQAEKEFGGDS

SEQ ID NO: 1624675 - protein, 10 aa, Staphylococcus aureus
SNTPGNTTQV

SEQ ID NO: 1624676 - protein, 4 aa, Staphylococcus aureus
SPIP

SEQ ID NO: 1624677 - protein, 15 aa, Staphylococcus aureus
SPRQIASQIEKDTGY

SEQ ID NO: 1624678 - protein, 13 aa, Staphylococcus aureus
SQIRKMYNQFHPR

SEQ ID NO: 1624679 - protein, 7 aa, Staphylococcus aureus
SQLREAG

SEQ ID NO: 1624680 - protein, 6 aa, Staphylococcus aureus
SRESLN

SEQ ID NO: 1624681 - protein, 9 aa, Staphylococcus aureus
SRGEHTKHP

SEQ ID NO: 1624682 - protein, 32 aa, Staphylococcus aureus; identical to SEQ ID NO: 1562055

SEQ ID NO: 1624683 - protein, 10 aa, Staphylococcus aureus
SSPTRAMGNE

SEQ ID NO: 1624684 - protein, 9 aa, Staphylococcus aureus
SSSAKGKIK

SEQ ID NO: 1624685 - protein, 5 aa, Staphylococcus aureus
SSSDA

SEQ ID NO: 1624686 - protein, 8 aa, Staphylococcus aureus
SSTYKQAQ

SEQ ID NO: 1624687 - protein, 11 aa, Staphylococcus aureus
STDLESDNDLE

SEQ ID NO: 1624688 - protein, 6 aa, Staphylococcus aureus
STIGNK

SEQ ID NO: 1624689 - protein, 10 aa, Staphylococcus aureus
STNKAKDLWP

SEQ ID NO: 1624690 - protein, 6 aa, Staphylococcus aureus
STPTGM

SEQ ID NO: 1624691 - protein, 4 aa, Staphylococcus aureus
STSD

SEQ ID NO: 1624692 - protein, 9 aa, Staphylococcus aureus
STSGTFSDR

SEQ ID NO: 1624693 - protein, 12 aa, Staphylococcus aureus
SVESLTENERRL

SEQ ID NO: 1624694 - protein, 15 aa, Staphylococcus aureus
SVKQNAGNDAPKKFA

SEQ ID NO: 1624695 - protein, 10 aa, Staphylococcus aureus
SVNQEQQNNL

SEQ ID NO: 1624696 - protein, 13 aa, Staphylococcus aureus
SVTGYKNTAISDQ

SEQ ID NO: 1624697 - protein, 10 aa, Staphylococcus aureus
SYGKRTERHP

SEQ ID NO: 1624698 - protein, 6 aa, Staphylococcus aureus
SYNNER

SEQ ID NO: 1624699 - protein, 6 aa, Staphylococcus aureus
SYPEKV

SEQ ID NO: 1624700 - protein, 12 aa, Staphylococcus aureus
SYTDPSTGTTAT

SEQ ID NO: 1624701 - protein, 7 aa, Staphylococcus aureus
TAENEQD

SEQ ID NO: 1624702 - protein, 14 aa, Staphylococcus aureus
TDADQAKKDAYTNA

SEQ ID NO: 1624703 - protein, 21 aa, Staphylococcus aureus
TDDGRLSAKEVVGNKKALTAF

SEQ ID NO: 1624704 - protein, 7 aa, Staphylococcus aureus
TDGKDKL

SEQ ID NO: 1624705 - protein, 6 aa, Staphylococcus aureus
TDIDPT

SEQ ID NO: 1624706 - protein, 26 aa, Staphylococcus aureus
TDQAKQGITDATTTAEVEKAKAQGLE

SEQ ID NO: 1624707 - protein, 5 aa, Staphylococcus aureus
TDVDS

SEQ ID NO: 1624708 - protein, 6 aa, Staphylococcus aureus
TEKENS

SEQ ID NO: 1624709 - protein, 8 aa, Staphylococcus aureus
TEKQGKNK

SEQ ID NO: 1624710 - protein, 6 aa, Staphylococcus aureus
TENEDT

SEQ ID NO: 1624711 - protein, 7 aa, Staphylococcus aureus
TEQQKLD

SEQ ID NO: 1624712 - protein, 6 aa, Staphylococcus aureus
TGASAI

SEQ ID NO: 1624713 - protein, 7 aa, Staphylococcus aureus
TGASNKG

SEQ ID NO: 1624714 - protein, 19 aa, Staphylococcus aureus
TGEVDKAGNRISGFGKFSA

SEQ ID NO: 1624715 - protein, 15 aa, Staphylococcus aureus
TGGLRNSLDVDDNNV

SEQ ID NO: 1624716 - protein, 6 aa, Staphylococcus aureus
TISPNL

SEQ ID NO: 1624717 - protein, 14 aa, Staphylococcus aureus
TKDPELRSTPNGVN

SEQ ID NO: 1624718 - protein, 19 aa, Staphylococcus aureus
TKGQAGTNSITRPSFRVPN

SEQ ID NO: 1624719 - protein, 6 aa, Staphylococcus aureus
TKKRQR

SEQ ID NO: 1624720 - protein, 8 aa, Staphylococcus aureus
TKPGSEEL

SEQ ID NO: 1624721 - protein, 9 aa, Staphylococcus aureus
TKPGVSRTS

SEQ ID NO: 1624722 - protein, 4 aa, Staphylococcus aureus
TLAD

SEQ ID NO: 1624723 - protein, 9 aa, Staphylococcus aureus
TLSDGKVKP

SEQ ID NO: 1624724 - protein, 8 aa, Staphylococcus aureus
TNNKPETL

SEQ ID NO: 1624725 - protein, 8 aa, Staphylococcus aureus
TNPENPMH

SEQ ID NO: 1624726 - protein, 5 aa, Staphylococcus aureus
TNPSI

SEQ ID NO: 1624727 - protein, 14 aa, Staphylococcus aureus
TNVVDSDGNGGGSY

SEQ ID NO: 1624728 - protein, 15 aa, Staphylococcus aureus
TPSALGKWIKQHQNT

SEQ ID NO: 1624729 - protein, 5 aa, Staphylococcus aureus
TQKDG

SEQ ID NO: 1624730 - protein, 10 aa, Staphylococcus aureus
TRDGETIEYD

SEQ ID NO: 1624731 - protein, 36 aa, Staphylococcus aureus; identical to SEQ ID NO: 1566728

SEQ ID NO: 1624732 - protein, 13 aa, Staphylococcus aureus
TSNTYSKDEEKLI

SEQ ID NO: 1624733 - protein, 9 aa, Staphylococcus aureus
TSVTHDKDE

SEQ ID NO: 1624734 - protein, 7 aa, Staphylococcus aureus
TTFPDEK

SEQ ID NO: 1624735 - protein, 11 aa, Staphylococcus aureus
TTLSQQFTEAD

SEQ ID NO: 1624736 - protein, 14 aa, Staphylococcus aureus
TTTMGPGVKIDTAS

SEQ ID NO: 1624737 - protein, 11 aa, Staphylococcus aureus
TVEPSKPEQRE

SEQ ID NO: 1624738 - protein, 7 aa, Staphylococcus aureus
TVYKEGT

SEQ ID NO: 1624739 - protein, 5 aa, Staphylococcus aureus
TYQRR

SEQ ID NO: 1624740 - protein, 7 aa, Staphylococcus aureus
VAPGEHL

SEQ ID NO: 1624741 - protein, 6 aa, Staphylococcus aureus
VAPRSV

SEQ ID NO: 1624742 - protein, 8 aa, Staphylococcus aureus
VDTRSITR

SEQ ID NO: 1624743 - protein, 15 aa, Staphylococcus aureus
VEKEEVPKKALDKLS

SEQ ID NO: 1624744 - protein, 7 aa, Staphylococcus aureus
VEQQING

SEQ ID NO: 1624745 - protein, 4 aa, Staphylococcus aureus
VGHY

SEQ ID NO: 1624746 - protein, 13 aa, Staphylococcus aureus
VGQGFQPPAEKNA

SEQ ID NO: 1624747 - protein, 5 aa, Staphylococcus aureus
VGQTP

SEQ ID NO: 1624748 - protein, 6 aa, Staphylococcus aureus
VGRNKK

SEQ ID NO: 1624749 - protein, 24 aa, Staphylococcus aureus
VKAEDTKESIDQSDQLTAEEKTEA

SEQ ID NO: 1624750 - protein, 13 aa, Staphylococcus aureus
VKETTKTSKSYRT

SEQ ID NO: 1624751 - protein, 4 aa, Staphylococcus aureus
VNDT

SEQ ID NO: 1624752 - protein, 14 aa, Staphylococcus aureus
VNEEYQAKQNADVN

SEQ ID NO: 1624753 - protein, 25 aa, Staphylococcus aureus
VNTAKTALNGDARLNQAKNTAKQQL

SEQ ID NO: 1624754 - protein, 10 aa, Staphylococcus aureus
VPEGVDNEQQ

SEQ ID NO: 1624755 - protein, 5 aa, Staphylococcus aureus
VQEQN

SEQ ID NO: 1624756 - protein, 15 aa, Staphylococcus aureus
VQGPNTAKDNVESAL

SEQ ID NO: 1624757 - protein, 7 aa, Staphylococcus aureus
VQSPDQD

SEQ ID NO: 1624758 - protein, 8 aa, Staphylococcus aureus
VQTAQQSM

SEQ ID NO: 1624759 - protein, 5 aa, Staphylococcus aureus
VRNYT

SEQ ID NO: 1624760 - protein, 9 aa, Staphylococcus aureus
VSDNGGVDT

SEQ ID NO: 1624761 - protein, 13 aa, Staphylococcus aureus
VSEQTMQQNHANL

SEQ ID NO: 1624762 - protein, 29 aa, Staphylococcus aureus
VSNPNVYAAGDAAATDGLPLTPVASADSH

SEQ ID NO: 1624763 - protein, 4 aa, Staphylococcus aureus
VSQP

SEQ ID NO: 1624764 - protein, 12 aa, Staphylococcus aureus
VTVNKNDGSYNQ

SEQ ID NO: 1624765 - protein, 11 aa, Staphylococcus aureus
WQDGDDSSLRS

SEQ ID NO: 1624766 - protein, 4 aa, Staphylococcus aureus
YDGD

SEQ ID NO: 1624767 - protein, 12 aa, Staphylococcus aureus
YEDFKQSDAFND

SEQ ID NO: 1624768 - protein, 20 aa, Staphylococcus aureus
YEDSYENRTKKTTAGSSDLS

SEQ ID NO: 1624769 - protein, 6 aa, Staphylococcus aureus
YEQQYD

SEQ ID NO: 1624770 - protein, 9 aa, Staphylococcus aureus
YEQSNVSPS

SEQ ID NO: 1624771 - protein, 12 aa, Staphylococcus aureus
YGVSQDGENGAE

SEQ ID NO: 1624772 - protein, 13 aa, Staphylococcus aureus
YIDKSGQRLSNGR

SEQ ID NO: 1624773 - protein, 11 aa, Staphylococcus aureus
YISENTGYPFV

SEQ ID NO: 1624774 - protein, 18 aa, Staphylococcus aureus
YKDANGKWHTTKGQHAQP

SEQ ID NO: 1624775 - protein, 5 aa, Staphylococcus aureus
YKDTT

SEQ ID NO: 1624776 - protein, 12 aa, Staphylococcus aureus
YKMSNTDKNVKK

SEQ ID NO: 1624777 - protein, 6 aa, Staphylococcus aureus
YKTNKS

SEQ ID NO: 1624778 - protein, 9 aa, Staphylococcus aureus
YNESSKRYK

SEQ ID NO: 1624779 - protein, 13 aa, Staphylococcus aureus
YPKQQFANSPDYR

SEQ ID NO: 1624780 - protein, 8 aa, Staphylococcus aureus
YPNVKDTD

SEQ ID NO: 1624781 - protein, 12 aa, Staphylococcus aureus
YPRDGLEVSEER

SEQ ID NO: 1624782 - protein, 5 aa, Staphylococcus aureus
YQGYE

SEQ ID NO: 1624783 - protein, 4 aa, Staphylococcus aureus
YQSD

SEQ ID NO: 1624784 - protein, 25 aa, Staphylococcus aureus
YRDANDKAFKALKKNTEKKLGKIDE

SEQ ID NO: 1624785 - protein, 12 aa, Staphylococcus aureus
YSDSPKKQIKTG

SEQ ID NO: 1624786 - protein, 4 aa, Staphylococcus aureus
YSNL

SEQ ID NO: 1624787 - protein, 8 aa, Staphylococcus aureus
YYEGKTKN

SEQ ID NO: 1624788 - protein, 7 aa, Staphylococcus aureus
YYEQRPD

SEQ ID NO: 1624789 - protein, 10 aa, Staphylococcus aureus
YYNPNNNKKQ

SEQ ID NO: 1624790 - protein, 5 aa, Staphylococcus aureus
AAGYL

SEQ ID NO: 1624791 - protein, 8 aa, Staphylococcus aureus
AASGNRNW

SEQ ID NO: 1624792 - protein, 16 aa, Staphylococcus aureus
AAYNPTDRKKLEPQDI

SEQ ID NO: 1624793 - protein, 4 aa, Staphylococcus aureus
ADGH

SEQ ID NO: 1624794 - protein, 12 aa, Staphylococcus aureus
ADKEKSKYNEPL

SEQ ID NO: 1624795 - protein, 11 aa, Staphylococcus aureus
ADKKKSVSDRD

SEQ ID NO: 1624796 - protein, 13 aa, Staphylococcus aureus
ADNKEDENDVLQN

SEQ ID NO: 1624797 - protein, 13 aa, Staphylococcus aureus
AEEAVEKAKELNS

SEQ ID NO: 1624798 - protein, 14 aa, Staphylococcus aureus
AEELAGKEATFKTK

SEQ ID NO: 1624799 - protein, 10 aa, Staphylococcus aureus
AEIGSKAYGS

SEQ ID NO: 1624800 - protein, 7 aa, Staphylococcus aureus
AEKQHTI

SEQ ID NO: 1624801 - protein, 4 aa, Staphylococcus aureus
AELE

SEQ ID NO: 1624802 - protein, 4 aa, Staphylococcus aureus
AERT

SEQ ID NO: 1624803 - protein, 10 aa, Staphylococcus aureus
AESIENPQVR

SEQ ID NO: 1624804 - protein, 4 aa, Staphylococcus aureus
AFDS

SEQ ID NO: 1624805 - protein, 5 aa, Staphylococcus aureus
AFKND

SEQ ID NO: 1624806 - protein, 8 aa, Staphylococcus aureus
AGANKEDI

SEQ ID NO: 1624807 - protein, 6 aa, Staphylococcus aureus
AGDEQQ

SEQ ID NO: 1624808 - protein, 9 aa, Staphylococcus aureus
AGGDKKVNY

SEQ ID NO: 1624809 - protein, 19 aa, Staphylococcus aureus
AGKLRGDASTNFTRATELG

SEQ ID NO: 1624810 - protein, 62 aa, Staphylococcus aureus
AHEKKKADEYAKEKAEEAAKEAAKLAKMNKDQKDEYERKQLEKELEQLRSEKQLNEMRSEAR

SEQ ID NO: 1624811 - protein, 7 aa, Staphylococcus aureus
AHNSESI

SEQ ID NO: 1624812 - protein, 10 aa, Staphylococcus aureus
AHREQQPITT

SEQ ID NO: 1624813 - protein, 28 aa, Staphylococcus aureus
AIAEGKGKTKKESEQRAAESAYKQLKQI

SEQ ID NO: 1624814 - protein, 16 aa, Staphylococcus aureus
AIPQPKVDSSTVTPGE

SEQ ID NO: 1624815 - protein, 5 aa, Staphylococcus aureus
AIQTG

SEQ ID NO: 1624816 - protein, 18 aa, Staphylococcus aureus
AIRTKNLDQMTKAKQRLE

SEQ ID NO: 1624817 - protein, 5 aa, Staphylococcus aureus
AKKPV

SEQ ID NO: 1624818 - protein, 9 aa, Staphylococcus aureus
AKLNNPKDA

SEQ ID NO: 1624819 - protein, 7 aa, Staphylococcus aureus
AKQTDFE

SEQ ID NO: 1624820 - protein, 22 aa, Staphylococcus aureus
ALKKEPRANTQAAEHILQEIRQ

SEQ ID NO: 1624821 - protein, 4 aa, Staphylococcus aureus
ANAA

SEQ ID NO: 1624822 - protein, 8 aa, Staphylococcus aureus
ANASKVHG

SEQ ID NO: 1624823 - protein, 5 aa, Staphylococcus aureus
ANDYA

SEQ ID NO: 1624824 - protein, 6 aa, Staphylococcus aureus
ANKESY

SEQ ID NO: 1624825 - protein, 6 aa, Staphylococcus aureus
ANSERK

SEQ ID NO: 1624826 - protein, 11 aa, Staphylococcus aureus
ANVDDTTKEHL

SEQ ID NO: 1624827 - protein, 6 aa, Staphylococcus aureus
APPETF

SEQ ID NO: 1624828 - protein, 10 aa, Staphylococcus aureus
AQKNDQEAYE

SEQ ID NO: 1624829 - protein, 7 aa, Staphylococcus aureus
AQKSANV

SEQ ID NO: 1624830 - protein, 5 aa, Staphylococcus aureus
AQLGE

SEQ ID NO: 1624831 - protein, 8 aa, Staphylococcus aureus
AQSIDETY

SEQ ID NO: 1624832 - protein, 5 aa, Staphylococcus aureus
AQSPN

SEQ ID NO: 1624833 - protein, 12 aa, Staphylococcus aureus
ARGERERVKQHA

SEQ ID NO: 1624834 - protein, 5 aa, Staphylococcus aureus
ARPGN

SEQ ID NO: 1624835 - protein, 16 aa, Staphylococcus aureus
ASEKISEAMDANDPIP

SEQ ID NO: 1624836 - protein, 13 aa, Staphylococcus aureus
ASELTKAAGADFV

SEQ ID NO: 1624837 - protein, 18 aa, Staphylococcus aureus
ASNVPTSKTGAAIRKQAP

SEQ ID NO: 1624838 - protein, 25 aa, Staphylococcus aureus
ASSLTGDNATIPNHKDITDQLDYEG

SEQ ID NO: 1624839 - protein, 15 aa, Staphylococcus aureus
ASSQTIPTTSQPAIG

SEQ ID NO: 1624840 - protein, 4 aa, Staphylococcus aureus
ATAN

SEQ ID NO: 1624841 - protein, 7 aa, Staphylococcus aureus
ATDGKSL

SEQ ID NO: 1624842 - protein, 8 aa, Staphylococcus aureus
ATSEVEGI

SEQ ID NO: 1624843 - protein, 12 aa, Staphylococcus aureus
AVGEDGPTHEPI

SEQ ID NO: 1624844 - protein, 11 aa, Staphylococcus aureus
AVPKEASSNEA

SEQ ID NO: 1624845 - protein, 7 aa, Staphylococcus aureus
AYRIPNS

SEQ ID NO: 1624846 - protein, 4 aa, Staphylococcus aureus
CGRK

SEQ ID NO: 1624847 - protein, 14 aa, Staphylococcus aureus
CHGGETNKTQCSYG

SEQ ID NO: 1624848 - protein, 9 aa, Staphylococcus aureus
DAGIEPKDV

SEQ ID NO: 1624849 - protein, 15 aa, Staphylococcus aureus
DAHGSGVMGKGAGTV

SEQ ID NO: 1624850 - protein, 5 aa, Staphylococcus aureus
DANDI

SEQ ID NO: 1624851 - protein, 8 aa, Staphylococcus aureus
DAPKKNPK

SEQ ID NO: 1624852 - protein, 10 aa, Staphylococcus aureus
DARETAPEHV

SEQ ID NO: 1624853 - protein, 10 aa, Staphylococcus aureus
DASTKTTALY

SEQ ID NO: 1624854 - protein, 6 aa, Staphylococcus aureus
DATNDF

SEQ ID NO: 1624855 - protein, 12 aa, Staphylococcus aureus
DDDDDMNDSSNW

SEQ ID NO: 1624856 - protein, 8 aa, Staphylococcus aureus
DDKQDQRL

SEQ ID NO: 1624857 - protein, 12 aa, Staphylococcus aureus
DDSFPKQEKLTE

SEQ ID NO: 1624858 - protein, 8 aa, Staphylococcus aureus
DEEGIETP

SEQ ID NO: 1624859 - protein, 6 aa, Staphylococcus aureus
DEITTA

SEQ ID NO: 1624860 - protein, 5 aa, Staphylococcus aureus
DEQYS

SEQ ID NO: 1624861 - protein, 5 aa, Staphylococcus aureus
DGATL

SEQ ID NO: 1624862 - protein, 5 aa, Staphylococcus aureus
DGGHQ

SEQ ID NO: 1624863 - protein, 9 aa, Staphylococcus aureus
DGKGIDSDC

SEQ ID NO: 1624864 - protein, 7 aa, Staphylococcus aureus
DGTVEGL

SEQ ID NO: 1624865 - protein, 28 aa, Staphylococcus aureus
DIDKNKESLQKAKEIAGEKASEYFNKAM

SEQ ID NO: 1624866 - protein, 6 aa, Staphylococcus aureus
DKATMT

SEQ ID NO: 1624867 - protein, 4 aa, Staphylococcus aureus
DKAY

SEQ ID NO: 1624868 - protein, 8 aa, Staphylococcus aureus
DKFPDRKK

SEQ ID NO: 1624869 - protein, 9 aa, Staphylococcus aureus
DKKETAKKL

SEQ ID NO: 1624870 - protein, 9 aa, Staphylococcus aureus
DKQSKKAYE

SEQ ID NO: 1624871 - protein, 12 aa, Staphylococcus aureus
DLINQPEDKYGE

SEQ ID NO: 1624872 - protein, 9 aa, Staphylococcus aureus
DLKDNHGSH

SEQ ID NO: 1624873 - protein, 19 aa, Staphylococcus aureus
DLTNAQKDAAKRQIEGATH

SEQ ID NO: 1624874 - protein, 9 aa, Staphylococcus aureus
DNGKGFNVD

SEQ ID NO: 1624875 - protein, 8 aa, Staphylococcus aureus
DNKRSHDI

SEQ ID NO: 1624876 - protein, 6 aa, Staphylococcus aureus
DNKTWN

SEQ ID NO: 1624877 - protein, 12 aa, Staphylococcus aureus
DQAKGNDKNYPG

SEQ ID NO: 1624878 - protein, 9 aa, Staphylococcus aureus
DQGNPTGQQ

SEQ ID NO: 1624879 - protein, 11 aa, Staphylococcus aureus
DQIGPLTRNVK

SEQ ID NO: 1624880 - protein, 5 aa, Staphylococcus aureus
DQKLT

SEQ ID NO: 1624881 - protein, 15 aa, Staphylococcus aureus
DQMDKSENNSQEAEV

SEQ ID NO: 1624882 - protein, 10 aa, Staphylococcus aureus
DQSASVEDAI

SEQ ID NO: 1624883 - protein, 5 aa, Staphylococcus aureus
DRAAQ

SEQ ID NO: 1624884 - protein, 4 aa, Staphylococcus aureus
DSFT

SEQ ID NO: 1624885 - protein, 9 aa, Staphylococcus aureus
DSNPANPNY

SEQ ID NO: 1624886 - protein, 12 aa, Staphylococcus aureus
DSTLQGQPGDTL

SEQ ID NO: 1624887 - protein, 12 aa, Staphylococcus aureus
DSVKDDSEIQKE

SEQ ID NO: 1624888 - protein, 5 aa, Staphylococcus aureus
DTEGH

SEQ ID NO: 1624889 - protein, 8 aa, Staphylococcus aureus
DTPTSSET

SEQ ID NO: 1624890 - protein, 7 aa, Staphylococcus aureus
DTTEIQN

SEQ ID NO: 1624891 - protein, 8 aa, Staphylococcus aureus
DVDTTPRI

SEQ ID NO: 1624892 - protein, 6 aa, Staphylococcus aureus
DVGGRY

SEQ ID NO: 1624893 - protein, 8 aa, Staphylococcus aureus
DVSKETSV

SEQ ID NO: 1624894 - protein, 6 aa, Staphylococcus aureus
EAEQAA

SEQ ID NO: 1624895 - protein, 8 aa, Staphylococcus aureus
EAKTRSDY

SEQ ID NO: 1624896 - protein, 22 aa, Staphylococcus aureus
EARDDGPFLSKEDLNKKAGLSQ

SEQ ID NO: 1624897 - protein, 13 aa, Staphylococcus aureus
EARKIKPSIPTID

SEQ ID NO: 1624898 - protein, 6 aa, Staphylococcus aureus
EDERKD

SEQ ID NO: 1624899 - protein, 8 aa, Staphylococcus aureus
EDPKLKKR

SEQ ID NO: 1624900 - protein, 4 aa, Staphylococcus aureus
EDVD

SEQ ID NO: 1624901 - protein, 12 aa, Staphylococcus aureus
EDYADARGMLDN

SEQ ID NO: 1624902 - protein, 9 aa, Staphylococcus aureus
EEDKNNERI

SEQ ID NO: 1624903 - protein, 8 aa, Staphylococcus aureus
EEKSETGE

SEQ ID NO: 1624904 - protein, 5 aa, Staphylococcus aureus
EENTK

SEQ ID NO: 1624905 - protein, 7 aa, Staphylococcus aureus
EESKIPE

SEQ ID NO: 1624906 - protein, 9 aa, Staphylococcus aureus
EETPNDVEK

SEQ ID NO: 1624907 - protein, 7 aa, Staphylococcus aureus
EFEYDDT

SEQ ID NO: 1624908 - protein, 16 aa, Staphylococcus aureus
EGAFDPDKKYKSGHRD

SEQ ID NO: 1624909 - protein, 7 aa, Staphylococcus aureus
EGAGAQV

SEQ ID NO: 1624910 - protein, 8 aa, Staphylococcus aureus
EGDITAPY

SEQ ID NO: 1624911 - protein, 19 aa, Staphylococcus aureus
EGIKRPKKKISVEELEDTE

SEQ ID NO: 1624912 - protein, 6 aa, Staphylococcus aureus
EGLEDK

SEQ ID NO: 1624913 - protein, 4 aa, Staphylococcus aureus
EGNL

SEQ ID NO: 1624914 - protein, 14 aa, Staphylococcus aureus
EGSALDKEAYDRAT

SEQ ID NO: 1624915 - protein, 14 aa, Staphylococcus aureus
EGTYRTATIGSKAT

SEQ ID NO: 1624916 - protein, 4 aa, Staphylococcus aureus
EHNY

SEQ ID NO: 1624917 - protein, 5 aa, Staphylococcus aureus
EHVES

SEQ ID NO: 1624918 - protein, 7 aa, Staphylococcus aureus
EIDEETE

SEQ ID NO: 1624919 - protein, 12 aa, Staphylococcus aureus
EIKRGGQSYTYD

SEQ ID NO: 1624920 - protein, 13 aa, Staphylococcus aureus
EIPIDDGKSLGNF

SEQ ID NO: 1624921 - protein, 21 aa, Staphylococcus aureus
EKASSENFGEVSDDAQKLKIT

SEQ ID NO: 1624922 - protein, 7 aa, Staphylococcus aureus
EKENGEI

SEQ ID NO: 1624923 - protein, 5 aa, Staphylococcus aureus
EKNGE

SEQ ID NO: 1624924 - protein, 5 aa, Staphylococcus aureus
EKTPH

SEQ ID NO: 1624925 - protein, 24 aa, Staphylococcus aureus
EKVNELNGNERVAEAKTQAKQTID

SEQ ID NO: 1624926 - protein, 12 aa, Staphylococcus aureus
ELENKNKEQKLE

SEQ ID NO: 1624927 - protein, 6 aa, Staphylococcus aureus
ELPLPE

SEQ ID NO: 1624928 - protein, 16 aa, Staphylococcus aureus
ELQQKTSSFGQSTTVT

SEQ ID NO: 1624929 - protein, 10 aa, Staphylococcus aureus
ELSNQDELDQ

SEQ ID NO: 1624930 - protein, 4 aa, Staphylococcus aureus
ELSQ

SEQ ID NO: 1624931 - protein, 18 aa, Staphylococcus aureus
EMEDEPVRAIKRKKDSSM

SEQ ID NO: 1624932 - protein, 6 aa, Staphylococcus aureus
ENKRRM

SEQ ID NO: 1624933 - protein, 6 aa, Staphylococcus aureus
ENYITQ

SEQ ID NO: 1624934 - protein, 23 aa, Staphylococcus aureus
EPFKDGKVTDQETMDKELQSRLK

SEQ ID NO: 1624935 - protein, 38 aa, Staphylococcus aureus
EPKNNNQQPNNNYHQQRQTQTGNNPFDNTTAITDDDLP

SEQ ID NO: 1624936 - protein, 9 aa, Staphylococcus aureus
EPSNGLDPY

SEQ ID NO: 1624937 - protein, 5 aa, Staphylococcus aureus
EPTIG

SEQ ID NO: 1624938 - protein, 6 aa, Staphylococcus aureus
EPTRDE

SEQ ID NO: 1624939 - protein, 9 aa, Staphylococcus aureus
EPTSALDPI

SEQ ID NO: 1624940 - protein, 5 aa, Staphylococcus aureus
EPVSA

SEQ ID NO: 1624941 - protein, 7 aa, Staphylococcus aureus
EQEYGKD

SEQ ID NO: 1624942 - protein, 8 aa, Staphylococcus aureus
EQNNNGLS

SEQ ID NO: 1624943 - protein, 5 aa, Staphylococcus aureus
ERQVR

SEQ ID NO: 1624944 - protein, 10 aa, Staphylococcus aureus
ESAKDVGIEK

SEQ ID NO: 1624945 - protein, 15 aa, Staphylococcus aureus
ESFNPPTLKINSDKS

SEQ ID NO: 1624946 - protein, 5 aa, Staphylococcus aureus
ESKLK

SEQ ID NO: 1624947 - protein, 16 aa, Staphylococcus aureus
ETAPQAKQQATKGYGA

SEQ ID NO: 1624948 - protein, 6 aa, Staphylococcus aureus
ETGNPF

SEQ ID NO: 1624949 - protein, 9 aa, Staphylococcus aureus
ETLKESKPY

SEQ ID NO: 1624950 - protein, 19 aa, Staphylococcus aureus
ETRKSSLRDTYFNINQRGD

SEQ ID NO: 1624951 - protein, 7 aa, Staphylococcus aureus
ETSPMGS

SEQ ID NO: 1624952 - protein, 7 aa, Staphylococcus aureus
ETVTKEE

SEQ ID NO: 1624953 - protein, 11 aa, Staphylococcus aureus
EVEENANQEQL

SEQ ID NO: 1624954 - protein, 25 aa, Staphylococcus aureus
EVEGKTGTAQVAAPNGGGYVKGPNP

SEQ ID NO: 1624955 - protein, 10 aa, Staphylococcus aureus
EVKETSTDLT

SEQ ID NO: 1624956 - protein, 6 aa, Staphylococcus aureus
EVTKDT

SEQ ID NO: 1624957 - protein, 9 aa, Staphylococcus aureus
EYDSNSIAQ

SEQ ID NO: 1624958 - protein, 5 aa, Staphylococcus aureus
FDDDN

SEQ ID NO: 1624959 - protein, 10 aa, Staphylococcus aureus
FDTTKTSGEI

SEQ ID NO: 1624960 - protein, 100 aa, Staphylococcus aureus
FEESQDDNQLENEQVDQSTSSSVSEVSDITEESEETTHPNNTSGQQDNDDQQKDLQSSFSNKNEDTANENRPRTNQQDVATNQAVQTSKPMIRKGPNIKL

SEQ ID NO: 1624961 - protein, 10 aa, Staphylococcus aureus
FENASTGSYT

SEQ ID NO: 1624962 - protein, 4 aa, Staphylococcus aureus
FENN

SEQ ID NO: 1624963 - protein, 5 aa, Staphylococcus aureus
FGGNA

SEQ ID NO: 1624964 - protein, 11 aa, Staphylococcus aureus
FKNGAKQAQLQ

SEQ ID NO: 1624965 - protein, 14 aa, Staphylococcus aureus
FKSASAFPLPNAEY

SEQ ID NO: 1624966 - protein, 7 aa, Staphylococcus aureus
FKSDIAK

SEQ ID NO: 1624967 - protein, 10 aa, Staphylococcus aureus
FKTKQIKRKY

SEQ ID NO: 1624968 - protein, 11 aa, Staphylococcus aureus
FKTNATVDSLT

SEQ ID NO: 1624969 - protein, 4 aa, Staphylococcus aureus
FNKE

SEQ ID NO: 1624970 - protein, 8 aa, Staphylococcus aureus
FPKYEQNY

SEQ ID NO: 1624971 - protein, 6 aa, Staphylococcus aureus
FPQDTN

SEQ ID NO: 1624972 - protein, 6 aa, Staphylococcus aureus
FQEEAK

SEQ ID NO: 1624973 - protein, 12 aa, Staphylococcus aureus
FSGQYGDKVSPK

SEQ ID NO: 1624974 - protein, 4 aa, Staphylococcus aureus
FTDE

SEQ ID NO: 1624975 - protein, 15 aa, Staphylococcus aureus
FTHPGSPNGTFTKET

SEQ ID NO: 1624976 - protein, 5 aa, Staphylococcus aureus
FYPNG

SEQ ID NO: 1624977 - protein, 7 aa, Staphylococcus aureus
GAAPDLD

SEQ ID NO: 1624978 - protein, 12 aa, Staphylococcus aureus
GAGSVSDKLVGD

SEQ ID NO: 1624979 - protein, 11 aa, Staphylococcus aureus
GDFDGQQTFTE

SEQ ID NO: 1624980 - protein, 5 aa, Staphylococcus aureus
GDFTE

SEQ ID NO: 1624981 - protein, 8 aa, Staphylococcus aureus
GEHGDTEL

SEQ ID NO: 1624982 - protein, 7 aa, Staphylococcus aureus
GGAPTQR

SEQ ID NO: 1624983 - protein, 5 aa, Staphylococcus aureus
GGGGI

SEQ ID NO: 1624984 - protein, 7 aa, Staphylococcus aureus
GGKSTAD

SEQ ID NO: 1624985 - protein, 13 aa, Staphylococcus aureus
GGKTDPMEKRTRV

SEQ ID NO: 1624986 - protein, 19 aa, Staphylococcus aureus
GGNTNYQDTIRRNKALAQS

SEQ ID NO: 1624987 - protein, 12 aa, Staphylococcus aureus
GGPNIKKYFFFR

SEQ ID NO: 1624988 - protein, 7 aa, Staphylococcus aureus
GGVTDAD

SEQ ID NO: 1624989 - protein, 6 aa, Staphylococcus aureus
GHNLET

SEQ ID NO: 1624990 - protein, 8 aa, Staphylococcus aureus
GHRDEKTT

SEQ ID NO: 1624991 - protein, 5 aa, Staphylococcus aureus
GINSV

SEQ ID NO: 1624992 - protein, 15 aa, Staphylococcus aureus
GIPGGQMANTEEVEN

SEQ ID NO: 1624993 - protein, 14 aa, Staphylococcus aureus
GKDEKKYKDGPYDN

SEQ ID NO: 1624994 - protein, 7 aa, Staphylococcus aureus
GKKTYSD

SEQ ID NO: 1624995 - protein, 5 aa, Staphylococcus aureus
GKLTG

SEQ ID NO: 1624996 - protein, 7 aa, Staphylococcus aureus
GKNKQQM

SEQ ID NO: 1624997 - protein, 5 aa, Staphylococcus aureus
GKPIG

SEQ ID NO: 1624998 - protein, 8 aa, Staphylococcus aureus
GKRGTAQR

SEQ ID NO: 1624999 - protein, 59 aa, Staphylococcus aureus; identical to SEQ ID NO: 1562172

SEQ ID NO: 1625000 - protein, 13 aa, Staphylococcus aureus
GKSYVNGKYMLKR

SEQ ID NO: 1625001 - protein, 8 aa, Staphylococcus aureus
GKVKNEGV

SEQ ID NO: 1625002 - protein, 4 aa, Staphylococcus aureus
GLAS

SEQ ID NO: 1625003 - protein, 5 aa, Staphylococcus aureus
GLEPW

SEQ ID NO: 1625004 - protein, 9 aa, Staphylococcus aureus
GLPSDFPEN

SEQ ID NO: 1625005 - protein, 5 aa, Staphylococcus aureus
GLQDK

SEQ ID NO: 1625006 - protein, 24 aa, Staphylococcus aureus
GLSGTSSDLRDLSEEAESGKARSQ

SEQ ID NO: 1625007 - protein, 13 aa, Staphylococcus aureus
GNFTGNKKKGVGV

SEQ ID NO: 1625008 - protein, 5 aa, Staphylococcus aureus
GNMGS

SEQ ID NO: 1625009 - protein, 21 aa, Staphylococcus aureus
GNRLTKDGSTTWDPSKSYIKE

SEQ ID NO: 1625010 - protein, 21 aa, Staphylococcus aureus
GPNTEADEKSAYDNVQVGGAP

SEQ ID NO: 1625011 - protein, 6 aa, Staphylococcus aureus
GQKEQA

SEQ ID NO: 1625012 - protein, 16 aa, Staphylococcus aureus
GQNSDAWKKARGFTSA

SEQ ID NO: 1625013 - protein, 7 aa, Staphylococcus aureus
GQVGRQN

SEQ ID NO: 1625014 - protein, 25 aa, Staphylococcus aureus
GRDITDDIAQGLNTSYETAEKVKHQ

SEQ ID NO: 1625015 - protein, 6 aa, Staphylococcus aureus
GRGMNR

SEQ ID NO: 1625016 - protein, 8 aa, Staphylococcus aureus
GRKSLEEV

SEQ ID NO: 1625017 - protein, 7 aa, Staphylococcus aureus
GRLPGGI

SEQ ID NO: 1625018 - protein, 4 aa, Staphylococcus aureus
GSKP

SEQ ID NO: 1625019 - protein, 6 aa, Staphylococcus aureus
GSKSNV

SEQ ID NO: 1625020 - protein, 9 aa, Staphylococcus aureus
GSKVSTEDF

SEQ ID NO: 1625021 - protein, 4 aa, Staphylococcus aureus
GSRG

SEQ ID NO: 1625022 - protein, 10 aa, Staphylococcus aureus
GTDEGSQIKK

SEQ ID NO: 1625023 - protein, 29 aa, Staphylococcus aureus
GVETGGELKTAYADGGPIESGNTDGEGKI

SEQ ID NO: 1625024 - protein, 12 aa, Staphylococcus aureus
GVFSEPASNASI

SEQ ID NO: 1625025 - protein, 8 aa, Staphylococcus aureus
GVGGYPKG

SEQ ID NO: 1625026 - protein, 8 aa, Staphylococcus aureus
GVGKGQPV

SEQ ID NO: 1625027 - protein, 15 aa, Staphylococcus aureus
GVNADNVKIQEDASK

SEQ ID NO: 1625028 - protein, 10 aa, Staphylococcus aureus
GVYGQTDTGM

SEQ ID NO: 1625029 - protein, 4 aa, Staphylococcus aureus
HASL

SEQ ID NO: 1625030 - protein, 4 aa, Staphylococcus aureus
HDGF

SEQ ID NO: 1625031 - protein, 13 aa, Staphylococcus aureus
HDRGVKGQKETIK

SEQ ID NO: 1625032 - protein, 8 aa, Staphylococcus aureus
HDSNKNPI

SEQ ID NO: 1625033 - protein, 5 aa, Staphylococcus aureus
HFTDE

SEQ ID NO: 1625034 - protein, 10 aa, Staphylococcus aureus
HGAGSPCGKS

SEQ ID NO: 1625035 - protein, 7 aa, Staphylococcus aureus
HGDANEG

SEQ ID NO: 1625036 - protein, 8 aa, Staphylococcus aureus
HGGTKKKK

SEQ ID NO: 1625037 - protein, 8 aa, Staphylococcus aureus
HGMDPSIG

SEQ ID NO: 1625038 - protein, 18 aa, Staphylococcus aureus
HGREERQLAEKELQQLEQ

SEQ ID NO: 1625039 - protein, 4 aa, Staphylococcus aureus
HIPG

SEQ ID NO: 1625040 - protein, 7 aa, Staphylococcus aureus
HKNQELN

SEQ ID NO: 1625041 - protein, 5 aa, Staphylococcus aureus
HNLET

SEQ ID NO: 1625042 - protein, 4 aa, Staphylococcus aureus
HPYG

SEQ ID NO: 1625043 - protein, 15 aa, Staphylococcus aureus
HQLKSPDDIKKELNK

SEQ ID NO: 1625044 - protein, 5 aa, Staphylococcus aureus
HQTVE

SEQ ID NO: 1625045 - protein, 10 aa, Staphylococcus aureus
HRDAYNNITK

SEQ ID NO: 1625046 - protein, 11 aa, Staphylococcus aureus
HRESPQSVEVA

SEQ ID NO: 1625047 - protein, 33 aa, Staphylococcus aureus; identical to SEQ ID NO: 1566836

SEQ ID NO: 1625048 - protein, 6 aa, Staphylococcus aureus
IAGIPS

SEQ ID NO: 1625049 - protein, 9 aa, Staphylococcus aureus
IAKATGTSL

SEQ ID NO: 1625050 - protein, 4 aa, Staphylococcus aureus
IAKT

SEQ ID NO: 1625051 - protein, 7 aa, Staphylococcus aureus
IATPEQL

SEQ ID NO: 1625052 - protein, 4 aa, Staphylococcus aureus
IDDA

SEQ ID NO: 1625053 - protein, 12 aa, Staphylococcus aureus
IDGKYAPPHPSD

SEQ ID NO: 1625054 - protein, 4 aa, Staphylococcus aureus
IDYA

SEQ ID NO: 1625055 - protein, 22 aa, Staphylococcus aureus
IEEAKEKANQKIKAATKEADDI

SEQ ID NO: 1625056 - protein, 4 aa, Staphylococcus aureus
IENG

SEQ ID NO: 1625057 - protein, 10 aa, Staphylococcus aureus
IENQPKEIED

SEQ ID NO: 1625058 - protein, 14 aa, Staphylococcus aureus
IEQNYTGKRKIRTD

SEQ ID NO: 1625059 - protein, 21 aa, Staphylococcus aureus
IERSKTDRYQKKHSSKGQSKL

SEQ ID NO: 1625060 - protein, 47 aa, Staphylococcus aureus; identical to SEQ ID NO: 1570798

SEQ ID NO: 1625061 - protein, 15 aa, Staphylococcus aureus
IGSTISTGNASWGTT

SEQ ID NO: 1625062 - protein, 6 aa, Staphylococcus aureus
IGTVAE

SEQ ID NO: 1625063 - protein, 6 aa, Staphylococcus aureus
IHETDD

SEQ ID NO: 1625064 - protein, 7 aa, Staphylococcus aureus
IHNPNGT

SEQ ID NO: 1625065 - protein, 12 aa, Staphylococcus aureus
IIGQTDAKKQMS

SEQ ID NO: 1625066 - protein, 8 aa, Staphylococcus aureus
IKADRKQF

SEQ ID NO: 1625067 - protein, 13 aa, Staphylococcus aureus
ILTDKEVEAYFIN

SEQ ID NO: 1625068 - protein, 9 aa, Staphylococcus aureus
INEENNELG

SEQ ID NO: 1625069 - protein, 4 aa, Staphylococcus aureus
IPAK

SEQ ID NO: 1625070 - protein, 5 aa, Staphylococcus aureus
IPDSK

SEQ ID NO: 1625071 - protein, 5 aa, Staphylococcus aureus
IPGFS

SEQ ID NO: 1625072 - protein, 9 aa, Staphylococcus aureus
IPNKVPNRI

SEQ ID NO: 1625073 - protein, 5 aa, Staphylococcus aureus
IPSSA

SEQ ID NO: 1625074 - protein, 13 aa, Staphylococcus aureus
IPTDNASWRGPNI

SEQ ID NO: 1625075 - protein, 5 aa, Staphylococcus aureus
IQQQG

SEQ ID NO: 1625076 - protein, 5 aa, Staphylococcus aureus
IRENE

SEQ ID NO: 1625077 - protein, 19 aa, Staphylococcus aureus
ISEDEAKKYGLNDEENGQF

SEQ ID NO: 1625078 - protein, 9 aa, Staphylococcus aureus
ISKDFDDEA

SEQ ID NO: 1625079 - protein, 10 aa, Staphylococcus aureus
ISKDLKEDPI

SEQ ID NO: 1625080 - protein, 9 aa, Staphylococcus aureus
ISPAAQGVH

SEQ ID NO: 1625081 - protein, 11 aa, Staphylococcus aureus
ISRRALENTDL

SEQ ID NO: 1625082 - protein, 22 aa, Staphylococcus aureus
ISTDNASWGRGPNTKAGGKSAY

SEQ ID NO: 1625083 - protein, 7 aa, Staphylococcus aureus
ITEADAS

SEQ ID NO: 1625084 - protein, 9 aa, Staphylococcus aureus
ITQGTNSDV

SEQ ID NO: 1625085 - protein, 6 aa, Staphylococcus aureus
KADESY

SEQ ID NO: 1625086 - protein, 5 aa, Staphylococcus aureus
KADNV

SEQ ID NO: 1625087 - protein, 7 aa, Staphylococcus aureus
KADSWDR

SEQ ID NO: 1625088 - protein, 17 aa, Staphylococcus aureus
KAEKAGKKVEMKKTEEY

SEQ ID NO: 1625089 - protein, 9 aa, Staphylococcus aureus
KAGEYSDCH

SEQ ID NO: 1625090 - protein, 15 aa, Staphylococcus aureus
KAIQELKQERNALES

SEQ ID NO: 1625091 - protein, 9 aa, Staphylococcus aureus
KARKSPNQT

SEQ ID NO: 1625092 - protein, 12 aa, Staphylococcus aureus
KASSFADQSQDN

SEQ ID NO: 1625093 - protein, 5 aa, Staphylococcus aureus
KAVNE

SEQ ID NO: 1625094 - protein, 6 aa, Staphylococcus aureus
KDIGKD

SEQ ID NO: 1625095 - protein, 8 aa, Staphylococcus aureus
KDIPDNGF

SEQ ID NO: 1625096 - protein, 15 aa, Staphylococcus aureus
KDKSASYYAYYGTDE

SEQ ID NO: 1625097 - protein, 19 aa, Staphylococcus aureus
KDLESGTPTEVLTGENEGY

SEQ ID NO: 1625098 - protein, 6 aa, Staphylococcus aureus
KDNMTI

SEQ ID NO: 1625099 - protein, 6 aa, Staphylococcus aureus
KDPLTA

SEQ ID NO: 1625100 - protein, 5 aa, Staphylococcus aureus
KDQET

SEQ ID NO: 1625101 - protein, 8 aa, Staphylococcus aureus
KDTGKVTV

SEQ ID NO: 1625102 - protein, 26 aa, Staphylococcus aureus
KDVQKTLQNDVDNGSFYKNKDQQVGA

SEQ ID NO: 1625103 - protein, 13 aa, Staphylococcus aureus
KEAGIYELLLTVN

SEQ ID NO: 1625104 - protein, 8 aa, Staphylococcus aureus
KEAYHGGH

SEQ ID NO: 1625105 - protein, 6 aa, Staphylococcus aureus
KEFAQD

SEQ ID NO: 1625106 - protein, 8 aa, Staphylococcus aureus
KEKTNSPY

SEQ ID NO: 1625107 - protein, 24 aa, Staphylococcus aureus
KELYEKTPTADLEDDKPQLPDEDA

SEQ ID NO: 1625108 - protein, 4 aa, Staphylococcus aureus
KENP

SEQ ID NO: 1625109 - protein, 9 aa, Staphylococcus aureus
KEVSNTSIY

SEQ ID NO: 1625110 - protein, 10 aa, Staphylococcus aureus
KEVTTKTTIR

SEQ ID NO: 1625111 - protein, 7 aa, Staphylococcus aureus
KFNDEDL

SEQ ID NO: 1625112 - protein, 4 aa, Staphylococcus aureus
KGEF

SEQ ID NO: 1625113 - protein, 5 aa, Staphylococcus aureus
KGENI

SEQ ID NO: 1625114 - protein, 6 aa, Staphylococcus aureus
KGETRN

SEQ ID NO: 1625115 - protein, 16 aa, Staphylococcus aureus
KGLKSDLEKSKNQKFE

SEQ ID NO: 1625116 - protein, 4 aa, Staphylococcus aureus
KGSG

SEQ ID NO: 1625117 - protein, 8 aa, Staphylococcus aureus
KHAKKAKN

SEQ ID NO: 1625118 - protein, 13 aa, Staphylococcus aureus
KHGVKTKELAGKV

SEQ ID NO: 1625119 - protein, 8 aa, Staphylococcus aureus
KIEHNGRE

SEQ ID NO: 1625120 - protein, 8 aa, Staphylococcus aureus
KINNDPRG

SEQ ID NO: 1625121 - protein, 8 aa, Staphylococcus aureus
KISKTSEI

SEQ ID NO: 1625122 - protein, 5 aa, Staphylococcus aureus
KIVSK

SEQ ID NO: 1625123 - protein, 4 aa, Staphylococcus aureus
KKAL

SEQ ID NO: 1625124 - protein, 13 aa, Staphylococcus aureus
KKASANSKKPRHV

SEQ ID NO: 1625125 - protein, 6 aa, Staphylococcus aureus
KKEDVL

SEQ ID NO: 1625126 - protein, 4 aa, Staphylococcus aureus
KKHL

SEQ ID NO: 1625127 - protein, 6 aa, Staphylococcus aureus
KKHVSD

SEQ ID NO: 1625128 - protein, 13 aa, Staphylococcus aureus
KKIGHTGTLDPEV

SEQ ID NO: 1625129 - protein, 7 aa, Staphylococcus aureus
KKITSEA

SEQ ID NO: 1625130 - protein, 8 aa, Staphylococcus aureus
KKLKATGY

SEQ ID NO: 1625131 - protein, 7 aa, Staphylococcus aureus
KKPELRD

SEQ ID NO: 1625132 - protein, 6 aa, Staphylococcus aureus
KKQALK

SEQ ID NO: 1625133 - protein, 9 aa, Staphylococcus aureus
KKRSLQDER

SEQ ID NO: 1625134 - protein, 13 aa, Staphylococcus aureus
KKSRISHKDKQKY

SEQ ID NO: 1625135 - protein, 6 aa, Staphylococcus aureus
KKTNVL

SEQ ID NO: 1625136 - protein, 10 aa, Staphylococcus aureus
KLASYPGNYE

SEQ ID NO: 1625137 - protein, 7 aa, Staphylococcus aureus
KLEAGTA

SEQ ID NO: 1625138 - protein, 14 aa, Staphylococcus aureus
KLGYDTGESETPIT

SEQ ID NO: 1625139 - protein, 5 aa, Staphylococcus aureus
KLLSE

SEQ ID NO: 1625140 - protein, 6 aa, Staphylococcus aureus
KLNNEI

SEQ ID NO: 1625141 - protein, 4 aa, Staphylococcus aureus
KLSG

SEQ ID NO: 1625142 - protein, 8 aa, Staphylococcus aureus
KNDEERDG

SEQ ID NO: 1625143 - protein, 5 aa, Staphylococcus aureus
KNDKS

SEQ ID NO: 1625144 - protein, 8 aa, Staphylococcus aureus
KNDSPYNS

SEQ ID NO: 1625145 - protein, 7 aa, Staphylococcus aureus
KNGSIKV

SEQ ID NO: 1625146 - protein, 7 aa, Staphylococcus aureus
KNNPTSK

SEQ ID NO: 1625147 - protein, 10 aa, Staphylococcus aureus
KNQLREKARL

SEQ ID NO: 1625148 - protein, 4 aa, Staphylococcus aureus
KNQS

SEQ ID NO: 1625149 - protein, 10 aa, Staphylococcus aureus
KNSKDDYPAT

SEQ ID NO: 1625150 - protein, 17 aa, Staphylococcus aureus
KNYSNGDVSINENVPSY

SEQ ID NO: 1625151 - protein, 8 aa, Staphylococcus aureus
KPIVERTS

SEQ ID NO: 1625152 - protein, 17 aa, Staphylococcus aureus
KPRLTKAKIKISRKLKR

SEQ ID NO: 1625153 - protein, 7 aa, Staphylococcus aureus
KQKDKIK

SEQ ID NO: 1625154 - protein, 13 aa, Staphylococcus aureus
KQKIKAGHESVAG

SEQ ID NO: 1625155 - protein, 18 aa, Staphylococcus aureus
KQSTENYHKRNRRRKAER

SEQ ID NO: 1625156 - protein, 8 aa, Staphylococcus aureus
KREAPPLI

SEQ ID NO: 1625157 - protein, 6 aa, Staphylococcus aureus
KRISNP

SEQ ID NO: 1625158 - protein, 4 aa, Staphylococcus aureus
KSAV

SEQ ID NO: 1625159 - protein, 10 aa, Staphylococcus aureus
KSGTNTTGIQ

SEQ ID NO: 1625160 - protein, 6 aa, Staphylococcus aureus
KSLKQS

SEQ ID NO: 1625161 - protein, 17 aa, Staphylococcus aureus
KSQMSDDEIKRLEEQGL

SEQ ID NO: 1625162 - protein, 8 aa, Staphylococcus aureus
KSRKLTHN

SEQ ID NO: 1625163 - protein, 18 aa, Staphylococcus aureus
KSSINTKKPFYDDINPIE

SEQ ID NO: 1625164 - protein, 12 aa, Staphylococcus aureus
KSSKDANGAISD

SEQ ID NO: 1625165 - protein, 7 aa, Staphylococcus aureus
KTDVQDT

SEQ ID NO: 1625166 - protein, 20 aa, Staphylococcus aureus
KTHAKSTLSRLKKKGKVEME

SEQ ID NO: 1625167 - protein, 25 aa, Staphylococcus aureus
KTHSGSKPTTIKEKKSNTNTVKNAI

SEQ ID NO: 1625168 - protein, 13 aa, Staphylococcus aureus
KTITNKKEDGTKK

SEQ ID NO: 1625169 - protein, 8 aa, Staphylococcus aureus
KTKKYKSD

SEQ ID NO: 1625170 - protein, 9 aa, Staphylococcus aureus
KTKKYKSDI

SEQ ID NO: 1625171 - protein, 4 aa, Staphylococcus aureus
KTPY

SEQ ID NO: 1625172 - protein, 12 aa, Staphylococcus aureus
KTSVSLKRHSDA

SEQ ID NO: 1625173 - protein, 4 aa, Staphylococcus aureus
KTVN

SEQ ID NO: 1625174 - protein, 6 aa, Staphylococcus aureus
KVDEPL

SEQ ID NO: 1625175 - protein, 14 aa, Staphylococcus aureus
KVDKSSSYYHYYGD

SEQ ID NO: 1625176 - protein, 7 aa, Staphylococcus aureus
KVSNVTN

SEQ ID NO: 1625177 - protein, 12 aa, Staphylococcus aureus
KYGSNQKGYKSD

SEQ ID NO: 1625178 - protein, 13 aa, Staphylococcus aureus
KYKGNGAYTSGNH

SEQ ID NO: 1625179 - protein, 5 aa, Staphylococcus aureus
KYQAK

SEQ ID NO: 1625180 - protein, 6 aa, Staphylococcus aureus
KYQDTT

SEQ ID NO: 1625181 - protein, 5 aa, Staphylococcus aureus
LATNG

SEQ ID NO: 1625182 - protein, 9 aa, Staphylococcus aureus
LEAKEENQI

SEQ ID NO: 1625183 - protein, 11 aa, Staphylococcus aureus
LEEVADETIES

SEQ ID NO: 1625184 - protein, 4 aa, Staphylococcus aureus
LEIN

SEQ ID NO: 1625185 - protein, 17 aa, Staphylococcus aureus
LEQKEKGHSIEEQERKL

SEQ ID NO: 1625186 - protein, 6 aa, Staphylococcus aureus
LESAKR

SEQ ID NO: 1625187 - protein, 14 aa, Staphylococcus aureus
LETEDGSKINPTLS

SEQ ID NO: 1625188 - protein, 29 aa, Staphylococcus aureus
LGNDEPTTIDTANSKPAKAVKKPLPSKDN

SEQ ID NO: 1625189 - protein, 14 aa, Staphylococcus aureus
LKAETFEKEMPQTK

SEQ ID NO: 1625190 - protein, 11 aa, Staphylococcus aureus
LKDKNNTEIYD

SEQ ID NO: 1625191 - protein, 14 aa, Staphylococcus aureus
LKDREEYKKQRDEL

SEQ ID NO: 1625192 - protein, 8 aa, Staphylococcus aureus
LKKEKPDL

SEQ ID NO: 1625193 - protein, 10 aa, Staphylococcus aureus
LKKGLDSLNA

SEQ ID NO: 1625194 - protein, 11 aa, Staphylococcus aureus
LKNKPDKSTIT

SEQ ID NO: 1625195 - protein, 6 aa, Staphylococcus aureus
LKNSDN

SEQ ID NO: 1625196 - protein, 5 aa, Staphylococcus aureus
LKSTL

SEQ ID NO: 1625197 - protein, 10 aa, Staphylococcus aureus
LNDSSNDEQI

SEQ ID NO: 1625198 - protein, 11 aa, Staphylococcus aureus
LNGSSKYFDRR

SEQ ID NO: 1625199 - protein, 4 aa, Staphylococcus aureus
LNNK

SEQ ID NO: 1625200 - protein, 65 aa, Staphylococcus aureus; identical to SEQ ID NO: 1568234

SEQ ID NO: 1625201 - protein, 11 aa, Staphylococcus aureus
LNQPDAADELE

SEQ ID NO: 1625202 - protein, 11 aa, Staphylococcus aureus
LNQSRNFAQNT

SEQ ID NO: 1625203 - protein, 12 aa, Staphylococcus aureus
LPDNRKKKRTDL

SEQ ID NO: 1625204 - protein, 10 aa, Staphylococcus aureus
LPSEVSGGQL

SEQ ID NO: 1625205 - protein, 6 aa, Staphylococcus aureus
LPTARK

SEQ ID NO: 1625206 - protein, 18 aa, Staphylococcus aureus
LQSQYDKEASIKYGHTKA

SEQ ID NO: 1625207 - protein, 10 aa, Staphylococcus aureus
LRDGEQTPGV

SEQ ID NO: 1625208 - protein, 15 aa, Staphylococcus aureus
LRERNKELEKKASAW

SEQ ID NO: 1625209 - protein, 7 aa, Staphylococcus aureus
LSEKNGE

SEQ ID NO: 1625210 - protein, 5 aa, Staphylococcus aureus
LSGPD

SEQ ID NO: 1625211 - protein, 8 aa, Staphylococcus aureus
LSGSKGSL

SEQ ID NO: 1625212 - protein, 5 aa, Staphylococcus aureus
LSKGL

SEQ ID NO: 1625213 - protein, 20 aa, Staphylococcus aureus
LSKYKDGDISYNPEVPSYSA

SEQ ID NO: 1625214 - protein, 6 aa, Staphylococcus aureus
LSNEGL

SEQ ID NO: 1625215 - protein, 6 aa, Staphylococcus aureus
LSPTKQ

SEQ ID NO: 1625216 - protein, 11 aa, Staphylococcus aureus
LSRDDNFKQFD

SEQ ID NO: 1625217 - protein, 13 aa, Staphylococcus aureus
LSVEAGQILTVEF

SEQ ID NO: 1625218 - protein, 4 aa, Staphylococcus aureus
LTMP

SEQ ID NO: 1625219 - protein, 5 aa, Staphylococcus aureus
LTPKK

SEQ ID NO: 1625220 - protein, 10 aa, Staphylococcus aureus
MATQNKGEAL

SEQ ID NO: 1625221 - protein, 7 aa, Staphylococcus aureus
MKLSGTV

SEQ ID NO: 1625222 - protein, 7 aa, Staphylococcus aureus
MNGNYTR

SEQ ID NO: 1625223 - protein, 10 aa, Staphylococcus aureus
MQDKKAKLNP

SEQ ID NO: 1625224 - protein, 7 aa, Staphylococcus aureus
MRHSDGQ

SEQ ID NO: 1625225 - protein, 5 aa, Staphylococcus aureus
MSNTL

SEQ ID NO: 1625226 - protein, 19 aa, Staphylococcus aureus
MTKPETTSNELDLSANDEL

SEQ ID NO: 1625227 - protein, 15 aa, Staphylococcus aureus
NAQQPERGKIYDRNG

SEQ ID NO: 1625228 - protein, 7 aa, Staphylococcus aureus
NDDEFYS

SEQ ID NO: 1625229 - protein, 5 aa, Staphylococcus aureus
NDGVP

SEQ ID NO: 1625230 - protein, 7 aa, Staphylococcus aureus
NDLKEGD

SEQ ID NO: 1625231 - protein, 6 aa, Staphylococcus aureus
NDPEYV

SEQ ID NO: 1625232 - protein, 5 aa, Staphylococcus aureus
NDSMT

SEQ ID NO: 1625233 - protein, 10 aa, Staphylococcus aureus
NEDTKIATIQ

SEQ ID NO: 1625234 - protein, 5 aa, Staphylococcus aureus
NEINS

SEQ ID NO: 1625235 - protein, 9 aa, Staphylococcus aureus
NFPGIGPVP

SEQ ID NO: 1625236 - protein, 6 aa, Staphylococcus aureus
NGIKTH

SEQ ID NO: 1625237 - protein, 10 aa, Staphylococcus aureus
NGKGVQAKQL

SEQ ID NO: 1625238 - protein, 7 aa, Staphylococcus aureus
NGNVPGN

SEQ ID NO: 1625239 - protein, 6 aa, Staphylococcus aureus
NGSGLA

SEQ ID NO: 1625240 - protein, 6 aa, Staphylococcus aureus
NGVNGV

SEQ ID NO: 1625241 - protein, 11 aa, Staphylococcus aureus
NHHPRKSLGYR

SEQ ID NO: 1625242 - protein, 6 aa, Staphylococcus aureus
NISKQD

SEQ ID NO: 1625243 - protein, 10 aa, Staphylococcus aureus
NKDSAIGNLA

SEQ ID NO: 1625244 - protein, 10 aa, Staphylococcus aureus
NKGWTSPAKA

SEQ ID NO: 1625245 - protein, 12 aa, Staphylococcus aureus
NKKGYKSKEPLD

SEQ ID NO: 1625246 - protein, 6 aa, Staphylococcus aureus
NKMNNQ

SEQ ID NO: 1625247 - protein, 12 aa, Staphylococcus aureus
NKQKIMSSDKTI

SEQ ID NO: 1625248 - protein, 8 aa, Staphylococcus aureus
NKQSQELL

SEQ ID NO: 1625249 - protein, 8 aa, Staphylococcus aureus
NKSYTRYK

SEQ ID NO: 1625250 - protein, 9 aa, Staphylococcus aureus
NKTAGQTQK

SEQ ID NO: 1625251 - protein, 6 aa, Staphylococcus aureus
NKVDND

SEQ ID NO: 1625252 - protein, 6 aa, Staphylococcus aureus
NKVTAK

SEQ ID NO: 1625253 - protein, 10 aa, Staphylococcus aureus
NLSSNKEEFG

SEQ ID NO: 1625254 - protein, 5 aa, Staphylococcus aureus
NLTVE

SEQ ID NO: 1625255 - protein, 7 aa, Staphylococcus aureus
NNDSTSF

SEQ ID NO: 1625256 - protein, 7 aa, Staphylococcus aureus
NNEEVKA

SEQ ID NO: 1625257 - protein, 7 aa, Staphylococcus aureus
NNFPDYE

SEQ ID NO: 1625258 - protein, 5 aa, Staphylococcus aureus
NNLDS

SEQ ID NO: 1625259 - protein, 10 aa, Staphylococcus aureus
NNVDRNKLSR

SEQ ID NO: 1625260 - protein, 25 aa, Staphylococcus aureus
NNVNSAKHALNGTQNLNNAKQAAIT

SEQ ID NO: 1625261 - protein, 27 aa, Staphylococcus aureus
NNVQGCSDMGSMPDKITGYQSIEADDI

SEQ ID NO: 1625262 - protein, 14 aa, Staphylococcus aureus
NPILTDKEKQALKD

SEQ ID NO: 1625263 - protein, 9 aa, Staphylococcus aureus
NPKQKDNKV

SEQ ID NO: 1625264 - protein, 5 aa, Staphylococcus aureus
NPQEL

SEQ ID NO: 1625265 - protein, 4 aa, Staphylococcus aureus
NPQN

SEQ ID NO: 1625266 - protein, 9 aa, Staphylococcus aureus
NPTKEQDSN

SEQ ID NO: 1625267 - protein, 22 aa, Staphylococcus aureus
NQDNKTLKDMTKSGKQRPWREK

SEQ ID NO: 1625268 - protein, 5 aa, Staphylococcus aureus
NQFAK

SEQ ID NO: 1625269 - protein, 13 aa, Staphylococcus aureus
NQITEITSSKRYG

SEQ ID NO: 1625270 - protein, 10 aa, Staphylococcus aureus
NQKEHSTIHT

SEQ ID NO: 1625271 - protein, 7 aa, Staphylococcus aureus
NQNDIDE

SEQ ID NO: 1625272 - protein, 13 aa, Staphylococcus aureus
NQTTNPMLNPDDI

SEQ ID NO: 1625273 - protein, 8 aa, Staphylococcus aureus
NREEREAV

SEQ ID NO: 1625274 - protein, 10 aa, Staphylococcus aureus
NRLSEDKDKE

SEQ ID NO: 1625275 - protein, 6 aa, Staphylococcus aureus
NRLTDS

SEQ ID NO: 1625276 - protein, 26 aa, Staphylococcus aureus
NRSLNTNNLTGKVNVNSKELKNYSVE

SEQ ID NO: 1625277 - protein, 9 aa, Staphylococcus aureus
NSDDAWSET

SEQ ID NO: 1625278 - protein, 9 aa, Staphylococcus aureus
NSFSKNNQY

SEQ ID NO: 1625279 - protein, 6 aa, Staphylococcus aureus
NSNDAV

SEQ ID NO: 1625280 - protein, 7 aa, Staphylococcus aureus
NSNDDIS

SEQ ID NO: 1625281 - protein, 9 aa, Staphylococcus aureus
NSWTGSPGR

SEQ ID NO: 1625282 - protein, 6 aa, Staphylococcus aureus
NTDKHG

SEQ ID NO: 1625283 - protein, 9 aa, Staphylococcus aureus
NTKAQKMHS

SEQ ID NO: 1625284 - protein, 5 aa, Staphylococcus aureus
NTPFE

SEQ ID NO: 1625285 - protein, 7 aa, Staphylococcus aureus
NTQGIND

SEQ ID NO: 1625286 - protein, 8 aa, Staphylococcus aureus
NTRTTKGE

SEQ ID NO: 1625287 - protein, 12 aa, Staphylococcus aureus
NVPYEQETEKVG

SEQ ID NO: 1625288 - protein, 13 aa, Staphylococcus aureus
NVSENDNANQPHS

SEQ ID NO: 1625289 - protein, 12 aa, Staphylococcus aureus
PAGEERPLPTTA

SEQ ID NO: 1625290 - protein, 5 aa, Staphylococcus aureus
PAHHK

SEQ ID NO: 1625291 - protein, 7 aa, Staphylococcus aureus
PDSGTRI

SEQ ID NO: 1625292 - protein, 7 aa, Staphylococcus aureus
PEDGSLQ

SEQ ID NO: 1625293 - protein, 12 aa, Staphylococcus aureus
PEEIEKRLSQKK

SEQ ID NO: 1625294 - protein, 10 aa, Staphylococcus aureus
PELRGQKLGR

SEQ ID NO: 1625295 - protein, 4 aa, Staphylococcus aureus
PFNN

SEQ ID NO: 1625296 - protein, 13 aa, Staphylococcus aureus
PFTGEKNKKRKKK

SEQ ID NO: 1625297 - protein, 5 aa, Staphylococcus aureus
PGDPL

SEQ ID NO: 1625298 - protein, 5 aa, Staphylococcus aureus
PGKRV

SEQ ID NO: 1625299 - protein, 5 aa, Staphylococcus aureus
PHPSA

SEQ ID NO: 1625300 - protein, 4 aa, Staphylococcus aureus
PKEM

SEQ ID NO: 1625301 - protein, 11 aa, Staphylococcus aureus
PKFGTTDGTIT

SEQ ID NO: 1625302 - protein, 4 aa, Staphylococcus aureus
PKGI

SEQ ID NO: 1625303 - protein, 10 aa, Staphylococcus aureus
PKHNSNKADE

SEQ ID NO: 1625304 - protein, 7 aa, Staphylococcus aureus
PKPKVNS

SEQ ID NO: 1625305 - protein, 9 aa, Staphylococcus aureus
PKTESSIGK

SEQ ID NO: 1625306 - protein, 16 aa, Staphylococcus aureus
PMGSPRPRFSTKGRYA

SEQ ID NO: 1625307 - protein, 7 aa, Staphylococcus aureus
PTGMEIT

SEQ ID NO: 1625308 - protein, 7 aa, Staphylococcus aureus
PTKNAAS

SEQ ID NO: 1625309 - protein, 9 aa, Staphylococcus aureus
PTQKLTKSQ

SEQ ID NO: 1625310 - protein, 12 aa, Staphylococcus aureus
PTRNNKKNDITS

SEQ ID NO: 1625311 - protein, 4 aa, Staphylococcus aureus
PYTN

SEQ ID NO: 1625312 - protein, 4 aa, Staphylococcus aureus
PYTR

SEQ ID NO: 1625313 - protein, 9 aa, Staphylococcus aureus
QAHGRERKG

SEQ ID NO: 1625314 - protein, 6 aa, Staphylococcus aureus
QALTQK

SEQ ID NO: 1625315 - protein, 21 aa, Staphylococcus aureus
QDDNPDFESGEITQELQKGYK

SEQ ID NO: 1625316 - protein, 8 aa, Staphylococcus aureus
QDPAARST

SEQ ID NO: 1625317 - protein, 10 aa, Staphylococcus aureus
QDYVPVSQPQ

SEQ ID NO: 1625318 - protein, 24 aa, Staphylococcus aureus
QEITGNEGRTKGSTNYVNADTQVK

SEQ ID NO: 1625319 - protein, 24 aa, Staphylococcus aureus
QETDSSDTSYSSDTSYSSDTSYSS

SEQ ID NO: 1625320 - protein, 7 aa, Staphylococcus aureus
QETGGLH

SEQ ID NO: 1625321 - protein, 14 aa, Staphylococcus aureus
QETKTFQTSLNPSI

SEQ ID NO: 1625322 - protein, 14 aa, Staphylococcus aureus
QETKTFQTSLTPSI

SEQ ID NO: 1625323 - protein, 5 aa, Staphylococcus aureus
QFNNS

SEQ ID NO: 1625324 - protein, 12 aa, Staphylococcus aureus
QGEDISTKKMSD

SEQ ID NO: 1625325 - protein, 5 aa, Staphylococcus aureus
QGKST

SEQ ID NO: 1625326 - protein, 22 aa, Staphylococcus aureus
QITSGNERISSVNGPPGTGKTT

SEQ ID NO: 1625327 - protein, 5 aa, Staphylococcus aureus
QKNHP

SEQ ID NO: 1625328 - protein, 10 aa, Staphylococcus aureus
QKRATAQGNM

SEQ ID NO: 1625329 - protein, 8 aa, Staphylococcus aureus
QKRIEDGV

SEQ ID NO: 1625330 - protein, 13 aa, Staphylococcus aureus
QLKRGTDKNNLRG

SEQ ID NO: 1625331 - protein, 14 aa, Staphylococcus aureus
QLPTEQVNEAREKA

SEQ ID NO: 1625332 - protein, 9 aa, Staphylococcus aureus
QNGDYQPTV

SEQ ID NO: 1625333 - protein, 8 aa, Staphylococcus aureus
QNNGQPVI

SEQ ID NO: 1625334 - protein, 6 aa, Staphylococcus aureus
QNPPKR

SEQ ID NO: 1625335 - protein, 183 aa, Staphylococcus aureus
QNQLTTKIDSNSESLKAIQTSQEAIQEAQASQAKVLAESSNKVENNTATDEKAESKDSKVAGVNTSTDAKTDTKAENAGDGTATKVDKEDQISATEAIEKASVEQPKNDKAAETSNKEATVDAEAQHDAEQQVAEAHAEASKQATSNDSLEAKAENDSTASQSEMSEPKPQEEKKGFFARLFN

SEQ ID NO: 1625336 - protein, 7 aa, Staphylococcus aureus
QPFTTED

SEQ ID NO: 1625337 - protein, 7 aa, Staphylococcus aureus
QQNDKKM

SEQ ID NO: 1625338 - protein, 12 aa, Staphylococcus aureus
QRASQSSIENLP

SEQ ID NO: 1625339 - protein, 16 aa, Staphylococcus aureus
QRPTFNPETGKDFGKK

SEQ ID NO: 1625340 - protein, 4 aa, Staphylococcus aureus
QSGI

SEQ ID NO: 1625341 - protein, 7 aa, Staphylococcus aureus
QSGLAPE

SEQ ID NO: 1625342 - protein, 8 aa, Staphylococcus aureus
QSTLQDRR

SEQ ID NO: 1625343 - protein, 6 aa, Staphylococcus aureus
QTLAGL

SEQ ID NO: 1625344 - protein, 5 aa, Staphylococcus aureus
QTLSY

SEQ ID NO: 1625345 - protein, 4 aa, Staphylococcus aureus
QTPY

SEQ ID NO: 1625346 - protein, 12 aa, Staphylococcus aureus
QTVRDNAQTLNT

SEQ ID NO: 1625347 - protein, 12 aa, Staphylococcus aureus
QVVAEGEKIPTD

SEQ ID NO: 1625348 - protein, 6 aa, Staphylococcus aureus
QYSQSL

SEQ ID NO: 1625349 - protein, 11 aa, Staphylococcus aureus
RAAPAEGDGEI

SEQ ID NO: 1625350 - protein, 17 aa, Staphylococcus aureus
RAPGSVGMASDASRVFK

SEQ ID NO: 1625351 - protein, 6 aa, Staphylococcus aureus
RDEDID

SEQ ID NO: 1625352 - protein, 11 aa, Staphylococcus aureus
REEAYDKVQPK

SEQ ID NO: 1625353 - protein, 7 aa, Staphylococcus aureus
REELGMT

SEQ ID NO: 1625354 - protein, 4 aa, Staphylococcus aureus
REGN

SEQ ID NO: 1625355 - protein, 9 aa, Staphylococcus aureus
RGKKPIQRN

SEQ ID NO: 1625356 - protein, 7 aa, Staphylococcus aureus
RIPQNDI

SEQ ID NO: 1625357 - protein, 6 aa, Staphylococcus aureus
RKIDRA

SEQ ID NO: 1625358 - protein, 12 aa, Staphylococcus aureus
RKLPGLSERERK

SEQ ID NO: 1625359 - protein, 21 aa, Staphylococcus aureus
RKQGGRHKGPPPFTKQDQKVF

SEQ ID NO: 1625360 - protein, 5 aa, Staphylococcus aureus
RLDDA

SEQ ID NO: 1625361 - protein, 5 aa, Staphylococcus aureus
RPEDL

SEQ ID NO: 1625362 - protein, 15 aa, Staphylococcus aureus
RPIEEKEDFETGGNV

SEQ ID NO: 1625363 - protein, 10 aa, Staphylococcus aureus
RQPQMGETIN

SEQ ID NO: 1625364 - protein, 6 aa, Staphylococcus aureus
RRDDVT

SEQ ID NO: 1625365 - protein, 4 aa, Staphylococcus aureus
RRPT

SEQ ID NO: 1625366 - protein, 12 aa, Staphylococcus aureus
RRSTEALYEQQQ

SEQ ID NO: 1625367 - protein, 26 aa, Staphylococcus aureus
RSSAGRIAARARGRYGGRPEKLNQKD

SEQ ID NO: 1625368 - protein, 5 aa, Staphylococcus aureus
RSYEG

SEQ ID NO: 1625369 - protein, 4 aa, Staphylococcus aureus
RSYT

SEQ ID NO: 1625370 - protein, 5 aa, Staphylococcus aureus
RTNGF

SEQ ID NO: 1625371 - protein, 14 aa, Staphylococcus aureus
RYDKTKLDLNDKES

SEQ ID NO: 1625372 - protein, 9 aa, Staphylococcus aureus
RYTKRSQLR

SEQ ID NO: 1625373 - protein, 7 aa, Staphylococcus aureus
SAKSNIG

SEQ ID NO: 1625374 - protein, 9 aa, Staphylococcus aureus
SAQTEEMGE

SEQ ID NO: 1625375 - protein, 9 aa, Staphylococcus aureus
SDEYNGPDM

SEQ ID NO: 1625376 - protein, 7 aa, Staphylococcus aureus
SDIRNGH

SEQ ID NO: 1625377 - protein, 30 aa, Staphylococcus aureus
SDKTSVDSASTRGPTPSDEKPSIVTETSPF

SEQ ID NO: 1625378 - protein, 7 aa, Staphylococcus aureus
SDLPQPE

SEQ ID NO: 1625379 - protein, 4 aa, Staphylococcus aureus
SDND

SEQ ID NO: 1625380 - protein, 9 aa, Staphylococcus aureus
SDNNGLKSP

SEQ ID NO: 1625381 - protein, 9 aa, Staphylococcus aureus
SDQPAPPHH

SEQ ID NO: 1625382 - protein, 9 aa, Staphylococcus aureus
SEAGRTDNV

SEQ ID NO: 1625383 - protein, 11 aa, Staphylococcus aureus
SEGDKDALHTQ

SEQ ID NO: 1625384 - protein, 14 aa, Staphylococcus aureus
SEIDSIKDDLKKIN

SEQ ID NO: 1625385 - protein, 8 aa, Staphylococcus aureus
SELSGGQL

SEQ ID NO: 1625386 - protein, 7 aa, Staphylococcus aureus
SENNEAT

SEQ ID NO: 1625387 - protein, 11 aa, Staphylococcus aureus
SETIDTPVQTL

SEQ ID NO: 1625388 - protein, 8 aa, Staphylococcus aureus
SGEMTYGN

SEQ ID NO: 1625389 - protein, 7 aa, Staphylococcus aureus
SGENELK

SEQ ID NO: 1625390 - protein, 9 aa, Staphylococcus aureus
SGSTGNATF

SEQ ID NO: 1625391 - protein, 12 aa, Staphylococcus aureus
SGYGDPQGEQVR

SEQ ID NO: 1625392 - protein, 13 aa, Staphylococcus aureus
SGYKRNYSPLDGV

SEQ ID NO: 1625393 - protein, 8 aa, Staphylococcus aureus
SHKDDRER

SEQ ID NO: 1625394 - protein, 9 aa, Staphylococcus aureus
SIARSGKGT

SEQ ID NO: 1625395 - protein, 12 aa, Staphylococcus aureus
SINASLNNKTIS

SEQ ID NO: 1625396 - protein, 14 aa, Staphylococcus aureus
SKAVKITKGSGSLE

SEQ ID NO: 1625397 - protein, 11 aa, Staphylococcus aureus
SKDQQASSAAT

SEQ ID NO: 1625398 - protein, 4 aa, Staphylococcus aureus
SKDR

SEQ ID NO: 1625399 - protein, 7 aa, Staphylococcus aureus
SKFNNRK

SEQ ID NO: 1625400 - protein, 6 aa, Staphylococcus aureus
SKGIEP

SEQ ID NO: 1625401 - protein, 6 aa, Staphylococcus aureus
SKKDGL

SEQ ID NO: 1625402 - protein, 4 aa, Staphylococcus aureus
SKKE

SEQ ID NO: 1625403 - protein, 9 aa, Staphylococcus aureus
SKKSHAANY

SEQ ID NO: 1625404 - protein, 7 aa, Staphylococcus aureus
SKPTYAR

SEQ ID NO: 1625405 - protein, 5 aa, Staphylococcus aureus
SLEKQ

SEQ ID NO: 1625406 - protein, 5 aa, Staphylococcus aureus
SLNTL

SEQ ID NO: 1625407 - protein, 8 aa, Staphylococcus aureus
SLVESPSK

SEQ ID NO: 1625408 - protein, 4 aa, Staphylococcus aureus
SNEN

SEQ ID NO: 1625409 - protein, 8 aa, Staphylococcus aureus
SNGDFTPS

SEQ ID NO: 1625410 - protein, 13 aa, Staphylococcus aureus
SNQAEKEFGGDSD

SEQ ID NO: 1625411 - protein, 4 aa, Staphylococcus aureus
SNYR

SEQ ID NO: 1625412 - protein, 4 aa, Staphylococcus aureus
SPDG

SEQ ID NO: 1625413 - protein, 15 aa, Staphylococcus aureus
SPEKVLPLSKKCIST

SEQ ID NO: 1625414 - protein, 6 aa, Staphylococcus aureus
SPGEVN

SEQ ID NO: 1625415 - protein, 4 aa, Staphylococcus aureus
SPIN

SEQ ID NO: 1625416 - protein, 16 aa, Staphylococcus aureus
SQHKAVRAQQNGEFDS

SEQ ID NO: 1625417 - protein, 9 aa, Staphylococcus aureus
SQKATANKV

SEQ ID NO: 1625418 - protein, 4 aa, Staphylococcus aureus
SQQQ

SEQ ID NO: 1625419 - protein, 10 aa, Staphylococcus aureus
SQWATPNEHK

SEQ ID NO: 1625420 - protein, 13 aa, Staphylococcus aureus
SRTNGLKLTPREN

SEQ ID NO: 1625421 - protein, 28 aa, Staphylococcus aureus
SRYDNSLEKSKIKVEGLSKKQKVQAQIT

SEQ ID NO: 1625422 - protein, 6 aa, Staphylococcus aureus
SSGLPH

SEQ ID NO: 1625423 - protein, 17 aa, Staphylococcus aureus
SSGQHSSYFERYLYPIK

SEQ ID NO: 1625424 - protein, 6 aa, Staphylococcus aureus
SSNLDA

SEQ ID NO: 1625425 - protein, 9 aa, Staphylococcus aureus
SSTDSAHLA

SEQ ID NO: 1625426 - protein, 19 aa, Staphylococcus aureus
SSVEKGDKVSREKMHNAST

SEQ ID NO: 1625427 - protein, 9 aa, Staphylococcus aureus
SSVRAREKA

SEQ ID NO: 1625428 - protein, 16 aa, Staphylococcus aureus
STDNASWGVGPNTENF

SEQ ID NO: 1625429 - protein, 5 aa, Staphylococcus aureus
STGEP

SEQ ID NO: 1625430 - protein, 6 aa, Staphylococcus aureus
STGLPH

SEQ ID NO: 1625431 - protein, 16 aa, Staphylococcus aureus
STYRAQNRGGRGVQGM

SEQ ID NO: 1625432 - protein, 16 aa, Staphylococcus aureus
SVDSRTILDSGGAERL

SEQ ID NO: 1625433 - protein, 9 aa, Staphylococcus aureus
SVENPHIAT

SEQ ID NO: 1625434 - protein, 15 aa, Staphylococcus aureus
SVSSDKEQHIFSTYH

SEQ ID NO: 1625435 - protein, 9 aa, Staphylococcus aureus
TAEPDAQLD

SEQ ID NO: 1625436 - protein, 10 aa, Staphylococcus aureus
TAKPYAPGKF

SEQ ID NO: 1625437 - protein, 13 aa, Staphylococcus aureus
TDAVEKTTGANRQ

SEQ ID NO: 1625438 - protein, 7 aa, Staphylococcus aureus
TDETTVT

SEQ ID NO: 1625439 - protein, 14 aa, Staphylococcus aureus
TDKWESKRGNTTWG

SEQ ID NO: 1625440 - protein, 5 aa, Staphylococcus aureus
TDQGG

SEQ ID NO: 1625441 - protein, 5 aa, Staphylococcus aureus
TDQPL

SEQ ID NO: 1625442 - protein, 8 aa, Staphylococcus aureus
TEAGEIYT

SEQ ID NO: 1625443 - protein, 16 aa, Staphylococcus aureus
TEESKRFSDFPKDYKG

SEQ ID NO: 1625444 - protein, 8 aa, Staphylococcus aureus
TEKPFKRS

SEQ ID NO: 1625445 - protein, 7 aa, Staphylococcus aureus
TEKQCQD

SEQ ID NO: 1625446 - protein, 6 aa, Staphylococcus aureus
TEQKKQ

SEQ ID NO: 1625447 - protein, 11 aa, Staphylococcus aureus
TETKSVPEEME

SEQ ID NO: 1625448 - protein, 5 aa, Staphylococcus aureus
TEYPG

SEQ ID NO: 1625449 - protein, 9 aa, Staphylococcus aureus
TFKEEELEP

SEQ ID NO: 1625450 - protein, 7 aa, Staphylococcus aureus
TGGKKMT

SEQ ID NO: 1625451 - protein, 7 aa, Staphylococcus aureus
TGQWGKK

SEQ ID NO: 1625452 - protein, 16 aa, Staphylococcus aureus
TGRGTVATGRVERGQI

SEQ ID NO: 1625453 - protein, 10 aa, Staphylococcus aureus
THLEQPQKYK

SEQ ID NO: 1625454 - protein, 11 aa, Staphylococcus aureus
TISKSKNEDMM

SEQ ID NO: 1625455 - protein, 6 aa, Staphylococcus aureus
TKDKEF

SEQ ID NO: 1625456 - protein, 6 aa, Staphylococcus aureus
TKEDVP

SEQ ID NO: 1625457 - protein, 9 aa, Staphylococcus aureus
TKKREAKIR

SEQ ID NO: 1625458 - protein, 9 aa, Staphylococcus aureus
TKPIADDKL

SEQ ID NO: 1625459 - protein, 16 aa, Staphylococcus aureus
TKSPDEIKEELDKKEG

SEQ ID NO: 1625460 - protein, 6 aa, Staphylococcus aureus
TLPKKD

SEQ ID NO: 1625461 - protein, 12 aa, Staphylococcus aureus
TNVTNKETTTSM

SEQ ID NO: 1625462 - protein, 12 aa, Staphylococcus aureus
TPKERNDALNTE

SEQ ID NO: 1625463 - protein, 19 aa, Staphylococcus aureus
TPSNSKKVYTRSITNGRLD

SEQ ID NO: 1625464 - protein, 4 aa, Staphylococcus aureus
TREL

SEQ ID NO: 1625465 - protein, 19 aa, Staphylococcus aureus
TRLKQNKQQIAHEENRRNQ

SEQ ID NO: 1625466 - protein, 6 aa, Staphylococcus aureus
TSGYET

SEQ ID NO: 1625467 - protein, 8 aa, Staphylococcus aureus
TSPTPDKI

SEQ ID NO: 1625468 - protein, 8 aa, Staphylococcus aureus
TSSRKERE

SEQ ID NO: 1625469 - protein, 6 aa, Staphylococcus aureus
TSSRSK

SEQ ID NO: 1625470 - protein, 9 aa, Staphylococcus aureus
TTEGNRNNA

SEQ ID NO: 1625471 - protein, 9 aa, Staphylococcus aureus
TTGGKKMTN

SEQ ID NO: 1625472 - protein, 5 aa, Staphylococcus aureus
TTGTS

SEQ ID NO: 1625473 - protein, 8 aa, Staphylococcus aureus
TTIKNGQN

SEQ ID NO: 1625474 - protein, 4 aa, Staphylococcus aureus
TYGT

SEQ ID NO: 1625475 - protein, 5 aa, Staphylococcus aureus
TYPRI

SEQ ID NO: 1625476 - protein, 32 aa, Staphylococcus aureus; identical to SEQ ID NO: 1566302

SEQ ID NO: 1625477 - protein, 4 aa, Staphylococcus aureus
VDAR

SEQ ID NO: 1625478 - protein, 7 aa, Staphylococcus aureus
VDSTNGT

SEQ ID NO: 1625479 - protein, 14 aa, Staphylococcus aureus
VEESQRIEVDENKE

SEQ ID NO: 1625480 - protein, 6 aa, Staphylococcus aureus
VEPNEG

SEQ ID NO: 1625481 - protein, 7 aa, Staphylococcus aureus
VERQTQQ

SEQ ID NO: 1625482 - protein, 7 aa, Staphylococcus aureus
VGAADIP

SEQ ID NO: 1625483 - protein, 6 aa, Staphylococcus aureus
VGERLN

SEQ ID NO: 1625484 - protein, 16 aa, Staphylococcus aureus
VGERLNAEVGSKAYGS

SEQ ID NO: 1625485 - protein, 10 aa, Staphylococcus aureus
VGGAGPQHRE

SEQ ID NO: 1625486 - protein, 6 aa, Staphylococcus aureus
VGLSPT

SEQ ID NO: 1625487 - protein, 16 aa, Staphylococcus aureus
VGMSEEEAKNSGRNIK

SEQ ID NO: 1625488 - protein, 8 aa, Staphylococcus aureus
VGTGASDI

SEQ ID NO: 1625489 - protein, 10 aa, Staphylococcus aureus
VGTGEQKINL

SEQ ID NO: 1625490 - protein, 27 aa, Staphylococcus aureus
VKEDADEVNEDEQSTVSEDGTEQQREA

SEQ ID NO: 1625491 - protein, 21 aa, Staphylococcus aureus
VKEPKPVDATGAVDPLKPDDR

SEQ ID NO: 1625492 - protein, 12 aa, Staphylococcus aureus
VKNGEIDSIYWD

SEQ ID NO: 1625493 - protein, 10 aa, Staphylococcus aureus
VKSGGPELAK

SEQ ID NO: 1625494 - protein, 7 aa, Staphylococcus aureus
VNPNTDA

SEQ ID NO: 1625495 - protein, 8 aa, Staphylococcus aureus
VPNEGRSV

SEQ ID NO: 1625496 - protein, 15 aa, Staphylococcus aureus
VPYAGSSDIDGLPQD

SEQ ID NO: 1625497 - protein, 18 aa, Staphylococcus aureus
VQRENNNYENEDIDHSKT

SEQ ID NO: 1625498 - protein, 4 aa, Staphylococcus aureus
VRKV

SEQ ID NO: 1625499 - protein, 6 aa, Staphylococcus aureus
VSSENN

SEQ ID NO: 1625500 - protein, 6 aa, Staphylococcus aureus
VTGKDL

SEQ ID NO: 1625501 - protein, 12 aa, Staphylococcus aureus
VTLRETGRLGDL

SEQ ID NO: 1625502 - protein, 5 aa, Staphylococcus aureus
VTNNG

SEQ ID NO: 1625503 - protein, 10 aa, Staphylococcus aureus
VVHGSDRTLD

SEQ ID NO: 1625504 - protein, 12 aa, Staphylococcus aureus
VVSDREGKKYLI

SEQ ID NO: 1625505 - protein, 32 aa, Staphylococcus aureus
WDGDDEELDKAVKDVSNANPNHTVIVDDIPLE

SEQ ID NO: 1625506 - protein, 7 aa, Staphylococcus aureus
WNPVTKE

SEQ ID NO: 1625507 - protein, 27 aa, Staphylococcus aureus
WPTSSKEESKTKRLADKQGDPEEKPGI

SEQ ID NO: 1625508 - protein, 12 aa, Staphylococcus aureus
WTNKDKIEGSLE

SEQ ID NO: 1625509 - protein, 12 aa, Staphylococcus aureus
YASSNIKSKQAP

SEQ ID NO: 1625510 - protein, 6 aa, Staphylococcus aureus
YDEKQE

SEQ ID NO: 1625511 - protein, 8 aa, Staphylococcus aureus
YDETGTDV

SEQ ID NO: 1625512 - protein, 14 aa, Staphylococcus aureus
YDGEELNKSLSDMA

SEQ ID NO: 1625513 - protein, 34 aa, Staphylococcus aureus
YESYKKSLDKNKSTLKQQSKSSTTVRKKNGLSYK

SEQ ID NO: 1625514 - protein, 24 aa, Staphylococcus aureus
YGQNWNGKGWTNGVAQPGWGPETV

SEQ ID NO: 1625515 - protein, 8 aa, Staphylococcus aureus
YGYPQEAT

SEQ ID NO: 1625516 - protein, 13 aa, Staphylococcus aureus
YHSKGLESWKEKN

SEQ ID NO: 1625517 - protein, 4 aa, Staphylococcus aureus
YKAG

SEQ ID NO: 1625518 - protein, 9 aa, Staphylococcus aureus
YKNMPSKTQ

SEQ ID NO: 1625519 - protein, 4 aa, Staphylococcus aureus
YKVS

SEQ ID NO: 1625520 - protein, 11 aa, Staphylococcus aureus
YQQRNNKDENL

SEQ ID NO: 1625521 - protein, 10 aa, Staphylococcus aureus
YQRQLSRNEA

SEQ ID NO: 1625522 - protein, 9 aa, Staphylococcus aureus
YQVTTGEPV

SEQ ID NO: 1625523 - protein, 5 aa, Staphylococcus aureus
YSQSL

SEQ ID NO: 1625524 - protein, 10 aa, Staphylococcus aureus
YTNSSNLSEP

SEQ ID NO: 1625525 - protein, 4 aa, Staphylococcus aureus
YTQN

SEQ ID NO: 1625526 - protein, 4 aa, Staphylococcus aureus
AAEI

SEQ ID NO: 1625527 - protein, 21 aa, Staphylococcus aureus
AAEIRSEKSIAKSCSVSATTV

SEQ ID NO: 1625528 - protein, 4 aa, Staphylococcus aureus
AAYE

SEQ ID NO: 1625529 - protein, 9 aa, Staphylococcus aureus
ADEEGIETP

SEQ ID NO: 1625530 - protein, 7 aa, Staphylococcus aureus
ADENEEK

SEQ ID NO: 1625531 - protein, 4 aa, Staphylococcus aureus
ADIL

SEQ ID NO: 1625532 - protein, 5 aa, Staphylococcus aureus
ADKEC

SEQ ID NO: 1625533 - protein, 8 aa, Staphylococcus aureus
ADTGNGIK

SEQ ID NO: 1625534 - protein, 16 aa, Staphylococcus aureus
AEATKVSPKEIQPAPK

SEQ ID NO: 1625535 - protein, 4 aa, Staphylococcus aureus
AEDI

SEQ ID NO: 1625536 - protein, 8 aa, Staphylococcus aureus
AEGGHTIS

SEQ ID NO: 1625537 - protein, 4 aa, Staphylococcus aureus
AGAL

SEQ ID NO: 1625538 - protein, 11 aa, Staphylococcus aureus
AGLASSASAYA

SEQ ID NO: 1625539 - protein, 7 aa, Staphylococcus aureus
AGNRRPV

SEQ ID NO: 1625540 - protein, 4 aa, Staphylococcus aureus
AIED

SEQ ID NO: 1625541 - protein, 34 aa, Staphylococcus aureus; identical to SEQ ID NO: 1567009

SEQ ID NO: 1625542 - protein, 10 aa, Staphylococcus aureus
AKDGYTKEHP

SEQ ID NO: 1625543 - protein, 6 aa, Staphylococcus aureus
AKDKHV

SEQ ID NO: 1625544 - protein, 8 aa, Staphylococcus aureus
AKGTSITD

SEQ ID NO: 1625545 - protein, 24 aa, Staphylococcus aureus
AKKREIKGYSDMKKDELIKALEGV

SEQ ID NO: 1625546 - protein, 5 aa, Staphylococcus aureus
AKPTE

SEQ ID NO: 1625547 - protein, 5 aa, Staphylococcus aureus
AKQSG

SEQ ID NO: 1625548 - protein, 12 aa, Staphylococcus aureus
AKSNKPGELSNE

SEQ ID NO: 1625549 - protein, 7 aa, Staphylococcus aureus
AKTIEGG

SEQ ID NO: 1625550 - protein, 10 aa, Staphylococcus aureus
AKTNGKHDID

SEQ ID NO: 1625551 - protein, 5 aa, Staphylococcus aureus
AKVSL

SEQ ID NO: 1625552 - protein, 7 aa, Staphylococcus aureus
ALPEDKE

SEQ ID NO: 1625553 - protein, 17 aa, Staphylococcus aureus
ALQQKREEHKNEEQDAI

SEQ ID NO: 1625554 - protein, 18 aa, Staphylococcus aureus
ALRNTSYCGQSKSRHRFG

SEQ ID NO: 1625555 - protein, 8 aa, Staphylococcus aureus
AMKSSNLK

SEQ ID NO: 1625556 - protein, 11 aa, Staphylococcus aureus
ANKSRAKWDNI

SEQ ID NO: 1625557 - protein, 4 aa, Staphylococcus aureus
ANRY

SEQ ID NO: 1625558 - protein, 7 aa, Staphylococcus aureus
ANSERKI

SEQ ID NO: 1625559 - protein, 13 aa, Staphylococcus aureus
ANSKVKNYKVTPE

SEQ ID NO: 1625560 - protein, 29 aa, Staphylococcus aureus
ANSRISDLENKAQAYSRTFDEQKRYMDEK

SEQ ID NO: 1625561 - protein, 12 aa, Staphylococcus aureus
ANVDDTTKEHLE

SEQ ID NO: 1625562 - protein, 8 aa, Staphylococcus aureus
APHTAENV

SEQ ID NO: 1625563 - protein, 13 aa, Staphylococcus aureus
APVESLTENERRL

SEQ ID NO: 1625564 - protein, 6 aa, Staphylococcus aureus
APYTAE

SEQ ID NO: 1625565 - protein, 8 aa, Staphylococcus aureus
AQDRHTQA

SEQ ID NO: 1625566 - protein, 10 aa, Staphylococcus aureus
AQISTTNNKA

SEQ ID NO: 1625567 - protein, 19 aa, Staphylococcus aureus
AQPGEESSNVWNNAGTGHS

SEQ ID NO: 1625568 - protein, 8 aa, Staphylococcus aureus
AQQNAEGA

SEQ ID NO: 1625569 - protein, 6 aa, Staphylococcus aureus
AQRTAG

SEQ ID NO: 1625570 - protein, 22 aa, Staphylococcus aureus
ARERKKSDERIKNAKENNDSNE

SEQ ID NO: 1625571 - protein, 6 aa, Staphylococcus aureus
ARKGEI

SEQ ID NO: 1625572 - protein, 8 aa, Staphylococcus aureus
ASGLNDSN

SEQ ID NO: 1625573 - protein, 10 aa, Staphylococcus aureus
ASHSHNNPHH

SEQ ID NO: 1625574 - protein, 14 aa, Staphylococcus aureus
ASIDSGSNNQYQKN

SEQ ID NO: 1625575 - protein, 7 aa, Staphylococcus aureus
ASQGEIA

SEQ ID NO: 1625576 - protein, 17 aa, Staphylococcus aureus
ASRRGKLTSVDKENVLA

SEQ ID NO: 1625577 - protein, 8 aa, Staphylococcus aureus
ASSKEVAL

SEQ ID NO: 1625578 - protein, 19 aa, Staphylococcus aureus
ASTGNRRSHALNSTKRRWN

SEQ ID NO: 1625579 - protein, 4 aa, Staphylococcus aureus
ATER

SEQ ID NO: 1625580 - protein, 5 aa, Staphylococcus aureus
ATERQ

SEQ ID NO: 1625581 - protein, 6 aa, Staphylococcus aureus
AVEAAK

SEQ ID NO: 1625582 - protein, 4 aa, Staphylococcus aureus
AVED

SEQ ID NO: 1625583 - protein, 7 aa, Staphylococcus aureus
AVKGSLK

SEQ ID NO: 1625584 - protein, 74 aa, Staphylococcus aureus
DAQDDLKEKESQAYADGKISEEEQRAIQDAQAKLEEAKQNAELKARNAEKKANVYTDNKVKESTDAQRKTLTRY

SEQ ID NO: 1625585 - protein, 10 aa, Staphylococcus aureus
DDADRIATEE

SEQ ID NO: 1625586 - protein, 7 aa, Staphylococcus aureus
DDLQNIS

SEQ ID NO: 1625587 - protein, 7 aa, Staphylococcus aureus
DDQELPE

SEQ ID NO: 1625588 - protein, 6 aa, Staphylococcus aureus
DDQGGE

SEQ ID NO: 1625589 - protein, 7 aa, Staphylococcus aureus
DEEISTE

SEQ ID NO: 1625590 - protein, 9 aa, Staphylococcus aureus
DEGMPESSK

SEQ ID NO: 1625591 - protein, 6 aa, Staphylococcus aureus
DEIRNE

SEQ ID NO: 1625592 - protein, 7 aa, Staphylococcus aureus
DEKPYMG

SEQ ID NO: 1625593 - protein, 14 aa, Staphylococcus aureus
DELTTAQSKSLNEA

SEQ ID NO: 1625594 - protein, 10 aa, Staphylococcus aureus
DENKSLNDDF

SEQ ID NO: 1625595 - protein, 7 aa, Staphylococcus aureus
DENPTDK

SEQ ID NO: 1625596 - protein, 8 aa, Staphylococcus aureus
DEPYETLG

SEQ ID NO: 1625597 - protein, 6 aa, Staphylococcus aureus
DESKDA

SEQ ID NO: 1625598 - protein, 5 aa, Staphylococcus aureus
DEVSV

SEQ ID NO: 1625599 - protein, 16 aa, Staphylococcus aureus
DEWATPNKIVEALEEL

SEQ ID NO: 1625600 - protein, 9 aa, Staphylococcus aureus
DFSLNGEKG

SEQ ID NO: 1625601 - protein, 6 aa, Staphylococcus aureus
DFTKAN

SEQ ID NO: 1625602 - protein, 9 aa, Staphylococcus aureus
DGLTRQNYA

SEQ ID NO: 1625603 - protein, 10 aa, Staphylococcus aureus
DGNPKNNNVE

SEQ ID NO: 1625604 - protein, 7 aa, Staphylococcus aureus
DGRPELS

SEQ ID NO: 1625605 - protein, 6 aa, Staphylococcus aureus
DGTDYS

SEQ ID NO: 1625606 - protein, 16 aa, Staphylococcus aureus
DGTMAKGQDLQKFKEK

SEQ ID NO: 1625607 - protein, 6 aa, Staphylococcus aureus
DGVQAQ

SEQ ID NO: 1625608 - protein, 28 aa, Staphylococcus aureus
DIDKNKESLQKAKGIAGEKASEYFNKAM

SEQ ID NO: 1625609 - protein, 7 aa, Staphylococcus aureus
DIESNKD

SEQ ID NO: 1625610 - protein, 7 aa, Staphylococcus aureus
DIPVYGT

SEQ ID NO: 1625611 - protein, 5 aa, Staphylococcus aureus
DITSN

SEQ ID NO: 1625612 - protein, 5 aa, Staphylococcus aureus
DKDID

SEQ ID NO: 1625613 - protein, 28 aa, Staphylococcus aureus
DKDPIKTGAEYAKKHGWDTPEKAISGGA

SEQ ID NO: 1625614 - protein, 16 aa, Staphylococcus aureus
DKEGYRDGEFEKGDKG

SEQ ID NO: 1625615 - protein, 7 aa, Staphylococcus aureus
DKGISSA

SEQ ID NO: 1625616 - protein, 9 aa, Staphylococcus aureus
DKLPDRKNY

SEQ ID NO: 1625617 - protein, 4 aa, Staphylococcus aureus
DKNS

SEQ ID NO: 1625618 - protein, 9 aa, Staphylococcus aureus
DKQWEDAKK

SEQ ID NO: 1625619 - protein, 6 aa, Staphylococcus aureus
DKRNES

SEQ ID NO: 1625620 - protein, 20 aa, Staphylococcus aureus
DKSISNYRINQDTDVSYGGI

SEQ ID NO: 1625621 - protein, 8 aa, Staphylococcus aureus
DKSLGEGI

SEQ ID NO: 1625622 - protein, 10 aa, Staphylococcus aureus
DKSNITPQDV

SEQ ID NO: 1625623 - protein, 9 aa, Staphylococcus aureus
DKSNTRKYI

SEQ ID NO: 1625624 - protein, 6 aa, Staphylococcus aureus
DKVTGC

SEQ ID NO: 1625625 - protein, 11 aa, Staphylococcus aureus
DLAESQDDLEA

SEQ ID NO: 1625626 - protein, 15 aa, Staphylococcus aureus
DLAPKATNNKEYTIN

SEQ ID NO: 1625627 - protein, 6 aa, Staphylococcus aureus
DLGRKG

SEQ ID NO: 1625628 - protein, 4 aa, Staphylococcus aureus
DNAY

SEQ ID NO: 1625629 - protein, 6 aa, Staphylococcus aureus
DNISKN

SEQ ID NO: 1625630 - protein, 10 aa, Staphylococcus aureus
DNPHTKAQPL

SEQ ID NO: 1625631 - protein, 9 aa, Staphylococcus aureus
DNQTPEDTK

SEQ ID NO: 1625632 - protein, 4 aa, Staphylococcus aureus
DPNI

SEQ ID NO: 1625633 - protein, 5 aa, Staphylococcus aureus
DQERQ

SEQ ID NO: 1625634 - protein, 11 aa, Staphylococcus aureus
DQMTKAKQRLE

SEQ ID NO: 1625635 - protein, 4 aa, Staphylococcus aureus
DQMY

SEQ ID NO: 1625636 - protein, 5 aa, Staphylococcus aureus
DQTFG

SEQ ID NO: 1625637 - protein, 10 aa, Staphylococcus aureus
DRDDQPDLEN

SEQ ID NO: 1625638 - protein, 12 aa, Staphylococcus aureus
DRELEQKLEKLV

SEQ ID NO: 1625639 - protein, 4 aa, Staphylococcus aureus
DRIK

SEQ ID NO: 1625640 - protein, 14 aa, Staphylococcus aureus
DRIKNNSLSSSVSS

SEQ ID NO: 1625641 - protein, 12 aa, Staphylococcus aureus
DRISSGDLGNED

SEQ ID NO: 1625642 - protein, 5 aa, Staphylococcus aureus
DRKTI

SEQ ID NO: 1625643 - protein, 8 aa, Staphylococcus aureus
DRLENSEA

SEQ ID NO: 1625644 - protein, 16 aa, Staphylococcus aureus
DRNPNLTDKEKQALKD

SEQ ID NO: 1625645 - protein, 5 aa, Staphylococcus aureus
DRSAW

SEQ ID NO: 1625646 - protein, 8 aa, Staphylococcus aureus
DSALQENE

SEQ ID NO: 1625647 - protein, 8 aa, Staphylococcus aureus
DSNITSKA

SEQ ID NO: 1625648 - protein, 6 aa, Staphylococcus aureus
DSRSFN

SEQ ID NO: 1625649 - protein, 9 aa, Staphylococcus aureus
DSSKNEAQI

SEQ ID NO: 1625650 - protein, 8 aa, Staphylococcus aureus
DSSLQTTD

SEQ ID NO: 1625651 - protein, 4 aa, Staphylococcus aureus
DSTA

SEQ ID NO: 1625652 - protein, 19 aa, Staphylococcus aureus
DSTARATWYPDDSNDEYTK

SEQ ID NO: 1625653 - protein, 14 aa, Staphylococcus aureus
DSVYPKNKKFSENT

SEQ ID NO: 1625654 - protein, 11 aa, Staphylococcus aureus
DSYIEKDNQMT

SEQ ID NO: 1625655 - protein, 12 aa, Staphylococcus aureus
DTDNPHKITNER

SEQ ID NO: 1625656 - protein, 4 aa, Staphylococcus aureus
DTFE

SEQ ID NO: 1625657 - protein, 7 aa, Staphylococcus aureus
DYADAHE

SEQ ID NO: 1625658 - protein, 5 aa, Staphylococcus aureus
DYDGQ

SEQ ID NO: 1625659 - protein, 36 aa, Staphylococcus aureus
DYESYKKSLDKNKSTLKQQSKSSTTVRKKNGLSYKE

SEQ ID NO: 1625660 - protein, 35 aa, Staphylococcus aureus
DYESYKKSLDKNKSTLKQQSKSYTTVRKKNGLSYK

SEQ ID NO: 1625661 - protein, 15 aa, Staphylococcus aureus
DYHGEVTAPKTKSAI

SEQ ID NO: 1625662 - protein, 9 aa, Staphylococcus aureus
DYKQSRKIS

SEQ ID NO: 1625663 - protein, 4 aa, Staphylococcus aureus
EAAQ

SEQ ID NO: 1625664 - protein, 8 aa, Staphylococcus aureus
EAATPHGL

SEQ ID NO: 1625665 - protein, 35 aa, Staphylococcus aureus
EAFKQSVNSGGLVTSGSTSNWQKSKITKDDGKITQ

SEQ ID NO: 1625666 - protein, 4 aa, Staphylococcus aureus
EAGV

SEQ ID NO: 1625667 - protein, 14 aa, Staphylococcus aureus
EAKQNYDTSPKNQF

SEQ ID NO: 1625668 - protein, 10 aa, Staphylococcus aureus
EALGDADVSI

SEQ ID NO: 1625669 - protein, 18 aa, Staphylococcus aureus
EAPMGSPRPRFSTKGRYA

SEQ ID NO: 1625670 - protein, 11 aa, Staphylococcus aureus
EAPYSKKPIYV

SEQ ID NO: 1625671 - protein, 21 aa, Staphylococcus aureus
EAREREIARQRRKEAELRKKK

SEQ ID NO: 1625672 - protein, 8 aa, Staphylococcus aureus
EDENTASI

SEQ ID NO: 1625673 - protein, 6 aa, Staphylococcus aureus
EDEPEI

SEQ ID NO: 1625674 - protein, 7 aa, Staphylococcus aureus
EDERQRL

SEQ ID NO: 1625675 - protein, 5 aa, Staphylococcus aureus
EDGSI

SEQ ID NO: 1625676 - protein, 6 aa, Staphylococcus aureus
EDNTSF

SEQ ID NO: 1625677 - protein, 5 aa, Staphylococcus aureus
EDPEK

SEQ ID NO: 1625678 - protein, 4 aa, Staphylococcus aureus
EDQN

SEQ ID NO: 1625679 - protein, 9 aa, Staphylococcus aureus
EDYADARGM

SEQ ID NO: 1625680 - protein, 4 aa, Staphylococcus aureus
EDYE

SEQ ID NO: 1625681 - protein, 5 aa, Staphylococcus aureus
EEISA

SEQ ID NO: 1625682 - protein, 10 aa, Staphylococcus aureus
EELSENKDKM

SEQ ID NO: 1625683 - protein, 4 aa, Staphylococcus aureus
EEMR

SEQ ID NO: 1625684 - protein, 9 aa, Staphylococcus aureus
EENTDYTAI

SEQ ID NO: 1625685 - protein, 4 aa, Staphylococcus aureus
EESG

SEQ ID NO: 1625686 - protein, 5 aa, Staphylococcus aureus
EESLT

SEQ ID NO: 1625687 - protein, 90 aa, Staphylococcus aureus
EESQDDNQLENEQVDQSTSSSVSEVSDITEESEETTHPNNTSGQQDNDDQQKDLQPSFSNQNEDTANENRPRTNQQDVATNQAVQTSKPM

SEQ ID NO: 1625688 - protein, 11 aa, Staphylococcus aureus
EETISTDHPAY

SEQ ID NO: 1625689 - protein, 10 aa, Staphylococcus aureus
EGAGGGHAPD

SEQ ID NO: 1625690 - protein, 19 aa, Staphylococcus aureus
EGIKRPKKKVSVEELEDTE

SEQ ID NO: 1625691 - protein, 5 aa, Staphylococcus aureus
EGLEP

SEQ ID NO: 1625692 - protein, 6 aa, Staphylococcus aureus
EGLEPW

SEQ ID NO: 1625693 - protein, 9 aa, Staphylococcus aureus
EGYKIGNRG

SEQ ID NO: 1625694 - protein, 11 aa, Staphylococcus aureus
EHFPEANPRIG

SEQ ID NO: 1625695 - protein, 4 aa, Staphylococcus aureus
EHTN

SEQ ID NO: 1625696 - protein, 8 aa, Staphylococcus aureus
EISNHSNQ

SEQ ID NO: 1625697 - protein, 7 aa, Staphylococcus aureus
EKCPDEK

SEQ ID NO: 1625698 - protein, 20 aa, Staphylococcus aureus
EKEGRDAANAAQEKAEKEGK

SEQ ID NO: 1625699 - protein, 4 aa, Staphylococcus aureus
EKIN

SEQ ID NO: 1625700 - protein, 10 aa, Staphylococcus aureus
EKNTPQGAGS

SEQ ID NO: 1625701 - protein, 6 aa, Staphylococcus aureus
EKNYPS

SEQ ID NO: 1625702 - protein, 10 aa, Staphylococcus aureus
EKSMQIQNDL

SEQ ID NO: 1625703 - protein, 7 aa, Staphylococcus aureus
EKSVGYR

SEQ ID NO: 1625704 - protein, 11 aa, Staphylococcus aureus
EKYPITTKQSP

SEQ ID NO: 1625705 - protein, 4 aa, Staphylococcus aureus
ELND

SEQ ID NO: 1625706 - protein, 6 aa, Staphylococcus aureus
ELQGRV

SEQ ID NO: 1625707 - protein, 9 aa, Staphylococcus aureus
EMQNNNEPM

SEQ ID NO: 1625708 - protein, 13 aa, Staphylococcus aureus
EMQSTEGYSIDGQ

SEQ ID NO: 1625709 - protein, 7 aa, Staphylococcus aureus
ENCDDKV

SEQ ID NO: 1625710 - protein, 5 aa, Staphylococcus aureus
ENDVD

SEQ ID NO: 1625711 - protein, 15 aa, Staphylococcus aureus
ENEVNQQYKDDKGEL

SEQ ID NO: 1625712 - protein, 13 aa, Staphylococcus aureus
ENGRKEIYKRTYK

SEQ ID NO: 1625713 - protein, 5 aa, Staphylococcus aureus
ENIKQ

SEQ ID NO: 1625714 - protein, 4 aa, Staphylococcus aureus
ENIN

SEQ ID NO: 1625715 - protein, 6 aa, Staphylococcus aureus
ENKEDD

SEQ ID NO: 1625716 - protein, 10 aa, Staphylococcus aureus
ENKGQHPSTQ

SEQ ID NO: 1625717 - protein, 8 aa, Staphylococcus aureus
ENKKTNHY

SEQ ID NO: 1625718 - protein, 9 aa, Staphylococcus aureus
ENNGPKRFD

SEQ ID NO: 1625719 - protein, 5 aa, Staphylococcus aureus
ENPED

SEQ ID NO: 1625720 - protein, 7 aa, Staphylococcus aureus
ENPVSKR

SEQ ID NO: 1625721 - protein, 9 aa, Staphylococcus aureus
ENQKLDAGD

SEQ ID NO: 1625722 - protein, 22 aa, Staphylococcus aureus
EPGGEYKETIETGTKAAARGGF

SEQ ID NO: 1625723 - protein, 12 aa, Staphylococcus aureus
EPKLTKQNIEQA

SEQ ID NO: 1625724 - protein, 13 aa, Staphylococcus aureus
EPTGALDSKTSKA

SEQ ID NO: 1625725 - protein, 10 aa, Staphylococcus aureus
EPVDQGGQHE

SEQ ID NO: 1625726 - protein, 7 aa, Staphylococcus aureus
EQAIPSE

SEQ ID NO: 1625727 - protein, 5 aa, Staphylococcus aureus
EQKAN

SEQ ID NO: 1625728 - protein, 4 aa, Staphylococcus aureus
EQMD

SEQ ID NO: 1625729 - protein, 5 aa, Staphylococcus aureus
EQMPN

SEQ ID NO: 1625730 - protein, 14 aa, Staphylococcus aureus
EQQKKEKEMKKKQK

SEQ ID NO: 1625731 - protein, 4 aa, Staphylococcus aureus
EQRR

SEQ ID NO: 1625732 - protein, 11 aa, Staphylococcus aureus
EREESTKQDTI

SEQ ID NO: 1625733 - protein, 7 aa, Staphylococcus aureus
EREVGQN

SEQ ID NO: 1625734 - protein, 5 aa, Staphylococcus aureus
ERHRI

SEQ ID NO: 1625735 - protein, 5 aa, Staphylococcus aureus
ERNAN

SEQ ID NO: 1625736 - protein, 5 aa, Staphylococcus aureus
ERNEE

SEQ ID NO: 1625737 - protein, 8 aa, Staphylococcus aureus
ERNQALRN

SEQ ID NO: 1625738 - protein, 8 aa, Staphylococcus aureus
ERNQETKY

SEQ ID NO: 1625739 - protein, 4 aa, Staphylococcus aureus
ERQR

SEQ ID NO: 1625740 - protein, 5 aa, Staphylococcus aureus
ERSVE

SEQ ID NO: 1625741 - protein, 9 aa, Staphylococcus aureus
ESDDNYRLN

SEQ ID NO: 1625742 - protein, 8 aa, Staphylococcus aureus
ESGCGKSI

SEQ ID NO: 1625743 - protein, 4 aa, Staphylococcus aureus
ESIE

SEQ ID NO: 1625744 - protein, 10 aa, Staphylococcus aureus
ESQLKKYRGK

SEQ ID NO: 1625745 - protein, 12 aa, Staphylococcus aureus
ESRGNNKNDRGF

SEQ ID NO: 1625746 - protein, 7 aa, Staphylococcus aureus
ETGVPTM

SEQ ID NO: 1625747 - protein, 11 aa, Staphylococcus aureus
ETKPGVGYPKR

SEQ ID NO: 1625748 - protein, 7 aa, Staphylococcus aureus
ETTLTNQ

SEQ ID NO: 1625749 - protein, 5 aa, Staphylococcus aureus
EVHPN

SEQ ID NO: 1625750 - protein, 9 aa, Staphylococcus aureus
EVNQSSNTW

SEQ ID NO: 1625751 - protein, 9 aa, Staphylococcus aureus
EVPSEEDLS

SEQ ID NO: 1625752 - protein, 7 aa, Staphylococcus aureus
EVTTSKE

SEQ ID NO: 1625753 - protein, 4 aa, Staphylococcus aureus
EYPV

SEQ ID NO: 1625754 - protein, 8 aa, Staphylococcus aureus
EYRGYDSA

SEQ ID NO: 1625755 - protein, 12 aa, Staphylococcus aureus
EYSSPKEALENA

SEQ ID NO: 1625756 - protein, 16 aa, Staphylococcus aureus
FANPTDLENKKTNDRL

SEQ ID NO: 1625757 - protein, 8 aa, Staphylococcus aureus
FANTEGGT

SEQ ID NO: 1625758 - protein, 7 aa, Staphylococcus aureus
FATPTLG

SEQ ID NO: 1625759 - protein, 4 aa, Staphylococcus aureus
FDNR

SEQ ID NO: 1625760 - protein, 24 aa, Staphylococcus aureus
FDTSTNTRQNVDAQEKTYTTNPVN

SEQ ID NO: 1625761 - protein, 9 aa, Staphylococcus aureus
FGDERRTEI

SEQ ID NO: 1625762 - protein, 9 aa, Staphylococcus aureus
FGGYDGKGQ

SEQ ID NO: 1625763 - protein, 8 aa, Staphylococcus aureus
FGNDDERV

SEQ ID NO: 1625764 - protein, 11 aa, Staphylococcus aureus
FGNKASSLTVQ

SEQ ID NO: 1625765 - protein, 14 aa, Staphylococcus aureus
FGPNEDFDAYPRQI

SEQ ID NO: 1625766 - protein, 8 aa, Staphylococcus aureus
FGSSKNPF

SEQ ID NO: 1625767 - protein, 9 aa, Staphylococcus aureus
FKKSQKTIA

SEQ ID NO: 1625768 - protein, 4 aa, Staphylococcus aureus
FKTH

SEQ ID NO: 1625769 - protein, 13 aa, Staphylococcus aureus
FKYDNSRGNRNEN

SEQ ID NO: 1625770 - protein, 6 aa, Staphylococcus aureus
FNPDNP

SEQ ID NO: 1625771 - protein, 11 aa, Staphylococcus aureus
FNRKTKQLESF

SEQ ID NO: 1625772 - protein, 7 aa, Staphylococcus aureus
FRNSNEY

SEQ ID NO: 1625773 - protein, 13 aa, Staphylococcus aureus
FSTNKKKGYAKEK

SEQ ID NO: 1625774 - protein, 13 aa, Staphylococcus aureus
FTGDTHQAKGNND

SEQ ID NO: 1625775 - protein, 11 aa, Staphylococcus aureus
FTIDEDDQHIR

SEQ ID NO: 1625776 - protein, 6 aa, Staphylococcus aureus
GAPTQR

SEQ ID NO: 1625777 - protein, 23 aa, Staphylococcus aureus
GAVEESKSQFKDEVYSLLNIFLK

SEQ ID NO: 1625778 - protein, 15 aa, Staphylococcus aureus
GAVKSELANGVEIDG

SEQ ID NO: 1625779 - protein, 6 aa, Staphylococcus aureus
GCSYRE

SEQ ID NO: 1625780 - protein, 24 aa, Staphylococcus aureus
GDEVSRPGPRIDEGLKELRDAIYR

SEQ ID NO: 1625781 - protein, 7 aa, Staphylococcus aureus
GDQLENT

SEQ ID NO: 1625782 - protein, 11 aa, Staphylococcus aureus
GDQLSRTTGFD

SEQ ID NO: 1625783 - protein, 11 aa, Staphylococcus aureus
GDVDDIRESPA

SEQ ID NO: 1625784 - protein, 8 aa, Staphylococcus aureus
GDVPSYPY

SEQ ID NO: 1625785 - protein, 7 aa, Staphylococcus aureus
GEASLTY

SEQ ID NO: 1625786 - protein, 5 aa, Staphylococcus aureus
GEHND

SEQ ID NO: 1625787 - protein, 7 aa, Staphylococcus aureus
GEITYGN

SEQ ID NO: 1625788 - protein, 4 aa, Staphylococcus aureus
GGEN

SEQ ID NO: 1625789 - protein, 10 aa, Staphylococcus aureus
GGHSKDRNSI

SEQ ID NO: 1625790 - protein, 8 aa, Staphylococcus aureus
GHEERTKM

SEQ ID NO: 1625791 - protein, 13 aa, Staphylococcus aureus
GIDGKYAPPHPSD

SEQ ID NO: 1625792 - protein, 4 aa, Staphylococcus aureus
GIKR

SEQ ID NO: 1625793 - protein, 7 aa, Staphylococcus aureus
GIPTQKH

SEQ ID NO: 1625794 - protein, 8 aa, Staphylococcus aureus
GISEEEFD

SEQ ID NO: 1625795 - protein, 10 aa, Staphylococcus aureus
GISESTEKTV

SEQ ID NO: 1625796 - protein, 18 aa, Staphylococcus aureus
GIYSTGAGGSRAKKIPWS

SEQ ID NO: 1625797 - protein, 7 aa, Staphylococcus aureus
GKEGLSI

SEQ ID NO: 1625798 - protein, 9 aa, Staphylococcus aureus
GKGQVQDAG

SEQ ID NO: 1625799 - protein, 7 aa, Staphylococcus aureus
GKNPTWR

SEQ ID NO: 1625800 - protein, 5 aa, Staphylococcus aureus
GKQGI

SEQ ID NO: 1625801 - protein, 17 aa, Staphylococcus aureus
GKSTKGMFDGEAPGQIG

SEQ ID NO: 1625802 - protein, 8 aa, Staphylococcus aureus
GKVTPGQK

SEQ ID NO: 1625803 - protein, 4 aa, Staphylococcus aureus
GLQP

SEQ ID NO: 1625804 - protein, 5 aa, Staphylococcus aureus
GLSEI

SEQ ID NO: 1625805 - protein, 7 aa, Staphylococcus aureus
GMDPSIG

SEQ ID NO: 1625806 - protein, 8 aa, Staphylococcus aureus
GNEALAQE

SEQ ID NO: 1625807 - protein, 7 aa, Staphylococcus aureus
GNPEEYK

SEQ ID NO: 1625808 - protein, 19 aa, Staphylococcus aureus
GNRLTKDGSTTWDPSKSYI

SEQ ID NO: 1625809 - protein, 4 aa, Staphylococcus aureus
GPEL

SEQ ID NO: 1625810 - protein, 21 aa, Staphylococcus aureus
GPILNPDTKYDSHGVYSGSAF

SEQ ID NO: 1625811 - protein, 7 aa, Staphylococcus aureus
GPNNFTD

SEQ ID NO: 1625812 - protein, 8 aa, Staphylococcus aureus
GPNTEKLD

SEQ ID NO: 1625813 - protein, 6 aa, Staphylococcus aureus
GPQHRE

SEQ ID NO: 1625814 - protein, 12 aa, Staphylococcus aureus
GPQHRGWRKVSL

SEQ ID NO: 1625815 - protein, 6 aa, Staphylococcus aureus
GQKKRV

SEQ ID NO: 1625816 - protein, 17 aa, Staphylococcus aureus
GQTKPHQKYKKEASESE

SEQ ID NO: 1625817 - protein, 12 aa, Staphylococcus aureus
GRDFTTSEAKKL

SEQ ID NO: 1625818 - protein, 9 aa, Staphylococcus aureus
GRDKKYTLE

SEQ ID NO: 1625819 - protein, 9 aa, Staphylococcus aureus
GRNHSISGI

SEQ ID NO: 1625820 - protein, 5 aa, Staphylococcus aureus
GRQHK

SEQ ID NO: 1625821 - protein, 4 aa, Staphylococcus aureus
GRSR

SEQ ID NO: 1625822 - protein, 6 aa, Staphylococcus aureus
GSAKDI

SEQ ID NO: 1625823 - protein, 5 aa, Staphylococcus aureus
GSEFS

SEQ ID NO: 1625824 - protein, 12 aa, Staphylococcus aureus
GSGDLKGSSVGY

SEQ ID NO: 1625825 - protein, 20 aa, Staphylococcus aureus
GSGVATLGLPDSPGVPEGIA

SEQ ID NO: 1625826 - protein, 7 aa, Staphylococcus aureus
GSTDKRG

SEQ ID NO: 1625827 - protein, 9 aa, Staphylococcus aureus
GSYGTGKSH

SEQ ID NO: 1625828 - protein, 9 aa, Staphylococcus aureus
GTKVEANAN

SEQ ID NO: 1625829 - protein, 17 aa, Staphylococcus aureus
GTNNNKSIGSNNPFRGK

SEQ ID NO: 1625830 - protein, 4 aa, Staphylococcus aureus
GTSF

SEQ ID NO: 1625831 - protein, 11 aa, Staphylococcus aureus
GTTGNISARTM

SEQ ID NO: 1625832 - protein, 4 aa, Staphylococcus aureus
GVTE

SEQ ID NO: 1625833 - protein, 7 aa, Staphylococcus aureus
GYPQEAT

SEQ ID NO: 1625834 - protein, 17 aa, Staphylococcus aureus
HANDNKKAVKTKIKFVK

SEQ ID NO: 1625835 - protein, 12 aa, Staphylococcus aureus
HEGKRSKELGIP

SEQ ID NO: 1625836 - protein, 4 aa, Staphylococcus aureus
HEPW

SEQ ID NO: 1625837 - protein, 7 aa, Staphylococcus aureus
HEQDSLQ

SEQ ID NO: 1625838 - protein, 10 aa, Staphylococcus aureus
HESPSEYTRE

SEQ ID NO: 1625839 - protein, 4 aa, Staphylococcus aureus
HGKT

SEQ ID NO: 1625840 - protein, 5 aa, Staphylococcus aureus
HGTEL

SEQ ID NO: 1625841 - protein, 20 aa, Staphylococcus aureus
HKGFQQAEGELEQMLSQLIE

SEQ ID NO: 1625842 - protein, 50 aa, Staphylococcus aureus
HKGITKAKKDDSANEDVLKRDDKLSEEIESGPEDREVETPKKGFWSRLFG

SEQ ID NO: 1625843 - protein, 7 aa, Staphylococcus aureus
HKKINRK

SEQ ID NO: 1625844 - protein, 9 aa, Staphylococcus aureus
HKNNPRAIR

SEQ ID NO: 1625845 - protein, 6 aa, Staphylococcus aureus
HNDGIT

SEQ ID NO: 1625846 - protein, 8 aa, Staphylococcus aureus
HPGQSSFS

SEQ ID NO: 1625847 - protein, 12 aa, Staphylococcus aureus
HPNGENDTGGYY

SEQ ID NO: 1625848 - protein, 6 aa, Staphylococcus aureus
HQKQAV

SEQ ID NO: 1625849 - protein, 9 aa, Staphylococcus aureus
HREIGTPIS

SEQ ID NO: 1625850 - protein, 6 aa, Staphylococcus aureus
HRKEFE

SEQ ID NO: 1625851 - protein, 4 aa, Staphylococcus aureus
HSEN

SEQ ID NO: 1625852 - protein, 16 aa, Staphylococcus aureus
HSQLNTNKTKKKNMAN

SEQ ID NO: 1625853 - protein, 13 aa, Staphylococcus aureus
HVADKEQGHSCGE

SEQ ID NO: 1625854 - protein, 6 aa, Staphylococcus aureus
HYTEPW

SEQ ID NO: 1625855 - protein, 4 aa, Staphylococcus aureus
IDEQ

SEQ ID NO: 1625856 - protein, 11 aa, Staphylococcus aureus
IDQSASVEDAI

SEQ ID NO: 1625857 - protein, 7 aa, Staphylococcus aureus
IEDTSAA

SEQ ID NO: 1625858 - protein, 4 aa, Staphylococcus aureus
IEES

SEQ ID NO: 1625859 - protein, 12 aa, Staphylococcus aureus
IEETDQYKGTIH

SEQ ID NO: 1625860 - protein, 8 aa, Staphylococcus aureus
IESRANKE

SEQ ID NO: 1625861 - protein, 19 aa, Staphylococcus aureus
IGAEGMTSEAVDGRSNAYE

SEQ ID NO: 1625862 - protein, 10 aa, Staphylococcus aureus
IGDDQYGNDR

SEQ ID NO: 1625863 - protein, 16 aa, Staphylococcus aureus
IGRSTTTEDQTGDTLE

SEQ ID NO: 1625864 - protein, 22 aa, Staphylococcus aureus
IHGESGLDGPKLPSTPSRQAVA

SEQ ID NO: 1625865 - protein, 18 aa, Staphylococcus aureus
IKDVEEALQGTKMTREDL

SEQ ID NO: 1625866 - protein, 4 aa, Staphylococcus aureus
IMAD

SEQ ID NO: 1625867 - protein, 6 aa, Staphylococcus aureus
INETSS

SEQ ID NO: 1625868 - protein, 7 aa, Staphylococcus aureus
INKRAEH

SEQ ID NO: 1625869 - protein, 5 aa, Staphylococcus aureus
INMKN

SEQ ID NO: 1625870 - protein, 6 aa, Staphylococcus aureus
INTDPE

SEQ ID NO: 1625871 - protein, 5 aa, Staphylococcus aureus
IPKGN

SEQ ID NO: 1625872 - protein, 24 aa, Staphylococcus aureus
IPKKAQTRNELQAKRNNYLEDSEV

SEQ ID NO: 1625873 - protein, 18 aa, Staphylococcus aureus
IPKRRKTIEDIEKDESKM

SEQ ID NO: 1625874 - protein, 6 aa, Staphylococcus aureus
IPRGDT

SEQ ID NO: 1625875 - protein, 13 aa, Staphylococcus aureus
IPTNNASWRGPQY

SEQ ID NO: 1625876 - protein, 13 aa, Staphylococcus aureus
IQKVTGAPVYFGG

SEQ ID NO: 1625877 - protein, 12 aa, Staphylococcus aureus
IQPGSSGSPILN

SEQ ID NO: 1625878 - protein, 6 aa, Staphylococcus aureus
IQPNEV

SEQ ID NO: 1625879 - protein, 4 aa, Staphylococcus aureus
IRSN

SEQ ID NO: 1625880 - protein, 12 aa, Staphylococcus aureus
ISGGKGTAEEKI

SEQ ID NO: 1625881 - protein, 7 aa, Staphylococcus aureus
ISGPQSK

SEQ ID NO: 1625882 - protein, 16 aa, Staphylococcus aureus
ISGQFSTPSKLTPRDV

SEQ ID NO: 1625883 - protein, 12 aa, Staphylococcus aureus
ISKINDSDPTGT

SEQ ID NO: 1625884 - protein, 7 aa, Staphylococcus aureus
ISKNPDN

SEQ ID NO: 1625885 - protein, 8 aa, Staphylococcus aureus
ISKNTVSR

SEQ ID NO: 1625886 - protein, 35 aa, Staphylococcus aureus
ISKRNSTGNASWGVGPNTEAYDKSAYDNVQVGVVQ

SEQ ID NO: 1625887 - protein, 6 aa, Staphylococcus aureus
ISQPNI

SEQ ID NO: 1625888 - protein, 17 aa, Staphylococcus aureus
ISQPTFDKQARIYNTQL

SEQ ID NO: 1625889 - protein, 4 aa, Staphylococcus aureus
ISRR

SEQ ID NO: 1625890 - protein, 72 aa, Staphylococcus aureus; identical to SEQ ID NO: 1564116

SEQ ID NO: 1625891 - protein, 17 aa, Staphylococcus aureus
ITELGSVDKGTTRTDNT

SEQ ID NO: 1625892 - protein, 6 aa, Staphylococcus aureus
ITGTSY

SEQ ID NO: 1625893 - protein, 9 aa, Staphylococcus aureus
ITPRENKGK

SEQ ID NO: 1625894 - protein, 4 aa, Staphylococcus aureus
ITSV

SEQ ID NO: 1625895 - protein, 6 aa, Staphylococcus aureus
IYGTSV

SEQ ID NO: 1625896 - protein, 6 aa, Staphylococcus aureus
KADALK

SEQ ID NO: 1625897 - protein, 5 aa, Staphylococcus aureus
KAEQL

SEQ ID NO: 1625898 - protein, 4 aa, Staphylococcus aureus
KAIN

SEQ ID NO: 1625899 - protein, 7 aa, Staphylococcus aureus
KAKEYQD

SEQ ID NO: 1625900 - protein, 13 aa, Staphylococcus aureus
KALSSALDKTVGK

SEQ ID NO: 1625901 - protein, 4 aa, Staphylococcus aureus
KANA

SEQ ID NO: 1625902 - protein, 6 aa, Staphylococcus aureus
KASKTF

SEQ ID NO: 1625903 - protein, 8 aa, Staphylococcus aureus
KASPKLRE

SEQ ID NO: 1625904 - protein, 6 aa, Staphylococcus aureus
KCKQEE

SEQ ID NO: 1625905 - protein, 11 aa, Staphylococcus aureus
KCSNEAELKEG

SEQ ID NO: 1625906 - protein, 18 aa, Staphylococcus aureus
KDAKIYGNNATGKTTTAT

SEQ ID NO: 1625907 - protein, 6 aa, Staphylococcus aureus
KDASVL

SEQ ID NO: 1625908 - protein, 15 aa, Staphylococcus aureus
KDDNLIKKEGEGPAT

SEQ ID NO: 1625909 - protein, 4 aa, Staphylococcus aureus
KDET

SEQ ID NO: 1625910 - protein, 77 aa, Staphylococcus aureus
KDGELKEVKAHNQRQARMRKDDHLTNQVKNKVRSKIKNKVKPGYKKKFKQEVEKMKRQERKQFSKQQNRQKRKQNKK

SEQ ID NO: 1625911 - protein, 5 aa, Staphylococcus aureus
KDGIT

SEQ ID NO: 1625912 - protein, 14 aa, Staphylococcus aureus
KDISIKQSSHLKDT

SEQ ID NO: 1625913 - protein, 9 aa, Staphylococcus aureus
KDKTPNGRD

SEQ ID NO: 1625914 - protein, 16 aa, Staphylococcus aureus
KDRNSFSKTDLIMMQL

SEQ ID NO: 1625915 - protein, 8 aa, Staphylococcus aureus
KDTESAKQ

SEQ ID NO: 1625916 - protein, 12 aa, Staphylococcus aureus
KEFADKAAARFG

SEQ ID NO: 1625917 - protein, 6 aa, Staphylococcus aureus
KEHEEL

SEQ ID NO: 1625918 - protein, 5 aa, Staphylococcus aureus
KEIEG

SEQ ID NO: 1625919 - protein, 6 aa, Staphylococcus aureus
KEIKNI

SEQ ID NO: 1625920 - protein, 14 aa, Staphylococcus aureus
KEIKNYSVSQSQFE

SEQ ID NO: 1625921 - protein, 20 aa, Staphylococcus aureus
KESWTAGKIRGKLNKGQKQV

SEQ ID NO: 1625922 - protein, 41 aa, Staphylococcus aureus
KEVTTKTTIRISDKTSVDSASTRGPTPSDEKPSIVTETSPF

SEQ ID NO: 1625923 - protein, 83 aa, Staphylococcus aureus
KFKKEQKNDNKQSTQNNHQKSNNQNQNKGQQKDNKKNQQQNNKGNKGNKKNNRNNKKNNKNNKPQNQPAAPKEIPSKVTYQEG

SEQ ID NO: 1625924 - protein, 25 aa, Staphylococcus aureus
KFQNGQKLTAEKVKSSLENSMKKSD

SEQ ID NO: 1625925 - protein, 8 aa, Staphylococcus aureus
KGDDGEWY

SEQ ID NO: 1625926 - protein, 5 aa, Staphylococcus aureus
KGDER

SEQ ID NO: 1625927 - protein, 12 aa, Staphylococcus aureus
KGFKQRKDAVKK

SEQ ID NO: 1625928 - protein, 10 aa, Staphylococcus aureus
KGQKKTDYEF

SEQ ID NO: 1625929 - protein, 9 aa, Staphylococcus aureus
KGTNQKEVA

SEQ ID NO: 1625930 - protein, 11 aa, Staphylococcus aureus
KGYSDETSYAV

SEQ ID NO: 1625931 - protein, 6 aa, Staphylococcus aureus
KHAKDE

SEQ ID NO: 1625932 - protein, 16 aa, Staphylococcus aureus
KHGAQASIPLLEEVNQ

SEQ ID NO: 1625933 - protein, 7 aa, Staphylococcus aureus
KHKYDGK

SEQ ID NO: 1625934 - protein, 26 aa, Staphylococcus aureus
KIKDTTNKPVDTSRPTVVSPKYKDIK

SEQ ID NO: 1625935 - protein, 14 aa, Staphylococcus aureus
KIKYRNNSYAYDTE

SEQ ID NO: 1625936 - protein, 5 aa, Staphylococcus aureus
KIMTD

SEQ ID NO: 1625937 - protein, 7 aa, Staphylococcus aureus
KKCKSSY

SEQ ID NO: 1625938 - protein, 10 aa, Staphylococcus aureus
KKDIDNGVYD

SEQ ID NO: 1625939 - protein, 21 aa, Staphylococcus aureus
KKFATEQEDNKGRKQKTSGFT

SEQ ID NO: 1625940 - protein, 16 aa, Staphylococcus aureus
KKITSVPQVFQDILAT

SEQ ID NO: 1625941 - protein, 15 aa, Staphylococcus aureus
KKMTVQPDVSQSDID

SEQ ID NO: 1625942 - protein, 10 aa, Staphylococcus aureus
KKNGKKRISH

SEQ ID NO: 1625943 - protein, 13 aa, Staphylococcus aureus
KKQAAKDEIDQLQ

SEQ ID NO: 1625944 - protein, 6 aa, Staphylococcus aureus
KKTYDI

SEQ ID NO: 1625945 - protein, 15 aa, Staphylococcus aureus
KKYSHRKEQFQNEES

SEQ ID NO: 1625946 - protein, 18 aa, Staphylococcus aureus
KLGETLSKDLYGKEINAS

SEQ ID NO: 1625947 - protein, 6 aa, Staphylococcus aureus
KLSNKK

SEQ ID NO: 1625948 - protein, 7 aa, Staphylococcus aureus
KLTEKHE

SEQ ID NO: 1625949 - protein, 6 aa, Staphylococcus aureus
KMTGSK

SEQ ID NO: 1625950 - protein, 12 aa, Staphylococcus aureus
KNAKKERKVFQI

SEQ ID NO: 1625951 - protein, 5 aa, Staphylococcus aureus
KNDEV

SEQ ID NO: 1625952 - protein, 7 aa, Staphylococcus aureus
KNDGDLT

SEQ ID NO: 1625953 - protein, 6 aa, Staphylococcus aureus
KNDIEI

SEQ ID NO: 1625954 - protein, 16 aa, Staphylococcus aureus
KNDKDGRPQENEKRYP

SEQ ID NO: 1625955 - protein, 14 aa, Staphylococcus aureus
KNEISNHSNHSNQF

SEQ ID NO: 1625956 - protein, 10 aa, Staphylococcus aureus
KNENKIIEQN

SEQ ID NO: 1625957 - protein, 6 aa, Staphylococcus aureus
KNERDY

SEQ ID NO: 1625958 - protein, 40 aa, Staphylococcus aureus
KNESRFKGAKGDKGEPGQPGAKGDTGKKGEQGTPGKNGTV

SEQ ID NO: 1625959 - protein, 5 aa, Staphylococcus aureus
KNIKT

SEQ ID NO: 1625960 - protein, 6 aa, Staphylococcus aureus
KNMNNS

SEQ ID NO: 1625961 - protein, 7 aa, Staphylococcus aureus
KNNRNPV

SEQ ID NO: 1625962 - protein, 15 aa, Staphylococcus aureus
KNNSSGLIDKGNQDL

SEQ ID NO: 1625963 - protein, 6 aa, Staphylococcus aureus
KNSDEI

SEQ ID NO: 1625964 - protein, 9 aa, Staphylococcus aureus
KNWRNDTNK

SEQ ID NO: 1625965 - protein, 16 aa, Staphylococcus aureus
KNYKNGRISSNENVPY

SEQ ID NO: 1625966 - protein, 6 aa, Staphylococcus aureus
KPEIYT

SEQ ID NO: 1625967 - protein, 6 aa, Staphylococcus aureus
KPEQNI

SEQ ID NO: 1625968 - protein, 6 aa, Staphylococcus aureus
KPKRVT

SEQ ID NO: 1625969 - protein, 4 aa, Staphylococcus aureus
KPTF

SEQ ID NO: 1625970 - protein, 4 aa, Staphylococcus aureus
KQAK

SEQ ID NO: 1625971 - protein, 7 aa, Staphylococcus aureus
KQFNPDG

SEQ ID NO: 1625972 - protein, 7 aa, Staphylococcus aureus
KQGINVG

SEQ ID NO: 1625973 - protein, 5 aa, Staphylococcus aureus
KQGKS

SEQ ID NO: 1625974 - protein, 7 aa, Staphylococcus aureus
KQGSITV

SEQ ID NO: 1625975 - protein, 19 aa, Staphylococcus aureus
KQNTVPLGTVKTNKKEVTV

SEQ ID NO: 1625976 - protein, 26 aa, Staphylococcus aureus
KQQLESKKQTNKPYVKPSKEKTPKWL

SEQ ID NO: 1625977 - protein, 9 aa, Staphylococcus aureus
KQQPTNQNF

SEQ ID NO: 1625978 - protein, 4 aa, Staphylococcus aureus
KQSK

SEQ ID NO: 1625979 - protein, 15 aa, Staphylococcus aureus
KRAFDHDEGPNTGGM

SEQ ID NO: 1625980 - protein, 7 aa, Staphylococcus aureus
KRAQRGI

SEQ ID NO: 1625981 - protein, 11 aa, Staphylococcus aureus
KRSLKTKEEAV

SEQ ID NO: 1625982 - protein, 11 aa, Staphylococcus aureus
KRTKTHTCPSP

SEQ ID NO: 1625983 - protein, 9 aa, Staphylococcus aureus
KRVTAQGNA

SEQ ID NO: 1625984 - protein, 5 aa, Staphylococcus aureus
KSANI

SEQ ID NO: 1625985 - protein, 10 aa, Staphylococcus aureus
KSDTPPENPV

SEQ ID NO: 1625986 - protein, 28 aa, Staphylococcus aureus
KSETAPRSVQSPTQAPKKETAKPQPKAV

SEQ ID NO: 1625987 - protein, 6 aa, Staphylococcus aureus
KSFTEE

SEQ ID NO: 1625988 - protein, 9 aa, Staphylococcus aureus
KSIAPYETD

SEQ ID NO: 1625989 - protein, 7 aa, Staphylococcus aureus
KSIDPRI

SEQ ID NO: 1625990 - protein, 11 aa, Staphylococcus aureus
KSITQEAKQGD

SEQ ID NO: 1625991 - protein, 12 aa, Staphylococcus aureus
KSKFDSKRLSNA

SEQ ID NO: 1625992 - protein, 9 aa, Staphylococcus aureus
KSKLDSKRL

SEQ ID NO: 1625993 - protein, 6 aa, Staphylococcus aureus
KSKSRK

SEQ ID NO: 1625994 - protein, 10 aa, Staphylococcus aureus
KSNKKYGGND

SEQ ID NO: 1625995 - protein, 9 aa, Staphylococcus aureus
KSNNNDFYS

SEQ ID NO: 1625996 - protein, 6 aa, Staphylococcus aureus
KSNPII

SEQ ID NO: 1625997 - protein, 5 aa, Staphylococcus aureus
KSNQR

SEQ ID NO: 1625998 - protein, 11 aa, Staphylococcus aureus
KSNTPGNTTQV

SEQ ID NO: 1625999 - protein, 8 aa, Staphylococcus aureus
KSRKGLSN

SEQ ID NO: 1626000 - protein, 15 aa, Staphylococcus aureus
KSTAQEKGQARKEKL

SEQ ID NO: 1626001 - protein, 8 aa, Staphylococcus aureus
KTGTEHIK

SEQ ID NO: 1626002 - protein, 54 aa, Staphylococcus aureus
KTNKKDTHENEVESTDEEIYQSEDNHQEHKQNHEHVQDKDKEESKFKKLMKSLF

SEQ ID NO: 1626003 - protein, 5 aa, Staphylococcus aureus
KTVAK

SEQ ID NO: 1626004 - protein, 8 aa, Staphylococcus aureus
KVEYRAEK

SEQ ID NO: 1626005 - protein, 8 aa, Staphylococcus aureus
KVKGNEYD

SEQ ID NO: 1626006 - protein, 6 aa, Staphylococcus aureus
KVNELE

SEQ ID NO: 1626007 - protein, 7 aa, Staphylococcus aureus
KVNPQKD

SEQ ID NO: 1626008 - protein, 36 aa, Staphylococcus aureus
KVNQPKNEGSSGNYQKRGSYFGQRNRISKEKTPKWL

SEQ ID NO: 1626009 - protein, 5 aa, Staphylococcus aureus
KVSAK

SEQ ID NO: 1626010 - protein, 7 aa, Staphylococcus aureus
KVTENNG

SEQ ID NO: 1626011 - protein, 21 aa, Staphylococcus aureus
KVTKVYGDQDSVSFAPGEKAT

SEQ ID NO: 1626012 - protein, 8 aa, Staphylococcus aureus
KWYTPSYK

SEQ ID NO: 1626013 - protein, 10 aa, Staphylococcus aureus
KYEKQLNDIT

SEQ ID NO: 1626014 - protein, 6 aa, Staphylococcus aureus
KYGDLG

SEQ ID NO: 1626015 - protein, 6 aa, Staphylococcus aureus
KYPELD

SEQ ID NO: 1626016 - protein, 148 aa, Staphylococcus aureus
LAESSNKVENNTATDEKAESKDSKVAGVNTSTDAKTDTKAENAGDGTATKVDKEDQISATEAIEKASVEQSKNDKAAETSNKEATVDAEAQHDAEQQVAEAHAEASKQATSNDSLEAKAENDSTASQSEMSEPKPQEEKKGFFARLFN

SEQ ID NO: 1626017 - protein, 7 aa, Staphylococcus aureus
LANEKTR

SEQ ID NO: 1626018 - protein, 20 aa, Staphylococcus aureus
LATKARNKQLTAEDMQGGTF

SEQ ID NO: 1626019 - protein, 10 aa, Staphylococcus aureus
LDKDKDAEVQ

SEQ ID NO: 1626020 - protein, 19 aa, Staphylococcus aureus
LDKNEYEADPPLFFFSGPI

SEQ ID NO: 1626021 - protein, 6 aa, Staphylococcus aureus
LDNAEK

SEQ ID NO: 1626022 - protein, 10 aa, Staphylococcus aureus
LEETKKTSDL

SEQ ID NO: 1626023 - protein, 8 aa, Staphylococcus aureus
LEKKGRKE

SEQ ID NO: 1626024 - protein, 12 aa, Staphylococcus aureus
LENTEYVEGKPY

SEQ ID NO: 1626025 - protein, 4 aa, Staphylococcus aureus
LEPI

SEQ ID NO: 1626026 - protein, 7 aa, Staphylococcus aureus
LEPYTED

SEQ ID NO: 1626027 - protein, 8 aa, Staphylococcus aureus
LGAAPDLD

SEQ ID NO: 1626028 - protein, 14 aa, Staphylococcus aureus
LGAIPTSTLGYEKQ

SEQ ID NO: 1626029 - protein, 9 aa, Staphylococcus aureus
LGGKNDYKD

SEQ ID NO: 1626030 - protein, 6 aa, Staphylococcus aureus
LGRTTK

SEQ ID NO: 1626031 - protein, 7 aa, Staphylococcus aureus
LHDSLES

SEQ ID NO: 1626032 - protein, 9 aa, Staphylococcus aureus
LIEQGTRES

SEQ ID NO: 1626033 - protein, 10 aa, Staphylococcus aureus
LISGSSTVYE

SEQ ID NO: 1626034 - protein, 7 aa, Staphylococcus aureus
LKETPKY

SEQ ID NO: 1626035 - protein, 6 aa, Staphylococcus aureus
LKGANT

SEQ ID NO: 1626036 - protein, 10 aa, Staphylococcus aureus
LKGEKVSYEQ

SEQ ID NO: 1626037 - protein, 7 aa, Staphylococcus aureus
LKKYRGK

SEQ ID NO: 1626038 - protein, 9 aa, Staphylococcus aureus
LKSARNKAQ

SEQ ID NO: 1626039 - protein, 10 aa, Staphylococcus aureus
LKSHTTPNNL

SEQ ID NO: 1626040 - protein, 11 aa, Staphylococcus aureus
LKSKNADELLD

SEQ ID NO: 1626041 - protein, 7 aa, Staphylococcus aureus
LKTPEIE

SEQ ID NO: 1626042 - protein, 15 aa, Staphylococcus aureus
LLATPNEDEKPEEIT

SEQ ID NO: 1626043 - protein, 4 aa, Staphylococcus aureus
LMSS

SEQ ID NO: 1626044 - protein, 6 aa, Staphylococcus aureus
LNEEDE

SEQ ID NO: 1626045 - protein, 6 aa, Staphylococcus aureus
LNEHQK

SEQ ID NO: 1626046 - protein, 8 aa, Staphylococcus aureus
LNNEKQQR

SEQ ID NO: 1626047 - protein, 7 aa, Staphylococcus aureus
LNSESQT

SEQ ID NO: 1626048 - protein, 20 aa, Staphylococcus aureus
LNTPQKAKLKEQVGQANRLE

SEQ ID NO: 1626049 - protein, 21 aa, Staphylococcus aureus
LNTPQKAKLKEQVGQANRLED

SEQ ID NO: 1626050 - protein, 35 aa, Staphylococcus aureus; identical to SEQ ID NO: 1566883

SEQ ID NO: 1626051 - protein, 8 aa, Staphylococcus aureus
LNVPQTPM

SEQ ID NO: 1626052 - protein, 13 aa, Staphylococcus aureus
LPAEQVNEAREKA

SEQ ID NO: 1626053 - protein, 5 aa, Staphylococcus aureus
LPNGV

SEQ ID NO: 1626054 - protein, 12 aa, Staphylococcus aureus
LPQRKKIENPHP

SEQ ID NO: 1626055 - protein, 32 aa, Staphylococcus aureus
LQEEYNKRLKEELSRRMKQKEKEKQEAVDEAK

SEQ ID NO: 1626056 - protein, 4 aa, Staphylococcus aureus
LQTI

SEQ ID NO: 1626057 - protein, 15 aa, Staphylococcus aureus
LRQEAAEQSKWTRQK

SEQ ID NO: 1626058 - protein, 7 aa, Staphylococcus aureus
LSDTEKA

SEQ ID NO: 1626059 - protein, 9 aa, Staphylococcus aureus
LSEPETKKI

SEQ ID NO: 1626060 - protein, 5 aa, Staphylococcus aureus
LSGGM

SEQ ID NO: 1626061 - protein, 5 aa, Staphylococcus aureus
LSGGQ

SEQ ID NO: 1626062 - protein, 18 aa, Staphylococcus aureus
LSKKEELEKEINQSKSKY

SEQ ID NO: 1626063 - protein, 10 aa, Staphylococcus aureus
LSNSSTTENI

SEQ ID NO: 1626064 - protein, 6 aa, Staphylococcus aureus
LSQQDD

SEQ ID NO: 1626065 - protein, 14 aa, Staphylococcus aureus
LSTPYFLSGENFRN

SEQ ID NO: 1626066 - protein, 5 aa, Staphylococcus aureus
LSTRY

SEQ ID NO: 1626067 - protein, 10 aa, Staphylococcus aureus
LTEKQAAEAI

SEQ ID NO: 1626068 - protein, 7 aa, Staphylococcus aureus
LTENESK

SEQ ID NO: 1626069 - protein, 5 aa, Staphylococcus aureus
LTKSQ

SEQ ID NO: 1626070 - protein, 12 aa, Staphylococcus aureus
LTNAAGSGKIEA

SEQ ID NO: 1626071 - protein, 13 aa, Staphylococcus aureus
MDRELEQKLEKLV

SEQ ID NO: 1626072 - protein, 4 aa, Staphylococcus aureus
MEEG

SEQ ID NO: 1626073 - protein, 7 aa, Staphylococcus aureus
MKDAESK

SEQ ID NO: 1626074 - protein, 6 aa, Staphylococcus aureus
MKTEGK

SEQ ID NO: 1626075 - protein, 10 aa, Staphylococcus aureus
MNNDNESTDY

SEQ ID NO: 1626076 - protein, 4 aa, Staphylococcus aureus
MNVD

SEQ ID NO: 1626077 - protein, 17 aa, Staphylococcus aureus
MPNARQTKEDVEVSPFD

SEQ ID NO: 1626078 - protein, 14 aa, Staphylococcus aureus
MRKQRDACKKQRDE

SEQ ID NO: 1626079 - protein, 6 aa, Staphylococcus aureus
MSDDMG

SEQ ID NO: 1626080 - protein, 8 aa, Staphylococcus aureus
MSNGEYQR

SEQ ID NO: 1626081 - protein, 7 aa, Staphylococcus aureus
MTGQDAV

SEQ ID NO: 1626082 - protein, 18 aa, Staphylococcus aureus
MTKPETTSNELDLSANDE

SEQ ID NO: 1626083 - protein, 13 aa, Staphylococcus aureus
MVPSGKSNHEMEG

SEQ ID NO: 1626084 - protein, 9 aa, Staphylococcus aureus
MYSGDDNGV

SEQ ID NO: 1626085 - protein, 7 aa, Staphylococcus aureus
NADFDGD

SEQ ID NO: 1626086 - protein, 8 aa, Staphylococcus aureus
NADKGVGS

SEQ ID NO: 1626087 - protein, 13 aa, Staphylococcus aureus
NAIKGEKPISSGA

SEQ ID NO: 1626088 - protein, 11 aa, Staphylococcus aureus
NAKAGKYQEKY

SEQ ID NO: 1626089 - protein, 9 aa, Staphylococcus aureus
NAKGNLEAL

SEQ ID NO: 1626090 - protein, 10 aa, Staphylococcus aureus
NAKGNLEALG

SEQ ID NO: 1626091 - protein, 6 aa, Staphylococcus aureus
NAKKVE

SEQ ID NO: 1626092 - protein, 9 aa, Staphylococcus aureus
NATPEQYDK

SEQ ID NO: 1626093 - protein, 14 aa, Staphylococcus aureus
NDFEKGKNQNHLTD

SEQ ID NO: 1626094 - protein, 25 aa, Staphylococcus aureus
NDKEFKEGMQRARKELNYTANTNTV

SEQ ID NO: 1626095 - protein, 18 aa, Staphylococcus aureus
NDLPSTTRVRKDDGTTEV

SEQ ID NO: 1626096 - protein, 8 aa, Staphylococcus aureus
NDRATQAM

SEQ ID NO: 1626097 - protein, 14 aa, Staphylococcus aureus
NDYSEEIKAEVNNQ

SEQ ID NO: 1626098 - protein, 15 aa, Staphylococcus aureus
NEARNRHSLAHPNTN

SEQ ID NO: 1626099 - protein, 6 aa, Staphylococcus aureus
NEDFSD

SEQ ID NO: 1626100 - protein, 14 aa, Staphylococcus aureus
NEGLKKTLTTKRSR

SEQ ID NO: 1626101 - protein, 4 aa, Staphylococcus aureus
NEID

SEQ ID NO: 1626102 - protein, 8 aa, Staphylococcus aureus
NENKKEIK

SEQ ID NO: 1626103 - protein, 7 aa, Staphylococcus aureus
NENNYGV

SEQ ID NO: 1626104 - protein, 19 aa, Staphylococcus aureus
NEQLDEQNKVTSIDEYKES

SEQ ID NO: 1626105 - protein, 6 aa, Staphylococcus aureus
NEQTQV

SEQ ID NO: 1626106 - protein, 39 aa, Staphylococcus aureus
NESRFKGAKGDKGEPGQPGAKGEAGKKGEQGAPGKNGTV

SEQ ID NO: 1626107 - protein, 5 aa, Staphylococcus aureus
NFHGD

SEQ ID NO: 1626108 - protein, 5 aa, Staphylococcus aureus
NFNSD

SEQ ID NO: 1626109 - protein, 23 aa, Staphylococcus aureus
NGDGINEVKDARVDNTGYDHKTL

SEQ ID NO: 1626110 - protein, 19 aa, Staphylococcus aureus
NGEDEEDSETEPEEMGKTE

SEQ ID NO: 1626111 - protein, 5 aa, Staphylococcus aureus
NGELQ

SEQ ID NO: 1626112 - protein, 4 aa, Staphylococcus aureus
NGGR

SEQ ID NO: 1626113 - protein, 20 aa, Staphylococcus aureus
NGKKAAITAGYSKKTAESLA

SEQ ID NO: 1626114 - protein, 9 aa, Staphylococcus aureus
NGKPAKIDD

SEQ ID NO: 1626115 - protein, 5 aa, Staphylococcus aureus
NGKRK

SEQ ID NO: 1626116 - protein, 5 aa, Staphylococcus aureus
NGLEE

SEQ ID NO: 1626117 - protein, 23 aa, Staphylococcus aureus
NGLKGNVQGPMTLKEPLKSYIQK

SEQ ID NO: 1626118 - protein, 11 aa, Staphylococcus aureus
NGQIQEPSYDP

SEQ ID NO: 1626119 - protein, 9 aa, Staphylococcus aureus
NGSSKSPYH

SEQ ID NO: 1626120 - protein, 7 aa, Staphylococcus aureus
NGTSTPI

SEQ ID NO: 1626121 - protein, 10 aa, Staphylococcus aureus
NHSKKLSVDE

SEQ ID NO: 1626122 - protein, 12 aa, Staphylococcus aureus
NIASNPEEDDEA

SEQ ID NO: 1626123 - protein, 10 aa, Staphylococcus aureus
NKDNKGKETV

SEQ ID NO: 1626124 - protein, 28 aa, Staphylococcus aureus
NKINPPAQKAVGKSASKITVGSKAPYNL

SEQ ID NO: 1626125 - protein, 10 aa, Staphylococcus aureus
NKKEDQITNY

SEQ ID NO: 1626126 - protein, 9 aa, Staphylococcus aureus
NKKMTKSVR

SEQ ID NO: 1626127 - protein, 7 aa, Staphylococcus aureus
NKKPNHY

SEQ ID NO: 1626128 - protein, 5 aa, Staphylococcus aureus
NKLDR

SEQ ID NO: 1626129 - protein, 7 aa, Staphylococcus aureus
NKPIQTI

SEQ ID NO: 1626130 - protein, 14 aa, Staphylococcus aureus
NKRELNTMSESGKD

SEQ ID NO: 1626131 - protein, 7 aa, Staphylococcus aureus
NKSEKYL

SEQ ID NO: 1626132 - protein, 15 aa, Staphylococcus aureus
NKSTGTNVPKDQVEA

SEQ ID NO: 1626133 - protein, 14 aa, Staphylococcus aureus
NKTDSKEEKIKKSF

SEQ ID NO: 1626134 - protein, 15 aa, Staphylococcus aureus
NKTDSKEEQIKKSFE

SEQ ID NO: 1626135 - protein, 17 aa, Staphylococcus aureus
NKTIKSKNMHIDIYLYT

SEQ ID NO: 1626136 - protein, 8 aa, Staphylococcus aureus
NLKGNNIN

SEQ ID NO: 1626137 - protein, 11 aa, Staphylococcus aureus
NLKGSSVGDRK

SEQ ID NO: 1626138 - protein, 6 aa, Staphylococcus aureus
NLPEQQ

SEQ ID NO: 1626139 - protein, 5 aa, Staphylococcus aureus
NMPPN

SEQ ID NO: 1626140 - protein, 7 aa, Staphylococcus aureus
NNELTGQ

SEQ ID NO: 1626141 - protein, 13 aa, Staphylococcus aureus
NNFDNRQPGSNEE

SEQ ID NO: 1626142 - protein, 6 aa, Staphylococcus aureus
NNGARF

SEQ ID NO: 1626143 - protein, 7 aa, Staphylococcus aureus
NNISDNE

SEQ ID NO: 1626144 - protein, 21 aa, Staphylococcus aureus
NNISDNEWQQRLTNFDDLHQH

SEQ ID NO: 1626145 - protein, 5 aa, Staphylococcus aureus
NNPQI

SEQ ID NO: 1626146 - protein, 4 aa, Staphylococcus aureus
NNRL

SEQ ID NO: 1626147 - protein, 17 aa, Staphylococcus aureus
NPESSKQVLESFVKDVF

SEQ ID NO: 1626148 - protein, 11 aa, Staphylococcus aureus
NPKNPGEHQYA

SEQ ID NO: 1626149 - protein, 6 aa, Staphylococcus aureus
NPNPKN

SEQ ID NO: 1626150 - protein, 6 aa, Staphylococcus aureus
NPQHTV

SEQ ID NO: 1626151 - protein, 5 aa, Staphylococcus aureus
NQAAE

SEQ ID NO: 1626152 - protein, 5 aa, Staphylococcus aureus
NQDSF

SEQ ID NO: 1626153 - protein, 14 aa, Staphylococcus aureus
NQMPQSQITQPTHQ

SEQ ID NO: 1626154 - protein, 10 aa, Staphylococcus aureus
NRARQAEITQ

SEQ ID NO: 1626155 - protein, 4 aa, Staphylococcus aureus
NRLP

SEQ ID NO: 1626156 - protein, 5 aa, Staphylococcus aureus
NRNPD

SEQ ID NO: 1626157 - protein, 24 aa, Staphylococcus aureus
NRNYTKESKERLARTISQTNDNLD

SEQ ID NO: 1626158 - protein, 17 aa, Staphylococcus aureus
NRPKTEELRRFLNVINE

SEQ ID NO: 1626159 - protein, 5 aa, Staphylococcus aureus
NRPTY

SEQ ID NO: 1626160 - protein, 4 aa, Staphylococcus aureus
NRQN

SEQ ID NO: 1626161 - protein, 20 aa, Staphylococcus aureus
NRTPEERQNIDTNQDSEYNS

SEQ ID NO: 1626162 - protein, 28 aa, Staphylococcus aureus
NRYDPAGEISYSKETVDKIENSIKIRFL

SEQ ID NO: 1626163 - protein, 7 aa, Staphylococcus aureus
NSINPQK

SEQ ID NO: 1626164 - protein, 7 aa, Staphylococcus aureus
NSVGKGE

SEQ ID NO: 1626165 - protein, 6 aa, Staphylococcus aureus
NTLNNP

SEQ ID NO: 1626166 - protein, 11 aa, Staphylococcus aureus
NTLRHSNGTKV

SEQ ID NO: 1626167 - protein, 9 aa, Staphylococcus aureus
NTNDERYAN

SEQ ID NO: 1626168 - protein, 23 aa, Staphylococcus aureus
NTPIDNSVNTPIDANVKENNTSI

SEQ ID NO: 1626169 - protein, 8 aa, Staphylococcus aureus
NTPTEKHD

SEQ ID NO: 1626170 - protein, 14 aa, Staphylococcus aureus
NTSINNNSATDVTH

SEQ ID NO: 1626171 - protein, 11 aa, Staphylococcus aureus
NTYEPGSTFKS

SEQ ID NO: 1626172 - protein, 11 aa, Staphylococcus aureus
NVPTNNSEGGY

SEQ ID NO: 1626173 - protein, 10 aa, Staphylococcus aureus
NVSKSTAYDM

SEQ ID NO: 1626174 - protein, 6 aa, Staphylococcus aureus
NVSNER

SEQ ID NO: 1626175 - protein, 5 aa, Staphylococcus aureus
NYEDI

SEQ ID NO: 1626176 - protein, 5 aa, Staphylococcus aureus
NYLDT

SEQ ID NO: 1626177 - protein, 7 aa, Staphylococcus aureus
PATSTNR

SEQ ID NO: 1626178 - protein, 10 aa, Staphylococcus aureus
PDKDKTLNEG

SEQ ID NO: 1626179 - protein, 4 aa, Staphylococcus aureus
PDKI

SEQ ID NO: 1626180 - protein, 17 aa, Staphylococcus aureus
PDNSYAYEHENGQYGKS

SEQ ID NO: 1626181 - protein, 6 aa, Staphylococcus aureus
PEELTS

SEQ ID NO: 1626182 - protein, 6 aa, Staphylococcus aureus
PELTSA

SEQ ID NO: 1626183 - protein, 16 aa, Staphylococcus aureus
PEVLTGSTRLKSGTAQ

SEQ ID NO: 1626184 - protein, 27 aa, Staphylococcus aureus
PGIRPKGASQDDQHRITTPEEARQLGS

SEQ ID NO: 1626185 - protein, 11 aa, Staphylococcus aureus
PGKVGYSAETV

SEQ ID NO: 1626186 - protein, 5 aa, Staphylococcus aureus
PIDTP

SEQ ID NO: 1626187 - protein, 14 aa, Staphylococcus aureus
PIEEKEDFETGGNV

SEQ ID NO: 1626188 - protein, 5 aa, Staphylococcus aureus
PISDC

SEQ ID NO: 1626189 - protein, 4 aa, Staphylococcus aureus
PKDE

SEQ ID NO: 1626190 - protein, 11 aa, Staphylococcus aureus
PKNENIQAQQK

SEQ ID NO: 1626191 - protein, 10 aa, Staphylococcus aureus
PLVPTTGKYG

SEQ ID NO: 1626192 - protein, 8 aa, Staphylococcus aureus
PNAKPGAY

SEQ ID NO: 1626193 - protein, 5 aa, Staphylococcus aureus
PNDEM

SEQ ID NO: 1626194 - protein, 21 aa, Staphylococcus aureus
PNGKPYRKNSAIDGGKKTAAF

SEQ ID NO: 1626195 - protein, 13 aa, Staphylococcus aureus
PNGTMGQRWEEGK

SEQ ID NO: 1626196 - protein, 13 aa, Staphylococcus aureus
PNGVTADHPAYRP

SEQ ID NO: 1626197 - protein, 14 aa, Staphylococcus aureus
PNTKKEKQPKRGDD

SEQ ID NO: 1626198 - protein, 5 aa, Staphylococcus aureus
PQEVQ

SEQ ID NO: 1626199 - protein, 5 aa, Staphylococcus aureus
PQTMS

SEQ ID NO: 1626200 - protein, 27 aa, Staphylococcus aureus
PRLSLSEKSLKRTPSFSVNRPGEETGV

SEQ ID NO: 1626201 - protein, 5 aa, Staphylococcus aureus
PSNLY

SEQ ID NO: 1626202 - protein, 23 aa, Staphylococcus aureus
PSSFGNREKDDINQITIDNLNAI

SEQ ID NO: 1626203 - protein, 8 aa, Staphylococcus aureus
PSSGDSVG

SEQ ID NO: 1626204 - protein, 7 aa, Staphylococcus aureus
PTLSKDS

SEQ ID NO: 1626205 - protein, 9 aa, Staphylococcus aureus
PTRYDQPSI

SEQ ID NO: 1626206 - protein, 7 aa, Staphylococcus aureus
PTTLQHK

SEQ ID NO: 1626207 - protein, 17 aa, Staphylococcus aureus
PVNENTPKLTLNEGNTP

SEQ ID NO: 1626208 - protein, 11 aa, Staphylococcus aureus
PVNRDENGYRI

SEQ ID NO: 1626209 - protein, 20 aa, Staphylococcus aureus
PWSQQDTNIGGDRVQSNVSV

SEQ ID NO: 1626210 - protein, 27 aa, Staphylococcus aureus
PYHPDKTTPAPKPEDDSDDNEKNNKKV

SEQ ID NO: 1626211 - protein, 12 aa, Staphylococcus aureus
PYYQTQNKTEFD

SEQ ID NO: 1626212 - protein, 25 aa, Staphylococcus aureus
QAATTKKSDAKAEIAQKASERKTAI

SEQ ID NO: 1626213 - protein, 27 aa, Staphylococcus aureus
QAATTKKSDAKAEIAQKASERKTAIEA

SEQ ID NO: 1626214 - protein, 4 aa, Staphylococcus aureus
QAIQ

SEQ ID NO: 1626215 - protein, 21 aa, Staphylococcus aureus
QAPANYYPEDEYGGYDEYGGY

SEQ ID NO: 1626216 - protein, 22 aa, Staphylococcus aureus
QAPANYYPEDEYGGYDEYGGYI

SEQ ID NO: 1626217 - protein, 7 aa, Staphylococcus aureus
QAVEQRG

SEQ ID NO: 1626218 - protein, 6 aa, Staphylococcus aureus
QDDIDT

SEQ ID NO: 1626219 - protein, 7 aa, Staphylococcus aureus
QDKKETV

SEQ ID NO: 1626220 - protein, 5 aa, Staphylococcus aureus
QDTRE

SEQ ID NO: 1626221 - protein, 29 aa, Staphylococcus aureus
QEDEYEKMKQRELAKNKRKREIQKQGTRK

SEQ ID NO: 1626222 - protein, 8 aa, Staphylococcus aureus
QEKQQAMR

SEQ ID NO: 1626223 - protein, 13 aa, Staphylococcus aureus
QESIKQTNQQLEK

SEQ ID NO: 1626224 - protein, 24 aa, Staphylococcus aureus
QETDTSYTSDSSDTSYKSYKSYTS

SEQ ID NO: 1626225 - protein, 24 aa, Staphylococcus aureus
QFYKGQKQIAGKPITKDTAEKVEK

SEQ ID NO: 1626226 - protein, 15 aa, Staphylococcus aureus
QGGKKDYSRNSVEEE

SEQ ID NO: 1626227 - protein, 6 aa, Staphylococcus aureus
QGKPKL

SEQ ID NO: 1626228 - protein, 13 aa, Staphylococcus aureus
QGLPGALSNSAGT

SEQ ID NO: 1626229 - protein, 7 aa, Staphylococcus aureus
QGQYPDT

SEQ ID NO: 1626230 - protein, 9 aa, Staphylococcus aureus
QGVSTEGAT

SEQ ID NO: 1626231 - protein, 5 aa, Staphylococcus aureus
QHGTA

SEQ ID NO: 1626232 - protein, 21 aa, Staphylococcus aureus
QHTDDYDATETIDASGKVVSP

SEQ ID NO: 1626233 - protein, 12 aa, Staphylococcus aureus
QIAEITSSKRYG

SEQ ID NO: 1626234 - protein, 6 aa, Staphylococcus aureus
QINDKI

SEQ ID NO: 1626235 - protein, 4 aa, Staphylococcus aureus
QIPD

SEQ ID NO: 1626236 - protein, 12 aa, Staphylococcus aureus
QIRKQTRKKITE

SEQ ID NO: 1626237 - protein, 7 aa, Staphylococcus aureus
QIRTLRS

SEQ ID NO: 1626238 - protein, 8 aa, Staphylococcus aureus
QKDKIKQV

SEQ ID NO: 1626239 - protein, 9 aa, Staphylococcus aureus
QKDQEQFNK

SEQ ID NO: 1626240 - protein, 7 aa, Staphylococcus aureus
QKETGKF

SEQ ID NO: 1626241 - protein, 7 aa, Staphylococcus aureus
QKGDNEM

SEQ ID NO: 1626242 - protein, 10 aa, Staphylococcus aureus
QLDRSAERGM

SEQ ID NO: 1626243 - protein, 10 aa, Staphylococcus aureus
QLENKNTNDR

SEQ ID NO: 1626244 - protein, 16 aa, Staphylococcus aureus
QLQEINEKVSSKISKN

SEQ ID NO: 1626245 - protein, 6 aa, Staphylococcus aureus
QNDNQT

SEQ ID NO: 1626246 - protein, 25 aa, Staphylococcus aureus
QNEDGTVSEEIKERTYDLKSKGQGR

SEQ ID NO: 1626247 - protein, 7 aa, Staphylococcus aureus
QNKGIGK

SEQ ID NO: 1626248 - protein, 7 aa, Staphylococcus aureus
QNMADTQ

SEQ ID NO: 1626249 - protein, 4 aa, Staphylococcus aureus
QNNI

SEQ ID NO: 1626250 - protein, 4 aa, Staphylococcus aureus
QNNP

SEQ ID NO: 1626251 - protein, 4 aa, Staphylococcus aureus
QNSE

SEQ ID NO: 1626252 - protein, 8 aa, Staphylococcus aureus
QNSEQNLL

SEQ ID NO: 1626253 - protein, 4 aa, Staphylococcus aureus
QNTP

SEQ ID NO: 1626254 - protein, 6 aa, Staphylococcus aureus
QPDHRP

SEQ ID NO: 1626255 - protein, 8 aa, Staphylococcus aureus
QPPAEKDA

SEQ ID NO: 1626256 - protein, 7 aa, Staphylococcus aureus
QQAEKTA

SEQ ID NO: 1626257 - protein, 8 aa, Staphylococcus aureus
QQHQAISE

SEQ ID NO: 1626258 - protein, 6 aa, Staphylococcus aureus
QQNNKK

SEQ ID NO: 1626259 - protein, 6 aa, Staphylococcus aureus
QQPVGS

SEQ ID NO: 1626260 - protein, 9 aa, Staphylococcus aureus
QQVAQAGLE

SEQ ID NO: 1626261 - protein, 6 aa, Staphylococcus aureus
QQVEQD

SEQ ID NO: 1626262 - protein, 13 aa, Staphylococcus aureus
QRGKHYGATWQDK

SEQ ID NO: 1626263 - protein, 10 aa, Staphylococcus aureus
QSDAKKANIE

SEQ ID NO: 1626264 - protein, 25 aa, Staphylococcus aureus
QSEDDIVTSSVKSNHPVAPSSNQSI

SEQ ID NO: 1626265 - protein, 35 aa, Staphylococcus aureus; identical to SEQ ID NO: 1569387

SEQ ID NO: 1626266 - protein, 35 aa, Staphylococcus aureus; identical to SEQ ID NO: 1569388

SEQ ID NO: 1626267 - protein, 7 aa, Staphylococcus aureus
QSNKVGN

SEQ ID NO: 1626268 - protein, 7 aa, Staphylococcus aureus
QSQFETK

SEQ ID NO: 1626269 - protein, 13 aa, Staphylococcus aureus
QSWSNGNIGTNGV

SEQ ID NO: 1626270 - protein, 5 aa, Staphylococcus aureus
QTEQY

SEQ ID NO: 1626271 - protein, 6 aa, Staphylococcus aureus
QTIENS

SEQ ID NO: 1626272 - protein, 7 aa, Staphylococcus aureus
QTSNNRI

SEQ ID NO: 1626273 - protein, 8 aa, Staphylococcus aureus
QVHPDDDY

SEQ ID NO: 1626274 - protein, 11 aa, Staphylococcus aureus
QVKTKAEQLDQ

SEQ ID NO: 1626275 - protein, 5 aa, Staphylococcus aureus
QVMKS

SEQ ID NO: 1626276 - protein, 13 aa, Staphylococcus aureus
QVQTNELYENSKP

SEQ ID NO: 1626277 - protein, 14 aa, Staphylococcus aureus
RAKSEYTSDESIDA

SEQ ID NO: 1626278 - protein, 18 aa, Staphylococcus aureus
RDAGTGIREYNDGTFGYE

SEQ ID NO: 1626279 - protein, 9 aa, Staphylococcus aureus
RDGSEEKIY

SEQ ID NO: 1626280 - protein, 49 aa, Staphylococcus aureus; identical to SEQ ID NO: 1567213

SEQ ID NO: 1626281 - protein, 9 aa, Staphylococcus aureus
REKDPKKYV

SEQ ID NO: 1626282 - protein, 9 aa, Staphylococcus aureus
REKTKHNNI

SEQ ID NO: 1626283 - protein, 8 aa, Staphylococcus aureus
RENPELSQ

SEQ ID NO: 1626284 - protein, 5 aa, Staphylococcus aureus
REYPG

SEQ ID NO: 1626285 - protein, 4 aa, Staphylococcus aureus
RFEQ

SEQ ID NO: 1626286 - protein, 4 aa, Staphylococcus aureus
RFKQ

SEQ ID NO: 1626287 - protein, 6 aa, Staphylococcus aureus
RGMAEM

SEQ ID NO: 1626288 - protein, 4 aa, Staphylococcus aureus
RGRM

SEQ ID NO: 1626289 - protein, 11 aa, Staphylococcus aureus
RGYTSKRSLRR

SEQ ID NO: 1626290 - protein, 4 aa, Staphylococcus aureus
RIKD

SEQ ID NO: 1626291 - protein, 9 aa, Staphylococcus aureus
RKGTNLTYQ

SEQ ID NO: 1626292 - protein, 4 aa, Staphylococcus aureus
RKMN

SEQ ID NO: 1626293 - protein, 4 aa, Staphylococcus aureus
RKPH

SEQ ID NO: 1626294 - protein, 8 aa, Staphylococcus aureus
RKREDKIP

SEQ ID NO: 1626295 - protein, 8 aa, Staphylococcus aureus
RPDGSKEV

SEQ ID NO: 1626296 - protein, 15 aa, Staphylococcus aureus
RPYGQEKFGTKAELK

SEQ ID NO: 1626297 - protein, 14 aa, Staphylococcus aureus
RQDKEPIKPNPDLS

SEQ ID NO: 1626298 - protein, 15 aa, Staphylococcus aureus
RRKTSSVKALKTHTN

SEQ ID NO: 1626299 - protein, 13 aa, Staphylococcus aureus
RRSTEALYEQQQQ

SEQ ID NO: 1626300 - protein, 6 aa, Staphylococcus aureus
RSENDR

SEQ ID NO: 1626301 - protein, 8 aa, Staphylococcus aureus
RSEPGKRA

SEQ ID NO: 1626302 - protein, 6 aa, Staphylococcus aureus
RSSGYD

SEQ ID NO: 1626303 - protein, 5 aa, Staphylococcus aureus
RTEGL

SEQ ID NO: 1626304 - protein, 4 aa, Staphylococcus aureus
RTLN

SEQ ID NO: 1626305 - protein, 16 aa, Staphylococcus aureus
RTQEDSASSKAEEKFA

SEQ ID NO: 1626306 - protein, 6 aa, Staphylococcus aureus
RYNEGE

SEQ ID NO: 1626307 - protein, 7 aa, Staphylococcus aureus
RYNKDGN

SEQ ID NO: 1626308 - protein, 17 aa, Staphylococcus aureus
SAGGASGEAYMAEQDGQ

SEQ ID NO: 1626309 - protein, 13 aa, Staphylococcus aureus
SDSSNAHTLNSSS

SEQ ID NO: 1626310 - protein, 12 aa, Staphylococcus aureus
SEAGEKHFESDE

SEQ ID NO: 1626311 - protein, 6 aa, Staphylococcus aureus
SEEATN

SEQ ID NO: 1626312 - protein, 9 aa, Staphylococcus aureus
SEEEIGTNF

SEQ ID NO: 1626313 - protein, 4 aa, Staphylococcus aureus
SEKK

SEQ ID NO: 1626314 - protein, 10 aa, Staphylococcus aureus
SELTQEKSEI

SEQ ID NO: 1626315 - protein, 7 aa, Staphylococcus aureus
SESDKKM

SEQ ID NO: 1626316 - protein, 11 aa, Staphylococcus aureus
SETSNKQPSIE

SEQ ID NO: 1626317 - protein, 24 aa, Staphylococcus aureus
SFNFDGKDTKIYGNNATGKTTTAT

SEQ ID NO: 1626318 - protein, 5 aa, Staphylococcus aureus
SGARN

SEQ ID NO: 1626319 - protein, 9 aa, Staphylococcus aureus
SGARNIKTE

SEQ ID NO: 1626320 - protein, 7 aa, Staphylococcus aureus
SGKNWVK

SEQ ID NO: 1626321 - protein, 6 aa, Staphylococcus aureus
SGQHPN

SEQ ID NO: 1626322 - protein, 29 aa, Staphylococcus aureus
SHEADTDTEDTMDGSYNTGGSVESTMSGT

SEQ ID NO: 1626323 - protein, 6 aa, Staphylococcus aureus
SIEETN

SEQ ID NO: 1626324 - protein, 22 aa, Staphylococcus aureus
SIENEDSTQIRKQTRKKELRLR

SEQ ID NO: 1626325 - protein, 18 aa, Staphylococcus aureus
SIKRKDNKITKDDSNVER

SEQ ID NO: 1626326 - protein, 4 aa, Staphylococcus aureus
SIPI

SEQ ID NO: 1626327 - protein, 8 aa, Staphylococcus aureus
SISKGEAL

SEQ ID NO: 1626328 - protein, 13 aa, Staphylococcus aureus
SKCNNEAELKEGI

SEQ ID NO: 1626329 - protein, 7 aa, Staphylococcus aureus
SKGDANY

SEQ ID NO: 1626330 - protein, 24 aa, Staphylococcus aureus
SKGSLTGVDGRLQTRNYENKEGQR

SEQ ID NO: 1626331 - protein, 10 aa, Staphylococcus aureus
SKISSDNVES

SEQ ID NO: 1626332 - protein, 7 aa, Staphylococcus aureus
SKWGERS

SEQ ID NO: 1626333 - protein, 17 aa, Staphylococcus aureus
SLNPSNLPDNDGNGGGV

SEQ ID NO: 1626334 - protein, 11 aa, Staphylococcus aureus
SLYGPTVGDSI

SEQ ID NO: 1626335 - protein, 4 aa, Staphylococcus aureus
SNPF

SEQ ID NO: 1626336 - protein, 4 aa, Staphylococcus aureus
SNPI

SEQ ID NO: 1626337 - protein, 14 aa, Staphylococcus aureus
SNSNQDTANTTDPF

SEQ ID NO: 1626338 - protein, 6 aa, Staphylococcus aureus
SNVDNI

SEQ ID NO: 1626339 - protein, 7 aa, Staphylococcus aureus
SNVTDGF

SEQ ID NO: 1626340 - protein, 14 aa, Staphylococcus aureus
SNVTNNESSATMRE

SEQ ID NO: 1626341 - protein, 11 aa, Staphylococcus aureus
SPTLNSPYDLY

SEQ ID NO: 1626342 - protein, 14 aa, Staphylococcus aureus
SQFKSGERQLPNFE

SEQ ID NO: 1626343 - protein, 8 aa, Staphylococcus aureus
SQNNNFKR

SEQ ID NO: 1626344 - protein, 4 aa, Staphylococcus aureus
SQTS

SEQ ID NO: 1626345 - protein, 7 aa, Staphylococcus aureus
SRDGITL

SEQ ID NO: 1626346 - protein, 7 aa, Staphylococcus aureus
SRDVPNS

SEQ ID NO: 1626347 - protein, 4 aa, Staphylococcus aureus
SSAL

SEQ ID NO: 1626348 - protein, 12 aa, Staphylococcus aureus
SSSFSNPNNAGQ

SEQ ID NO: 1626349 - protein, 7 aa, Staphylococcus aureus
SSTDQNT

SEQ ID NO: 1626350 - protein, 25 aa, Staphylococcus aureus
STDENEKVDIESTENQFESKDKITK

SEQ ID NO: 1626351 - protein, 8 aa, Staphylococcus aureus
STGRKHTH

SEQ ID NO: 1626352 - protein, 9 aa, Staphylococcus aureus
STNEKGKSV

SEQ ID NO: 1626353 - protein, 16 aa, Staphylococcus aureus
STNGMPKFKDKTGGTL

SEQ ID NO: 1626354 - protein, 12 aa, Staphylococcus aureus
STQGLHNRGSFE

SEQ ID NO: 1626355 - protein, 7 aa, Staphylococcus aureus
SVKEAIK

SEQ ID NO: 1626356 - protein, 11 aa, Staphylococcus aureus
SVNQEQQNNLQ

SEQ ID NO: 1626357 - protein, 13 aa, Staphylococcus aureus
SVSTDGASPKLTK

SEQ ID NO: 1626358 - protein, 7 aa, Staphylococcus aureus
SVSTNDI

SEQ ID NO: 1626359 - protein, 8 aa, Staphylococcus aureus
SYEQSYTK

SEQ ID NO: 1626360 - protein, 14 aa, Staphylococcus aureus
SYNDFDADGNVKEM

SEQ ID NO: 1626361 - protein, 8 aa, Staphylococcus aureus
SYTRQSDV

SEQ ID NO: 1626362 - protein, 7 aa, Staphylococcus aureus
TAASATA

SEQ ID NO: 1626363 - protein, 5 aa, Staphylococcus aureus
TAEEI

SEQ ID NO: 1626364 - protein, 4 aa, Staphylococcus aureus
TARK

SEQ ID NO: 1626365 - protein, 5 aa, Staphylococcus aureus
TAYQS

SEQ ID NO: 1626366 - protein, 10 aa, Staphylococcus aureus
TCEGEKDNYK

SEQ ID NO: 1626367 - protein, 12 aa, Staphylococcus aureus
TDAQRRYDNEEL

SEQ ID NO: 1626368 - protein, 4 aa, Staphylococcus aureus
TDDN

SEQ ID NO: 1626369 - protein, 5 aa, Staphylococcus aureus
TDRRK

SEQ ID NO: 1626370 - protein, 7 aa, Staphylococcus aureus
TEAEQAA

SEQ ID NO: 1626371 - protein, 8 aa, Staphylococcus aureus
TEGKPAVD

SEQ ID NO: 1626372 - protein, 4 aa, Staphylococcus aureus
TEGY

SEQ ID NO: 1626373 - protein, 12 aa, Staphylococcus aureus
TEIGNNGNFGAS

SEQ ID NO: 1626374 - protein, 13 aa, Staphylococcus aureus
TEKQSGKSVENRP

SEQ ID NO: 1626375 - protein, 10 aa, Staphylococcus aureus
TFKKEDLEPW

SEQ ID NO: 1626376 - protein, 22 aa, Staphylococcus aureus
TFREQTQSLRQQPQRTTSINGH

SEQ ID NO: 1626377 - protein, 6 aa, Staphylococcus aureus
TGEYQV

SEQ ID NO: 1626378 - protein, 8 aa, Staphylococcus aureus
TGLKEVSE

SEQ ID NO: 1626379 - protein, 4 aa, Staphylococcus aureus
TGLP

SEQ ID NO: 1626380 - protein, 8 aa, Staphylococcus aureus
TGTTLEAN

SEQ ID NO: 1626381 - protein, 7 aa, Staphylococcus aureus
TIDNKQN

SEQ ID NO: 1626382 - protein, 8 aa, Staphylococcus aureus
TIRSSNGM

SEQ ID NO: 1626383 - protein, 14 aa, Staphylococcus aureus
TISMSQDQSNKVVT

SEQ ID NO: 1626384 - protein, 7 aa, Staphylococcus aureus
TKKPLTI

SEQ ID NO: 1626385 - protein, 8 aa, Staphylococcus aureus
TKLEPPLD

SEQ ID NO: 1626386 - protein, 4 aa, Staphylococcus aureus
TKQS

SEQ ID NO: 1626387 - protein, 16 aa, Staphylococcus aureus
TMAQLSKEQKGQISHR

SEQ ID NO: 1626388 - protein, 8 aa, Staphylococcus aureus
TMSEEEQN

SEQ ID NO: 1626389 - protein, 11 aa, Staphylococcus aureus
TNDERNRKEKI

SEQ ID NO: 1626390 - protein, 8 aa, Staphylococcus aureus
TNDQREVG

SEQ ID NO: 1626391 - protein, 4 aa, Staphylococcus aureus
TNDV

SEQ ID NO: 1626392 - protein, 19 aa, Staphylococcus aureus
TNELTSKDYTKNKKAAEEV

SEQ ID NO: 1626393 - protein, 5 aa, Staphylococcus aureus
TNPYN

SEQ ID NO: 1626394 - protein, 8 aa, Staphylococcus aureus
TNQKQRSE

SEQ ID NO: 1626395 - protein, 37 aa, Staphylococcus aureus
TNSASSSIKSAVETCNNVSKPDKDESTTVSGNNNAHS

SEQ ID NO: 1626396 - protein, 4 aa, Staphylococcus aureus
TNSN

SEQ ID NO: 1626397 - protein, 16 aa, Staphylococcus aureus
TNTIIGENDSGKTNAL

SEQ ID NO: 1626398 - protein, 4 aa, Staphylococcus aureus
TNVY

SEQ ID NO: 1626399 - protein, 6 aa, Staphylococcus aureus
TPNALT

SEQ ID NO: 1626400 - protein, 30 aa, Staphylococcus aureus
TQDQLGEKLNTKKATISNYETGYRTPKQDD

SEQ ID NO: 1626401 - protein, 5 aa, Staphylococcus aureus
TQPLQ

SEQ ID NO: 1626402 - protein, 17 aa, Staphylococcus aureus
TRDASGGADDTREGTVM

SEQ ID NO: 1626403 - protein, 6 aa, Staphylococcus aureus
TRYDSG

SEQ ID NO: 1626404 - protein, 8 aa, Staphylococcus aureus
TSHKAMSD

SEQ ID NO: 1626405 - protein, 36 aa, Staphylococcus aureus; identical to SEQ ID NO: 1564728

SEQ ID NO: 1626406 - protein, 5 aa, Staphylococcus aureus
TTGAK

SEQ ID NO: 1626407 - protein, 4 aa, Staphylococcus aureus
TTKE

SEQ ID NO: 1626408 - protein, 8 aa, Staphylococcus aureus
TTQPEPYS

SEQ ID NO: 1626409 - protein, 8 aa, Staphylococcus aureus
TTTQDKAV

SEQ ID NO: 1626410 - protein, 18 aa, Staphylococcus aureus
TVDSPTVRVGGEAQASFN

SEQ ID NO: 1626411 - protein, 14 aa, Staphylococcus aureus
TVEDSIGNNESDYE

SEQ ID NO: 1626412 - protein, 8 aa, Staphylococcus aureus
TVPRDENL

SEQ ID NO: 1626413 - protein, 11 aa, Staphylococcus aureus
TVRDNAQTLNT

SEQ ID NO: 1626414 - protein, 19 aa, Staphylococcus aureus
TVSNESSASSNTVKPVASA

SEQ ID NO: 1626415 - protein, 4 aa, Staphylococcus aureus
TVTQ

SEQ ID NO: 1626416 - protein, 8 aa, Staphylococcus aureus
TWTNRPGA

SEQ ID NO: 1626417 - protein, 4 aa, Staphylococcus aureus
VAEG

SEQ ID NO: 1626418 - protein, 4 aa, Staphylococcus aureus
VAKY

SEQ ID NO: 1626419 - protein, 7 aa, Staphylococcus aureus
VATATFR

SEQ ID NO: 1626420 - protein, 7 aa, Staphylococcus aureus
VDDRKEV

SEQ ID NO: 1626421 - protein, 9 aa, Staphylococcus aureus
VDESHLSKG

SEQ ID NO: 1626422 - protein, 5 aa, Staphylococcus aureus
VDGRV

SEQ ID NO: 1626423 - protein, 8 aa, Staphylococcus aureus
VDKEKETL

SEQ ID NO: 1626424 - protein, 9 aa, Staphylococcus aureus
VDNTEAEGK

SEQ ID NO: 1626425 - protein, 11 aa, Staphylococcus aureus
VDQGESLNAPT

SEQ ID NO: 1626426 - protein, 6 aa, Staphylococcus aureus
VEMRDG

SEQ ID NO: 1626427 - protein, 8 aa, Staphylococcus aureus
VEPKEDVD

SEQ ID NO: 1626428 - protein, 4 aa, Staphylococcus aureus
VEPS

SEQ ID NO: 1626429 - protein, 11 aa, Staphylococcus aureus
VGNSGNSTEPH

SEQ ID NO: 1626430 - protein, 11 aa, Staphylococcus aureus
VHGQKRARTYE

SEQ ID NO: 1626431 - protein, 16 aa, Staphylococcus aureus
VKEAPMPKEETAQLET

SEQ ID NO: 1626432 - protein, 6 aa, Staphylococcus aureus
VKEKGF

SEQ ID NO: 1626433 - protein, 15 aa, Staphylococcus aureus
VKKMTGASSRTNVRQ

SEQ ID NO: 1626434 - protein, 8 aa, Staphylococcus aureus
VKKQKSKI

SEQ ID NO: 1626435 - protein, 7 aa, Staphylococcus aureus
VKPETKY

SEQ ID NO: 1626436 - protein, 11 aa, Staphylococcus aureus
VKQTATSLDQA

SEQ ID NO: 1626437 - protein, 14 aa, Staphylococcus aureus
VKSEAYKALEEKGR

SEQ ID NO: 1626438 - protein, 11 aa, Staphylococcus aureus
VKTTKSDPAKY

SEQ ID NO: 1626439 - protein, 8 aa, Staphylococcus aureus
VLGGSSSI

SEQ ID NO: 1626440 - protein, 5 aa, Staphylococcus aureus
VLPDN

SEQ ID NO: 1626441 - protein, 10 aa, Staphylococcus aureus
VNADEYEAIG

SEQ ID NO: 1626442 - protein, 11 aa, Staphylococcus aureus
VPGNHELKDTN

SEQ ID NO: 1626443 - protein, 11 aa, Staphylococcus aureus
VPGNNELKDTN

SEQ ID NO: 1626444 - protein, 6 aa, Staphylococcus aureus
VPNEHK

SEQ ID NO: 1626445 - protein, 8 aa, Staphylococcus aureus
VSDNPHTY

SEQ ID NO: 1626446 - protein, 8 aa, Staphylococcus aureus
VSGESDDM

SEQ ID NO: 1626447 - protein, 10 aa, Staphylococcus aureus
VSKAENPYDQ

SEQ ID NO: 1626448 - protein, 9 aa, Staphylococcus aureus
VTATGKAVH

SEQ ID NO: 1626449 - protein, 13 aa, Staphylococcus aureus
VTLQKQQQKQRAL

SEQ ID NO: 1626450 - protein, 9 aa, Staphylococcus aureus
VTLTDGKVK

SEQ ID NO: 1626451 - protein, 7 aa, Staphylococcus aureus
VTPDPEC

SEQ ID NO: 1626452 - protein, 4 aa, Staphylococcus aureus
VTQN

SEQ ID NO: 1626453 - protein, 8 aa, Staphylococcus aureus
VTSTDDKN

SEQ ID NO: 1626454 - protein, 5 aa, Staphylococcus aureus
VTWSN

SEQ ID NO: 1626455 - protein, 17 aa, Staphylococcus aureus
VYSKQDRQFFKGNRDYE

SEQ ID NO: 1626456 - protein, 10 aa, Staphylococcus aureus
WKDAQEASDI

SEQ ID NO: 1626457 - protein, 6 aa, Staphylococcus aureus
WRGPNI

SEQ ID NO: 1626458 - protein, 6 aa, Staphylococcus aureus
YDGIPD

SEQ ID NO: 1626459 - protein, 4 aa, Staphylococcus aureus
YDNK

SEQ ID NO: 1626460 - protein, 5 aa, Staphylococcus aureus
YDSEQ

SEQ ID NO: 1626461 - protein, 4 aa, Staphylococcus aureus
YEQY

SEQ ID NO: 1626462 - protein, 10 aa, Staphylococcus aureus
YERKKEKQSV

SEQ ID NO: 1626463 - protein, 4 aa, Staphylococcus aureus
YEYS

SEQ ID NO: 1626464 - protein, 7 aa, Staphylococcus aureus
YGKDDEV

SEQ ID NO: 1626465 - protein, 8 aa, Staphylococcus aureus
YGQAPQPF

SEQ ID NO: 1626466 - protein, 10 aa, Staphylococcus aureus
YGSDASAALH

SEQ ID NO: 1626467 - protein, 7 aa, Staphylococcus aureus
YGSKSNV

SEQ ID NO: 1626468 - protein, 9 aa, Staphylococcus aureus
YHQPNDTTL

SEQ ID NO: 1626469 - protein, 19 aa, Staphylococcus aureus
YHRPTSPDYTVGTEPLTQQ

SEQ ID NO: 1626470 - protein, 10 aa, Staphylococcus aureus
YKNNAETEKY

SEQ ID NO: 1626471 - protein, 9 aa, Staphylococcus aureus
YNIPTDKSP

SEQ ID NO: 1626472 - protein, 10 aa, Staphylococcus aureus
YNIPTNKAPK

SEQ ID NO: 1626473 - protein, 11 aa, Staphylococcus aureus
YNKNTKETMPF

SEQ ID NO: 1626474 - protein, 11 aa, Staphylococcus aureus
YNQSKKENEYV

SEQ ID NO: 1626475 - protein, 7 aa, Staphylococcus aureus
YNQTHPD

SEQ ID NO: 1626476 - protein, 4 aa, Staphylococcus aureus
YPKT

SEQ ID NO: 1626477 - protein, 4 aa, Staphylococcus aureus
YPMP

SEQ ID NO: 1626478 - protein, 19 aa, Staphylococcus aureus
YQEDGNNRVRNLESQKDDL

SEQ ID NO: 1626479 - protein, 8 aa, Staphylococcus aureus
YQETGGLH

SEQ ID NO: 1626480 - protein, 7 aa, Staphylococcus aureus
YQGIDKN

SEQ ID NO: 1626481 - protein, 6 aa, Staphylococcus aureus
YRDKQS

SEQ ID NO: 1626482 - protein, 5 aa, Staphylococcus aureus
YSDGA

SEQ ID NO: 1626483 - protein, 14 aa, Staphylococcus aureus
YSDNIKTYESHGDE

SEQ ID NO: 1626484 - protein, 15 aa, Staphylococcus aureus
YSDNPNSKSFGGTDA

SEQ ID NO: 1626485 - protein, 11 aa, Staphylococcus aureus
YSEKAGSGGPR

SEQ ID NO: 1626486 - protein, 5 aa, Staphylococcus aureus
YSEST

SEQ ID NO: 1626487 - protein, 4 aa, Staphylococcus aureus
YSRH

SEQ ID NO: 1626488 - protein, 8 aa, Staphylococcus aureus
YVNSQNKV

SEQ ID NO: 1626489 - protein, 11 aa, Staphylococcus aureus
YYNPNNNKKQY

SEQ ID NO: 1626490 - protein, 13 aa, Staphylococcus aureus
YYNRDEDDSITGK

SEQ ID NO: 1626491 - protein, 7 aa, Staphylococcus aureus
AARVSDK

SEQ ID NO: 1626492 - protein, 16 aa, Staphylococcus aureus
AAVNGHKQTAESLNTA

SEQ ID NO: 1626493 - protein, 7 aa, Staphylococcus aureus
ADETIES

SEQ ID NO: 1626494 - protein, 17 aa, Staphylococcus aureus
ADKVSLNSSALKNPQLI

SEQ ID NO: 1626495 - protein, 9 aa, Staphylococcus aureus
ADPGWLGPK

SEQ ID NO: 1626496 - protein, 8 aa, Staphylococcus aureus
ADSRDLNY

SEQ ID NO: 1626497 - protein, 9 aa, Staphylococcus aureus
AEAGRTDNV

SEQ ID NO: 1626498 - protein, 22 aa, Staphylococcus aureus
AEDGSVDFEDNRYTENTRAAYP

SEQ ID NO: 1626499 - protein, 17 aa, Staphylococcus aureus
AEGTVEPQATPTIASPF

SEQ ID NO: 1626500 - protein, 14 aa, Staphylococcus aureus
AEGTVEPQATPTIS

SEQ ID NO: 1626501 - protein, 11 aa, Staphylococcus aureus
AELSGGQQQRI

SEQ ID NO: 1626502 - protein, 8 aa, Staphylococcus aureus
AENRKQDS

SEQ ID NO: 1626503 - protein, 13 aa, Staphylococcus aureus
AEQANEGYSIHEQ

SEQ ID NO: 1626504 - protein, 16 aa, Staphylococcus aureus
AESKEEAERKYEAQVK

SEQ ID NO: 1626505 - protein, 27 aa, Staphylococcus aureus
AESKEEAKEKYEARNKPVDGATNLNDI

SEQ ID NO: 1626506 - protein, 27 aa, Staphylococcus aureus
AETENDYQNAQQYSEQKPSADSTQTEI

SEQ ID NO: 1626507 - protein, 7 aa, Staphylococcus aureus
AETERDT

SEQ ID NO: 1626508 - protein, 4 aa, Staphylococcus aureus
AEVE

SEQ ID NO: 1626509 - protein, 6 aa, Staphylococcus aureus
AFNGKI

SEQ ID NO: 1626510 - protein, 6 aa, Staphylococcus aureus
AFSDAN

SEQ ID NO: 1626511 - protein, 15 aa, Staphylococcus aureus
AGANAALNAFDYIIR

SEQ ID NO: 1626512 - protein, 11 aa, Staphylococcus aureus
AGDSNRKNQEE

SEQ ID NO: 1626513 - protein, 8 aa, Staphylococcus aureus
AGENASGG

SEQ ID NO: 1626514 - protein, 12 aa, Staphylococcus aureus
AGFGNGTDQEYD

SEQ ID NO: 1626515 - protein, 11 aa, Staphylococcus aureus
AGGAVTGGTTL

SEQ ID NO: 1626516 - protein, 4 aa, Staphylococcus aureus
AGNF

SEQ ID NO: 1626517 - protein, 5 aa, Staphylococcus aureus
AGNRQ

SEQ ID NO: 1626518 - protein, 11 aa, Staphylococcus aureus
AGTTVSRASLH

SEQ ID NO: 1626519 - protein, 13 aa, Staphylococcus aureus
AHGKPSGIDTQTI

SEQ ID NO: 1626520 - protein, 10 aa, Staphylococcus aureus
AIANDQGITK

SEQ ID NO: 1626521 - protein, 7 aa, Staphylococcus aureus
AIEDAES

SEQ ID NO: 1626522 - protein, 12 aa, Staphylococcus aureus
AIRTKNLDQMTK

SEQ ID NO: 1626523 - protein, 5 aa, Staphylococcus aureus
AITPS

SEQ ID NO: 1626524 - protein, 4 aa, Staphylococcus aureus
AKAD

SEQ ID NO: 1626525 - protein, 9 aa, Staphylococcus aureus
AKEKLKKNN

SEQ ID NO: 1626526 - protein, 6 aa, Staphylococcus aureus
AKENLT

SEQ ID NO: 1626527 - protein, 4 aa, Staphylococcus aureus
AKLD

SEQ ID NO: 1626528 - protein, 9 aa, Staphylococcus aureus
AKNNDKKSL

SEQ ID NO: 1626529 - protein, 8 aa, Staphylococcus aureus
AKNQPTKG

SEQ ID NO: 1626530 - protein, 7 aa, Staphylococcus aureus
AKQLPQI

SEQ ID NO: 1626531 - protein, 8 aa, Staphylococcus aureus
AKRNPREI

SEQ ID NO: 1626532 - protein, 10 aa, Staphylococcus aureus
AKSMEEETGI

SEQ ID NO: 1626533 - protein, 7 aa, Staphylococcus aureus
AKSNIGI

SEQ ID NO: 1626534 - protein, 4 aa, Staphylococcus aureus
AKTM

SEQ ID NO: 1626535 - protein, 9 aa, Staphylococcus aureus
AKTNATQAI

SEQ ID NO: 1626536 - protein, 10 aa, Staphylococcus aureus
AKTNGKHDIE

SEQ ID NO: 1626537 - protein, 6 aa, Staphylococcus aureus
ALKSQG

SEQ ID NO: 1626538 - protein, 10 aa, Staphylococcus aureus
ALQDKTETLN

SEQ ID NO: 1626539 - protein, 8 aa, Staphylococcus aureus
ALSQLTSS

SEQ ID NO: 1626540 - protein, 8 aa, Staphylococcus aureus
ALSQVTTA

SEQ ID NO: 1626541 - protein, 5 aa, Staphylococcus aureus
AMENR

SEQ ID NO: 1626542 - protein, 11 aa, Staphylococcus aureus
AMGKEETLSTA

SEQ ID NO: 1626543 - protein, 8 aa, Staphylococcus aureus
ANATDEEA

SEQ ID NO: 1626544 - protein, 4 aa, Staphylococcus aureus
ANDS

SEQ ID NO: 1626545 - protein, 4 aa, Staphylococcus aureus
ANFE

SEQ ID NO: 1626546 - protein, 11 aa, Staphylococcus aureus
ANGPTTPEATR

SEQ ID NO: 1626547 - protein, 6 aa, Staphylococcus aureus
ANKGDL

SEQ ID NO: 1626548 - protein, 6 aa, Staphylococcus aureus
ANKQNF

SEQ ID NO: 1626549 - protein, 7 aa, Staphylococcus aureus
ANLDRND

SEQ ID NO: 1626550 - protein, 62 aa, Staphylococcus aureus
ANPVKKPAGKKELDQAAADKKTQIEQTPNASQQEINDAKQEVDTELNQAKTNVDQSSTNEYV

SEQ ID NO: 1626551 - protein, 17 aa, Staphylococcus aureus
APANYYPEDEYGGYIEP

SEQ ID NO: 1626552 - protein, 12 aa, Staphylococcus aureus
APDGNTISATEH

SEQ ID NO: 1626553 - protein, 24 aa, Staphylococcus aureus
APISEEERENMKRTITKPRPGHAD

SEQ ID NO: 1626554 - protein, 11 aa, Staphylococcus aureus
APNPGSDAAIA

SEQ ID NO: 1626555 - protein, 27 aa, Staphylococcus aureus
APPQEKPPSKYTEYENEQMKKKGLTPE

SEQ ID NO: 1626556 - protein, 10 aa, Staphylococcus aureus
AQNAIDTEGR

SEQ ID NO: 1626557 - protein, 7 aa, Staphylococcus aureus
AQQPPYT

SEQ ID NO: 1626558 - protein, 11 aa, Staphylococcus aureus
AQREVNKAPMD

SEQ ID NO: 1626559 - protein, 6 aa, Staphylococcus aureus
AQSEGY

SEQ ID NO: 1626560 - protein, 4 aa, Staphylococcus aureus
AQSR

SEQ ID NO: 1626561 - protein, 4 aa, Staphylococcus aureus
ARDT

SEQ ID NO: 1626562 - protein, 24 aa, Staphylococcus aureus
ARERKKSDERIKDAVQEAEKLAKM

SEQ ID NO: 1626563 - protein, 4 aa, Staphylococcus aureus
ARKP

SEQ ID NO: 1626564 - protein, 42 aa, Staphylococcus aureus
ARPRFNKPSETNAYNVTTNQDGTVSYGARPTQNKPSETNAYN

SEQ ID NO: 1626565 - protein, 10 aa, Staphylococcus aureus
ARPTRNTSSI

SEQ ID NO: 1626566 - protein, 10 aa, Staphylococcus aureus
ASEAKENEPI

SEQ ID NO: 1626567 - protein, 23 aa, Staphylococcus aureus
ASEASSTTSVDLANRSRSLTEEN

SEQ ID NO: 1626568 - protein, 8 aa, Staphylococcus aureus
ASEIPESD

SEQ ID NO: 1626569 - protein, 11 aa, Staphylococcus aureus
ASGGSAFNSTY

SEQ ID NO: 1626570 - protein, 7 aa, Staphylococcus aureus
ASISNEE

SEQ ID NO: 1626571 - protein, 13 aa, Staphylococcus aureus
ASKFEGLGKGDTR

SEQ ID NO: 1626572 - protein, 8 aa, Staphylococcus aureus
ASKYGSNV

SEQ ID NO: 1626573 - protein, 10 aa, Staphylococcus aureus
ASLKTSDTAD

SEQ ID NO: 1626574 - protein, 5 aa, Staphylococcus aureus
ASLSR

SEQ ID NO: 1626575 - protein, 8 aa, Staphylococcus aureus
ASNATYEE

SEQ ID NO: 1626576 - protein, 9 aa, Staphylococcus aureus
ASNCPASDL

SEQ ID NO: 1626577 - protein, 9 aa, Staphylococcus aureus
ASRRAQTLS

SEQ ID NO: 1626578 - protein, 12 aa, Staphylococcus aureus
ASWRGPNTENFK

SEQ ID NO: 1626579 - protein, 8 aa, Staphylococcus aureus
ATDAPTFK

SEQ ID NO: 1626580 - protein, 16 aa, Staphylococcus aureus
ATGTPAGVGAGMQPPK

SEQ ID NO: 1626581 - protein, 7 aa, Staphylococcus aureus
ATHSDPS

SEQ ID NO: 1626582 - protein, 10 aa, Staphylococcus aureus
ATKSARHQLQ

SEQ ID NO: 1626583 - protein, 6 aa, Staphylococcus aureus
ATLNDI

SEQ ID NO: 1626584 - protein, 20 aa, Staphylococcus aureus
ATMGKSPHQNDRMTLKLNKN

SEQ ID NO: 1626585 - protein, 4 aa, Staphylococcus aureus
ATNF

SEQ ID NO: 1626586 - protein, 57 aa, Staphylococcus aureus
ATNKENEEVKSLTEEQGQDKLEDTHSEGSTQDVNDLAENAEVKKKPRKLSEADFDDD

SEQ ID NO: 1626587 - protein, 9 aa, Staphylococcus aureus
ATNNHTPIK

SEQ ID NO: 1626588 - protein, 6 aa, Staphylococcus aureus
ATPEQL

SEQ ID NO: 1626589 - protein, 6 aa, Staphylococcus aureus
ATQASI

SEQ ID NO: 1626590 - protein, 6 aa, Staphylococcus aureus
ATQIQK

SEQ ID NO: 1626591 - protein, 4 aa, Staphylococcus aureus
ATQK

SEQ ID NO: 1626592 - protein, 6 aa, Staphylococcus aureus
ATQTQI

SEQ ID NO: 1626593 - protein, 9 aa, Staphylococcus aureus
ATSTTNNKD

SEQ ID NO: 1626594 - protein, 19 aa, Staphylococcus aureus
ATTDKEKGALKQLATNEGY

SEQ ID NO: 1626595 - protein, 10 aa, Staphylococcus aureus
AVAPSNDKQG

SEQ ID NO: 1626596 - protein, 8 aa, Staphylococcus aureus
AYGTPVET

SEQ ID NO: 1626597 - protein, 9 aa, Staphylococcus aureus
AYVSSETDI

SEQ ID NO: 1626598 - protein, 7 aa, Staphylococcus aureus
CGPGRRK

SEQ ID NO: 1626599 - protein, 5 aa, Staphylococcus aureus
CNRRP

SEQ ID NO: 1626600 - protein, 9 aa, Staphylococcus aureus
CPGSGKTRV

SEQ ID NO: 1626601 - protein, 8 aa, Staphylococcus aureus
CRDPHDSR

SEQ ID NO: 1626602 - protein, 15 aa, Staphylococcus aureus
CSVQRKNQKLIEESP

SEQ ID NO: 1626603 - protein, 6 aa, Staphylococcus aureus
DAKDGY

SEQ ID NO: 1626604 - protein, 19 aa, Staphylococcus aureus
DALQQQVNSQVDDSHYTTA

SEQ ID NO: 1626605 - protein, 7 aa, Staphylococcus aureus
DANNNNK

SEQ ID NO: 1626606 - protein, 7 aa, Staphylococcus aureus
DARHNRQ

SEQ ID NO: 1626607 - protein, 15 aa, Staphylococcus aureus
DARMPERNHKTDAGY

SEQ ID NO: 1626608 - protein, 13 aa, Staphylococcus aureus
DASVGANTKVGPF

SEQ ID NO: 1626609 - protein, 26 aa, Staphylococcus aureus
DDAEDGNLINTSDEDKITDEEAKAHS

SEQ ID NO: 1626610 - protein, 12 aa, Staphylococcus aureus
DDAKLETRNGYN

SEQ ID NO: 1626611 - protein, 8 aa, Staphylococcus aureus
DDDEQTKV

SEQ ID NO: 1626612 - protein, 5 aa, Staphylococcus aureus
DDGEI

SEQ ID NO: 1626613 - protein, 7 aa, Staphylococcus aureus
DDIADSI

SEQ ID NO: 1626614 - protein, 8 aa, Staphylococcus aureus
DDKNGYLA

SEQ ID NO: 1626615 - protein, 9 aa, Staphylococcus aureus
DDKQDQSLV

SEQ ID NO: 1626616 - protein, 7 aa, Staphylococcus aureus
DDLKREI

SEQ ID NO: 1626617 - protein, 7 aa, Staphylococcus aureus
DDNATNV

SEQ ID NO: 1626618 - protein, 4 aa, Staphylococcus aureus
DDNV

SEQ ID NO: 1626619 - protein, 10 aa, Staphylococcus aureus
DDRIPTRNLN

SEQ ID NO: 1626620 - protein, 5 aa, Staphylococcus aureus
DDSGR

SEQ ID NO: 1626621 - protein, 8 aa, Staphylococcus aureus
DDTKRKAF

SEQ ID NO: 1626622 - protein, 8 aa, Staphylococcus aureus
DDYHQKHG

SEQ ID NO: 1626623 - protein, 5 aa, Staphylococcus aureus
DEELT

SEQ ID NO: 1626624 - protein, 5 aa, Staphylococcus aureus
DEFNQ

SEQ ID NO: 1626625 - protein, 4 aa, Staphylococcus aureus
DEGK

SEQ ID NO: 1626626 - protein, 15 aa, Staphylococcus aureus
DEGQVNESSMVREPE

SEQ ID NO: 1626627 - protein, 8 aa, Staphylococcus aureus
DEKPQLET

SEQ ID NO: 1626628 - protein, 15 aa, Staphylococcus aureus
DEMDKKEKEKLSQQQ

SEQ ID NO: 1626629 - protein, 8 aa, Staphylococcus aureus
DENGYKAG

SEQ ID NO: 1626630 - protein, 5 aa, Staphylococcus aureus
DENSV

SEQ ID NO: 1626631 - protein, 6 aa, Staphylococcus aureus
DENVMN

SEQ ID NO: 1626632 - protein, 10 aa, Staphylococcus aureus
DEQDNEIEMT

SEQ ID NO: 1626633 - protein, 10 aa, Staphylococcus aureus
DEVKSKQTQF

SEQ ID NO: 1626634 - protein, 9 aa, Staphylococcus aureus
DEYKYSAKK

SEQ ID NO: 1626635 - protein, 5 aa, Staphylococcus aureus
DFEND

SEQ ID NO: 1626636 - protein, 21 aa, Staphylococcus aureus
DFPDPDSPIIATNSPAPTDKF

SEQ ID NO: 1626637 - protein, 8 aa, Staphylococcus aureus
DGDKKVAT

SEQ ID NO: 1626638 - protein, 5 aa, Staphylococcus aureus
DGENI

SEQ ID NO: 1626639 - protein, 6 aa, Staphylococcus aureus
DGGMSD

SEQ ID NO: 1626640 - protein, 5 aa, Staphylococcus aureus
DGLKF

SEQ ID NO: 1626641 - protein, 4 aa, Staphylococcus aureus
DGNG

SEQ ID NO: 1626642 - protein, 9 aa, Staphylococcus aureus
DGRTGEPFD

SEQ ID NO: 1626643 - protein, 11 aa, Staphylococcus aureus
DGSGNKKPKIL

SEQ ID NO: 1626644 - protein, 7 aa, Staphylococcus aureus
DGSQYGE

SEQ ID NO: 1626645 - protein, 6 aa, Staphylococcus aureus
DGSYNH

SEQ ID NO: 1626646 - protein, 23 aa, Staphylococcus aureus
DGTLSSKIVTTNNKSLDKVYNQT

SEQ ID NO: 1626647 - protein, 7 aa, Staphylococcus aureus
DGTNETF

SEQ ID NO: 1626648 - protein, 8 aa, Staphylococcus aureus
DGTNPALN

SEQ ID NO: 1626649 - protein, 5 aa, Staphylococcus aureus
DGVMP

SEQ ID NO: 1626650 - protein, 8 aa, Staphylococcus aureus
DHPKPVPY

SEQ ID NO: 1626651 - protein, 9 aa, Staphylococcus aureus
DIDKPSEPF

SEQ ID NO: 1626652 - protein, 6 aa, Staphylococcus aureus
DINGNR

SEQ ID NO: 1626653 - protein, 8 aa, Staphylococcus aureus
DIPSSPVL

SEQ ID NO: 1626654 - protein, 17 aa, Staphylococcus aureus
DISEERNSSEVKDKKEQ

SEQ ID NO: 1626655 - protein, 17 aa, Staphylococcus aureus
DKDDPRFDNPTKPIGPF

SEQ ID NO: 1626656 - protein, 14 aa, Staphylococcus aureus
DKDTTSQINSPKSN

SEQ ID NO: 1626657 - protein, 6 aa, Staphylococcus aureus
DKEYSE

SEQ ID NO: 1626658 - protein, 6 aa, Staphylococcus aureus
DKGYLD

SEQ ID NO: 1626659 - protein, 10 aa, Staphylococcus aureus
DKKDNIDDGS

SEQ ID NO: 1626660 - protein, 7 aa, Staphylococcus aureus
DKKPELR

SEQ ID NO: 1626661 - protein, 7 aa, Staphylococcus aureus
DKKSELR

SEQ ID NO: 1626662 - protein, 8 aa, Staphylococcus aureus
DKLTPNQM

SEQ ID NO: 1626663 - protein, 15 aa, Staphylococcus aureus
DKQSGRTDKRNGYQQ

SEQ ID NO: 1626664 - protein, 5 aa, Staphylococcus aureus
DLGDS

SEQ ID NO: 1626665 - protein, 5 aa, Staphylococcus aureus
DLKEG

SEQ ID NO: 1626666 - protein, 7 aa, Staphylococcus aureus
DLNNKYP

SEQ ID NO: 1626667 - protein, 18 aa, Staphylococcus aureus
DLTNAQKDAAKRQIEGAT

SEQ ID NO: 1626668 - protein, 8 aa, Staphylococcus aureus
DNDSRGSF

SEQ ID NO: 1626669 - protein, 8 aa, Staphylococcus aureus
DNKDNTDA

SEQ ID NO: 1626670 - protein, 7 aa, Staphylococcus aureus
DNKTWNE

SEQ ID NO: 1626671 - protein, 11 aa, Staphylococcus aureus
DNLTEQEKNNY

SEQ ID NO: 1626672 - protein, 4 aa, Staphylococcus aureus
DNNN

SEQ ID NO: 1626673 - protein, 5 aa, Staphylococcus aureus
DNPDI

SEQ ID NO: 1626674 - protein, 6 aa, Staphylococcus aureus
DNQGGE

SEQ ID NO: 1626675 - protein, 11 aa, Staphylococcus aureus
DNVDVENKTLE

SEQ ID NO: 1626676 - protein, 17 aa, Staphylococcus aureus
DNYNDNSNDNMNGAADI

SEQ ID NO: 1626677 - protein, 17 aa, Staphylococcus aureus
DPFKKADQLVKEAQEQT

SEQ ID NO: 1626678 - protein, 14 aa, Staphylococcus aureus
DPGVSGGSMKRPSL

SEQ ID NO: 1626679 - protein, 7 aa, Staphylococcus aureus
DPGWLGP

SEQ ID NO: 1626680 - protein, 7 aa, Staphylococcus aureus
DPKECQE

SEQ ID NO: 1626681 - protein, 7 aa, Staphylococcus aureus
DQDANLN

SEQ ID NO: 1626682 - protein, 4 aa, Staphylococcus aureus
DQGY

SEQ ID NO: 1626683 - protein, 12 aa, Staphylococcus aureus
DQIGHSKKESYS

SEQ ID NO: 1626684 - protein, 17 aa, Staphylococcus aureus
DQINGQQETRTRLSDEL

SEQ ID NO: 1626685 - protein, 5 aa, Staphylococcus aureus
DQNLS

SEQ ID NO: 1626686 - protein, 8 aa, Staphylococcus aureus
DRDNQLNT

SEQ ID NO: 1626687 - protein, 12 aa, Staphylococcus aureus
DRELDRKLEKLI

SEQ ID NO: 1626688 - protein, 8 aa, Staphylococcus aureus
DRGARGKD

SEQ ID NO: 1626689 - protein, 4 aa, Staphylococcus aureus
DRIG

SEQ ID NO: 1626690 - protein, 15 aa, Staphylococcus aureus
DRKVNKAFRHIGHSH

SEQ ID NO: 1626691 - protein, 7 aa, Staphylococcus aureus
DRPRTQY

SEQ ID NO: 1626692 - protein, 15 aa, Staphylococcus aureus
DRTDLSSDKTVDSET

SEQ ID NO: 1626693 - protein, 5 aa, Staphylococcus aureus
DSADI

SEQ ID NO: 1626694 - protein, 9 aa, Staphylococcus aureus
DSAPESMNT

SEQ ID NO: 1626695 - protein, 6 aa, Staphylococcus aureus
DSETDE

SEQ ID NO: 1626696 - protein, 12 aa, Staphylococcus aureus
DSIDNQQTKNAI

SEQ ID NO: 1626697 - protein, 12 aa, Staphylococcus aureus
DSMSGGEKAKYK

SEQ ID NO: 1626698 - protein, 15 aa, Staphylococcus aureus
DSNDSVKREKGKRGL

SEQ ID NO: 1626699 - protein, 7 aa, Staphylococcus aureus
DSNEKDA

SEQ ID NO: 1626700 - protein, 4 aa, Staphylococcus aureus
DSQK

SEQ ID NO: 1626701 - protein, 4 aa, Staphylococcus aureus
DSQR

SEQ ID NO: 1626702 - protein, 5 aa, Staphylococcus aureus
DSRDY

SEQ ID NO: 1626703 - protein, 8 aa, Staphylococcus aureus
DSRGSKVD

SEQ ID NO: 1626704 - protein, 14 aa, Staphylococcus aureus
DSRYKGTTYDVERE

SEQ ID NO: 1626705 - protein, 14 aa, Staphylococcus aureus
DSSINQKYNGQRKS

SEQ ID NO: 1626706 - protein, 4 aa, Staphylococcus aureus
DSYI

SEQ ID NO: 1626707 - protein, 14 aa, Staphylococcus aureus
DTANDMKTASNANL

SEQ ID NO: 1626708 - protein, 5 aa, Staphylococcus aureus
DTCPE

SEQ ID NO: 1626709 - protein, 8 aa, Staphylococcus aureus
DTEGMSPA

SEQ ID NO: 1626710 - protein, 17 aa, Staphylococcus aureus
DTLNNQIEKQESRHETT

SEQ ID NO: 1626711 - protein, 23 aa, Staphylococcus aureus
DTSTNTRQNVDAQEKTYTTNPVN

SEQ ID NO: 1626712 - protein, 14 aa, Staphylococcus aureus
DTYKSYKEKYDTAK

SEQ ID NO: 1626713 - protein, 8 aa, Staphylococcus aureus
DVDDEKDM

SEQ ID NO: 1626714 - protein, 8 aa, Staphylococcus aureus
DVDGTPQG

SEQ ID NO: 1626715 - protein, 22 aa, Staphylococcus aureus
DVNSAASQVNAAKTALNGDNNL

SEQ ID NO: 1626716 - protein, 5 aa, Staphylococcus aureus
DVSEG

SEQ ID NO: 1626717 - protein, 8 aa, Staphylococcus aureus
DVTTSQKI

SEQ ID NO: 1626718 - protein, 36 aa, Staphylococcus aureus
DYESYKKSLDKNKSTLKQHSKSSTTVRKKNGLSYKE

SEQ ID NO: 1626719 - protein, 8 aa, Staphylococcus aureus
DYKDELRR

SEQ ID NO: 1626720 - protein, 7 aa, Staphylococcus aureus
DYPGKED

SEQ ID NO: 1626721 - protein, 16 aa, Staphylococcus aureus
EAEQVHDDLSKQYQQF

SEQ ID NO: 1626722 - protein, 19 aa, Staphylococcus aureus
EAGRANGRSAKLDGPYDGY

SEQ ID NO: 1626723 - protein, 10 aa, Staphylococcus aureus
EAIKPNVHQG

SEQ ID NO: 1626724 - protein, 19 aa, Staphylococcus aureus
EAMKNASNESFGYTEDEIV

SEQ ID NO: 1626725 - protein, 11 aa, Staphylococcus aureus
EAQEGSEKKQV

SEQ ID NO: 1626726 - protein, 7 aa, Staphylococcus aureus
EAQGDID

SEQ ID NO: 1626727 - protein, 6 aa, Staphylococcus aureus
EASQYV

SEQ ID NO: 1626728 - protein, 5 aa, Staphylococcus aureus
EASVG

SEQ ID NO: 1626729 - protein, 49 aa, Staphylococcus aureus
EDAYNAKVNEADNSNASTSSEIAEAKQKLAELKQTADQNVNQATSKDDI

SEQ ID NO: 1626730 - protein, 6 aa, Staphylococcus aureus
EDDNTD

SEQ ID NO: 1626731 - protein, 5 aa, Staphylococcus aureus
EDEAE

SEQ ID NO: 1626732 - protein, 20 aa, Staphylococcus aureus
EDEDELDEDEEDFEDEEDFK

SEQ ID NO: 1626733 - protein, 4 aa, Staphylococcus aureus
EDEI

SEQ ID NO: 1626734 - protein, 6 aa, Staphylococcus aureus
EDIGEE

SEQ ID NO: 1626735 - protein, 5 aa, Staphylococcus aureus
EDKDM

SEQ ID NO: 1626736 - protein, 4 aa, Staphylococcus aureus
EDKI

SEQ ID NO: 1626737 - protein, 9 aa, Staphylococcus aureus
EDLANASKD

SEQ ID NO: 1626738 - protein, 6 aa, Staphylococcus aureus
EDLGYQ

SEQ ID NO: 1626739 - protein, 4 aa, Staphylococcus aureus
EDPD

SEQ ID NO: 1626740 - protein, 6 aa, Staphylococcus aureus
EDPNYS

SEQ ID NO: 1626741 - protein, 10 aa, Staphylococcus aureus
EDSEINSEDL

SEQ ID NO: 1626742 - protein, 5 aa, Staphylococcus aureus
EDYER

SEQ ID NO: 1626743 - protein, 5 aa, Staphylococcus aureus
EEAEA

SEQ ID NO: 1626744 - protein, 8 aa, Staphylococcus aureus
EEAHKNNK

SEQ ID NO: 1626745 - protein, 7 aa, Staphylococcus aureus
EEDVMDS

SEQ ID NO: 1626746 - protein, 6 aa, Staphylococcus aureus
EEGNRR

SEQ ID NO: 1626747 - protein, 7 aa, Staphylococcus aureus
EEHTGQP

SEQ ID NO: 1626748 - protein, 7 aa, Staphylococcus aureus
EEIQSEQ

SEQ ID NO: 1626749 - protein, 13 aa, Staphylococcus aureus
EEKSTQPKGRKFK

SEQ ID NO: 1626750 - protein, 20 aa, Staphylococcus aureus
EELNEEEKKSSKRKYDDTLP

SEQ ID NO: 1626751 - protein, 7 aa, Staphylococcus aureus
EEPPDNT

SEQ ID NO: 1626752 - protein, 10 aa, Staphylococcus aureus
EEPPISVKDG

SEQ ID NO: 1626753 - protein, 67 aa, Staphylococcus aureus
EETKKAVKEADESWKNKTVKKYEETVTKSPVVKEEKKVEEPQLPKVGNQQEVKTTAGKAEETTQPVA

SEQ ID NO: 1626754 - protein, 7 aa, Staphylococcus aureus
EETTELS

SEQ ID NO: 1626755 - protein, 14 aa, Staphylococcus aureus
EEYTGNVTEDSEET

SEQ ID NO: 1626756 - protein, 7 aa, Staphylococcus aureus
EEYTGQP

SEQ ID NO: 1626757 - protein, 6 aa, Staphylococcus aureus
EGAQLE

SEQ ID NO: 1626758 - protein, 10 aa, Staphylococcus aureus
EGDESFPIES

SEQ ID NO: 1626759 - protein, 6 aa, Staphylococcus aureus
EGGQVQ

SEQ ID NO: 1626760 - protein, 18 aa, Staphylococcus aureus
EGMSKHSASYFGSDESSF

SEQ ID NO: 1626761 - protein, 5 aa, Staphylococcus aureus
EGNNK

SEQ ID NO: 1626762 - protein, 9 aa, Staphylococcus aureus
EHASYTEHP

SEQ ID NO: 1626763 - protein, 10 aa, Staphylococcus aureus
EHDNEQWDDQ

SEQ ID NO: 1626764 - protein, 4 aa, Staphylococcus aureus
EHLN

SEQ ID NO: 1626765 - protein, 7 aa, Staphylococcus aureus
EHNVTKI

SEQ ID NO: 1626766 - protein, 7 aa, Staphylococcus aureus
EHPERAQ

SEQ ID NO: 1626767 - protein, 6 aa, Staphylococcus aureus
EIDPLG

SEQ ID NO: 1626768 - protein, 5 aa, Staphylococcus aureus
EIDST

SEQ ID NO: 1626769 - protein, 6 aa, Staphylococcus aureus
EIEQEI

SEQ ID NO: 1626770 - protein, 6 aa, Staphylococcus aureus
EIETSR

SEQ ID NO: 1626771 - protein, 6 aa, Staphylococcus aureus
EIGPRI

SEQ ID NO: 1626772 - protein, 16 aa, Staphylococcus aureus
EIKAHPNGFYNNGGGL

SEQ ID NO: 1626773 - protein, 15 aa, Staphylococcus aureus
EIKEPATEKESEEEP

SEQ ID NO: 1626774 - protein, 26 aa, Staphylococcus aureus
EIPNAEQTVNYQNAEDNAKTNFDDAK

SEQ ID NO: 1626775 - protein, 6 aa, Staphylococcus aureus
EISPDT

SEQ ID NO: 1626776 - protein, 16 aa, Staphylococcus aureus
EISSYQINKDTGISYG

SEQ ID NO: 1626777 - protein, 6 aa, Staphylococcus aureus
EIYEAP

SEQ ID NO: 1626778 - protein, 13 aa, Staphylococcus aureus
EKAQGNDEAHEMD

SEQ ID NO: 1626779 - protein, 21 aa, Staphylococcus aureus
EKASSENFGEESDDAKKLKIT

SEQ ID NO: 1626780 - protein, 7 aa, Staphylococcus aureus
EKATSLS

SEQ ID NO: 1626781 - protein, 8 aa, Staphylococcus aureus
EKEENDVE

SEQ ID NO: 1626782 - protein, 6 aa, Staphylococcus aureus
EKEQGV

SEQ ID NO: 1626783 - protein, 7 aa, Staphylococcus aureus
EKERKVY

SEQ ID NO: 1626784 - protein, 7 aa, Staphylococcus aureus
EKHPDKA

SEQ ID NO: 1626785 - protein, 7 aa, Staphylococcus aureus
EKLGADP

SEQ ID NO: 1626786 - protein, 9 aa, Staphylococcus aureus
EKLPEKRYN

SEQ ID NO: 1626787 - protein, 5 aa, Staphylococcus aureus
EKPKA

SEQ ID NO: 1626788 - protein, 7 aa, Staphylococcus aureus
EKREGSY

SEQ ID NO: 1626789 - protein, 10 aa, Staphylococcus aureus
EKSEVRRIAE

SEQ ID NO: 1626790 - protein, 25 aa, Staphylococcus aureus
EKTHNYTKSSKIKKAEKLSSEGQDI

SEQ ID NO: 1626791 - protein, 24 aa, Staphylococcus aureus
EKVGTFENQKKASVVSDSHTEDHS

SEQ ID NO: 1626792 - protein, 6 aa, Staphylococcus aureus
EKVNDK

SEQ ID NO: 1626793 - protein, 5 aa, Staphylococcus aureus
ELEER

SEQ ID NO: 1626794 - protein, 8 aa, Staphylococcus aureus
ELHEGKKE

SEQ ID NO: 1626795 - protein, 6 aa, Staphylococcus aureus
ELKDTN

SEQ ID NO: 1626796 - protein, 4 aa, Staphylococcus aureus
ELKF

SEQ ID NO: 1626797 - protein, 36 aa, Staphylococcus aureus
ELKKKQKRKRYKEKRDAFQKRKREIKKVKAKEKHKG

SEQ ID NO: 1626798 - protein, 5 aa, Staphylococcus aureus
ELNEQ

SEQ ID NO: 1626799 - protein, 5 aa, Staphylococcus aureus
EMNGE

SEQ ID NO: 1626800 - protein, 8 aa, Staphylococcus aureus
EMNRQNVD

SEQ ID NO: 1626801 - protein, 6 aa, Staphylococcus aureus
EMSEPE

SEQ ID NO: 1626802 - protein, 5 aa, Staphylococcus aureus
ENDSI

SEQ ID NO: 1626803 - protein, 14 aa, Staphylococcus aureus
ENDYEDNKEPEFRR

SEQ ID NO: 1626804 - protein, 9 aa, Staphylococcus aureus
ENEKQYQYT

SEQ ID NO: 1626805 - protein, 9 aa, Staphylococcus aureus
ENGKPRNEI

SEQ ID NO: 1626806 - protein, 5 aa, Staphylococcus aureus
ENKKA

SEQ ID NO: 1626807 - protein, 17 aa, Staphylococcus aureus
ENKKDNFTAYATPEHNY

SEQ ID NO: 1626808 - protein, 7 aa, Staphylococcus aureus
ENKKEIN

SEQ ID NO: 1626809 - protein, 10 aa, Staphylococcus aureus
ENKQASPMAD

SEQ ID NO: 1626810 - protein, 4 aa, Staphylococcus aureus
ENPF

SEQ ID NO: 1626811 - protein, 8 aa, Staphylococcus aureus
ENPNTKKV

SEQ ID NO: 1626812 - protein, 8 aa, Staphylococcus aureus
ENRENEGD

SEQ ID NO: 1626813 - protein, 12 aa, Staphylococcus aureus
ENYRQKKGDIQQ

SEQ ID NO: 1626814 - protein, 5 aa, Staphylococcus aureus
EPGSL

SEQ ID NO: 1626815 - protein, 8 aa, Staphylococcus aureus
EPTNGLDP

SEQ ID NO: 1626816 - protein, 4 aa, Staphylococcus aureus
EPTR

SEQ ID NO: 1626817 - protein, 6 aa, Staphylococcus aureus
EQGAVH

SEQ ID NO: 1626818 - protein, 6 aa, Staphylococcus aureus
EQGENG

SEQ ID NO: 1626819 - protein, 5 aa, Staphylococcus aureus
EQGEV

SEQ ID NO: 1626820 - protein, 5 aa, Staphylococcus aureus
EQGIK

SEQ ID NO: 1626821 - protein, 7 aa, Staphylococcus aureus
EQIEQDG

SEQ ID NO: 1626822 - protein, 10 aa, Staphylococcus aureus
EQIKNQNDIY

SEQ ID NO: 1626823 - protein, 11 aa, Staphylococcus aureus
EQITNDTSRQL

SEQ ID NO: 1626824 - protein, 16 aa, Staphylococcus aureus
EQKSQGFLKGRNEKEE

SEQ ID NO: 1626825 - protein, 13 aa, Staphylococcus aureus
EQLDEQNTKGDNI

SEQ ID NO: 1626826 - protein, 21 aa, Staphylococcus aureus
EQPSWNPKDFAPSIYQSDDRL

SEQ ID NO: 1626827 - protein, 24 aa, Staphylococcus aureus
EQRQNTENNQEKTFSSEESNSKPF

SEQ ID NO: 1626828 - protein, 5 aa, Staphylococcus aureus
ERGIK

SEQ ID NO: 1626829 - protein, 5 aa, Staphylococcus aureus
ERGLT

SEQ ID NO: 1626830 - protein, 6 aa, Staphylococcus aureus
ERHNIS

SEQ ID NO: 1626831 - protein, 20 aa, Staphylococcus aureus
ERKAEQAVLSDDEVKTITEY

SEQ ID NO: 1626832 - protein, 15 aa, Staphylococcus aureus
ERKSSSNYYEGGNEI

SEQ ID NO: 1626833 - protein, 5 aa, Staphylococcus aureus
ERPES

SEQ ID NO: 1626834 - protein, 5 aa, Staphylococcus aureus
ERQIT

SEQ ID NO: 1626835 - protein, 23 aa, Staphylococcus aureus
ERVKSANDAISKLNEKDSIENRR

SEQ ID NO: 1626836 - protein, 6 aa, Staphylococcus aureus
ERWGPR

SEQ ID NO: 1626837 - protein, 6 aa, Staphylococcus aureus
ERYKAE

SEQ ID NO: 1626838 - protein, 7 aa, Staphylococcus aureus
ESAASGL

SEQ ID NO: 1626839 - protein, 6 aa, Staphylococcus aureus
ESDNTQ

SEQ ID NO: 1626840 - protein, 5 aa, Staphylococcus aureus
ESFDD

SEQ ID NO: 1626841 - protein, 5 aa, Staphylococcus aureus
ESFGA

SEQ ID NO: 1626842 - protein, 7 aa, Staphylococcus aureus
ESGENKK

SEQ ID NO: 1626843 - protein, 18 aa, Staphylococcus aureus
ESGESAYETMALKELGMK

SEQ ID NO: 1626844 - protein, 8 aa, Staphylococcus aureus
ESGSGKSL

SEQ ID NO: 1626845 - protein, 5 aa, Staphylococcus aureus
ESINT

SEQ ID NO: 1626846 - protein, 21 aa, Staphylococcus aureus
ESLEPEQLNEKTLNDMRSGSE

SEQ ID NO: 1626847 - protein, 15 aa, Staphylococcus aureus
ESLKESQDKNDVDLQ

SEQ ID NO: 1626848 - protein, 6 aa, Staphylococcus aureus
ESLSKA

SEQ ID NO: 1626849 - protein, 4 aa, Staphylococcus aureus
ESQA

SEQ ID NO: 1626850 - protein, 14 aa, Staphylococcus aureus
ESRKRQERQNQREE

SEQ ID NO: 1626851 - protein, 5 aa, Staphylococcus aureus
ESSNH

SEQ ID NO: 1626852 - protein, 6 aa, Staphylococcus aureus
ESYPNV

SEQ ID NO: 1626853 - protein, 4 aa, Staphylococcus aureus
ETDF

SEQ ID NO: 1626854 - protein, 14 aa, Staphylococcus aureus
ETDGETVLKSPTKY

SEQ ID NO: 1626855 - protein, 9 aa, Staphylococcus aureus
ETDSSESFS

SEQ ID NO: 1626856 - protein, 5 aa, Staphylococcus aureus
ETKSI

SEQ ID NO: 1626857 - protein, 9 aa, Staphylococcus aureus
ETPIGRNGI

SEQ ID NO: 1626858 - protein, 5 aa, Staphylococcus aureus
ETTLG

SEQ ID NO: 1626859 - protein, 9 aa, Staphylococcus aureus
ETVTPHDHQ

SEQ ID NO: 1626860 - protein, 12 aa, Staphylococcus aureus
EVENMSGGERQR

SEQ ID NO: 1626861 - protein, 7 aa, Staphylococcus aureus
EVNTPLS

SEQ ID NO: 1626862 - protein, 12 aa, Staphylococcus aureus
EVQQARENNQPI

SEQ ID NO: 1626863 - protein, 13 aa, Staphylococcus aureus
EVRKKLRGQYAKE

SEQ ID NO: 1626864 - protein, 5 aa, Staphylococcus aureus
EVRRR

SEQ ID NO: 1626865 - protein, 8 aa, Staphylococcus aureus
EVSIEEKA

SEQ ID NO: 1626866 - protein, 15 aa, Staphylococcus aureus
EVTQAQNNADALNTA

SEQ ID NO: 1626867 - protein, 10 aa, Staphylococcus aureus
EYEDEQSPEK

SEQ ID NO: 1626868 - protein, 14 aa, Staphylococcus aureus
EYESNYETASDDSL

SEQ ID NO: 1626869 - protein, 14 aa, Staphylococcus aureus
EYKRNNSDGNVKKL

SEQ ID NO: 1626870 - protein, 9 aa, Staphylococcus aureus
EYNQTNPDS

SEQ ID NO: 1626871 - protein, 11 aa, Staphylococcus aureus
EYQKEIAEKNR

SEQ ID NO: 1626872 - protein, 11 aa, Staphylococcus aureus
EYTKSKSAHGG

SEQ ID NO: 1626873 - protein, 11 aa, Staphylococcus aureus
EYVGKGPNSIR

SEQ ID NO: 1626874 - protein, 7 aa, Staphylococcus aureus
FAAGRHP

SEQ ID NO: 1626875 - protein, 5 aa, Staphylococcus aureus
FAEEA

SEQ ID NO: 1626876 - protein, 4 aa, Staphylococcus aureus
FDLN

SEQ ID NO: 1626877 - protein, 5 aa, Staphylococcus aureus
FDSNG

SEQ ID NO: 1626878 - protein, 7 aa, Staphylococcus aureus
FEKEDRK

SEQ ID NO: 1626879 - protein, 18 aa, Staphylococcus aureus
FELKRGERGSDRKHIETA

SEQ ID NO: 1626880 - protein, 4 aa, Staphylococcus aureus
FEPE

SEQ ID NO: 1626881 - protein, 16 aa, Staphylococcus aureus
FEPFPNSPRQDENNPL

SEQ ID NO: 1626882 - protein, 7 aa, Staphylococcus aureus
FESNKTE

SEQ ID NO: 1626883 - protein, 8 aa, Staphylococcus aureus
FESSSEAV

SEQ ID NO: 1626884 - protein, 4 aa, Staphylococcus aureus
FGGN

SEQ ID NO: 1626885 - protein, 16 aa, Staphylococcus aureus
FGGNDLGSDALKAKLN

SEQ ID NO: 1626886 - protein, 8 aa, Staphylococcus aureus
FGGPKGVG

SEQ ID NO: 1626887 - protein, 6 aa, Staphylococcus aureus
FGIAPD

SEQ ID NO: 1626888 - protein, 7 aa, Staphylococcus aureus
FKENGWD

SEQ ID NO: 1626889 - protein, 8 aa, Staphylococcus aureus
FKQYSRNE

SEQ ID NO: 1626890 - protein, 12 aa, Staphylococcus aureus
FKSASAFPLPNA

SEQ ID NO: 1626891 - protein, 7 aa, Staphylococcus aureus
FNEKDQE

SEQ ID NO: 1626892 - protein, 4 aa, Staphylococcus aureus
FNPN

SEQ ID NO: 1626893 - protein, 11 aa, Staphylococcus aureus
FQSKGTLEGYS

SEQ ID NO: 1626894 - protein, 11 aa, Staphylococcus aureus
FSKKAAELQLD

SEQ ID NO: 1626895 - protein, 8 aa, Staphylococcus aureus
FSKTAEDQ

SEQ ID NO: 1626896 - protein, 6 aa, Staphylococcus aureus
FSQNTG

SEQ ID NO: 1626897 - protein, 15 aa, Staphylococcus aureus
FSSRKQYDDLSFNFL

SEQ ID NO: 1626898 - protein, 21 aa, Staphylococcus aureus
FTDADEAKRNAYTNAVTQAEQ

SEQ ID NO: 1626899 - protein, 9 aa, Staphylococcus aureus
FTKVDPPIL

SEQ ID NO: 1626900 - protein, 4 aa, Staphylococcus aureus
FTPG

SEQ ID NO: 1626901 - protein, 4 aa, Staphylococcus aureus
FTRN

SEQ ID NO: 1626902 - protein, 5 aa, Staphylococcus aureus
GAGVG

SEQ ID NO: 1626903 - protein, 4 aa, Staphylococcus aureus
GAID

SEQ ID NO: 1626904 - protein, 8 aa, Staphylococcus aureus
GAKRAGKT

SEQ ID NO: 1626905 - protein, 18 aa, Staphylococcus aureus
GAPPGYIGHDEGGQLTEA

SEQ ID NO: 1626906 - protein, 9 aa, Staphylococcus aureus
GAPTRAVEH

SEQ ID NO: 1626907 - protein, 14 aa, Staphylococcus aureus
GASTTATKAFETED

SEQ ID NO: 1626908 - protein, 15 aa, Staphylococcus aureus
GASVYSASEIARDEF

SEQ ID NO: 1626909 - protein, 4 aa, Staphylococcus aureus
GDKV

SEQ ID NO: 1626910 - protein, 17 aa, Staphylococcus aureus
GDSAGGSTKSGRDSRTQ

SEQ ID NO: 1626911 - protein, 6 aa, Staphylococcus aureus
GEGRDI

SEQ ID NO: 1626912 - protein, 4 aa, Staphylococcus aureus
GEKN

SEQ ID NO: 1626913 - protein, 6 aa, Staphylococcus aureus
GELKSK

SEQ ID NO: 1626914 - protein, 6 aa, Staphylococcus aureus
GENSWG

SEQ ID NO: 1626915 - protein, 4 aa, Staphylococcus aureus
GEQE

SEQ ID NO: 1626916 - protein, 9 aa, Staphylococcus aureus
GESGCGKST

SEQ ID NO: 1626917 - protein, 4 aa, Staphylococcus aureus
GESY

SEQ ID NO: 1626918 - protein, 25 aa, Staphylococcus aureus
GFGYKDTTKTTGSKRNITINSRTAK

SEQ ID NO: 1626919 - protein, 12 aa, Staphylococcus aureus
GFYKQDETIEYA

SEQ ID NO: 1626920 - protein, 14 aa, Staphylococcus aureus
GGAVGGGLTGGATF

SEQ ID NO: 1626921 - protein, 15 aa, Staphylococcus aureus
GGHVTGPKDPNIKKI

SEQ ID NO: 1626922 - protein, 11 aa, Staphylococcus aureus
GGIQEEAPSFN

SEQ ID NO: 1626923 - protein, 9 aa, Staphylococcus aureus
GGKGQVGRV

SEQ ID NO: 1626924 - protein, 7 aa, Staphylococcus aureus
GGLPEKV

SEQ ID NO: 1626925 - protein, 9 aa, Staphylococcus aureus
GGNGTGKTT

SEQ ID NO: 1626926 - protein, 8 aa, Staphylococcus aureus
GGQMAKTI

SEQ ID NO: 1626927 - protein, 10 aa, Staphylococcus aureus
GGQMAKTIDK

SEQ ID NO: 1626928 - protein, 5 aa, Staphylococcus aureus
GGREM

SEQ ID NO: 1626929 - protein, 4 aa, Staphylococcus aureus
GGTI

SEQ ID NO: 1626930 - protein, 8 aa, Staphylococcus aureus
GGVDSSVT

SEQ ID NO: 1626931 - protein, 5 aa, Staphylococcus aureus
GGVGI

SEQ ID NO: 1626932 - protein, 4 aa, Staphylococcus aureus
GGWT

SEQ ID NO: 1626933 - protein, 20 aa, Staphylococcus aureus
GGYKAYEEENDSYDTQEEYK

SEQ ID NO: 1626934 - protein, 8 aa, Staphylococcus aureus
GHDHSKHY

SEQ ID NO: 1626935 - protein, 5 aa, Staphylococcus aureus
GHEDI

SEQ ID NO: 1626936 - protein, 6 aa, Staphylococcus aureus
GHGTEL

SEQ ID NO: 1626937 - protein, 23 aa, Staphylococcus aureus
GHNDINNAMTKEEIEQAKAQLAQ

SEQ ID NO: 1626938 - protein, 6 aa, Staphylococcus aureus
GIEETQ

SEQ ID NO: 1626939 - protein, 4 aa, Staphylococcus aureus
GINA

SEQ ID NO: 1626940 - protein, 4 aa, Staphylococcus aureus
GINN

SEQ ID NO: 1626941 - protein, 8 aa, Staphylococcus aureus
GKDEPKNF

SEQ ID NO: 1626942 - protein, 8 aa, Staphylococcus aureus
GKEPGQAV

SEQ ID NO: 1626943 - protein, 4 aa, Staphylococcus aureus
GKFP

SEQ ID NO: 1626944 - protein, 4 aa, Staphylococcus aureus
GKGC

SEQ ID NO: 1626945 - protein, 32 aa, Staphylococcus aureus
GKIGSTWGNASNWANAAARAGYTVNNTPKAGA

SEQ ID NO: 1626946 - protein, 17 aa, Staphylococcus aureus
GKISKWENEKEEPRLST

SEQ ID NO: 1626947 - protein, 5 aa, Staphylococcus aureus
GKITD

SEQ ID NO: 1626948 - protein, 16 aa, Staphylococcus aureus
GKKGDLASRRNAAKTL

SEQ ID NO: 1626949 - protein, 7 aa, Staphylococcus aureus
GKKGIKR

SEQ ID NO: 1626950 - protein, 7 aa, Staphylococcus aureus
GKLDKKA

SEQ ID NO: 1626951 - protein, 10 aa, Staphylococcus aureus
GKNFGQGMSG

SEQ ID NO: 1626952 - protein, 6 aa, Staphylococcus aureus
GKQSAV

SEQ ID NO: 1626953 - protein, 12 aa, Staphylococcus aureus
GKRLDSFGQRGI

SEQ ID NO: 1626954 - protein, 8 aa, Staphylococcus aureus
GKSQRKAY

SEQ ID NO: 1626955 - protein, 9 aa, Staphylococcus aureus
GKSQRKAYI

SEQ ID NO: 1626956 - protein, 17 aa, Staphylococcus aureus
GKSTVRKWETGDIENMK

SEQ ID NO: 1626957 - protein, 39 aa, Staphylococcus aureus
GKVNTHSAHHHNKSYSQPSNQQQRLATDDDIGNGESIFD

SEQ ID NO: 1626958 - protein, 5 aa, Staphylococcus aureus
GLASL

SEQ ID NO: 1626959 - protein, 22 aa, Staphylococcus aureus
GLDGSTKSFNPVPLNEKNAENY

SEQ ID NO: 1626960 - protein, 8 aa, Staphylococcus aureus
GLKDGDSL

SEQ ID NO: 1626961 - protein, 12 aa, Staphylococcus aureus
GLKDKNNTEIYD

SEQ ID NO: 1626962 - protein, 9 aa, Staphylococcus aureus
GLNQQQQDL

SEQ ID NO: 1626963 - protein, 15 aa, Staphylococcus aureus
GMSEEEAKNSGRNIK

SEQ ID NO: 1626964 - protein, 7 aa, Staphylococcus aureus
GMSKAQS

SEQ ID NO: 1626965 - protein, 7 aa, Staphylococcus aureus
GNDLEEI

SEQ ID NO: 1626966 - protein, 6 aa, Staphylococcus aureus
GNEAMT

SEQ ID NO: 1626967 - protein, 14 aa, Staphylococcus aureus
GNEISSNKNGSRPY

SEQ ID NO: 1626968 - protein, 15 aa, Staphylococcus aureus
GNGSSPDEWKDEVPN

SEQ ID NO: 1626969 - protein, 5 aa, Staphylococcus aureus
GNKNI

SEQ ID NO: 1626970 - protein, 11 aa, Staphylococcus aureus
GNKPSGESTRG

SEQ ID NO: 1626971 - protein, 5 aa, Staphylococcus aureus
GNPSL

SEQ ID NO: 1626972 - protein, 11 aa, Staphylococcus aureus
GNRSVLSDSNL

SEQ ID NO: 1626973 - protein, 7 aa, Staphylococcus aureus
GNVKAYT

SEQ ID NO: 1626974 - protein, 5 aa, Staphylococcus aureus
GPDLS

SEQ ID NO: 1626975 - protein, 5 aa, Staphylococcus aureus
GPQHR

SEQ ID NO: 1626976 - protein, 10 aa, Staphylococcus aureus
GPVPPNPSEL

SEQ ID NO: 1626977 - protein, 9 aa, Staphylococcus aureus
GQGESMDQA

SEQ ID NO: 1626978 - protein, 8 aa, Staphylococcus aureus
GQGQEATQ

SEQ ID NO: 1626979 - protein, 8 aa, Staphylococcus aureus
GRFATSDL

SEQ ID NO: 1626980 - protein, 5 aa, Staphylococcus aureus
GRMSA

SEQ ID NO: 1626981 - protein, 10 aa, Staphylococcus aureus
GRNKDKLQNV

SEQ ID NO: 1626982 - protein, 8 aa, Staphylococcus aureus
GRSGRADK

SEQ ID NO: 1626983 - protein, 4 aa, Staphylococcus aureus
GRTI

SEQ ID NO: 1626984 - protein, 4 aa, Staphylococcus aureus
GSAH

SEQ ID NO: 1626985 - protein, 4 aa, Staphylococcus aureus
GSEL

SEQ ID NO: 1626986 - protein, 7 aa, Staphylococcus aureus
GSFRGKR

SEQ ID NO: 1626987 - protein, 9 aa, Staphylococcus aureus
GSGSKSYIQ

SEQ ID NO: 1626988 - protein, 24 aa, Staphylococcus aureus
GSITESSTYGDNDTPAPPTDELGG

SEQ ID NO: 1626989 - protein, 15 aa, Staphylococcus aureus
GSKQELENQINEEKT

SEQ ID NO: 1626990 - protein, 6 aa, Staphylococcus aureus
GSKTRI

SEQ ID NO: 1626991 - protein, 5 aa, Staphylococcus aureus
GSPEH

SEQ ID NO: 1626992 - protein, 7 aa, Staphylococcus aureus
GTDSHTT

SEQ ID NO: 1626993 - protein, 10 aa, Staphylococcus aureus
GTLKNNTDLT

SEQ ID NO: 1626994 - protein, 5 aa, Staphylococcus aureus
GTQLS

SEQ ID NO: 1626995 - protein, 6 aa, Staphylococcus aureus
GTVKGL

SEQ ID NO: 1626996 - protein, 10 aa, Staphylococcus aureus
GTYKGKEVSV

SEQ ID NO: 1626997 - protein, 6 aa, Staphylococcus aureus
GVDRND

SEQ ID NO: 1626998 - protein, 13 aa, Staphylococcus aureus
GVEATTQIKKDLP

SEQ ID NO: 1626999 - protein, 11 aa, Staphylococcus aureus
GVEGKGRSVPK

SEQ ID NO: 1627000 - protein, 9 aa, Staphylococcus aureus
GVGKTTTIG

SEQ ID NO: 1627001 - protein, 4 aa, Staphylococcus aureus
GWEP

SEQ ID NO: 1627002 - protein, 26 aa, Staphylococcus aureus
GYDSKGKKIQKYRSGFTTKKEAREEY

SEQ ID NO: 1627003 - protein, 9 aa, Staphylococcus aureus
GYGDNAKAA

SEQ ID NO: 1627004 - protein, 7 aa, Staphylococcus aureus
GYGPGVV

SEQ ID NO: 1627005 - protein, 12 aa, Staphylococcus aureus
GYGPTENTTFTT

SEQ ID NO: 1627006 - protein, 5 aa, Staphylococcus aureus
GYHDD

SEQ ID NO: 1627007 - protein, 7 aa, Staphylococcus aureus
GYVSPND

SEQ ID NO: 1627008 - protein, 6 aa, Staphylococcus aureus
HAKEAE

SEQ ID NO: 1627009 - protein, 19 aa, Staphylococcus aureus
HANDKNKDKYKNKKFRVEK

SEQ ID NO: 1627010 - protein, 11 aa, Staphylococcus aureus
HANNELNDKTI

SEQ ID NO: 1627011 - protein, 5 aa, Staphylococcus aureus
HDGSL

SEQ ID NO: 1627012 - protein, 10 aa, Staphylococcus aureus
HDNEETEEDV

SEQ ID NO: 1627013 - protein, 14 aa, Staphylococcus aureus
HDRGVKGQKETINS

SEQ ID NO: 1627014 - protein, 4 aa, Staphylococcus aureus
HDSA

SEQ ID NO: 1627015 - protein, 4 aa, Staphylococcus aureus
HEGI

SEQ ID NO: 1627016 - protein, 13 aa, Staphylococcus aureus
HEKPPIPGRTNST

SEQ ID NO: 1627017 - protein, 12 aa, Staphylococcus aureus
HETAKEALGDKE

SEQ ID NO: 1627018 - protein, 6 aa, Staphylococcus aureus
HETNES

SEQ ID NO: 1627019 - protein, 5 aa, Staphylococcus aureus
HGDTI

SEQ ID NO: 1627020 - protein, 11 aa, Staphylococcus aureus
HGEKNYAQELE

SEQ ID NO: 1627021 - protein, 13 aa, Staphylococcus aureus
HGGATNKTQCSYG

SEQ ID NO: 1627022 - protein, 9 aa, Staphylococcus aureus
HGGTKKKKW

SEQ ID NO: 1627023 - protein, 6 aa, Staphylococcus aureus
HGSDDK

SEQ ID NO: 1627024 - protein, 10 aa, Staphylococcus aureus
HGSKDTKDEV

SEQ ID NO: 1627025 - protein, 18 aa, Staphylococcus aureus
HHEKQAEQLVEETKDNID

SEQ ID NO: 1627026 - protein, 4 aa, Staphylococcus aureus
HIPA

SEQ ID NO: 1627027 - protein, 9 aa, Staphylococcus aureus
HKDDKEVKD

SEQ ID NO: 1627028 - protein, 7 aa, Staphylococcus aureus
HKDDRER

SEQ ID NO: 1627029 - protein, 9 aa, Staphylococcus aureus
HKDPDSLNP

SEQ ID NO: 1627030 - protein, 10 aa, Staphylococcus aureus
HKTYRDSEHT

SEQ ID NO: 1627031 - protein, 23 aa, Staphylococcus aureus
HLSDEQKAKGIIGASAGNHAQGV

SEQ ID NO: 1627032 - protein, 6 aa, Staphylococcus aureus
HNKEQM

SEQ ID NO: 1627033 - protein, 9 aa, Staphylococcus aureus
HPKSKEDLL

SEQ ID NO: 1627034 - protein, 15 aa, Staphylococcus aureus
HPTPKSASGFSEADL

SEQ ID NO: 1627035 - protein, 12 aa, Staphylococcus aureus
HPTTGGVSASFA

SEQ ID NO: 1627036 - protein, 18 aa, Staphylococcus aureus
HQLKSPDEIKEELDKKEG

SEQ ID NO: 1627037 - protein, 7 aa, Staphylococcus aureus
HQPYLES

SEQ ID NO: 1627038 - protein, 5 aa, Staphylococcus aureus
HQRLT

SEQ ID NO: 1627039 - protein, 25 aa, Staphylococcus aureus
HQTPKQYRGDRPAITENQQSVQHNY

SEQ ID NO: 1627040 - protein, 4 aa, Staphylococcus aureus
HRDA

SEQ ID NO: 1627041 - protein, 9 aa, Staphylococcus aureus
HRDAYNNIT

SEQ ID NO: 1627042 - protein, 5 aa, Staphylococcus aureus
HRSSD

SEQ ID NO: 1627043 - protein, 10 aa, Staphylococcus aureus
HSAKDGHVTA

SEQ ID NO: 1627044 - protein, 10 aa, Staphylococcus aureus
HSAKDGRVTA

SEQ ID NO: 1627045 - protein, 9 aa, Staphylococcus aureus
HSNDNGETL

SEQ ID NO: 1627046 - protein, 7 aa, Staphylococcus aureus
HSTTETQ

SEQ ID NO: 1627047 - protein, 4 aa, Staphylococcus aureus
HSWG

SEQ ID NO: 1627048 - protein, 12 aa, Staphylococcus aureus
HSWGAAKQLDTA

SEQ ID NO: 1627049 - protein, 15 aa, Staphylococcus aureus
HTGVSDELGGQGVGK

SEQ ID NO: 1627050 - protein, 5 aa, Staphylococcus aureus
HTLTT

SEQ ID NO: 1627051 - protein, 7 aa, Staphylococcus aureus
IAEENNL

SEQ ID NO: 1627052 - protein, 15 aa, Staphylococcus aureus
IAKEQKKPKYSTQAQ

SEQ ID NO: 1627053 - protein, 4 aa, Staphylococcus aureus
IAKG

SEQ ID NO: 1627054 - protein, 27 aa, Staphylococcus aureus
IANKDQTKASENYIDADPTKKTAFDNA

SEQ ID NO: 1627055 - protein, 18 aa, Staphylococcus aureus
IANNTKRHKSVSKLSSQP

SEQ ID NO: 1627056 - protein, 6 aa, Staphylococcus aureus
IAQESS

SEQ ID NO: 1627057 - protein, 4 aa, Staphylococcus aureus
IDEK

SEQ ID NO: 1627058 - protein, 29 aa, Staphylococcus aureus
IDGVTSAEVNLENGQVSVQYDDSKVAVSQ

SEQ ID NO: 1627059 - protein, 10 aa, Staphylococcus aureus
IDKKGQINSE

SEQ ID NO: 1627060 - protein, 4 aa, Staphylococcus aureus
IDNE

SEQ ID NO: 1627061 - protein, 5 aa, Staphylococcus aureus
IDTQE

SEQ ID NO: 1627062 - protein, 7 aa, Staphylococcus aureus
IEGKGDP

SEQ ID NO: 1627063 - protein, 5 aa, Staphylococcus aureus
IEMSE

SEQ ID NO: 1627064 - protein, 10 aa, Staphylococcus aureus
IENEDKVPYY

SEQ ID NO: 1627065 - protein, 6 aa, Staphylococcus aureus
IENGTF

SEQ ID NO: 1627066 - protein, 10 aa, Staphylococcus aureus
IENKESNDQF

SEQ ID NO: 1627067 - protein, 7 aa, Staphylococcus aureus
IEQGTRE

SEQ ID NO: 1627068 - protein, 6 aa, Staphylococcus aureus
IEQITS

SEQ ID NO: 1627069 - protein, 9 aa, Staphylococcus aureus
IESESEINS

SEQ ID NO: 1627070 - protein, 12 aa, Staphylococcus aureus
IETGKAVPTQQV

SEQ ID NO: 1627071 - protein, 5 aa, Staphylococcus aureus
IETRL

SEQ ID NO: 1627072 - protein, 19 aa, Staphylococcus aureus
IGDAGGKLHTGRSRNDQVA

SEQ ID NO: 1627073 - protein, 5 aa, Staphylococcus aureus
IGDEH

SEQ ID NO: 1627074 - protein, 4 aa, Staphylococcus aureus
IGGF

SEQ ID NO: 1627075 - protein, 8 aa, Staphylococcus aureus
IGPGNNRH

SEQ ID NO: 1627076 - protein, 20 aa, Staphylococcus aureus
IGRSKDKNGTSWVGENTRAP

SEQ ID NO: 1627077 - protein, 45 aa, Staphylococcus aureus
IGSTISTGNASWGVGPNTENFEKRNSTGNAGWGVGPNTEKLEHQF

SEQ ID NO: 1627078 - protein, 17 aa, Staphylococcus aureus
IGTIGDSVARGSHAKAN

SEQ ID NO: 1627079 - protein, 11 aa, Staphylococcus aureus
IIGQTDAKKQM

SEQ ID NO: 1627080 - protein, 13 aa, Staphylococcus aureus
IKETEESLTVESD

SEQ ID NO: 1627081 - protein, 17 aa, Staphylococcus aureus
IKLRTTKEEFNATNRTL

SEQ ID NO: 1627082 - protein, 8 aa, Staphylococcus aureus
IKNEPEKH

SEQ ID NO: 1627083 - protein, 5 aa, Staphylococcus aureus
IKNGR

SEQ ID NO: 1627084 - protein, 40 aa, Staphylococcus aureus
IKPNQKGDKDIESAIKETSKYSVKSSDFLTDDDEKNQEIV

SEQ ID NO: 1627085 - protein, 5 aa, Staphylococcus aureus
IKRET

SEQ ID NO: 1627086 - protein, 9 aa, Staphylococcus aureus
IKSEDDSAV

SEQ ID NO: 1627087 - protein, 10 aa, Staphylococcus aureus
IKSNHKDVTD

SEQ ID NO: 1627088 - protein, 10 aa, Staphylococcus aureus
IKTQQQTIDR

SEQ ID NO: 1627089 - protein, 10 aa, Staphylococcus aureus
IKVKSNSDFT

SEQ ID NO: 1627090 - protein, 7 aa, Staphylococcus aureus
INDPTSF

SEQ ID NO: 1627091 - protein, 4 aa, Staphylococcus aureus
INGA

SEQ ID NO: 1627092 - protein, 4 aa, Staphylococcus aureus
INKT

SEQ ID NO: 1627093 - protein, 10 aa, Staphylococcus aureus
INTENNSVPY

SEQ ID NO: 1627094 - protein, 13 aa, Staphylococcus aureus
INVPYEQETEKVG

SEQ ID NO: 1627095 - protein, 6 aa, Staphylococcus aureus
IPDDKL

SEQ ID NO: 1627096 - protein, 10 aa, Staphylococcus aureus
IPENQKYGAF

SEQ ID NO: 1627097 - protein, 5 aa, Staphylococcus aureus
IPKGR

SEQ ID NO: 1627098 - protein, 5 aa, Staphylococcus aureus
IPKSF

SEQ ID NO: 1627099 - protein, 8 aa, Staphylococcus aureus
IPNDTTGE

SEQ ID NO: 1627100 - protein, 15 aa, Staphylococcus aureus
IPNHESKLNENSKTL

SEQ ID NO: 1627101 - protein, 5 aa, Staphylococcus aureus
IPSRN

SEQ ID NO: 1627102 - protein, 26 aa, Staphylococcus aureus
IPTKQAPELKLKGSGNLKGSSVGSKD

SEQ ID NO: 1627103 - protein, 5 aa, Staphylococcus aureus
IQPTE

SEQ ID NO: 1627104 - protein, 12 aa, Staphylococcus aureus
IRDDVGMSKAQS

SEQ ID NO: 1627105 - protein, 18 aa, Staphylococcus aureus
IRGKDGGYLANDQSADVS

SEQ ID NO: 1627106 - protein, 23 aa, Staphylococcus aureus
IRKQTRKKELKDETVDAHLFLEL

SEQ ID NO: 1627107 - protein, 13 aa, Staphylococcus aureus
IRKQTRKKRTEIK

SEQ ID NO: 1627108 - protein, 4 aa, Staphylococcus aureus
ISDE

SEQ ID NO: 1627109 - protein, 5 aa, Staphylococcus aureus
ISEMT

SEQ ID NO: 1627110 - protein, 10 aa, Staphylococcus aureus
ISKEELDQTL

SEQ ID NO: 1627111 - protein, 8 aa, Staphylococcus aureus
ISLTTDPA

SEQ ID NO: 1627112 - protein, 5 aa, Staphylococcus aureus
ISRAR

SEQ ID NO: 1627113 - protein, 11 aa, Staphylococcus aureus
ISRKVNPKRLQ

SEQ ID NO: 1627114 - protein, 9 aa, Staphylococcus aureus
ISSERAAEK

SEQ ID NO: 1627115 - protein, 15 aa, Staphylococcus aureus
ITATKLSEDTGVSRT

SEQ ID NO: 1627116 - protein, 4 aa, Staphylococcus aureus
ITEE

SEQ ID NO: 1627117 - protein, 9 aa, Staphylococcus aureus
ITEEQRNQY

SEQ ID NO: 1627118 - protein, 11 aa, Staphylococcus aureus
ITNNEDGIPNT

SEQ ID NO: 1627119 - protein, 6 aa, Staphylococcus aureus
ITPGDF

SEQ ID NO: 1627120 - protein, 13 aa, Staphylococcus aureus
ITQNMNDTQRSEI

SEQ ID NO: 1627121 - protein, 15 aa, Staphylococcus aureus
ITQTASSIYDKQGDN

SEQ ID NO: 1627122 - protein, 15 aa, Staphylococcus aureus
ITSSRDIHPIYFMTK

SEQ ID NO: 1627123 - protein, 4 aa, Staphylococcus aureus
ITTM

SEQ ID NO: 1627124 - protein, 28 aa, Staphylococcus aureus
IVADGGNSEGGAGAKYQGAKHPNEKVVA

SEQ ID NO: 1627125 - protein, 4 aa, Staphylococcus aureus
IYKQ

SEQ ID NO: 1627126 - protein, 11 aa, Staphylococcus aureus
IYSQNQVTRQL

SEQ ID NO: 1627127 - protein, 4 aa, Staphylococcus aureus
IYST

SEQ ID NO: 1627128 - protein, 7 aa, Staphylococcus aureus
KAETLEE

SEQ ID NO: 1627129 - protein, 19 aa, Staphylococcus aureus
KAGKDIPGVELKVTESLVI

SEQ ID NO: 1627130 - protein, 15 aa, Staphylococcus aureus
KAGTVSKRSDINKKI

SEQ ID NO: 1627131 - protein, 13 aa, Staphylococcus aureus
KAKESAKQDIDKQ

SEQ ID NO: 1627132 - protein, 4 aa, Staphylococcus aureus
KAKG

SEQ ID NO: 1627133 - protein, 16 aa, Staphylococcus aureus
KANANPVITTGHPDFS

SEQ ID NO: 1627134 - protein, 20 aa, Staphylococcus aureus
KAQETASSIKNTLSNLLSFW

SEQ ID NO: 1627135 - protein, 5 aa, Staphylococcus aureus
KAQQD

SEQ ID NO: 1627136 - protein, 13 aa, Staphylococcus aureus
KARQKELDDLNNS

SEQ ID NO: 1627137 - protein, 11 aa, Staphylococcus aureus
KASRIRQIASN

SEQ ID NO: 1627138 - protein, 8 aa, Staphylococcus aureus
KATQTQTV

SEQ ID NO: 1627139 - protein, 10 aa, Staphylococcus aureus
KAVTPNSNDY

SEQ ID NO: 1627140 - protein, 7 aa, Staphylococcus aureus
KAYNSAV

SEQ ID NO: 1627141 - protein, 8 aa, Staphylococcus aureus
KDAPVLNG

SEQ ID NO: 1627142 - protein, 6 aa, Staphylococcus aureus
KDDKAY

SEQ ID NO: 1627143 - protein, 7 aa, Staphylococcus aureus
KDDNNKV

SEQ ID NO: 1627144 - protein, 5 aa, Staphylococcus aureus
KDDVQ

SEQ ID NO: 1627145 - protein, 6 aa, Staphylococcus aureus
KDENLI

SEQ ID NO: 1627146 - protein, 8 aa, Staphylococcus aureus
KDEPAGED

SEQ ID NO: 1627147 - protein, 7 aa, Staphylococcus aureus
KDGYKPA

SEQ ID NO: 1627148 - protein, 8 aa, Staphylococcus aureus
KDIIDSKG

SEQ ID NO: 1627149 - protein, 8 aa, Staphylococcus aureus
KDKGVYKG

SEQ ID NO: 1627150 - protein, 5 aa, Staphylococcus aureus
KDKHG

SEQ ID NO: 1627151 - protein, 9 aa, Staphylococcus aureus
KDNKNNGKV

SEQ ID NO: 1627152 - protein, 9 aa, Staphylococcus aureus
KDNNDNSLK

SEQ ID NO: 1627153 - protein, 7 aa, Staphylococcus aureus
KDNNGLK

SEQ ID NO: 1627154 - protein, 10 aa, Staphylococcus aureus
KDVAKVSRRD

SEQ ID NO: 1627155 - protein, 8 aa, Staphylococcus aureus
KDVVESED

SEQ ID NO: 1627156 - protein, 10 aa, Staphylococcus aureus
KDYGEHAKEL

SEQ ID NO: 1627157 - protein, 13 aa, Staphylococcus aureus
KDYISATEDHHSK

SEQ ID NO: 1627158 - protein, 13 aa, Staphylococcus aureus
KDYKNEKSLNMRQ

SEQ ID NO: 1627159 - protein, 31 aa, Staphylococcus aureus
KDYKNGDISYNPNVPSYSAKYQLNNDDYNVQ

SEQ ID NO: 1627160 - protein, 13 aa, Staphylococcus aureus
KEAGIYEALLTVN

SEQ ID NO: 1627161 - protein, 19 aa, Staphylococcus aureus
KEALTDPEDAITSAKSMVE

SEQ ID NO: 1627162 - protein, 5 aa, Staphylococcus aureus
KEDID

SEQ ID NO: 1627163 - protein, 9 aa, Staphylococcus aureus
KEDYADARG

SEQ ID NO: 1627164 - protein, 7 aa, Staphylococcus aureus
KEEKVPE

SEQ ID NO: 1627165 - protein, 10 aa, Staphylococcus aureus
KEERASAKKG

SEQ ID NO: 1627166 - protein, 16 aa, Staphylococcus aureus
KEGFRDEEFEKGDKGT

SEQ ID NO: 1627167 - protein, 5 aa, Staphylococcus aureus
KEIEH

SEQ ID NO: 1627168 - protein, 6 aa, Staphylococcus aureus
KEIKQF

SEQ ID NO: 1627169 - protein, 8 aa, Staphylococcus aureus
KEKGFTPK

SEQ ID NO: 1627170 - protein, 5 aa, Staphylococcus aureus
KENGE

SEQ ID NO: 1627171 - protein, 7 aa, Staphylococcus aureus
KENLNYD

SEQ ID NO: 1627172 - protein, 9 aa, Staphylococcus aureus
KENPDRSQQ

SEQ ID NO: 1627173 - protein, 7 aa, Staphylococcus aureus
KEPYDEH

SEQ ID NO: 1627174 - protein, 8 aa, Staphylococcus aureus
KERNIDAS

SEQ ID NO: 1627175 - protein, 5 aa, Staphylococcus aureus
KESLE

SEQ ID NO: 1627176 - protein, 8 aa, Staphylococcus aureus
KETQRVPR

SEQ ID NO: 1627177 - protein, 4 aa, Staphylococcus aureus
KEVT

SEQ ID NO: 1627178 - protein, 12 aa, Staphylococcus aureus
KFNASKSKELET

SEQ ID NO: 1627179 - protein, 4 aa, Staphylococcus aureus
KGCR

SEQ ID NO: 1627180 - protein, 5 aa, Staphylococcus aureus
KGDKL

SEQ ID NO: 1627181 - protein, 5 aa, Staphylococcus aureus
KGFNP

SEQ ID NO: 1627182 - protein, 9 aa, Staphylococcus aureus
KGGKGGVDL

SEQ ID NO: 1627183 - protein, 7 aa, Staphylococcus aureus
KGIGTQV

SEQ ID NO: 1627184 - protein, 5 aa, Staphylococcus aureus
KGKEA

SEQ ID NO: 1627185 - protein, 7 aa, Staphylococcus aureus
KGKFPKR

SEQ ID NO: 1627186 - protein, 10 aa, Staphylococcus aureus
KGKHYGATWQ

SEQ ID NO: 1627187 - protein, 16 aa, Staphylococcus aureus
KGLKSDLEKAKNQKFE

SEQ ID NO: 1627188 - protein, 6 aa, Staphylococcus aureus
KGLTGD

SEQ ID NO: 1627189 - protein, 5 aa, Staphylococcus aureus
KGNLG

SEQ ID NO: 1627190 - protein, 6 aa, Staphylococcus aureus
KGNPRA

SEQ ID NO: 1627191 - protein, 4 aa, Staphylococcus aureus
KGNV

SEQ ID NO: 1627192 - protein, 25 aa, Staphylococcus aureus
KGPNGENVKLNQSEMNDDDELEVGE

SEQ ID NO: 1627193 - protein, 5 aa, Staphylococcus aureus
KGSFK

SEQ ID NO: 1627194 - protein, 7 aa, Staphylococcus aureus
KGSKIYD

SEQ ID NO: 1627195 - protein, 11 aa, Staphylococcus aureus
KGTDKEAPQNI

SEQ ID NO: 1627196 - protein, 9 aa, Staphylococcus aureus
KGYQLNTSR

SEQ ID NO: 1627197 - protein, 7 aa, Staphylococcus aureus
KHASNTI

SEQ ID NO: 1627198 - protein, 15 aa, Staphylococcus aureus
KHETDRLVNICFKKM

SEQ ID NO: 1627199 - protein, 7 aa, Staphylococcus aureus
KHHSDEE

SEQ ID NO: 1627200 - protein, 8 aa, Staphylococcus aureus
KHLSSDEI

SEQ ID NO: 1627201 - protein, 5 aa, Staphylococcus aureus
KHQFK

SEQ ID NO: 1627202 - protein, 21 aa, Staphylococcus aureus
KHVDAEDKLTSQIATAGQNRN

SEQ ID NO: 1627203 - protein, 42 aa, Staphylococcus aureus
KHVSAEDGKEKVKPKPIVKGDQVGRNDDCPCGSGKKFKNCHG

SEQ ID NO: 1627204 - protein, 6 aa, Staphylococcus aureus
KHYDNG

SEQ ID NO: 1627205 - protein, 7 aa, Staphylococcus aureus
KIEANAN

SEQ ID NO: 1627206 - protein, 6 aa, Staphylococcus aureus
KIEGEL

SEQ ID NO: 1627207 - protein, 9 aa, Staphylococcus aureus
KINNAQSKS

SEQ ID NO: 1627208 - protein, 5 aa, Staphylococcus aureus
KIPTH

SEQ ID NO: 1627209 - protein, 12 aa, Staphylococcus aureus
KITDLSKKYNSY

SEQ ID NO: 1627210 - protein, 14 aa, Staphylococcus aureus
KITEDTFNALTEQF

SEQ ID NO: 1627211 - protein, 9 aa, Staphylococcus aureus
KKEGLKGGG

SEQ ID NO: 1627212 - protein, 8 aa, Staphylococcus aureus
KKENSKGI

SEQ ID NO: 1627213 - protein, 9 aa, Staphylococcus aureus
KKESSKGII

SEQ ID NO: 1627214 - protein, 29 aa, Staphylococcus aureus
KKGVSSTKNGRDSESKRLGAKRADGQFVT

SEQ ID NO: 1627215 - protein, 10 aa, Staphylococcus aureus
KKKSNDNVKH

SEQ ID NO: 1627216 - protein, 15 aa, Staphylococcus aureus
KKNNGSWNFNPQSAG

SEQ ID NO: 1627217 - protein, 5 aa, Staphylococcus aureus
KKNRQ

SEQ ID NO: 1627218 - protein, 16 aa, Staphylococcus aureus
KKNSGNASVPRNTGLK

SEQ ID NO: 1627219 - protein, 14 aa, Staphylococcus aureus
KKQTRYGEGIGKQY

SEQ ID NO: 1627220 - protein, 7 aa, Staphylococcus aureus
KKRNDNF

SEQ ID NO: 1627221 - protein, 9 aa, Staphylococcus aureus
KKSKELETI

SEQ ID NO: 1627222 - protein, 8 aa, Staphylococcus aureus
KKSKNNED

SEQ ID NO: 1627223 - protein, 10 aa, Staphylococcus aureus
KKSKTEIKQR

SEQ ID NO: 1627224 - protein, 7 aa, Staphylococcus aureus
KKSSRRR

SEQ ID NO: 1627225 - protein, 6 aa, Staphylococcus aureus
KKYGHY

SEQ ID NO: 1627226 - protein, 18 aa, Staphylococcus aureus
KLGALTDRNGLRPGRYTI

SEQ ID NO: 1627227 - protein, 12 aa, Staphylococcus aureus
KLIEDEKRLTQS

SEQ ID NO: 1627228 - protein, 10 aa, Staphylococcus aureus
KLNDKTPTTL

SEQ ID NO: 1627229 - protein, 13 aa, Staphylococcus aureus
KLNLTTRPTLKSI

SEQ ID NO: 1627230 - protein, 6 aa, Staphylococcus aureus
KLRQQI

SEQ ID NO: 1627231 - protein, 16 aa, Staphylococcus aureus
KLRTTKEEFNASKRTL

SEQ ID NO: 1627232 - protein, 13 aa, Staphylococcus aureus
KLSEPETKNIYSQ

SEQ ID NO: 1627233 - protein, 6 aa, Staphylococcus aureus
KLSTSG

SEQ ID NO: 1627234 - protein, 13 aa, Staphylococcus aureus
KLTGKPAATIDPE

SEQ ID NO: 1627235 - protein, 5 aa, Staphylococcus aureus
KMEEG

SEQ ID NO: 1627236 - protein, 9 aa, Staphylococcus aureus
KNANKDADI

SEQ ID NO: 1627237 - protein, 8 aa, Staphylococcus aureus
KNDMATIK

SEQ ID NO: 1627238 - protein, 8 aa, Staphylococcus aureus
KNDNKRNE

SEQ ID NO: 1627239 - protein, 5 aa, Staphylococcus aureus
KNGEY

SEQ ID NO: 1627240 - protein, 8 aa, Staphylococcus aureus
KNGYYADT

SEQ ID NO: 1627241 - protein, 6 aa, Staphylococcus aureus
KNIKTD

SEQ ID NO: 1627242 - protein, 13 aa, Staphylococcus aureus
KNIQHSSELSEKA

SEQ ID NO: 1627243 - protein, 9 aa, Staphylococcus aureus
KNKAETEKY

SEQ ID NO: 1627244 - protein, 7 aa, Staphylococcus aureus
KNKELKG

SEQ ID NO: 1627245 - protein, 4 aa, Staphylococcus aureus
KNKL

SEQ ID NO: 1627246 - protein, 6 aa, Staphylococcus aureus
KNKNMT

SEQ ID NO: 1627247 - protein, 7 aa, Staphylococcus aureus
KNKTIDI

SEQ ID NO: 1627248 - protein, 22 aa, Staphylococcus aureus
KNLETNKKEKPIKSLFKKVFNI

SEQ ID NO: 1627249 - protein, 13 aa, Staphylococcus aureus
KNNDFTKNNITSI

SEQ ID NO: 1627250 - protein, 13 aa, Staphylococcus aureus
KNNRPLSISSEHV

SEQ ID NO: 1627251 - protein, 6 aa, Staphylococcus aureus
KNNTNW

SEQ ID NO: 1627252 - protein, 10 aa, Staphylococcus aureus
KNRGGDGGIP

SEQ ID NO: 1627253 - protein, 9 aa, Staphylococcus aureus
KNRKIENND

SEQ ID NO: 1627254 - protein, 5 aa, Staphylococcus aureus
KNTGI

SEQ ID NO: 1627255 - protein, 7 aa, Staphylococcus aureus
KNVETIE

SEQ ID NO: 1627256 - protein, 6 aa, Staphylococcus aureus
KPAITK

SEQ ID NO: 1627257 - protein, 6 aa, Staphylococcus aureus
KPGDDL

SEQ ID NO: 1627258 - protein, 4 aa, Staphylococcus aureus
KPGG

SEQ ID NO: 1627259 - protein, 6 aa, Staphylococcus aureus
KPQTID

SEQ ID NO: 1627260 - protein, 14 aa, Staphylococcus aureus
KPTGMEITAEGEQL

SEQ ID NO: 1627261 - protein, 22 aa, Staphylococcus aureus
KPVNDKSYTGWTSDGHTGEDVN

SEQ ID NO: 1627262 - protein, 11 aa, Staphylococcus aureus
KPVSKEGTERL

SEQ ID NO: 1627263 - protein, 5 aa, Staphylococcus aureus
KPYCP

SEQ ID NO: 1627264 - protein, 7 aa, Staphylococcus aureus
KQEGGNI

SEQ ID NO: 1627265 - protein, 6 aa, Staphylococcus aureus
KQIDHD

SEQ ID NO: 1627266 - protein, 14 aa, Staphylococcus aureus
KQKSQKTREKVDKA

SEQ ID NO: 1627267 - protein, 23 aa, Staphylococcus aureus
KQNEKINAKVDKMSTKTVTTANG

SEQ ID NO: 1627268 - protein, 28 aa, Staphylococcus aureus
KQNRPNSITKYDPTKHNFKEKSENKPNF

SEQ ID NO: 1627269 - protein, 57 aa, Staphylococcus aureus
KQRGYDLERGQSRQVTNAKHEQISQYKQKTEYHKQEYERESQKTDHIKQKNDKLMQE

SEQ ID NO: 1627270 - protein, 5 aa, Staphylococcus aureus
KRAGI

SEQ ID NO: 1627271 - protein, 7 aa, Staphylococcus aureus
KRDHQSA

SEQ ID NO: 1627272 - protein, 8 aa, Staphylococcus aureus
KRGLTREQ

SEQ ID NO: 1627273 - protein, 7 aa, Staphylococcus aureus
KRLGPYT

SEQ ID NO: 1627274 - protein, 21 aa, Staphylococcus aureus
KRNIDKEKKMLEENGDLIESK

SEQ ID NO: 1627275 - protein, 7 aa, Staphylococcus aureus
KRRVDEL

SEQ ID NO: 1627276 - protein, 16 aa, Staphylococcus aureus
KRTNVGSKVDTIKSLG

SEQ ID NO: 1627277 - protein, 7 aa, Staphylococcus aureus
KSAYNNV

SEQ ID NO: 1627278 - protein, 7 aa, Staphylococcus aureus
KSAYYSR

SEQ ID NO: 1627279 - protein, 27 aa, Staphylococcus aureus
KSETAPRSVQSPTQAPKKETAIPQPKA

SEQ ID NO: 1627280 - protein, 12 aa, Staphylococcus aureus
KSFTNSKGIQGW

SEQ ID NO: 1627281 - protein, 6 aa, Staphylococcus aureus
KSKALY

SEQ ID NO: 1627282 - protein, 5 aa, Staphylococcus aureus
KSKKG

SEQ ID NO: 1627283 - protein, 8 aa, Staphylococcus aureus
KSKPYQKK

SEQ ID NO: 1627284 - protein, 7 aa, Staphylococcus aureus
KSLPDNE

SEQ ID NO: 1627285 - protein, 6 aa, Staphylococcus aureus
KSLRDD

SEQ ID NO: 1627286 - protein, 7 aa, Staphylococcus aureus
KSMPERN

SEQ ID NO: 1627287 - protein, 6 aa, Staphylococcus aureus
KSNEKL

SEQ ID NO: 1627288 - protein, 11 aa, Staphylococcus aureus
KSSGYNSYKAV

SEQ ID NO: 1627289 - protein, 5 aa, Staphylococcus aureus
KSTNI

SEQ ID NO: 1627290 - protein, 7 aa, Staphylococcus aureus
KSVWKGT

SEQ ID NO: 1627291 - protein, 4 aa, Staphylococcus aureus
KTAF

SEQ ID NO: 1627292 - protein, 14 aa, Staphylococcus aureus
KTAGGNTPKADVER

SEQ ID NO: 1627293 - protein, 6 aa, Staphylococcus aureus
KTESQQ

SEQ ID NO: 1627294 - protein, 12 aa, Staphylococcus aureus
KTFDSQRKRNIN

SEQ ID NO: 1627295 - protein, 18 aa, Staphylococcus aureus
KTHAKSTLSKLKKKGKIE

SEQ ID NO: 1627296 - protein, 18 aa, Staphylococcus aureus
KTHAKSTLSRLKKKGKIE

SEQ ID NO: 1627297 - protein, 5 aa, Staphylococcus aureus
KTKKW

SEQ ID NO: 1627298 - protein, 12 aa, Staphylococcus aureus
KTKPESGTVETV

SEQ ID NO: 1627299 - protein, 5 aa, Staphylococcus aureus
KTLTG

SEQ ID NO: 1627300 - protein, 14 aa, Staphylococcus aureus
KTQGANTSKQDVEA

SEQ ID NO: 1627301 - protein, 9 aa, Staphylococcus aureus
KTQNSGFRN

SEQ ID NO: 1627302 - protein, 6 aa, Staphylococcus aureus
KTRSYQ

SEQ ID NO: 1627303 - protein, 10 aa, Staphylococcus aureus
KTSGSKVTTL

SEQ ID NO: 1627304 - protein, 4 aa, Staphylococcus aureus
KTSI

SEQ ID NO: 1627305 - protein, 8 aa, Staphylococcus aureus
KTSLYNQS

SEQ ID NO: 1627306 - protein, 9 aa, Staphylococcus aureus
KTSSIQYEN

SEQ ID NO: 1627307 - protein, 6 aa, Staphylococcus aureus
KTSYPK

SEQ ID NO: 1627308 - protein, 6 aa, Staphylococcus aureus
KTVKDN

SEQ ID NO: 1627309 - protein, 5 aa, Staphylococcus aureus
KTYDI

SEQ ID NO: 1627310 - protein, 9 aa, Staphylococcus aureus
KVALDGDEN

SEQ ID NO: 1627311 - protein, 12 aa, Staphylococcus aureus
KVGNKDERNRKK

SEQ ID NO: 1627312 - protein, 28 aa, Staphylococcus aureus
KVNDTNQALNGNQKLADAKQDAKTTLGT

SEQ ID NO: 1627313 - protein, 9 aa, Staphylococcus aureus
KVNSTKSMT

SEQ ID NO: 1627314 - protein, 15 aa, Staphylococcus aureus
KVSNHSRYTNNTNET

SEQ ID NO: 1627315 - protein, 23 aa, Staphylococcus aureus
KVTQAKNDLNGNTNLATAKQNVQ

SEQ ID NO: 1627316 - protein, 12 aa, Staphylococcus aureus
KWELTGQSLHDI

SEQ ID NO: 1627317 - protein, 8 aa, Staphylococcus aureus
KYETDYRK

SEQ ID NO: 1627318 - protein, 7 aa, Staphylococcus aureus
KYIDETT

SEQ ID NO: 1627319 - protein, 7 aa, Staphylococcus aureus
KYQGTYS

SEQ ID NO: 1627320 - protein, 8 aa, Staphylococcus aureus
KYSVPTKY

SEQ ID NO: 1627321 - protein, 5 aa, Staphylococcus aureus
KYTEH

SEQ ID NO: 1627322 - protein, 48 aa, Staphylococcus aureus; identical to SEQ ID NO: 1568211

SEQ ID NO: 1627323 - protein, 13 aa, Staphylococcus aureus
LAISGGDVGGSKN

SEQ ID NO: 1627324 - protein, 7 aa, Staphylococcus aureus
LDAQRRG

SEQ ID NO: 1627325 - protein, 8 aa, Staphylococcus aureus
LDDNPDEL

SEQ ID NO: 1627326 - protein, 4 aa, Staphylococcus aureus
LDGI

SEQ ID NO: 1627327 - protein, 5 aa, Staphylococcus aureus
LDGTN

SEQ ID NO: 1627328 - protein, 5 aa, Staphylococcus aureus
LDKSN

SEQ ID NO: 1627329 - protein, 6 aa, Staphylococcus aureus
LDKSTY

SEQ ID NO: 1627330 - protein, 11 aa, Staphylococcus aureus
LDKTQTNAEVA

SEQ ID NO: 1627331 - protein, 10 aa, Staphylococcus aureus
LEAKEENQIL

SEQ ID NO: 1627332 - protein, 8 aa, Staphylococcus aureus
LEETPDAA

SEQ ID NO: 1627333 - protein, 57 aa, Staphylococcus aureus
LEGSSSKLEIKPQGTESTLKGIQGESSDIEVKPQATETTEASQYGPRPQFNKTPKYV

SEQ ID NO: 1627334 - protein, 5 aa, Staphylococcus aureus
LENAK

SEQ ID NO: 1627335 - protein, 11 aa, Staphylococcus aureus
LENNKRKFPTT

SEQ ID NO: 1627336 - protein, 6 aa, Staphylococcus aureus
LEPPIK

SEQ ID NO: 1627337 - protein, 6 aa, Staphylococcus aureus
LEQSYG

SEQ ID NO: 1627338 - protein, 14 aa, Staphylococcus aureus
LERDPNNKLAIKYI

SEQ ID NO: 1627339 - protein, 5 aa, Staphylococcus aureus
LGGYD

SEQ ID NO: 1627340 - protein, 8 aa, Staphylococcus aureus
LGITRKKA

SEQ ID NO: 1627341 - protein, 6 aa, Staphylococcus aureus
LGKDNK

SEQ ID NO: 1627342 - protein, 7 aa, Staphylococcus aureus
LGKDNKF

SEQ ID NO: 1627343 - protein, 4 aa, Staphylococcus aureus
LGNT

SEQ ID NO: 1627344 - protein, 14 aa, Staphylococcus aureus
LHPPKGDAFARRSQ

SEQ ID NO: 1627345 - protein, 20 aa, Staphylococcus aureus
LIPDYSNNLENSKTHFSTGS

SEQ ID NO: 1627346 - protein, 14 aa, Staphylococcus aureus
LKDTGTGDTLCGEK

SEQ ID NO: 1627347 - protein, 12 aa, Staphylococcus aureus
LKEKPNMPQKSQ

SEQ ID NO: 1627348 - protein, 14 aa, Staphylococcus aureus
LKERDEYKKQRDEL

SEQ ID NO: 1627349 - protein, 21 aa, Staphylococcus aureus
LKKEPRANTQAAEHILQEIRQ

SEQ ID NO: 1627350 - protein, 10 aa, Staphylococcus aureus
LKNKPDKSTI

SEQ ID NO: 1627351 - protein, 48 aa, Staphylococcus aureus
LKPVQSKQAVSESKPASQAAPSSRSDSQESNTNAYKTNNMTSNNVENN

SEQ ID NO: 1627352 - protein, 4 aa, Staphylococcus aureus
LKQE

SEQ ID NO: 1627353 - protein, 12 aa, Staphylococcus aureus
LKRGTDKNNLRG

SEQ ID NO: 1627354 - protein, 7 aa, Staphylococcus aureus
LKSAEDQ

SEQ ID NO: 1627355 - protein, 7 aa, Staphylococcus aureus
LKSGEGI

SEQ ID NO: 1627356 - protein, 9 aa, Staphylococcus aureus
LLDQESNDF

SEQ ID NO: 1627357 - protein, 7 aa, Staphylococcus aureus
LMDPEQV

SEQ ID NO: 1627358 - protein, 12 aa, Staphylococcus aureus
LNDAPKSEIPTP

SEQ ID NO: 1627359 - protein, 9 aa, Staphylococcus aureus
LNDVAPARA

SEQ ID NO: 1627360 - protein, 7 aa, Staphylococcus aureus
LNENDQL

SEQ ID NO: 1627361 - protein, 4 aa, Staphylococcus aureus
LNKG

SEQ ID NO: 1627362 - protein, 7 aa, Staphylococcus aureus
LNPRYNT

SEQ ID NO: 1627363 - protein, 21 aa, Staphylococcus aureus
LPEEKVNQFKPKEENKPKTIE

SEQ ID NO: 1627364 - protein, 17 aa, Staphylococcus aureus
LPKKRKTIEDIEKDEAK

SEQ ID NO: 1627365 - protein, 5 aa, Staphylococcus aureus
LPLPS

SEQ ID NO: 1627366 - protein, 4 aa, Staphylococcus aureus
LPTG

SEQ ID NO: 1627367 - protein, 6 aa, Staphylococcus aureus
LQKNND

SEQ ID NO: 1627368 - protein, 5 aa, Staphylococcus aureus
LQTED

SEQ ID NO: 1627369 - protein, 8 aa, Staphylococcus aureus
LQTSNNRI

SEQ ID NO: 1627370 - protein, 11 aa, Staphylococcus aureus
LREITKDSKMQ

SEQ ID NO: 1627371 - protein, 8 aa, Staphylococcus aureus
LRQNLEKQ

SEQ ID NO: 1627372 - protein, 8 aa, Staphylococcus aureus
LRRDQHDG

SEQ ID NO: 1627373 - protein, 5 aa, Staphylococcus aureus
LSALP

SEQ ID NO: 1627374 - protein, 9 aa, Staphylococcus aureus
LSDKSAKKT

SEQ ID NO: 1627375 - protein, 10 aa, Staphylococcus aureus
LSDVRKDGTL

SEQ ID NO: 1627376 - protein, 7 aa, Staphylococcus aureus
LSERTKR

SEQ ID NO: 1627377 - protein, 6 aa, Staphylococcus aureus
LSESTK

SEQ ID NO: 1627378 - protein, 16 aa, Staphylococcus aureus
LSKNNKSKLMKASEAT

SEQ ID NO: 1627379 - protein, 8 aa, Staphylococcus aureus
LSKSTLSQ

SEQ ID NO: 1627380 - protein, 9 aa, Staphylococcus aureus
LSKTDLSQY

SEQ ID NO: 1627381 - protein, 11 aa, Staphylococcus aureus
LSNTFKDSNEL

SEQ ID NO: 1627382 - protein, 6 aa, Staphylococcus aureus
LTDEDW

SEQ ID NO: 1627383 - protein, 4 aa, Staphylococcus aureus
LTED

SEQ ID NO: 1627384 - protein, 8 aa, Staphylococcus aureus
LTETQKHQ

SEQ ID NO: 1627385 - protein, 7 aa, Staphylococcus aureus
LTGAKPA

SEQ ID NO: 1627386 - protein, 4 aa, Staphylococcus aureus
LTGL

SEQ ID NO: 1627387 - protein, 6 aa, Staphylococcus aureus
LTGSNG

SEQ ID NO: 1627388 - protein, 13 aa, Staphylococcus aureus
LTIEQQKQVDTIS

SEQ ID NO: 1627389 - protein, 8 aa, Staphylococcus aureus
LTNDDYNV

SEQ ID NO: 1627390 - protein, 9 aa, Staphylococcus aureus
LTNNPSRQF

SEQ ID NO: 1627391 - protein, 7 aa, Staphylococcus aureus
LTNPYNG

SEQ ID NO: 1627392 - protein, 6 aa, Staphylococcus aureus
LTPKKL

SEQ ID NO: 1627393 - protein, 7 aa, Staphylococcus aureus
LTPNEMK

SEQ ID NO: 1627394 - protein, 13 aa, Staphylococcus aureus
LYQASKPKLQEDR

SEQ ID NO: 1627395 - protein, 9 aa, Staphylococcus aureus
LYRQGQNHT

SEQ ID NO: 1627396 - protein, 8 aa, Staphylococcus aureus
MAENQNDE

SEQ ID NO: 1627397 - protein, 6 aa, Staphylococcus aureus
MDNPYG

SEQ ID NO: 1627398 - protein, 5 aa, Staphylococcus aureus
MEEEG

SEQ ID NO: 1627399 - protein, 10 aa, Staphylococcus aureus
MGGRKAAERI

SEQ ID NO: 1627400 - protein, 7 aa, Staphylococcus aureus
MKTDHKT

SEQ ID NO: 1627401 - protein, 6 aa, Staphylococcus aureus
MSKAQS

SEQ ID NO: 1627402 - protein, 29 aa, Staphylococcus aureus
MTAHSSDDDDQYRTKEERETLKKADCNEK

SEQ ID NO: 1627403 - protein, 38 aa, Staphylococcus aureus
NAANLRDKQTKLEKQYEEAKNEWKNAQNGMSTSLSEED

SEQ ID NO: 1627404 - protein, 10 aa, Staphylococcus aureus
NAESDTANYM

SEQ ID NO: 1627405 - protein, 9 aa, Staphylococcus aureus
NAKRISNTI

SEQ ID NO: 1627406 - protein, 5 aa, Staphylococcus aureus
NAQEA

SEQ ID NO: 1627407 - protein, 35 aa, Staphylococcus aureus
NARQSPLTGGDSFNHSSKNKPQNLAEIARQKRIIK

SEQ ID NO: 1627408 - protein, 6 aa, Staphylococcus aureus
NAYQQK

SEQ ID NO: 1627409 - protein, 14 aa, Staphylococcus aureus
NDIDTHATSNDEDF

SEQ ID NO: 1627410 - protein, 14 aa, Staphylococcus aureus
NDIDTHATSNNEDF

SEQ ID NO: 1627411 - protein, 25 aa, Staphylococcus aureus
NDKEFKEGMQQARKELDYTANTDAV

SEQ ID NO: 1627412 - protein, 8 aa, Staphylococcus aureus
NDKEVENT

SEQ ID NO: 1627413 - protein, 5 aa, Staphylococcus aureus
NDLEY

SEQ ID NO: 1627414 - protein, 11 aa, Staphylococcus aureus
NDRYEDEHQQY

SEQ ID NO: 1627415 - protein, 4 aa, Staphylococcus aureus
NDSI

SEQ ID NO: 1627416 - protein, 8 aa, Staphylococcus aureus
NDSREFKE

SEQ ID NO: 1627417 - protein, 29 aa, Staphylococcus aureus
NDTKKPSKQSVSELKRQYETEESGTSYER

SEQ ID NO: 1627418 - protein, 11 aa, Staphylococcus aureus
NDVTTKYHSGQ

SEQ ID NO: 1627419 - protein, 5 aa, Staphylococcus aureus
NEAHR

SEQ ID NO: 1627420 - protein, 4 aa, Staphylococcus aureus
NEDA

SEQ ID NO: 1627421 - protein, 10 aa, Staphylococcus aureus
NEDLQQYPKI

SEQ ID NO: 1627422 - protein, 5 aa, Staphylococcus aureus
NEDVN

SEQ ID NO: 1627423 - protein, 7 aa, Staphylococcus aureus
NEEDLDD

SEQ ID NO: 1627424 - protein, 10 aa, Staphylococcus aureus
NEELNNKEIE

SEQ ID NO: 1627425 - protein, 4 aa, Staphylococcus aureus
NEEY

SEQ ID NO: 1627426 - protein, 11 aa, Staphylococcus aureus
NEGFEKAGPIH

SEQ ID NO: 1627427 - protein, 24 aa, Staphylococcus aureus
NEGVNAMTEQDNAHHSEQIKTNLK

SEQ ID NO: 1627428 - protein, 5 aa, Staphylococcus aureus
NEIDK

SEQ ID NO: 1627429 - protein, 6 aa, Staphylococcus aureus
NEINSD

SEQ ID NO: 1627430 - protein, 11 aa, Staphylococcus aureus
NEKKDFKVNGK

SEQ ID NO: 1627431 - protein, 9 aa, Staphylococcus aureus
NEKQQNFGK

SEQ ID NO: 1627432 - protein, 18 aa, Staphylococcus aureus
NELKTKDKNLDGNDIREG

SEQ ID NO: 1627433 - protein, 9 aa, Staphylococcus aureus
NELSPFDDY

SEQ ID NO: 1627434 - protein, 12 aa, Staphylococcus aureus
NENIEKDINNHT

SEQ ID NO: 1627435 - protein, 7 aa, Staphylococcus aureus
NENKKDD

SEQ ID NO: 1627436 - protein, 7 aa, Staphylococcus aureus
NENNQYN

SEQ ID NO: 1627437 - protein, 5 aa, Staphylococcus aureus
NEQNR

SEQ ID NO: 1627438 - protein, 6 aa, Staphylococcus aureus
NEQRSS

SEQ ID NO: 1627439 - protein, 5 aa, Staphylococcus aureus
NFNPD

SEQ ID NO: 1627440 - protein, 23 aa, Staphylococcus aureus
NGDGINEVKDARIDNTGYGHKTL

SEQ ID NO: 1627441 - protein, 22 aa, Staphylococcus aureus
NGDGINEVKDARVDNTGYGHKT

SEQ ID NO: 1627442 - protein, 6 aa, Staphylococcus aureus
NGEKLH

SEQ ID NO: 1627443 - protein, 8 aa, Staphylococcus aureus
NGNYEGGY

SEQ ID NO: 1627444 - protein, 9 aa, Staphylococcus aureus
NGPQAPHDI

SEQ ID NO: 1627445 - protein, 5 aa, Staphylococcus aureus
NGQVA

SEQ ID NO: 1627446 - protein, 7 aa, Staphylococcus aureus
NGRDALS

SEQ ID NO: 1627447 - protein, 8 aa, Staphylococcus aureus
NGRKPSEC

SEQ ID NO: 1627448 - protein, 5 aa, Staphylococcus aureus
NGTKK

SEQ ID NO: 1627449 - protein, 9 aa, Staphylococcus aureus
NGTKLSTEI

SEQ ID NO: 1627450 - protein, 14 aa, Staphylococcus aureus
NGVKANIKKTLTPH

SEQ ID NO: 1627451 - protein, 6 aa, Staphylococcus aureus
NGYEKR

SEQ ID NO: 1627452 - protein, 4 aa, Staphylococcus aureus
NIEN

SEQ ID NO: 1627453 - protein, 6 aa, Staphylococcus aureus
NIPPHN

SEQ ID NO: 1627454 - protein, 22 aa, Staphylococcus aureus
NISRQTINTLENGSYIPSLKTA

SEQ ID NO: 1627455 - protein, 7 aa, Staphylococcus aureus
NKAKNIK

SEQ ID NO: 1627456 - protein, 15 aa, Staphylococcus aureus
NKDQIAEYEREQMEK

SEQ ID NO: 1627457 - protein, 9 aa, Staphylococcus aureus
NKDTGKVTL

SEQ ID NO: 1627458 - protein, 4 aa, Staphylococcus aureus
NKEK

SEQ ID NO: 1627459 - protein, 8 aa, Staphylococcus aureus
NKGWTTPA

SEQ ID NO: 1627460 - protein, 32 aa, Staphylococcus aureus
NKKAFDKGTTTEDIAQSISPGLRKKAVAGKFN

SEQ ID NO: 1627461 - protein, 9 aa, Staphylococcus aureus
NKKKQKIDA

SEQ ID NO: 1627462 - protein, 14 aa, Staphylococcus aureus
NKTQDNVKQPAHYT

SEQ ID NO: 1627463 - protein, 10 aa, Staphylococcus aureus
NKVPRDSDKY

SEQ ID NO: 1627464 - protein, 10 aa, Staphylococcus aureus
NLEDGETSQF

SEQ ID NO: 1627465 - protein, 12 aa, Staphylococcus aureus
NLEETKKTSDLI

SEQ ID NO: 1627466 - protein, 14 aa, Staphylococcus aureus
NLENGNPEVHPGPT

SEQ ID NO: 1627467 - protein, 15 aa, Staphylococcus aureus
NLNQPQKTALKDQVS

SEQ ID NO: 1627468 - protein, 10 aa, Staphylococcus aureus
NLNSNKEEFG

SEQ ID NO: 1627469 - protein, 4 aa, Staphylococcus aureus
NMGQ

SEQ ID NO: 1627470 - protein, 21 aa, Staphylococcus aureus
NNAQKQDLNTQVTNAPNISTV

SEQ ID NO: 1627471 - protein, 18 aa, Staphylococcus aureus
NNAQKQQLQSQITQSSDI

SEQ ID NO: 1627472 - protein, 16 aa, Staphylococcus aureus
NNETTNEEKGNDIGPV

SEQ ID NO: 1627473 - protein, 5 aa, Staphylococcus aureus
NNFPS

SEQ ID NO: 1627474 - protein, 4 aa, Staphylococcus aureus
NNKH

SEQ ID NO: 1627475 - protein, 6 aa, Staphylococcus aureus
NNKPST

SEQ ID NO: 1627476 - protein, 11 aa, Staphylococcus aureus
NNPEQRVGDST

SEQ ID NO: 1627477 - protein, 9 aa, Staphylococcus aureus
NNSNSFESL

SEQ ID NO: 1627478 - protein, 9 aa, Staphylococcus aureus
NNSPQARLS

SEQ ID NO: 1627479 - protein, 20 aa, Staphylococcus aureus
NPDDEETDEGIIAKWTKNKI

SEQ ID NO: 1627480 - protein, 10 aa, Staphylococcus aureus
NPETKEIKQP

SEQ ID NO: 1627481 - protein, 12 aa, Staphylococcus aureus
NPETTNTASNIE

SEQ ID NO: 1627482 - protein, 6 aa, Staphylococcus aureus
NPITTE

SEQ ID NO: 1627483 - protein, 10 aa, Staphylococcus aureus
NPKQKDNKVS

SEQ ID NO: 1627484 - protein, 23 aa, Staphylococcus aureus
NPLKGNGELGKRSPFNDNKTRLY

SEQ ID NO: 1627485 - protein, 4 aa, Staphylococcus aureus
NPNV

SEQ ID NO: 1627486 - protein, 8 aa, Staphylococcus aureus
NQAPSTKV

SEQ ID NO: 1627487 - protein, 7 aa, Staphylococcus aureus
NQESESL

SEQ ID NO: 1627488 - protein, 4 aa, Staphylococcus aureus
NQIG

SEQ ID NO: 1627489 - protein, 6 aa, Staphylococcus aureus
NQNDIY

SEQ ID NO: 1627490 - protein, 6 aa, Staphylococcus aureus
NQNPND

SEQ ID NO: 1627491 - protein, 13 aa, Staphylococcus aureus
NQQGDSTREENTS

SEQ ID NO: 1627492 - protein, 13 aa, Staphylococcus aureus
NQRTNGNRKETWS

SEQ ID NO: 1627493 - protein, 11 aa, Staphylococcus aureus
NQSINENNKRV

SEQ ID NO: 1627494 - protein, 5 aa, Staphylococcus aureus
NQSSI

SEQ ID NO: 1627495 - protein, 7 aa, Staphylococcus aureus
NQTSANR

SEQ ID NO: 1627496 - protein, 23 aa, Staphylococcus aureus
NQTTSPTMNPDDVNGATTQVNNT

SEQ ID NO: 1627497 - protein, 23 aa, Staphylococcus aureus
NQTTSPTMNPDEVNRATTQVNNT

SEQ ID NO: 1627498 - protein, 32 aa, Staphylococcus aureus; identical to SEQ ID NO: 1571689

SEQ ID NO: 1627499 - protein, 12 aa, Staphylococcus aureus
NQYGATPSQNHS

SEQ ID NO: 1627500 - protein, 8 aa, Staphylococcus aureus
NRAAEEIK

SEQ ID NO: 1627501 - protein, 6 aa, Staphylococcus aureus
NRNEEI

SEQ ID NO: 1627502 - protein, 6 aa, Staphylococcus aureus
NRQGTP

SEQ ID NO: 1627503 - protein, 5 aa, Staphylococcus aureus
NRTVR

SEQ ID NO: 1627504 - protein, 14 aa, Staphylococcus aureus
NSAIDGGKKTAAFS

SEQ ID NO: 1627505 - protein, 7 aa, Staphylococcus aureus
NSASFYR

SEQ ID NO: 1627506 - protein, 10 aa, Staphylococcus aureus
NSDAKSLKEV

SEQ ID NO: 1627507 - protein, 7 aa, Staphylococcus aureus
NSGKPCK

SEQ ID NO: 1627508 - protein, 6 aa, Staphylococcus aureus
NSGTEA

SEQ ID NO: 1627509 - protein, 8 aa, Staphylococcus aureus
NSLAKGEK

SEQ ID NO: 1627510 - protein, 14 aa, Staphylococcus aureus
NSNNTTSDINQQQL

SEQ ID NO: 1627511 - protein, 18 aa, Staphylococcus aureus
NSNSNNKLKIPLSSIVSV

SEQ ID NO: 1627512 - protein, 11 aa, Staphylococcus aureus
NSQNVEKDLTK

SEQ ID NO: 1627513 - protein, 6 aa, Staphylococcus aureus
NSSYRR

SEQ ID NO: 1627514 - protein, 8 aa, Staphylococcus aureus
NTEGEDIS

SEQ ID NO: 1627515 - protein, 18 aa, Staphylococcus aureus
NTGNSRNGSYDRTVKTEY

SEQ ID NO: 1627516 - protein, 8 aa, Staphylococcus aureus
NTKEPNTI

SEQ ID NO: 1627517 - protein, 7 aa, Staphylococcus aureus
NTLPDND

SEQ ID NO: 1627518 - protein, 34 aa, Staphylococcus aureus; identical to SEQ ID NO: 1566909

SEQ ID NO: 1627519 - protein, 22 aa, Staphylococcus aureus
NTQQTSTKHQTTQNNYVTDQQK

SEQ ID NO: 1627520 - protein, 6 aa, Staphylococcus aureus
NVAKGD

SEQ ID NO: 1627521 - protein, 4 aa, Staphylococcus aureus
NVDM

SEQ ID NO: 1627522 - protein, 26 aa, Staphylococcus aureus
NVGTPEGVRELENAGADATKVGIGPG

SEQ ID NO: 1627523 - protein, 8 aa, Staphylococcus aureus
NVKKQNDY

SEQ ID NO: 1627524 - protein, 6 aa, Staphylococcus aureus
NVSERR

SEQ ID NO: 1627525 - protein, 9 aa, Staphylococcus aureus
NYAKKKKSI

SEQ ID NO: 1627526 - protein, 6 aa, Staphylococcus aureus
NYHQET

SEQ ID NO: 1627527 - protein, 12 aa, Staphylococcus aureus
NYPRGASTNGTV

SEQ ID NO: 1627528 - protein, 10 aa, Staphylococcus aureus
NYSDNTKSFD

SEQ ID NO: 1627529 - protein, 6 aa, Staphylococcus aureus
NYSGEN

SEQ ID NO: 1627530 - protein, 6 aa, Staphylococcus aureus
NYSIKT

SEQ ID NO: 1627531 - protein, 8 aa, Staphylococcus aureus
NYVQDGRG

SEQ ID NO: 1627532 - protein, 9 aa, Staphylococcus aureus
PAEGYNNPR

SEQ ID NO: 1627533 - protein, 21 aa, Staphylococcus aureus
PAHQTKSPDEIKKELESKKND

SEQ ID NO: 1627534 - protein, 6 aa, Staphylococcus aureus
PAPYKN

SEQ ID NO: 1627535 - protein, 6 aa, Staphylococcus aureus
PAYPQQ

SEQ ID NO: 1627536 - protein, 12 aa, Staphylococcus aureus
PCNNSTPSKGGD

SEQ ID NO: 1627537 - protein, 4 aa, Staphylococcus aureus
PDGK

SEQ ID NO: 1627538 - protein, 12 aa, Staphylococcus aureus
PDGKKIGNSNTP

SEQ ID NO: 1627539 - protein, 7 aa, Staphylococcus aureus
PDLPEAE

SEQ ID NO: 1627540 - protein, 11 aa, Staphylococcus aureus
PDLPSGVESYE

SEQ ID NO: 1627541 - protein, 10 aa, Staphylococcus aureus
PDVRDGLKPV

SEQ ID NO: 1627542 - protein, 5 aa, Staphylococcus aureus
PEDKQ

SEQ ID NO: 1627543 - protein, 8 aa, Staphylococcus aureus
PENDSPSY

SEQ ID NO: 1627544 - protein, 7 aa, Staphylococcus aureus
PEPFSNE

SEQ ID NO: 1627545 - protein, 4 aa, Staphylococcus aureus
PESN

SEQ ID NO: 1627546 - protein, 6 aa, Staphylococcus aureus
PETEYE

SEQ ID NO: 1627547 - protein, 6 aa, Staphylococcus aureus
PETNST

SEQ ID NO: 1627548 - protein, 8 aa, Staphylococcus aureus
PEVAERPE

SEQ ID NO: 1627549 - protein, 10 aa, Staphylococcus aureus
PEYDSNSIAQ

SEQ ID NO: 1627550 - protein, 7 aa, Staphylococcus aureus
PGAPPDL

SEQ ID NO: 1627551 - protein, 15 aa, Staphylococcus aureus
PGEPKGTIYEASLII

SEQ ID NO: 1627552 - protein, 18 aa, Staphylococcus aureus
PIESGKNYKSYEKVKLKA

SEQ ID NO: 1627553 - protein, 7 aa, Staphylococcus aureus
PIGASGA

SEQ ID NO: 1627554 - protein, 5 aa, Staphylococcus aureus
PINET

SEQ ID NO: 1627555 - protein, 5 aa, Staphylococcus aureus
PIPPH

SEQ ID NO: 1627556 - protein, 8 aa, Staphylococcus aureus
PITECSGN

SEQ ID NO: 1627557 - protein, 16 aa, Staphylococcus aureus
PIYKNQEKRHQLAGKY

SEQ ID NO: 1627558 - protein, 13 aa, Staphylococcus aureus
PKAGGSLDGENMP

SEQ ID NO: 1627559 - protein, 8 aa, Staphylococcus aureus
PKAPYEVS

SEQ ID NO: 1627560 - protein, 9 aa, Staphylococcus aureus
PKIPQGRGK

SEQ ID NO: 1627561 - protein, 7 aa, Staphylococcus aureus
PKKVKVD

SEQ ID NO: 1627562 - protein, 16 aa, Staphylococcus aureus
PKNKYPDSIEDSTAKW

SEQ ID NO: 1627563 - protein, 14 aa, Staphylococcus aureus
PKNYEDKSNPDPKV

SEQ ID NO: 1627564 - protein, 17 aa, Staphylococcus aureus
PKSLNPNIKIYDVLYIS

SEQ ID NO: 1627565 - protein, 7 aa, Staphylococcus aureus
PLAKGAS

SEQ ID NO: 1627566 - protein, 4 aa, Staphylococcus aureus
PLPE

SEQ ID NO: 1627567 - protein, 6 aa, Staphylococcus aureus
PNDEMK

SEQ ID NO: 1627568 - protein, 17 aa, Staphylococcus aureus
PNKLKGAPKSVRGDRRG

SEQ ID NO: 1627569 - protein, 10 aa, Staphylococcus aureus
PNKYDKLKED

SEQ ID NO: 1627570 - protein, 6 aa, Staphylococcus aureus
PNPYST

SEQ ID NO: 1627571 - protein, 12 aa, Staphylococcus aureus
PNVEKRPKPDYE

SEQ ID NO: 1627572 - protein, 4 aa, Staphylococcus aureus
PPIA

SEQ ID NO: 1627573 - protein, 9 aa, Staphylococcus aureus
PPQPNGVSK

SEQ ID NO: 1627574 - protein, 11 aa, Staphylococcus aureus
PPVEGGDKPLI

SEQ ID NO: 1627575 - protein, 20 aa, Staphylococcus aureus
PQHREIGSTISTGNASWGTT

SEQ ID NO: 1627576 - protein, 8 aa, Staphylococcus aureus
PQKSTYKF

SEQ ID NO: 1627577 - protein, 5 aa, Staphylococcus aureus
PQLNG

SEQ ID NO: 1627578 - protein, 345 aa, Staphylococcus aureus
PQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQD

SEQ ID NO: 1627579 - protein, 8 aa, Staphylococcus aureus
PRGSNGLK

SEQ ID NO: 1627580 - protein, 19 aa, Staphylococcus aureus
PSKQDMKDVRGTMKDGAAD

SEQ ID NO: 1627581 - protein, 5 aa, Staphylococcus aureus
PSLDN

SEQ ID NO: 1627582 - protein, 4 aa, Staphylococcus aureus
PTAA

SEQ ID NO: 1627583 - protein, 9 aa, Staphylococcus aureus
PTEDESREY

SEQ ID NO: 1627584 - protein, 5 aa, Staphylococcus aureus
PTKGN

SEQ ID NO: 1627585 - protein, 5 aa, Staphylococcus aureus
PTKKT

SEQ ID NO: 1627586 - protein, 9 aa, Staphylococcus aureus
PTNDGHTKK

SEQ ID NO: 1627587 - protein, 5 aa, Staphylococcus aureus
PTNHL

SEQ ID NO: 1627588 - protein, 9 aa, Staphylococcus aureus
PTSALDQEN

SEQ ID NO: 1627589 - protein, 7 aa, Staphylococcus aureus
PTSHTKE

SEQ ID NO: 1627590 - protein, 10 aa, Staphylococcus aureus
PTYRNKVSKR

SEQ ID NO: 1627591 - protein, 8 aa, Staphylococcus aureus
PVEEAQRF

SEQ ID NO: 1627592 - protein, 6 aa, Staphylococcus aureus
PVPEYD

SEQ ID NO: 1627593 - protein, 5 aa, Staphylococcus aureus
PYAGS

SEQ ID NO: 1627594 - protein, 6 aa, Staphylococcus aureus
PYKKTN

SEQ ID NO: 1627595 - protein, 9 aa, Staphylococcus aureus
PYQRGSIEN

SEQ ID NO: 1627596 - protein, 13 aa, Staphylococcus aureus
PYRPQTKGSAESL

SEQ ID NO: 1627597 - protein, 7 aa, Staphylococcus aureus
PYSKEVP

SEQ ID NO: 1627598 - protein, 5 aa, Staphylococcus aureus
QANVD

SEQ ID NO: 1627599 - protein, 10 aa, Staphylococcus aureus
QARNRDEASQ

SEQ ID NO: 1627600 - protein, 7 aa, Staphylococcus aureus
QATAETN

SEQ ID NO: 1627601 - protein, 15 aa, Staphylococcus aureus
QDEVDYQTERSEQLG

SEQ ID NO: 1627602 - protein, 8 aa, Staphylococcus aureus
QDGTATYV

SEQ ID NO: 1627603 - protein, 24 aa, Staphylococcus aureus
QDIEEKEKAKVKDTGEAYQSLNDH

SEQ ID NO: 1627604 - protein, 4 aa, Staphylococcus aureus
QDPH

SEQ ID NO: 1627605 - protein, 5 aa, Staphylococcus aureus
QEDYQ

SEQ ID NO: 1627606 - protein, 4 aa, Staphylococcus aureus
QEEI

SEQ ID NO: 1627607 - protein, 8 aa, Staphylococcus aureus
QELENNKI

SEQ ID NO: 1627608 - protein, 7 aa, Staphylococcus aureus
QEQGYNS

SEQ ID NO: 1627609 - protein, 9 aa, Staphylococcus aureus
QEVDSYRTA

SEQ ID NO: 1627610 - protein, 10 aa, Staphylococcus aureus
QGDTHQDGKT

SEQ ID NO: 1627611 - protein, 5 aa, Staphylococcus aureus
QGGQF

SEQ ID NO: 1627612 - protein, 12 aa, Staphylococcus aureus
QGIPDDAKYEQV

SEQ ID NO: 1627613 - protein, 7 aa, Staphylococcus aureus
QGKNEFE

SEQ ID NO: 1627614 - protein, 6 aa, Staphylococcus aureus
QGNELG

SEQ ID NO: 1627615 - protein, 10 aa, Staphylococcus aureus
QGNSHNRLKS

SEQ ID NO: 1627616 - protein, 6 aa, Staphylococcus aureus
QGQRLV

SEQ ID NO: 1627617 - protein, 10 aa, Staphylococcus aureus
QGSNQVGNKK

SEQ ID NO: 1627618 - protein, 5 aa, Staphylococcus aureus
QGTSF

SEQ ID NO: 1627619 - protein, 11 aa, Staphylococcus aureus
QGYAEENNKSF

SEQ ID NO: 1627620 - protein, 9 aa, Staphylococcus aureus
QHGGSRLKD

SEQ ID NO: 1627621 - protein, 4 aa, Staphylococcus aureus
QIEP

SEQ ID NO: 1627622 - protein, 13 aa, Staphylococcus aureus
QIKDEEKEREKIR

SEQ ID NO: 1627623 - protein, 7 aa, Staphylococcus aureus
QINAPTK

SEQ ID NO: 1627624 - protein, 5 aa, Staphylococcus aureus
QINTR

SEQ ID NO: 1627625 - protein, 9 aa, Staphylococcus aureus
QKAFDTTGE

SEQ ID NO: 1627626 - protein, 8 aa, Staphylococcus aureus
QKGFEQTR

SEQ ID NO: 1627627 - protein, 7 aa, Staphylococcus aureus
QKHSRGR

SEQ ID NO: 1627628 - protein, 4 aa, Staphylococcus aureus
QKRD

SEQ ID NO: 1627629 - protein, 4 aa, Staphylococcus aureus
QKRQ

SEQ ID NO: 1627630 - protein, 10 aa, Staphylococcus aureus
QKSPKELVET

SEQ ID NO: 1627631 - protein, 11 aa, Staphylococcus aureus
QLNEKYGTKYE

SEQ ID NO: 1627632 - protein, 6 aa, Staphylococcus aureus
QLVKSD

SEQ ID NO: 1627633 - protein, 4 aa, Staphylococcus aureus
QNER

SEQ ID NO: 1627634 - protein, 11 aa, Staphylococcus aureus
QNFKSSGCVGQ

SEQ ID NO: 1627635 - protein, 5 aa, Staphylococcus aureus
QNGYK

SEQ ID NO: 1627636 - protein, 20 aa, Staphylococcus aureus
QNLKPEQEEEYNELETQNGK

SEQ ID NO: 1627637 - protein, 7 aa, Staphylococcus aureus
QNPPKRV

SEQ ID NO: 1627638 - protein, 35 aa, Staphylococcus aureus
QNQLTTKIDSNSESLKAIQTSQEAIQEAQASQAKV

SEQ ID NO: 1627639 - protein, 4 aa, Staphylococcus aureus
QNQP

SEQ ID NO: 1627640 - protein, 19 aa, Staphylococcus aureus
QNRPSLSDNYTQPTTPNPI

SEQ ID NO: 1627641 - protein, 4 aa, Staphylococcus aureus
QNRQ

SEQ ID NO: 1627642 - protein, 5 aa, Staphylococcus aureus
QPETK

SEQ ID NO: 1627643 - protein, 5 aa, Staphylococcus aureus
QPFDN

SEQ ID NO: 1627644 - protein, 17 aa, Staphylococcus aureus
QPTTVAASSKDKSVSKL

SEQ ID NO: 1627645 - protein, 11 aa, Staphylococcus aureus
QQFKDQPKNEI

SEQ ID NO: 1627646 - protein, 7 aa, Staphylococcus aureus
QQHPEDE

SEQ ID NO: 1627647 - protein, 5 aa, Staphylococcus aureus
QQLEQ

SEQ ID NO: 1627648 - protein, 7 aa, Staphylococcus aureus
QQQQELK

SEQ ID NO: 1627649 - protein, 6 aa, Staphylococcus aureus
QQQRPE

SEQ ID NO: 1627650 - protein, 5 aa, Staphylococcus aureus
QQRPE

SEQ ID NO: 1627651 - protein, 4 aa, Staphylococcus aureus
QQTR

SEQ ID NO: 1627652 - protein, 8 aa, Staphylococcus aureus
QQVPEETP

SEQ ID NO: 1627653 - protein, 12 aa, Staphylococcus aureus
QRINPEVKKNAL

SEQ ID NO: 1627654 - protein, 13 aa, Staphylococcus aureus
QRKNQTKKKKEQI

SEQ ID NO: 1627655 - protein, 4 aa, Staphylococcus aureus
QRYR

SEQ ID NO: 1627656 - protein, 27 aa, Staphylococcus aureus
QSDDPDEPGGDGKKGNPDKKEYDEGTE

SEQ ID NO: 1627657 - protein, 9 aa, Staphylococcus aureus
QSDSEDPRK

SEQ ID NO: 1627658 - protein, 21 aa, Staphylococcus aureus
QSKGEHKGKIEGEVKSIEKHS

SEQ ID NO: 1627659 - protein, 10 aa, Staphylococcus aureus
QSLHQSPYSA

SEQ ID NO: 1627660 - protein, 7 aa, Staphylococcus aureus
QSPKMYG

SEQ ID NO: 1627661 - protein, 6 aa, Staphylococcus aureus
QSRQQF

SEQ ID NO: 1627662 - protein, 4 aa, Staphylococcus aureus
QTAI

SEQ ID NO: 1627663 - protein, 8 aa, Staphylococcus aureus
QTTDGFEL

SEQ ID NO: 1627664 - protein, 7 aa, Staphylococcus aureus
QTTQGAY

SEQ ID NO: 1627665 - protein, 6 aa, Staphylococcus aureus
QVESDW

SEQ ID NO: 1627666 - protein, 7 aa, Staphylococcus aureus
QVPPQNH

SEQ ID NO: 1627667 - protein, 9 aa, Staphylococcus aureus
QYGKETDGY

SEQ ID NO: 1627668 - protein, 6 aa, Staphylococcus aureus
QYNVDG

SEQ ID NO: 1627669 - protein, 9 aa, Staphylococcus aureus
QYQSDASFT

SEQ ID NO: 1627670 - protein, 7 aa, Staphylococcus aureus
QYSQSLE

SEQ ID NO: 1627671 - protein, 7 aa, Staphylococcus aureus
RAAKVSG

SEQ ID NO: 1627672 - protein, 4 aa, Staphylococcus aureus
RAKT

SEQ ID NO: 1627673 - protein, 14 aa, Staphylococcus aureus
RANQSVTTANGIEV

SEQ ID NO: 1627674 - protein, 8 aa, Staphylococcus aureus
RAQKEKYD

SEQ ID NO: 1627675 - protein, 8 aa, Staphylococcus aureus
RATSEYET

SEQ ID NO: 1627676 - protein, 11 aa, Staphylococcus aureus
RDPLAGKTVTG

SEQ ID NO: 1627677 - protein, 5 aa, Staphylococcus aureus
RDQSL

SEQ ID NO: 1627678 - protein, 83 aa, Staphylococcus aureus; identical to SEQ ID NO: 1572022

SEQ ID NO: 1627679 - protein, 8 aa, Staphylococcus aureus
RDVTDEAS

SEQ ID NO: 1627680 - protein, 6 aa, Staphylococcus aureus
RDWETG

SEQ ID NO: 1627681 - protein, 13 aa, Staphylococcus aureus
REATKNEDSVTGS

SEQ ID NO: 1627682 - protein, 7 aa, Staphylococcus aureus
REATRIG

SEQ ID NO: 1627683 - protein, 4 aa, Staphylococcus aureus
REFS

SEQ ID NO: 1627684 - protein, 9 aa, Staphylococcus aureus
REKEFATGL

SEQ ID NO: 1627685 - protein, 8 aa, Staphylococcus aureus
RENPELSK

SEQ ID NO: 1627686 - protein, 8 aa, Staphylococcus aureus
RFKSNETI

SEQ ID NO: 1627687 - protein, 6 aa, Staphylococcus aureus
RGGFNK

SEQ ID NO: 1627688 - protein, 5 aa, Staphylococcus aureus
RGKIE

SEQ ID NO: 1627689 - protein, 6 aa, Staphylococcus aureus
RGQGIG

SEQ ID NO: 1627690 - protein, 13 aa, Staphylococcus aureus
RISTLNDYDPTGH

SEQ ID NO: 1627691 - protein, 5 aa, Staphylococcus aureus
RKARG

SEQ ID NO: 1627692 - protein, 7 aa, Staphylococcus aureus
RKCTQED

SEQ ID NO: 1627693 - protein, 8 aa, Staphylococcus aureus
RKDENHKK

SEQ ID NO: 1627694 - protein, 5 aa, Staphylococcus aureus
RKDNN

SEQ ID NO: 1627695 - protein, 11 aa, Staphylococcus aureus
RKDSKSKDEVE

SEQ ID NO: 1627696 - protein, 59 aa, Staphylococcus aureus
RKEQNDTTDKDKTSNENSDSTNNSDSSNQQQPATDQNSNQNQGGTQQAPQASNNQNGVV

SEQ ID NO: 1627697 - protein, 19 aa, Staphylococcus aureus
RKGKVHYSKTGAHIVPYID

SEQ ID NO: 1627698 - protein, 7 aa, Staphylococcus aureus
RKKYNNP

SEQ ID NO: 1627699 - protein, 16 aa, Staphylococcus aureus
RKLERKRKKEAELRRK

SEQ ID NO: 1627700 - protein, 9 aa, Staphylococcus aureus
RKNGASKNI

SEQ ID NO: 1627701 - protein, 6 aa, Staphylococcus aureus
RKPVEK

SEQ ID NO: 1627702 - protein, 4 aa, Staphylococcus aureus
RKQP

SEQ ID NO: 1627703 - protein, 22 aa, Staphylococcus aureus
RKQTRKKELKDETVDAHLFLEL

SEQ ID NO: 1627704 - protein, 9 aa, Staphylococcus aureus
RKSRASLQK

SEQ ID NO: 1627705 - protein, 8 aa, Staphylococcus aureus
RLGSDTNL

SEQ ID NO: 1627706 - protein, 9 aa, Staphylococcus aureus
RLKSDPSFY

SEQ ID NO: 1627707 - protein, 4 aa, Staphylococcus aureus
RNEE

SEQ ID NO: 1627708 - protein, 8 aa, Staphylococcus aureus
RNGNAESI

SEQ ID NO: 1627709 - protein, 4 aa, Staphylococcus aureus
RNKL

SEQ ID NO: 1627710 - protein, 10 aa, Staphylococcus aureus
RNSTGNASWG

SEQ ID NO: 1627711 - protein, 9 aa, Staphylococcus aureus
RNTRTTKGE

SEQ ID NO: 1627712 - protein, 7 aa, Staphylococcus aureus
RPHSSSQ

SEQ ID NO: 1627713 - protein, 14 aa, Staphylococcus aureus
RPVVADSGAIGGSH

SEQ ID NO: 1627714 - protein, 71 aa, Staphylococcus aureus; identical to SEQ ID NO: 1562247

SEQ ID NO: 1627715 - protein, 11 aa, Staphylococcus aureus
RQDNQYNGRPL

SEQ ID NO: 1627716 - protein, 5 aa, Staphylococcus aureus
RQNLD

SEQ ID NO: 1627717 - protein, 9 aa, Staphylococcus aureus
RQQTGLHKQ

SEQ ID NO: 1627718 - protein, 12 aa, Staphylococcus aureus
RQRRKEAELRRK

SEQ ID NO: 1627719 - protein, 10 aa, Staphylococcus aureus
RQSPEFGNPD

SEQ ID NO: 1627720 - protein, 6 aa, Staphylococcus aureus
RQTDEY

SEQ ID NO: 1627721 - protein, 6 aa, Staphylococcus aureus
RRDQHD

SEQ ID NO: 1627722 - protein, 12 aa, Staphylococcus aureus
RRKALEKEQALK

SEQ ID NO: 1627723 - protein, 16 aa, Staphylococcus aureus
RRPDVYKRTKPEKQTV

SEQ ID NO: 1627724 - protein, 5 aa, Staphylococcus aureus
RRTQY

SEQ ID NO: 1627725 - protein, 10 aa, Staphylococcus aureus
RSACTTCGDV

SEQ ID NO: 1627726 - protein, 6 aa, Staphylococcus aureus
RSDEQL

SEQ ID NO: 1627727 - protein, 6 aa, Staphylococcus aureus
RSENKY

SEQ ID NO: 1627728 - protein, 19 aa, Staphylococcus aureus
RSEPGKRARQYFIQVEKAW

SEQ ID NO: 1627729 - protein, 9 aa, Staphylococcus aureus
RSKVSQNIL

SEQ ID NO: 1627730 - protein, 14 aa, Staphylococcus aureus
RSSTLKANSKVASI

SEQ ID NO: 1627731 - protein, 5 aa, Staphylococcus aureus
RSTDK

SEQ ID NO: 1627732 - protein, 10 aa, Staphylococcus aureus
RSTETIQSRF

SEQ ID NO: 1627733 - protein, 19 aa, Staphylococcus aureus
RSVSTISREISRNNLNQSY

SEQ ID NO: 1627734 - protein, 5 aa, Staphylococcus aureus
RTHPE

SEQ ID NO: 1627735 - protein, 7 aa, Staphylococcus aureus
RTTNQPL

SEQ ID NO: 1627736 - protein, 7 aa, Staphylococcus aureus
RTTNQSL

SEQ ID NO: 1627737 - protein, 4 aa, Staphylococcus aureus
RTVR

SEQ ID NO: 1627738 - protein, 6 aa, Staphylococcus aureus
RYQVSK

SEQ ID NO: 1627739 - protein, 7 aa, Staphylococcus aureus
RYSTEKV

SEQ ID NO: 1627740 - protein, 10 aa, Staphylococcus aureus
SAGKNRDANL

SEQ ID NO: 1627741 - protein, 5 aa, Staphylococcus aureus
SAHDN

SEQ ID NO: 1627742 - protein, 13 aa, Staphylococcus aureus
SAIKAGYNANSAH

SEQ ID NO: 1627743 - protein, 23 aa, Staphylococcus aureus
SALDNGGVNESKLATEPHNEIKE

SEQ ID NO: 1627744 - protein, 7 aa, Staphylococcus aureus
SANQVKR

SEQ ID NO: 1627745 - protein, 22 aa, Staphylococcus aureus
SAPTKKPTSPTTYTETTTQVPM

SEQ ID NO: 1627746 - protein, 33 aa, Staphylococcus aureus; identical to SEQ ID NO: 1565760

SEQ ID NO: 1627747 - protein, 5 aa, Staphylococcus aureus
SDEEK

SEQ ID NO: 1627748 - protein, 6 aa, Staphylococcus aureus
SDGGSL

SEQ ID NO: 1627749 - protein, 10 aa, Staphylococcus aureus
SDITKTKGLQ

SEQ ID NO: 1627750 - protein, 8 aa, Staphylococcus aureus
SDIVQESS

SEQ ID NO: 1627751 - protein, 23 aa, Staphylococcus aureus
SDLENKAQAYSRTFDEQKRYMDE

SEQ ID NO: 1627752 - protein, 5 aa, Staphylococcus aureus
SDLKE

SEQ ID NO: 1627753 - protein, 5 aa, Staphylococcus aureus
SDLTI

SEQ ID NO: 1627754 - protein, 7 aa, Staphylococcus aureus
SDSKTRN

SEQ ID NO: 1627755 - protein, 7 aa, Staphylococcus aureus
SDTSFNV

SEQ ID NO: 1627756 - protein, 8 aa, Staphylococcus aureus
SEAKANER

SEQ ID NO: 1627757 - protein, 5 aa, Staphylococcus aureus
SEEAR

SEQ ID NO: 1627758 - protein, 16 aa, Staphylococcus aureus
SEEEGTVVAQNGASLS

SEQ ID NO: 1627759 - protein, 7 aa, Staphylococcus aureus
SEEKFGR

SEQ ID NO: 1627760 - protein, 6 aa, Staphylococcus aureus
SEGAYA

SEQ ID NO: 1627761 - protein, 8 aa, Staphylococcus aureus
SEGKYSES

SEQ ID NO: 1627762 - protein, 7 aa, Staphylococcus aureus
SEGLAQE

SEQ ID NO: 1627763 - protein, 5 aa, Staphylococcus aureus
SEHEH

SEQ ID NO: 1627764 - protein, 5 aa, Staphylococcus aureus
SELTK

SEQ ID NO: 1627765 - protein, 22 aa, Staphylococcus aureus
SEMQQQRDRARQARQNSQSMQV

SEQ ID NO: 1627766 - protein, 6 aa, Staphylococcus aureus
SEPYNT

SEQ ID NO: 1627767 - protein, 9 aa, Staphylococcus aureus
SEQEIKGED

SEQ ID NO: 1627768 - protein, 29 aa, Staphylococcus aureus
SERTKKGLESARARGNMGGRKAMPQEKKE

SEQ ID NO: 1627769 - protein, 7 aa, Staphylococcus aureus
SFDSNGI

SEQ ID NO: 1627770 - protein, 8 aa, Staphylococcus aureus
SFEEKDIN

SEQ ID NO: 1627771 - protein, 19 aa, Staphylococcus aureus
SFGQKQEHSAREMTNEEIE

SEQ ID NO: 1627772 - protein, 7 aa, Staphylococcus aureus
SFGTGKS

SEQ ID NO: 1627773 - protein, 9 aa, Staphylococcus aureus
SFMPREDQD

SEQ ID NO: 1627774 - protein, 7 aa, Staphylococcus aureus
SFTHENG

SEQ ID NO: 1627775 - protein, 7 aa, Staphylococcus aureus
SGEKVRR

SEQ ID NO: 1627776 - protein, 7 aa, Staphylococcus aureus
SGGERTK

SEQ ID NO: 1627777 - protein, 12 aa, Staphylococcus aureus
SGHRGALPHGVA

SEQ ID NO: 1627778 - protein, 5 aa, Staphylococcus aureus
SGLTT

SEQ ID NO: 1627779 - protein, 6 aa, Staphylococcus aureus
SGMGTS

SEQ ID NO: 1627780 - protein, 4 aa, Staphylococcus aureus
SGMK

SEQ ID NO: 1627781 - protein, 6 aa, Staphylococcus aureus
SGPDME

SEQ ID NO: 1627782 - protein, 7 aa, Staphylococcus aureus
SGPSHAE

SEQ ID NO: 1627783 - protein, 7 aa, Staphylococcus aureus
SGRTEPR

SEQ ID NO: 1627784 - protein, 9 aa, Staphylococcus aureus
SGSNPKYNQ

SEQ ID NO: 1627785 - protein, 6 aa, Staphylococcus aureus
SGWEHK

SEQ ID NO: 1627786 - protein, 14 aa, Staphylococcus aureus
SGYGTSNFANGRYG

SEQ ID NO: 1627787 - protein, 13 aa, Staphylococcus aureus
SGYTSGRNLYTSG

SEQ ID NO: 1627788 - protein, 19 aa, Staphylococcus aureus
SHEPDNAGASKSNLPGNPI

SEQ ID NO: 1627789 - protein, 11 aa, Staphylococcus aureus
SHKEKHTRQIA

SEQ ID NO: 1627790 - protein, 4 aa, Staphylococcus aureus
SIAI

SEQ ID NO: 1627791 - protein, 11 aa, Staphylococcus aureus
SIAKHEKKIES

SEQ ID NO: 1627792 - protein, 34 aa, Staphylococcus aureus; identical to SEQ ID NO: 1565318

SEQ ID NO: 1627793 - protein, 6 aa, Staphylococcus aureus
SIENDE

SEQ ID NO: 1627794 - protein, 21 aa, Staphylococcus aureus
SINNAQKRDLTTKIDQATTVA

SEQ ID NO: 1627795 - protein, 6 aa, Staphylococcus aureus
SINNEE

SEQ ID NO: 1627796 - protein, 8 aa, Staphylococcus aureus
SINRPNVD

SEQ ID NO: 1627797 - protein, 31 aa, Staphylococcus aureus; identical to SEQ ID NO: 1572254

SEQ ID NO: 1627798 - protein, 6 aa, Staphylococcus aureus
SIQTTT

SEQ ID NO: 1627799 - protein, 13 aa, Staphylococcus aureus
SIRSYNASGVEDI

SEQ ID NO: 1627800 - protein, 5 aa, Staphylococcus aureus
SISER

SEQ ID NO: 1627801 - protein, 8 aa, Staphylococcus aureus
SISPEYNA

SEQ ID NO: 1627802 - protein, 8 aa, Staphylococcus aureus
SITTTPEA

SEQ ID NO: 1627803 - protein, 4 aa, Staphylococcus aureus
SKEK

SEQ ID NO: 1627804 - protein, 5 aa, Staphylococcus aureus
SKETG

SEQ ID NO: 1627805 - protein, 24 aa, Staphylococcus aureus
SKGSLAGVDGRLQTRNYENKDGQR

SEQ ID NO: 1627806 - protein, 14 aa, Staphylococcus aureus
SKINDQSKSIQDVD

SEQ ID NO: 1627807 - protein, 9 aa, Staphylococcus aureus
SKKTYDKSR

SEQ ID NO: 1627808 - protein, 4 aa, Staphylococcus aureus
SKLK

SEQ ID NO: 1627809 - protein, 8 aa, Staphylococcus aureus
SKPSMSAG

SEQ ID NO: 1627810 - protein, 13 aa, Staphylococcus aureus
SKQSKNENIRETA

SEQ ID NO: 1627811 - protein, 7 aa, Staphylococcus aureus
SKRDMAD

SEQ ID NO: 1627812 - protein, 32 aa, Staphylococcus aureus
SKRIDDKERDKFNQHQETIAGHANKDEFTPEE

SEQ ID NO: 1627813 - protein, 6 aa, Staphylococcus aureus
SKSKYL

SEQ ID NO: 1627814 - protein, 11 aa, Staphylococcus aureus
SKSVSSKNLEN

SEQ ID NO: 1627815 - protein, 6 aa, Staphylococcus aureus
SKYREN

SEQ ID NO: 1627816 - protein, 7 aa, Staphylococcus aureus
SKYTRSK

SEQ ID NO: 1627817 - protein, 6 aa, Staphylococcus aureus
SLDDGF

SEQ ID NO: 1627818 - protein, 9 aa, Staphylococcus aureus
SLEDAKARV

SEQ ID NO: 1627819 - protein, 7 aa, Staphylococcus aureus
SLGATEE

SEQ ID NO: 1627820 - protein, 7 aa, Staphylococcus aureus
SLGEQKR

SEQ ID NO: 1627821 - protein, 14 aa, Staphylococcus aureus
SLKDSKNPDRRVAQ

SEQ ID NO: 1627822 - protein, 5 aa, Staphylococcus aureus
SLKQG

SEQ ID NO: 1627823 - protein, 8 aa, Staphylococcus aureus
SLNDDNYE

SEQ ID NO: 1627824 - protein, 5 aa, Staphylococcus aureus
SLRET

SEQ ID NO: 1627825 - protein, 4 aa, Staphylococcus aureus
SLTD

SEQ ID NO: 1627826 - protein, 7 aa, Staphylococcus aureus
SLTLNDN

SEQ ID NO: 1627827 - protein, 9 aa, Staphylococcus aureus
SMDNKEVKR

SEQ ID NO: 1627828 - protein, 14 aa, Staphylococcus aureus
SNGLHKDVSQRSNY

SEQ ID NO: 1627829 - protein, 9 aa, Staphylococcus aureus
SNGSNYTKE

SEQ ID NO: 1627830 - protein, 4 aa, Staphylococcus aureus
SNIQ

SEQ ID NO: 1627831 - protein, 7 aa, Staphylococcus aureus
SNISQRI

SEQ ID NO: 1627832 - protein, 5 aa, Staphylococcus aureus
SNKKI

SEQ ID NO: 1627833 - protein, 9 aa, Staphylococcus aureus
SNNPYPPNL

SEQ ID NO: 1627834 - protein, 17 aa, Staphylococcus aureus
SNNSVKIDTPFKDNSLD

SEQ ID NO: 1627835 - protein, 19 aa, Staphylococcus aureus
SNRPKQSHLTKKERLADEN

SEQ ID NO: 1627836 - protein, 15 aa, Staphylococcus aureus
SNSGFKRKSDAKHHA

SEQ ID NO: 1627837 - protein, 6 aa, Staphylococcus aureus
SNYREN

SEQ ID NO: 1627838 - protein, 8 aa, Staphylococcus aureus
SPAQIEAY

SEQ ID NO: 1627839 - protein, 8 aa, Staphylococcus aureus
SPEIDGKQ

SEQ ID NO: 1627840 - protein, 7 aa, Staphylococcus aureus
SPETQFE

SEQ ID NO: 1627841 - protein, 13 aa, Staphylococcus aureus
SPFGSSSPLNDTH

SEQ ID NO: 1627842 - protein, 9 aa, Staphylococcus aureus
SPGGHNENT

SEQ ID NO: 1627843 - protein, 7 aa, Staphylococcus aureus
SPKVATY

SEQ ID NO: 1627844 - protein, 12 aa, Staphylococcus aureus
SPVQGSEQGGVR

SEQ ID NO: 1627845 - protein, 6 aa, Staphylococcus aureus
SPYPGA

SEQ ID NO: 1627846 - protein, 8 aa, Staphylococcus aureus
SQATEQRS

SEQ ID NO: 1627847 - protein, 6 aa, Staphylococcus aureus
SQEQVD

SEQ ID NO: 1627848 - protein, 4 aa, Staphylococcus aureus
SQKD

SEQ ID NO: 1627849 - protein, 9 aa, Staphylococcus aureus
SRIRKETIA

SEQ ID NO: 1627850 - protein, 5 aa, Staphylococcus aureus
SRKHG

SEQ ID NO: 1627851 - protein, 12 aa, Staphylococcus aureus
SRSFQGGEQKPL

SEQ ID NO: 1627852 - protein, 7 aa, Staphylococcus aureus
SRSSLRE

SEQ ID NO: 1627853 - protein, 15 aa, Staphylococcus aureus
SRTISASQAAGYNFI

SEQ ID NO: 1627854 - protein, 8 aa, Staphylococcus aureus
SRVTTLSS

SEQ ID NO: 1627855 - protein, 25 aa, Staphylococcus aureus
SSAGRIAARARGRYGGRPEKLNKKD

SEQ ID NO: 1627856 - protein, 5 aa, Staphylococcus aureus
SSDFG

SEQ ID NO: 1627857 - protein, 11 aa, Staphylococcus aureus
SSDKYETAKDT

SEQ ID NO: 1627858 - protein, 4 aa, Staphylococcus aureus
SSEM

SEQ ID NO: 1627859 - protein, 42 aa, Staphylococcus aureus
SSFENSVTAPAGNQGHGLDKSEFDKKAEINFKDGSKATMKTG

SEQ ID NO: 1627860 - protein, 8 aa, Staphylococcus aureus
SSHAASEE

SEQ ID NO: 1627861 - protein, 8 aa, Staphylococcus aureus
SSHGINNI

SEQ ID NO: 1627862 - protein, 5 aa, Staphylococcus aureus
SSKSA

SEQ ID NO: 1627863 - protein, 5 aa, Staphylococcus aureus
SSLKM

SEQ ID NO: 1627864 - protein, 7 aa, Staphylococcus aureus
SSNDISK

SEQ ID NO: 1627865 - protein, 5 aa, Staphylococcus aureus
SSPEM

SEQ ID NO: 1627866 - protein, 13 aa, Staphylococcus aureus
SSPHRKDAYRANE

SEQ ID NO: 1627867 - protein, 10 aa, Staphylococcus aureus
SSQIEQQEKL

SEQ ID NO: 1627868 - protein, 10 aa, Staphylococcus aureus
SSTHRGPSEL

SEQ ID NO: 1627869 - protein, 20 aa, Staphylococcus aureus
STISTNRVNYSDNESIRIEV

SEQ ID NO: 1627870 - protein, 7 aa, Staphylococcus aureus
STKNLSD

SEQ ID NO: 1627871 - protein, 6 aa, Staphylococcus aureus
STPLTQ

SEQ ID NO: 1627872 - protein, 6 aa, Staphylococcus aureus
STSALD

SEQ ID NO: 1627873 - protein, 7 aa, Staphylococcus aureus
STYNENE

SEQ ID NO: 1627874 - protein, 10 aa, Staphylococcus aureus
SVNKSTGNQY

SEQ ID NO: 1627875 - protein, 9 aa, Staphylococcus aureus
SVNSNGSVR

SEQ ID NO: 1627876 - protein, 4 aa, Staphylococcus aureus
SVRG

SEQ ID NO: 1627877 - protein, 10 aa, Staphylococcus aureus
SVSDDRGRTV

SEQ ID NO: 1627878 - protein, 7 aa, Staphylococcus aureus
SYDSNLS

SEQ ID NO: 1627879 - protein, 5 aa, Staphylococcus aureus
SYEHT

SEQ ID NO: 1627880 - protein, 6 aa, Staphylococcus aureus
SYEVTK

SEQ ID NO: 1627881 - protein, 10 aa, Staphylococcus aureus
SYGEYPSTSL

SEQ ID NO: 1627882 - protein, 5 aa, Staphylococcus aureus
SYIKN

SEQ ID NO: 1627883 - protein, 13 aa, Staphylococcus aureus
SYKNSIRKQPHEN

SEQ ID NO: 1627884 - protein, 6 aa, Staphylococcus aureus
SYNPEK

SEQ ID NO: 1627885 - protein, 14 aa, Staphylococcus aureus
SYQDEEDEEDEEAD

SEQ ID NO: 1627886 - protein, 4 aa, Staphylococcus aureus
SYQS

SEQ ID NO: 1627887 - protein, 10 aa, Staphylococcus aureus
TAGASGGVTY

SEQ ID NO: 1627888 - protein, 21 aa, Staphylococcus aureus
TAGGGGKGIRVARDEKELETG

SEQ ID NO: 1627889 - protein, 17 aa, Staphylococcus aureus
TAIPQPKVDSSSVTPGE

SEQ ID NO: 1627890 - protein, 5 aa, Staphylococcus aureus
TASEV

SEQ ID NO: 1627891 - protein, 6 aa, Staphylococcus aureus
TASNTN

SEQ ID NO: 1627892 - protein, 19 aa, Staphylococcus aureus
TCHGDGAKPGTSKKTCSYC

SEQ ID NO: 1627893 - protein, 4 aa, Staphylococcus aureus
TDAK

SEQ ID NO: 1627894 - protein, 9 aa, Staphylococcus aureus
TDDRKLRES

SEQ ID NO: 1627895 - protein, 8 aa, Staphylococcus aureus
TDEESDWK

SEQ ID NO: 1627896 - protein, 7 aa, Staphylococcus aureus
TDGDVEA

SEQ ID NO: 1627897 - protein, 10 aa, Staphylococcus aureus
TDHGSDFTSN

SEQ ID NO: 1627898 - protein, 21 aa, Staphylococcus aureus
TDIDREKEKQIAKMEKRARDI

SEQ ID NO: 1627899 - protein, 10 aa, Staphylococcus aureus
TDKELSETTL

SEQ ID NO: 1627900 - protein, 4 aa, Staphylococcus aureus
TDKI

SEQ ID NO: 1627901 - protein, 13 aa, Staphylococcus aureus
TDKNKATKSPFDD

SEQ ID NO: 1627902 - protein, 15 aa, Staphylococcus aureus
TDKNKATKSPFDDLT

SEQ ID NO: 1627903 - protein, 7 aa, Staphylococcus aureus
TDLASDD

SEQ ID NO: 1627904 - protein, 11 aa, Staphylococcus aureus
TDRFDDNDKEH

SEQ ID NO: 1627905 - protein, 5 aa, Staphylococcus aureus
TDTKT

SEQ ID NO: 1627906 - protein, 5 aa, Staphylococcus aureus
TDYEL

SEQ ID NO: 1627907 - protein, 5 aa, Staphylococcus aureus
TDYRN

SEQ ID NO: 1627908 - protein, 4 aa, Staphylococcus aureus
TEAE

SEQ ID NO: 1627909 - protein, 8 aa, Staphylococcus aureus
TEEDIRED

SEQ ID NO: 1627910 - protein, 4 aa, Staphylococcus aureus
TEEG

SEQ ID NO: 1627911 - protein, 6 aa, Staphylococcus aureus
TEGAEV

SEQ ID NO: 1627912 - protein, 8 aa, Staphylococcus aureus
TEGRNRQV

SEQ ID NO: 1627913 - protein, 6 aa, Staphylococcus aureus
TEITEV

SEQ ID NO: 1627914 - protein, 7 aa, Staphylococcus aureus
TEKPEEE

SEQ ID NO: 1627915 - protein, 11 aa, Staphylococcus aureus
TENAIKKEQVE

SEQ ID NO: 1627916 - protein, 9 aa, Staphylococcus aureus
TENATTARR

SEQ ID NO: 1627917 - protein, 8 aa, Staphylococcus aureus
TEQKSRHT

SEQ ID NO: 1627918 - protein, 6 aa, Staphylococcus aureus
TESEQW

SEQ ID NO: 1627919 - protein, 5 aa, Staphylococcus aureus
TEYGN

SEQ ID NO: 1627920 - protein, 9 aa, Staphylococcus aureus
TGATRPGSM

SEQ ID NO: 1627921 - protein, 15 aa, Staphylococcus aureus
TGDPSKVGHLPGATN

SEQ ID NO: 1627922 - protein, 8 aa, Staphylococcus aureus
TGEDGEHA

SEQ ID NO: 1627923 - protein, 6 aa, Staphylococcus aureus
TGGTPF

SEQ ID NO: 1627924 - protein, 12 aa, Staphylococcus aureus
TGIKQSKHIGGF

SEQ ID NO: 1627925 - protein, 30 aa, Staphylococcus aureus
TGMIGDPSGKSEERVLQTEEQVDKNIEGIS

SEQ ID NO: 1627926 - protein, 5 aa, Staphylococcus aureus
TGRQS

SEQ ID NO: 1627927 - protein, 5 aa, Staphylococcus aureus
TGSQR

SEQ ID NO: 1627928 - protein, 7 aa, Staphylococcus aureus
THDLTEE

SEQ ID NO: 1627929 - protein, 19 aa, Staphylococcus aureus
THPHYKPSKYLKAVFVNIR

SEQ ID NO: 1627930 - protein, 10 aa, Staphylococcus aureus
THPPGPSKRI

SEQ ID NO: 1627931 - protein, 24 aa, Staphylococcus aureus
THSGSKPTTIKEKKSNTNTVKNAI

SEQ ID NO: 1627932 - protein, 11 aa, Staphylococcus aureus
TIASNDKFNAS

SEQ ID NO: 1627933 - protein, 6 aa, Staphylococcus aureus
TIGSDT

SEQ ID NO: 1627934 - protein, 9 aa, Staphylococcus aureus
TINQKAQTL

SEQ ID NO: 1627935 - protein, 6 aa, Staphylococcus aureus
TINSPT

SEQ ID NO: 1627936 - protein, 7 aa, Staphylococcus aureus
TIPEDRD

SEQ ID NO: 1627937 - protein, 10 aa, Staphylococcus aureus
TIPENQKYGA

SEQ ID NO: 1627938 - protein, 7 aa, Staphylococcus aureus
TITDDNF

SEQ ID NO: 1627939 - protein, 11 aa, Staphylococcus aureus
TKDIKQVQERL

SEQ ID NO: 1627940 - protein, 5 aa, Staphylococcus aureus
TKDPM

SEQ ID NO: 1627941 - protein, 11 aa, Staphylococcus aureus
TKDSKGSSIKD

SEQ ID NO: 1627942 - protein, 10 aa, Staphylococcus aureus
TKDTANKGYE

SEQ ID NO: 1627943 - protein, 32 aa, Staphylococcus aureus
TKDTRTRDTHRHLDGAKKRIDEPFKSSGCIGQ

SEQ ID NO: 1627944 - protein, 6 aa, Staphylococcus aureus
TKEDLP

SEQ ID NO: 1627945 - protein, 16 aa, Staphylococcus aureus
TKEEAAQHFKNQDAAT

SEQ ID NO: 1627946 - protein, 8 aa, Staphylococcus aureus
TKEITQNK

SEQ ID NO: 1627947 - protein, 52 aa, Staphylococcus aureus
TKELPNSQFQNNESGSSRTVNLSGQELPNSQSNDTELNNTNYIENEDNDTYD

SEQ ID NO: 1627948 - protein, 15 aa, Staphylococcus aureus
TKESDYGLRIHVEYK

SEQ ID NO: 1627949 - protein, 10 aa, Staphylococcus aureus
TKSTPEGARD

SEQ ID NO: 1627950 - protein, 6 aa, Staphylococcus aureus
TKVKNG

SEQ ID NO: 1627951 - protein, 7 aa, Staphylococcus aureus
TKYGTVN

SEQ ID NO: 1627952 - protein, 7 aa, Staphylococcus aureus
TLDETDD

SEQ ID NO: 1627953 - protein, 15 aa, Staphylococcus aureus
TLDEYRKNIEKDAAL

SEQ ID NO: 1627954 - protein, 14 aa, Staphylococcus aureus
TLDTGKTLEESYAD

SEQ ID NO: 1627955 - protein, 26 aa, Staphylococcus aureus
TLETPKEDGVDDGSEVSATTNTLGKS

SEQ ID NO: 1627956 - protein, 5 aa, Staphylococcus aureus
TLPAQ

SEQ ID NO: 1627957 - protein, 13 aa, Staphylococcus aureus
TLPERARKLTEDD

SEQ ID NO: 1627958 - protein, 13 aa, Staphylococcus aureus
TLTKKGWSRMDSK

SEQ ID NO: 1627959 - protein, 6 aa, Staphylococcus aureus
TLYENN

SEQ ID NO: 1627960 - protein, 6 aa, Staphylococcus aureus
TMKSTD

SEQ ID NO: 1627961 - protein, 7 aa, Staphylococcus aureus
TNAGKSS

SEQ ID NO: 1627962 - protein, 6 aa, Staphylococcus aureus
TNEAQQ

SEQ ID NO: 1627963 - protein, 4 aa, Staphylococcus aureus
TNGP

SEQ ID NO: 1627964 - protein, 5 aa, Staphylococcus aureus
TNHPA

SEQ ID NO: 1627965 - protein, 4 aa, Staphylococcus aureus
TNPS

SEQ ID NO: 1627966 - protein, 4 aa, Staphylococcus aureus
TNQR

SEQ ID NO: 1627967 - protein, 6 aa, Staphylococcus aureus
TNQTGH

SEQ ID NO: 1627968 - protein, 40 aa, Staphylococcus aureus
TNTDDHQAKTKSAQQGKVNKAKQQAKTLPDTGMSHNDDLP

SEQ ID NO: 1627969 - protein, 8 aa, Staphylococcus aureus
TNTSISPY

SEQ ID NO: 1627970 - protein, 9 aa, Staphylococcus aureus
TNYPSDRQE

SEQ ID NO: 1627971 - protein, 4 aa, Staphylococcus aureus
TPKK

SEQ ID NO: 1627972 - protein, 10 aa, Staphylococcus aureus
TPKTESSIGK

SEQ ID NO: 1627973 - protein, 9 aa, Staphylococcus aureus
TPLAESGIG

SEQ ID NO: 1627974 - protein, 6 aa, Staphylococcus aureus
TPTMTS

SEQ ID NO: 1627975 - protein, 5 aa, Staphylococcus aureus
TQETA

SEQ ID NO: 1627976 - protein, 5 aa, Staphylococcus aureus
TQKGI

SEQ ID NO: 1627977 - protein, 9 aa, Staphylococcus aureus
TQKPIGETL

SEQ ID NO: 1627978 - protein, 10 aa, Staphylococcus aureus
TQNLTNENYN

SEQ ID NO: 1627979 - protein, 4 aa, Staphylococcus aureus
TQTV

SEQ ID NO: 1627980 - protein, 9 aa, Staphylococcus aureus
TRALTTKYD

SEQ ID NO: 1627981 - protein, 29 aa, Staphylococcus aureus
TRGLGAGANPEIGKKAAEESREQIEDAIQ

SEQ ID NO: 1627982 - protein, 8 aa, Staphylococcus aureus
TRQDADTI

SEQ ID NO: 1627983 - protein, 7 aa, Staphylococcus aureus
TRRDSEY

SEQ ID NO: 1627984 - protein, 5 aa, Staphylococcus aureus
TSDKS

SEQ ID NO: 1627985 - protein, 5 aa, Staphylococcus aureus
TSDSA

SEQ ID NO: 1627986 - protein, 9 aa, Staphylococcus aureus
TSGTQPMQG

SEQ ID NO: 1627987 - protein, 33 aa, Staphylococcus aureus
TSITHSDGHTSISKTPKVTGKGQQYFVNKFLGE

SEQ ID NO: 1627988 - protein, 6 aa, Staphylococcus aureus
TSKFND

SEQ ID NO: 1627989 - protein, 8 aa, Staphylococcus aureus
TSKSKHNA

SEQ ID NO: 1627990 - protein, 9 aa, Staphylococcus aureus
TSLATPKVS

SEQ ID NO: 1627991 - protein, 10 aa, Staphylococcus aureus
TSLQSAKNTS

SEQ ID NO: 1627992 - protein, 13 aa, Staphylococcus aureus
TSNGVSPRPIPGI

SEQ ID NO: 1627993 - protein, 8 aa, Staphylococcus aureus
TSRPSYIS

SEQ ID NO: 1627994 - protein, 4 aa, Staphylococcus aureus
TSSG

SEQ ID NO: 1627995 - protein, 8 aa, Staphylococcus aureus
TTANNGRY

SEQ ID NO: 1627996 - protein, 20 aa, Staphylococcus aureus
TTEPIDARSTTYSTDVAKGY

SEQ ID NO: 1627997 - protein, 24 aa, Staphylococcus aureus
TTIQERTAMGRRASARKGLAKTVP

SEQ ID NO: 1627998 - protein, 10 aa, Staphylococcus aureus
TTKKGNHGEP

SEQ ID NO: 1627999 - protein, 8 aa, Staphylococcus aureus
TTTNPSKI

SEQ ID NO: 1628000 - protein, 10 aa, Staphylococcus aureus
TVDESYLSKG

SEQ ID NO: 1628001 - protein, 11 aa, Staphylococcus aureus
TVKGPDDYKSM

SEQ ID NO: 1628002 - protein, 18 aa, Staphylococcus aureus
TVKGPEYPTMENKTLQGE

SEQ ID NO: 1628003 - protein, 6 aa, Staphylococcus aureus
TVKNKL

SEQ ID NO: 1628004 - protein, 10 aa, Staphylococcus aureus
TVKPKANQAI

SEQ ID NO: 1628005 - protein, 4 aa, Staphylococcus aureus
TYAI

SEQ ID NO: 1628006 - protein, 28 aa, Staphylococcus aureus
TYAYGPRSESFSGNIENTESAKIIFDIF

SEQ ID NO: 1628007 - protein, 4 aa, Staphylococcus aureus
TYEE

SEQ ID NO: 1628008 - protein, 12 aa, Staphylococcus aureus
TYETENESIITD

SEQ ID NO: 1628009 - protein, 15 aa, Staphylococcus aureus
TYKDQKRRRRGKSKF

SEQ ID NO: 1628010 - protein, 4 aa, Staphylococcus aureus
VAED

SEQ ID NO: 1628011 - protein, 15 aa, Staphylococcus aureus
VAHARGKVLGGSSSI

SEQ ID NO: 1628012 - protein, 7 aa, Staphylococcus aureus
VAPSPIS

SEQ ID NO: 1628013 - protein, 8 aa, Staphylococcus aureus
VAQAGKSL

SEQ ID NO: 1628014 - protein, 5 aa, Staphylococcus aureus
VDDDS

SEQ ID NO: 1628015 - protein, 16 aa, Staphylococcus aureus
VDDYPKDVKKGKKQFD

SEQ ID NO: 1628016 - protein, 4 aa, Staphylococcus aureus
VDED

SEQ ID NO: 1628017 - protein, 4 aa, Staphylococcus aureus
VDNT

SEQ ID NO: 1628018 - protein, 4 aa, Staphylococcus aureus
VDVS

SEQ ID NO: 1628019 - protein, 12 aa, Staphylococcus aureus
VEATTQIKKDLP

SEQ ID NO: 1628020 - protein, 24 aa, Staphylococcus aureus
VEDGNLINTSDEDKTTDEEEKAHS

SEQ ID NO: 1628021 - protein, 15 aa, Staphylococcus aureus
VEETANNALNQAKQY

SEQ ID NO: 1628022 - protein, 15 aa, Staphylococcus aureus
VEKAGAAHTWIENLG

SEQ ID NO: 1628023 - protein, 7 aa, Staphylococcus aureus
VEKPQSY

SEQ ID NO: 1628024 - protein, 5 aa, Staphylococcus aureus
VELSK

SEQ ID NO: 1628025 - protein, 7 aa, Staphylococcus aureus
VENSKKY

SEQ ID NO: 1628026 - protein, 9 aa, Staphylococcus aureus
VEQDDMKKN

SEQ ID NO: 1628027 - protein, 12 aa, Staphylococcus aureus
VEQITNDTSRQL

SEQ ID NO: 1628028 - protein, 14 aa, Staphylococcus aureus
VETQRSKDNVEEVD

SEQ ID NO: 1628029 - protein, 7 aa, Staphylococcus aureus
VFDDESE

SEQ ID NO: 1628030 - protein, 4 aa, Staphylococcus aureus
VGAD

SEQ ID NO: 1628031 - protein, 5 aa, Staphylococcus aureus
VGERL

SEQ ID NO: 1628032 - protein, 10 aa, Staphylococcus aureus
VGESVKANQP

SEQ ID NO: 1628033 - protein, 4 aa, Staphylococcus aureus
VGEY

SEQ ID NO: 1628034 - protein, 12 aa, Staphylococcus aureus
VGGAPTQKLTES

SEQ ID NO: 1628035 - protein, 29 aa, Staphylococcus aureus
VGGITKTNSKKVDHKAELSVTKKDNQGMI

SEQ ID NO: 1628036 - protein, 5 aa, Staphylococcus aureus
VGKTY

SEQ ID NO: 1628037 - protein, 5 aa, Staphylococcus aureus
VGPRG

SEQ ID NO: 1628038 - protein, 10 aa, Staphylococcus aureus
VGTARDKGVR

SEQ ID NO: 1628039 - protein, 7 aa, Staphylococcus aureus
VGTGSGI

SEQ ID NO: 1628040 - protein, 21 aa, Staphylococcus aureus
VHVETKDVDGNTSFENEQTSY

SEQ ID NO: 1628041 - protein, 7 aa, Staphylococcus aureus
VKGEDDL

SEQ ID NO: 1628042 - protein, 6 aa, Staphylococcus aureus
VKGGRR

SEQ ID NO: 1628043 - protein, 6 aa, Staphylococcus aureus
VKNVSG

SEQ ID NO: 1628044 - protein, 14 aa, Staphylococcus aureus
VNADATTEEKEAFT

SEQ ID NO: 1628045 - protein, 5 aa, Staphylococcus aureus
VNDHE

SEQ ID NO: 1628046 - protein, 50 aa, Staphylococcus aureus; identical to SEQ ID NO: 1567791

SEQ ID NO: 1628047 - protein, 5 aa, Staphylococcus aureus
VNGDY

SEQ ID NO: 1628048 - protein, 17 aa, Staphylococcus aureus
VNGNQNVKAETKNKVNE

SEQ ID NO: 1628049 - protein, 19 aa, Staphylococcus aureus
VNVKQKGSLADDKELSSID

SEQ ID NO: 1628050 - protein, 10 aa, Staphylococcus aureus
VPGDKGQLAL

SEQ ID NO: 1628051 - protein, 9 aa, Staphylococcus aureus
VPKNSGKWE

SEQ ID NO: 1628052 - protein, 7 aa, Staphylococcus aureus
VPLEDAE

SEQ ID NO: 1628053 - protein, 8 aa, Staphylococcus aureus
VPQGYSVE

SEQ ID NO: 1628054 - protein, 18 aa, Staphylococcus aureus
VPRGTGRVRNMPTAAHTK

SEQ ID NO: 1628055 - protein, 6 aa, Staphylococcus aureus
VPSTAK

SEQ ID NO: 1628056 - protein, 5 aa, Staphylococcus aureus
VPSYS

SEQ ID NO: 1628057 - protein, 4 aa, Staphylococcus aureus
VPTA

SEQ ID NO: 1628058 - protein, 51 aa, Staphylococcus aureus
VQSSKAKERQNIENADKAIKDFQDNKAPHDKSAAYEANSKLPKDLRDKNNR

SEQ ID NO: 1628059 - protein, 6 aa, Staphylococcus aureus
VQSTLQ

SEQ ID NO: 1628060 - protein, 7 aa, Staphylococcus aureus
VQSYQGA

SEQ ID NO: 1628061 - protein, 5 aa, Staphylococcus aureus
VQTFE

SEQ ID NO: 1628062 - protein, 21 aa, Staphylococcus aureus
VRNEYGDAHGKSKKNYRPETR

SEQ ID NO: 1628063 - protein, 6 aa, Staphylococcus aureus
VRRTET

SEQ ID NO: 1628064 - protein, 11 aa, Staphylococcus aureus
VSGGAHNSIND

SEQ ID NO: 1628065 - protein, 11 aa, Staphylococcus aureus
VSSKGRVRTHK

SEQ ID NO: 1628066 - protein, 14 aa, Staphylococcus aureus
VTAAQNTANELNTA

SEQ ID NO: 1628067 - protein, 16 aa, Staphylococcus aureus
VTTHADGTATYGPRVT

SEQ ID NO: 1628068 - protein, 81 aa, Staphylococcus aureus
VTTHANGQVSYGARPTQKKPSKTNAYNVTTHANGQVSYGARPTQKKPSKTNAYNVTTHANGQVSYGARPTYKKPSETNAYN

SEQ ID NO: 1628069 - protein, 6 aa, Staphylococcus aureus
VVKSNY

SEQ ID NO: 1628070 - protein, 13 aa, Staphylococcus aureus
VVSKPKKSSRSEE

SEQ ID NO: 1628071 - protein, 9 aa, Staphylococcus aureus
WAFETSDKS

SEQ ID NO: 1628072 - protein, 8 aa, Staphylococcus aureus
WGATPSAL

SEQ ID NO: 1628073 - protein, 15 aa, Staphylococcus aureus
WKKKGIKTAKEAYNY

SEQ ID NO: 1628074 - protein, 5 aa, Staphylococcus aureus
WRDSE

SEQ ID NO: 1628075 - protein, 5 aa, Staphylococcus aureus
WTQKG

SEQ ID NO: 1628076 - protein, 7 aa, Staphylococcus aureus
YAKKATY

SEQ ID NO: 1628077 - protein, 14 aa, Staphylococcus aureus
YATKGSRAKKIPWS

SEQ ID NO: 1628078 - protein, 8 aa, Staphylococcus aureus
YAYESGGD

SEQ ID NO: 1628079 - protein, 7 aa, Staphylococcus aureus
YDGTESD

SEQ ID NO: 1628080 - protein, 5 aa, Staphylococcus aureus
YDIQK

SEQ ID NO: 1628081 - protein, 10 aa, Staphylococcus aureus
YDSSVKKSTN

SEQ ID NO: 1628082 - protein, 10 aa, Staphylococcus aureus
YENGTTSDKN

SEQ ID NO: 1628083 - protein, 7 aa, Staphylococcus aureus
YEQGGDI

SEQ ID NO: 1628084 - protein, 10 aa, Staphylococcus aureus
YEQSNASPNV

SEQ ID NO: 1628085 - protein, 13 aa, Staphylococcus aureus
YERPQPKDDYYDV

SEQ ID NO: 1628086 - protein, 4 aa, Staphylococcus aureus
YEST

SEQ ID NO: 1628087 - protein, 8 aa, Staphylococcus aureus
YETQEISK

SEQ ID NO: 1628088 - protein, 4 aa, Staphylococcus aureus
YGGL

SEQ ID NO: 1628089 - protein, 8 aa, Staphylococcus aureus
YGKENNSD

SEQ ID NO: 1628090 - protein, 6 aa, Staphylococcus aureus
YHKDKA

SEQ ID NO: 1628091 - protein, 12 aa, Staphylococcus aureus
YIETRGRDRHGI

SEQ ID NO: 1628092 - protein, 4 aa, Staphylococcus aureus
YKAR

SEQ ID NO: 1628093 - protein, 19 aa, Staphylococcus aureus
YKDANGKWHTTKGQAPQPF

SEQ ID NO: 1628094 - protein, 6 aa, Staphylococcus aureus
YKGKNI

SEQ ID NO: 1628095 - protein, 5 aa, Staphylococcus aureus
YKQDR

SEQ ID NO: 1628096 - protein, 7 aa, Staphylococcus aureus
YKSAKGW

SEQ ID NO: 1628097 - protein, 11 aa, Staphylococcus aureus
YKTSEQQAKNA

SEQ ID NO: 1628098 - protein, 4 aa, Staphylococcus aureus
YKYE

SEQ ID NO: 1628099 - protein, 12 aa, Staphylococcus aureus
YLKGEKEDYWFL

SEQ ID NO: 1628100 - protein, 14 aa, Staphylococcus aureus
YLNNRSKAKIPQNV

SEQ ID NO: 1628101 - protein, 5 aa, Staphylococcus aureus
YLPGT

SEQ ID NO: 1628102 - protein, 27 aa, Staphylococcus aureus
YNEKKKEFGKNWEDAQKAGKAVGEDLS

SEQ ID NO: 1628103 - protein, 9 aa, Staphylococcus aureus
YNGKDKDVA

SEQ ID NO: 1628104 - protein, 8 aa, Staphylococcus aureus
YNSDRKES

SEQ ID NO: 1628105 - protein, 12 aa, Staphylococcus aureus
YPASGGQEPESR

SEQ ID NO: 1628106 - protein, 9 aa, Staphylococcus aureus
YPKGTDFAN

SEQ ID NO: 1628107 - protein, 11 aa, Staphylococcus aureus
YPKGTDFANIT

SEQ ID NO: 1628108 - protein, 9 aa, Staphylococcus aureus
YPKLSRKPY

SEQ ID NO: 1628109 - protein, 11 aa, Staphylococcus aureus
YPNDIDKQKGF

SEQ ID NO: 1628110 - protein, 8 aa, Staphylococcus aureus
YPNPNGNK

SEQ ID NO: 1628111 - protein, 6 aa, Staphylococcus aureus
YPWPGY

SEQ ID NO: 1628112 - protein, 8 aa, Staphylococcus aureus
YQDKGYGS

SEQ ID NO: 1628113 - protein, 7 aa, Staphylococcus aureus
YQETGGL

SEQ ID NO: 1628114 - protein, 9 aa, Staphylococcus aureus
YQKGEKRNL

SEQ ID NO: 1628115 - protein, 6 aa, Staphylococcus aureus
YQNAAE

SEQ ID NO: 1628116 - protein, 4 aa, Staphylococcus aureus
YQST

SEQ ID NO: 1628117 - protein, 9 aa, Staphylococcus aureus
YRASTTNKK

SEQ ID NO: 1628118 - protein, 13 aa, Staphylococcus aureus
YRRDSDDATHSHQ

SEQ ID NO: 1628119 - protein, 13 aa, Staphylococcus aureus
YRVPDEERQDETI

SEQ ID NO: 1628120 - protein, 4 aa, Staphylococcus aureus
YSAT

SEQ ID NO: 1628121 - protein, 8 aa, Staphylococcus aureus
YSENEQQD

SEQ ID NO: 1628122 - protein, 16 aa, Staphylococcus aureus
YSESNTTYKDDNDITS

SEQ ID NO: 1628123 - protein, 4 aa, Staphylococcus aureus
YSNF

SEQ ID NO: 1628124 - protein, 7 aa, Staphylococcus aureus
YSSHPNR

SEQ ID NO: 1628125 - protein, 9 aa, Staphylococcus aureus
YSSKTLKES

SEQ ID NO: 1628126 - protein, 11 aa, Staphylococcus aureus
YSTSGQKNTLA

SEQ ID NO: 1628127 - protein, 4 aa, Staphylococcus aureus
YSYT

SEQ ID NO: 1628128 - protein, 4 aa, Staphylococcus aureus
YTPI

SEQ ID NO: 1628129 - protein, 21 aa, Staphylococcus aureus
YTQYQNQYEQEQLEQQRQYEQ

SEQ ID NO: 1628130 - protein, 20 aa, Staphylococcus aureus
YYDSIKRKNNKITKDDSNVE

SEQ ID NO: 1628131 - protein, 7 aa, Staphylococcus aureus
YYKTSQK

SEQ ID NO: 1628132 - protein, 11 aa, Staphylococcus aureus
AAALSGTTYPI

SEQ ID NO: 1628133 - protein, 6 aa, Staphylococcus aureus
AADELG

SEQ ID NO: 1628134 - protein, 4 aa, Staphylococcus aureus
AAEG

SEQ ID NO: 1628135 - protein, 5 aa, Staphylococcus aureus
AAGAD

SEQ ID NO: 1628136 - protein, 15 aa, Staphylococcus aureus
AAGSGDFAGNRADSI

SEQ ID NO: 1628137 - protein, 7 aa, Staphylococcus aureus
AALDGDQ

SEQ ID NO: 1628138 - protein, 7 aa, Staphylococcus aureus
AAQPHLN

SEQ ID NO: 1628139 - protein, 12 aa, Staphylococcus aureus
AARTRGKQGTGL

SEQ ID NO: 1628140 - protein, 7 aa, Staphylococcus aureus
AASEQSS

SEQ ID NO: 1628141 - protein, 16 aa, Staphylococcus aureus
AASPHGTPGDRRLKSN

SEQ ID NO: 1628142 - protein, 4 aa, Staphylococcus aureus
ADIR

SEQ ID NO: 1628143 - protein, 4 aa, Staphylococcus aureus
ADKE

SEQ ID NO: 1628144 - protein, 29 aa, Staphylococcus aureus
ADKTNTLASSKYVNADSTKQNAYTTKVTN

SEQ ID NO: 1628145 - protein, 5 aa, Staphylococcus aureus
ADNAI

SEQ ID NO: 1628146 - protein, 6 aa, Staphylococcus aureus
ADNAIR

SEQ ID NO: 1628147 - protein, 26 aa, Staphylococcus aureus
ADQKKNNISADTNATQDEKQQAIKQV

SEQ ID NO: 1628148 - protein, 8 aa, Staphylococcus aureus
ADQKSAFN

SEQ ID NO: 1628149 - protein, 9 aa, Staphylococcus aureus
ADTKGKPLI

SEQ ID NO: 1628150 - protein, 14 aa, Staphylococcus aureus
ADYGGTLDSFPGEF

SEQ ID NO: 1628151 - protein, 17 aa, Staphylococcus aureus
ADYGGTLDSFPGEFAEA

SEQ ID NO: 1628152 - protein, 16 aa, Staphylococcus aureus
AEEGGENGSAKASYVK

SEQ ID NO: 1628153 - protein, 9 aa, Staphylococcus aureus
AEERTIKGS

SEQ ID NO: 1628154 - protein, 5 aa, Staphylococcus aureus
AEHNG

SEQ ID NO: 1628155 - protein, 4 aa, Staphylococcus aureus
AEKG

SEQ ID NO: 1628156 - protein, 10 aa, Staphylococcus aureus
AEKISGKELR

SEQ ID NO: 1628157 - protein, 10 aa, Staphylococcus aureus
AEKNTKQFTP

SEQ ID NO: 1628158 - protein, 10 aa, Staphylococcus aureus
AEKVNKALDQ

SEQ ID NO: 1628159 - protein, 4 aa, Staphylococcus aureus
AENE

SEQ ID NO: 1628160 - protein, 6 aa, Staphylococcus aureus
AENRAH

SEQ ID NO: 1628161 - protein, 9 aa, Staphylococcus aureus
AESITEPEV

SEQ ID NO: 1628162 - protein, 15 aa, Staphylococcus aureus
AESKEEAKEKYEAQF

SEQ ID NO: 1628163 - protein, 5 aa, Staphylococcus aureus
AESNA

SEQ ID NO: 1628164 - protein, 8 aa, Staphylococcus aureus
AETTQDAM

SEQ ID NO: 1628165 - protein, 17 aa, Staphylococcus aureus
AEYKHTHKHRGTSKGAD

SEQ ID NO: 1628166 - protein, 4 aa, Staphylococcus aureus
AFAP

SEQ ID NO: 1628167 - protein, 15 aa, Staphylococcus aureus
AFKGSDFKELTEEEF

SEQ ID NO: 1628168 - protein, 7 aa, Staphylococcus aureus
AFSTNGD

SEQ ID NO: 1628169 - protein, 7 aa, Staphylococcus aureus
AFTPKTV

SEQ ID NO: 1628170 - protein, 6 aa, Staphylococcus aureus
AGEEQQ

SEQ ID NO: 1628171 - protein, 17 aa, Staphylococcus aureus
AGEGNIEQRRINGRPTI

SEQ ID NO: 1628172 - protein, 9 aa, Staphylococcus aureus
AGEKTKTFH

SEQ ID NO: 1628173 - protein, 6 aa, Staphylococcus aureus
AGFPTK

SEQ ID NO: 1628174 - protein, 23 aa, Staphylococcus aureus
AGGNYTNASPDKQGAYTDAYNAA

SEQ ID NO: 1628175 - protein, 7 aa, Staphylococcus aureus
AGGSTDL

SEQ ID NO: 1628176 - protein, 7 aa, Staphylococcus aureus
AGINPSQ

SEQ ID NO: 1628177 - protein, 8 aa, Staphylococcus aureus
AGNGSDEL

SEQ ID NO: 1628178 - protein, 7 aa, Staphylococcus aureus
AGNQITN

SEQ ID NO: 1628179 - protein, 5 aa, Staphylococcus aureus
AGQAG

SEQ ID NO: 1628180 - protein, 25 aa, Staphylococcus aureus
AHEKKKADEYAKEKAAEAAKEAAKL

SEQ ID NO: 1628181 - protein, 13 aa, Staphylococcus aureus
AHGEYDEVATSTA

SEQ ID NO: 1628182 - protein, 6 aa, Staphylococcus aureus
AIAKAS

SEQ ID NO: 1628183 - protein, 19 aa, Staphylococcus aureus
AIEDDENGLKTYQPKIDED

SEQ ID NO: 1628184 - protein, 10 aa, Staphylococcus aureus
AIKNQKTIYT

SEQ ID NO: 1628185 - protein, 11 aa, Staphylococcus aureus
AIKNQKTVYTK

SEQ ID NO: 1628186 - protein, 19 aa, Staphylococcus aureus
AINGRQIDAPSSKPSADKI

SEQ ID NO: 1628187 - protein, 10 aa, Staphylococcus aureus
AISADPKGVP

SEQ ID NO: 1628188 - protein, 38 aa, Staphylococcus aureus
AKAQKNRQKPQNKTNFEKSKQIKPKQYNQTKNHQQQKK

SEQ ID NO: 1628189 - protein, 7 aa, Staphylococcus aureus
AKASLSK

SEQ ID NO: 1628190 - protein, 13 aa, Staphylococcus aureus
AKAYGTDNAKVYD

SEQ ID NO: 1628191 - protein, 7 aa, Staphylococcus aureus
AKDAREN

SEQ ID NO: 1628192 - protein, 14 aa, Staphylococcus aureus
AKDELATKANEQKA

SEQ ID NO: 1628193 - protein, 14 aa, Staphylococcus aureus
AKEAGIYEALLTVN

SEQ ID NO: 1628194 - protein, 12 aa, Staphylococcus aureus
AKEGIEVSTDKS

SEQ ID NO: 1628195 - protein, 4 aa, Staphylococcus aureus
AKEH

SEQ ID NO: 1628196 - protein, 4 aa, Staphylococcus aureus
AKGE

SEQ ID NO: 1628197 - protein, 8 aa, Staphylococcus aureus
AKGEMSTK

SEQ ID NO: 1628198 - protein, 5 aa, Staphylococcus aureus
AKGVD

SEQ ID NO: 1628199 - protein, 34 aa, Staphylococcus aureus
AKHGKNLKKVEAAAIKATAEKFEREKAKGLKPRA

SEQ ID NO: 1628200 - protein, 5 aa, Staphylococcus aureus
AKKFT

SEQ ID NO: 1628201 - protein, 7 aa, Staphylococcus aureus
AKKNQDF

SEQ ID NO: 1628202 - protein, 11 aa, Staphylococcus aureus
AKKPYKESKPL

SEQ ID NO: 1628203 - protein, 17 aa, Staphylococcus aureus
AKMNKDQKDEYEREQME

SEQ ID NO: 1628204 - protein, 8 aa, Staphylococcus aureus
AKNKDNPV

SEQ ID NO: 1628205 - protein, 9 aa, Staphylococcus aureus
AKNNNRQDM

SEQ ID NO: 1628206 - protein, 14 aa, Staphylococcus aureus
AKSEKGRPGRYEKS

SEQ ID NO: 1628207 - protein, 12 aa, Staphylococcus aureus
AKSNKADELSNE

SEQ ID NO: 1628208 - protein, 11 aa, Staphylococcus aureus
AKSNKPGEIDD

SEQ ID NO: 1628209 - protein, 7 aa, Staphylococcus aureus
AKTPFNQ

SEQ ID NO: 1628210 - protein, 16 aa, Staphylococcus aureus
AKYKNYPKETNEKRIK

SEQ ID NO: 1628211 - protein, 9 aa, Staphylococcus aureus
ALESSNANG

SEQ ID NO: 1628212 - protein, 14 aa, Staphylococcus aureus
ALGTSPRMTFIKQK

SEQ ID NO: 1628213 - protein, 23 aa, Staphylococcus aureus
ALKKEPRANTQAAERILQDLRSQ

SEQ ID NO: 1628214 - protein, 9 aa, Staphylococcus aureus
ALKSDPTLS

SEQ ID NO: 1628215 - protein, 7 aa, Staphylococcus aureus
ALRNTNY

SEQ ID NO: 1628216 - protein, 4 aa, Staphylococcus aureus
ANAS

SEQ ID NO: 1628217 - protein, 12 aa, Staphylococcus aureus
ANKEKSKYNEPL

SEQ ID NO: 1628218 - protein, 4 aa, Staphylococcus aureus
ANNH

SEQ ID NO: 1628219 - protein, 6 aa, Staphylococcus aureus
ANPNII

SEQ ID NO: 1628220 - protein, 9 aa, Staphylococcus aureus
ANPSDTFKD

SEQ ID NO: 1628221 - protein, 42 aa, Staphylococcus aureus; identical to SEQ ID NO: 1567319

SEQ ID NO: 1628222 - protein, 8 aa, Staphylococcus aureus
ANSYRQKI

SEQ ID NO: 1628223 - protein, 20 aa, Staphylococcus aureus
ANVEESENTDNINSQDTSYI

SEQ ID NO: 1628224 - protein, 14 aa, Staphylococcus aureus
APADIPAVNKIMTE

SEQ ID NO: 1628225 - protein, 10 aa, Staphylococcus aureus
APAEKQTRLS

SEQ ID NO: 1628226 - protein, 10 aa, Staphylococcus aureus
APDRNRVDGY

SEQ ID NO: 1628227 - protein, 6 aa, Staphylococcus aureus
APDYAE

SEQ ID NO: 1628228 - protein, 6 aa, Staphylococcus aureus
APEKNR

SEQ ID NO: 1628229 - protein, 5 aa, Staphylococcus aureus
APGGS

SEQ ID NO: 1628230 - protein, 8 aa, Staphylococcus aureus
APGHGEDD

SEQ ID NO: 1628231 - protein, 4 aa, Staphylococcus aureus
APGW

SEQ ID NO: 1628232 - protein, 13 aa, Staphylococcus aureus
APIAKQNATKGYG

SEQ ID NO: 1628233 - protein, 8 aa, Staphylococcus aureus
APIKEQAT

SEQ ID NO: 1628234 - protein, 10 aa, Staphylococcus aureus
APKNHNHDER

SEQ ID NO: 1628235 - protein, 17 aa, Staphylococcus aureus
APMGSPRPRFSTKGRYA

SEQ ID NO: 1628236 - protein, 15 aa, Staphylococcus aureus
APQNEYKRKKNQSMI

SEQ ID NO: 1628237 - protein, 10 aa, Staphylococcus aureus
APQPNQATTK

SEQ ID NO: 1628238 - protein, 9 aa, Staphylococcus aureus
APSKPEKLK

SEQ ID NO: 1628239 - protein, 6 aa, Staphylococcus aureus
APTTYT

SEQ ID NO: 1628240 - protein, 15 aa, Staphylococcus aureus
AQDEDTKTDTPVNRL

SEQ ID NO: 1628241 - protein, 5 aa, Staphylococcus aureus
AQELE

SEQ ID NO: 1628242 - protein, 8 aa, Staphylococcus aureus
AQIRSGSN

SEQ ID NO: 1628243 - protein, 11 aa, Staphylococcus aureus
AQITNANYKRH

SEQ ID NO: 1628244 - protein, 7 aa, Staphylococcus aureus
AQKVPNK

SEQ ID NO: 1628245 - protein, 11 aa, Staphylococcus aureus
AQTQQKGYGTN

SEQ ID NO: 1628246 - protein, 8 aa, Staphylococcus aureus
ARGKKRID

SEQ ID NO: 1628247 - protein, 4 aa, Staphylococcus aureus
ARNI

SEQ ID NO: 1628248 - protein, 9 aa, Staphylococcus aureus
ARNPKGQAV

SEQ ID NO: 1628249 - protein, 12 aa, Staphylococcus aureus
ARPSGQNGPTMR

SEQ ID NO: 1628250 - protein, 13 aa, Staphylococcus aureus
ARRQPEEKRQNIR

SEQ ID NO: 1628251 - protein, 12 aa, Staphylococcus aureus
ARTRTKKGKAVF

SEQ ID NO: 1628252 - protein, 5 aa, Staphylococcus aureus
ASATG

SEQ ID NO: 1628253 - protein, 8 aa, Staphylococcus aureus
ASDKDGLP

SEQ ID NO: 1628254 - protein, 6 aa, Staphylococcus aureus
ASDKFG

SEQ ID NO: 1628255 - protein, 20 aa, Staphylococcus aureus
ASDRITVDDTATQLSKDLKQ

SEQ ID NO: 1628256 - protein, 5 aa, Staphylococcus aureus
ASDTT

SEQ ID NO: 1628257 - protein, 7 aa, Staphylococcus aureus
ASEWQED

SEQ ID NO: 1628258 - protein, 12 aa, Staphylococcus aureus
ASIADPANAHLK

SEQ ID NO: 1628259 - protein, 6 aa, Staphylococcus aureus
ASIGRT

SEQ ID NO: 1628260 - protein, 8 aa, Staphylococcus aureus
ASITGTIE

SEQ ID NO: 1628261 - protein, 13 aa, Staphylococcus aureus
ASKLNFEPKEGDE

SEQ ID NO: 1628262 - protein, 11 aa, Staphylococcus aureus
ASKVDRTQHYS

SEQ ID NO: 1628263 - protein, 12 aa, Staphylococcus aureus
ASPKVGQPAPKV

SEQ ID NO: 1628264 - protein, 6 aa, Staphylococcus aureus
ASQGEI

SEQ ID NO: 1628265 - protein, 22 aa, Staphylococcus aureus
ASQTGTFRGRNSNFNGEGFSRQ

SEQ ID NO: 1628266 - protein, 4 aa, Staphylococcus aureus
ASRG

SEQ ID NO: 1628267 - protein, 4 aa, Staphylococcus aureus
ASSD

SEQ ID NO: 1628268 - protein, 9 aa, Staphylococcus aureus
ASTVEAQEK

SEQ ID NO: 1628269 - protein, 7 aa, Staphylococcus aureus
ASYPPET

SEQ ID NO: 1628270 - protein, 10 aa, Staphylococcus aureus
ATAENKEELI

SEQ ID NO: 1628271 - protein, 8 aa, Staphylococcus aureus
ATDAPSFK

SEQ ID NO: 1628272 - protein, 14 aa, Staphylococcus aureus
ATDDQCVPSSKGVI

SEQ ID NO: 1628273 - protein, 10 aa, Staphylococcus aureus
ATDIEKTDEA

SEQ ID NO: 1628274 - protein, 12 aa, Staphylococcus aureus
ATFETKINNGSL

SEQ ID NO: 1628275 - protein, 16 aa, Staphylococcus aureus
ATFPDGTKLITVHHPI

SEQ ID NO: 1628276 - protein, 7 aa, Staphylococcus aureus
ATGKAKK

SEQ ID NO: 1628277 - protein, 15 aa, Staphylococcus aureus
ATKTKEEKKQYKQLS

SEQ ID NO: 1628278 - protein, 57 aa, Staphylococcus aureus
ATNKENEEVKSLTEEQGQDKLEDTHSESSTQDANDLAENAEVKKKPRKLSEADFDDD

SEQ ID NO: 1628279 - protein, 5 aa, Staphylococcus aureus
ATPYS

SEQ ID NO: 1628280 - protein, 4 aa, Staphylococcus aureus
ATQQ

SEQ ID NO: 1628281 - protein, 6 aa, Staphylococcus aureus
ATSINK

SEQ ID NO: 1628282 - protein, 6 aa, Staphylococcus aureus
ATTTSW

SEQ ID NO: 1628283 - protein, 7 aa, Staphylococcus aureus
ATVEERN

SEQ ID NO: 1628284 - protein, 21 aa, Staphylococcus aureus
ATVSGLSNKQLESLKATKPAR

SEQ ID NO: 1628285 - protein, 13 aa, Staphylococcus aureus
AVDKYNKDKANAI

SEQ ID NO: 1628286 - protein, 14 aa, Staphylococcus aureus
AVEIGKADTTSNKF

SEQ ID NO: 1628287 - protein, 7 aa, Staphylococcus aureus
AVGGGQY

SEQ ID NO: 1628288 - protein, 8 aa, Staphylococcus aureus
AVNQGHRH

SEQ ID NO: 1628289 - protein, 6 aa, Staphylococcus aureus
AVRSGK

SEQ ID NO: 1628290 - protein, 4 aa, Staphylococcus aureus
AVSE

SEQ ID NO: 1628291 - protein, 15 aa, Staphylococcus aureus
AVSGSGKNGRITKED

SEQ ID NO: 1628292 - protein, 27 aa, Staphylococcus aureus
AVSGSGMKGKKDLAEGINGKAPEAYPH

SEQ ID NO: 1628293 - protein, 10 aa, Staphylococcus aureus
AVSNTGTQLN

SEQ ID NO: 1628294 - protein, 24 aa, Staphylococcus aureus
AVTAAKKALNGEERLNNRKAEALQ

SEQ ID NO: 1628295 - protein, 73 aa, Staphylococcus aureus
AVTDAKNNITAATDDNGVDQAKDAGKNSIQSTQPATAVKSNAKNDVDQAVTTQNQAIDNTTGATTEEKNAAKD

SEQ ID NO: 1628296 - protein, 25 aa, Staphylococcus aureus
AVTTAKDNLHGDQKLARDQQQAVTT

SEQ ID NO: 1628297 - protein, 15 aa, Staphylococcus aureus
CEQTTKNAEKLFNLN

SEQ ID NO: 1628298 - protein, 4 aa, Staphylococcus aureus
CHTN

SEQ ID NO: 1628299 - protein, 4 aa, Staphylococcus aureus
CQKE

SEQ ID NO: 1628300 - protein, 4 aa, Staphylococcus aureus
CSLG

SEQ ID NO: 1628301 - protein, 7 aa, Staphylococcus aureus
CTRTQAS

SEQ ID NO: 1628302 - protein, 22 aa, Staphylococcus aureus
DAEDGNLINTSDEDKTTDEEKK

SEQ ID NO: 1628303 - protein, 23 aa, Staphylococcus aureus
DAEDGNLINTSDEDKTTDEEKKH

SEQ ID NO: 1628304 - protein, 7 aa, Staphylococcus aureus
DAKNGKL

SEQ ID NO: 1628305 - protein, 8 aa, Staphylococcus aureus
DANATNVK

SEQ ID NO: 1628306 - protein, 6 aa, Staphylococcus aureus
DANTSF

SEQ ID NO: 1628307 - protein, 73 aa, Staphylococcus aureus
DAQDDLKEKESQAYADGKISEEEQRAIQDAQAKLEEAKQNAELKARNAEKKANAYTDNKVKESTDAQRRTLTR

SEQ ID NO: 1628308 - protein, 18 aa, Staphylococcus aureus
DAQKQALKGQIDQSPEIA

SEQ ID NO: 1628309 - protein, 7 aa, Staphylococcus aureus
DARNNFS

SEQ ID NO: 1628310 - protein, 6 aa, Staphylococcus aureus
DATIQK

SEQ ID NO: 1628311 - protein, 7 aa, Staphylococcus aureus
DATLNDI

SEQ ID NO: 1628312 - protein, 21 aa, Staphylococcus aureus
DAYRQAATEAGFDASPKSLPV

SEQ ID NO: 1628313 - protein, 9 aa, Staphylococcus aureus
DDDEHKRNI

SEQ ID NO: 1628314 - protein, 17 aa, Staphylococcus aureus
DDDGKPKHVPGVYPEDD

SEQ ID NO: 1628315 - protein, 12 aa, Staphylococcus aureus
DDDNEDKNKKYI

SEQ ID NO: 1628316 - protein, 12 aa, Staphylococcus aureus
DDEGKPKHVPGV

SEQ ID NO: 1628317 - protein, 8 aa, Staphylococcus aureus
DDERASQL

SEQ ID NO: 1628318 - protein, 12 aa, Staphylococcus aureus
DDETFSSAGTLA

SEQ ID NO: 1628319 - protein, 11 aa, Staphylococcus aureus
DDFKNNDKTYK

SEQ ID NO: 1628320 - protein, 12 aa, Staphylococcus aureus
DDFTQQDEYSND

SEQ ID NO: 1628321 - protein, 5 aa, Staphylococcus aureus
DDIEG

SEQ ID NO: 1628322 - protein, 12 aa, Staphylococcus aureus
DDIINQGDIVFY

SEQ ID NO: 1628323 - protein, 14 aa, Staphylococcus aureus
DDITTDSRTAREGS

SEQ ID NO: 1628324 - protein, 10 aa, Staphylococcus aureus
DDLGSASATT

SEQ ID NO: 1628325 - protein, 5 aa, Staphylococcus aureus
DDNAA

SEQ ID NO: 1628326 - protein, 11 aa, Staphylococcus aureus
DDNDVKQASHN

SEQ ID NO: 1628327 - protein, 15 aa, Staphylococcus aureus
DDPIPTTYTDGDERA

SEQ ID NO: 1628328 - protein, 4 aa, Staphylococcus aureus
DDRI

SEQ ID NO: 1628329 - protein, 8 aa, Staphylococcus aureus
DDSLEKID

SEQ ID NO: 1628330 - protein, 9 aa, Staphylococcus aureus
DDSNEKYQT

SEQ ID NO: 1628331 - protein, 4 aa, Staphylococcus aureus
DDTN

SEQ ID NO: 1628332 - protein, 7 aa, Staphylococcus aureus
DDYDPNA

SEQ ID NO: 1628333 - protein, 10 aa, Staphylococcus aureus
DEDDNENDKQ

SEQ ID NO: 1628334 - protein, 6 aa, Staphylococcus aureus
DEDEEI

SEQ ID NO: 1628335 - protein, 16 aa, Staphylococcus aureus
DEDGKLGETENTQPAL

SEQ ID NO: 1628336 - protein, 5 aa, Staphylococcus aureus
DEDND

SEQ ID NO: 1628337 - protein, 13 aa, Staphylococcus aureus
DEETGIKATHEEG

SEQ ID NO: 1628338 - protein, 8 aa, Staphylococcus aureus
DEEVRNEA

SEQ ID NO: 1628339 - protein, 14 aa, Staphylococcus aureus
DEFTASKLERGKRT

SEQ ID NO: 1628340 - protein, 4 aa, Staphylococcus aureus
DEIV

SEQ ID NO: 1628341 - protein, 23 aa, Staphylococcus aureus
DEKAPENMSDKEIEQVKEKEGQR

SEQ ID NO: 1628342 - protein, 17 aa, Staphylococcus aureus
DEKTTQEFSKRLKDEGV

SEQ ID NO: 1628343 - protein, 11 aa, Staphylococcus aureus
DENATQEDYTA

SEQ ID NO: 1628344 - protein, 7 aa, Staphylococcus aureus
DENATQR

SEQ ID NO: 1628345 - protein, 11 aa, Staphylococcus aureus
DENGYNALSSN

SEQ ID NO: 1628346 - protein, 4 aa, Staphylococcus aureus
DEPR

SEQ ID NO: 1628347 - protein, 37 aa, Staphylococcus aureus; identical to SEQ ID NO: 1561135

SEQ ID NO: 1628348 - protein, 4 aa, Staphylococcus aureus
DESE

SEQ ID NO: 1628349 - protein, 21 aa, Staphylococcus aureus
DESIHPNDDVNESQSSNDTFP

SEQ ID NO: 1628350 - protein, 15 aa, Staphylococcus aureus
DETSANNDNKYKSEP

SEQ ID NO: 1628351 - protein, 6 aa, Staphylococcus aureus
DEYEQH

SEQ ID NO: 1628352 - protein, 21 aa, Staphylococcus aureus
DFASTKEELEAKAASLSTKTI

SEQ ID NO: 1628353 - protein, 5 aa, Staphylococcus aureus
DFNDP

SEQ ID NO: 1628354 - protein, 13 aa, Staphylococcus aureus
DFNPDTDSITESE

SEQ ID NO: 1628355 - protein, 8 aa, Staphylococcus aureus
DFSGYPDC

SEQ ID NO: 1628356 - protein, 4 aa, Staphylococcus aureus
DFVP

SEQ ID NO: 1628357 - protein, 7 aa, Staphylococcus aureus
DGCPTDS

SEQ ID NO: 1628358 - protein, 7 aa, Staphylococcus aureus
DGDKRRI

SEQ ID NO: 1628359 - protein, 10 aa, Staphylococcus aureus
DGDWRKQNNI

SEQ ID NO: 1628360 - protein, 7 aa, Staphylococcus aureus
DGEKWTN

SEQ ID NO: 1628361 - protein, 9 aa, Staphylococcus aureus
DGFENAPRA

SEQ ID NO: 1628362 - protein, 6 aa, Staphylococcus aureus
DGGPIS

SEQ ID NO: 1628363 - protein, 8 aa, Staphylococcus aureus
DGKSDFNN

SEQ ID NO: 1628364 - protein, 9 aa, Staphylococcus aureus
DGNNGKGTF

SEQ ID NO: 1628365 - protein, 7 aa, Staphylococcus aureus
DGQASNL

SEQ ID NO: 1628366 - protein, 6 aa, Staphylococcus aureus
DGRPKL

SEQ ID NO: 1628367 - protein, 18 aa, Staphylococcus aureus
DGSVGSGFDLPDKTCETC

SEQ ID NO: 1628368 - protein, 6 aa, Staphylococcus aureus
DGYISG

SEQ ID NO: 1628369 - protein, 5 aa, Staphylococcus aureus
DHDFD

SEQ ID NO: 1628370 - protein, 5 aa, Staphylococcus aureus
DHLKE

SEQ ID NO: 1628371 - protein, 7 aa, Staphylococcus aureus
DHPENEL

SEQ ID NO: 1628372 - protein, 5 aa, Staphylococcus aureus
DIDTE

SEQ ID NO: 1628373 - protein, 9 aa, Staphylococcus aureus
DIKGSSVGY

SEQ ID NO: 1628374 - protein, 18 aa, Staphylococcus aureus
DIPSNHRPVTSDKNSKLI

SEQ ID NO: 1628375 - protein, 7 aa, Staphylococcus aureus
DKANKAD

SEQ ID NO: 1628376 - protein, 9 aa, Staphylococcus aureus
DKDASPTVT

SEQ ID NO: 1628377 - protein, 14 aa, Staphylococcus aureus
DKDDTKRRSDWKTN

SEQ ID NO: 1628378 - protein, 8 aa, Staphylococcus aureus
DKDFYDSK

SEQ ID NO: 1628379 - protein, 17 aa, Staphylococcus aureus
DKDGNKKDLTSADTFEE

SEQ ID NO: 1628380 - protein, 4 aa, Staphylococcus aureus
DKDK

SEQ ID NO: 1628381 - protein, 11 aa, Staphylococcus aureus
DKEEFKKEDDY

SEQ ID NO: 1628382 - protein, 17 aa, Staphylococcus aureus
DKEGYRDDQFDKNDKGT

SEQ ID NO: 1628383 - protein, 7 aa, Staphylococcus aureus
DKEHPDP

SEQ ID NO: 1628384 - protein, 7 aa, Staphylococcus aureus
DKELENY

SEQ ID NO: 1628385 - protein, 10 aa, Staphylococcus aureus
DKELSDIQSK

SEQ ID NO: 1628386 - protein, 6 aa, Staphylococcus aureus
DKETGE

SEQ ID NO: 1628387 - protein, 16 aa, Staphylococcus aureus
DKFHSNKRRVSPTGQR

SEQ ID NO: 1628388 - protein, 5 aa, Staphylococcus aureus
DKGDI

SEQ ID NO: 1628389 - protein, 23 aa, Staphylococcus aureus
DKGDSFDYETTKSKIGPYDKNEN

SEQ ID NO: 1628390 - protein, 21 aa, Staphylococcus aureus
DKGFKGNAKLSDFKSEDYPTL

SEQ ID NO: 1628391 - protein, 12 aa, Staphylococcus aureus
DKIEQGIKRGKK

SEQ ID NO: 1628392 - protein, 17 aa, Staphylococcus aureus
DKKDQFPEELSGGQKQR

SEQ ID NO: 1628393 - protein, 9 aa, Staphylococcus aureus
DKKKKHSVN

SEQ ID NO: 1628394 - protein, 6 aa, Staphylococcus aureus
DKKPAC

SEQ ID NO: 1628395 - protein, 14 aa, Staphylococcus aureus
DKLQSGQISIEEPG

SEQ ID NO: 1628396 - protein, 6 aa, Staphylococcus aureus
DKNGEL

SEQ ID NO: 1628397 - protein, 8 aa, Staphylococcus aureus
DKNYDPLR

SEQ ID NO: 1628398 - protein, 7 aa, Staphylococcus aureus
DKPLIPA

SEQ ID NO: 1628399 - protein, 8 aa, Staphylococcus aureus
DKPQETKH

SEQ ID NO: 1628400 - protein, 6 aa, Staphylococcus aureus
DKQHYT

SEQ ID NO: 1628401 - protein, 10 aa, Staphylococcus aureus
DKQSKKAYEN

SEQ ID NO: 1628402 - protein, 14 aa, Staphylococcus aureus
DKRVSYKQDFDSRR

SEQ ID NO: 1628403 - protein, 17 aa, Staphylococcus aureus
DKSSHQEVHENNSAYEE

SEQ ID NO: 1628404 - protein, 15 aa, Staphylococcus aureus
DKSSYAKTQDITTIS

SEQ ID NO: 1628405 - protein, 10 aa, Staphylococcus aureus
DKTAEAKEQV

SEQ ID NO: 1628406 - protein, 15 aa, Staphylococcus aureus
DKTAGSNDNKAAVEQ

SEQ ID NO: 1628407 - protein, 8 aa, Staphylococcus aureus
DKTKDGKI

SEQ ID NO: 1628408 - protein, 4 aa, Staphylococcus aureus
DKYE

SEQ ID NO: 1628409 - protein, 6 aa, Staphylococcus aureus
DKYEFG

SEQ ID NO: 1628410 - protein, 7 aa, Staphylococcus aureus
DLDPEKY

SEQ ID NO: 1628411 - protein, 21 aa, Staphylococcus aureus
DLGGSEAKTSCSNGKGKSIKF

SEQ ID NO: 1628412 - protein, 4 aa, Staphylococcus aureus
DLGY

SEQ ID NO: 1628413 - protein, 18 aa, Staphylococcus aureus
DLKRAKYAGIEQQKMKGK

SEQ ID NO: 1628414 - protein, 25 aa, Staphylococcus aureus
DLSSKEVSEATRIQYGGSVKPNNIK

SEQ ID NO: 1628415 - protein, 7 aa, Staphylococcus aureus
DLTDDEK

SEQ ID NO: 1628416 - protein, 12 aa, Staphylococcus aureus
DLTEKGTQVDKL

SEQ ID NO: 1628417 - protein, 6 aa, Staphylococcus aureus
DMTNKQ

SEQ ID NO: 1628418 - protein, 10 aa, Staphylococcus aureus
DNDGHGTMER

SEQ ID NO: 1628419 - protein, 13 aa, Staphylococcus aureus
DNFTAYATPEHNY

SEQ ID NO: 1628420 - protein, 6 aa, Staphylococcus aureus
DNGTIH

SEQ ID NO: 1628421 - protein, 5 aa, Staphylococcus aureus
DNKKA

SEQ ID NO: 1628422 - protein, 38 aa, Staphylococcus aureus; identical to SEQ ID NO: 1567915

SEQ ID NO: 1628423 - protein, 42 aa, Staphylococcus aureus
DNNKAIQNDIPDQKVDDKNDKNAVNKEEKHDNGANNSEETKV

SEQ ID NO: 1628424 - protein, 10 aa, Staphylococcus aureus
DNPGSQHGHG

SEQ ID NO: 1628425 - protein, 6 aa, Staphylococcus aureus
DNPSEH

SEQ ID NO: 1628426 - protein, 5 aa, Staphylococcus aureus
DNQTV

SEQ ID NO: 1628427 - protein, 4 aa, Staphylococcus aureus
DNSL

SEQ ID NO: 1628428 - protein, 6 aa, Staphylococcus aureus
DNSLNI

SEQ ID NO: 1628429 - protein, 6 aa, Staphylococcus aureus
DNSNVK

SEQ ID NO: 1628430 - protein, 8 aa, Staphylococcus aureus
DNSVGTGW

SEQ ID NO: 1628431 - protein, 7 aa, Staphylococcus aureus
DNWGRGG

SEQ ID NO: 1628432 - protein, 13 aa, Staphylococcus aureus
DPEKYKNANEEEL

SEQ ID NO: 1628433 - protein, 8 aa, Staphylococcus aureus
DPNFTSEE

SEQ ID NO: 1628434 - protein, 9 aa, Staphylococcus aureus
DPQASIGRG

SEQ ID NO: 1628435 - protein, 6 aa, Staphylococcus aureus
DQAIKE

SEQ ID NO: 1628436 - protein, 32 aa, Staphylococcus aureus; identical to SEQ ID NO: 1565072

SEQ ID NO: 1628437 - protein, 12 aa, Staphylococcus aureus
DQETGIKATHEE

SEQ ID NO: 1628438 - protein, 5 aa, Staphylococcus aureus
DQGLG

SEQ ID NO: 1628439 - protein, 7 aa, Staphylococcus aureus
DQNKIEK

SEQ ID NO: 1628440 - protein, 11 aa, Staphylococcus aureus
DQPRTELSAYA

SEQ ID NO: 1628441 - protein, 9 aa, Staphylococcus aureus
DQQASSAQL

SEQ ID NO: 1628442 - protein, 14 aa, Staphylococcus aureus
DQRTAEANGADYGI

SEQ ID NO: 1628443 - protein, 6 aa, Staphylococcus aureus
DQTEAL

SEQ ID NO: 1628444 - protein, 6 aa, Staphylococcus aureus
DQTNTI

SEQ ID NO: 1628445 - protein, 12 aa, Staphylococcus aureus
DQTPSYKLLIFL

SEQ ID NO: 1628446 - protein, 13 aa, Staphylococcus aureus
DRGGYYESSGALK

SEQ ID NO: 1628447 - protein, 13 aa, Staphylococcus aureus
DRGISGKSMNRPE

SEQ ID NO: 1628448 - protein, 7 aa, Staphylococcus aureus
DRGKDFD

SEQ ID NO: 1628449 - protein, 4 aa, Staphylococcus aureus
DRHD

SEQ ID NO: 1628450 - protein, 8 aa, Staphylococcus aureus
DRIEQPGW

SEQ ID NO: 1628451 - protein, 32 aa, Staphylococcus aureus
DRQETTYQVATDNAQDNRDNQQLNQNTATTNM

SEQ ID NO: 1628452 - protein, 8 aa, Staphylococcus aureus
DRTPYDRD

SEQ ID NO: 1628453 - protein, 6 aa, Staphylococcus aureus
DRVPRE

SEQ ID NO: 1628454 - protein, 18 aa, Staphylococcus aureus
DSAGGASGEAYMAEQDGQ

SEQ ID NO: 1628455 - protein, 5 aa, Staphylococcus aureus
DSDCS

SEQ ID NO: 1628456 - protein, 14 aa, Staphylococcus aureus
DSEGEKFNNNETLR

SEQ ID NO: 1628457 - protein, 6 aa, Staphylococcus aureus
DSIDEM

SEQ ID NO: 1628458 - protein, 6 aa, Staphylococcus aureus
DSMEEK

SEQ ID NO: 1628459 - protein, 9 aa, Staphylococcus aureus
DSPLDIEST

SEQ ID NO: 1628460 - protein, 16 aa, Staphylococcus aureus
DSRKSLDERETEKKYP

SEQ ID NO: 1628461 - protein, 6 aa, Staphylococcus aureus
DSRTYH

SEQ ID NO: 1628462 - protein, 7 aa, Staphylococcus aureus
DSSKLSS

SEQ ID NO: 1628463 - protein, 7 aa, Staphylococcus aureus
DSSNFKS

SEQ ID NO: 1628464 - protein, 7 aa, Staphylococcus aureus
DSTRTRC

SEQ ID NO: 1628465 - protein, 8 aa, Staphylococcus aureus
DSTSNVRA

SEQ ID NO: 1628466 - protein, 9 aa, Staphylococcus aureus
DSTTKKAMK

SEQ ID NO: 1628467 - protein, 5 aa, Staphylococcus aureus
DSTTV

SEQ ID NO: 1628468 - protein, 7 aa, Staphylococcus aureus
DSYNPFV

SEQ ID NO: 1628469 - protein, 6 aa, Staphylococcus aureus
DTDSVD

SEQ ID NO: 1628470 - protein, 6 aa, Staphylococcus aureus
DTDTKV

SEQ ID NO: 1628471 - protein, 6 aa, Staphylococcus aureus
DTDYQG

SEQ ID NO: 1628472 - protein, 13 aa, Staphylococcus aureus
DTEKEWETGAGTR

SEQ ID NO: 1628473 - protein, 22 aa, Staphylococcus aureus
DTEVDEDTTSNIEDNTNRNASE

SEQ ID NO: 1628474 - protein, 12 aa, Staphylococcus aureus
DTFKQEMGGTGR

SEQ ID NO: 1628475 - protein, 8 aa, Staphylococcus aureus
DTIEEAVE

SEQ ID NO: 1628476 - protein, 10 aa, Staphylococcus aureus
DTINNKEDLQ

SEQ ID NO: 1628477 - protein, 6 aa, Staphylococcus aureus
DTMDEG

SEQ ID NO: 1628478 - protein, 13 aa, Staphylococcus aureus
DTMIKNGKKVKKT

SEQ ID NO: 1628479 - protein, 4 aa, Staphylococcus aureus
DTNI

SEQ ID NO: 1628480 - protein, 8 aa, Staphylococcus aureus
DTNPKNIG

SEQ ID NO: 1628481 - protein, 4 aa, Staphylococcus aureus
DTQK

SEQ ID NO: 1628482 - protein, 14 aa, Staphylococcus aureus
DTRAEQESTSGTSF

SEQ ID NO: 1628483 - protein, 6 aa, Staphylococcus aureus
DTSDYS

SEQ ID NO: 1628484 - protein, 14 aa, Staphylococcus aureus
DTSPDFNASNVKPQ

SEQ ID NO: 1628485 - protein, 4 aa, Staphylococcus aureus
DTTS

SEQ ID NO: 1628486 - protein, 5 aa, Staphylococcus aureus
DTVKS

SEQ ID NO: 1628487 - protein, 4 aa, Staphylococcus aureus
DVDN

SEQ ID NO: 1628488 - protein, 12 aa, Staphylococcus aureus
DVEVETNVGPRG

SEQ ID NO: 1628489 - protein, 4 aa, Staphylococcus aureus
DVHI

SEQ ID NO: 1628490 - protein, 10 aa, Staphylococcus aureus
DVKANDKEGF

SEQ ID NO: 1628491 - protein, 8 aa, Staphylococcus aureus
DVPGSGMG

SEQ ID NO: 1628492 - protein, 7 aa, Staphylococcus aureus
DVPKSMK

SEQ ID NO: 1628493 - protein, 9 aa, Staphylococcus aureus
DVQSQEGNL

SEQ ID NO: 1628494 - protein, 4 aa, Staphylococcus aureus
DVSD

SEQ ID NO: 1628495 - protein, 7 aa, Staphylococcus aureus
DVSQDAK

SEQ ID NO: 1628496 - protein, 7 aa, Staphylococcus aureus
DVSYSYA

SEQ ID NO: 1628497 - protein, 4 aa, Staphylococcus aureus
DYEG

SEQ ID NO: 1628498 - protein, 10 aa, Staphylococcus aureus
DYKARGVNEY

SEQ ID NO: 1628499 - protein, 4 aa, Staphylococcus aureus
DYNH

SEQ ID NO: 1628500 - protein, 5 aa, Staphylococcus aureus
DYPAL

SEQ ID NO: 1628501 - protein, 5 aa, Staphylococcus aureus
DYQSK

SEQ ID NO: 1628502 - protein, 15 aa, Staphylococcus aureus
DYRTQNNLCMAILRI

SEQ ID NO: 1628503 - protein, 4 aa, Staphylococcus aureus
EAAE

SEQ ID NO: 1628504 - protein, 4 aa, Staphylococcus aureus
EADD

SEQ ID NO: 1628505 - protein, 20 aa, Staphylococcus aureus
EAEATPDNIEDSEIKGRHDL

SEQ ID NO: 1628506 - protein, 11 aa, Staphylococcus aureus
EAEERSERIQN

SEQ ID NO: 1628507 - protein, 16 aa, Staphylococcus aureus
EAGKTLAKYAASTGQH

SEQ ID NO: 1628508 - protein, 5 aa, Staphylococcus aureus
EAIEK

SEQ ID NO: 1628509 - protein, 13 aa, Staphylococcus aureus
EAKEGMEVSTDKS

SEQ ID NO: 1628510 - protein, 9 aa, Staphylococcus aureus
EAKKFPSNL

SEQ ID NO: 1628511 - protein, 6 aa, Staphylococcus aureus
EAKSSA

SEQ ID NO: 1628512 - protein, 8 aa, Staphylococcus aureus
EANNNEIA

SEQ ID NO: 1628513 - protein, 5 aa, Staphylococcus aureus
EAPGF

SEQ ID NO: 1628514 - protein, 12 aa, Staphylococcus aureus
EASADKKSSISN

SEQ ID NO: 1628515 - protein, 6 aa, Staphylococcus aureus
EASGEV

SEQ ID NO: 1628516 - protein, 17 aa, Staphylococcus aureus
EATTLDDSNYKERWNSG

SEQ ID NO: 1628517 - protein, 8 aa, Staphylococcus aureus
EATVDIET

SEQ ID NO: 1628518 - protein, 5 aa, Staphylococcus aureus
ECPNQ

SEQ ID NO: 1628519 - protein, 19 aa, Staphylococcus aureus
EDANQVNYAASQKEALQTA

SEQ ID NO: 1628520 - protein, 8 aa, Staphylococcus aureus
EDDKSKKL

SEQ ID NO: 1628521 - protein, 20 aa, Staphylococcus aureus
EDDTTEQSEASADEQKSLSD

SEQ ID NO: 1628522 - protein, 5 aa, Staphylococcus aureus
EDEHS

SEQ ID NO: 1628523 - protein, 7 aa, Staphylococcus aureus
EDELDAG

SEQ ID NO: 1628524 - protein, 4 aa, Staphylococcus aureus
EDGK

SEQ ID NO: 1628525 - protein, 9 aa, Staphylococcus aureus
EDKLDDMTK

SEQ ID NO: 1628526 - protein, 16 aa, Staphylococcus aureus
EDKNHDVQKNEKKYPV

SEQ ID NO: 1628527 - protein, 16 aa, Staphylococcus aureus
EDKNTPIDSTASPLDT

SEQ ID NO: 1628528 - protein, 6 aa, Staphylococcus aureus
EDKQIY

SEQ ID NO: 1628529 - protein, 7 aa, Staphylococcus aureus
EDNDPVY

SEQ ID NO: 1628530 - protein, 8 aa, Staphylococcus aureus
EDNENEVY

SEQ ID NO: 1628531 - protein, 6 aa, Staphylococcus aureus
EDNKNG

SEQ ID NO: 1628532 - protein, 17 aa, Staphylococcus aureus
EDPKNRIDIASNKKAKP

SEQ ID NO: 1628533 - protein, 7 aa, Staphylococcus aureus
EDREDKQ

SEQ ID NO: 1628534 - protein, 10 aa, Staphylococcus aureus
EDSKAKEFLK

SEQ ID NO: 1628535 - protein, 11 aa, Staphylococcus aureus
EDTPGVTRDRI

SEQ ID NO: 1628536 - protein, 19 aa, Staphylococcus aureus
EDVTPKDFGRVGAQAAKQA

SEQ ID NO: 1628537 - protein, 23 aa, Staphylococcus aureus
EEAPSPILDDETRREMGNAAVRA

SEQ ID NO: 1628538 - protein, 7 aa, Staphylococcus aureus
EEDGKFV

SEQ ID NO: 1628539 - protein, 16 aa, Staphylococcus aureus
EEDKQQIATLEESNSQ

SEQ ID NO: 1628540 - protein, 16 aa, Staphylococcus aureus
EEGAKTLQPGLDLVGK

SEQ ID NO: 1628541 - protein, 13 aa, Staphylococcus aureus
EEIDDSMPENSTM

SEQ ID NO: 1628542 - protein, 12 aa, Staphylococcus aureus
EEISDSVRRDPI

SEQ ID NO: 1628543 - protein, 13 aa, Staphylococcus aureus
EEKLNDKKPTTLK

SEQ ID NO: 1628544 - protein, 8 aa, Staphylococcus aureus
EEKSNAMI

SEQ ID NO: 1628545 - protein, 57 aa, Staphylococcus aureus
EELANEKEKQAALQSRVESEKEKIANLQEKRAQLDESRQALEDAQTNNNLEKAAELQ

SEQ ID NO: 1628546 - protein, 17 aa, Staphylococcus aureus
EEPEVKDLTEEKYNQDY

SEQ ID NO: 1628547 - protein, 9 aa, Staphylococcus aureus
EERAPLKRN

SEQ ID NO: 1628548 - protein, 5 aa, Staphylococcus aureus
EERLN

SEQ ID NO: 1628549 - protein, 34 aa, Staphylococcus aureus
EESDGDNGKSKDNNDDEGKDKQDKKTNSEEEIEK

SEQ ID NO: 1628550 - protein, 99 aa, Staphylococcus aureus
EESQDDNQLEDEQVDQSTSSSVSEVSDITEESEETTHPNNTSGQQDNDDQQKDLQPSFSNQNEDTANENRPRTNQQDVATNQAVQTSKPMIRKGPNIKL

SEQ ID NO: 1628551 - protein, 99 aa, Staphylococcus aureus
EESQDDNQLENEQVDQSTSSSVSEVSDITEESEETTHPNNTSGQQDNDDQQKDLQSSFSNKNEDTANENRPRTNQQDVATNQAVQTSKPMIRKGPNIKL

SEQ ID NO: 1628552 - protein, 15 aa, Staphylococcus aureus
EESYESEKKRIENEL

SEQ ID NO: 1628553 - protein, 5 aa, Staphylococcus aureus
EETDC

SEQ ID NO: 1628554 - protein, 5 aa, Staphylococcus aureus
EETEL

SEQ ID NO: 1628555 - protein, 6 aa, Staphylococcus aureus
EEVDDD

SEQ ID NO: 1628556 - protein, 10 aa, Staphylococcus aureus
EEVDEKLREK

SEQ ID NO: 1628557 - protein, 10 aa, Staphylococcus aureus
EEVNEKLREK

SEQ ID NO: 1628558 - protein, 5 aa, Staphylococcus aureus
EEYEG

SEQ ID NO: 1628559 - protein, 14 aa, Staphylococcus aureus
EEYTGNVTEDNGET

SEQ ID NO: 1628560 - protein, 11 aa, Staphylococcus aureus
EFEQSNASPNV

SEQ ID NO: 1628561 - protein, 12 aa, Staphylococcus aureus
EFEQSNASPNVI

SEQ ID NO: 1628562 - protein, 7 aa, Staphylococcus aureus
EFSGKGY

SEQ ID NO: 1628563 - protein, 4 aa, Staphylococcus aureus
EGAE

SEQ ID NO: 1628564 - protein, 19 aa, Staphylococcus aureus
EGDEPKVIQNPEGSRTTPS

SEQ ID NO: 1628565 - protein, 4 aa, Staphylococcus aureus
EGEE

SEQ ID NO: 1628566 - protein, 9 aa, Staphylococcus aureus
EGFEKAGPI

SEQ ID NO: 1628567 - protein, 7 aa, Staphylococcus aureus
EGFGPFD

SEQ ID NO: 1628568 - protein, 5 aa, Staphylococcus aureus
EGIGL

SEQ ID NO: 1628569 - protein, 12 aa, Staphylococcus aureus
EGKRGRKPTTIS

SEQ ID NO: 1628570 - protein, 9 aa, Staphylococcus aureus
EGKTPETLK

SEQ ID NO: 1628571 - protein, 7 aa, Staphylococcus aureus
EGNIASF

SEQ ID NO: 1628572 - protein, 15 aa, Staphylococcus aureus
EGQKSKHLKLHGLML

SEQ ID NO: 1628573 - protein, 8 aa, Staphylococcus aureus
EGQSISKI

SEQ ID NO: 1628574 - protein, 7 aa, Staphylococcus aureus
EGRAREL

SEQ ID NO: 1628575 - protein, 5 aa, Staphylococcus aureus
EGTPI

SEQ ID NO: 1628576 - protein, 8 aa, Staphylococcus aureus
EGYDTPEN

SEQ ID NO: 1628577 - protein, 17 aa, Staphylococcus aureus
EHDGNQIDKNNSTDNSH

SEQ ID NO: 1628578 - protein, 10 aa, Staphylococcus aureus
EHEQDGEKAY

SEQ ID NO: 1628579 - protein, 9 aa, Staphylococcus aureus
EHKGAYKDG

SEQ ID NO: 1628580 - protein, 17 aa, Staphylococcus aureus
EHKHKYKDIENGLKGEE

SEQ ID NO: 1628581 - protein, 8 aa, Staphylococcus aureus
EIADPKKR

SEQ ID NO: 1628582 - protein, 4 aa, Staphylococcus aureus
EIDD

SEQ ID NO: 1628583 - protein, 17 aa, Staphylococcus aureus
EIEKNKNANIEEKFNDS

SEQ ID NO: 1628584 - protein, 8 aa, Staphylococcus aureus
EIENNDDV

SEQ ID NO: 1628585 - protein, 8 aa, Staphylococcus aureus
EIETRTAK

SEQ ID NO: 1628586 - protein, 5 aa, Staphylococcus aureus
EIGTF

SEQ ID NO: 1628587 - protein, 9 aa, Staphylococcus aureus
EINKTQKRL

SEQ ID NO: 1628588 - protein, 27 aa, Staphylococcus aureus
EIPNAEQTVNYQNAEDNAKTNFDDAKR

SEQ ID NO: 1628589 - protein, 51 aa, Staphylococcus aureus
EIQATPDATDEEKQAADAEANTENGKANQAISAATTNAQVDEAKANAEAAI

SEQ ID NO: 1628590 - protein, 11 aa, Staphylococcus aureus
EISENSYENDD

SEQ ID NO: 1628591 - protein, 7 aa, Staphylococcus aureus
EISNMQQ

SEQ ID NO: 1628592 - protein, 6 aa, Staphylococcus aureus
EISQTE

SEQ ID NO: 1628593 - protein, 5 aa, Staphylococcus aureus
EITED

SEQ ID NO: 1628594 - protein, 6 aa, Staphylococcus aureus
EITQES

SEQ ID NO: 1628595 - protein, 60 aa, Staphylococcus aureus; identical to SEQ ID NO: 1564917

SEQ ID NO: 1628596 - protein, 6 aa, Staphylococcus aureus
EKAGGI

SEQ ID NO: 1628597 - protein, 5 aa, Staphylococcus aureus
EKAIN

SEQ ID NO: 1628598 - protein, 11 aa, Staphylococcus aureus
EKALNQESLKE

SEQ ID NO: 1628599 - protein, 9 aa, Staphylococcus aureus
EKANDGTIN

SEQ ID NO: 1628600 - protein, 14 aa, Staphylococcus aureus
EKDDYVDSSEVKEG

SEQ ID NO: 1628601 - protein, 8 aa, Staphylococcus aureus
EKDEKKKY

SEQ ID NO: 1628602 - protein, 12 aa, Staphylococcus aureus
EKDEYSGEDKNE

SEQ ID NO: 1628603 - protein, 8 aa, Staphylococcus aureus
EKDPKYKL

SEQ ID NO: 1628604 - protein, 9 aa, Staphylococcus aureus
EKDPTIREQ

SEQ ID NO: 1628605 - protein, 9 aa, Staphylococcus aureus
EKENGEIAI

SEQ ID NO: 1628606 - protein, 5 aa, Staphylococcus aureus
EKEQV

SEQ ID NO: 1628607 - protein, 12 aa, Staphylococcus aureus
EKERKKIINSLG

SEQ ID NO: 1628608 - protein, 16 aa, Staphylococcus aureus
EKGERELGTQMKATGE

SEQ ID NO: 1628609 - protein, 7 aa, Staphylococcus aureus
EKGTEIT

SEQ ID NO: 1628610 - protein, 7 aa, Staphylococcus aureus
EKGVSVE

SEQ ID NO: 1628611 - protein, 10 aa, Staphylococcus aureus
EKGYDGTTLD

SEQ ID NO: 1628612 - protein, 11 aa, Staphylococcus aureus
EKGYDGTTLDD

SEQ ID NO: 1628613 - protein, 6 aa, Staphylococcus aureus
EKHSYP

SEQ ID NO: 1628614 - protein, 12 aa, Staphylococcus aureus
EKIERKNNVATA

SEQ ID NO: 1628615 - protein, 9 aa, Staphylococcus aureus
EKIERTKDM

SEQ ID NO: 1628616 - protein, 5 aa, Staphylococcus aureus
EKKNL

SEQ ID NO: 1628617 - protein, 17 aa, Staphylococcus aureus
EKLQEKIKEEKKKEYEK

SEQ ID NO: 1628618 - protein, 19 aa, Staphylococcus aureus
EKMKAEKAKQQDNNESAVD

SEQ ID NO: 1628619 - protein, 6 aa, Staphylococcus aureus
EKTSEL

SEQ ID NO: 1628620 - protein, 24 aa, Staphylococcus aureus
EKVGTFENQKKASVVSDSRTEDHS

SEQ ID NO: 1628621 - protein, 23 aa, Staphylococcus aureus
EKVNELNGNERVAEAKTQAKQTI

SEQ ID NO: 1628622 - protein, 8 aa, Staphylococcus aureus
EKVTDNES

SEQ ID NO: 1628623 - protein, 4 aa, Staphylococcus aureus
EKVV

SEQ ID NO: 1628624 - protein, 18 aa, Staphylococcus aureus
ELDDPQYTTRIQDGKNPI

SEQ ID NO: 1628625 - protein, 6 aa, Staphylococcus aureus
ELEDEG

SEQ ID NO: 1628626 - protein, 6 aa, Staphylococcus aureus
ELENER

SEQ ID NO: 1628627 - protein, 8 aa, Staphylococcus aureus
ELGKDGAE

SEQ ID NO: 1628628 - protein, 12 aa, Staphylococcus aureus
ELKAGKTNTEED

SEQ ID NO: 1628629 - protein, 19 aa, Staphylococcus aureus
ELKNQNSELETKYKETQLN

SEQ ID NO: 1628630 - protein, 5 aa, Staphylococcus aureus
ELKNS

SEQ ID NO: 1628631 - protein, 6 aa, Staphylococcus aureus
ELKSLR

SEQ ID NO: 1628632 - protein, 7 aa, Staphylococcus aureus
ELNESAD

SEQ ID NO: 1628633 - protein, 11 aa, Staphylococcus aureus
ELPNTGSEEMD

SEQ ID NO: 1628634 - protein, 15 aa, Staphylococcus aureus
ELQQKLAEKLQQLNM

SEQ ID NO: 1628635 - protein, 13 aa, Staphylococcus aureus
ELSADGPIRPPYE

SEQ ID NO: 1628636 - protein, 13 aa, Staphylococcus aureus
ELSDEDKQTVERA

SEQ ID NO: 1628637 - protein, 5 aa, Staphylococcus aureus
ELSSS

SEQ ID NO: 1628638 - protein, 5 aa, Staphylococcus aureus
EMNRQ

SEQ ID NO: 1628639 - protein, 11 aa, Staphylococcus aureus
EMSNQDELDPT

SEQ ID NO: 1628640 - protein, 4 aa, Staphylococcus aureus
ENAI

SEQ ID NO: 1628641 - protein, 8 aa, Staphylococcus aureus
ENDVRADQ

SEQ ID NO: 1628642 - protein, 5 aa, Staphylococcus aureus
ENEAD

SEQ ID NO: 1628643 - protein, 5 aa, Staphylococcus aureus
ENEDT

SEQ ID NO: 1628644 - protein, 10 aa, Staphylococcus aureus
ENEFESETGN

SEQ ID NO: 1628645 - protein, 5 aa, Staphylococcus aureus
ENEGV

SEQ ID NO: 1628646 - protein, 64 aa, Staphylococcus aureus
ENENVEQSADTISDEKEQYHRDYRKQSHDSRSQKRHRRRRNQTTEEQNYSEKRGNSKISQQSIK

SEQ ID NO: 1628647 - protein, 7 aa, Staphylococcus aureus
ENGENIN

SEQ ID NO: 1628648 - protein, 8 aa, Staphylococcus aureus
ENGQETIE

SEQ ID NO: 1628649 - protein, 12 aa, Staphylococcus aureus
ENGQLKQRPYPA

SEQ ID NO: 1628650 - protein, 13 aa, Staphylococcus aureus
ENINKTSINIQTD

SEQ ID NO: 1628651 - protein, 7 aa, Staphylococcus aureus
ENKDKLY

SEQ ID NO: 1628652 - protein, 8 aa, Staphylococcus aureus
ENKVTPKV

SEQ ID NO: 1628653 - protein, 9 aa, Staphylococcus aureus
ENLGQVASQ

SEQ ID NO: 1628654 - protein, 7 aa, Staphylococcus aureus
ENMQNND

SEQ ID NO: 1628655 - protein, 4 aa, Staphylococcus aureus
ENNF

SEQ ID NO: 1628656 - protein, 10 aa, Staphylococcus aureus
ENNKAETGFS

SEQ ID NO: 1628657 - protein, 9 aa, Staphylococcus aureus
ENNKYDPTL

SEQ ID NO: 1628658 - protein, 7 aa, Staphylococcus aureus
ENNPHKS

SEQ ID NO: 1628659 - protein, 7 aa, Staphylococcus aureus
ENNPKGS

SEQ ID NO: 1628660 - protein, 6 aa, Staphylococcus aureus
ENNQLK

SEQ ID NO: 1628661 - protein, 4 aa, Staphylococcus aureus
ENPE

SEQ ID NO: 1628662 - protein, 6 aa, Staphylococcus aureus
ENQNDE

SEQ ID NO: 1628663 - protein, 13 aa, Staphylococcus aureus
ENSEHGYGNESEL

SEQ ID NO: 1628664 - protein, 4 aa, Staphylococcus aureus
ENVN

SEQ ID NO: 1628665 - protein, 5 aa, Staphylococcus aureus
ENYER

SEQ ID NO: 1628666 - protein, 8 aa, Staphylococcus aureus
ENYNNGDV

SEQ ID NO: 1628667 - protein, 7 aa, Staphylococcus aureus
EPDLPEA

SEQ ID NO: 1628668 - protein, 7 aa, Staphylococcus aureus
EPKEGDE

SEQ ID NO: 1628669 - protein, 37 aa, Staphylococcus aureus
EPKNNNQQQNNNYQQQRQTQTGNNPFDNNADSIEDLP

SEQ ID NO: 1628670 - protein, 6 aa, Staphylococcus aureus
EPLESE

SEQ ID NO: 1628671 - protein, 7 aa, Staphylococcus aureus
EPQEATL

SEQ ID NO: 1628672 - protein, 12 aa, Staphylococcus aureus
EPQEYDEKYKNF

SEQ ID NO: 1628673 - protein, 9 aa, Staphylococcus aureus
EPQVKDGSV

SEQ ID NO: 1628674 - protein, 15 aa, Staphylococcus aureus
EQEGIKSNKTKVGDR

SEQ ID NO: 1628675 - protein, 10 aa, Staphylococcus aureus
EQEQKAIKKE

SEQ ID NO: 1628676 - protein, 12 aa, Staphylococcus aureus
EQESKQQLTEDQ

SEQ ID NO: 1628677 - protein, 13 aa, Staphylococcus aureus
EQKLKDADTLKSS

SEQ ID NO: 1628678 - protein, 6 aa, Staphylococcus aureus
EQLEDH

SEQ ID NO: 1628679 - protein, 5 aa, Staphylococcus aureus
EQLEN

SEQ ID NO: 1628680 - protein, 9 aa, Staphylococcus aureus
EQLPNGQNF

SEQ ID NO: 1628681 - protein, 8 aa, Staphylococcus aureus
EQNQLPQG

SEQ ID NO: 1628682 - protein, 24 aa, Staphylococcus aureus
EQRQNTENNQEKTFSSEESNSKSF

SEQ ID NO: 1628683 - protein, 24 aa, Staphylococcus aureus
EQRQNTENNQEKTFSSEESNSRPF

SEQ ID NO: 1628684 - protein, 7 aa, Staphylococcus aureus
EQYETTT

SEQ ID NO: 1628685 - protein, 4 aa, Staphylococcus aureus
EREL

SEQ ID NO: 1628686 - protein, 5 aa, Staphylococcus aureus
ERERG

SEQ ID NO: 1628687 - protein, 5 aa, Staphylococcus aureus
ERLGI

SEQ ID NO: 1628688 - protein, 8 aa, Staphylococcus aureus
ERYQVSKS

SEQ ID NO: 1628689 - protein, 7 aa, Staphylococcus aureus
ESAKSAL

SEQ ID NO: 1628690 - protein, 6 aa, Staphylococcus aureus
ESATVS

SEQ ID NO: 1628691 - protein, 4 aa, Staphylococcus aureus
ESDV

SEQ ID NO: 1628692 - protein, 10 aa, Staphylococcus aureus
ESFNKEKNKT

SEQ ID NO: 1628693 - protein, 5 aa, Staphylococcus aureus
ESGIH

SEQ ID NO: 1628694 - protein, 14 aa, Staphylococcus aureus
ESIKDQPQTEASSK

SEQ ID NO: 1628695 - protein, 9 aa, Staphylococcus aureus
ESKRKVRRD

SEQ ID NO: 1628696 - protein, 20 aa, Staphylococcus aureus
ESKTTKKLKGFKSKKSGKSF

SEQ ID NO: 1628697 - protein, 20 aa, Staphylococcus aureus
ESLNDSNENIKAQTKIKTFL

SEQ ID NO: 1628698 - protein, 19 aa, Staphylococcus aureus
ESQWGKGENATRQNNPLSV

SEQ ID NO: 1628699 - protein, 6 aa, Staphylococcus aureus
ESRNAE

SEQ ID NO: 1628700 - protein, 6 aa, Staphylococcus aureus
ESSHAM

SEQ ID NO: 1628701 - protein, 15 aa, Staphylococcus aureus
ESSMKPSNSEKTSFS

SEQ ID NO: 1628702 - protein, 6 aa, Staphylococcus aureus
ESSRET

SEQ ID NO: 1628703 - protein, 5 aa, Staphylococcus aureus
ETCTG

SEQ ID NO: 1628704 - protein, 5 aa, Staphylococcus aureus
ETEGI

SEQ ID NO: 1628705 - protein, 13 aa, Staphylococcus aureus
ETFKEEGLEPWTS

SEQ ID NO: 1628706 - protein, 5 aa, Staphylococcus aureus
ETGAF

SEQ ID NO: 1628707 - protein, 9 aa, Staphylococcus aureus
ETGEEAYQV

SEQ ID NO: 1628708 - protein, 6 aa, Staphylococcus aureus
ETGLQD

SEQ ID NO: 1628709 - protein, 19 aa, Staphylococcus aureus
ETGNGKSELAKGIKDGKKR

SEQ ID NO: 1628710 - protein, 11 aa, Staphylococcus aureus
ETGQLGEVPSN

SEQ ID NO: 1628711 - protein, 5 aa, Staphylococcus aureus
ETHDD

SEQ ID NO: 1628712 - protein, 4 aa, Staphylococcus aureus
ETIR

SEQ ID NO: 1628713 - protein, 4 aa, Staphylococcus aureus
ETPI

SEQ ID NO: 1628714 - protein, 11 aa, Staphylococcus aureus
ETRVDKRIDTK

SEQ ID NO: 1628715 - protein, 15 aa, Staphylococcus aureus
ETTELSSDDHHTTVR

SEQ ID NO: 1628716 - protein, 5 aa, Staphylococcus aureus
ETTYQ

SEQ ID NO: 1628717 - protein, 13 aa, Staphylococcus aureus
ETYNNYNRKQQAY

SEQ ID NO: 1628718 - protein, 13 aa, Staphylococcus aureus
EVETSFEEEGKTL

SEQ ID NO: 1628719 - protein, 5 aa, Staphylococcus aureus
EVGPQ

SEQ ID NO: 1628720 - protein, 6 aa, Staphylococcus aureus
EVGSWS

SEQ ID NO: 1628721 - protein, 8 aa, Staphylococcus aureus
EVKNSTGK

SEQ ID NO: 1628722 - protein, 7 aa, Staphylococcus aureus
EVKYDEA

SEQ ID NO: 1628723 - protein, 13 aa, Staphylococcus aureus
EVNDKDELKNQSR

SEQ ID NO: 1628724 - protein, 14 aa, Staphylococcus aureus
EVSLQKQQQKQRAL

SEQ ID NO: 1628725 - protein, 11 aa, Staphylococcus aureus
EVTGKSYAENY

SEQ ID NO: 1628726 - protein, 12 aa, Staphylococcus aureus
EVYNSKDPKYKK

SEQ ID NO: 1628727 - protein, 16 aa, Staphylococcus aureus
EYARNNETVERPKRKV

SEQ ID NO: 1628728 - protein, 11 aa, Staphylococcus aureus
EYEEKRQEEEL

SEQ ID NO: 1628729 - protein, 5 aa, Staphylococcus aureus
EYEFD

SEQ ID NO: 1628730 - protein, 10 aa, Staphylococcus aureus
EYGDQLPSNL

SEQ ID NO: 1628731 - protein, 4 aa, Staphylococcus aureus
EYNG

SEQ ID NO: 1628732 - protein, 17 aa, Staphylococcus aureus
EYRKRSIEQKKYESKLN

SEQ ID NO: 1628733 - protein, 15 aa, Staphylococcus aureus
FAEGGNSGSPVFNNK

SEQ ID NO: 1628734 - protein, 13 aa, Staphylococcus aureus
FAGSEATLKTGQN

SEQ ID NO: 1628735 - protein, 10 aa, Staphylococcus aureus
FDDKEVPSGV

SEQ ID NO: 1628736 - protein, 13 aa, Staphylococcus aureus
FDKDGEDKATKEV

SEQ ID NO: 1628737 - protein, 5 aa, Staphylococcus aureus
FDKGT

SEQ ID NO: 1628738 - protein, 38 aa, Staphylococcus aureus
FDTSTNARQNVDAQEKTYTTSPVNINRDQEETKETEIQ

SEQ ID NO: 1628739 - protein, 9 aa, Staphylococcus aureus
FEDLKDSNG

SEQ ID NO: 1628740 - protein, 5 aa, Staphylococcus aureus
FEEKT

SEQ ID NO: 1628741 - protein, 9 aa, Staphylococcus aureus
FEKSDYANG

SEQ ID NO: 1628742 - protein, 8 aa, Staphylococcus aureus
FEKYTKQI

SEQ ID NO: 1628743 - protein, 8 aa, Staphylococcus aureus
FEPEKRTI

SEQ ID NO: 1628744 - protein, 4 aa, Staphylococcus aureus
FESE

SEQ ID NO: 1628745 - protein, 27 aa, Staphylococcus aureus
FETSSEGSSSGKDSRSKSSNKNVSYTG

SEQ ID NO: 1628746 - protein, 8 aa, Staphylococcus aureus
FGAPHETA

SEQ ID NO: 1628747 - protein, 9 aa, Staphylococcus aureus
FGEATRRAI

SEQ ID NO: 1628748 - protein, 10 aa, Staphylococcus aureus
FGEPNKEAQE

SEQ ID NO: 1628749 - protein, 18 aa, Staphylococcus aureus
FGKPQKVVTDQAPSTKAA

SEQ ID NO: 1628750 - protein, 13 aa, Staphylococcus aureus
FGNPDRNISPDTY

SEQ ID NO: 1628751 - protein, 4 aa, Staphylococcus aureus
FGSL

SEQ ID NO: 1628752 - protein, 11 aa, Staphylococcus aureus
FIKSSSSALGN

SEQ ID NO: 1628753 - protein, 16 aa, Staphylococcus aureus
FINEDQAQKDAYTQAV

SEQ ID NO: 1628754 - protein, 11 aa, Staphylococcus aureus
FKEGDKFYSKR

SEQ ID NO: 1628755 - protein, 8 aa, Staphylococcus aureus
FKEKEEAF

SEQ ID NO: 1628756 - protein, 8 aa, Staphylococcus aureus
FKNNRQTF

SEQ ID NO: 1628757 - protein, 13 aa, Staphylococcus aureus
FKNREKAQKILKP

SEQ ID NO: 1628758 - protein, 8 aa, Staphylococcus aureus
FKPNTNEV

SEQ ID NO: 1628759 - protein, 17 aa, Staphylococcus aureus
FKTNKKINGDTKDVAEV

SEQ ID NO: 1628760 - protein, 4 aa, Staphylococcus aureus
FNEE

SEQ ID NO: 1628761 - protein, 4 aa, Staphylococcus aureus
FNKK

SEQ ID NO: 1628762 - protein, 12 aa, Staphylococcus aureus
FNRKAQAKELND

SEQ ID NO: 1628763 - protein, 12 aa, Staphylococcus aureus
FPRPKTDSSEDI

SEQ ID NO: 1628764 - protein, 8 aa, Staphylococcus aureus
FQQEDAEF

SEQ ID NO: 1628765 - protein, 10 aa, Staphylococcus aureus
FRDRRQRKRD

SEQ ID NO: 1628766 - protein, 14 aa, Staphylococcus aureus
FRNKGSKVCSANSV

SEQ ID NO: 1628767 - protein, 8 aa, Staphylococcus aureus
FRSSGYDG

SEQ ID NO: 1628768 - protein, 15 aa, Staphylococcus aureus
FSGYNGRISEKSSGI

SEQ ID NO: 1628769 - protein, 11 aa, Staphylococcus aureus
FSKTGYSNSRL

SEQ ID NO: 1628770 - protein, 6 aa, Staphylococcus aureus
FSSKGA

SEQ ID NO: 1628771 - protein, 18 aa, Staphylococcus aureus
FTDADPEKQTAYNNAVTA

SEQ ID NO: 1628772 - protein, 9 aa, Staphylococcus aureus
FTKKSAQKL

SEQ ID NO: 1628773 - protein, 10 aa, Staphylococcus aureus
FTPEQQKKVD

SEQ ID NO: 1628774 - protein, 6 aa, Staphylococcus aureus
FTSEGK

SEQ ID NO: 1628775 - protein, 8 aa, Staphylococcus aureus
FVRHGEKK

SEQ ID NO: 1628776 - protein, 9 aa, Staphylococcus aureus
FYPDKRTID

SEQ ID NO: 1628777 - protein, 4 aa, Staphylococcus aureus
GADL

SEQ ID NO: 1628778 - protein, 23 aa, Staphylococcus aureus
GAFGDSTPKVNTPQVTIQQPTTM

SEQ ID NO: 1628779 - protein, 4 aa, Staphylococcus aureus
GAGA

SEQ ID NO: 1628780 - protein, 9 aa, Staphylococcus aureus
GAGGSIGSE

SEQ ID NO: 1628781 - protein, 30 aa, Staphylococcus aureus; identical to SEQ ID NO: 1564563

SEQ ID NO: 1628782 - protein, 11 aa, Staphylococcus aureus
GAISNEKGEML

SEQ ID NO: 1628783 - protein, 5 aa, Staphylococcus aureus
GAKDI

SEQ ID NO: 1628784 - protein, 6 aa, Staphylococcus aureus
GAKDIP

SEQ ID NO: 1628785 - protein, 8 aa, Staphylococcus aureus
GAKNRDKI

SEQ ID NO: 1628786 - protein, 5 aa, Staphylococcus aureus
GALGE

SEQ ID NO: 1628787 - protein, 14 aa, Staphylococcus aureus
GAQALPELTPGGDV

SEQ ID NO: 1628788 - protein, 5 aa, Staphylococcus aureus
GASLP

SEQ ID NO: 1628789 - protein, 23 aa, Staphylococcus aureus
GATASGLSNKQLESLKATKPTRI

SEQ ID NO: 1628790 - protein, 16 aa, Staphylococcus aureus
GATATFNSSDKDIDEQ

SEQ ID NO: 1628791 - protein, 8 aa, Staphylococcus aureus
GCGSSREH

SEQ ID NO: 1628792 - protein, 7 aa, Staphylococcus aureus
GDDNGEF

SEQ ID NO: 1628793 - protein, 8 aa, Staphylococcus aureus
GDDTSHNQ

SEQ ID NO: 1628794 - protein, 9 aa, Staphylococcus aureus
GDENGARLP

SEQ ID NO: 1628795 - protein, 4 aa, Staphylococcus aureus
GDFH

SEQ ID NO: 1628796 - protein, 11 aa, Staphylococcus aureus
GDFPETTEKIP

SEQ ID NO: 1628797 - protein, 4 aa, Staphylococcus aureus
GDGD

SEQ ID NO: 1628798 - protein, 14 aa, Staphylococcus aureus
GDGDLKGSSVGSKN

SEQ ID NO: 1628799 - protein, 6 aa, Staphylococcus aureus
GDGGTA

SEQ ID NO: 1628800 - protein, 5 aa, Staphylococcus aureus
GDGQD

SEQ ID NO: 1628801 - protein, 8 aa, Staphylococcus aureus
GDGSGGAL

SEQ ID NO: 1628802 - protein, 7 aa, Staphylococcus aureus
GDIADSI

SEQ ID NO: 1628803 - protein, 7 aa, Staphylococcus aureus
GDKVPDI

SEQ ID NO: 1628804 - protein, 38 aa, Staphylococcus aureus
GDSEDTVQAEHVGEDTASSKVHEQHTTNVKVRDIGDDK

SEQ ID NO: 1628805 - protein, 6 aa, Staphylococcus aureus
GDSHFD

SEQ ID NO: 1628806 - protein, 7 aa, Staphylococcus aureus
GDSYEKI

SEQ ID NO: 1628807 - protein, 17 aa, Staphylococcus aureus
GDTADGYAGVKGIGEKT

SEQ ID NO: 1628808 - protein, 6 aa, Staphylococcus aureus
GEDKTI

SEQ ID NO: 1628809 - protein, 10 aa, Staphylococcus aureus
GEKSAYKNVQ

SEQ ID NO: 1628810 - protein, 6 aa, Staphylococcus aureus
GELGQP

SEQ ID NO: 1628811 - protein, 7 aa, Staphylococcus aureus
GENSWGS

SEQ ID NO: 1628812 - protein, 9 aa, Staphylococcus aureus
GEQEAPEEM

SEQ ID NO: 1628813 - protein, 4 aa, Staphylococcus aureus
GEQK

SEQ ID NO: 1628814 - protein, 24 aa, Staphylococcus aureus
GERGPNTEGDEKSAYNNVQVGGAP

SEQ ID NO: 1628815 - protein, 9 aa, Staphylococcus aureus
GEVNYDESA

SEQ ID NO: 1628816 - protein, 14 aa, Staphylococcus aureus
GEYSMTKAAAQNGW

SEQ ID NO: 1628817 - protein, 6 aa, Staphylococcus aureus
GFKTEG

SEQ ID NO: 1628818 - protein, 26 aa, Staphylococcus aureus
GFSNKDKNSITNESHWTNEDEPGLSV

SEQ ID NO: 1628819 - protein, 13 aa, Staphylococcus aureus
GFTTNKNRARVNN

SEQ ID NO: 1628820 - protein, 12 aa, Staphylococcus aureus
GFYKQGETIEYA

SEQ ID NO: 1628821 - protein, 8 aa, Staphylococcus aureus
GGAPTKRN

SEQ ID NO: 1628822 - protein, 10 aa, Staphylococcus aureus
GGDNLAATFS

SEQ ID NO: 1628823 - protein, 4 aa, Staphylococcus aureus
GGGA

SEQ ID NO: 1628824 - protein, 10 aa, Staphylococcus aureus
GGKSFNKKPT

SEQ ID NO: 1628825 - protein, 5 aa, Staphylococcus aureus
GGNAW

SEQ ID NO: 1628826 - protein, 7 aa, Staphylococcus aureus
GGNPANF

SEQ ID NO: 1628827 - protein, 6 aa, Staphylococcus aureus
GGNTHH

SEQ ID NO: 1628828 - protein, 15 aa, Staphylococcus aureus
GGYSREKANELLKDN

SEQ ID NO: 1628829 - protein, 10 aa, Staphylococcus aureus
GHPRVAETTT

SEQ ID NO: 1628830 - protein, 9 aa, Staphylococcus aureus
GHSDTTEVY

SEQ ID NO: 1628831 - protein, 14 aa, Staphylococcus aureus
GICGSDTSRYKKMG

SEQ ID NO: 1628832 - protein, 7 aa, Staphylococcus aureus
GIDQKSR

SEQ ID NO: 1628833 - protein, 4 aa, Staphylococcus aureus
GIEG

SEQ ID NO: 1628834 - protein, 5 aa, Staphylococcus aureus
GIGPN

SEQ ID NO: 1628835 - protein, 5 aa, Staphylococcus aureus
GILEN

SEQ ID NO: 1628836 - protein, 5 aa, Staphylococcus aureus
GINDD

SEQ ID NO: 1628837 - protein, 8 aa, Staphylococcus aureus
GINEPATE

SEQ ID NO: 1628838 - protein, 6 aa, Staphylococcus aureus
GINEPV

SEQ ID NO: 1628839 - protein, 9 aa, Staphylococcus aureus
GINQSKSNQ

SEQ ID NO: 1628840 - protein, 11 aa, Staphylococcus aureus
GIQANAGTLDQ

SEQ ID NO: 1628841 - protein, 4 aa, Staphylococcus aureus
GIRS

SEQ ID NO: 1628842 - protein, 19 aa, Staphylococcus aureus
GITPPNTSLRTPAKNATGN

SEQ ID NO: 1628843 - protein, 5 aa, Staphylococcus aureus
GITRK

SEQ ID NO: 1628844 - protein, 7 aa, Staphylococcus aureus
GKAGGEI

SEQ ID NO: 1628845 - protein, 7 aa, Staphylococcus aureus
GKAISKI

SEQ ID NO: 1628846 - protein, 9 aa, Staphylococcus aureus
GKDALKPNS

SEQ ID NO: 1628847 - protein, 11 aa, Staphylococcus aureus
GKDTDIKAEPE

SEQ ID NO: 1628848 - protein, 12 aa, Staphylococcus aureus
GKDTNIKAEPEL

SEQ ID NO: 1628849 - protein, 4 aa, Staphylococcus aureus
GKGN

SEQ ID NO: 1628850 - protein, 10 aa, Staphylococcus aureus
GKIEEGESRV

SEQ ID NO: 1628851 - protein, 5 aa, Staphylococcus aureus
GKIND

SEQ ID NO: 1628852 - protein, 17 aa, Staphylococcus aureus
GKKDDVNSGGKQMPSHF

SEQ ID NO: 1628853 - protein, 8 aa, Staphylococcus aureus
GKKPLAQA

SEQ ID NO: 1628854 - protein, 6 aa, Staphylococcus aureus
GKKQVV

SEQ ID NO: 1628855 - protein, 8 aa, Staphylococcus aureus
GKKRTNKI

SEQ ID NO: 1628856 - protein, 9 aa, Staphylococcus aureus
GKNGAGKTT

SEQ ID NO: 1628857 - protein, 7 aa, Staphylococcus aureus
GKNTIDE

SEQ ID NO: 1628858 - protein, 10 aa, Staphylococcus aureus
GKPKDLQYEH

SEQ ID NO: 1628859 - protein, 17 aa, Staphylococcus aureus
GKPQKVVTDQAPSTKAA

SEQ ID NO: 1628860 - protein, 4 aa, Staphylococcus aureus
GKQT

SEQ ID NO: 1628861 - protein, 7 aa, Staphylococcus aureus
GKSKLLS

SEQ ID NO: 1628862 - protein, 10 aa, Staphylococcus aureus
GKTDGAMDAG

SEQ ID NO: 1628863 - protein, 10 aa, Staphylococcus aureus
GKVGYSTETV

SEQ ID NO: 1628864 - protein, 7 aa, Staphylococcus aureus
GKWGGVD

SEQ ID NO: 1628865 - protein, 10 aa, Staphylococcus aureus
GLDPEKRFNV

SEQ ID NO: 1628866 - protein, 25 aa, Staphylococcus aureus
GLDTPKKIGPKYAPVGASNDPNNMN

SEQ ID NO: 1628867 - protein, 5 aa, Staphylococcus aureus
GLEPS

SEQ ID NO: 1628868 - protein, 12 aa, Staphylococcus aureus
GLEYEEQKQLTL

SEQ ID NO: 1628869 - protein, 6 aa, Staphylococcus aureus
GLGENV

SEQ ID NO: 1628870 - protein, 10 aa, Staphylococcus aureus
GLGGMGGAQP

SEQ ID NO: 1628871 - protein, 6 aa, Staphylococcus aureus
GLGKEA

SEQ ID NO: 1628872 - protein, 14 aa, Staphylococcus aureus
GLGPTTPIDTITEE

SEQ ID NO: 1628873 - protein, 10 aa, Staphylococcus aureus
GLNRKTTGEI

SEQ ID NO: 1628874 - protein, 4 aa, Staphylococcus aureus
GLTE

SEQ ID NO: 1628875 - protein, 5 aa, Staphylococcus aureus
GLVDG

SEQ ID NO: 1628876 - protein, 5 aa, Staphylococcus aureus
GMENG

SEQ ID NO: 1628877 - protein, 15 aa, Staphylococcus aureus
GMPSNEIGTDKQAKF

SEQ ID NO: 1628878 - protein, 16 aa, Staphylococcus aureus
GMQRARKELNYTANTD

SEQ ID NO: 1628879 - protein, 8 aa, Staphylococcus aureus
GMSKAQSL

SEQ ID NO: 1628880 - protein, 15 aa, Staphylococcus aureus
GMTPGTYSKKENGHI

SEQ ID NO: 1628881 - protein, 9 aa, Staphylococcus aureus
GNDRSSRRD

SEQ ID NO: 1628882 - protein, 10 aa, Staphylococcus aureus
GNGLSSKEIS

SEQ ID NO: 1628883 - protein, 6 aa, Staphylococcus aureus
GNGSHT

SEQ ID NO: 1628884 - protein, 16 aa, Staphylococcus aureus
GNGSSPDEWKGEVPSI

SEQ ID NO: 1628885 - protein, 10 aa, Staphylococcus aureus
GNKPSGESTR

SEQ ID NO: 1628886 - protein, 7 aa, Staphylococcus aureus
GNRIQKN

SEQ ID NO: 1628887 - protein, 12 aa, Staphylococcus aureus
GNRISSFGKFSA

SEQ ID NO: 1628888 - protein, 5 aa, Staphylococcus aureus
GPERF

SEQ ID NO: 1628889 - protein, 4 aa, Staphylococcus aureus
GPFH

SEQ ID NO: 1628890 - protein, 9 aa, Staphylococcus aureus
GPGLTKKMN

SEQ ID NO: 1628891 - protein, 9 aa, Staphylococcus aureus
GPGSYKSAG

SEQ ID NO: 1628892 - protein, 6 aa, Staphylococcus aureus
GPQHSE

SEQ ID NO: 1628893 - protein, 4 aa, Staphylococcus aureus
GPSH

SEQ ID NO: 1628894 - protein, 18 aa, Staphylococcus aureus
GPTGSQMGKKESTKDTAR

SEQ ID NO: 1628895 - protein, 9 aa, Staphylococcus aureus
GQEERDKEA

SEQ ID NO: 1628896 - protein, 5 aa, Staphylococcus aureus
GQELY

SEQ ID NO: 1628897 - protein, 4 aa, Staphylococcus aureus
GQER

SEQ ID NO: 1628898 - protein, 16 aa, Staphylococcus aureus
GQESDDDMARDHQEAW

SEQ ID NO: 1628899 - protein, 8 aa, Staphylococcus aureus
GQIEAYDK

SEQ ID NO: 1628900 - protein, 8 aa, Staphylococcus aureus
GQPMEPNV

SEQ ID NO: 1628901 - protein, 9 aa, Staphylococcus aureus
GQRTDITSE

SEQ ID NO: 1628902 - protein, 14 aa, Staphylococcus aureus
GQSPRLATTHPANT

SEQ ID NO: 1628903 - protein, 8 aa, Staphylococcus aureus
GRDITDDI

SEQ ID NO: 1628904 - protein, 4 aa, Staphylococcus aureus
GRGL

SEQ ID NO: 1628905 - protein, 11 aa, Staphylococcus aureus
GRHDDKGRLAE

SEQ ID NO: 1628906 - protein, 10 aa, Staphylococcus aureus
GRVGRSDQQS

SEQ ID NO: 1628907 - protein, 18 aa, Staphylococcus aureus
GSAESDAFNGKISNESPM

SEQ ID NO: 1628908 - protein, 15 aa, Staphylococcus aureus
GSDHANPPNNERIPT

SEQ ID NO: 1628909 - protein, 14 aa, Staphylococcus aureus
GSDREQALATKELS

SEQ ID NO: 1628910 - protein, 26 aa, Staphylococcus aureus
GSFTTSDSASYAQDFKSEENAKKIAE

SEQ ID NO: 1628911 - protein, 10 aa, Staphylococcus aureus
GSKDTANIYK

SEQ ID NO: 1628912 - protein, 13 aa, Staphylococcus aureus
GSNANPTLKETKG

SEQ ID NO: 1628913 - protein, 5 aa, Staphylococcus aureus
GSRGS

SEQ ID NO: 1628914 - protein, 7 aa, Staphylococcus aureus
GSTSERG

SEQ ID NO: 1628915 - protein, 18 aa, Staphylococcus aureus
GSVDGEEFEGGQAEGYDL

SEQ ID NO: 1628916 - protein, 17 aa, Staphylococcus aureus
GTATSVDEAIANEKAGM

SEQ ID NO: 1628917 - protein, 8 aa, Staphylococcus aureus
GTEADTIE

SEQ ID NO: 1628918 - protein, 5 aa, Staphylococcus aureus
GTELE

SEQ ID NO: 1628919 - protein, 7 aa, Staphylococcus aureus
GTFPKEY

SEQ ID NO: 1628920 - protein, 12 aa, Staphylococcus aureus
GTFVKEQDSSIL

SEQ ID NO: 1628921 - protein, 11 aa, Staphylococcus aureus
GTGQTYTSGIK

SEQ ID NO: 1628922 - protein, 10 aa, Staphylococcus aureus
GTGTQKENYT

SEQ ID NO: 1628923 - protein, 15 aa, Staphylococcus aureus
GTITDKYNKRQDKED

SEQ ID NO: 1628924 - protein, 13 aa, Staphylococcus aureus
GTPKERNAALNTE

SEQ ID NO: 1628925 - protein, 10 aa, Staphylococcus aureus
GTQSYQTYSG

SEQ ID NO: 1628926 - protein, 18 aa, Staphylococcus aureus
GTVSGEIADGKYGENGFG

SEQ ID NO: 1628927 - protein, 4 aa, Staphylococcus aureus
GVAL

SEQ ID NO: 1628928 - protein, 5 aa, Staphylococcus aureus
GVANH

SEQ ID NO: 1628929 - protein, 7 aa, Staphylococcus aureus
GVDRNDI

SEQ ID NO: 1628930 - protein, 10 aa, Staphylococcus aureus
GVGLGTNPDE

SEQ ID NO: 1628931 - protein, 7 aa, Staphylococcus aureus
GVGNGQR

SEQ ID NO: 1628932 - protein, 22 aa, Staphylococcus aureus
GVKKSERKKMLSKKETLAKEPL

SEQ ID NO: 1628933 - protein, 5 aa, Staphylococcus aureus
GVKRT

SEQ ID NO: 1628934 - protein, 8 aa, Staphylococcus aureus
GVPRGRGK

SEQ ID NO: 1628935 - protein, 14 aa, Staphylococcus aureus
GWVGAGTKRGLPKA

SEQ ID NO: 1628936 - protein, 18 aa, Staphylococcus aureus
GYEKRNINEMSGGQKQRV

SEQ ID NO: 1628937 - protein, 4 aa, Staphylococcus aureus
GYHE

SEQ ID NO: 1628938 - protein, 17 aa, Staphylococcus aureus
GYRAQHNDAVGPTKGGV

SEQ ID NO: 1628939 - protein, 9 aa, Staphylococcus aureus
HAKGSGAFG

SEQ ID NO: 1628940 - protein, 17 aa, Staphylococcus aureus
HANGNDKSNLKKIRVLK

SEQ ID NO: 1628941 - protein, 15 aa, Staphylococcus aureus
HARSTKVKNLNPAIE

SEQ ID NO: 1628942 - protein, 23 aa, Staphylococcus aureus
HATKDTRTRDTHRHLDGESVEID

SEQ ID NO: 1628943 - protein, 10 aa, Staphylococcus aureus
HDSEETEEDV

SEQ ID NO: 1628944 - protein, 15 aa, Staphylococcus aureus
HDSEYRFTAEKTQSF

SEQ ID NO: 1628945 - protein, 5 aa, Staphylococcus aureus
HEQMD

SEQ ID NO: 1628946 - protein, 6 aa, Staphylococcus aureus
HFEDGQ

SEQ ID NO: 1628947 - protein, 8 aa, Staphylococcus aureus
HFNPSQGF

SEQ ID NO: 1628948 - protein, 24 aa, Staphylococcus aureus
HGGSIDVKSELGKGTTFIIKLPKP

SEQ ID NO: 1628949 - protein, 5 aa, Staphylococcus aureus
HGKRV

SEQ ID NO: 1628950 - protein, 12 aa, Staphylococcus aureus
HGSHEEHKGRID

SEQ ID NO: 1628951 - protein, 4 aa, Staphylococcus aureus
HGYG

SEQ ID NO: 1628952 - protein, 8 aa, Staphylococcus aureus
HKLSPQDE

SEQ ID NO: 1628953 - protein, 15 aa, Staphylococcus aureus
HLDRDKDKRACEPDK

SEQ ID NO: 1628954 - protein, 8 aa, Staphylococcus aureus
HLEQPQKY

SEQ ID NO: 1628955 - protein, 8 aa, Staphylococcus aureus
HNDDEQNI

SEQ ID NO: 1628956 - protein, 20 aa, Staphylococcus aureus
HNETGVSRSTISGYKNGKAE

SEQ ID NO: 1628957 - protein, 5 aa, Staphylococcus aureus
HNETI

SEQ ID NO: 1628958 - protein, 9 aa, Staphylococcus aureus
HNPAENEGK

SEQ ID NO: 1628959 - protein, 9 aa, Staphylococcus aureus
HNPPMEDAA

SEQ ID NO: 1628960 - protein, 6 aa, Staphylococcus aureus
HNPVAD

SEQ ID NO: 1628961 - protein, 4 aa, Staphylococcus aureus
HNQH

SEQ ID NO: 1628962 - protein, 7 aa, Staphylococcus aureus
HPKTTIA

SEQ ID NO: 1628963 - protein, 9 aa, Staphylococcus aureus
HQGEKYYQN

SEQ ID NO: 1628964 - protein, 6 aa, Staphylococcus aureus
HQLSGG

SEQ ID NO: 1628965 - protein, 19 aa, Staphylococcus aureus
HQNTGTFNHQDNLSDEEKE

SEQ ID NO: 1628966 - protein, 6 aa, Staphylococcus aureus
HQSIEQ

SEQ ID NO: 1628967 - protein, 17 aa, Staphylococcus aureus
HRGETVTEGSSSNAYAI

SEQ ID NO: 1628968 - protein, 10 aa, Staphylococcus aureus
HRKRPATAKP

SEQ ID NO: 1628969 - protein, 11 aa, Staphylococcus aureus
HRTKTEKANDL

SEQ ID NO: 1628970 - protein, 9 aa, Staphylococcus aureus
HSEGVDLTS

SEQ ID NO: 1628971 - protein, 6 aa, Staphylococcus aureus
HSEKQQ

SEQ ID NO: 1628972 - protein, 5 aa, Staphylococcus aureus
HSINN

SEQ ID NO: 1628973 - protein, 19 aa, Staphylococcus aureus
HSKEHAKETIRKTNGAIRS

SEQ ID NO: 1628974 - protein, 12 aa, Staphylococcus aureus
HSKGLESWKEKN

SEQ ID NO: 1628975 - protein, 18 aa, Staphylococcus aureus
HSKVSKATLYKNNKIRKK

SEQ ID NO: 1628976 - protein, 15 aa, Staphylococcus aureus
HSNTKYLSRNSTLEC

SEQ ID NO: 1628977 - protein, 5 aa, Staphylococcus aureus
HTAET

SEQ ID NO: 1628978 - protein, 24 aa, Staphylococcus aureus
HTDKGKGILDKEGTKVIKGKTKFA

SEQ ID NO: 1628979 - protein, 6 aa, Staphylococcus aureus
HTGKKI

SEQ ID NO: 1628980 - protein, 4 aa, Staphylococcus aureus
HTKH

SEQ ID NO: 1628981 - protein, 21 aa, Staphylococcus aureus
HTQSEDSRCGAGNDRKIRAEQ

SEQ ID NO: 1628982 - protein, 5 aa, Staphylococcus aureus
HTYKD

SEQ ID NO: 1628983 - protein, 11 aa, Staphylococcus aureus
HVEKKSGKFVK

SEQ ID NO: 1628984 - protein, 9 aa, Staphylococcus aureus
HVQKGTGKF

SEQ ID NO: 1628985 - protein, 13 aa, Staphylococcus aureus
HVSKKSEGASITP

SEQ ID NO: 1628986 - protein, 13 aa, Staphylococcus aureus
HWSNDDPGKGNLY

SEQ ID NO: 1628987 - protein, 7 aa, Staphylococcus aureus
IAAEQVK

SEQ ID NO: 1628988 - protein, 32 aa, Staphylococcus aureus; identical to SEQ ID NO: 1565245

SEQ ID NO: 1628989 - protein, 8 aa, Staphylococcus aureus
IADKNGGE

SEQ ID NO: 1628990 - protein, 27 aa, Staphylococcus aureus
IAEGKGKTKKESEQRAAKSAYKQLKQI

SEQ ID NO: 1628991 - protein, 12 aa, Staphylococcus aureus
IAKRSSVPVLIV

SEQ ID NO: 1628992 - protein, 9 aa, Staphylococcus aureus
IAKTTTKIY

SEQ ID NO: 1628993 - protein, 7 aa, Staphylococcus aureus
IANSTGK

SEQ ID NO: 1628994 - protein, 7 aa, Staphylococcus aureus
IASQHNA

SEQ ID NO: 1628995 - protein, 6 aa, Staphylococcus aureus
IDEEEM

SEQ ID NO: 1628996 - protein, 9 aa, Staphylococcus aureus
IDEGVKGSD

SEQ ID NO: 1628997 - protein, 6 aa, Staphylococcus aureus
IDEPRI

SEQ ID NO: 1628998 - protein, 6 aa, Staphylococcus aureus
IDEPRV

SEQ ID NO: 1628999 - protein, 10 aa, Staphylococcus aureus
IDEQGAQRNI

SEQ ID NO: 1629000 - protein, 4 aa, Staphylococcus aureus
IDFD

SEQ ID NO: 1629001 - protein, 14 aa, Staphylococcus aureus
IDGEGEDGGSSGTI

SEQ ID NO: 1629002 - protein, 4 aa, Staphylococcus aureus
IDGM

SEQ ID NO: 1629003 - protein, 29 aa, Staphylococcus aureus
IDGVTSADVNLENGQVSVQYDDSKVAVSQ

SEQ ID NO: 1629004 - protein, 9 aa, Staphylococcus aureus
IDHNSEDEY

SEQ ID NO: 1629005 - protein, 15 aa, Staphylococcus aureus
IDNNAQAICKVLKSY

SEQ ID NO: 1629006 - protein, 19 aa, Staphylococcus aureus
IDPKTYVKEHQSDYKDIKV

SEQ ID NO: 1629007 - protein, 4 aa, Staphylococcus aureus
IDQG

SEQ ID NO: 1629008 - protein, 6 aa, Staphylococcus aureus
IDSPVA

SEQ ID NO: 1629009 - protein, 4 aa, Staphylococcus aureus
IDSQ

SEQ ID NO: 1629010 - protein, 14 aa, Staphylococcus aureus
IDTLNEKQLPDIRG

SEQ ID NO: 1629011 - protein, 7 aa, Staphylococcus aureus
IDWPGEE

SEQ ID NO: 1629012 - protein, 7 aa, Staphylococcus aureus
IDWPSEE

SEQ ID NO: 1629013 - protein, 4 aa, Staphylococcus aureus
IEDK

SEQ ID NO: 1629014 - protein, 8 aa, Staphylococcus aureus
IEEDAKKA

SEQ ID NO: 1629015 - protein, 9 aa, Staphylococcus aureus
IEEKESPRI

SEQ ID NO: 1629016 - protein, 12 aa, Staphylococcus aureus
IEETDTPKLESD

SEQ ID NO: 1629017 - protein, 16 aa, Staphylococcus aureus
IEKNKNANIEEKFNDS

SEQ ID NO: 1629018 - protein, 8 aa, Staphylococcus aureus
IENGEAAS

SEQ ID NO: 1629019 - protein, 18 aa, Staphylococcus aureus
IENYENGDISYNSEAPIY

SEQ ID NO: 1629020 - protein, 9 aa, Staphylococcus aureus
IEPPSASPV

SEQ ID NO: 1629021 - protein, 8 aa, Staphylococcus aureus
IEQGTRES

SEQ ID NO: 1629022 - protein, 30 aa, Staphylococcus aureus
IESTAKDVQTAKTSANKDSVTVKGKAPNTL

SEQ ID NO: 1629023 - protein, 6 aa, Staphylococcus aureus
IETGEV

SEQ ID NO: 1629024 - protein, 10 aa, Staphylococcus aureus
IEVGGGIRTK

SEQ ID NO: 1629025 - protein, 5 aa, Staphylococcus aureus
IGGQQ

SEQ ID NO: 1629026 - protein, 10 aa, Staphylococcus aureus
IGIEPGRSIV

SEQ ID NO: 1629027 - protein, 11 aa, Staphylococcus aureus
IGIPNKGDWTH

SEQ ID NO: 1629028 - protein, 6 aa, Staphylococcus aureus
IGNNDE

SEQ ID NO: 1629029 - protein, 7 aa, Staphylococcus aureus
IGQPVNG

SEQ ID NO: 1629030 - protein, 4 aa, Staphylococcus aureus
IKDG

SEQ ID NO: 1629031 - protein, 10 aa, Staphylococcus aureus
IKDGANDHGE

SEQ ID NO: 1629032 - protein, 18 aa, Staphylococcus aureus
IKDGANDHGETIKKHRND

SEQ ID NO: 1629033 - protein, 10 aa, Staphylococcus aureus
IKDNTNDHGE

SEQ ID NO: 1629034 - protein, 16 aa, Staphylococcus aureus
IKDTTLNDSKTYTDSK

SEQ ID NO: 1629035 - protein, 4 aa, Staphylococcus aureus
IKEE

SEQ ID NO: 1629036 - protein, 9 aa, Staphylococcus aureus
IKEKYGPDA

SEQ ID NO: 1629037 - protein, 7 aa, Staphylococcus aureus
IKGKNTL

SEQ ID NO: 1629038 - protein, 13 aa, Staphylococcus aureus
IKKPDAEKTINDD

SEQ ID NO: 1629039 - protein, 11 aa, Staphylococcus aureus
IKQNATNLNSA

SEQ ID NO: 1629040 - protein, 5 aa, Staphylococcus aureus
IKSKD

SEQ ID NO: 1629041 - protein, 4 aa, Staphylococcus aureus
IKSS

SEQ ID NO: 1629042 - protein, 7 aa, Staphylococcus aureus
IKTQSDL

SEQ ID NO: 1629043 - protein, 10 aa, Staphylococcus aureus
IKTSKYVKKE

SEQ ID NO: 1629044 - protein, 6 aa, Staphylococcus aureus
IKYATQ

SEQ ID NO: 1629045 - protein, 7 aa, Staphylococcus aureus
IKYDDYS

SEQ ID NO: 1629046 - protein, 11 aa, Staphylococcus aureus
IKYNTEETTAI

SEQ ID NO: 1629047 - protein, 4 aa, Staphylococcus aureus
INDP

SEQ ID NO: 1629048 - protein, 4 aa, Staphylococcus aureus
INGH

SEQ ID NO: 1629049 - protein, 7 aa, Staphylococcus aureus
INGNFTK

SEQ ID NO: 1629050 - protein, 7 aa, Staphylococcus aureus
INKGDKL

SEQ ID NO: 1629051 - protein, 10 aa, Staphylococcus aureus
INKRGNKKAR

SEQ ID NO: 1629052 - protein, 10 aa, Staphylococcus aureus
INNADTVSDV

SEQ ID NO: 1629053 - protein, 6 aa, Staphylococcus aureus
INNDGP

SEQ ID NO: 1629054 - protein, 20 aa, Staphylococcus aureus
INNGVDNGDVDDALTQGKAA

SEQ ID NO: 1629055 - protein, 10 aa, Staphylococcus aureus
INNISTGEQI

SEQ ID NO: 1629056 - protein, 6 aa, Staphylococcus aureus
INPATN

SEQ ID NO: 1629057 - protein, 6 aa, Staphylococcus aureus
INPSFS

SEQ ID NO: 1629058 - protein, 29 aa, Staphylococcus aureus
INQNTESTSAISKASYEVENANNNGLSKR

SEQ ID NO: 1629059 - protein, 21 aa, Staphylococcus aureus
INSTYNDQNIRVNKNKKTEKY

SEQ ID NO: 1629060 - protein, 5 aa, Staphylococcus aureus
IPAGS

SEQ ID NO: 1629061 - protein, 6 aa, Staphylococcus aureus
IPDASK

SEQ ID NO: 1629062 - protein, 19 aa, Staphylococcus aureus
IPDYSNNLENSKTHFSTGS

SEQ ID NO: 1629063 - protein, 4 aa, Staphylococcus aureus
IPKD

SEQ ID NO: 1629064 - protein, 5 aa, Staphylococcus aureus
IPPNE

SEQ ID NO: 1629065 - protein, 21 aa, Staphylococcus aureus
IPTGNGDVIDGAREQWNDGSN

SEQ ID NO: 1629066 - protein, 14 aa, Staphylococcus aureus
IPTKDIKDENIKKE

SEQ ID NO: 1629067 - protein, 14 aa, Staphylococcus aureus
IPTKEIKDENIKTE

SEQ ID NO: 1629068 - protein, 15 aa, Staphylococcus aureus
IPTKEIKDKNIKKEI

SEQ ID NO: 1629069 - protein, 4 aa, Staphylococcus aureus
IPYE

SEQ ID NO: 1629070 - protein, 5 aa, Staphylococcus aureus
IQDAK

SEQ ID NO: 1629071 - protein, 10 aa, Staphylococcus aureus
IQDDKLKKEI

SEQ ID NO: 1629072 - protein, 5 aa, Staphylococcus aureus
IQHGS

SEQ ID NO: 1629073 - protein, 7 aa, Staphylococcus aureus
IQKRNPE

SEQ ID NO: 1629074 - protein, 4 aa, Staphylococcus aureus
IQNG

SEQ ID NO: 1629075 - protein, 5 aa, Staphylococcus aureus
IQNGK

SEQ ID NO: 1629076 - protein, 4 aa, Staphylococcus aureus
IQPQ

SEQ ID NO: 1629077 - protein, 6 aa, Staphylococcus aureus
IQSEDG

SEQ ID NO: 1629078 - protein, 11 aa, Staphylococcus aureus
IQTAQELNTAM

SEQ ID NO: 1629079 - protein, 9 aa, Staphylococcus aureus
IQYDPNRSA

SEQ ID NO: 1629080 - protein, 9 aa, Staphylococcus aureus
IREPGSYAR

SEQ ID NO: 1629081 - protein, 4 aa, Staphylococcus aureus
IRGE

SEQ ID NO: 1629082 - protein, 17 aa, Staphylococcus aureus
IRNASDSIQKVGEEFNQ

SEQ ID NO: 1629083 - protein, 5 aa, Staphylococcus aureus
IRQQI

SEQ ID NO: 1629084 - protein, 10 aa, Staphylococcus aureus
IRSPKLDKLP

SEQ ID NO: 1629085 - protein, 18 aa, Staphylococcus aureus
ISEDEAKKYGLNDEENSQ

SEQ ID NO: 1629086 - protein, 9 aa, Staphylococcus aureus
ISESEDVQQ

SEQ ID NO: 1629087 - protein, 13 aa, Staphylococcus aureus
ISGETIVKNGKAE

SEQ ID NO: 1629088 - protein, 8 aa, Staphylococcus aureus
ISGGGNTA

SEQ ID NO: 1629089 - protein, 11 aa, Staphylococcus aureus
ISKGEKDDDSF

SEQ ID NO: 1629090 - protein, 11 aa, Staphylococcus aureus
ISPEAASGGPI

SEQ ID NO: 1629091 - protein, 5 aa, Staphylococcus aureus
ISPEK

SEQ ID NO: 1629092 - protein, 6 aa, Staphylococcus aureus
ISQTTV

SEQ ID NO: 1629093 - protein, 4 aa, Staphylococcus aureus
ISRS

SEQ ID NO: 1629094 - protein, 12 aa, Staphylococcus aureus
ISSNRGNDVQIL

SEQ ID NO: 1629095 - protein, 12 aa, Staphylococcus aureus
ISSQLTPPRQSN

SEQ ID NO: 1629096 - protein, 13 aa, Staphylococcus aureus
ISTDNASWRGPNI

SEQ ID NO: 1629097 - protein, 27 aa, Staphylococcus aureus
ISTDNASWRGPNIEAGGKSAYNNVQVG

SEQ ID NO: 1629098 - protein, 22 aa, Staphylococcus aureus
ISTDNASWRGPNIEAGGKSVYN

SEQ ID NO: 1629099 - protein, 4 aa, Staphylococcus aureus
ISTN

SEQ ID NO: 1629100 - protein, 28 aa, Staphylococcus aureus
ISYTESNEEFNKDEQNKEIENKQEEEID

SEQ ID NO: 1629101 - protein, 5 aa, Staphylococcus aureus
ITAKD

SEQ ID NO: 1629102 - protein, 10 aa, Staphylococcus aureus
ITEDNRSDLG

SEQ ID NO: 1629103 - protein, 9 aa, Staphylococcus aureus
ITGGSNNYT

SEQ ID NO: 1629104 - protein, 6 aa, Staphylococcus aureus
ITGRTE

SEQ ID NO: 1629105 - protein, 17 aa, Staphylococcus aureus
ITKNGASYDDLPKHANT

SEQ ID NO: 1629106 - protein, 12 aa, Staphylococcus aureus
ITNDLNSEDIEN

SEQ ID NO: 1629107 - protein, 9 aa, Staphylococcus aureus
ITPRDSKGK

SEQ ID NO: 1629108 - protein, 4 aa, Staphylococcus aureus
ITPS

SEQ ID NO: 1629109 - protein, 4 aa, Staphylococcus aureus
ITQT

SEQ ID NO: 1629110 - protein, 15 aa, Staphylococcus aureus
ITSKSKIKYNTPKSV

SEQ ID NO: 1629111 - protein, 12 aa, Staphylococcus aureus
ITSSENSYDGNL

SEQ ID NO: 1629112 - protein, 10 aa, Staphylococcus aureus
ITTEQPLKST

SEQ ID NO: 1629113 - protein, 29 aa, Staphylococcus aureus
IVRSSKSGVTTYNNNTGVANYNDKNEKYH

SEQ ID NO: 1629114 - protein, 12 aa, Staphylococcus aureus
IYPTPSKHDAHI

SEQ ID NO: 1629115 - protein, 10 aa, Staphylococcus aureus
KADDSQFSNV

SEQ ID NO: 1629116 - protein, 18 aa, Staphylococcus aureus
KAETDQKSKKNKTVNAGS

SEQ ID NO: 1629117 - protein, 12 aa, Staphylococcus aureus
KAFSENTKARFE

SEQ ID NO: 1629118 - protein, 39 aa, Staphylococcus aureus
KAHNQRQARMRKDDHLTNQVKDKVRSKIKNKVKPGYKKK

SEQ ID NO: 1629119 - protein, 69 aa, Staphylococcus aureus
KAHNQRQARMRKDDHLTNQVKNKVRSKIKNKVKPGYKKKFKQEVEKMKRQERKQFSKQQNRQKRKQNKK

SEQ ID NO: 1629120 - protein, 8 aa, Staphylococcus aureus
KAISPRTT

SEQ ID NO: 1629121 - protein, 11 aa, Staphylococcus aureus
KAKDAEGKQPR

SEQ ID NO: 1629122 - protein, 5 aa, Staphylococcus aureus
KAKGY

SEQ ID NO: 1629123 - protein, 15 aa, Staphylococcus aureus
KAKNDTSDSAGDERI

SEQ ID NO: 1629124 - protein, 10 aa, Staphylococcus aureus
KAKTDSNKDN

SEQ ID NO: 1629125 - protein, 8 aa, Staphylococcus aureus
KAKTYSLG

SEQ ID NO: 1629126 - protein, 6 aa, Staphylococcus aureus
KALNRA

SEQ ID NO: 1629127 - protein, 14 aa, Staphylococcus aureus
KALSSALDKTVGKI

SEQ ID NO: 1629128 - protein, 4 aa, Staphylococcus aureus
KARA

SEQ ID NO: 1629129 - protein, 8 aa, Staphylococcus aureus
KASTETDY

SEQ ID NO: 1629130 - protein, 7 aa, Staphylococcus aureus
KATKEGH

SEQ ID NO: 1629131 - protein, 7 aa, Staphylococcus aureus
KAVQQNV

SEQ ID NO: 1629132 - protein, 9 aa, Staphylococcus aureus
KAYNTNTEQ

SEQ ID NO: 1629133 - protein, 5 aa, Staphylococcus aureus
KAYQL

SEQ ID NO: 1629134 - protein, 18 aa, Staphylococcus aureus
KDAAEKAKKDLSGVSQTQ

SEQ ID NO: 1629135 - protein, 16 aa, Staphylococcus aureus
KDAAQAAVEKANNTED

SEQ ID NO: 1629136 - protein, 9 aa, Staphylococcus aureus
KDAETGKYK

SEQ ID NO: 1629137 - protein, 13 aa, Staphylococcus aureus
KDAVKESFKNPRE

SEQ ID NO: 1629138 - protein, 4 aa, Staphylococcus aureus
KDDI

SEQ ID NO: 1629139 - protein, 9 aa, Staphylococcus aureus
KDDKLKQKI

SEQ ID NO: 1629140 - protein, 7 aa, Staphylococcus aureus
KDDNTYE

SEQ ID NO: 1629141 - protein, 7 aa, Staphylococcus aureus
KDDQMER

SEQ ID NO: 1629142 - protein, 15 aa, Staphylococcus aureus
KDEEGKDYPDWKSKS

SEQ ID NO: 1629143 - protein, 12 aa, Staphylococcus aureus
KDENGNDYPEWE

SEQ ID NO: 1629144 - protein, 8 aa, Staphylococcus aureus
KDFYDSET

SEQ ID NO: 1629145 - protein, 8 aa, Staphylococcus aureus
KDGKPEVQ

SEQ ID NO: 1629146 - protein, 12 aa, Staphylococcus aureus
KDGPILTTKIEE

SEQ ID NO: 1629147 - protein, 8 aa, Staphylococcus aureus
KDGTLHPD

SEQ ID NO: 1629148 - protein, 5 aa, Staphylococcus aureus
KDIEE

SEQ ID NO: 1629149 - protein, 10 aa, Staphylococcus aureus
KDIENTYDGT

SEQ ID NO: 1629150 - protein, 10 aa, Staphylococcus aureus
KDIGKAQRVA

SEQ ID NO: 1629151 - protein, 6 aa, Staphylococcus aureus
KDKAFT

SEQ ID NO: 1629152 - protein, 10 aa, Staphylococcus aureus
KDKEEDTYRG

SEQ ID NO: 1629153 - protein, 9 aa, Staphylococcus aureus
KDKKTITAY

SEQ ID NO: 1629154 - protein, 10 aa, Staphylococcus aureus
KDKLPDRKNY

SEQ ID NO: 1629155 - protein, 6 aa, Staphylococcus aureus
KDMHQH

SEQ ID NO: 1629156 - protein, 6 aa, Staphylococcus aureus
KDMQPY

SEQ ID NO: 1629157 - protein, 23 aa, Staphylococcus aureus
KDNKSDKPNDKLISETAKSVMKE

SEQ ID NO: 1629158 - protein, 4 aa, Staphylococcus aureus
KDNS

SEQ ID NO: 1629159 - protein, 4 aa, Staphylococcus aureus
KDNV

SEQ ID NO: 1629160 - protein, 22 aa, Staphylococcus aureus
KDNYNKYIQGQKQRVIFENGHF

SEQ ID NO: 1629161 - protein, 8 aa, Staphylococcus aureus
KDPKPVPY

SEQ ID NO: 1629162 - protein, 7 aa, Staphylococcus aureus
KDTAKRM

SEQ ID NO: 1629163 - protein, 4 aa, Staphylococcus aureus
KDTT

SEQ ID NO: 1629164 - protein, 6 aa, Staphylococcus aureus
KDVANA

SEQ ID NO: 1629165 - protein, 37 aa, Staphylococcus aureus
KDVPEKADIGTLEKPGQDGVDDGSSFDESTYTSSKSG

SEQ ID NO: 1629166 - protein, 13 aa, Staphylococcus aureus
KDVSGKTKKDIDL

SEQ ID NO: 1629167 - protein, 12 aa, Staphylococcus aureus
KDYEENTPLEEQ

SEQ ID NO: 1629168 - protein, 9 aa, Staphylococcus aureus
KEAEKDAAL

SEQ ID NO: 1629169 - protein, 7 aa, Staphylococcus aureus
KEAIERS

SEQ ID NO: 1629170 - protein, 7 aa, Staphylococcus aureus
KEALPSD

SEQ ID NO: 1629171 - protein, 14 aa, Staphylococcus aureus
KEARDRAISGQGST

SEQ ID NO: 1629172 - protein, 15 aa, Staphylococcus aureus
KEARERAISGQGSTL

SEQ ID NO: 1629173 - protein, 13 aa, Staphylococcus aureus
KEDGSVEKFPKPV

SEQ ID NO: 1629174 - protein, 13 aa, Staphylococcus aureus
KEDQAAKHPKLGA

SEQ ID NO: 1629175 - protein, 4 aa, Staphylococcus aureus
KEDV

SEQ ID NO: 1629176 - protein, 5 aa, Staphylococcus aureus
KEDYP

SEQ ID NO: 1629177 - protein, 5 aa, Staphylococcus aureus
KEEEI

SEQ ID NO: 1629178 - protein, 13 aa, Staphylococcus aureus
KEEGRKKIVIYVN

SEQ ID NO: 1629179 - protein, 5 aa, Staphylococcus aureus
KEEIQ

SEQ ID NO: 1629180 - protein, 7 aa, Staphylococcus aureus
KEELGNA

SEQ ID NO: 1629181 - protein, 7 aa, Staphylococcus aureus
KEENVNK

SEQ ID NO: 1629182 - protein, 11 aa, Staphylococcus aureus
KEETLNQSKIG

SEQ ID NO: 1629183 - protein, 17 aa, Staphylococcus aureus
KEEWEKAKRTPDERGDF

SEQ ID NO: 1629184 - protein, 11 aa, Staphylococcus aureus
KEFKPNKNQHD

SEQ ID NO: 1629185 - protein, 9 aa, Staphylococcus aureus
KEGEFSRQN

SEQ ID NO: 1629186 - protein, 5 aa, Staphylococcus aureus
KEGKE

SEQ ID NO: 1629187 - protein, 5 aa, Staphylococcus aureus
KEGKI

SEQ ID NO: 1629188 - protein, 7 aa, Staphylococcus aureus
KEGRPAL

SEQ ID NO: 1629189 - protein, 6 aa, Staphylococcus aureus
KEKAYQ

SEQ ID NO: 1629190 - protein, 4 aa, Staphylococcus aureus
KEKD

SEQ ID NO: 1629191 - protein, 8 aa, Staphylococcus aureus
KEKGIYKG

SEQ ID NO: 1629192 - protein, 8 aa, Staphylococcus aureus
KEKLTVSP

SEQ ID NO: 1629193 - protein, 6 aa, Staphylococcus aureus
KEKNLI

SEQ ID NO: 1629194 - protein, 16 aa, Staphylococcus aureus
KEKPKEFEINDTATGT

SEQ ID NO: 1629195 - protein, 13 aa, Staphylococcus aureus
KEMKHDNSLSRSE

SEQ ID NO: 1629196 - protein, 10 aa, Staphylococcus aureus
KEMKQAAKDL

SEQ ID NO: 1629197 - protein, 5 aa, Staphylococcus aureus
KENGQ

SEQ ID NO: 1629198 - protein, 34 aa, Staphylococcus aureus
KENVKTKEDAENKIAPRKNTTDDVIAQMEKELSD

SEQ ID NO: 1629199 - protein, 18 aa, Staphylococcus aureus
KEPKKVSIEPVDNETATH

SEQ ID NO: 1629200 - protein, 7 aa, Staphylococcus aureus
KEQKDDI

SEQ ID NO: 1629201 - protein, 6 aa, Staphylococcus aureus
KEQKEA

SEQ ID NO: 1629202 - protein, 6 aa, Staphylococcus aureus
KEQPDA

SEQ ID NO: 1629203 - protein, 10 aa, Staphylococcus aureus
KEQYKEREND

SEQ ID NO: 1629204 - protein, 14 aa, Staphylococcus aureus
KERHQDKQKNKYKI

SEQ ID NO: 1629205 - protein, 5 aa, Staphylococcus aureus
KERTR

SEQ ID NO: 1629206 - protein, 11 aa, Staphylococcus aureus
KESDALSAVED

SEQ ID NO: 1629207 - protein, 4 aa, Staphylococcus aureus
KEST

SEQ ID NO: 1629208 - protein, 5 aa, Staphylococcus aureus
KETDS

SEQ ID NO: 1629209 - protein, 9 aa, Staphylococcus aureus
KETQGKQNN

SEQ ID NO: 1629210 - protein, 9 aa, Staphylococcus aureus
KETTANKLR

SEQ ID NO: 1629211 - protein, 24 aa, Staphylococcus aureus
KETTANKLRSAVTPVKQDKLSKGK

SEQ ID NO: 1629212 - protein, 12 aa, Staphylococcus aureus
KETTPPKRYTEK

SEQ ID NO: 1629213 - protein, 6 aa, Staphylococcus aureus
KETYGV

SEQ ID NO: 1629214 - protein, 7 aa, Staphylococcus aureus
KEYEYEK

SEQ ID NO: 1629215 - protein, 21 aa, Staphylococcus aureus
KEYKQSNGSPNIKGYTRRDSA

SEQ ID NO: 1629216 - protein, 27 aa, Staphylococcus aureus
KFEDETGKKSSISKHNESIKKRNQQKI

SEQ ID NO: 1629217 - protein, 13 aa, Staphylococcus aureus
KFKPGDKLPSVTQ

SEQ ID NO: 1629218 - protein, 5 aa, Staphylococcus aureus
KFNSD

SEQ ID NO: 1629219 - protein, 18 aa, Staphylococcus aureus
KFPYAANGRALSLDDTNG

SEQ ID NO: 1629220 - protein, 11 aa, Staphylococcus aureus
KGASESTKAEV

SEQ ID NO: 1629221 - protein, 14 aa, Staphylococcus aureus
KGDKGIQLDANAPT

SEQ ID NO: 1629222 - protein, 5 aa, Staphylococcus aureus
KGDYE

SEQ ID NO: 1629223 - protein, 12 aa, Staphylococcus aureus
KGEDNGRSIVDK

SEQ ID NO: 1629224 - protein, 41 aa, Staphylococcus aureus
KGHDDDSSSKEEPAKEEAPAEQAPVATQTEEVDENRTVKAM

SEQ ID NO: 1629225 - protein, 6 aa, Staphylococcus aureus
KGHEPV

SEQ ID NO: 1629226 - protein, 4 aa, Staphylococcus aureus
KGID

SEQ ID NO: 1629227 - protein, 8 aa, Staphylococcus aureus
KGIKNTPN

SEQ ID NO: 1629228 - protein, 12 aa, Staphylococcus aureus
KGITNPSDEQGI

SEQ ID NO: 1629229 - protein, 9 aa, Staphylococcus aureus
KGKATEVAN

SEQ ID NO: 1629230 - protein, 5 aa, Staphylococcus aureus
KGKGV

SEQ ID NO: 1629231 - protein, 5 aa, Staphylococcus aureus
KGKME

SEQ ID NO: 1629232 - protein, 9 aa, Staphylococcus aureus
KGKRSTDDI

SEQ ID NO: 1629233 - protein, 15 aa, Staphylococcus aureus
KGLKSDLEKAENQKF

SEQ ID NO: 1629234 - protein, 12 aa, Staphylococcus aureus
KGLTKPSNERLK

SEQ ID NO: 1629235 - protein, 6 aa, Staphylococcus aureus
KGNINK

SEQ ID NO: 1629236 - protein, 6 aa, Staphylococcus aureus
KGNNEV

SEQ ID NO: 1629237 - protein, 7 aa, Staphylococcus aureus
KGPGDVV

SEQ ID NO: 1629238 - protein, 11 aa, Staphylococcus aureus
KGQMKQADRLG

SEQ ID NO: 1629239 - protein, 6 aa, Staphylococcus aureus
KGQSEP

SEQ ID NO: 1629240 - protein, 9 aa, Staphylococcus aureus
KGSKSGITS

SEQ ID NO: 1629241 - protein, 5 aa, Staphylococcus aureus
KGTDN

SEQ ID NO: 1629242 - protein, 7 aa, Staphylococcus aureus
KGVQNAI

SEQ ID NO: 1629243 - protein, 5 aa, Staphylococcus aureus
KGVTN

SEQ ID NO: 1629244 - protein, 20 aa, Staphylococcus aureus
KGYQQYKDDSQIRNSTSASK

SEQ ID NO: 1629245 - protein, 5 aa, Staphylococcus aureus
KGYQV

SEQ ID NO: 1629246 - protein, 5 aa, Staphylococcus aureus
KHNLK

SEQ ID NO: 1629247 - protein, 8 aa, Staphylococcus aureus
KHNSTKQL

SEQ ID NO: 1629248 - protein, 33 aa, Staphylococcus aureus
KHQSLDSKAKHKEKNKLRQQRYREKQKKLLEAK

SEQ ID NO: 1629249 - protein, 32 aa, Staphylococcus aureus
KHVDEDDKEILTSRNTTLENLPNRGLTAVNES

SEQ ID NO: 1629250 - protein, 32 aa, Staphylococcus aureus
KHVDEDDKKVLTSRNTTLENLPNRGLTAVNES

SEQ ID NO: 1629251 - protein, 14 aa, Staphylococcus aureus
KIDRDAKKVETNQG

SEQ ID NO: 1629252 - protein, 5 aa, Staphylococcus aureus
KIHPR

SEQ ID NO: 1629253 - protein, 18 aa, Staphylococcus aureus
KIPKRMPQQDYKQKRWFG

SEQ ID NO: 1629254 - protein, 8 aa, Staphylococcus aureus
KISDEEIN

SEQ ID NO: 1629255 - protein, 8 aa, Staphylococcus aureus
KKAIQQGF

SEQ ID NO: 1629256 - protein, 7 aa, Staphylococcus aureus
KKATADA

SEQ ID NO: 1629257 - protein, 8 aa, Staphylococcus aureus
KKDASDKV

SEQ ID NO: 1629258 - protein, 16 aa, Staphylococcus aureus
KKDGAINKGDYNNNNV

SEQ ID NO: 1629259 - protein, 8 aa, Staphylococcus aureus
KKDNINEL

SEQ ID NO: 1629260 - protein, 17 aa, Staphylococcus aureus
KKEIGKEPNKGVNPDEV

SEQ ID NO: 1629261 - protein, 17 aa, Staphylococcus aureus
KKEKRFIKKENKWKDEK

SEQ ID NO: 1629262 - protein, 5 aa, Staphylococcus aureus
KKELT

SEQ ID NO: 1629263 - protein, 9 aa, Staphylococcus aureus
KKFSNKGSR

SEQ ID NO: 1629264 - protein, 7 aa, Staphylococcus aureus
KKGGHFP

SEQ ID NO: 1629265 - protein, 8 aa, Staphylococcus aureus
KKGGNFPK

SEQ ID NO: 1629266 - protein, 5 aa, Staphylococcus aureus
KKGQR

SEQ ID NO: 1629267 - protein, 9 aa, Staphylococcus aureus
KKHAKKAKN

SEQ ID NO: 1629268 - protein, 6 aa, Staphylococcus aureus
KKIEDK

SEQ ID NO: 1629269 - protein, 6 aa, Staphylococcus aureus
KKITKI

SEQ ID NO: 1629270 - protein, 9 aa, Staphylococcus aureus
KKKKQNGYM

SEQ ID NO: 1629271 - protein, 11 aa, Staphylococcus aureus
KKLKTRDGSAA

SEQ ID NO: 1629272 - protein, 31 aa, Staphylococcus aureus; identical to SEQ ID NO: 1565268

SEQ ID NO: 1629273 - protein, 5 aa, Staphylococcus aureus
KKPYN

SEQ ID NO: 1629274 - protein, 35 aa, Staphylococcus aureus
KKQAAKDEIDQLQATQTNVINNDQNATTEEKEAAI

SEQ ID NO: 1629275 - protein, 5 aa, Staphylococcus aureus
KKQFE

SEQ ID NO: 1629276 - protein, 14 aa, Staphylococcus aureus
KKRQQNKKASKLDP

SEQ ID NO: 1629277 - protein, 8 aa, Staphylococcus aureus
KKSANKKI

SEQ ID NO: 1629278 - protein, 14 aa, Staphylococcus aureus
KKSNEVNPEFNKDK

SEQ ID NO: 1629279 - protein, 13 aa, Staphylococcus aureus
KKSYEGKYTILRE

SEQ ID NO: 1629280 - protein, 7 aa, Staphylococcus aureus
KKTGNPH

SEQ ID NO: 1629281 - protein, 10 aa, Staphylococcus aureus
KKTIPVRPGR

SEQ ID NO: 1629282 - protein, 15 aa, Staphylococcus aureus
KKTVTETIEYEEVEH

SEQ ID NO: 1629283 - protein, 13 aa, Staphylococcus aureus
KKVPTRVATEKGL

SEQ ID NO: 1629284 - protein, 16 aa, Staphylococcus aureus
KKYAQTLKQTGGIGTV

SEQ ID NO: 1629285 - protein, 17 aa, Staphylococcus aureus
KKYLTVQDSKNNDVPAG

SEQ ID NO: 1629286 - protein, 4 aa, Staphylococcus aureus
KLDM

SEQ ID NO: 1629287 - protein, 9 aa, Staphylococcus aureus
KLEDYKEEI

SEQ ID NO: 1629288 - protein, 10 aa, Staphylococcus aureus
KLKEGHSGDY

SEQ ID NO: 1629289 - protein, 7 aa, Staphylococcus aureus
KLKPNQY

SEQ ID NO: 1629290 - protein, 4 aa, Staphylococcus aureus
KLKQ

SEQ ID NO: 1629291 - protein, 8 aa, Staphylococcus aureus
KLMPEGGS

SEQ ID NO: 1629292 - protein, 4 aa, Staphylococcus aureus
KLRR

SEQ ID NO: 1629293 - protein, 7 aa, Staphylococcus aureus
KLSQQQI

SEQ ID NO: 1629294 - protein, 14 aa, Staphylococcus aureus
KLTKPLKNKEVKSV

SEQ ID NO: 1629295 - protein, 8 aa, Staphylococcus aureus
KLTNSGRL

SEQ ID NO: 1629296 - protein, 7 aa, Staphylococcus aureus
KMGKPVS

SEQ ID NO: 1629297 - protein, 9 aa, Staphylococcus aureus
KMLEENGDL

SEQ ID NO: 1629298 - protein, 11 aa, Staphylococcus aureus
KNAIDGDTLEQ

SEQ ID NO: 1629299 - protein, 14 aa, Staphylococcus aureus
KNAKKERKKGFSNQ

SEQ ID NO: 1629300 - protein, 7 aa, Staphylococcus aureus
KNASGQI

SEQ ID NO: 1629301 - protein, 8 aa, Staphylococcus aureus
KNDGDLTK

SEQ ID NO: 1629302 - protein, 15 aa, Staphylococcus aureus
KNDKDGRPQENEKRY

SEQ ID NO: 1629303 - protein, 5 aa, Staphylococcus aureus
KNDLS

SEQ ID NO: 1629304 - protein, 5 aa, Staphylococcus aureus
KNDPF

SEQ ID NO: 1629305 - protein, 6 aa, Staphylococcus aureus
KNEIRE

SEQ ID NO: 1629306 - protein, 40 aa, Staphylococcus aureus
KNESRFKGAKGDKGEPGQPGAKGEAGKKGEQGVPGKNGTV

SEQ ID NO: 1629307 - protein, 40 aa, Staphylococcus aureus
KNESRFKGAKGDKGESGQPGAKGDTGKKGEQGTPGKNGTV

SEQ ID NO: 1629308 - protein, 15 aa, Staphylococcus aureus
KNFKEDALKTKEITG

SEQ ID NO: 1629309 - protein, 8 aa, Staphylococcus aureus
KNGKKHIS

SEQ ID NO: 1629310 - protein, 5 aa, Staphylococcus aureus
KNGNI

SEQ ID NO: 1629311 - protein, 6 aa, Staphylococcus aureus
KNGPKV

SEQ ID NO: 1629312 - protein, 12 aa, Staphylococcus aureus
KNGTPEEKAKIE

SEQ ID NO: 1629313 - protein, 5 aa, Staphylococcus aureus
KNGYI

SEQ ID NO: 1629314 - protein, 6 aa, Staphylococcus aureus
KNGYYN

SEQ ID NO: 1629315 - protein, 6 aa, Staphylococcus aureus
KNIIDE

SEQ ID NO: 1629316 - protein, 7 aa, Staphylococcus aureus
KNKDDLK

SEQ ID NO: 1629317 - protein, 4 aa, Staphylococcus aureus
KNKE

SEQ ID NO: 1629318 - protein, 15 aa, Staphylococcus aureus
KNKEVKDVSFNESEI

SEQ ID NO: 1629319 - protein, 10 aa, Staphylococcus aureus
KNKEVSDKTI

SEQ ID NO: 1629320 - protein, 10 aa, Staphylococcus aureus
KNKRITDEAY

SEQ ID NO: 1629321 - protein, 5 aa, Staphylococcus aureus
KNNFN

SEQ ID NO: 1629322 - protein, 8 aa, Staphylococcus aureus
KNNFPDYE

SEQ ID NO: 1629323 - protein, 11 aa, Staphylococcus aureus
KNNFSTDSKNL

SEQ ID NO: 1629324 - protein, 9 aa, Staphylococcus aureus
KNNKPLSIS

SEQ ID NO: 1629325 - protein, 12 aa, Staphylococcus aureus
KNNNNNNNNRIQ

SEQ ID NO: 1629326 - protein, 13 aa, Staphylococcus aureus
KNNVPYKKETGYY

SEQ ID NO: 1629327 - protein, 12 aa, Staphylococcus aureus
KNQQNGQRSNMT

SEQ ID NO: 1629328 - protein, 7 aa, Staphylococcus aureus
KNSYQAQ

SEQ ID NO: 1629329 - protein, 6 aa, Staphylococcus aureus
KNTATF

SEQ ID NO: 1629330 - protein, 5 aa, Staphylococcus aureus
KNTII

SEQ ID NO: 1629331 - protein, 7 aa, Staphylococcus aureus
KNVAKGD

SEQ ID NO: 1629332 - protein, 4 aa, Staphylococcus aureus
KNVD

SEQ ID NO: 1629333 - protein, 7 aa, Staphylococcus aureus
KNVNGEY

SEQ ID NO: 1629334 - protein, 17 aa, Staphylococcus aureus
KNYKDGDISYNPEAPIY

SEQ ID NO: 1629335 - protein, 7 aa, Staphylococcus aureus
KNYRDKR

SEQ ID NO: 1629336 - protein, 8 aa, Staphylococcus aureus
KPAEYISD

SEQ ID NO: 1629337 - protein, 8 aa, Staphylococcus aureus
KPATTVKA

SEQ ID NO: 1629338 - protein, 8 aa, Staphylococcus aureus
KPDEHQSN

SEQ ID NO: 1629339 - protein, 7 aa, Staphylococcus aureus
KPDLTGQ

SEQ ID NO: 1629340 - protein, 5 aa, Staphylococcus aureus
KPDYV

SEQ ID NO: 1629341 - protein, 5 aa, Staphylococcus aureus
KPLKG

SEQ ID NO: 1629342 - protein, 9 aa, Staphylococcus aureus
KPNSLSTNK

SEQ ID NO: 1629343 - protein, 7 aa, Staphylococcus aureus
KPTHNYT

SEQ ID NO: 1629344 - protein, 9 aa, Staphylococcus aureus
KQAENVNNY

SEQ ID NO: 1629345 - protein, 4 aa, Staphylococcus aureus
KQDH

SEQ ID NO: 1629346 - protein, 8 aa, Staphylococcus aureus
KQEEIEKY

SEQ ID NO: 1629347 - protein, 4 aa, Staphylococcus aureus
KQNY

SEQ ID NO: 1629348 - protein, 12 aa, Staphylococcus aureus
KQPLKDKNNPFF

SEQ ID NO: 1629349 - protein, 10 aa, Staphylococcus aureus
KQPNEKPHKT

SEQ ID NO: 1629350 - protein, 7 aa, Staphylococcus aureus
KQPVVKE

SEQ ID NO: 1629351 - protein, 26 aa, Staphylococcus aureus
KQQIESKKQTYKPHVKQSKEKTPKWL

SEQ ID NO: 1629352 - protein, 26 aa, Staphylococcus aureus
KQQLESKKQNYKPYVKQSKEKTPKWL

SEQ ID NO: 1629353 - protein, 56 aa, Staphylococcus aureus
KQRGYDLERGQSRQVTNAKHEQISQYKQKTEYHKQEYERESQKTDHIKQKNDKLMQ

SEQ ID NO: 1629354 - protein, 55 aa, Staphylococcus aureus
KQRLSQASKAKRNQAQQMAQASSKQKNKSIAPDRLSASKQKGTVEKAAQKQAKHI

SEQ ID NO: 1629355 - protein, 23 aa, Staphylococcus aureus
KQTVQSKNNLDFGDPFGGGFGFF

SEQ ID NO: 1629356 - protein, 6 aa, Staphylococcus aureus
KRAPIQ

SEQ ID NO: 1629357 - protein, 9 aa, Staphylococcus aureus
KRATAEKNK

SEQ ID NO: 1629358 - protein, 14 aa, Staphylococcus aureus
KRDPKTIPDDESRD

SEQ ID NO: 1629359 - protein, 7 aa, Staphylococcus aureus
KREAYRN

SEQ ID NO: 1629360 - protein, 9 aa, Staphylococcus aureus
KRGIDPKKY

SEQ ID NO: 1629361 - protein, 5 aa, Staphylococcus aureus
KRGND

SEQ ID NO: 1629362 - protein, 8 aa, Staphylococcus aureus
KRGQLPEK

SEQ ID NO: 1629363 - protein, 8 aa, Staphylococcus aureus
KRKGKLVT

SEQ ID NO: 1629364 - protein, 10 aa, Staphylococcus aureus
KRLSKSPAFF

SEQ ID NO: 1629365 - protein, 10 aa, Staphylococcus aureus
KRNKENADDV

SEQ ID NO: 1629366 - protein, 5 aa, Staphylococcus aureus
KRPMT

SEQ ID NO: 1629367 - protein, 24 aa, Staphylococcus aureus
KRSPKYNPGMNNHDETDGESEDIQ

SEQ ID NO: 1629368 - protein, 6 aa, Staphylococcus aureus
KRTPYL

SEQ ID NO: 1629369 - protein, 10 aa, Staphylococcus aureus
KRYKRNESYY

SEQ ID NO: 1629370 - protein, 14 aa, Staphylococcus aureus
KSDDEAKALAKEHG

SEQ ID NO: 1629371 - protein, 6 aa, Staphylococcus aureus
KSELNK

SEQ ID NO: 1629372 - protein, 28 aa, Staphylococcus aureus
KSETAPRSIQSPTQASKKETAKPQPKAV

SEQ ID NO: 1629373 - protein, 6 aa, Staphylococcus aureus
KSETSE

SEQ ID NO: 1629374 - protein, 7 aa, Staphylococcus aureus
KSEVDSF

SEQ ID NO: 1629375 - protein, 15 aa, Staphylococcus aureus
KSGDSLMDNDTKQNL

SEQ ID NO: 1629376 - protein, 12 aa, Staphylococcus aureus
KSGEPNPESNQA

SEQ ID NO: 1629377 - protein, 16 aa, Staphylococcus aureus
KSGKSLKKAEKQNESL

SEQ ID NO: 1629378 - protein, 9 aa, Staphylococcus aureus
KSGPFANQV

SEQ ID NO: 1629379 - protein, 10 aa, Staphylococcus aureus
KSGRYGGTFA

SEQ ID NO: 1629380 - protein, 7 aa, Staphylococcus aureus
KSGYEAA

SEQ ID NO: 1629381 - protein, 12 aa, Staphylococcus aureus
KSGYGADTSGIQ

SEQ ID NO: 1629382 - protein, 7 aa, Staphylococcus aureus
KSHKTPR

SEQ ID NO: 1629383 - protein, 21 aa, Staphylococcus aureus
KSIHDSTYPTIEDGLNAGAKN

SEQ ID NO: 1629384 - protein, 6 aa, Staphylococcus aureus
KSIPPT

SEQ ID NO: 1629385 - protein, 13 aa, Staphylococcus aureus
KSITKGKYTRAGE

SEQ ID NO: 1629386 - protein, 8 aa, Staphylococcus aureus
KSITQEVK

SEQ ID NO: 1629387 - protein, 8 aa, Staphylococcus aureus
KSKPYQKQ

SEQ ID NO: 1629388 - protein, 9 aa, Staphylococcus aureus
KSKTNTRGI

SEQ ID NO: 1629389 - protein, 18 aa, Staphylococcus aureus
KSLNSIEESFDDNPETSW

SEQ ID NO: 1629390 - protein, 4 aa, Staphylococcus aureus
KSMP

SEQ ID NO: 1629391 - protein, 8 aa, Staphylococcus aureus
KSMQIQND

SEQ ID NO: 1629392 - protein, 4 aa, Staphylococcus aureus
KSQH

SEQ ID NO: 1629393 - protein, 23 aa, Staphylococcus aureus
KSSDTSEKPKEDSKEAQIKKSFE

SEQ ID NO: 1629394 - protein, 7 aa, Staphylococcus aureus
KSSSIDE

SEQ ID NO: 1629395 - protein, 12 aa, Staphylococcus aureus
KSTKSRSLYEET

SEQ ID NO: 1629396 - protein, 6 aa, Staphylococcus aureus
KSTLSQ

SEQ ID NO: 1629397 - protein, 10 aa, Staphylococcus aureus
KSVDEPLQTG

SEQ ID NO: 1629398 - protein, 10 aa, Staphylococcus aureus
KSYQGQGYGS

SEQ ID NO: 1629399 - protein, 13 aa, Staphylococcus aureus
KSYSDDALKQKTI

SEQ ID NO: 1629400 - protein, 4 aa, Staphylococcus aureus
KTAV

SEQ ID NO: 1629401 - protein, 12 aa, Staphylococcus aureus
KTEASRRALPQK

SEQ ID NO: 1629402 - protein, 9 aa, Staphylococcus aureus
KTFDTTEEL

SEQ ID NO: 1629403 - protein, 9 aa, Staphylococcus aureus
KTGAPTQKL

SEQ ID NO: 1629404 - protein, 5 aa, Staphylococcus aureus
KTGDR

SEQ ID NO: 1629405 - protein, 5 aa, Staphylococcus aureus
KTGLE

SEQ ID NO: 1629406 - protein, 11 aa, Staphylococcus aureus
KTGTKAKADRY

SEQ ID NO: 1629407 - protein, 9 aa, Staphylococcus aureus
KTKDGRTFY

SEQ ID NO: 1629408 - protein, 8 aa, Staphylococcus aureus
KTKISQTT

SEQ ID NO: 1629409 - protein, 14 aa, Staphylococcus aureus
KTLDIDGKVNWITE

SEQ ID NO: 1629410 - protein, 6 aa, Staphylococcus aureus
KTLEVD

SEQ ID NO: 1629411 - protein, 9 aa, Staphylococcus aureus
KTNDQGKIE

SEQ ID NO: 1629412 - protein, 6 aa, Staphylococcus aureus
KTPENL

SEQ ID NO: 1629413 - protein, 4 aa, Staphylococcus aureus
KTPM

SEQ ID NO: 1629414 - protein, 8 aa, Staphylococcus aureus
KTRNEEAE

SEQ ID NO: 1629415 - protein, 9 aa, Staphylococcus aureus
KTSTSSSIE

SEQ ID NO: 1629416 - protein, 15 aa, Staphylococcus aureus
KTTEELQNFMSKVKV

SEQ ID NO: 1629417 - protein, 21 aa, Staphylococcus aureus
KTTEKAEARNISQKSAMRTAV

SEQ ID NO: 1629418 - protein, 6 aa, Staphylococcus aureus
KTYQRR

SEQ ID NO: 1629419 - protein, 14 aa, Staphylococcus aureus
KTYTRQKKLRLIKE

SEQ ID NO: 1629420 - protein, 21 aa, Staphylococcus aureus
KVALDGDENLAAAKQQANNRL

SEQ ID NO: 1629421 - protein, 16 aa, Staphylococcus aureus
KVIENNDLKGAIAGEL

SEQ ID NO: 1629422 - protein, 13 aa, Staphylococcus aureus
KVKPGTKLSNIGK

SEQ ID NO: 1629423 - protein, 10 aa, Staphylococcus aureus
KVSSTKSMTG

SEQ ID NO: 1629424 - protein, 10 aa, Staphylococcus aureus
KVTAKERADE

SEQ ID NO: 1629425 - protein, 15 aa, Staphylococcus aureus
KVTPEKLNEGSAEIE

SEQ ID NO: 1629426 - protein, 12 aa, Staphylococcus aureus
KVYGNEEQVGAG

SEQ ID NO: 1629427 - protein, 7 aa, Staphylococcus aureus
KYAPSEL

SEQ ID NO: 1629428 - protein, 5 aa, Staphylococcus aureus
KYEGY

SEQ ID NO: 1629429 - protein, 6 aa, Staphylococcus aureus
KYEKQL

SEQ ID NO: 1629430 - protein, 4 aa, Staphylococcus aureus
KYIQ

SEQ ID NO: 1629431 - protein, 12 aa, Staphylococcus aureus
KYKGNSQRPTEF

SEQ ID NO: 1629432 - protein, 8 aa, Staphylococcus aureus
KYKKYKPV

SEQ ID NO: 1629433 - protein, 10 aa, Staphylococcus aureus
KYKSEDPNDV

SEQ ID NO: 1629434 - protein, 12 aa, Staphylococcus aureus
KYKSSKDYKNLD

SEQ ID NO: 1629435 - protein, 8 aa, Staphylococcus aureus
KYSKVRKR

SEQ ID NO: 1629436 - protein, 19 aa, Staphylococcus aureus
KYTAEEKKNYNPIKTTDIN

SEQ ID NO: 1629437 - protein, 16 aa, Staphylococcus aureus
KYVSSEQVSEEEINHE

SEQ ID NO: 1629438 - protein, 5 aa, Staphylococcus aureus
LADEY

SEQ ID NO: 1629439 - protein, 6 aa, Staphylococcus aureus
LAKQGQ

SEQ ID NO: 1629440 - protein, 5 aa, Staphylococcus aureus
LANDP

SEQ ID NO: 1629441 - protein, 12 aa, Staphylococcus aureus
LANGATKTQINK

SEQ ID NO: 1629442 - protein, 9 aa, Staphylococcus aureus
LAPEDKIDG

SEQ ID NO: 1629443 - protein, 10 aa, Staphylococcus aureus
LAQKAKSEDV

SEQ ID NO: 1629444 - protein, 19 aa, Staphylococcus aureus
LAQKMAQEQNKKKEEKMKE

SEQ ID NO: 1629445 - protein, 9 aa, Staphylococcus aureus
LARQGQRIK

SEQ ID NO: 1629446 - protein, 6 aa, Staphylococcus aureus
LARTEG

SEQ ID NO: 1629447 - protein, 8 aa, Staphylococcus aureus
LASKKYKN

SEQ ID NO: 1629448 - protein, 16 aa, Staphylococcus aureus
LASQGAKVTSSVTKNT

SEQ ID NO: 1629449 - protein, 7 aa, Staphylococcus aureus
LASRGID

SEQ ID NO: 1629450 - protein, 6 aa, Staphylococcus aureus
LATEDN

SEQ ID NO: 1629451 - protein, 4 aa, Staphylococcus aureus
LDEN

SEQ ID NO: 1629452 - protein, 21 aa, Staphylococcus aureus
LDENKNTFSIKQTKSLKKNQQ

SEQ ID NO: 1629453 - protein, 8 aa, Staphylococcus aureus
LDGTAKGG

SEQ ID NO: 1629454 - protein, 8 aa, Staphylococcus aureus
LDKNPDEL

SEQ ID NO: 1629455 - protein, 11 aa, Staphylococcus aureus
LDKTQTNTEVA

SEQ ID NO: 1629456 - protein, 19 aa, Staphylococcus aureus
LDKTTNTGKDTASTNDRYD

SEQ ID NO: 1629457 - protein, 25 aa, Staphylococcus aureus
LDKYSSKIKGQLKHKASKKDKMTGD

SEQ ID NO: 1629458 - protein, 8 aa, Staphylococcus aureus
LDNGQRHE

SEQ ID NO: 1629459 - protein, 5 aa, Staphylococcus aureus
LDSRV

SEQ ID NO: 1629460 - protein, 15 aa, Staphylococcus aureus
LEDNQVTVRDRDSME

SEQ ID NO: 1629461 - protein, 9 aa, Staphylococcus aureus
LEEEKRRRE

SEQ ID NO: 1629462 - protein, 8 aa, Staphylococcus aureus
LEHDTNEN

SEQ ID NO: 1629463 - protein, 10 aa, Staphylococcus aureus
LEKEDITKKV

SEQ ID NO: 1629464 - protein, 5 aa, Staphylococcus aureus
LEPND

SEQ ID NO: 1629465 - protein, 5 aa, Staphylococcus aureus
LEQGQ

SEQ ID NO: 1629466 - protein, 5 aa, Staphylococcus aureus
LEQQK

SEQ ID NO: 1629467 - protein, 7 aa, Staphylococcus aureus
LERETKK

SEQ ID NO: 1629468 - protein, 7 aa, Staphylococcus aureus
LESEMNK

SEQ ID NO: 1629469 - protein, 14 aa, Staphylococcus aureus
LESKNRKNVPFTAT

SEQ ID NO: 1629470 - protein, 15 aa, Staphylococcus aureus
LETGNLDQYDISGQG

SEQ ID NO: 1629471 - protein, 9 aa, Staphylococcus aureus
LGEYAKSDL

SEQ ID NO: 1629472 - protein, 14 aa, Staphylococcus aureus
LGGEQPDKPNSAID

SEQ ID NO: 1629473 - protein, 12 aa, Staphylococcus aureus
LGSDTGGSIRQP

SEQ ID NO: 1629474 - protein, 5 aa, Staphylococcus aureus
LGSEH

SEQ ID NO: 1629475 - protein, 8 aa, Staphylococcus aureus
LGTGKVAS

SEQ ID NO: 1629476 - protein, 6 aa, Staphylococcus aureus
LKADNG

SEQ ID NO: 1629477 - protein, 15 aa, Staphylococcus aureus
LKAKTTNLAKGGATM

SEQ ID NO: 1629478 - protein, 11 aa, Staphylococcus aureus
LKEREEDPEKL

SEQ ID NO: 1629479 - protein, 9 aa, Staphylococcus aureus
LKGHGPKDL

SEQ ID NO: 1629480 - protein, 9 aa, Staphylococcus aureus
LKKGLDNLN

SEQ ID NO: 1629481 - protein, 9 aa, Staphylococcus aureus
LKNDDYNVK

SEQ ID NO: 1629482 - protein, 6 aa, Staphylococcus aureus
LKNEND

SEQ ID NO: 1629483 - protein, 49 aa, Staphylococcus aureus
LKPVQSKQAVSESKPASQAAPSSRFDSQESNTNAYKTNNMTSNNVENNQ

SEQ ID NO: 1629484 - protein, 19 aa, Staphylococcus aureus
LKSYNNGDVSINSNVPSYD

SEQ ID NO: 1629485 - protein, 14 aa, Staphylococcus aureus
LLATPNENEKPEEI

SEQ ID NO: 1629486 - protein, 12 aa, Staphylococcus aureus
LLSNRGSRQENY

SEQ ID NO: 1629487 - protein, 8 aa, Staphylococcus aureus
LMEKAGSN

SEQ ID NO: 1629488 - protein, 5 aa, Staphylococcus aureus
LNESG

SEQ ID NO: 1629489 - protein, 18 aa, Staphylococcus aureus
LNGDQRLQDAKDKAIQSI

SEQ ID NO: 1629490 - protein, 20 aa, Staphylococcus aureus
LNGVESDNKVTDLTEWRKVN

SEQ ID NO: 1629491 - protein, 7 aa, Staphylococcus aureus
LNHTGAH

SEQ ID NO: 1629492 - protein, 13 aa, Staphylococcus aureus
LNKKADFHKNSEK

SEQ ID NO: 1629493 - protein, 17 aa, Staphylococcus aureus
LNKSNGQNKTKDQVTEA

SEQ ID NO: 1629494 - protein, 14 aa, Staphylococcus aureus
LNNLSTSALQQIRG

SEQ ID NO: 1629495 - protein, 15 aa, Staphylococcus aureus
LNQDKRIGPDPKTFE

SEQ ID NO: 1629496 - protein, 10 aa, Staphylococcus aureus
LNREKSTLEG

SEQ ID NO: 1629497 - protein, 13 aa, Staphylococcus aureus
LNTSNSPFTEKQV

SEQ ID NO: 1629498 - protein, 14 aa, Staphylococcus aureus
LNTTEKLYKYAQQV

SEQ ID NO: 1629499 - protein, 14 aa, Staphylococcus aureus
LPAEQVNEAREKAL

SEQ ID NO: 1629500 - protein, 5 aa, Staphylococcus aureus
LPANE

SEQ ID NO: 1629501 - protein, 8 aa, Staphylococcus aureus
LPDCQKPN

SEQ ID NO: 1629502 - protein, 9 aa, Staphylococcus aureus
LPDRSSPLL

SEQ ID NO: 1629503 - protein, 20 aa, Staphylococcus aureus
LPEPERSKEHITSNGETKIP

SEQ ID NO: 1629504 - protein, 13 aa, Staphylococcus aureus
LPKHEKKNSSQID

SEQ ID NO: 1629505 - protein, 75 aa, Staphylococcus aureus
LPKNDRSQRPARGKTIQAKTRGKSLDKSKSDDKGRKKKGSQRKGKNERKNDKSGNSKHKPFYKDKSVKKKARRKK

SEQ ID NO: 1629506 - protein, 9 aa, Staphylococcus aureus
LPNTKPGAY

SEQ ID NO: 1629507 - protein, 4 aa, Staphylococcus aureus
LPPC

SEQ ID NO: 1629508 - protein, 11 aa, Staphylococcus aureus
LPPKTESSIGK

SEQ ID NO: 1629509 - protein, 8 aa, Staphylococcus aureus
LPSTPNKA

SEQ ID NO: 1629510 - protein, 7 aa, Staphylococcus aureus
LQDPIPA

SEQ ID NO: 1629511 - protein, 5 aa, Staphylococcus aureus
LQENR

SEQ ID NO: 1629512 - protein, 5 aa, Staphylococcus aureus
LQERS

SEQ ID NO: 1629513 - protein, 5 aa, Staphylococcus aureus
LQEYK

SEQ ID NO: 1629514 - protein, 6 aa, Staphylococcus aureus
LQGRKT

SEQ ID NO: 1629515 - protein, 21 aa, Staphylococcus aureus
LQGYAEENNKSFVKNSNNAIS

SEQ ID NO: 1629516 - protein, 6 aa, Staphylococcus aureus
LQTDEN

SEQ ID NO: 1629517 - protein, 10 aa, Staphylococcus aureus
LQTEKDVQSA

SEQ ID NO: 1629518 - protein, 9 aa, Staphylococcus aureus
LRKIGPKDR

SEQ ID NO: 1629519 - protein, 14 aa, Staphylococcus aureus
LRQQGQQSGNGNYL

SEQ ID NO: 1629520 - protein, 10 aa, Staphylococcus aureus
LRRDSDRKEF

SEQ ID NO: 1629521 - protein, 12 aa, Staphylococcus aureus
LSAGQRNKINDN

SEQ ID NO: 1629522 - protein, 16 aa, Staphylococcus aureus
LSEDEASSSKMEETIP

SEQ ID NO: 1629523 - protein, 4 aa, Staphylococcus aureus
LSEG

SEQ ID NO: 1629524 - protein, 6 aa, Staphylococcus aureus
LSEKQV

SEQ ID NO: 1629525 - protein, 7 aa, Staphylococcus aureus
LSERRKA

SEQ ID NO: 1629526 - protein, 10 aa, Staphylococcus aureus
LSESESLSDP

SEQ ID NO: 1629527 - protein, 7 aa, Staphylococcus aureus
LSETRKA

SEQ ID NO: 1629528 - protein, 7 aa, Staphylococcus aureus
LSEVETY

SEQ ID NO: 1629529 - protein, 6 aa, Staphylococcus aureus
LSGQLT

SEQ ID NO: 1629530 - protein, 7 aa, Staphylococcus aureus
LSKDNEV

SEQ ID NO: 1629531 - protein, 9 aa, Staphylococcus aureus
LSKTSKVIE

SEQ ID NO: 1629532 - protein, 12 aa, Staphylococcus aureus
LSKVRSSKDERK

SEQ ID NO: 1629533 - protein, 7 aa, Staphylococcus aureus
LSNDEGK

SEQ ID NO: 1629534 - protein, 21 aa, Staphylococcus aureus
LSNPSKAAENLKSKVASIAKS

SEQ ID NO: 1629535 - protein, 5 aa, Staphylococcus aureus
LSPEL

SEQ ID NO: 1629536 - protein, 14 aa, Staphylococcus aureus
LSQYTAPKTDFDGV

SEQ ID NO: 1629537 - protein, 12 aa, Staphylococcus aureus
LSRKELSEKINV

SEQ ID NO: 1629538 - protein, 23 aa, Staphylococcus aureus
LTDEEKEKISYTNGAKLLGLSAN

SEQ ID NO: 1629539 - protein, 9 aa, Staphylococcus aureus
LTEPNGQSI

SEQ ID NO: 1629540 - protein, 6 aa, Staphylococcus aureus
LTGSDG

SEQ ID NO: 1629541 - protein, 19 aa, Staphylococcus aureus
LTKEGAKLEYSDITKTRGL

SEQ ID NO: 1629542 - protein, 4 aa, Staphylococcus aureus
LTKS

SEQ ID NO: 1629543 - protein, 6 aa, Staphylococcus aureus
LTPSAL

SEQ ID NO: 1629544 - protein, 4 aa, Staphylococcus aureus
LTRY

SEQ ID NO: 1629545 - protein, 15 aa, Staphylococcus aureus
LVAETGAGQHGVASA

SEQ ID NO: 1629546 - protein, 6 aa, Staphylococcus aureus
LYGDST

SEQ ID NO: 1629547 - protein, 7 aa, Staphylococcus aureus
LYGPTVG

SEQ ID NO: 1629548 - protein, 4 aa, Staphylococcus aureus
LYNE

SEQ ID NO: 1629549 - protein, 9 aa, Staphylococcus aureus
LYNGDYNKG

SEQ ID NO: 1629550 - protein, 9 aa, Staphylococcus aureus
MAGPSTPVE

SEQ ID NO: 1629551 - protein, 10 aa, Staphylococcus aureus
MAKTTAEAQK

SEQ ID NO: 1629552 - protein, 8 aa, Staphylococcus aureus
MANQTGHT

SEQ ID NO: 1629553 - protein, 17 aa, Staphylococcus aureus
MDDLRAKAKEAVESGQY

SEQ ID NO: 1629554 - protein, 54 aa, Staphylococcus aureus
MEENSDSKNDNKSTTNGQQINNKSTTNGQQINTNKNVKNGDNVKNDENEKKKAA

SEQ ID NO: 1629555 - protein, 53 aa, Staphylococcus aureus
MEENSDSKNDNKSTTNQQQMDNKWTTNQQQINTNKNVKNGDNVKNGENEKKKV

SEQ ID NO: 1629556 - protein, 5 aa, Staphylococcus aureus
MEHDG

SEQ ID NO: 1629557 - protein, 7 aa, Staphylococcus aureus
MENKGYR

SEQ ID NO: 1629558 - protein, 7 aa, Staphylococcus aureus
MESEQRY

SEQ ID NO: 1629559 - protein, 11 aa, Staphylococcus aureus
MKDEKNKRLKQ

SEQ ID NO: 1629560 - protein, 6 aa, Staphylococcus aureus
MKEQNM

SEQ ID NO: 1629561 - protein, 7 aa, Staphylococcus aureus
MKEQNMS

SEQ ID NO: 1629562 - protein, 13 aa, Staphylococcus aureus
MKGEPQPEVDKPK

SEQ ID NO: 1629563 - protein, 11 aa, Staphylococcus aureus
MKGIKDAPSLD

SEQ ID NO: 1629564 - protein, 8 aa, Staphylococcus aureus
MKQKDTET

SEQ ID NO: 1629565 - protein, 11 aa, Staphylococcus aureus
MKTGSYRSATY

SEQ ID NO: 1629566 - protein, 19 aa, Staphylococcus aureus
MLKSGADGALMSGSGPTVY

SEQ ID NO: 1629567 - protein, 12 aa, Staphylococcus aureus
MNKSEDAQVNRP

SEQ ID NO: 1629568 - protein, 13 aa, Staphylococcus aureus
MNPGGSMKDRPAK

SEQ ID NO: 1629569 - protein, 4 aa, Staphylococcus aureus
MNRV

SEQ ID NO: 1629570 - protein, 21 aa, Staphylococcus aureus
MPGGQYSNLSQQAKSLGLGER

SEQ ID NO: 1629571 - protein, 9 aa, Staphylococcus aureus
MQDAGQLPQ

SEQ ID NO: 1629572 - protein, 16 aa, Staphylococcus aureus
MQPEQQKLTAKAGWAE

SEQ ID NO: 1629573 - protein, 13 aa, Staphylococcus aureus
MRKQRDACKKQRD

SEQ ID NO: 1629574 - protein, 10 aa, Staphylococcus aureus
MSEKDKEEFE

SEQ ID NO: 1629575 - protein, 9 aa, Staphylococcus aureus
MSKGYGYQD

SEQ ID NO: 1629576 - protein, 5 aa, Staphylococcus aureus
MSNAE

SEQ ID NO: 1629577 - protein, 14 aa, Staphylococcus aureus
MTNHSGNGEKGEEA

SEQ ID NO: 1629578 - protein, 4 aa, Staphylococcus aureus
MTNK

SEQ ID NO: 1629579 - protein, 8 aa, Staphylococcus aureus
MTTETKRH

SEQ ID NO: 1629580 - protein, 7 aa, Staphylococcus aureus
MTTGEGI

SEQ ID NO: 1629581 - protein, 39 aa, Staphylococcus aureus
NAANLRDKQTKLEKQYEEAKNEWKNTQNGMSTSLSEEDI

SEQ ID NO: 1629582 - protein, 17 aa, Staphylococcus aureus
NADDDPPKKLKYKENSA

SEQ ID NO: 1629583 - protein, 15 aa, Staphylococcus aureus
NADTDKQTAYNTAVN

SEQ ID NO: 1629584 - protein, 16 aa, Staphylococcus aureus
NADTDKQTAYTTAVNE

SEQ ID NO: 1629585 - protein, 24 aa, Staphylococcus aureus
NAEPHKTEEIKATSINNAEKLATI

SEQ ID NO: 1629586 - protein, 6 aa, Staphylococcus aureus
NANQKF

SEQ ID NO: 1629587 - protein, 7 aa, Staphylococcus aureus
NAQNGIN

SEQ ID NO: 1629588 - protein, 6 aa, Staphylococcus aureus
NAQNYK

SEQ ID NO: 1629589 - protein, 6 aa, Staphylococcus aureus
NAQQFT

SEQ ID NO: 1629590 - protein, 33 aa, Staphylococcus aureus; identical to SEQ ID NO: 1565725

SEQ ID NO: 1629591 - protein, 5 aa, Staphylococcus aureus
NAQTL

SEQ ID NO: 1629592 - protein, 6 aa, Staphylococcus aureus
NARADN

SEQ ID NO: 1629593 - protein, 16 aa, Staphylococcus aureus
NASGVEDIGLKDGDSL

SEQ ID NO: 1629594 - protein, 6 aa, Staphylococcus aureus
NASNYK

SEQ ID NO: 1629595 - protein, 13 aa, Staphylococcus aureus
NATPGGVVKKGDV

SEQ ID NO: 1629596 - protein, 11 aa, Staphylococcus aureus
NATTGQNGAFH

SEQ ID NO: 1629597 - protein, 6 aa, Staphylococcus aureus
NDAETL

SEQ ID NO: 1629598 - protein, 11 aa, Staphylococcus aureus
NDDKNLPTNQN

SEQ ID NO: 1629599 - protein, 5 aa, Staphylococcus aureus
NDEFD

SEQ ID NO: 1629600 - protein, 5 aa, Staphylococcus aureus
NDERM

SEQ ID NO: 1629601 - protein, 5 aa, Staphylococcus aureus
NDFSK

SEQ ID NO: 1629602 - protein, 10 aa, Staphylococcus aureus
NDGEKDYEVE

SEQ ID NO: 1629603 - protein, 6 aa, Staphylococcus aureus
NDGPAI

SEQ ID NO: 1629604 - protein, 14 aa, Staphylococcus aureus
NDGTRVTPEVKEGD

SEQ ID NO: 1629605 - protein, 15 aa, Staphylococcus aureus
NDHQTFRKDEKVEYD

SEQ ID NO: 1629606 - protein, 6 aa, Staphylococcus aureus
NDIDQY

SEQ ID NO: 1629607 - protein, 14 aa, Staphylococcus aureus
NDKGLTVSGQKIGR

SEQ ID NO: 1629608 - protein, 8 aa, Staphylococcus aureus
NDKLTSKK

SEQ ID NO: 1629609 - protein, 8 aa, Staphylococcus aureus
NDKNKMSE

SEQ ID NO: 1629610 - protein, 11 aa, Staphylococcus aureus
NDKNKSTSLLE

SEQ ID NO: 1629611 - protein, 8 aa, Staphylococcus aureus
NDKQGRID

SEQ ID NO: 1629612 - protein, 7 aa, Staphylococcus aureus
NDKTNTF

SEQ ID NO: 1629613 - protein, 5 aa, Staphylococcus aureus
NDNKY

SEQ ID NO: 1629614 - protein, 5 aa, Staphylococcus aureus
NDPTS

SEQ ID NO: 1629615 - protein, 24 aa, Staphylococcus aureus
NDTEADEDTTSNIEDNTNRNASEM

SEQ ID NO: 1629616 - protein, 14 aa, Staphylococcus aureus
NDTKQAQFLAWLDK

SEQ ID NO: 1629617 - protein, 26 aa, Staphylococcus aureus
NDVSETETVNIDNKDTVKQKEAKFEN

SEQ ID NO: 1629618 - protein, 7 aa, Staphylococcus aureus
NDVYGEQ

SEQ ID NO: 1629619 - protein, 12 aa, Staphylococcus aureus
NEAEERSARIQN

SEQ ID NO: 1629620 - protein, 14 aa, Staphylococcus aureus
NEAQDNVKQPAHYT

SEQ ID NO: 1629621 - protein, 9 aa, Staphylococcus aureus
NEDEMTSED

SEQ ID NO: 1629622 - protein, 16 aa, Staphylococcus aureus
NEDITITDQKVSELKD

SEQ ID NO: 1629623 - protein, 9 aa, Staphylococcus aureus
NEDTKIATI

SEQ ID NO: 1629624 - protein, 9 aa, Staphylococcus aureus
NEEEIQNHA

SEQ ID NO: 1629625 - protein, 5 aa, Staphylococcus aureus
NEEIA

SEQ ID NO: 1629626 - protein, 6 aa, Staphylococcus aureus
NEESIH

SEQ ID NO: 1629627 - protein, 5 aa, Staphylococcus aureus
NEEYE

SEQ ID NO: 1629628 - protein, 4 aa, Staphylococcus aureus
NEIA

SEQ ID NO: 1629629 - protein, 20 aa, Staphylococcus aureus
NEIQEAQKYYTQKRSKKHEN

SEQ ID NO: 1629630 - protein, 20 aa, Staphylococcus aureus
NEISGAQDTYKSLKSKQKEL

SEQ ID NO: 1629631 - protein, 9 aa, Staphylococcus aureus
NEKGAMPTT

SEQ ID NO: 1629632 - protein, 8 aa, Staphylococcus aureus
NEKGEFSF

SEQ ID NO: 1629633 - protein, 8 aa, Staphylococcus aureus
NELETKQE

SEQ ID NO: 1629634 - protein, 5 aa, Staphylococcus aureus
NENFK

SEQ ID NO: 1629635 - protein, 10 aa, Staphylococcus aureus
NENIDSKKFE

SEQ ID NO: 1629636 - protein, 20 aa, Staphylococcus aureus
NENNSNVNKTNIKATKIKST

SEQ ID NO: 1629637 - protein, 7 aa, Staphylococcus aureus
NEPMNSG

SEQ ID NO: 1629638 - protein, 5 aa, Staphylococcus aureus
NEQRA

SEQ ID NO: 1629639 - protein, 11 aa, Staphylococcus aureus
NEQSEDPREIE

SEQ ID NO: 1629640 - protein, 5 aa, Staphylococcus aureus
NERPH

SEQ ID NO: 1629641 - protein, 9 aa, Staphylococcus aureus
NERRQRAEA

SEQ ID NO: 1629642 - protein, 12 aa, Staphylococcus aureus
NESKMKDEYTKR

SEQ ID NO: 1629643 - protein, 4 aa, Staphylococcus aureus
NETI

SEQ ID NO: 1629644 - protein, 8 aa, Staphylococcus aureus
NFPDEAPG

SEQ ID NO: 1629645 - protein, 11 aa, Staphylococcus aureus
NFSNTDTKKWT

SEQ ID NO: 1629646 - protein, 6 aa, Staphylococcus aureus
NGAQGI

SEQ ID NO: 1629647 - protein, 10 aa, Staphylococcus aureus
NGAVKLSTDN

SEQ ID NO: 1629648 - protein, 10 aa, Staphylococcus aureus
NGFSSAASFA

SEQ ID NO: 1629649 - protein, 5 aa, Staphylococcus aureus
NGGLR

SEQ ID NO: 1629650 - protein, 8 aa, Staphylococcus aureus
NGNRPRPL

SEQ ID NO: 1629651 - protein, 4 aa, Staphylococcus aureus
NGQP

SEQ ID NO: 1629652 - protein, 6 aa, Staphylococcus aureus
NGRDAL

SEQ ID NO: 1629653 - protein, 9 aa, Staphylococcus aureus
NGSEETHSN

SEQ ID NO: 1629654 - protein, 7 aa, Staphylococcus aureus
NGVGKTT

SEQ ID NO: 1629655 - protein, 6 aa, Staphylococcus aureus
NHGGKA

SEQ ID NO: 1629656 - protein, 10 aa, Staphylococcus aureus
NHSEAKVPIG

SEQ ID NO: 1629657 - protein, 7 aa, Staphylococcus aureus
NHTAEQA

SEQ ID NO: 1629658 - protein, 4 aa, Staphylococcus aureus
NHTL

SEQ ID NO: 1629659 - protein, 7 aa, Staphylococcus aureus
NHTLNKD

SEQ ID NO: 1629660 - protein, 13 aa, Staphylococcus aureus
NHTLNKDDAIKEG

SEQ ID NO: 1629661 - protein, 9 aa, Staphylococcus aureus
NIDNTNETY

SEQ ID NO: 1629662 - protein, 4 aa, Staphylococcus aureus
NIGS

SEQ ID NO: 1629663 - protein, 11 aa, Staphylococcus aureus
NIGTPNDLPGV

SEQ ID NO: 1629664 - protein, 11 aa, Staphylococcus aureus
NIHTQSTKEIA

SEQ ID NO: 1629665 - protein, 14 aa, Staphylococcus aureus
NIKGNSEETSTVSN

SEQ ID NO: 1629666 - protein, 9 aa, Staphylococcus aureus
NIKKNSSQN

SEQ ID NO: 1629667 - protein, 7 aa, Staphylococcus aureus
NIPDNKK

SEQ ID NO: 1629668 - protein, 17 aa, Staphylococcus aureus
NIPTADYKEVERKKDAL

SEQ ID NO: 1629669 - protein, 7 aa, Staphylococcus aureus
NIQNDGT

SEQ ID NO: 1629670 - protein, 10 aa, Staphylococcus aureus
NIVNGSPNVI

SEQ ID NO: 1629671 - protein, 9 aa, Staphylococcus aureus
NIVSTNPAM

SEQ ID NO: 1629672 - protein, 14 aa, Staphylococcus aureus
NKADRIKSQLMTAN

SEQ ID NO: 1629673 - protein, 7 aa, Staphylococcus aureus
NKAGFDR

SEQ ID NO: 1629674 - protein, 16 aa, Staphylococcus aureus
NKDKDQLSVDKLRAFG

SEQ ID NO: 1629675 - protein, 9 aa, Staphylococcus aureus
NKDQDIVDD

SEQ ID NO: 1629676 - protein, 5 aa, Staphylococcus aureus
NKDTG

SEQ ID NO: 1629677 - protein, 17 aa, Staphylococcus aureus
NKEGNINTVKINEIHFK

SEQ ID NO: 1629678 - protein, 38 aa, Staphylococcus aureus
NKEGVSDKESAENKLKPRNTKKETTDDVIAQMEKELSD

SEQ ID NO: 1629679 - protein, 8 aa, Staphylococcus aureus
NKEKTLNK

SEQ ID NO: 1629680 - protein, 7 aa, Staphylococcus aureus
NKETIIP

SEQ ID NO: 1629681 - protein, 5 aa, Staphylococcus aureus
NKFSS

SEQ ID NO: 1629682 - protein, 7 aa, Staphylococcus aureus
NKGEKHP

SEQ ID NO: 1629683 - protein, 8 aa, Staphylococcus aureus
NKGGTALE

SEQ ID NO: 1629684 - protein, 4 aa, Staphylococcus aureus
NKGI

SEQ ID NO: 1629685 - protein, 15 aa, Staphylococcus aureus
NKGQTKYLTKTKEYC

SEQ ID NO: 1629686 - protein, 16 aa, Staphylococcus aureus
NKGQTKYLTKTKEYCK

SEQ ID NO: 1629687 - protein, 7 aa, Staphylococcus aureus
NKGSGTE

SEQ ID NO: 1629688 - protein, 13 aa, Staphylococcus aureus
NKITDLSKKYNSY

SEQ ID NO: 1629689 - protein, 15 aa, Staphylococcus aureus
NKKAFDKGTTTEDIA

SEQ ID NO: 1629690 - protein, 7 aa, Staphylococcus aureus
NKKINGI

SEQ ID NO: 1629691 - protein, 8 aa, Staphylococcus aureus
NKKPNHHY

SEQ ID NO: 1629692 - protein, 7 aa, Staphylococcus aureus
NKLQSER

SEQ ID NO: 1629693 - protein, 9 aa, Staphylococcus aureus
NKNDGKDAL

SEQ ID NO: 1629694 - protein, 7 aa, Staphylococcus aureus
NKNIRSN

SEQ ID NO: 1629695 - protein, 6 aa, Staphylococcus aureus
NKNTDS

SEQ ID NO: 1629696 - protein, 8 aa, Staphylococcus aureus
NKQFDKEI

SEQ ID NO: 1629697 - protein, 11 aa, Staphylococcus aureus
NKQNFNSAKTT

SEQ ID NO: 1629698 - protein, 4 aa, Staphylococcus aureus
NKRI

SEQ ID NO: 1629699 - protein, 17 aa, Staphylococcus aureus
NKYPSELSGGQQQRTAA

SEQ ID NO: 1629700 - protein, 15 aa, Staphylococcus aureus
NLEQSTYKNMTIYDF

SEQ ID NO: 1629701 - protein, 5 aa, Staphylococcus aureus
NLKNE

SEQ ID NO: 1629702 - protein, 6 aa, Staphylococcus aureus
NLNEDD

SEQ ID NO: 1629703 - protein, 5 aa, Staphylococcus aureus
NLNSF

SEQ ID NO: 1629704 - protein, 33 aa, Staphylococcus aureus; identical to SEQ ID NO: 1565587

SEQ ID NO: 1629705 - protein, 9 aa, Staphylococcus aureus
NLRKAKDRA

SEQ ID NO: 1629706 - protein, 4 aa, Staphylococcus aureus
NLSQ

SEQ ID NO: 1629707 - protein, 5 aa, Staphylococcus aureus
NLTPK

SEQ ID NO: 1629708 - protein, 5 aa, Staphylococcus aureus
NLTSN

SEQ ID NO: 1629709 - protein, 7 aa, Staphylococcus aureus
NMSTELK

SEQ ID NO: 1629710 - protein, 21 aa, Staphylococcus aureus
NNAQKADVKSKINAASNIAGV

SEQ ID NO: 1629711 - protein, 6 aa, Staphylococcus aureus
NNDEQF

SEQ ID NO: 1629712 - protein, 11 aa, Staphylococcus aureus
NNDIEKKALNN

SEQ ID NO: 1629713 - protein, 7 aa, Staphylococcus aureus
NNDTAKY

SEQ ID NO: 1629714 - protein, 5 aa, Staphylococcus aureus
NNEDA

SEQ ID NO: 1629715 - protein, 5 aa, Staphylococcus aureus
NNEPI

SEQ ID NO: 1629716 - protein, 6 aa, Staphylococcus aureus
NNGDSV

SEQ ID NO: 1629717 - protein, 7 aa, Staphylococcus aureus
NNIKGFK

SEQ ID NO: 1629718 - protein, 12 aa, Staphylococcus aureus
NNKEQDLSNSAP

SEQ ID NO: 1629719 - protein, 7 aa, Staphylococcus aureus
NNKIQET

SEQ ID NO: 1629720 - protein, 4 aa, Staphylococcus aureus
NNKK

SEQ ID NO: 1629721 - protein, 6 aa, Staphylococcus aureus
NNPKGS

SEQ ID NO: 1629722 - protein, 6 aa, Staphylococcus aureus
NNPNFK

SEQ ID NO: 1629723 - protein, 27 aa, Staphylococcus aureus
NNPTINKGNVSSATQAVISSKNALDGV

SEQ ID NO: 1629724 - protein, 7 aa, Staphylococcus aureus
NNPYEGG

SEQ ID NO: 1629725 - protein, 9 aa, Staphylococcus aureus
NNQASPYTK

SEQ ID NO: 1629726 - protein, 7 aa, Staphylococcus aureus
NNQKQEF

SEQ ID NO: 1629727 - protein, 9 aa, Staphylococcus aureus
NNQLEEEKK

SEQ ID NO: 1629728 - protein, 6 aa, Staphylococcus aureus
NNQSPK

SEQ ID NO: 1629729 - protein, 22 aa, Staphylococcus aureus
NNRDNISKGDKVVTSGLADQLP

SEQ ID NO: 1629730 - protein, 4 aa, Staphylococcus aureus
NNSK

SEQ ID NO: 1629731 - protein, 5 aa, Staphylococcus aureus
NNSPQ

SEQ ID NO: 1629732 - protein, 11 aa, Staphylococcus aureus
NNSQATNKRLE

SEQ ID NO: 1629733 - protein, 6 aa, Staphylococcus aureus
NNTQKL

SEQ ID NO: 1629734 - protein, 10 aa, Staphylococcus aureus
NNVNKSLKGL

SEQ ID NO: 1629735 - protein, 22 aa, Staphylococcus aureus
NNVQGCSDMGSMPDKITGYQSI

SEQ ID NO: 1629736 - protein, 4 aa, Staphylococcus aureus
NPDF

SEQ ID NO: 1629737 - protein, 6 aa, Staphylococcus aureus
NPDSAV

SEQ ID NO: 1629738 - protein, 6 aa, Staphylococcus aureus
NPERQN

SEQ ID NO: 1629739 - protein, 11 aa, Staphylococcus aureus
NPKKKDTREIE

SEQ ID NO: 1629740 - protein, 10 aa, Staphylococcus aureus
NPKVGKDNHE

SEQ ID NO: 1629741 - protein, 8 aa, Staphylococcus aureus
NPNDERYK

SEQ ID NO: 1629742 - protein, 12 aa, Staphylococcus aureus
NPPEVTTRRTHG

SEQ ID NO: 1629743 - protein, 6 aa, Staphylococcus aureus
NPRATV

SEQ ID NO: 1629744 - protein, 7 aa, Staphylococcus aureus
NPSSKGL

SEQ ID NO: 1629745 - protein, 6 aa, Staphylococcus aureus
NPWEGL

SEQ ID NO: 1629746 - protein, 7 aa, Staphylococcus aureus
NQALTNY

SEQ ID NO: 1629747 - protein, 4 aa, Staphylococcus aureus
NQDE

SEQ ID NO: 1629748 - protein, 9 aa, Staphylococcus aureus
NQDTDNIGA

SEQ ID NO: 1629749 - protein, 7 aa, Staphylococcus aureus
NQFNKKQ

SEQ ID NO: 1629750 - protein, 6 aa, Staphylococcus aureus
NQIVSR

SEQ ID NO: 1629751 - protein, 9 aa, Staphylococcus aureus
NQKEHSAIH

SEQ ID NO: 1629752 - protein, 10 aa, Staphylococcus aureus
NQKEHSAIHT

SEQ ID NO: 1629753 - protein, 17 aa, Staphylococcus aureus
NQKQEQLAKKGNGDRVD

SEQ ID NO: 1629754 - protein, 4 aa, Staphylococcus aureus
NQLG

SEQ ID NO: 1629755 - protein, 15 aa, Staphylococcus aureus
NQMPHSQITQPTHQV

SEQ ID NO: 1629756 - protein, 7 aa, Staphylococcus aureus
NQQADNM

SEQ ID NO: 1629757 - protein, 6 aa, Staphylococcus aureus
NQQEDV

SEQ ID NO: 1629758 - protein, 10 aa, Staphylococcus aureus
NQTNQLSAKK

SEQ ID NO: 1629759 - protein, 14 aa, Staphylococcus aureus
NQTTNPTLNPDDIT

SEQ ID NO: 1629760 - protein, 13 aa, Staphylococcus aureus
NQTTNPTLNPDEI

SEQ ID NO: 1629761 - protein, 30 aa, Staphylococcus aureus; identical to SEQ ID NO: 1568327

SEQ ID NO: 1629762 - protein, 13 aa, Staphylococcus aureus
NQVSTTASELNTA

SEQ ID NO: 1629763 - protein, 7 aa, Staphylococcus aureus
NRDIKGD

SEQ ID NO: 1629764 - protein, 25 aa, Staphylococcus aureus
NRDKPSEEDSAKDNSVDDQQLEQDR

SEQ ID NO: 1629765 - protein, 4 aa, Staphylococcus aureus
NRDL

SEQ ID NO: 1629766 - protein, 7 aa, Staphylococcus aureus
NRDNAQA

SEQ ID NO: 1629767 - protein, 8 aa, Staphylococcus aureus
NREKEWKK

SEQ ID NO: 1629768 - protein, 15 aa, Staphylococcus aureus
NRGDKLIEEVVRELY

SEQ ID NO: 1629769 - protein, 13 aa, Staphylococcus aureus
NRGVERTNKSAVE

SEQ ID NO: 1629770 - protein, 4 aa, Staphylococcus aureus
NRKG

SEQ ID NO: 1629771 - protein, 6 aa, Staphylococcus aureus
NRNPKI

SEQ ID NO: 1629772 - protein, 5 aa, Staphylococcus aureus
NRQQM

SEQ ID NO: 1629773 - protein, 9 aa, Staphylococcus aureus
NRSADAKKI

SEQ ID NO: 1629774 - protein, 6 aa, Staphylococcus aureus
NSAGIK

SEQ ID NO: 1629775 - protein, 7 aa, Staphylococcus aureus
NSAKERI

SEQ ID NO: 1629776 - protein, 15 aa, Staphylococcus aureus
NSDGQVTAEAQGIAT

SEQ ID NO: 1629777 - protein, 4 aa, Staphylococcus aureus
NSDR

SEQ ID NO: 1629778 - protein, 19 aa, Staphylococcus aureus
NSEDDKTKRDALYKILYET

SEQ ID NO: 1629779 - protein, 51 aa, Staphylococcus aureus
NSEDEEMLENTATNDTGASQTTIDDQVEAPMSSNDSEEVMSDSTKTDTNVL

SEQ ID NO: 1629780 - protein, 6 aa, Staphylococcus aureus
NSEQYG

SEQ ID NO: 1629781 - protein, 5 aa, Staphylococcus aureus
NSERY

SEQ ID NO: 1629782 - protein, 9 aa, Staphylococcus aureus
NSGGKKLSK

SEQ ID NO: 1629783 - protein, 11 aa, Staphylococcus aureus
NSGKDYKHLDK

SEQ ID NO: 1629784 - protein, 12 aa, Staphylococcus aureus
NSGQISEDKAKK

SEQ ID NO: 1629785 - protein, 47 aa, Staphylococcus aureus; identical to SEQ ID NO: 1565139

SEQ ID NO: 1629786 - protein, 6 aa, Staphylococcus aureus
NSKGLT

SEQ ID NO: 1629787 - protein, 5 aa, Staphylococcus aureus
NSMAA

SEQ ID NO: 1629788 - protein, 16 aa, Staphylococcus aureus
NSMTTEYGRGTGAYGD

SEQ ID NO: 1629789 - protein, 10 aa, Staphylococcus aureus
NSNNPYPPNL

SEQ ID NO: 1629790 - protein, 5 aa, Staphylococcus aureus
NSPEF

SEQ ID NO: 1629791 - protein, 19 aa, Staphylococcus aureus
NSQLDEQNKVTSIDEYKES

SEQ ID NO: 1629792 - protein, 33 aa, Staphylococcus aureus
NSQNDVDQAKTTGENSIDQVTPTVNKKATARNE

SEQ ID NO: 1629793 - protein, 8 aa, Staphylococcus aureus
NSRTTNGY

SEQ ID NO: 1629794 - protein, 8 aa, Staphylococcus aureus
NSSASGSP

SEQ ID NO: 1629795 - protein, 4 aa, Staphylococcus aureus
NSTS

SEQ ID NO: 1629796 - protein, 5 aa, Staphylococcus aureus
NTAAN

SEQ ID NO: 1629797 - protein, 7 aa, Staphylococcus aureus
NTDAEGR

SEQ ID NO: 1629798 - protein, 10 aa, Staphylococcus aureus
NTEIENKNMQ

SEQ ID NO: 1629799 - protein, 6 aa, Staphylococcus aureus
NTEKAR

SEQ ID NO: 1629800 - protein, 4 aa, Staphylococcus aureus
NTFT

SEQ ID NO: 1629801 - protein, 5 aa, Staphylococcus aureus
NTINQ

SEQ ID NO: 1629802 - protein, 8 aa, Staphylococcus aureus
NTKKATGY

SEQ ID NO: 1629803 - protein, 11 aa, Staphylococcus aureus
NTKSVETRDMQ

SEQ ID NO: 1629804 - protein, 7 aa, Staphylococcus aureus
NTNLGRD

SEQ ID NO: 1629805 - protein, 8 aa, Staphylococcus aureus
NTRTATGY

SEQ ID NO: 1629806 - protein, 7 aa, Staphylococcus aureus
NTRTTKG

SEQ ID NO: 1629807 - protein, 15 aa, Staphylococcus aureus
NTTEILGEDDVEGVK

SEQ ID NO: 1629808 - protein, 4 aa, Staphylococcus aureus
NTYR

SEQ ID NO: 1629809 - protein, 4 aa, Staphylococcus aureus
NVDD

SEQ ID NO: 1629810 - protein, 4 aa, Staphylococcus aureus
NVDE

SEQ ID NO: 1629811 - protein, 4 aa, Staphylococcus aureus
NVER

SEQ ID NO: 1629812 - protein, 8 aa, Staphylococcus aureus
NVGGLPED

SEQ ID NO: 1629813 - protein, 8 aa, Staphylococcus aureus
NVLPSEVE

SEQ ID NO: 1629814 - protein, 6 aa, Staphylococcus aureus
NVNIGA

SEQ ID NO: 1629815 - protein, 7 aa, Staphylococcus aureus
NVPAAIK

SEQ ID NO: 1629816 - protein, 5 aa, Staphylococcus aureus
NVPYK

SEQ ID NO: 1629817 - protein, 12 aa, Staphylococcus aureus
NVSQQSLNTEPN

SEQ ID NO: 1629818 - protein, 8 aa, Staphylococcus aureus
NVTSGDVG

SEQ ID NO: 1629819 - protein, 15 aa, Staphylococcus aureus
NYDDEIDNESGEDSI

SEQ ID NO: 1629820 - protein, 10 aa, Staphylococcus aureus
NYDQEDAEVQ

SEQ ID NO: 1629821 - protein, 8 aa, Staphylococcus aureus
NYENGREY

SEQ ID NO: 1629822 - protein, 12 aa, Staphylococcus aureus
NYERKKEKQSVL

SEQ ID NO: 1629823 - protein, 11 aa, Staphylococcus aureus
NYINEGEGARK

SEQ ID NO: 1629824 - protein, 10 aa, Staphylococcus aureus
NYKDLSNDAK

SEQ ID NO: 1629825 - protein, 39 aa, Staphylococcus aureus
NYKDTHSYKDRLNAQQKVNTLSEGHQKRFNKQINKVYNG

SEQ ID NO: 1629826 - protein, 9 aa, Staphylococcus aureus
NYPRGVSTN

SEQ ID NO: 1629827 - protein, 8 aa, Staphylococcus aureus
NYQGQGIA

SEQ ID NO: 1629828 - protein, 14 aa, Staphylococcus aureus
NYRRPGTGAYPLRG

SEQ ID NO: 1629829 - protein, 5 aa, Staphylococcus aureus
NYRSG

SEQ ID NO: 1629830 - protein, 12 aa, Staphylococcus aureus
NYRSSSMSKARI

SEQ ID NO: 1629831 - protein, 12 aa, Staphylococcus aureus
NYSEDAQRKMTR

SEQ ID NO: 1629832 - protein, 10 aa, Staphylococcus aureus
NYYEPKESDF

SEQ ID NO: 1629833 - protein, 6 aa, Staphylococcus aureus
PAADPE

SEQ ID NO: 1629834 - protein, 12 aa, Staphylococcus aureus
PADKRTDSVPGE

SEQ ID NO: 1629835 - protein, 20 aa, Staphylococcus aureus
PAQKLKSPDDIKKELNKKKG

SEQ ID NO: 1629836 - protein, 26 aa, Staphylococcus aureus
PATEEAIGKVAKGNKADVDKAVEAAD

SEQ ID NO: 1629837 - protein, 10 aa, Staphylococcus aureus
PDEEIGRGPH

SEQ ID NO: 1629838 - protein, 5 aa, Staphylococcus aureus
PDKPF

SEQ ID NO: 1629839 - protein, 4 aa, Staphylococcus aureus
PDRD

SEQ ID NO: 1629840 - protein, 14 aa, Staphylococcus aureus
PDSFSDGGKFNNVE

SEQ ID NO: 1629841 - protein, 5 aa, Staphylococcus aureus
PDYEE

SEQ ID NO: 1629842 - protein, 5 aa, Staphylococcus aureus
PEDQR

SEQ ID NO: 1629843 - protein, 9 aa, Staphylococcus aureus
PEESDTVNT

SEQ ID NO: 1629844 - protein, 8 aa, Staphylococcus aureus
PEHIENSP

SEQ ID NO: 1629845 - protein, 7 aa, Staphylococcus aureus
PEKAHGL

SEQ ID NO: 1629846 - protein, 7 aa, Staphylococcus aureus
PETSGIG

SEQ ID NO: 1629847 - protein, 14 aa, Staphylococcus aureus
PEVETSFEEEGKTL

SEQ ID NO: 1629848 - protein, 7 aa, Staphylococcus aureus
PFTTPEG

SEQ ID NO: 1629849 - protein, 13 aa, Staphylococcus aureus
PGCGKTGSFNSFC

SEQ ID NO: 1629850 - protein, 9 aa, Staphylococcus aureus
PGDKGQLAL

SEQ ID NO: 1629851 - protein, 12 aa, Staphylococcus aureus
PGGGVKEQTAGM

SEQ ID NO: 1629852 - protein, 27 aa, Staphylococcus aureus
PGIRPKGASQNDQHRITTPEEARQLGS

SEQ ID NO: 1629853 - protein, 8 aa, Staphylococcus aureus
PGTGKTFT

SEQ ID NO: 1629854 - protein, 4 aa, Staphylococcus aureus
PGVE

SEQ ID NO: 1629855 - protein, 9 aa, Staphylococcus aureus
PGVGSDRRS

SEQ ID NO: 1629856 - protein, 14 aa, Staphylococcus aureus
PHPPVSKKEAAEKD

SEQ ID NO: 1629857 - protein, 7 aa, Staphylococcus aureus
PHSDEKV

SEQ ID NO: 1629858 - protein, 5 aa, Staphylococcus aureus
PIDAN

SEQ ID NO: 1629859 - protein, 6 aa, Staphylococcus aureus
PIGNQR

SEQ ID NO: 1629860 - protein, 10 aa, Staphylococcus aureus
PIGSNAGGIK

SEQ ID NO: 1629861 - protein, 11 aa, Staphylococcus aureus
PIKKEDKQEVR

SEQ ID NO: 1629862 - protein, 16 aa, Staphylococcus aureus
PISTDNASWGGAQHRS

SEQ ID NO: 1629863 - protein, 13 aa, Staphylococcus aureus
PITDRFDDNDKEH

SEQ ID NO: 1629864 - protein, 8 aa, Staphylococcus aureus
PKDLQYEH

SEQ ID NO: 1629865 - protein, 56 aa, Staphylococcus aureus
PKEEPKSKPVVEPMAPKKQQETKPMTEKPITVPKAEPVEQKHRPSRQDNSDEIRRQ

SEQ ID NO: 1629866 - protein, 7 aa, Staphylococcus aureus
PKEKTYG

SEQ ID NO: 1629867 - protein, 7 aa, Staphylococcus aureus
PKEMETS

SEQ ID NO: 1629868 - protein, 6 aa, Staphylococcus aureus
PKGTEH

SEQ ID NO: 1629869 - protein, 14 aa, Staphylococcus aureus
PKKMTKIGKPYYKT

SEQ ID NO: 1629870 - protein, 20 aa, Staphylococcus aureus
PKKPNKKRKTKYFGGKVKSD

SEQ ID NO: 1629871 - protein, 38 aa, Staphylococcus aureus
PKNTDDNQQDLYQQQAQQTRGQSQYSNNKPVKDNPFAN

SEQ ID NO: 1629872 - protein, 11 aa, Staphylococcus aureus
PKQDGSEPNNW

SEQ ID NO: 1629873 - protein, 6 aa, Staphylococcus aureus
PKTKAS

SEQ ID NO: 1629874 - protein, 9 aa, Staphylococcus aureus
PKTPNNDNV

SEQ ID NO: 1629875 - protein, 8 aa, Staphylococcus aureus
PLLGENGA

SEQ ID NO: 1629876 - protein, 4 aa, Staphylococcus aureus
PLPY

SEQ ID NO: 1629877 - protein, 7 aa, Staphylococcus aureus
PLSNDDE

SEQ ID NO: 1629878 - protein, 5 aa, Staphylococcus aureus
PLYGD

SEQ ID NO: 1629879 - protein, 11 aa, Staphylococcus aureus
PMGSPRPRFRK

SEQ ID NO: 1629880 - protein, 13 aa, Staphylococcus aureus
PMGSPRPRFSTKG

SEQ ID NO: 1629881 - protein, 7 aa, Staphylococcus aureus
PNAEKRF

SEQ ID NO: 1629882 - protein, 4 aa, Staphylococcus aureus
PNDM

SEQ ID NO: 1629883 - protein, 5 aa, Staphylococcus aureus
PNEGV

SEQ ID NO: 1629884 - protein, 4 aa, Staphylococcus aureus
PNNK

SEQ ID NO: 1629885 - protein, 14 aa, Staphylococcus aureus
PNNTSNGTYHSSQY

SEQ ID NO: 1629886 - protein, 15 aa, Staphylococcus aureus
PPESWSKKKKAQAIG

SEQ ID NO: 1629887 - protein, 8 aa, Staphylococcus aureus
PPLSPTLT

SEQ ID NO: 1629888 - protein, 15 aa, Staphylococcus aureus
PQCSKHSINTTPSNM

SEQ ID NO: 1629889 - protein, 8 aa, Staphylococcus aureus
PQGSKDVK

SEQ ID NO: 1629890 - protein, 5 aa, Staphylococcus aureus
PQHAK

SEQ ID NO: 1629891 - protein, 6 aa, Staphylococcus aureus
PQSVKG

SEQ ID NO: 1629892 - protein, 18 aa, Staphylococcus aureus
PQVSMTDSGGRVKPLPIQ

SEQ ID NO: 1629893 - protein, 12 aa, Staphylococcus aureus
PRHKKDDQTNLN

SEQ ID NO: 1629894 - protein, 17 aa, Staphylococcus aureus
PRKAKPFNTKYCINREQ

SEQ ID NO: 1629895 - protein, 8 aa, Staphylococcus aureus
PSGESGKI

SEQ ID NO: 1629896 - protein, 10 aa, Staphylococcus aureus
PSKKEGEPDK

SEQ ID NO: 1629897 - protein, 16 aa, Staphylococcus aureus
PSKQDMKDVRGTMKDG

SEQ ID NO: 1629898 - protein, 8 aa, Staphylococcus aureus
PSRTISDV

SEQ ID NO: 1629899 - protein, 9 aa, Staphylococcus aureus
PSSRGLSTR

SEQ ID NO: 1629900 - protein, 10 aa, Staphylococcus aureus
PSSTNPTLPY

SEQ ID NO: 1629901 - protein, 8 aa, Staphylococcus aureus
PTDLGENC

SEQ ID NO: 1629902 - protein, 11 aa, Staphylococcus aureus
PTDSGLAQIGP

SEQ ID NO: 1629903 - protein, 14 aa, Staphylococcus aureus
PTEEIKDEKLKKEI

SEQ ID NO: 1629904 - protein, 5 aa, Staphylococcus aureus
PTEEQ

SEQ ID NO: 1629905 - protein, 4 aa, Staphylococcus aureus
PTES

SEQ ID NO: 1629906 - protein, 7 aa, Staphylococcus aureus
PTKKTME

SEQ ID NO: 1629907 - protein, 10 aa, Staphylococcus aureus
PTKPLPNDKL

SEQ ID NO: 1629908 - protein, 8 aa, Staphylococcus aureus
PTKTHSDI

SEQ ID NO: 1629909 - protein, 9 aa, Staphylococcus aureus
PTNKEQQKI

SEQ ID NO: 1629910 - protein, 17 aa, Staphylococcus aureus
PTQEAGNKMTEAEKREY

SEQ ID NO: 1629911 - protein, 4 aa, Staphylococcus aureus
PTRL

SEQ ID NO: 1629912 - protein, 7 aa, Staphylococcus aureus
PTSYGKT

SEQ ID NO: 1629913 - protein, 19 aa, Staphylococcus aureus
PTTYEASGGSDDTREGTVM

SEQ ID NO: 1629914 - protein, 7 aa, Staphylococcus aureus
PVESTRK

SEQ ID NO: 1629915 - protein, 9 aa, Staphylococcus aureus
PVGAGKTQL

SEQ ID NO: 1629916 - protein, 4 aa, Staphylococcus aureus
PVSE

SEQ ID NO: 1629917 - protein, 5 aa, Staphylococcus aureus
PVSST

SEQ ID NO: 1629918 - protein, 14 aa, Staphylococcus aureus
PWESYNDVKEHGQL

SEQ ID NO: 1629919 - protein, 4 aa, Staphylococcus aureus
PYQR

SEQ ID NO: 1629920 - protein, 15 aa, Staphylococcus aureus
PYTNYGRPNSKYEKM

SEQ ID NO: 1629921 - protein, 9 aa, Staphylococcus aureus
QAANDGNQV

SEQ ID NO: 1629922 - protein, 8 aa, Staphylococcus aureus
QAATTLND

SEQ ID NO: 1629923 - protein, 9 aa, Staphylococcus aureus
QAKNKKLQS

SEQ ID NO: 1629924 - protein, 11 aa, Staphylococcus aureus
QAKQTAKQQLN

SEQ ID NO: 1629925 - protein, 11 aa, Staphylococcus aureus
QANYPLNEGQA

SEQ ID NO: 1629926 - protein, 4 aa, Staphylococcus aureus
QAPA

SEQ ID NO: 1629927 - protein, 15 aa, Staphylococcus aureus
QAPAIEQKYDTMSND

SEQ ID NO: 1629928 - protein, 6 aa, Staphylococcus aureus
QAQTEH

SEQ ID NO: 1629929 - protein, 5 aa, Staphylococcus aureus
QARTE

SEQ ID NO: 1629930 - protein, 4 aa, Staphylococcus aureus
QATR

SEQ ID NO: 1629931 - protein, 12 aa, Staphylococcus aureus
QATRSAKHKSEQ

SEQ ID NO: 1629932 - protein, 8 aa, Staphylococcus aureus
QDEPNEQV

SEQ ID NO: 1629933 - protein, 27 aa, Staphylococcus aureus
QDIEEKEKAKVKDTGEAYQSLNDNEKL

SEQ ID NO: 1629934 - protein, 18 aa, Staphylococcus aureus
QDIENNQNLKVSKESGFR

SEQ ID NO: 1629935 - protein, 10 aa, Staphylococcus aureus
QDKEATQRAR

SEQ ID NO: 1629936 - protein, 4 aa, Staphylococcus aureus
QDPL

SEQ ID NO: 1629937 - protein, 5 aa, Staphylococcus aureus
QDSGE

SEQ ID NO: 1629938 - protein, 9 aa, Staphylococcus aureus
QDVKNKGVT

SEQ ID NO: 1629939 - protein, 14 aa, Staphylococcus aureus
QEAGMTKQQSSKRA

SEQ ID NO: 1629940 - protein, 14 aa, Staphylococcus aureus
QEAGMTKQQSSTRA

SEQ ID NO: 1629941 - protein, 15 aa, Staphylococcus aureus
QEDMNDKYKISAKRT

SEQ ID NO: 1629942 - protein, 8 aa, Staphylococcus aureus
QEDTTKLL

SEQ ID NO: 1629943 - protein, 6 aa, Staphylococcus aureus
QEEHDK

SEQ ID NO: 1629944 - protein, 14 aa, Staphylococcus aureus
QEKDFDNVSQAGRE

SEQ ID NO: 1629945 - protein, 6 aa, Staphylococcus aureus
QEKIEA

SEQ ID NO: 1629946 - protein, 6 aa, Staphylococcus aureus
QEKVAN

SEQ ID NO: 1629947 - protein, 4 aa, Staphylococcus aureus
QEKY

SEQ ID NO: 1629948 - protein, 8 aa, Staphylococcus aureus
QENKKEIN

SEQ ID NO: 1629949 - protein, 8 aa, Staphylococcus aureus
QEQKDKVI

SEQ ID NO: 1629950 - protein, 15 aa, Staphylococcus aureus
QESNEVGDEISKDNI

SEQ ID NO: 1629951 - protein, 12 aa, Staphylococcus aureus
QETKKFQTSLNP

SEQ ID NO: 1629952 - protein, 7 aa, Staphylococcus aureus
QFDNDRT

SEQ ID NO: 1629953 - protein, 5 aa, Staphylococcus aureus
QFIPG

SEQ ID NO: 1629954 - protein, 9 aa, Staphylococcus aureus
QFTEKSKHF

SEQ ID NO: 1629955 - protein, 10 aa, Staphylococcus aureus
QGAGGHDGHY

SEQ ID NO: 1629956 - protein, 9 aa, Staphylococcus aureus
QGGMTNASK

SEQ ID NO: 1629957 - protein, 5 aa, Staphylococcus aureus
QGKAA

SEQ ID NO: 1629958 - protein, 12 aa, Staphylococcus aureus
QGKVAAEEVIAE

SEQ ID NO: 1629959 - protein, 15 aa, Staphylococcus aureus
QGLNTSYETAEKVKH

SEQ ID NO: 1629960 - protein, 22 aa, Staphylococcus aureus
QGTSNEAINPNNPLKSSGFGDD

SEQ ID NO: 1629961 - protein, 7 aa, Staphylococcus aureus
QGYRSID

SEQ ID NO: 1629962 - protein, 7 aa, Staphylococcus aureus
QHHPDDE

SEQ ID NO: 1629963 - protein, 5 aa, Staphylococcus aureus
QHREP

SEQ ID NO: 1629964 - protein, 20 aa, Staphylococcus aureus
QHTDDYDATETIDASGKVVS

SEQ ID NO: 1629965 - protein, 17 aa, Staphylococcus aureus
QIATAKQNIDQATKLQP

SEQ ID NO: 1629966 - protein, 6 aa, Staphylococcus aureus
QIGNDR

SEQ ID NO: 1629967 - protein, 4 aa, Staphylococcus aureus
QIYN

SEQ ID NO: 1629968 - protein, 9 aa, Staphylococcus aureus
QKAEPTGID

SEQ ID NO: 1629969 - protein, 6 aa, Staphylococcus aureus
QKFKGA

SEQ ID NO: 1629970 - protein, 14 aa, Staphylococcus aureus
QKFNASKSKELETI

SEQ ID NO: 1629971 - protein, 5 aa, Staphylococcus aureus
QKFST

SEQ ID NO: 1629972 - protein, 11 aa, Staphylococcus aureus
QKGKHYGATWQ

SEQ ID NO: 1629973 - protein, 7 aa, Staphylococcus aureus
QKKTVQD

SEQ ID NO: 1629974 - protein, 10 aa, Staphylococcus aureus
QKNDKHQTSE

SEQ ID NO: 1629975 - protein, 18 aa, Staphylococcus aureus
QKPPQKTSTDNEPKKGGF

SEQ ID NO: 1629976 - protein, 10 aa, Staphylococcus aureus
QKRANGGSYE

SEQ ID NO: 1629977 - protein, 4 aa, Staphylococcus aureus
QLPD

SEQ ID NO: 1629978 - protein, 11 aa, Staphylococcus aureus
QLYPGAPKGQF

SEQ ID NO: 1629979 - protein, 15 aa, Staphylococcus aureus
QMTQPVKKGMKEKGV

SEQ ID NO: 1629980 - protein, 19 aa, Staphylococcus aureus
QNDGKDDIKITRSSKLRET

SEQ ID NO: 1629981 - protein, 5 aa, Staphylococcus aureus
QNDGY

SEQ ID NO: 1629982 - protein, 18 aa, Staphylococcus aureus
QNEEDNEEDEENEEEVNN

SEQ ID NO: 1629983 - protein, 8 aa, Staphylococcus aureus
QNELDERQ

SEQ ID NO: 1629984 - protein, 4 aa, Staphylococcus aureus
QNEV

SEQ ID NO: 1629985 - protein, 12 aa, Staphylococcus aureus
QNFQSSGCVGQA

SEQ ID NO: 1629986 - protein, 5 aa, Staphylococcus aureus
QNGEA

SEQ ID NO: 1629987 - protein, 36 aa, Staphylococcus aureus; identical to SEQ ID NO: 1565940

SEQ ID NO: 1629988 - protein, 4 aa, Staphylococcus aureus
QNHY

SEQ ID NO: 1629989 - protein, 8 aa, Staphylococcus aureus
QNINDSHS

SEQ ID NO: 1629990 - protein, 6 aa, Staphylococcus aureus
QNIREK

SEQ ID NO: 1629991 - protein, 12 aa, Staphylococcus aureus
QNKPYNTKGVIV

SEQ ID NO: 1629992 - protein, 7 aa, Staphylococcus aureus
QNMDTAT

SEQ ID NO: 1629993 - protein, 7 aa, Staphylococcus aureus
QNNKIRE

SEQ ID NO: 1629994 - protein, 7 aa, Staphylococcus aureus
QNNNGLS

SEQ ID NO: 1629995 - protein, 5 aa, Staphylococcus aureus
QNNYE

SEQ ID NO: 1629996 - protein, 9 aa, Staphylococcus aureus
QNPEATAVA

SEQ ID NO: 1629997 - protein, 34 aa, Staphylococcus aureus
QNQLTTKIDSNSESLKAIQTSQEAIQEAQASQAK

SEQ ID NO: 1629998 - protein, 4 aa, Staphylococcus aureus
QNQV

SEQ ID NO: 1629999 - protein, 20 aa, Staphylococcus aureus
QNSEQNLLNTATDIARILKL

SEQ ID NO: 1630000 - protein, 4 aa, Staphylococcus aureus
QNTL

SEQ ID NO: 1630001 - protein, 16 aa, Staphylococcus aureus
QNYGKQNALEQSEHTI

SEQ ID NO: 1630002 - protein, 5 aa, Staphylococcus aureus
QPDHR

SEQ ID NO: 1630003 - protein, 13 aa, Staphylococcus aureus
QPKENLAEVLDKH

SEQ ID NO: 1630004 - protein, 6 aa, Staphylococcus aureus
QPMKRN

SEQ ID NO: 1630005 - protein, 14 aa, Staphylococcus aureus
QPSGSIKDQDSIDM

SEQ ID NO: 1630006 - protein, 14 aa, Staphylococcus aureus
QPSHVNVNEITVRP

SEQ ID NO: 1630007 - protein, 9 aa, Staphylococcus aureus
QPSSSTPLS

SEQ ID NO: 1630008 - protein, 9 aa, Staphylococcus aureus
QQALENNQP

SEQ ID NO: 1630009 - protein, 10 aa, Staphylococcus aureus
QQEERESYQQ

SEQ ID NO: 1630010 - protein, 4 aa, Staphylococcus aureus
QQIR

SEQ ID NO: 1630011 - protein, 6 aa, Staphylococcus aureus
QQLEDE

SEQ ID NO: 1630012 - protein, 43 aa, Staphylococcus aureus
QQLKKPRDPEEEERLRKRHEERKRRKVEQDRKLKEKLEKRKAQ

SEQ ID NO: 1630013 - protein, 6 aa, Staphylococcus aureus
QQMEQD

SEQ ID NO: 1630014 - protein, 7 aa, Staphylococcus aureus
QQPYNAN

SEQ ID NO: 1630015 - protein, 7 aa, Staphylococcus aureus
QQYSTDN

SEQ ID NO: 1630016 - protein, 6 aa, Staphylococcus aureus
QRANYT

SEQ ID NO: 1630017 - protein, 9 aa, Staphylococcus aureus
QRDTLNQRK

SEQ ID NO: 1630018 - protein, 17 aa, Staphylococcus aureus
QREYQGNGEVKDVPASM

SEQ ID NO: 1630019 - protein, 17 aa, Staphylococcus aureus
QRGDADAMITGGTEAPI

SEQ ID NO: 1630020 - protein, 6 aa, Staphylococcus aureus
QRGGKG

SEQ ID NO: 1630021 - protein, 21 aa, Staphylococcus aureus
QRGHGRSEGKRAFYSNSNEIV

SEQ ID NO: 1630022 - protein, 7 aa, Staphylococcus aureus
QRIDEPD

SEQ ID NO: 1630023 - protein, 11 aa, Staphylococcus aureus
QRLIDEESGEV

SEQ ID NO: 1630024 - protein, 6 aa, Staphylococcus aureus
QRPPGH

SEQ ID NO: 1630025 - protein, 11 aa, Staphylococcus aureus
QRRNIQDTEDL

SEQ ID NO: 1630026 - protein, 14 aa, Staphylococcus aureus
QSAASLSNFESSAK

SEQ ID NO: 1630027 - protein, 9 aa, Staphylococcus aureus
QSADNQTAV

SEQ ID NO: 1630028 - protein, 28 aa, Staphylococcus aureus
QSDDPDEPGGDGKKGNPDKKENDEGTEI

SEQ ID NO: 1630029 - protein, 21 aa, Staphylococcus aureus
QSDNYVNADTNKKNDYNNAYN

SEQ ID NO: 1630030 - protein, 57 aa, Staphylococcus aureus
QSEQGRNQHQNDIKPTSKQHQSNINPTSKQHQTNTNNNDNKDNNEKNVNNEKKKAAA

SEQ ID NO: 1630031 - protein, 55 aa, Staphylococcus aureus
QSEQGRNQHQNDIKPTSKQHQSNINPTSKQHQTNTNNNDNKDNNEKNVNNEKKKV

SEQ ID NO: 1630032 - protein, 7 aa, Staphylococcus aureus
QSERATY

SEQ ID NO: 1630033 - protein, 4 aa, Staphylococcus aureus
QSGP

SEQ ID NO: 1630034 - protein, 5 aa, Staphylococcus aureus
QSGPT

SEQ ID NO: 1630035 - protein, 34 aa, Staphylococcus aureus; identical to SEQ ID NO: 1567206

SEQ ID NO: 1630036 - protein, 9 aa, Staphylococcus aureus
QSISPGLRK

SEQ ID NO: 1630037 - protein, 6 aa, Staphylococcus aureus
QSPLTY

SEQ ID NO: 1630038 - protein, 12 aa, Staphylococcus aureus
QSRHKDAEADFN

SEQ ID NO: 1630039 - protein, 6 aa, Staphylococcus aureus
QSTSYQ

SEQ ID NO: 1630040 - protein, 45 aa, Staphylococcus aureus
QTADATTEEKEQANQQVDAQLTQGNQNIENAQSIDDVNTAKDNAI

SEQ ID NO: 1630041 - protein, 10 aa, Staphylococcus aureus
QTDVPESSDW

SEQ ID NO: 1630042 - protein, 8 aa, Staphylococcus aureus
QTHGIPTG

SEQ ID NO: 1630043 - protein, 18 aa, Staphylococcus aureus
QTLNNEGKTVEIMDDIDS

SEQ ID NO: 1630044 - protein, 6 aa, Staphylococcus aureus
QTLRDE

SEQ ID NO: 1630045 - protein, 6 aa, Staphylococcus aureus
QTNHTE

SEQ ID NO: 1630046 - protein, 7 aa, Staphylococcus aureus
QTQIATQ

SEQ ID NO: 1630047 - protein, 7 aa, Staphylococcus aureus
QTTTSEI

SEQ ID NO: 1630048 - protein, 6 aa, Staphylococcus aureus
QTVTQT

SEQ ID NO: 1630049 - protein, 10 aa, Staphylococcus aureus
QVGDGPQQRE

SEQ ID NO: 1630050 - protein, 4 aa, Staphylococcus aureus
QVIE

SEQ ID NO: 1630051 - protein, 9 aa, Staphylococcus aureus
QVNEAREKA

SEQ ID NO: 1630052 - protein, 14 aa, Staphylococcus aureus
QVNQAKGDLNGNHN

SEQ ID NO: 1630053 - protein, 11 aa, Staphylococcus aureus
QVNSLGDDVKE

SEQ ID NO: 1630054 - protein, 25 aa, Staphylococcus aureus
QVQQTRGQSQYSNNKPVKDNPFANA

SEQ ID NO: 1630055 - protein, 7 aa, Staphylococcus aureus
QVQSSNY

SEQ ID NO: 1630056 - protein, 17 aa, Staphylococcus aureus
QVSMTDSGGRVKPLPIQ

SEQ ID NO: 1630057 - protein, 19 aa, Staphylococcus aureus
QVSMTDSGGRVKPLPVQNP

SEQ ID NO: 1630058 - protein, 17 aa, Staphylococcus aureus
QYEENECKKQEQLNEEI

SEQ ID NO: 1630059 - protein, 11 aa, Staphylococcus aureus
QYNANERNQIN

SEQ ID NO: 1630060 - protein, 11 aa, Staphylococcus aureus
RAEYEQERKRR

SEQ ID NO: 1630061 - protein, 5 aa, Staphylococcus aureus
RALAD

SEQ ID NO: 1630062 - protein, 15 aa, Staphylococcus aureus
RALERANNRLRVAEL

SEQ ID NO: 1630063 - protein, 14 aa, Staphylococcus aureus
RALNEEQEVTKSLP

SEQ ID NO: 1630064 - protein, 5 aa, Staphylococcus aureus
RANVQ

SEQ ID NO: 1630065 - protein, 7 aa, Staphylococcus aureus
RAPKVEL

SEQ ID NO: 1630066 - protein, 6 aa, Staphylococcus aureus
RAQSKD

SEQ ID NO: 1630067 - protein, 16 aa, Staphylococcus aureus
RAQSNARKLAKKCQSL

SEQ ID NO: 1630068 - protein, 4 aa, Staphylococcus aureus
RARQ

SEQ ID NO: 1630069 - protein, 4 aa, Staphylococcus aureus
RASI

SEQ ID NO: 1630070 - protein, 6 aa, Staphylococcus aureus
RATPLT

SEQ ID NO: 1630071 - protein, 43 aa, Staphylococcus aureus
RAVTPQNHVTHGPKDSMVRSEGKHSVSSHEINSSKYVESPNYT

SEQ ID NO: 1630072 - protein, 11 aa, Staphylococcus aureus
RDDVGMSKAQS

SEQ ID NO: 1630073 - protein, 4 aa, Staphylococcus aureus
RDGD

SEQ ID NO: 1630074 - protein, 5 aa, Staphylococcus aureus
RDLSD

SEQ ID NO: 1630075 - protein, 8 aa, Staphylococcus aureus
RDMSDSEL

SEQ ID NO: 1630076 - protein, 23 aa, Staphylococcus aureus
RDRNGEFKQQTVPAYRRTNDTLE

SEQ ID NO: 1630077 - protein, 21 aa, Staphylococcus aureus
RDRSEVISAKEEAIQLRKHRR

SEQ ID NO: 1630078 - protein, 9 aa, Staphylococcus aureus
RDSQSVETA

SEQ ID NO: 1630079 - protein, 15 aa, Staphylococcus aureus
RDTSKLEKVATPFPR

SEQ ID NO: 1630080 - protein, 5 aa, Staphylococcus aureus
REDNL

SEQ ID NO: 1630081 - protein, 11 aa, Staphylococcus aureus
REESNTNMQLS

SEQ ID NO: 1630082 - protein, 5 aa, Staphylococcus aureus
REETR

SEQ ID NO: 1630083 - protein, 6 aa, Staphylococcus aureus
REEWEK

SEQ ID NO: 1630084 - protein, 7 aa, Staphylococcus aureus
REFNNEA

SEQ ID NO: 1630085 - protein, 8 aa, Staphylococcus aureus
REHDRDAS

SEQ ID NO: 1630086 - protein, 6 aa, Staphylococcus aureus
RELGND

SEQ ID NO: 1630087 - protein, 7 aa, Staphylococcus aureus
RENIGKP

SEQ ID NO: 1630088 - protein, 7 aa, Staphylococcus aureus
RENIGQP

SEQ ID NO: 1630089 - protein, 19 aa, Staphylococcus aureus
RESKEREIARQRRKEVELR

SEQ ID NO: 1630090 - protein, 7 aa, Staphylococcus aureus
RESYTSK

SEQ ID NO: 1630091 - protein, 6 aa, Staphylococcus aureus
RETTVQ

SEQ ID NO: 1630092 - protein, 15 aa, Staphylococcus aureus
RFGKPKAFAEVNGET

SEQ ID NO: 1630093 - protein, 4 aa, Staphylococcus aureus
RFKD

SEQ ID NO: 1630094 - protein, 5 aa, Staphylococcus aureus
RGATS

SEQ ID NO: 1630095 - protein, 6 aa, Staphylococcus aureus
RGEESQ

SEQ ID NO: 1630096 - protein, 16 aa, Staphylococcus aureus
RGELTQNGFTSLETSE

SEQ ID NO: 1630097 - protein, 5 aa, Staphylococcus aureus
RGGLG

SEQ ID NO: 1630098 - protein, 6 aa, Staphylococcus aureus
RGGLGE

SEQ ID NO: 1630099 - protein, 17 aa, Staphylococcus aureus
RGKDGGYLSNDRSADVS

SEQ ID NO: 1630100 - protein, 7 aa, Staphylococcus aureus
RGKENFN

SEQ ID NO: 1630101 - protein, 12 aa, Staphylococcus aureus
RGKERSRRPEDI

SEQ ID NO: 1630102 - protein, 14 aa, Staphylococcus aureus
RGLTDATKATIETE

SEQ ID NO: 1630103 - protein, 5 aa, Staphylococcus aureus
RGTFA

SEQ ID NO: 1630104 - protein, 10 aa, Staphylococcus aureus
RIENGKKPRI

SEQ ID NO: 1630105 - protein, 15 aa, Staphylococcus aureus
RIQKENEINKTYQAQ

SEQ ID NO: 1630106 - protein, 17 aa, Staphylococcus aureus
RKAAQSLELDERPLDEI

SEQ ID NO: 1630107 - protein, 13 aa, Staphylococcus aureus
RKDRSSKDKQYKM

SEQ ID NO: 1630108 - protein, 9 aa, Staphylococcus aureus
RKEAGSWSD

SEQ ID NO: 1630109 - protein, 9 aa, Staphylococcus aureus
RKGYNLNDD

SEQ ID NO: 1630110 - protein, 5 aa, Staphylococcus aureus
RKKGV

SEQ ID NO: 1630111 - protein, 9 aa, Staphylococcus aureus
RKKKNSIHY

SEQ ID NO: 1630112 - protein, 15 aa, Staphylococcus aureus
RKLERKRKRGTRRKL

SEQ ID NO: 1630113 - protein, 8 aa, Staphylococcus aureus
RKRDNESF

SEQ ID NO: 1630114 - protein, 7 aa, Staphylococcus aureus
RKTHNQG

SEQ ID NO: 1630115 - protein, 7 aa, Staphylococcus aureus
RKVAEKA

SEQ ID NO: 1630116 - protein, 5 aa, Staphylococcus aureus
RKYEE

SEQ ID NO: 1630117 - protein, 13 aa, Staphylococcus aureus
RKYGGGAIASTQQ

SEQ ID NO: 1630118 - protein, 7 aa, Staphylococcus aureus
RLGSGQQ

SEQ ID NO: 1630119 - protein, 9 aa, Staphylococcus aureus
RLKEQGANA

SEQ ID NO: 1630120 - protein, 26 aa, Staphylococcus aureus
RLKSTDANRYVKNPQTAHIEILLEKS

SEQ ID NO: 1630121 - protein, 12 aa, Staphylococcus aureus
RLPDGRWPSQTE

SEQ ID NO: 1630122 - protein, 12 aa, Staphylococcus aureus
RLSKNGLRAKRQ

SEQ ID NO: 1630123 - protein, 5 aa, Staphylococcus aureus
RLVGP

SEQ ID NO: 1630124 - protein, 5 aa, Staphylococcus aureus
RMSQT

SEQ ID NO: 1630125 - protein, 8 aa, Staphylococcus aureus
RNDQPDLE

SEQ ID NO: 1630126 - protein, 6 aa, Staphylococcus aureus
RNEITP

SEQ ID NO: 1630127 - protein, 5 aa, Staphylococcus aureus
RNPDQ

SEQ ID NO: 1630128 - protein, 5 aa, Staphylococcus aureus
RNRTQ

SEQ ID NO: 1630129 - protein, 15 aa, Staphylococcus aureus
RPKKTTRIGKPYYKT

SEQ ID NO: 1630130 - protein, 16 aa, Staphylococcus aureus
RQDKGIHRDNEKKYPV

SEQ ID NO: 1630131 - protein, 14 aa, Staphylococcus aureus
RQEAAEQSKWTRQK

SEQ ID NO: 1630132 - protein, 7 aa, Staphylococcus aureus
RQGLNKP

SEQ ID NO: 1630133 - protein, 6 aa, Staphylococcus aureus
RQNLDQ

SEQ ID NO: 1630134 - protein, 8 aa, Staphylococcus aureus
RQPENEVQ

SEQ ID NO: 1630135 - protein, 4 aa, Staphylococcus aureus
RQRI

SEQ ID NO: 1630136 - protein, 6 aa, Staphylococcus aureus
RQRSQY

SEQ ID NO: 1630137 - protein, 9 aa, Staphylococcus aureus
RRDKPGYAQ

SEQ ID NO: 1630138 - protein, 6 aa, Staphylococcus aureus
RRDSEY

SEQ ID NO: 1630139 - protein, 7 aa, Staphylococcus aureus
RSDNAIR

SEQ ID NO: 1630140 - protein, 11 aa, Staphylococcus aureus
RSGDYARNNKK

SEQ ID NO: 1630141 - protein, 6 aa, Staphylococcus aureus
RSHADE

SEQ ID NO: 1630142 - protein, 8 aa, Staphylococcus aureus
RSTTPLST

SEQ ID NO: 1630143 - protein, 12 aa, Staphylococcus aureus
RSVSKSGTIQEV

SEQ ID NO: 1630144 - protein, 18 aa, Staphylococcus aureus
RSVSTISREISRNNLNQS

SEQ ID NO: 1630145 - protein, 8 aa, Staphylococcus aureus
RTAGVSEI

SEQ ID NO: 1630146 - protein, 6 aa, Staphylococcus aureus
RTEGLK

SEQ ID NO: 1630147 - protein, 9 aa, Staphylococcus aureus
RTENPDTKT

SEQ ID NO: 1630148 - protein, 4 aa, Staphylococcus aureus
RTGD

SEQ ID NO: 1630149 - protein, 11 aa, Staphylococcus aureus
RTHKSKTKHNS

SEQ ID NO: 1630150 - protein, 8 aa, Staphylococcus aureus
RTHNDELN

SEQ ID NO: 1630151 - protein, 12 aa, Staphylococcus aureus
RTLNYSKNQIFL

SEQ ID NO: 1630152 - protein, 4 aa, Staphylococcus aureus
RTLS

SEQ ID NO: 1630153 - protein, 6 aa, Staphylococcus aureus
RTRASL

SEQ ID NO: 1630154 - protein, 4 aa, Staphylococcus aureus
RTSQ

SEQ ID NO: 1630155 - protein, 6 aa, Staphylococcus aureus
RTYSAT

SEQ ID NO: 1630156 - protein, 4 aa, Staphylococcus aureus
RVKE

SEQ ID NO: 1630157 - protein, 9 aa, Staphylococcus aureus
RVKTGADLT

SEQ ID NO: 1630158 - protein, 13 aa, Staphylococcus aureus
RYAGENKSDEANI

SEQ ID NO: 1630159 - protein, 7 aa, Staphylococcus aureus
RYRSNNE

SEQ ID NO: 1630160 - protein, 14 aa, Staphylococcus aureus
RYSRSVKGTKPIFK

SEQ ID NO: 1630161 - protein, 11 aa, Staphylococcus aureus
SACNGNDTEGL

SEQ ID NO: 1630162 - protein, 4 aa, Staphylococcus aureus
SADS

SEQ ID NO: 1630163 - protein, 14 aa, Staphylococcus aureus
SAFDKSEKSMKKYQ

SEQ ID NO: 1630164 - protein, 8 aa, Staphylococcus aureus
SAGPIRTL

SEQ ID NO: 1630165 - protein, 17 aa, Staphylococcus aureus
SAISEKAIERKTGARGL

SEQ ID NO: 1630166 - protein, 23 aa, Staphylococcus aureus
SALDNGGVNESKLATEPHNEIKD

SEQ ID NO: 1630167 - protein, 13 aa, Staphylococcus aureus
SAMPKAKGTTSNK

SEQ ID NO: 1630168 - protein, 6 aa, Staphylococcus aureus
SAPALK

SEQ ID NO: 1630169 - protein, 8 aa, Staphylococcus aureus
SAPATGDL

SEQ ID NO: 1630170 - protein, 6 aa, Staphylococcus aureus
SAVPEH

SEQ ID NO: 1630171 - protein, 15 aa, Staphylococcus aureus
SAVTPVKQDKLSKGK

SEQ ID NO: 1630172 - protein, 6 aa, Staphylococcus aureus
SCDETS

SEQ ID NO: 1630173 - protein, 7 aa, Staphylococcus aureus
SCPSGAM

SEQ ID NO: 1630174 - protein, 10 aa, Staphylococcus aureus
SDDRKLRESA

SEQ ID NO: 1630175 - protein, 7 aa, Staphylococcus aureus
SDGGKTF

SEQ ID NO: 1630176 - protein, 8 aa, Staphylococcus aureus
SDIDAQTG

SEQ ID NO: 1630177 - protein, 7 aa, Staphylococcus aureus
SDKEIGN

SEQ ID NO: 1630178 - protein, 10 aa, Staphylococcus aureus
SDKPTGESTR

SEQ ID NO: 1630179 - protein, 15 aa, Staphylococcus aureus
SDKQMNDQRDMTNKS

SEQ ID NO: 1630180 - protein, 9 aa, Staphylococcus aureus
SDKTKDQFN

SEQ ID NO: 1630181 - protein, 31 aa, Staphylococcus aureus
SDKTSVDSASTRGPTASDEKPSIVTEKSPFT

SEQ ID NO: 1630182 - protein, 4 aa, Staphylococcus aureus
SDNE

SEQ ID NO: 1630183 - protein, 4 aa, Staphylococcus aureus
SDPG

SEQ ID NO: 1630184 - protein, 17 aa, Staphylococcus aureus
SDRITVDDNATQLSKDL

SEQ ID NO: 1630185 - protein, 14 aa, Staphylococcus aureus
SDSINESKAVSSKY

SEQ ID NO: 1630186 - protein, 9 aa, Staphylococcus aureus
SDSLDSAER

SEQ ID NO: 1630187 - protein, 4 aa, Staphylococcus aureus
SDSY

SEQ ID NO: 1630188 - protein, 27 aa, Staphylococcus aureus
SDTGWEVSEQTEYDGLRTTSWTSYQTR

SEQ ID NO: 1630189 - protein, 12 aa, Staphylococcus aureus
SDVIDDDNKLQD

SEQ ID NO: 1630190 - protein, 7 aa, Staphylococcus aureus
SDVYPTI

SEQ ID NO: 1630191 - protein, 16 aa, Staphylococcus aureus
SDYEAEPPLFLFSGSL

SEQ ID NO: 1630192 - protein, 14 aa, Staphylococcus aureus
SEASGIDISDDGYY

SEQ ID NO: 1630193 - protein, 10 aa, Staphylococcus aureus
SEASGTEIKY

SEQ ID NO: 1630194 - protein, 4 aa, Staphylococcus aureus
SEDA

SEQ ID NO: 1630195 - protein, 6 aa, Staphylococcus aureus
SEEVAR

SEQ ID NO: 1630196 - protein, 7 aa, Staphylococcus aureus
SEGRTRA

SEQ ID NO: 1630197 - protein, 8 aa, Staphylococcus aureus
SEGTAYRA

SEQ ID NO: 1630198 - protein, 6 aa, Staphylococcus aureus
SEHDQA

SEQ ID NO: 1630199 - protein, 4 aa, Staphylococcus aureus
SEIG

SEQ ID NO: 1630200 - protein, 8 aa, Staphylococcus aureus
SEKLPYRA

SEQ ID NO: 1630201 - protein, 5 aa, Staphylococcus aureus
SENAG

SEQ ID NO: 1630202 - protein, 9 aa, Staphylococcus aureus
SENARTTIK

SEQ ID NO: 1630203 - protein, 8 aa, Staphylococcus aureus
SERAEKFR

SEQ ID NO: 1630204 - protein, 20 aa, Staphylococcus aureus
SERTGQSIEKIQKDTDRDNF

SEQ ID NO: 1630205 - protein, 10 aa, Staphylococcus aureus
SESGTGAGVR

SEQ ID NO: 1630206 - protein, 8 aa, Staphylococcus aureus
SFGTGKSH

SEQ ID NO: 1630207 - protein, 8 aa, Staphylococcus aureus
SFKENGDW

SEQ ID NO: 1630208 - protein, 8 aa, Staphylococcus aureus
SFMPREDQ

SEQ ID NO: 1630209 - protein, 18 aa, Staphylococcus aureus
SFNASGVEDIGLKDGDSL

SEQ ID NO: 1630210 - protein, 7 aa, Staphylococcus aureus
SFRENYG

SEQ ID NO: 1630211 - protein, 14 aa, Staphylococcus aureus
SGAHGKARQITKSI

SEQ ID NO: 1630212 - protein, 11 aa, Staphylococcus aureus
SGDIKGSSVGY

SEQ ID NO: 1630213 - protein, 12 aa, Staphylococcus aureus
SGDQSQNKDNYK

SEQ ID NO: 1630214 - protein, 10 aa, Staphylococcus aureus
SGKGGVGKST

SEQ ID NO: 1630215 - protein, 11 aa, Staphylococcus aureus
SGKKIGGSDTP

SEQ ID NO: 1630216 - protein, 4 aa, Staphylococcus aureus
SGKP

SEQ ID NO: 1630217 - protein, 7 aa, Staphylococcus aureus
SGKSANE

SEQ ID NO: 1630218 - protein, 14 aa, Staphylococcus aureus
SGQQYGKRERGEIP

SEQ ID NO: 1630219 - protein, 11 aa, Staphylococcus aureus
SGSLPKGLNQD

SEQ ID NO: 1630220 - protein, 20 aa, Staphylococcus aureus
SGSTYKEAVQNTFGNETNYE

SEQ ID NO: 1630221 - protein, 6 aa, Staphylococcus aureus
SGTGDR

SEQ ID NO: 1630222 - protein, 4 aa, Staphylococcus aureus
SGTT

SEQ ID NO: 1630223 - protein, 9 aa, Staphylococcus aureus
SHESGIHQD

SEQ ID NO: 1630224 - protein, 8 aa, Staphylococcus aureus
SHIETGEN

SEQ ID NO: 1630225 - protein, 7 aa, Staphylococcus aureus
SHKDNDM

SEQ ID NO: 1630226 - protein, 4 aa, Staphylococcus aureus
SHLS

SEQ ID NO: 1630227 - protein, 11 aa, Staphylococcus aureus
SHQEHFTTQAP

SEQ ID NO: 1630228 - protein, 13 aa, Staphylococcus aureus
SHQGESEGSPRYL

SEQ ID NO: 1630229 - protein, 5 aa, Staphylococcus aureus
SHRPI

SEQ ID NO: 1630230 - protein, 12 aa, Staphylococcus aureus
SIARTGKGTPIK

SEQ ID NO: 1630231 - protein, 7 aa, Staphylococcus aureus
SIKGLSE

SEQ ID NO: 1630232 - protein, 6 aa, Staphylococcus aureus
SINPDT

SEQ ID NO: 1630233 - protein, 12 aa, Staphylococcus aureus
SINSDDAEISEE

SEQ ID NO: 1630234 - protein, 30 aa, Staphylococcus aureus; identical to SEQ ID NO: 1565163

SEQ ID NO: 1630235 - protein, 30 aa, Staphylococcus aureus; identical to SEQ ID NO: 1566479

SEQ ID NO: 1630236 - protein, 32 aa, Staphylococcus aureus; identical to SEQ ID NO: 1564853

SEQ ID NO: 1630237 - protein, 10 aa, Staphylococcus aureus
SIQPNGKDMN

SEQ ID NO: 1630238 - protein, 19 aa, Staphylococcus aureus
SITAKGQKLTIKTSSAYPE

SEQ ID NO: 1630239 - protein, 13 aa, Staphylococcus aureus
SKDFSGKNEAHEV

SEQ ID NO: 1630240 - protein, 10 aa, Staphylococcus aureus
SKDKHPDADK

SEQ ID NO: 1630241 - protein, 6 aa, Staphylococcus aureus
SKDLPK

SEQ ID NO: 1630242 - protein, 10 aa, Staphylococcus aureus
SKDSIQKGDQ

SEQ ID NO: 1630243 - protein, 9 aa, Staphylococcus aureus
SKEENSELS

SEQ ID NO: 1630244 - protein, 9 aa, Staphylococcus aureus
SKEKDDETF

SEQ ID NO: 1630245 - protein, 7 aa, Staphylococcus aureus
SKGDTNY

SEQ ID NO: 1630246 - protein, 9 aa, Staphylococcus aureus
SKGHTNDTD

SEQ ID NO: 1630247 - protein, 24 aa, Staphylococcus aureus
SKGSLAGVDGRLQSRSYENKDGQR

SEQ ID NO: 1630248 - protein, 4 aa, Staphylococcus aureus
SKKI

SEQ ID NO: 1630249 - protein, 5 aa, Staphylococcus aureus
SKKRK

SEQ ID NO: 1630250 - protein, 11 aa, Staphylococcus aureus
SKNKETRNSLN

SEQ ID NO: 1630251 - protein, 7 aa, Staphylococcus aureus
SKNKSLA

SEQ ID NO: 1630252 - protein, 5 aa, Staphylococcus aureus
SKNLS

SEQ ID NO: 1630253 - protein, 5 aa, Staphylococcus aureus
SKPIP

SEQ ID NO: 1630254 - protein, 23 aa, Staphylococcus aureus
SKPVGKTPQGGGNPDSSVTKEKF

SEQ ID NO: 1630255 - protein, 17 aa, Staphylococcus aureus
SKQNSETARKHSKDMAN

SEQ ID NO: 1630256 - protein, 8 aa, Staphylococcus aureus
SKRENSKL

SEQ ID NO: 1630257 - protein, 6 aa, Staphylococcus aureus
SKSELE

SEQ ID NO: 1630258 - protein, 18 aa, Staphylococcus aureus
SKSENIENTVNRFKDFFN

SEQ ID NO: 1630259 - protein, 24 aa, Staphylococcus aureus
SKSNTTKTTVTSTSVFPTKEAAQQ

SEQ ID NO: 1630260 - protein, 7 aa, Staphylococcus aureus
SKTIGRQ

SEQ ID NO: 1630261 - protein, 7 aa, Staphylococcus aureus
SKWQEQW

SEQ ID NO: 1630262 - protein, 9 aa, Staphylococcus aureus
SLAGISGRK

SEQ ID NO: 1630263 - protein, 9 aa, Staphylococcus aureus
SLLQDDKQI

SEQ ID NO: 1630264 - protein, 5 aa, Staphylococcus aureus
SLPQD

SEQ ID NO: 1630265 - protein, 9 aa, Staphylococcus aureus
SLSGGQRQR

SEQ ID NO: 1630266 - protein, 9 aa, Staphylococcus aureus
SLSQEQEVT

SEQ ID NO: 1630267 - protein, 7 aa, Staphylococcus aureus
SLTENYE

SEQ ID NO: 1630268 - protein, 6 aa, Staphylococcus aureus
SNAVKR

SEQ ID NO: 1630269 - protein, 8 aa, Staphylococcus aureus
SNGGNLVA

SEQ ID NO: 1630270 - protein, 19 aa, Staphylococcus aureus
SNGKSNKYNKLQSSLPNEK

SEQ ID NO: 1630271 - protein, 6 aa, Staphylococcus aureus
SNINEA

SEQ ID NO: 1630272 - protein, 4 aa, Staphylococcus aureus
SNIR

SEQ ID NO: 1630273 - protein, 5 aa, Staphylococcus aureus
SNITK

SEQ ID NO: 1630274 - protein, 6 aa, Staphylococcus aureus
SNKEAL

SEQ ID NO: 1630275 - protein, 5 aa, Staphylococcus aureus
SNKQW

SEQ ID NO: 1630276 - protein, 9 aa, Staphylococcus aureus
SNMATESGI

SEQ ID NO: 1630277 - protein, 8 aa, Staphylococcus aureus
SNPTDETM

SEQ ID NO: 1630278 - protein, 4 aa, Staphylococcus aureus
SNQR

SEQ ID NO: 1630279 - protein, 11 aa, Staphylococcus aureus
SNSDITKENGQ

SEQ ID NO: 1630280 - protein, 10 aa, Staphylococcus aureus
SNTFKDSNEL

SEQ ID NO: 1630281 - protein, 7 aa, Staphylococcus aureus
SNTRDAL

SEQ ID NO: 1630282 - protein, 11 aa, Staphylococcus aureus
SNVSTEKRQQV

SEQ ID NO: 1630283 - protein, 14 aa, Staphylococcus aureus
SPAQADGKATNPEQ

SEQ ID NO: 1630284 - protein, 4 aa, Staphylococcus aureus
SPEK

SEQ ID NO: 1630285 - protein, 8 aa, Staphylococcus aureus
SPFNIEGG

SEQ ID NO: 1630286 - protein, 15 aa, Staphylococcus aureus
SPKKTDLAKVNQEQL

SEQ ID NO: 1630287 - protein, 13 aa, Staphylococcus aureus
SPKSQNNEILSDS

SEQ ID NO: 1630288 - protein, 5 aa, Staphylococcus aureus
SPLEH

SEQ ID NO: 1630289 - protein, 10 aa, Staphylococcus aureus
SPNSERADEL

SEQ ID NO: 1630290 - protein, 4 aa, Staphylococcus aureus
SPPI

SEQ ID NO: 1630291 - protein, 13 aa, Staphylococcus aureus
SPPKGGNDKNRKR

SEQ ID NO: 1630292 - protein, 6 aa, Staphylococcus aureus
SPTTNI

SEQ ID NO: 1630293 - protein, 6 aa, Staphylococcus aureus
SPVNDE

SEQ ID NO: 1630294 - protein, 12 aa, Staphylococcus aureus
SQDSYKNKLKRL

SEQ ID NO: 1630295 - protein, 15 aa, Staphylococcus aureus
SQEEFDKKKQQLLGI

SEQ ID NO: 1630296 - protein, 7 aa, Staphylococcus aureus
SQFEDTK

SEQ ID NO: 1630297 - protein, 8 aa, Staphylococcus aureus
SQGLTSDT

SEQ ID NO: 1630298 - protein, 9 aa, Staphylococcus aureus
SQKDKAGKN

SEQ ID NO: 1630299 - protein, 10 aa, Staphylococcus aureus
SQLTPPRQSN

SEQ ID NO: 1630300 - protein, 21 aa, Staphylococcus aureus
SQNEGKSVDALKNSTAPLKNN

SEQ ID NO: 1630301 - protein, 8 aa, Staphylococcus aureus
SQNSNAKY

SEQ ID NO: 1630302 - protein, 12 aa, Staphylococcus aureus
SQRLIDEESGEV

SEQ ID NO: 1630303 - protein, 6 aa, Staphylococcus aureus
SQSSIR

SEQ ID NO: 1630304 - protein, 9 aa, Staphylococcus aureus
SQYDKLKGK

SEQ ID NO: 1630305 - protein, 6 aa, Staphylococcus aureus
SRDFGN

SEQ ID NO: 1630306 - protein, 11 aa, Staphylococcus aureus
SREDKYETKSF

SEQ ID NO: 1630307 - protein, 9 aa, Staphylococcus aureus
SREEAVASS

SEQ ID NO: 1630308 - protein, 7 aa, Staphylococcus aureus
SRGTEKE

SEQ ID NO: 1630309 - protein, 13 aa, Staphylococcus aureus
SRLPDGRWPSQTE

SEQ ID NO: 1630310 - protein, 7 aa, Staphylococcus aureus
SRPAENF

SEQ ID NO: 1630311 - protein, 21 aa, Staphylococcus aureus
SRRGSGANANRGTINKIIGVR

SEQ ID NO: 1630312 - protein, 4 aa, Staphylococcus aureus
SRRL

SEQ ID NO: 1630313 - protein, 7 aa, Staphylococcus aureus
SRVEKSI

SEQ ID NO: 1630314 - protein, 5 aa, Staphylococcus aureus
SRYPQ

SEQ ID NO: 1630315 - protein, 23 aa, Staphylococcus aureus
SSAVRSGKSYAEKEQWTSPDKAI

SEQ ID NO: 1630316 - protein, 19 aa, Staphylococcus aureus
SSDLTEAETQEAQKIKSQL

SEQ ID NO: 1630317 - protein, 4 aa, Staphylococcus aureus
SSEL

SEQ ID NO: 1630318 - protein, 16 aa, Staphylococcus aureus
SSIAQGEAKDLNHAAE

SEQ ID NO: 1630319 - protein, 5 aa, Staphylococcus aureus
SSITI

SEQ ID NO: 1630320 - protein, 5 aa, Staphylococcus aureus
SSKPL

SEQ ID NO: 1630321 - protein, 10 aa, Staphylococcus aureus
SSNDDGTISD

SEQ ID NO: 1630322 - protein, 10 aa, Staphylococcus aureus
SSNNGAVENI

SEQ ID NO: 1630323 - protein, 16 aa, Staphylococcus aureus
SSNNGAVENISKDLPK

SEQ ID NO: 1630324 - protein, 19 aa, Staphylococcus aureus
SSPNPTTAATTEISYGDES

SEQ ID NO: 1630325 - protein, 4 aa, Staphylococcus aureus
SSPT

SEQ ID NO: 1630326 - protein, 9 aa, Staphylococcus aureus
SSQGPQHRE

SEQ ID NO: 1630327 - protein, 17 aa, Staphylococcus aureus
SSRAKNILSQSSPVATQ

SEQ ID NO: 1630328 - protein, 9 aa, Staphylococcus aureus
SSSQYGGCT

SEQ ID NO: 1630329 - protein, 9 aa, Staphylococcus aureus
SSTHRGPSE

SEQ ID NO: 1630330 - protein, 8 aa, Staphylococcus aureus
SSTSAQSY

SEQ ID NO: 1630331 - protein, 5 aa, Staphylococcus aureus
SSYNR

SEQ ID NO: 1630332 - protein, 17 aa, Staphylococcus aureus
STDNASWGGPQHKEILF

SEQ ID NO: 1630333 - protein, 9 aa, Staphylococcus aureus
STEAKTGQA

SEQ ID NO: 1630334 - protein, 5 aa, Staphylococcus aureus
STEDI

SEQ ID NO: 1630335 - protein, 10 aa, Staphylococcus aureus
STETYKKDNI

SEQ ID NO: 1630336 - protein, 7 aa, Staphylococcus aureus
STGRKHT

SEQ ID NO: 1630337 - protein, 7 aa, Staphylococcus aureus
STGRPHE

SEQ ID NO: 1630338 - protein, 7 aa, Staphylococcus aureus
STGVKDV

SEQ ID NO: 1630339 - protein, 7 aa, Staphylococcus aureus
STKGMAE

SEQ ID NO: 1630340 - protein, 9 aa, Staphylococcus aureus
STKSCPYDN

SEQ ID NO: 1630341 - protein, 4 aa, Staphylococcus aureus
STLK

SEQ ID NO: 1630342 - protein, 7 aa, Staphylococcus aureus
STLSGGQ

SEQ ID NO: 1630343 - protein, 4 aa, Staphylococcus aureus
STND

SEQ ID NO: 1630344 - protein, 13 aa, Staphylococcus aureus
STNDVEAKETDTL

SEQ ID NO: 1630345 - protein, 4 aa, Staphylococcus aureus
STNE

SEQ ID NO: 1630346 - protein, 9 aa, Staphylococcus aureus
STNTRAGKL

SEQ ID NO: 1630347 - protein, 8 aa, Staphylococcus aureus
STPTRSSL

SEQ ID NO: 1630348 - protein, 6 aa, Staphylococcus aureus
STRTKC

SEQ ID NO: 1630349 - protein, 14 aa, Staphylococcus aureus
STSEGKPTPGYEST

SEQ ID NO: 1630350 - protein, 6 aa, Staphylococcus aureus
STSSNI

SEQ ID NO: 1630351 - protein, 9 aa, Staphylococcus aureus
SVDPAANPY

SEQ ID NO: 1630352 - protein, 11 aa, Staphylococcus aureus
SVEEKPYNEPG

SEQ ID NO: 1630353 - protein, 9 aa, Staphylococcus aureus
SVEENGLKD

SEQ ID NO: 1630354 - protein, 5 aa, Staphylococcus aureus
SVGKS

SEQ ID NO: 1630355 - protein, 7 aa, Staphylococcus aureus
SVKERQA

SEQ ID NO: 1630356 - protein, 17 aa, Staphylococcus aureus
SVKGGVSKEDTKASSDG

SEQ ID NO: 1630357 - protein, 8 aa, Staphylococcus aureus
SVNPGGGI

SEQ ID NO: 1630358 - protein, 9 aa, Staphylococcus aureus
SVPNKQNIQ

SEQ ID NO: 1630359 - protein, 6 aa, Staphylococcus aureus
SVRARE

SEQ ID NO: 1630360 - protein, 6 aa, Staphylococcus aureus
SVTASA

SEQ ID NO: 1630361 - protein, 10 aa, Staphylococcus aureus
SWKTDQADAH

SEQ ID NO: 1630362 - protein, 15 aa, Staphylococcus aureus
SYAKNPKETKDSYIS

SEQ ID NO: 1630363 - protein, 12 aa, Staphylococcus aureus
SYENLDKDQTYD

SEQ ID NO: 1630364 - protein, 7 aa, Staphylococcus aureus
SYTKSDV

SEQ ID NO: 1630365 - protein, 5 aa, Staphylococcus aureus
TAGYQ

SEQ ID NO: 1630366 - protein, 15 aa, Staphylococcus aureus
TAKKDDKDLNPSSIS

SEQ ID NO: 1630367 - protein, 5 aa, Staphylococcus aureus
TALKG

SEQ ID NO: 1630368 - protein, 9 aa, Staphylococcus aureus
TANTNGEKI

SEQ ID NO: 1630369 - protein, 6 aa, Staphylococcus aureus
TAPQLN

SEQ ID NO: 1630370 - protein, 9 aa, Staphylococcus aureus
TARGEHSEV

SEQ ID NO: 1630371 - protein, 5 aa, Staphylococcus aureus
TASDE

SEQ ID NO: 1630372 - protein, 9 aa, Staphylococcus aureus
TASIDPENE

SEQ ID NO: 1630373 - protein, 18 aa, Staphylococcus aureus
TDAKSDVNQTPVGTGPYQ

SEQ ID NO: 1630374 - protein, 7 aa, Staphylococcus aureus
TDEYENL

SEQ ID NO: 1630375 - protein, 6 aa, Staphylococcus aureus
TDEYGN

SEQ ID NO: 1630376 - protein, 20 aa, Staphylococcus aureus
TDGTRETKTAEVDENLEKDR

SEQ ID NO: 1630377 - protein, 20 aa, Staphylococcus aureus
TDGTRETKTPEVDENLEKDR

SEQ ID NO: 1630378 - protein, 6 aa, Staphylococcus aureus
TDIRDE

SEQ ID NO: 1630379 - protein, 13 aa, Staphylococcus aureus
TDKGMSMDKATKY

SEQ ID NO: 1630380 - protein, 11 aa, Staphylococcus aureus
TDKQYQKHPKT

SEQ ID NO: 1630381 - protein, 5 aa, Staphylococcus aureus
TDPGF

SEQ ID NO: 1630382 - protein, 6 aa, Staphylococcus aureus
TDQAPV

SEQ ID NO: 1630383 - protein, 15 aa, Staphylococcus aureus
TDSEDHSEDSASSLP

SEQ ID NO: 1630384 - protein, 13 aa, Staphylococcus aureus
TDYPAKINSNDID

SEQ ID NO: 1630385 - protein, 24 aa, Staphylococcus aureus
TEASRRALPQKLTHSEAVKSSAIS

SEQ ID NO: 1630386 - protein, 11 aa, Staphylococcus aureus
TEETKQEIKNV

SEQ ID NO: 1630387 - protein, 11 aa, Staphylococcus aureus
TEFENSNDYKD

SEQ ID NO: 1630388 - protein, 4 aa, Staphylococcus aureus
TEGK

SEQ ID NO: 1630389 - protein, 6 aa, Staphylococcus aureus
TEGSGI

SEQ ID NO: 1630390 - protein, 5 aa, Staphylococcus aureus
TEKEN

SEQ ID NO: 1630391 - protein, 6 aa, Staphylococcus aureus
TEKPFK

SEQ ID NO: 1630392 - protein, 14 aa, Staphylococcus aureus
TENNGPEAGEKEEK

SEQ ID NO: 1630393 - protein, 9 aa, Staphylococcus aureus
TERQVEGYS

SEQ ID NO: 1630394 - protein, 5 aa, Staphylococcus aureus
TESEQ

SEQ ID NO: 1630395 - protein, 12 aa, Staphylococcus aureus
TETKSVPEEMEA

SEQ ID NO: 1630396 - protein, 15 aa, Staphylococcus aureus
TEVVETARDSLVIGI

SEQ ID NO: 1630397 - protein, 7 aa, Staphylococcus aureus
TEYKDER

SEQ ID NO: 1630398 - protein, 9 aa, Staphylococcus aureus
TFNEKDQER

SEQ ID NO: 1630399 - protein, 17 aa, Staphylococcus aureus
TFTGGVTPVAKPSDKHY

SEQ ID NO: 1630400 - protein, 11 aa, Staphylococcus aureus
TGAYQVPSDPM

SEQ ID NO: 1630401 - protein, 8 aa, Staphylococcus aureus
TGGYGQDL

SEQ ID NO: 1630402 - protein, 4 aa, Staphylococcus aureus
TGHG

SEQ ID NO: 1630403 - protein, 6 aa, Staphylococcus aureus
TGKQRR

SEQ ID NO: 1630404 - protein, 12 aa, Staphylococcus aureus
TGKSSTSEDANE

SEQ ID NO: 1630405 - protein, 4 aa, Staphylococcus aureus
TGNP

SEQ ID NO: 1630406 - protein, 7 aa, Staphylococcus aureus
TGNQNSV

SEQ ID NO: 1630407 - protein, 9 aa, Staphylococcus aureus
TGNSSDVRQ

SEQ ID NO: 1630408 - protein, 16 aa, Staphylococcus aureus
TGPNPHHNSNSSKGGD

SEQ ID NO: 1630409 - protein, 16 aa, Staphylococcus aureus
TGPNPYNNSNPSKGGV

SEQ ID NO: 1630410 - protein, 22 aa, Staphylococcus aureus
TGTDEHGQKIQEKAQKSGKTEI

SEQ ID NO: 1630411 - protein, 11 aa, Staphylococcus aureus
TGVGKTELAKS

SEQ ID NO: 1630412 - protein, 19 aa, Staphylococcus aureus
TGYPRNDKLSHKRNDTEYI

SEQ ID NO: 1630413 - protein, 8 aa, Staphylococcus aureus
THGKKHTF

SEQ ID NO: 1630414 - protein, 11 aa, Staphylococcus aureus
THRNYDKTANF

SEQ ID NO: 1630415 - protein, 9 aa, Staphylococcus aureus
THSDAQKGI

SEQ ID NO: 1630416 - protein, 12 aa, Staphylococcus aureus
THSEAVKSSAIS

SEQ ID NO: 1630417 - protein, 24 aa, Staphylococcus aureus
THSGSKPTTIKEKKSNANTVKNAI

SEQ ID NO: 1630418 - protein, 8 aa, Staphylococcus aureus
THTPTNAM

SEQ ID NO: 1630419 - protein, 4 aa, Staphylococcus aureus
THYV

SEQ ID NO: 1630420 - protein, 7 aa, Staphylococcus aureus
TIDDVSA

SEQ ID NO: 1630421 - protein, 11 aa, Staphylococcus aureus
TIETNEDFDTM

SEQ ID NO: 1630422 - protein, 6 aa, Staphylococcus aureus
TIGGPN

SEQ ID NO: 1630423 - protein, 5 aa, Staphylococcus aureus
TIKDG

SEQ ID NO: 1630424 - protein, 4 aa, Staphylococcus aureus
TIKN

SEQ ID NO: 1630425 - protein, 24 aa, Staphylococcus aureus
TINEETEPELYDAEGNLINNSKTS

SEQ ID NO: 1630426 - protein, 23 aa, Staphylococcus aureus
TIQERTAMGRRASARKGLAKTVP

SEQ ID NO: 1630427 - protein, 21 aa, Staphylococcus aureus
TISMSQDQSNKVVTNDTNPIS

SEQ ID NO: 1630428 - protein, 7 aa, Staphylococcus aureus
TKANHGK

SEQ ID NO: 1630429 - protein, 14 aa, Staphylococcus aureus
TKAQPSETKAYINV

SEQ ID NO: 1630430 - protein, 5 aa, Staphylococcus aureus
TKCPN

SEQ ID NO: 1630431 - protein, 14 aa, Staphylococcus aureus
TKDPEYRTTPNGVS

SEQ ID NO: 1630432 - protein, 8 aa, Staphylococcus aureus
TKDRTTET

SEQ ID NO: 1630433 - protein, 7 aa, Staphylococcus aureus
TKETKKD

SEQ ID NO: 1630434 - protein, 11 aa, Staphylococcus aureus
TKETQQEINKT

SEQ ID NO: 1630435 - protein, 28 aa, Staphylococcus aureus
TKEYTGQEIAKKTNVSRDTVYRILREFK

SEQ ID NO: 1630436 - protein, 17 aa, Staphylococcus aureus
TKGGNHKDTNPEKEQVD

SEQ ID NO: 1630437 - protein, 6 aa, Staphylococcus aureus
TKGQAL

SEQ ID NO: 1630438 - protein, 8 aa, Staphylococcus aureus
TKKKKGEA

SEQ ID NO: 1630439 - protein, 5 aa, Staphylococcus aureus
TKNGS

SEQ ID NO: 1630440 - protein, 7 aa, Staphylococcus aureus
TKNTVSR

SEQ ID NO: 1630441 - protein, 8 aa, Staphylococcus aureus
TKPNSDEL

SEQ ID NO: 1630442 - protein, 8 aa, Staphylococcus aureus
TKQYPDEY

SEQ ID NO: 1630443 - protein, 19 aa, Staphylococcus aureus
TKRGGTTVTTGLPNPKDNF

SEQ ID NO: 1630444 - protein, 4 aa, Staphylococcus aureus
TKSG

SEQ ID NO: 1630445 - protein, 40 aa, Staphylococcus aureus
TKTEENKANAKSDQQGKVNKPKQQAKTLPDTGMSHNDDLP

SEQ ID NO: 1630446 - protein, 10 aa, Staphylococcus aureus
TKTLNEEAPY

SEQ ID NO: 1630447 - protein, 5 aa, Staphylococcus aureus
TKTPF

SEQ ID NO: 1630448 - protein, 11 aa, Staphylococcus aureus
TKTPYVSTGKD

SEQ ID NO: 1630449 - protein, 5 aa, Staphylococcus aureus
TKVKK

SEQ ID NO: 1630450 - protein, 7 aa, Staphylococcus aureus
TKYTEHK

SEQ ID NO: 1630451 - protein, 5 aa, Staphylococcus aureus
TLAGQ

SEQ ID NO: 1630452 - protein, 6 aa, Staphylococcus aureus
TLESTN

SEQ ID NO: 1630453 - protein, 5 aa, Staphylococcus aureus
TLKDP

SEQ ID NO: 1630454 - protein, 8 aa, Staphylococcus aureus
TLKQTGSL

SEQ ID NO: 1630455 - protein, 4 aa, Staphylococcus aureus
TLPN

SEQ ID NO: 1630456 - protein, 20 aa, Staphylococcus aureus
TMDDAVSDVSSLDEDGAISL

SEQ ID NO: 1630457 - protein, 7 aa, Staphylococcus aureus
TMNPDTR

SEQ ID NO: 1630458 - protein, 7 aa, Staphylococcus aureus
TNAQKEA

SEQ ID NO: 1630459 - protein, 7 aa, Staphylococcus aureus
TNGNKGI

SEQ ID NO: 1630460 - protein, 11 aa, Staphylococcus aureus
TNITNKQISTH

SEQ ID NO: 1630461 - protein, 18 aa, Staphylococcus aureus
TNKSVTNSNDAGVNFELT

SEQ ID NO: 1630462 - protein, 10 aa, Staphylococcus aureus
TNLERSNEHE

SEQ ID NO: 1630463 - protein, 9 aa, Staphylococcus aureus
TNNQSGELT

SEQ ID NO: 1630464 - protein, 11 aa, Staphylococcus aureus
TNPETAESKVN

SEQ ID NO: 1630465 - protein, 4 aa, Staphylococcus aureus
TNQN

SEQ ID NO: 1630466 - protein, 18 aa, Staphylococcus aureus
TNTMDDKGRYVDENGKLI

SEQ ID NO: 1630467 - protein, 7 aa, Staphylococcus aureus
TNTTGQS

SEQ ID NO: 1630468 - protein, 4 aa, Staphylococcus aureus
TNYF

SEQ ID NO: 1630469 - protein, 5 aa, Staphylococcus aureus
TNYTK

SEQ ID NO: 1630470 - protein, 5 aa, Staphylococcus aureus
TPAPY

SEQ ID NO: 1630471 - protein, 8 aa, Staphylococcus aureus
TPDNGSLS

SEQ ID NO: 1630472 - protein, 5 aa, Staphylococcus aureus
TPGIR

SEQ ID NO: 1630473 - protein, 5 aa, Staphylococcus aureus
TPNTS

SEQ ID NO: 1630474 - protein, 5 aa, Staphylococcus aureus
TPPLT

SEQ ID NO: 1630475 - protein, 11 aa, Staphylococcus aureus
TPQDKRLKSDK

SEQ ID NO: 1630476 - protein, 11 aa, Staphylococcus aureus
TPTKLTDRQKE

SEQ ID NO: 1630477 - protein, 9 aa, Staphylococcus aureus
TPVASADSH

SEQ ID NO: 1630478 - protein, 12 aa, Staphylococcus aureus
TPYFQSPEKNRI

SEQ ID NO: 1630479 - protein, 5 aa, Staphylococcus aureus
TPYTF

SEQ ID NO: 1630480 - protein, 6 aa, Staphylococcus aureus
TQAGDI

SEQ ID NO: 1630481 - protein, 11 aa, Staphylococcus aureus
TQDDKNTVNKL

SEQ ID NO: 1630482 - protein, 8 aa, Staphylococcus aureus
TQKERGVG

SEQ ID NO: 1630483 - protein, 8 aa, Staphylococcus aureus
TQNNSYES

SEQ ID NO: 1630484 - protein, 9 aa, Staphylococcus aureus
TQQSSDTTY

SEQ ID NO: 1630485 - protein, 7 aa, Staphylococcus aureus
TQSSSYV

SEQ ID NO: 1630486 - protein, 6 aa, Staphylococcus aureus
TQTQTV

SEQ ID NO: 1630487 - protein, 8 aa, Staphylococcus aureus
TQTQTVTQ

SEQ ID NO: 1630488 - protein, 13 aa, Staphylococcus aureus
TRDPELRTTQNGV

SEQ ID NO: 1630489 - protein, 14 aa, Staphylococcus aureus
TRDPELRTTQSGVN

SEQ ID NO: 1630490 - protein, 5 aa, Staphylococcus aureus
TRGEY

SEQ ID NO: 1630491 - protein, 19 aa, Staphylococcus aureus
TRLKQNKQQITHEENRRNR

SEQ ID NO: 1630492 - protein, 14 aa, Staphylococcus aureus
TRNGSSEKLAVTKN

SEQ ID NO: 1630493 - protein, 11 aa, Staphylococcus aureus
TRPSDTNKRKE

SEQ ID NO: 1630494 - protein, 12 aa, Staphylococcus aureus
TRTPYAKRENGI

SEQ ID NO: 1630495 - protein, 6 aa, Staphylococcus aureus
TRVENQ

SEQ ID NO: 1630496 - protein, 14 aa, Staphylococcus aureus
TRYQNINTAKNTLK

SEQ ID NO: 1630497 - protein, 14 aa, Staphylococcus aureus
TRYQSVNTAKNTLK

SEQ ID NO: 1630498 - protein, 13 aa, Staphylococcus aureus
TSDERVNYIIQKT

SEQ ID NO: 1630499 - protein, 7 aa, Staphylococcus aureus
TSDIEGK

SEQ ID NO: 1630500 - protein, 32 aa, Staphylococcus aureus
TSDQDDDGNEASGKNNNPKQQTRTQWASSETI

SEQ ID NO: 1630501 - protein, 6 aa, Staphylococcus aureus
TSDTDI

SEQ ID NO: 1630502 - protein, 14 aa, Staphylococcus aureus
TSEKTIDRTSNESL

SEQ ID NO: 1630503 - protein, 11 aa, Staphylococcus aureus
TSETVGFRKPH

SEQ ID NO: 1630504 - protein, 9 aa, Staphylococcus aureus
TSGDINNGE

SEQ ID NO: 1630505 - protein, 8 aa, Staphylococcus aureus
TSGVGKST

SEQ ID NO: 1630506 - protein, 7 aa, Staphylococcus aureus
TSKDTKF

SEQ ID NO: 1630507 - protein, 16 aa, Staphylococcus aureus
TSLDGIKRDTKRWKDE

SEQ ID NO: 1630508 - protein, 6 aa, Staphylococcus aureus
TSQEIG

SEQ ID NO: 1630509 - protein, 4 aa, Staphylococcus aureus
TSQK

SEQ ID NO: 1630510 - protein, 7 aa, Staphylococcus aureus
TSSKRYG

SEQ ID NO: 1630511 - protein, 5 aa, Staphylococcus aureus
TTAKI

SEQ ID NO: 1630512 - protein, 15 aa, Staphylococcus aureus
TTDYEKQEQEVPGLQ

SEQ ID NO: 1630513 - protein, 6 aa, Staphylococcus aureus
TTELPL

SEQ ID NO: 1630514 - protein, 9 aa, Staphylococcus aureus
TTERTPYPY

SEQ ID NO: 1630515 - protein, 5 aa, Staphylococcus aureus
TTEVS

SEQ ID NO: 1630516 - protein, 21 aa, Staphylococcus aureus
TTEVTDNAEMTKNIKNDLKSR

SEQ ID NO: 1630517 - protein, 8 aa, Staphylococcus aureus
TTGDKDVE

SEQ ID NO: 1630518 - protein, 6 aa, Staphylococcus aureus
TTGRET

SEQ ID NO: 1630519 - protein, 12 aa, Staphylococcus aureus
TTILGADDKAGL

SEQ ID NO: 1630520 - protein, 21 aa, Staphylococcus aureus
TTMDDAVSDVSSLDEDGAISL

SEQ ID NO: 1630521 - protein, 33 aa, Staphylococcus aureus
TTNDKVDTTRLPNPSTIQQSNKVYSEPSNEIEQ

SEQ ID NO: 1630522 - protein, 6 aa, Staphylococcus aureus
TTNVDK

SEQ ID NO: 1630523 - protein, 6 aa, Staphylococcus aureus
TTPFKK

SEQ ID NO: 1630524 - protein, 7 aa, Staphylococcus aureus
TTQDKAV

SEQ ID NO: 1630525 - protein, 4 aa, Staphylococcus aureus
TTSA

SEQ ID NO: 1630526 - protein, 7 aa, Staphylococcus aureus
TTTTKND

SEQ ID NO: 1630527 - protein, 5 aa, Staphylococcus aureus
TVEKA

SEQ ID NO: 1630528 - protein, 10 aa, Staphylococcus aureus
TVGDETETKE

SEQ ID NO: 1630529 - protein, 12 aa, Staphylococcus aureus
TVKQQGTDLNTA

SEQ ID NO: 1630530 - protein, 7 aa, Staphylococcus aureus
TYGDTPK

SEQ ID NO: 1630531 - protein, 13 aa, Staphylococcus aureus
TYNPKTSKKENTL

SEQ ID NO: 1630532 - protein, 6 aa, Staphylococcus aureus
TYPESQ

SEQ ID NO: 1630533 - protein, 5 aa, Staphylococcus aureus
TYPKV

SEQ ID NO: 1630534 - protein, 8 aa, Staphylococcus aureus
VAATNAAN

SEQ ID NO: 1630535 - protein, 19 aa, Staphylococcus aureus
VAEERQLKTNEVYNIYHQI

SEQ ID NO: 1630536 - protein, 5 aa, Staphylococcus aureus
VAGDG

SEQ ID NO: 1630537 - protein, 6 aa, Staphylococcus aureus
VAGGGT

SEQ ID NO: 1630538 - protein, 5 aa, Staphylococcus aureus
VASKY

SEQ ID NO: 1630539 - protein, 12 aa, Staphylococcus aureus
VASNKGLRQSLA

SEQ ID NO: 1630540 - protein, 6 aa, Staphylococcus aureus
VDDDNT

SEQ ID NO: 1630541 - protein, 8 aa, Staphylococcus aureus
VDDEKDAL

SEQ ID NO: 1630542 - protein, 7 aa, Staphylococcus aureus
VDDEKDM

SEQ ID NO: 1630543 - protein, 8 aa, Staphylococcus aureus
VDEPEDVK

SEQ ID NO: 1630544 - protein, 4 aa, Staphylococcus aureus
VDIT

SEQ ID NO: 1630545 - protein, 7 aa, Staphylococcus aureus
VDKSGAW

SEQ ID NO: 1630546 - protein, 10 aa, Staphylococcus aureus
VDMTTPEPIE

SEQ ID NO: 1630547 - protein, 6 aa, Staphylococcus aureus
VDNGDG

SEQ ID NO: 1630548 - protein, 5 aa, Staphylococcus aureus
VDNKQ

SEQ ID NO: 1630549 - protein, 27 aa, Staphylococcus aureus
VDQVNTDKAQPNYTEASTDKKEAVDQA

SEQ ID NO: 1630550 - protein, 6 aa, Staphylococcus aureus
VDSKTG

SEQ ID NO: 1630551 - protein, 6 aa, Staphylococcus aureus
VEAGRY

SEQ ID NO: 1630552 - protein, 13 aa, Staphylococcus aureus
VEDDHKKPLASST

SEQ ID NO: 1630553 - protein, 8 aa, Staphylococcus aureus
VEEQGITK

SEQ ID NO: 1630554 - protein, 25 aa, Staphylococcus aureus
VEETSNNALNQAKQYVDDKFGTTSW

SEQ ID NO: 1630555 - protein, 11 aa, Staphylococcus aureus
VEKAAGDNNEL

SEQ ID NO: 1630556 - protein, 6 aa, Staphylococcus aureus
VENSKK

SEQ ID NO: 1630557 - protein, 5 aa, Staphylococcus aureus
VEPGS

SEQ ID NO: 1630558 - protein, 16 aa, Staphylococcus aureus
VEPGSYSYSNKNAVNL

SEQ ID NO: 1630559 - protein, 9 aa, Staphylococcus aureus
VEPNRESVI

SEQ ID NO: 1630560 - protein, 6 aa, Staphylococcus aureus
VESSIR

SEQ ID NO: 1630561 - protein, 6 aa, Staphylococcus aureus
VETRDM

SEQ ID NO: 1630562 - protein, 7 aa, Staphylococcus aureus
VGANGEV

SEQ ID NO: 1630563 - protein, 24 aa, Staphylococcus aureus
VGGAPTERNRITNSNKQCKLAGAP

SEQ ID NO: 1630564 - protein, 16 aa, Staphylococcus aureus
VGPNTEAGEKSAYKNV

SEQ ID NO: 1630565 - protein, 6 aa, Staphylococcus aureus
VGQGPS

SEQ ID NO: 1630566 - protein, 12 aa, Staphylococcus aureus
VGSTDQNSNLSE

SEQ ID NO: 1630567 - protein, 5 aa, Staphylococcus aureus
VGTPL

SEQ ID NO: 1630568 - protein, 10 aa, Staphylococcus aureus
VGTTDKTGTV

SEQ ID NO: 1630569 - protein, 6 aa, Staphylococcus aureus
VGVGRR

SEQ ID NO: 1630570 - protein, 19 aa, Staphylococcus aureus
VGVSSEEIKEAIESSFKNS

SEQ ID NO: 1630571 - protein, 8 aa, Staphylococcus aureus
VHAEPTTF

SEQ ID NO: 1630572 - protein, 9 aa, Staphylococcus aureus
VHAQSSIDS

SEQ ID NO: 1630573 - protein, 11 aa, Staphylococcus aureus
VKDDNAKTREL

SEQ ID NO: 1630574 - protein, 6 aa, Staphylococcus aureus
VKDGYA

SEQ ID NO: 1630575 - protein, 7 aa, Staphylococcus aureus
VKEEQPD

SEQ ID NO: 1630576 - protein, 6 aa, Staphylococcus aureus
VKERTA

SEQ ID NO: 1630577 - protein, 12 aa, Staphylococcus aureus
VKGKKTLDQDTF

SEQ ID NO: 1630578 - protein, 9 aa, Staphylococcus aureus
VKKKFDRAK

SEQ ID NO: 1630579 - protein, 9 aa, Staphylococcus aureus
VKLPKGKKP

SEQ ID NO: 1630580 - protein, 14 aa, Staphylococcus aureus
VKPATKPDASWDEM

SEQ ID NO: 1630581 - protein, 5 aa, Staphylococcus aureus
VKPKH

SEQ ID NO: 1630582 - protein, 9 aa, Staphylococcus aureus
VKRKAKAFD

SEQ ID NO: 1630583 - protein, 17 aa, Staphylococcus aureus
VKRSQSIQTDFAHRVFL

SEQ ID NO: 1630584 - protein, 7 aa, Staphylococcus aureus
VKSKGHT

SEQ ID NO: 1630585 - protein, 9 aa, Staphylococcus aureus
VKYKTKNGK

SEQ ID NO: 1630586 - protein, 25 aa, Staphylococcus aureus
VNASIEKRERQESTKVKFRKGGIAI

SEQ ID NO: 1630587 - protein, 7 aa, Staphylococcus aureus
VNDKGDI

SEQ ID NO: 1630588 - protein, 34 aa, Staphylococcus aureus
VNENKKKYGFESATEDKQKKESDNINFESKSDAQ

SEQ ID NO: 1630589 - protein, 21 aa, Staphylococcus aureus
VNENKKKYGFESTTEDKQKKG

SEQ ID NO: 1630590 - protein, 13 aa, Staphylococcus aureus
VNKEAKAFLEQYP

SEQ ID NO: 1630591 - protein, 8 aa, Staphylococcus aureus
VNKGGQLI

SEQ ID NO: 1630592 - protein, 9 aa, Staphylococcus aureus
VNKQRYTSS

SEQ ID NO: 1630593 - protein, 7 aa, Staphylococcus aureus
VNTTTAL

SEQ ID NO: 1630594 - protein, 16 aa, Staphylococcus aureus
VPGKERKNILKGGELN

SEQ ID NO: 1630595 - protein, 8 aa, Staphylococcus aureus
VPMSESEV

SEQ ID NO: 1630596 - protein, 13 aa, Staphylococcus aureus
VPNSNINKVEPGK

SEQ ID NO: 1630597 - protein, 9 aa, Staphylococcus aureus
VPRGTKTAH

SEQ ID NO: 1630598 - protein, 7 aa, Staphylococcus aureus
VPSSSVN

SEQ ID NO: 1630599 - protein, 12 aa, Staphylococcus aureus
VPTLDKNKNHTI

SEQ ID NO: 1630600 - protein, 7 aa, Staphylococcus aureus
VQEIETD

SEQ ID NO: 1630601 - protein, 4 aa, Staphylococcus aureus
VQKD

SEQ ID NO: 1630602 - protein, 7 aa, Staphylococcus aureus
VQPETLR

SEQ ID NO: 1630603 - protein, 12 aa, Staphylococcus aureus
VQSNGKENHKRW

SEQ ID NO: 1630604 - protein, 12 aa, Staphylococcus aureus
VREESNTNIQLS

SEQ ID NO: 1630605 - protein, 18 aa, Staphylococcus aureus
VRGRGGPRCMSQPLFRED

SEQ ID NO: 1630606 - protein, 7 aa, Staphylococcus aureus
VSAAGAS

SEQ ID NO: 1630607 - protein, 10 aa, Staphylococcus aureus
VSEAKKIAKK

SEQ ID NO: 1630608 - protein, 22 aa, Staphylococcus aureus
VSEDGSVDFEDNRYTENTRAAY

SEQ ID NO: 1630609 - protein, 8 aa, Staphylococcus aureus
VSGSSRKI

SEQ ID NO: 1630610 - protein, 15 aa, Staphylococcus aureus
VSKDGKDNLAPYSQY

SEQ ID NO: 1630611 - protein, 20 aa, Staphylococcus aureus
VSNPNVYAAGDAAATDGLPL

SEQ ID NO: 1630612 - protein, 5 aa, Staphylococcus aureus
VSQDA

SEQ ID NO: 1630613 - protein, 7 aa, Staphylococcus aureus
VSQKDYD

SEQ ID NO: 1630614 - protein, 10 aa, Staphylococcus aureus
VSSKSDQLTT

SEQ ID NO: 1630615 - protein, 11 aa, Staphylococcus aureus
VSSNDQNLERQ

SEQ ID NO: 1630616 - protein, 10 aa, Staphylococcus aureus
VTAKKKDSTG

SEQ ID NO: 1630617 - protein, 12 aa, Staphylococcus aureus
VTARESNPKHQE

SEQ ID NO: 1630618 - protein, 15 aa, Staphylococcus aureus
VTASKLSTVTGISRT

SEQ ID NO: 1630619 - protein, 7 aa, Staphylococcus aureus
VTGETSN

SEQ ID NO: 1630620 - protein, 6 aa, Staphylococcus aureus
VTGKEN

SEQ ID NO: 1630621 - protein, 10 aa, Staphylococcus aureus
VTLRETGRLG

SEQ ID NO: 1630622 - protein, 11 aa, Staphylococcus aureus
VTNEAQRRGVA

SEQ ID NO: 1630623 - protein, 7 aa, Staphylococcus aureus
VTRVSEG

SEQ ID NO: 1630624 - protein, 8 aa, Staphylococcus aureus
VVDNGGKI

SEQ ID NO: 1630625 - protein, 7 aa, Staphylococcus aureus
VVERPSS

SEQ ID NO: 1630626 - protein, 7 aa, Staphylococcus aureus
VVNAAGP

SEQ ID NO: 1630627 - protein, 19 aa, Staphylococcus aureus
VVSETTDSKGHATYSDDND

SEQ ID NO: 1630628 - protein, 15 aa, Staphylococcus aureus
WDGQGYKNHKNQNDS

SEQ ID NO: 1630629 - protein, 11 aa, Staphylococcus aureus
WEEDTPFKDPR

SEQ ID NO: 1630630 - protein, 9 aa, Staphylococcus aureus
WLSSSQQKV

SEQ ID NO: 1630631 - protein, 20 aa, Staphylococcus aureus
WNDRAKAEGYKVDKNPEPGA

SEQ ID NO: 1630632 - protein, 7 aa, Staphylococcus aureus
WNKPGRQ

SEQ ID NO: 1630633 - protein, 13 aa, Staphylococcus aureus
WQAIEKKDSRIPM

SEQ ID NO: 1630634 - protein, 16 aa, Staphylococcus aureus
WRENNPDKKGNQRDYA

SEQ ID NO: 1630635 - protein, 8 aa, Staphylococcus aureus
WRGDSNNK

SEQ ID NO: 1630636 - protein, 8 aa, Staphylococcus aureus
YAESQGFK

SEQ ID NO: 1630637 - protein, 11 aa, Staphylococcus aureus
YAKPATSPFND

SEQ ID NO: 1630638 - protein, 4 aa, Staphylococcus aureus
YANE

SEQ ID NO: 1630639 - protein, 16 aa, Staphylococcus aureus
YAPNSDFKGGSPEENL

SEQ ID NO: 1630640 - protein, 4 aa, Staphylococcus aureus
YARG

SEQ ID NO: 1630641 - protein, 12 aa, Staphylococcus aureus
YATGPGGSRATK

SEQ ID NO: 1630642 - protein, 13 aa, Staphylococcus aureus
YATGPGGSRATKI

SEQ ID NO: 1630643 - protein, 7 aa, Staphylococcus aureus
YDEKNSE

SEQ ID NO: 1630644 - protein, 13 aa, Staphylococcus aureus
YDEPEYKEAMDTY

SEQ ID NO: 1630645 - protein, 20 aa, Staphylococcus aureus
YDESTLENDPKVVATEKGYS

SEQ ID NO: 1630646 - protein, 11 aa, Staphylococcus aureus
YDGRTGEPFDN

SEQ ID NO: 1630647 - protein, 17 aa, Staphylococcus aureus
YDKEGSRDGEFKKGDKG

SEQ ID NO: 1630648 - protein, 8 aa, Staphylococcus aureus
YDTTTARS

SEQ ID NO: 1630649 - protein, 9 aa, Staphylococcus aureus
YEAKDGNTY

SEQ ID NO: 1630650 - protein, 11 aa, Staphylococcus aureus
YEAKGEEKTIE

SEQ ID NO: 1630651 - protein, 46 aa, Staphylococcus aureus; identical to SEQ ID NO: 1565053

SEQ ID NO: 1630652 - protein, 4 aa, Staphylococcus aureus
YEPR

SEQ ID NO: 1630653 - protein, 8 aa, Staphylococcus aureus
YESKKDVY

SEQ ID NO: 1630654 - protein, 34 aa, Staphylococcus aureus
YESYKKSLDKNKSTLKQHSKSSTTVRKKNGLSYK

SEQ ID NO: 1630655 - protein, 13 aa, Staphylococcus aureus
YFKPSEDKSKETY

SEQ ID NO: 1630656 - protein, 6 aa, Staphylococcus aureus
YGISAQ

SEQ ID NO: 1630657 - protein, 5 aa, Staphylococcus aureus
YGNPT

SEQ ID NO: 1630658 - protein, 5 aa, Staphylococcus aureus
YGPKS

SEQ ID NO: 1630659 - protein, 14 aa, Staphylococcus aureus
YGPSDFIEDNKNGY

SEQ ID NO: 1630660 - protein, 10 aa, Staphylococcus aureus
YGSNVTAAEI

SEQ ID NO: 1630661 - protein, 4 aa, Staphylococcus aureus
YGTD

SEQ ID NO: 1630662 - protein, 7 aa, Staphylococcus aureus
YHATDNW

SEQ ID NO: 1630663 - protein, 16 aa, Staphylococcus aureus
YKAKKQELEDLESADQ

SEQ ID NO: 1630664 - protein, 8 aa, Staphylococcus aureus
YKDKAGTF

SEQ ID NO: 1630665 - protein, 7 aa, Staphylococcus aureus
YKDNEGK

SEQ ID NO: 1630666 - protein, 12 aa, Staphylococcus aureus
YKEAGKPTYPHE

SEQ ID NO: 1630667 - protein, 8 aa, Staphylococcus aureus
YKKTGDLQ

SEQ ID NO: 1630668 - protein, 9 aa, Staphylococcus aureus
YKQKKKEYH

SEQ ID NO: 1630669 - protein, 10 aa, Staphylococcus aureus
YKQKKKEYHD

SEQ ID NO: 1630670 - protein, 6 aa, Staphylococcus aureus
YKRDED

SEQ ID NO: 1630671 - protein, 7 aa, Staphylococcus aureus
YKRVETQ

SEQ ID NO: 1630672 - protein, 21 aa, Staphylococcus aureus
YKTKNGGSQDVLRNRRCMSEG

SEQ ID NO: 1630673 - protein, 11 aa, Staphylococcus aureus
YMSSNESYHPE

SEQ ID NO: 1630674 - protein, 8 aa, Staphylococcus aureus
YNATTTGE

SEQ ID NO: 1630675 - protein, 8 aa, Staphylococcus aureus
YNIPTEKA

SEQ ID NO: 1630676 - protein, 16 aa, Staphylococcus aureus
YNKDTGKITKNEREVN

SEQ ID NO: 1630677 - protein, 9 aa, Staphylococcus aureus
YNKNKNIKK

SEQ ID NO: 1630678 - protein, 10 aa, Staphylococcus aureus
YNKQHVNEEF

SEQ ID NO: 1630679 - protein, 12 aa, Staphylococcus aureus
YNNEKYQKGKNG

SEQ ID NO: 1630680 - protein, 5 aa, Staphylococcus aureus
YNPFV

SEQ ID NO: 1630681 - protein, 12 aa, Staphylococcus aureus
YNQYNDDQDDVD

SEQ ID NO: 1630682 - protein, 27 aa, Staphylococcus aureus
YNSNFEKEDVPNASNQQSESDLSDEEL

SEQ ID NO: 1630683 - protein, 11 aa, Staphylococcus aureus
YNSRKKYKQDV

SEQ ID NO: 1630684 - protein, 7 aa, Staphylococcus aureus
YNTPFET

SEQ ID NO: 1630685 - protein, 10 aa, Staphylococcus aureus
YPDDDNVLNQ

SEQ ID NO: 1630686 - protein, 14 aa, Staphylococcus aureus
YPDYDYNQETSTDP

SEQ ID NO: 1630687 - protein, 5 aa, Staphylococcus aureus
YPEDD

SEQ ID NO: 1630688 - protein, 11 aa, Staphylococcus aureus
YPESAHQSFKP

SEQ ID NO: 1630689 - protein, 4 aa, Staphylococcus aureus
YPGN

SEQ ID NO: 1630690 - protein, 5 aa, Staphylococcus aureus
YPIPG

SEQ ID NO: 1630691 - protein, 5 aa, Staphylococcus aureus
YPKEK

SEQ ID NO: 1630692 - protein, 5 aa, Staphylococcus aureus
YPQIG

SEQ ID NO: 1630693 - protein, 7 aa, Staphylococcus aureus
YPSDRQE

SEQ ID NO: 1630694 - protein, 6 aa, Staphylococcus aureus
YQAQER

SEQ ID NO: 1630695 - protein, 9 aa, Staphylococcus aureus
YQGGAGALK

SEQ ID NO: 1630696 - protein, 14 aa, Staphylococcus aureus
YQQHDADYHEENMT

SEQ ID NO: 1630697 - protein, 7 aa, Staphylococcus aureus
YQSGHTH

SEQ ID NO: 1630698 - protein, 9 aa, Staphylococcus aureus
YQSKPRKEV

SEQ ID NO: 1630699 - protein, 14 aa, Staphylococcus aureus
YRSTRVYEGIFYEE

SEQ ID NO: 1630700 - protein, 11 aa, Staphylococcus aureus
YRTGKRENIKN

SEQ ID NO: 1630701 - protein, 13 aa, Staphylococcus aureus
YRVPDEERQEETV

SEQ ID NO: 1630702 - protein, 27 aa, Staphylococcus aureus
YSAYSAANAATGKNIVTGRKLSKEERI

SEQ ID NO: 1630703 - protein, 9 aa, Staphylococcus aureus
YSDKNDVMK

SEQ ID NO: 1630704 - protein, 6 aa, Staphylococcus aureus
YSDNND

SEQ ID NO: 1630705 - protein, 11 aa, Staphylococcus aureus
YSEDKTVDSKS

SEQ ID NO: 1630706 - protein, 4 aa, Staphylococcus aureus
YSKE

SEQ ID NO: 1630707 - protein, 13 aa, Staphylococcus aureus
YSRHDQQNYVNGK

SEQ ID NO: 1630708 - protein, 19 aa, Staphylococcus aureus
YSSEKASHSMENGYSSAAT

SEQ ID NO: 1630709 - protein, 7 aa, Staphylococcus aureus
YSYNSTG

SEQ ID NO: 1630710 - protein, 12 aa, Staphylococcus aureus
YSYTQSEFSGRR

SEQ ID NO: 1630711 - protein, 5 aa, Staphylococcus aureus
YTDET

SEQ ID NO: 1630712 - protein, 5 aa, Staphylococcus aureus
YTEGV

SEQ ID NO: 1630713 - protein, 12 aa, Staphylococcus aureus
YTNSKYNIAPDE

SEQ ID NO: 1630714 - protein, 10 aa, Staphylococcus aureus
YTTNKSSILA

SEQ ID NO: 1630715 - protein, 9 aa, Staphylococcus aureus
YTYEADGAT

SEQ ID NO: 1630716 - protein, 5 aa, Staphylococcus aureus
YVSPE

SEQ ID NO: 1630717 - protein, 10 aa, Staphylococcus aureus
YYNPNNNKKK

SEQ ID NO: 1630718 - protein, 20 aa, Staphylococcus aureus
AAEIRSEKSIAKSCSVSATT

SEQ ID NO: 1630719 - protein, 18 aa, Staphylococcus aureus
AAGLTSSSSEMAAKGGSG

SEQ ID NO: 1630720 - protein, 11 aa, Staphylococcus aureus
AAGQGDDTDKH

SEQ ID NO: 1630721 - protein, 32 aa, Staphylococcus aureus; identical to SEQ ID NO: 1565803

SEQ ID NO: 1630722 - protein, 32 aa, Staphylococcus aureus; identical to SEQ ID NO: 1567002

SEQ ID NO: 1630723 - protein, 8 aa, Staphylococcus aureus
AAKQDSKV

SEQ ID NO: 1630724 - protein, 13 aa, Staphylococcus aureus
AAKYGHERYGKTY

SEQ ID NO: 1630725 - protein, 5 aa, Staphylococcus aureus
AANSK

SEQ ID NO: 1630726 - protein, 22 aa, Staphylococcus aureus
AAQSITDPTNGSNANKDAVEQA

SEQ ID NO: 1630727 - protein, 5 aa, Staphylococcus aureus
AARGL

SEQ ID NO: 1630728 - protein, 8 aa, Staphylococcus aureus
AAVTLGTS

SEQ ID NO: 1630729 - protein, 11 aa, Staphylococcus aureus
ACATGTNSIGE

SEQ ID NO: 1630730 - protein, 4 aa, Staphylococcus aureus
ACSL

SEQ ID NO: 1630731 - protein, 8 aa, Staphylococcus aureus
ADAGIQPE

SEQ ID NO: 1630732 - protein, 8 aa, Staphylococcus aureus
ADAKKDIR

SEQ ID NO: 1630733 - protein, 7 aa, Staphylococcus aureus
ADFNNDD

SEQ ID NO: 1630734 - protein, 26 aa, Staphylococcus aureus
ADHSTGGLTIGKDKGYEWNPQPIKSM

SEQ ID NO: 1630735 - protein, 5 aa, Staphylococcus aureus
ADLEK

SEQ ID NO: 1630736 - protein, 10 aa, Staphylococcus aureus
ADNDKDGYRQ

SEQ ID NO: 1630737 - protein, 8 aa, Staphylococcus aureus
ADNGKSTV

SEQ ID NO: 1630738 - protein, 21 aa, Staphylococcus aureus
ADSEEDGAANKEEYSASQIDD

SEQ ID NO: 1630739 - protein, 22 aa, Staphylococcus aureus
ADSYKNQNIDLEPTKKEGWKAR

SEQ ID NO: 1630740 - protein, 27 aa, Staphylococcus aureus
ADTETIGCSPDGYNINEKCGSTHPEKL

SEQ ID NO: 1630741 - protein, 4 aa, Staphylococcus aureus
ADTG

SEQ ID NO: 1630742 - protein, 4 aa, Staphylococcus aureus
AEED

SEQ ID NO: 1630743 - protein, 12 aa, Staphylococcus aureus
AEESFDGDALKF

SEQ ID NO: 1630744 - protein, 9 aa, Staphylococcus aureus
AEGGHTISN

SEQ ID NO: 1630745 - protein, 4 aa, Staphylococcus aureus
AEGL

SEQ ID NO: 1630746 - protein, 6 aa, Staphylococcus aureus
AEGLSV

SEQ ID NO: 1630747 - protein, 10 aa, Staphylococcus aureus
AEHRKAQNYA

SEQ ID NO: 1630748 - protein, 6 aa, Staphylococcus aureus
AEIGKG

SEQ ID NO: 1630749 - protein, 10 aa, Staphylococcus aureus
AEINKTQKRL

SEQ ID NO: 1630750 - protein, 19 aa, Staphylococcus aureus
AEIRSEKSIAKSCSVSATT

SEQ ID NO: 1630751 - protein, 10 aa, Staphylococcus aureus
AEISGGQQQR

SEQ ID NO: 1630752 - protein, 14 aa, Staphylococcus aureus
AEKAQGNDEAHEMD

SEQ ID NO: 1630753 - protein, 6 aa, Staphylococcus aureus
AELQGR

SEQ ID NO: 1630754 - protein, 10 aa, Staphylococcus aureus
AELRTGPNAA

SEQ ID NO: 1630755 - protein, 11 aa, Staphylococcus aureus
AELTDATPAAY

SEQ ID NO: 1630756 - protein, 7 aa, Staphylococcus aureus
AENDDEA

SEQ ID NO: 1630757 - protein, 8 aa, Staphylococcus aureus
AENGYPIT

SEQ ID NO: 1630758 - protein, 12 aa, Staphylococcus aureus
AERDKKAEKDYS

SEQ ID NO: 1630759 - protein, 5 aa, Staphylococcus aureus
AERKQ

SEQ ID NO: 1630760 - protein, 10 aa, Staphylococcus aureus
AERKQNQLST

SEQ ID NO: 1630761 - protein, 27 aa, Staphylococcus aureus
AESKEKAKEKYEVRNKPVDGATNLNDI

SEQ ID NO: 1630762 - protein, 4 aa, Staphylococcus aureus
AESL

SEQ ID NO: 1630763 - protein, 7 aa, Staphylococcus aureus
AESLSNE

SEQ ID NO: 1630764 - protein, 6 aa, Staphylococcus aureus
AETFGK

SEQ ID NO: 1630765 - protein, 7 aa, Staphylococcus aureus
AETGAFG

SEQ ID NO: 1630766 - protein, 6 aa, Staphylococcus aureus
AETKKL

SEQ ID NO: 1630767 - protein, 10 aa, Staphylococcus aureus
AEVGEGDKQE

SEQ ID NO: 1630768 - protein, 6 aa, Staphylococcus aureus
AEVNKG

SEQ ID NO: 1630769 - protein, 4 aa, Staphylococcus aureus
AFDR

SEQ ID NO: 1630770 - protein, 4 aa, Staphylococcus aureus
AFEN

SEQ ID NO: 1630771 - protein, 10 aa, Staphylococcus aureus
AFKEEGHEPW

SEQ ID NO: 1630772 - protein, 6 aa, Staphylococcus aureus
AFKGAD

SEQ ID NO: 1630773 - protein, 5 aa, Staphylococcus aureus
AFNQQ

SEQ ID NO: 1630774 - protein, 15 aa, Staphylococcus aureus
AGARGLLDQESNDFQ

SEQ ID NO: 1630775 - protein, 5 aa, Staphylococcus aureus
AGDLS

SEQ ID NO: 1630776 - protein, 10 aa, Staphylococcus aureus
AGDTEPVKGA

SEQ ID NO: 1630777 - protein, 9 aa, Staphylococcus aureus
AGDYAYANG

SEQ ID NO: 1630778 - protein, 9 aa, Staphylococcus aureus
AGEKPETIL

SEQ ID NO: 1630779 - protein, 14 aa, Staphylococcus aureus
AGFGNGNDAEEKDI

SEQ ID NO: 1630780 - protein, 11 aa, Staphylococcus aureus
AGGAEGAIDAS

SEQ ID NO: 1630781 - protein, 10 aa, Staphylococcus aureus
AGGDKRQYTF

SEQ ID NO: 1630782 - protein, 41 aa, Staphylococcus aureus
AGIEKGSGEPNKTKVATVTKNQVREIANSKMQDLNAADEEA

SEQ ID NO: 1630783 - protein, 5 aa, Staphylococcus aureus
AGIRM

SEQ ID NO: 1630784 - protein, 8 aa, Staphylococcus aureus
AGKTATQI

SEQ ID NO: 1630785 - protein, 15 aa, Staphylococcus aureus
AGNDGIDVNDKQKLN

SEQ ID NO: 1630786 - protein, 10 aa, Staphylococcus aureus
AGNPTKGNET

SEQ ID NO: 1630787 - protein, 4 aa, Staphylococcus aureus
AGNR

SEQ ID NO: 1630788 - protein, 27 aa, Staphylococcus aureus
AGPDKINNYSKSLKNSNGESKKAADLM

SEQ ID NO: 1630789 - protein, 6 aa, Staphylococcus aureus
AGPEFE

SEQ ID NO: 1630790 - protein, 13 aa, Staphylococcus aureus
AGPQHRSWRKVSL

SEQ ID NO: 1630791 - protein, 5 aa, Staphylococcus aureus
AGTIQ

SEQ ID NO: 1630792 - protein, 17 aa, Staphylococcus aureus
AGTTRDAIDTEYSYEGQ

SEQ ID NO: 1630793 - protein, 7 aa, Staphylococcus aureus
AGVGERL

SEQ ID NO: 1630794 - protein, 19 aa, Staphylococcus aureus
AGWKKGKDSDVRQKDGKNL

SEQ ID NO: 1630795 - protein, 6 aa, Staphylococcus aureus
AHGGEI

SEQ ID NO: 1630796 - protein, 8 aa, Staphylococcus aureus
AHGSDDKI

SEQ ID NO: 1630797 - protein, 5 aa, Staphylococcus aureus
AIANQ

SEQ ID NO: 1630798 - protein, 4 aa, Staphylococcus aureus
AIDE

SEQ ID NO: 1630799 - protein, 11 aa, Staphylococcus aureus
AIDEKGQINSE

SEQ ID NO: 1630800 - protein, 10 aa, Staphylococcus aureus
AIDESSQITS

SEQ ID NO: 1630801 - protein, 12 aa, Staphylococcus aureus
AIDKRIKRQRNI

SEQ ID NO: 1630802 - protein, 15 aa, Staphylococcus aureus
AIEGNPTIENGVPTV

SEQ ID NO: 1630803 - protein, 5 aa, Staphylococcus aureus
AIGDH

SEQ ID NO: 1630804 - protein, 9 aa, Staphylococcus aureus
AIGGDTLEQ

SEQ ID NO: 1630805 - protein, 18 aa, Staphylococcus aureus
AINAGQSVSRVGGSAQIN

SEQ ID NO: 1630806 - protein, 7 aa, Staphylococcus aureus
AINNQSE

SEQ ID NO: 1630807 - protein, 15 aa, Staphylococcus aureus
AISDDDDLRIALGTT

SEQ ID NO: 1630808 - protein, 7 aa, Staphylococcus aureus
AITKERI

SEQ ID NO: 1630809 - protein, 11 aa, Staphylococcus aureus
AITSYSQPTVR

SEQ ID NO: 1630810 - protein, 5 aa, Staphylococcus aureus
AKALQ

SEQ ID NO: 1630811 - protein, 14 aa, Staphylococcus aureus
AKDYRQGLQDQVEA

SEQ ID NO: 1630812 - protein, 14 aa, Staphylococcus aureus
AKEAGIYESLLTVN

SEQ ID NO: 1630813 - protein, 5 aa, Staphylococcus aureus
AKGEF

SEQ ID NO: 1630814 - protein, 32 aa, Staphylococcus aureus
AKGMPEGEYDLGGQKVTVQSQQARLANGALAG

SEQ ID NO: 1630815 - protein, 12 aa, Staphylococcus aureus
AKGVSKVNNQTN

SEQ ID NO: 1630816 - protein, 4 aa, Staphylococcus aureus
AKKA

SEQ ID NO: 1630817 - protein, 9 aa, Staphylococcus aureus
AKKGKGSGL

SEQ ID NO: 1630818 - protein, 21 aa, Staphylococcus aureus
AKKPLTTKGCKEEEGYMHRAH

SEQ ID NO: 1630819 - protein, 9 aa, Staphylococcus aureus
AKKYGNLGN

SEQ ID NO: 1630820 - protein, 9 aa, Staphylococcus aureus
AKLRGERSE

SEQ ID NO: 1630821 - protein, 21 aa, Staphylococcus aureus
AKNGYESATSGIENKDKIYNS

SEQ ID NO: 1630822 - protein, 8 aa, Staphylococcus aureus
AKNTGIKS

SEQ ID NO: 1630823 - protein, 13 aa, Staphylococcus aureus
AKNYDGNNGYRSG

SEQ ID NO: 1630824 - protein, 16 aa, Staphylococcus aureus
AKPGHGNIYNPTDEAI

SEQ ID NO: 1630825 - protein, 5 aa, Staphylococcus aureus
AKPKQ

SEQ ID NO: 1630826 - protein, 18 aa, Staphylococcus aureus
AKQDDNVHQSNQKPQVGD

SEQ ID NO: 1630827 - protein, 6 aa, Staphylococcus aureus
AKQTMN

SEQ ID NO: 1630828 - protein, 5 aa, Staphylococcus aureus
AKRVP

SEQ ID NO: 1630829 - protein, 13 aa, Staphylococcus aureus
AKSAEETDNGVKV

SEQ ID NO: 1630830 - protein, 12 aa, Staphylococcus aureus
AKSNKPGELDDE

SEQ ID NO: 1630831 - protein, 11 aa, Staphylococcus aureus
AKTLMEKAGSN

SEQ ID NO: 1630832 - protein, 7 aa, Staphylococcus aureus
AKVNASL

SEQ ID NO: 1630833 - protein, 12 aa, Staphylococcus aureus
AKVTTNEINGKD

SEQ ID NO: 1630834 - protein, 36 aa, Staphylococcus aureus
AKYFGKSNGNLDKKFKKDGYDLATNSKELSKSDKDK

SEQ ID NO: 1630835 - protein, 5 aa, Staphylococcus aureus
AKYGR

SEQ ID NO: 1630836 - protein, 20 aa, Staphylococcus aureus
ALGRKTKQGFYKKDKETKAR

SEQ ID NO: 1630837 - protein, 20 aa, Staphylococcus aureus
ALGRKTKQGFYKKNKETKAR

SEQ ID NO: 1630838 - protein, 11 aa, Staphylococcus aureus
ALKGKAYTSAK

SEQ ID NO: 1630839 - protein, 4 aa, Staphylococcus aureus
ALKN

SEQ ID NO: 1630840 - protein, 5 aa, Staphylococcus aureus
ALRDE

SEQ ID NO: 1630841 - protein, 5 aa, Staphylococcus aureus
ALSKD

SEQ ID NO: 1630842 - protein, 18 aa, Staphylococcus aureus
ALSNPKDGFLKKFLYHLK

SEQ ID NO: 1630843 - protein, 6 aa, Staphylococcus aureus
AMPREK

SEQ ID NO: 1630844 - protein, 4 aa, Staphylococcus aureus
ANGR

SEQ ID NO: 1630845 - protein, 9 aa, Staphylococcus aureus
ANGTTYAAP

SEQ ID NO: 1630846 - protein, 7 aa, Staphylococcus aureus
ANKQNFN

SEQ ID NO: 1630847 - protein, 27 aa, Staphylococcus aureus
ANKRTATIKNGTAMPTNLAGGSTTTIP

SEQ ID NO: 1630848 - protein, 9 aa, Staphylococcus aureus
ANNEKRALQ

SEQ ID NO: 1630849 - protein, 4 aa, Staphylococcus aureus
ANNR

SEQ ID NO: 1630850 - protein, 45 aa, Staphylococcus aureus
ANPVKKPAGKTELDQAAADKKTQIEQTPNASQQEINDAKQEVAAA

SEQ ID NO: 1630851 - protein, 13 aa, Staphylococcus aureus
ANRQQPNNQQAGV

SEQ ID NO: 1630852 - protein, 6 aa, Staphylococcus aureus
ANSGEF

SEQ ID NO: 1630853 - protein, 6 aa, Staphylococcus aureus
ANSNTV

SEQ ID NO: 1630854 - protein, 19 aa, Staphylococcus aureus
ANSRITDLENKAQTYSRAF

SEQ ID NO: 1630855 - protein, 6 aa, Staphylococcus aureus
ANTNIY

SEQ ID NO: 1630856 - protein, 11 aa, Staphylococcus aureus
ANTPNNERIPT

SEQ ID NO: 1630857 - protein, 4 aa, Staphylococcus aureus
ANYV

SEQ ID NO: 1630858 - protein, 20 aa, Staphylococcus aureus
APANYYPDDEYGGYDEYGGY

SEQ ID NO: 1630859 - protein, 9 aa, Staphylococcus aureus
APDDEEDAL

SEQ ID NO: 1630860 - protein, 6 aa, Staphylococcus aureus
APGSFG

SEQ ID NO: 1630861 - protein, 10 aa, Staphylococcus aureus
APIKEQATDM

SEQ ID NO: 1630862 - protein, 11 aa, Staphylococcus aureus
APIKEQATDML

SEQ ID NO: 1630863 - protein, 10 aa, Staphylococcus aureus
APLGSGEAYG

SEQ ID NO: 1630864 - protein, 22 aa, Staphylococcus aureus
APQKKTCSNRKRNRKVIIKYTS

SEQ ID NO: 1630865 - protein, 11 aa, Staphylococcus aureus
APQSTRRKSIE

SEQ ID NO: 1630866 - protein, 5 aa, Staphylococcus aureus
APTES

SEQ ID NO: 1630867 - protein, 12 aa, Staphylococcus aureus
APTNQQNLPRRY

SEQ ID NO: 1630868 - protein, 22 aa, Staphylococcus aureus
APVQKSSKKPARGIQKSKNAFS

SEQ ID NO: 1630869 - protein, 15 aa, Staphylococcus aureus
AQDDDANTDTPVNRL

SEQ ID NO: 1630870 - protein, 11 aa, Staphylococcus aureus
AQDEDTKTDIP

SEQ ID NO: 1630871 - protein, 15 aa, Staphylococcus aureus
AQDEETKTDTPVNRL

SEQ ID NO: 1630872 - protein, 5 aa, Staphylococcus aureus
AQDQI

SEQ ID NO: 1630873 - protein, 10 aa, Staphylococcus aureus
AQESASNLGL

SEQ ID NO: 1630874 - protein, 9 aa, Staphylococcus aureus
AQGHTDETV

SEQ ID NO: 1630875 - protein, 6 aa, Staphylococcus aureus
AQKGNI

SEQ ID NO: 1630876 - protein, 12 aa, Staphylococcus aureus
AQKNPDTGELKG

SEQ ID NO: 1630877 - protein, 13 aa, Staphylococcus aureus
AQKNPDTGELKGA

SEQ ID NO: 1630878 - protein, 5 aa, Staphylococcus aureus
AQLSQ

SEQ ID NO: 1630879 - protein, 8 aa, Staphylococcus aureus
AQNNNQQG

SEQ ID NO: 1630880 - protein, 4 aa, Staphylococcus aureus
AQNV

SEQ ID NO: 1630881 - protein, 5 aa, Staphylococcus aureus
AQQTY

SEQ ID NO: 1630882 - protein, 16 aa, Staphylococcus aureus
AQSKEEAKEKVEETYN

SEQ ID NO: 1630883 - protein, 11 aa, Staphylococcus aureus
AQVEDSSRPNV

SEQ ID NO: 1630884 - protein, 4 aa, Staphylococcus aureus
AQYY

SEQ ID NO: 1630885 - protein, 10 aa, Staphylococcus aureus
AREEWRKNDG

SEQ ID NO: 1630886 - protein, 5 aa, Staphylococcus aureus
ARFGN

SEQ ID NO: 1630887 - protein, 7 aa, Staphylococcus aureus
ARTEDVR

SEQ ID NO: 1630888 - protein, 7 aa, Staphylococcus aureus
ARTLSEQ

SEQ ID NO: 1630889 - protein, 9 aa, Staphylococcus aureus
ARVQTESQK

SEQ ID NO: 1630890 - protein, 12 aa, Staphylococcus aureus
ASADVGTTVVGA

SEQ ID NO: 1630891 - protein, 17 aa, Staphylococcus aureus
ASAPKDKNIKLYRIDLE

SEQ ID NO: 1630892 - protein, 30 aa, Staphylococcus aureus
ASEDKTPKLNKLGGSEWKKTKAKVQQSVED

SEQ ID NO: 1630893 - protein, 4 aa, Staphylococcus aureus
ASEG

SEQ ID NO: 1630894 - protein, 4 aa, Staphylococcus aureus
ASGG

SEQ ID NO: 1630895 - protein, 23 aa, Staphylococcus aureus
ASGNYTNASPDKQGAYTDAYNAA

SEQ ID NO: 1630896 - protein, 10 aa, Staphylococcus aureus
ASKDEPSLAD

SEQ ID NO: 1630897 - protein, 4 aa, Staphylococcus aureus
ASNG

SEQ ID NO: 1630898 - protein, 7 aa, Staphylococcus aureus
ASNKDGV

SEQ ID NO: 1630899 - protein, 15 aa, Staphylococcus aureus
ASNLNQAQQNNFTQQ

SEQ ID NO: 1630900 - protein, 7 aa, Staphylococcus aureus
ASPEAAN

SEQ ID NO: 1630901 - protein, 8 aa, Staphylococcus aureus
ASQKPTFE

SEQ ID NO: 1630902 - protein, 4 aa, Staphylococcus aureus
ASQL

SEQ ID NO: 1630903 - protein, 9 aa, Staphylococcus aureus
ASQNGRNYQ

SEQ ID NO: 1630904 - protein, 16 aa, Staphylococcus aureus
ASRRRKLTSVDKENVL

SEQ ID NO: 1630905 - protein, 11 aa, Staphylococcus aureus
ASRYTKPGDEI

SEQ ID NO: 1630906 - protein, 4 aa, Staphylococcus aureus
ASSP

SEQ ID NO: 1630907 - protein, 6 aa, Staphylococcus aureus
ASSYVE

SEQ ID NO: 1630908 - protein, 5 aa, Staphylococcus aureus
ASTGQ

SEQ ID NO: 1630909 - protein, 13 aa, Staphylococcus aureus
ATAREGKYAGQER

SEQ ID NO: 1630910 - protein, 4 aa, Staphylococcus aureus
ATDP

SEQ ID NO: 1630911 - protein, 6 aa, Staphylococcus aureus
ATDRRG

SEQ ID NO: 1630912 - protein, 5 aa, Staphylococcus aureus
ATGEV

SEQ ID NO: 1630913 - protein, 4 aa, Staphylococcus aureus
ATGY

SEQ ID NO: 1630914 - protein, 9 aa, Staphylococcus aureus
ATIGNNEGM

SEQ ID NO: 1630915 - protein, 9 aa, Staphylococcus aureus
ATISDQNEI

SEQ ID NO: 1630916 - protein, 16 aa, Staphylococcus aureus
ATKDNSLDTHGDETLR

SEQ ID NO: 1630917 - protein, 17 aa, Staphylococcus aureus
ATKDNSLDTHGDETLRD

SEQ ID NO: 1630918 - protein, 34 aa, Staphylococcus aureus
ATKDTRTRDTHRHLDGAKKKIDEPFKSSGCVGQA

SEQ ID NO: 1630919 - protein, 28 aa, Staphylococcus aureus
ATLNGSELEVDTTEIQNAALPNNKVESL

SEQ ID NO: 1630920 - protein, 5 aa, Staphylococcus aureus
ATLST

SEQ ID NO: 1630921 - protein, 4 aa, Staphylococcus aureus
ATNK

SEQ ID NO: 1630922 - protein, 34 aa, Staphylococcus aureus
ATNKENEEVKSLTEEQGQDKLEDTHSEGSTQDVN

SEQ ID NO: 1630923 - protein, 17 aa, Staphylococcus aureus
ATNKSDKFNPQNEDASI

SEQ ID NO: 1630924 - protein, 18 aa, Staphylococcus aureus
ATPHNGSQAADKFGNTEA

SEQ ID NO: 1630925 - protein, 15 aa, Staphylococcus aureus
ATPNDVEKLGGITSE

SEQ ID NO: 1630926 - protein, 7 aa, Staphylococcus aureus
ATQASIR

SEQ ID NO: 1630927 - protein, 40 aa, Staphylococcus aureus; identical to SEQ ID NO: 1569900

SEQ ID NO: 1630928 - protein, 13 aa, Staphylococcus aureus
ATQTQTATQTQIA

SEQ ID NO: 1630929 - protein, 10 aa, Staphylococcus aureus
ATRAQTGSAM

SEQ ID NO: 1630930 - protein, 8 aa, Staphylococcus aureus
ATSDDNLA

SEQ ID NO: 1630931 - protein, 5 aa, Staphylococcus aureus
ATSNV

SEQ ID NO: 1630932 - protein, 12 aa, Staphylococcus aureus
ATTDKQKGALKQ

SEQ ID NO: 1630933 - protein, 6 aa, Staphylococcus aureus
ATTIAK

SEQ ID NO: 1630934 - protein, 7 aa, Staphylococcus aureus
ATTNLER

SEQ ID NO: 1630935 - protein, 4 aa, Staphylococcus aureus
ATTV

SEQ ID NO: 1630936 - protein, 12 aa, Staphylococcus aureus
ATVKPKANQAIE

SEQ ID NO: 1630937 - protein, 20 aa, Staphylococcus aureus
ATVSNDSSASSNTVKPVASA

SEQ ID NO: 1630938 - protein, 9 aa, Staphylococcus aureus
AVAQAGKSL

SEQ ID NO: 1630939 - protein, 4 aa, Staphylococcus aureus
AVDA

SEQ ID NO: 1630940 - protein, 11 aa, Staphylococcus aureus
AVHPKNRNFKD

SEQ ID NO: 1630941 - protein, 7 aa, Staphylococcus aureus
AVQKSND

SEQ ID NO: 1630942 - protein, 28 aa, Staphylococcus aureus
AVTRAKAALNGAENLRNAKTSATNTING

SEQ ID NO: 1630943 - protein, 6 aa, Staphylococcus aureus
AYDQGA

SEQ ID NO: 1630944 - protein, 4 aa, Staphylococcus aureus
AYQL

SEQ ID NO: 1630945 - protein, 5 aa, Staphylococcus aureus
AYQPA

SEQ ID NO: 1630946 - protein, 14 aa, Staphylococcus aureus
AYRNKERGITPFKD

SEQ ID NO: 1630947 - protein, 8 aa, Staphylococcus aureus
AYSKEKNS

SEQ ID NO: 1630948 - protein, 23 aa, Staphylococcus aureus
CATKTQKYPPPTSKFSTSQQHQM

SEQ ID NO: 1630949 - protein, 7 aa, Staphylococcus aureus
CDHKLNS

SEQ ID NO: 1630950 - protein, 11 aa, Staphylococcus aureus
CHGKGTENKTI

SEQ ID NO: 1630951 - protein, 9 aa, Staphylococcus aureus
CPSLPTNVK

SEQ ID NO: 1630952 - protein, 7 aa, Staphylococcus aureus
CPYTNSL

SEQ ID NO: 1630953 - protein, 11 aa, Staphylococcus aureus
CPYTNSLDSRL

SEQ ID NO: 1630954 - protein, 9 aa, Staphylococcus aureus
CQAQSTSNF

SEQ ID NO: 1630955 - protein, 22 aa, Staphylococcus aureus
CQQCKRDGKLTTYDKSKRKSLD

SEQ ID NO: 1630956 - protein, 4 aa, Staphylococcus aureus
CSRT

SEQ ID NO: 1630957 - protein, 4 aa, Staphylococcus aureus
DADD

SEQ ID NO: 1630958 - protein, 19 aa, Staphylococcus aureus
DADEQKRNAYNQAVSAAET

SEQ ID NO: 1630959 - protein, 5 aa, Staphylococcus aureus
DAEAG

SEQ ID NO: 1630960 - protein, 25 aa, Staphylococcus aureus
DAEDGNLINTSDEDKTTDEEEKAHS

SEQ ID NO: 1630961 - protein, 10 aa, Staphylococcus aureus
DAGNELPPNR

SEQ ID NO: 1630962 - protein, 9 aa, Staphylococcus aureus
DAIASNGYI

SEQ ID NO: 1630963 - protein, 10 aa, Staphylococcus aureus
DAKENNDSNE

SEQ ID NO: 1630964 - protein, 8 aa, Staphylococcus aureus
DANGPTYQ

SEQ ID NO: 1630965 - protein, 9 aa, Staphylococcus aureus
DAPKTQEHV

SEQ ID NO: 1630966 - protein, 19 aa, Staphylococcus aureus
DAQKANLTSQIESGTTVAG

SEQ ID NO: 1630967 - protein, 19 aa, Staphylococcus aureus
DAQKQALKGQIDQSPEIAT

SEQ ID NO: 1630968 - protein, 8 aa, Staphylococcus aureus
DAQTGKVT

SEQ ID NO: 1630969 - protein, 10 aa, Staphylococcus aureus
DARETAPAHV

SEQ ID NO: 1630970 - protein, 29 aa, Staphylococcus aureus
DARGQNDPTNTIDYTETNKHRETDDVSKS

SEQ ID NO: 1630971 - protein, 5 aa, Staphylococcus aureus
DASEL

SEQ ID NO: 1630972 - protein, 7 aa, Staphylococcus aureus
DAVQNSK

SEQ ID NO: 1630973 - protein, 9 aa, Staphylococcus aureus
DAYDNNPEL

SEQ ID NO: 1630974 - protein, 9 aa, Staphylococcus aureus
DAYSQKGAI

SEQ ID NO: 1630975 - protein, 26 aa, Staphylococcus aureus
DDAEDGNLINTSDEDKTTDEEAKAHS

SEQ ID NO: 1630976 - protein, 6 aa, Staphylococcus aureus
DDAVNQ

SEQ ID NO: 1630977 - protein, 12 aa, Staphylococcus aureus
DDDEDNDKPDLY

SEQ ID NO: 1630978 - protein, 17 aa, Staphylococcus aureus
DDDFEDFGTTDSLRSDA

SEQ ID NO: 1630979 - protein, 5 aa, Staphylococcus aureus
DDDSV

SEQ ID NO: 1630980 - protein, 5 aa, Staphylococcus aureus
DDEGG

SEQ ID NO: 1630981 - protein, 7 aa, Staphylococcus aureus
DDEHGWN

SEQ ID NO: 1630982 - protein, 50 aa, Staphylococcus aureus
DDELNDEDEPLIPKRGDSKKLKAEKKISVKKTKSGSKNPGKKVKIQPDEV

SEQ ID NO: 1630983 - protein, 7 aa, Staphylococcus aureus
DDENIDR

SEQ ID NO: 1630984 - protein, 9 aa, Staphylococcus aureus
DDIESSKDG

SEQ ID NO: 1630985 - protein, 6 aa, Staphylococcus aureus
DDKDID

SEQ ID NO: 1630986 - protein, 13 aa, Staphylococcus aureus
DDKGPAASQGYGE

SEQ ID NO: 1630987 - protein, 5 aa, Staphylococcus aureus
DDKMA

SEQ ID NO: 1630988 - protein, 7 aa, Staphylococcus aureus
DDKTASV

SEQ ID NO: 1630989 - protein, 23 aa, Staphylococcus aureus
DDKTFRDGMKNSKKQLKDKSRPY

SEQ ID NO: 1630990 - protein, 6 aa, Staphylococcus aureus
DDKVDE

SEQ ID NO: 1630991 - protein, 15 aa, Staphylococcus aureus
DDLNEQKKKIETHTN

SEQ ID NO: 1630992 - protein, 18 aa, Staphylococcus aureus
DDLPSTTRVRKDDGTTEV

SEQ ID NO: 1630993 - protein, 13 aa, Staphylococcus aureus
DDMKKVKKENKKL

SEQ ID NO: 1630994 - protein, 4 aa, Staphylococcus aureus
DDSE

SEQ ID NO: 1630995 - protein, 12 aa, Staphylococcus aureus
DDSEIKDIQIIT

SEQ ID NO: 1630996 - protein, 7 aa, Staphylococcus aureus
DDSFSDT

SEQ ID NO: 1630997 - protein, 19 aa, Staphylococcus aureus
DDTTEQSEASADEQKSLSD

SEQ ID NO: 1630998 - protein, 9 aa, Staphylococcus aureus
DDVKSLSTD

SEQ ID NO: 1630999 - protein, 12 aa, Staphylococcus aureus
DDYRDCKRKAKR

SEQ ID NO: 1631000 - protein, 21 aa, Staphylococcus aureus
DEAVDKAKQALDKSSGQNLTA

SEQ ID NO: 1631001 - protein, 25 aa, Staphylococcus aureus
DEDNVQDINETAAPLAYGDSELSRT

SEQ ID NO: 1631002 - protein, 7 aa, Staphylococcus aureus
DEDPTDK

SEQ ID NO: 1631003 - protein, 10 aa, Staphylococcus aureus
DEDSTKGIVT

SEQ ID NO: 1631004 - protein, 5 aa, Staphylococcus aureus
DEEFD

SEQ ID NO: 1631005 - protein, 13 aa, Staphylococcus aureus
DEERANKKAVNKR

SEQ ID NO: 1631006 - protein, 5 aa, Staphylococcus aureus
DEERF

SEQ ID NO: 1631007 - protein, 14 aa, Staphylococcus aureus
DEFNEKDQQKNIML

SEQ ID NO: 1631008 - protein, 8 aa, Staphylococcus aureus
DEGGGSSI

SEQ ID NO: 1631009 - protein, 19 aa, Staphylococcus aureus
DEKSAYNNVQVGEGSQHRE

SEQ ID NO: 1631010 - protein, 5 aa, Staphylococcus aureus
DEKYD

SEQ ID NO: 1631011 - protein, 14 aa, Staphylococcus aureus
DEMDKKEKEKLSQQ

SEQ ID NO: 1631012 - protein, 9 aa, Staphylococcus aureus
DENATQEDY

SEQ ID NO: 1631013 - protein, 7 aa, Staphylococcus aureus
DENESED

SEQ ID NO: 1631014 - protein, 12 aa, Staphylococcus aureus
DENGYNALSSNK

SEQ ID NO: 1631015 - protein, 7 aa, Staphylococcus aureus
DENKRRM

SEQ ID NO: 1631016 - protein, 7 aa, Staphylococcus aureus
DENNEPL

SEQ ID NO: 1631017 - protein, 7 aa, Staphylococcus aureus
DENSNEW

SEQ ID NO: 1631018 - protein, 6 aa, Staphylococcus aureus
DEQRYT

SEQ ID NO: 1631019 - protein, 21 aa, Staphylococcus aureus
DESIHPNDDVNKSQSSNDTFP

SEQ ID NO: 1631020 - protein, 6 aa, Staphylococcus aureus
DESKHL

SEQ ID NO: 1631021 - protein, 7 aa, Staphylococcus aureus
DEVITST

SEQ ID NO: 1631022 - protein, 4 aa, Staphylococcus aureus
DEYD

SEQ ID NO: 1631023 - protein, 16 aa, Staphylococcus aureus
DEYEEKNMLDTLKITI

SEQ ID NO: 1631024 - protein, 11 aa, Staphylococcus aureus
DEYKDYYDKKV

SEQ ID NO: 1631025 - protein, 11 aa, Staphylococcus aureus
DFDADGNVKEM

SEQ ID NO: 1631026 - protein, 41 aa, Staphylococcus aureus; identical to SEQ ID NO: 1561380

SEQ ID NO: 1631027 - protein, 21 aa, Staphylococcus aureus
DFKNGTTKDGVKKFDGTGPFK

SEQ ID NO: 1631028 - protein, 9 aa, Staphylococcus aureus
DFKSENEGV

SEQ ID NO: 1631029 - protein, 10 aa, Staphylococcus aureus
DFNDQDRNRF

SEQ ID NO: 1631030 - protein, 13 aa, Staphylococcus aureus
DFSDRNNLDSLDK

SEQ ID NO: 1631031 - protein, 21 aa, Staphylococcus aureus
DFSKESTAETIERHSDPDSGI

SEQ ID NO: 1631032 - protein, 5 aa, Staphylococcus aureus
DGDIP

SEQ ID NO: 1631033 - protein, 14 aa, Staphylococcus aureus
DGEPVNDGKVGPIT

SEQ ID NO: 1631034 - protein, 9 aa, Staphylococcus aureus
DGEYGGKLP

SEQ ID NO: 1631035 - protein, 4 aa, Staphylococcus aureus
DGHG

SEQ ID NO: 1631036 - protein, 4 aa, Staphylococcus aureus
DGIT

SEQ ID NO: 1631037 - protein, 6 aa, Staphylococcus aureus
DGKIAQ

SEQ ID NO: 1631038 - protein, 13 aa, Staphylococcus aureus
DGKKPSEDMRGKK

SEQ ID NO: 1631039 - protein, 12 aa, Staphylococcus aureus
DGKPDKKNYRKY

SEQ ID NO: 1631040 - protein, 15 aa, Staphylococcus aureus
DGKSYTDQVDISSSE

SEQ ID NO: 1631041 - protein, 5 aa, Staphylococcus aureus
DGNHD

SEQ ID NO: 1631042 - protein, 4 aa, Staphylococcus aureus
DGNI

SEQ ID NO: 1631043 - protein, 10 aa, Staphylococcus aureus
DGNPGMDTQN

SEQ ID NO: 1631044 - protein, 13 aa, Staphylococcus aureus
DGNYSEEMKEVHY

SEQ ID NO: 1631045 - protein, 5 aa, Staphylococcus aureus
DGRIA

SEQ ID NO: 1631046 - protein, 4 aa, Staphylococcus aureus
DGRK

SEQ ID NO: 1631047 - protein, 8 aa, Staphylococcus aureus
DGSEEKIY

SEQ ID NO: 1631048 - protein, 9 aa, Staphylococcus aureus
DGSSDNTAE

SEQ ID NO: 1631049 - protein, 6 aa, Staphylococcus aureus
DGSSKF

SEQ ID NO: 1631050 - protein, 27 aa, Staphylococcus aureus
DGSYITPNERSDKSAELFSDNNNPLSE

SEQ ID NO: 1631051 - protein, 6 aa, Staphylococcus aureus
DGSYNQ

SEQ ID NO: 1631052 - protein, 7 aa, Staphylococcus aureus
DGTVKGL

SEQ ID NO: 1631053 - protein, 22 aa, Staphylococcus aureus
DGVPKDYKVADKSGQAITYASR

SEQ ID NO: 1631054 - protein, 9 aa, Staphylococcus aureus
DHGSDFTSN

SEQ ID NO: 1631055 - protein, 28 aa, Staphylococcus aureus
DIDKNKKSLQKAKEIAGEKASEYFNKAM

SEQ ID NO: 1631056 - protein, 13 aa, Staphylococcus aureus
DIDTHATSNEEDF

SEQ ID NO: 1631057 - protein, 4 aa, Staphylococcus aureus
DIED

SEQ ID NO: 1631058 - protein, 10 aa, Staphylococcus aureus
DIEEQSKKLS

SEQ ID NO: 1631059 - protein, 6 aa, Staphylococcus aureus
DIKEKQ

SEQ ID NO: 1631060 - protein, 19 aa, Staphylococcus aureus
DIKQNQDKQITQQQVEDTV

SEQ ID NO: 1631061 - protein, 4 aa, Staphylococcus aureus
DIPS

SEQ ID NO: 1631062 - protein, 9 aa, Staphylococcus aureus
DIPTNKAPK

SEQ ID NO: 1631063 - protein, 6 aa, Staphylococcus aureus
DIQGTG

SEQ ID NO: 1631064 - protein, 5 aa, Staphylococcus aureus
DIRDR

SEQ ID NO: 1631065 - protein, 51 aa, Staphylococcus aureus
DISGSQSDESTQGEEAQREDVSANPNDNDSDIEEKSEETEAKKGFWSRLFG

SEQ ID NO: 1631066 - protein, 5 aa, Staphylococcus aureus
DISKC

SEQ ID NO: 1631067 - protein, 10 aa, Staphylococcus aureus
DISKPQGFTA

SEQ ID NO: 1631068 - protein, 19 aa, Staphylococcus aureus
DITNNRTNQQVDDTTSQAL

SEQ ID NO: 1631069 - protein, 16 aa, Staphylococcus aureus
DIYEGDANDKSQNNQS

SEQ ID NO: 1631070 - protein, 7 aa, Staphylococcus aureus
DKAIEGS

SEQ ID NO: 1631071 - protein, 5 aa, Staphylococcus aureus
DKANL

SEQ ID NO: 1631072 - protein, 9 aa, Staphylococcus aureus
DKCKENIPQ

SEQ ID NO: 1631073 - protein, 15 aa, Staphylococcus aureus
DKDDTKRRSDWKTNE

SEQ ID NO: 1631074 - protein, 5 aa, Staphylococcus aureus
DKDFY

SEQ ID NO: 1631075 - protein, 13 aa, Staphylococcus aureus
DKDQALASQIGGL

SEQ ID NO: 1631076 - protein, 5 aa, Staphylococcus aureus
DKDYE

SEQ ID NO: 1631077 - protein, 9 aa, Staphylococcus aureus
DKEERVNPA

SEQ ID NO: 1631078 - protein, 8 aa, Staphylococcus aureus
DKEESSKN

SEQ ID NO: 1631079 - protein, 17 aa, Staphylococcus aureus
DKEGYRDDQFDKKDKGT

SEQ ID NO: 1631080 - protein, 17 aa, Staphylococcus aureus
DKEGYRDGKFKKGDKGT

SEQ ID NO: 1631081 - protein, 7 aa, Staphylococcus aureus
DKEKETL

SEQ ID NO: 1631082 - protein, 8 aa, Staphylococcus aureus
DKERRQAV

SEQ ID NO: 1631083 - protein, 9 aa, Staphylococcus aureus
DKEVYDPRK

SEQ ID NO: 1631084 - protein, 6 aa, Staphylococcus aureus
DKGAII

SEQ ID NO: 1631085 - protein, 12 aa, Staphylococcus aureus
DKGEKNNDSPYP

SEQ ID NO: 1631086 - protein, 7 aa, Staphylococcus aureus
DKGERQF

SEQ ID NO: 1631087 - protein, 14 aa, Staphylococcus aureus
DKIDEAKNEGDSIG

SEQ ID NO: 1631088 - protein, 8 aa, Staphylococcus aureus
DKKAKLNP

SEQ ID NO: 1631089 - protein, 14 aa, Staphylococcus aureus
DKKNNYPSNYGKND

SEQ ID NO: 1631090 - protein, 7 aa, Staphylococcus aureus
DKKYTNE

SEQ ID NO: 1631091 - protein, 26 aa, Staphylococcus aureus
DKLPKKGIDITHGDKAFEKKLEKLEE

SEQ ID NO: 1631092 - protein, 6 aa, Staphylococcus aureus
DKMQVS

SEQ ID NO: 1631093 - protein, 5 aa, Staphylococcus aureus
DKMSG

SEQ ID NO: 1631094 - protein, 13 aa, Staphylococcus aureus
DKMSTKTVTTANG

SEQ ID NO: 1631095 - protein, 15 aa, Staphylococcus aureus
DKNNEFEPKRKGNDY

SEQ ID NO: 1631096 - protein, 9 aa, Staphylococcus aureus
DKNSQNIEN

SEQ ID NO: 1631097 - protein, 5 aa, Staphylococcus aureus
DKQEV

SEQ ID NO: 1631098 - protein, 8 aa, Staphylococcus aureus
DKSHNELK

SEQ ID NO: 1631099 - protein, 11 aa, Staphylococcus aureus
DKSNITPQDVR

SEQ ID NO: 1631100 - protein, 7 aa, Staphylococcus aureus
DKSTEEL

SEQ ID NO: 1631101 - protein, 12 aa, Staphylococcus aureus
DKTAGSNDNKVA

SEQ ID NO: 1631102 - protein, 14 aa, Staphylococcus aureus
DKTEGIKRGPFGGA

SEQ ID NO: 1631103 - protein, 7 aa, Staphylococcus aureus
DKTGRKL

SEQ ID NO: 1631104 - protein, 8 aa, Staphylococcus aureus
DKTRPNNI

SEQ ID NO: 1631105 - protein, 7 aa, Staphylococcus aureus
DKYTYAE

SEQ ID NO: 1631106 - protein, 10 aa, Staphylococcus aureus
DLAKSDKIRK

SEQ ID NO: 1631107 - protein, 10 aa, Staphylococcus aureus
DLANDAANDL

SEQ ID NO: 1631108 - protein, 27 aa, Staphylococcus aureus
DLAPKATNNKEYTINTEIGNNGNFGAS

SEQ ID NO: 1631109 - protein, 23 aa, Staphylococcus aureus
DLEGQDLQQTENDLGVDDNYETY

SEQ ID NO: 1631110 - protein, 5 aa, Staphylococcus aureus
DLGAV

SEQ ID NO: 1631111 - protein, 6 aa, Staphylococcus aureus
DLGPTA

SEQ ID NO: 1631112 - protein, 4 aa, Staphylococcus aureus
DLLK

SEQ ID NO: 1631113 - protein, 5 aa, Staphylococcus aureus
DLLKQ

SEQ ID NO: 1631114 - protein, 17 aa, Staphylococcus aureus
DLNNSTINKNYNTINDK

SEQ ID NO: 1631115 - protein, 18 aa, Staphylococcus aureus
DLNTSNIVSSKESFGITE

SEQ ID NO: 1631116 - protein, 9 aa, Staphylococcus aureus
DLPEGLARE

SEQ ID NO: 1631117 - protein, 13 aa, Staphylococcus aureus
DLPYEHNNKLFLK

SEQ ID NO: 1631118 - protein, 19 aa, Staphylococcus aureus
DLRQGYEYSRTANPTRSSV

SEQ ID NO: 1631119 - protein, 8 aa, Staphylococcus aureus
DLSDSVNL

SEQ ID NO: 1631120 - protein, 4 aa, Staphylococcus aureus
DLSP

SEQ ID NO: 1631121 - protein, 18 aa, Staphylococcus aureus
DLTDAQKDAVKRQIEGAT

SEQ ID NO: 1631122 - protein, 4 aa, Staphylococcus aureus
DLTQ

SEQ ID NO: 1631123 - protein, 10 aa, Staphylococcus aureus
DLYDKTHSNK

SEQ ID NO: 1631124 - protein, 9 aa, Staphylococcus aureus
DMSTASDLK

SEQ ID NO: 1631125 - protein, 6 aa, Staphylococcus aureus
DNAEGK

SEQ ID NO: 1631126 - protein, 6 aa, Staphylococcus aureus
DNAPAL

SEQ ID NO: 1631127 - protein, 7 aa, Staphylococcus aureus
DNARQVE

SEQ ID NO: 1631128 - protein, 7 aa, Staphylococcus aureus
DNDAEKW

SEQ ID NO: 1631129 - protein, 6 aa, Staphylococcus aureus
DNDPVY

SEQ ID NO: 1631130 - protein, 7 aa, Staphylococcus aureus
DNEDYEV

SEQ ID NO: 1631131 - protein, 10 aa, Staphylococcus aureus
DNEEKYQYTG

SEQ ID NO: 1631132 - protein, 7 aa, Staphylococcus aureus
DNENVKG

SEQ ID NO: 1631133 - protein, 10 aa, Staphylococcus aureus
DNIANNDNRN

SEQ ID NO: 1631134 - protein, 11 aa, Staphylococcus aureus
DNIANNDNRNN

SEQ ID NO: 1631135 - protein, 6 aa, Staphylococcus aureus
DNITPY

SEQ ID NO: 1631136 - protein, 8 aa, Staphylococcus aureus
DNKPHGEF

SEQ ID NO: 1631137 - protein, 4 aa, Staphylococcus aureus
DNKQ

SEQ ID NO: 1631138 - protein, 18 aa, Staphylococcus aureus
DNKTLSTEHLHIDIYLYE

SEQ ID NO: 1631139 - protein, 4 aa, Staphylococcus aureus
DNLG

SEQ ID NO: 1631140 - protein, 7 aa, Staphylococcus aureus
DNNGDIN

SEQ ID NO: 1631141 - protein, 6 aa, Staphylococcus aureus
DNPNIE

SEQ ID NO: 1631142 - protein, 9 aa, Staphylococcus aureus
DNQNINPSW

SEQ ID NO: 1631143 - protein, 6 aa, Staphylococcus aureus
DNSEQR

SEQ ID NO: 1631144 - protein, 12 aa, Staphylococcus aureus
DNTKEKNPLQGK

SEQ ID NO: 1631145 - protein, 7 aa, Staphylococcus aureus
DNVKEVQ

SEQ ID NO: 1631146 - protein, 16 aa, Staphylococcus aureus
DPASYSDEFKTNSYDL

SEQ ID NO: 1631147 - protein, 7 aa, Staphylococcus aureus
DPETKEH

SEQ ID NO: 1631148 - protein, 18 aa, Staphylococcus aureus
DPETKERIYDRNSDSLDG

SEQ ID NO: 1631149 - protein, 13 aa, Staphylococcus aureus
DPGCPGQRGSIEN

SEQ ID NO: 1631150 - protein, 52 aa, Staphylococcus aureus
DPGHGGSDQGASSNTKYKSLEKDYTLKTAKELQRTLEKEGATVKMTRTDDTY

SEQ ID NO: 1631151 - protein, 4 aa, Staphylococcus aureus
DPIS

SEQ ID NO: 1631152 - protein, 8 aa, Staphylococcus aureus
DPKTNTEK

SEQ ID NO: 1631153 - protein, 5 aa, Staphylococcus aureus
DPNLK

SEQ ID NO: 1631154 - protein, 10 aa, Staphylococcus aureus
DPNTNTNGIT

SEQ ID NO: 1631155 - protein, 4 aa, Staphylococcus aureus
DPSR

SEQ ID NO: 1631156 - protein, 18 aa, Staphylococcus aureus
DPTLSNGAKGYYSPKSDE

SEQ ID NO: 1631157 - protein, 8 aa, Staphylococcus aureus
DPTNTDEA

SEQ ID NO: 1631158 - protein, 12 aa, Staphylococcus aureus
DQAKENDKNYPG

SEQ ID NO: 1631159 - protein, 18 aa, Staphylococcus aureus
DQAQTNSQVNQAATNGVS

SEQ ID NO: 1631160 - protein, 4 aa, Staphylococcus aureus
DQEV

SEQ ID NO: 1631161 - protein, 9 aa, Staphylococcus aureus
DQFNSSRKS

SEQ ID NO: 1631162 - protein, 4 aa, Staphylococcus aureus
DQLN

SEQ ID NO: 1631163 - protein, 9 aa, Staphylococcus aureus
DQLPDGQTF

SEQ ID NO: 1631164 - protein, 6 aa, Staphylococcus aureus
DQNKKD

SEQ ID NO: 1631165 - protein, 16 aa, Staphylococcus aureus
DQNPNLTDKEKQALKD

SEQ ID NO: 1631166 - protein, 6 aa, Staphylococcus aureus
DQPQQH

SEQ ID NO: 1631167 - protein, 11 aa, Staphylococcus aureus
DQTTNPSLDPT

SEQ ID NO: 1631168 - protein, 5 aa, Staphylococcus aureus
DQVHN

SEQ ID NO: 1631169 - protein, 48 aa, Staphylococcus aureus; identical to SEQ ID NO: 1567040

SEQ ID NO: 1631170 - protein, 5 aa, Staphylococcus aureus
DRARL

SEQ ID NO: 1631171 - protein, 6 aa, Staphylococcus aureus
DRDLTE

SEQ ID NO: 1631172 - protein, 9 aa, Staphylococcus aureus
DRESANQEA

SEQ ID NO: 1631173 - protein, 8 aa, Staphylococcus aureus
DRGIGERE

SEQ ID NO: 1631174 - protein, 10 aa, Staphylococcus aureus
DRGISEQDLK

SEQ ID NO: 1631175 - protein, 7 aa, Staphylococcus aureus
DRGKEFN

SEQ ID NO: 1631176 - protein, 12 aa, Staphylococcus aureus
DRIEKGKGEITV

SEQ ID NO: 1631177 - protein, 9 aa, Staphylococcus aureus
DRLGDMSKD

SEQ ID NO: 1631178 - protein, 8 aa, Staphylococcus aureus
DRQDQKAV

SEQ ID NO: 1631179 - protein, 9 aa, Staphylococcus aureus
DRSSHQEVL

SEQ ID NO: 1631180 - protein, 11 aa, Staphylococcus aureus
DRTNDAELRKA

SEQ ID NO: 1631181 - protein, 8 aa, Staphylococcus aureus
DSAQNDGL

SEQ ID NO: 1631182 - protein, 8 aa, Staphylococcus aureus
DSASDQDI

SEQ ID NO: 1631183 - protein, 5 aa, Staphylococcus aureus
DSDNF

SEQ ID NO: 1631184 - protein, 19 aa, Staphylococcus aureus
DSDNFKVTTPYTEISENVS

SEQ ID NO: 1631185 - protein, 6 aa, Staphylococcus aureus
DSELGE

SEQ ID NO: 1631186 - protein, 15 aa, Staphylococcus aureus
DSETTRTAVKQDLTE

SEQ ID NO: 1631187 - protein, 7 aa, Staphylococcus aureus
DSFDAGA

SEQ ID NO: 1631188 - protein, 12 aa, Staphylococcus aureus
DSHTDKKHGVTA

SEQ ID NO: 1631189 - protein, 6 aa, Staphylococcus aureus
DSIPGI

SEQ ID NO: 1631190 - protein, 9 aa, Staphylococcus aureus
DSKPANPNY

SEQ ID NO: 1631191 - protein, 14 aa, Staphylococcus aureus
DSKSKSTKDNNPNN

SEQ ID NO: 1631192 - protein, 19 aa, Staphylococcus aureus
DSKVAKHTKANTDLTTEGL

SEQ ID NO: 1631193 - protein, 10 aa, Staphylococcus aureus
DSLSKSPENW

SEQ ID NO: 1631194 - protein, 4 aa, Staphylococcus aureus
DSRL

SEQ ID NO: 1631195 - protein, 6 aa, Staphylococcus aureus
DSRSGE

SEQ ID NO: 1631196 - protein, 8 aa, Staphylococcus aureus
DSSKLSSH

SEQ ID NO: 1631197 - protein, 8 aa, Staphylococcus aureus
DSSNFKSV

SEQ ID NO: 1631198 - protein, 9 aa, Staphylococcus aureus
DSTKENVKV

SEQ ID NO: 1631199 - protein, 7 aa, Staphylococcus aureus
DSVAPIK

SEQ ID NO: 1631200 - protein, 11 aa, Staphylococcus aureus
DSYIEKDNQIT

SEQ ID NO: 1631201 - protein, 13 aa, Staphylococcus aureus
DSYKPKTSDETYD

SEQ ID NO: 1631202 - protein, 9 aa, Staphylococcus aureus
DSYRSEDLP

SEQ ID NO: 1631203 - protein, 4 aa, Staphylococcus aureus
DTAE

SEQ ID NO: 1631204 - protein, 4 aa, Staphylococcus aureus
DTDI

SEQ ID NO: 1631205 - protein, 21 aa, Staphylococcus aureus
DTESNDMNNMNDTNQHSNHSN

SEQ ID NO: 1631206 - protein, 23 aa, Staphylococcus aureus
DTEVDEDTSSNSEDNTNRNASEM

SEQ ID NO: 1631207 - protein, 23 aa, Staphylococcus aureus
DTEVEEDTTSNIEDNTNRNASEM

SEQ ID NO: 1631208 - protein, 11 aa, Staphylococcus aureus
DTFKSKQTEMR

SEQ ID NO: 1631209 - protein, 15 aa, Staphylococcus aureus
DTFSQKEGKKIETAL

SEQ ID NO: 1631210 - protein, 14 aa, Staphylococcus aureus
DTGGRVKPLPMRPD

SEQ ID NO: 1631211 - protein, 4 aa, Staphylococcus aureus
DTGL

SEQ ID NO: 1631212 - protein, 8 aa, Staphylococcus aureus
DTHRNESE

SEQ ID NO: 1631213 - protein, 17 aa, Staphylococcus aureus
DTIDGTKIKEINVELEY

SEQ ID NO: 1631214 - protein, 4 aa, Staphylococcus aureus
DTKT

SEQ ID NO: 1631215 - protein, 6 aa, Staphylococcus aureus
DTNATL

SEQ ID NO: 1631216 - protein, 9 aa, Staphylococcus aureus
DTNENSGVG

SEQ ID NO: 1631217 - protein, 14 aa, Staphylococcus aureus
DTNHIRNQLDMLQF

SEQ ID NO: 1631218 - protein, 9 aa, Staphylococcus aureus
DTNQSSSSM

SEQ ID NO: 1631219 - protein, 9 aa, Staphylococcus aureus
DTQDYSDLE

SEQ ID NO: 1631220 - protein, 9 aa, Staphylococcus aureus
DTQGQTLTR

SEQ ID NO: 1631221 - protein, 7 aa, Staphylococcus aureus
DTSNPDV

SEQ ID NO: 1631222 - protein, 4 aa, Staphylococcus aureus
DTSY

SEQ ID NO: 1631223 - protein, 6 aa, Staphylococcus aureus
DTTEIQ

SEQ ID NO: 1631224 - protein, 4 aa, Staphylococcus aureus
DTTI

SEQ ID NO: 1631225 - protein, 12 aa, Staphylococcus aureus
DTTKADALTSEE

SEQ ID NO: 1631226 - protein, 16 aa, Staphylococcus aureus
DTTPIERDEVTAATTA

SEQ ID NO: 1631227 - protein, 9 aa, Staphylococcus aureus
DVDKEKETL

SEQ ID NO: 1631228 - protein, 7 aa, Staphylococcus aureus
DVDTTVK

SEQ ID NO: 1631229 - protein, 6 aa, Staphylococcus aureus
DVKDAE

SEQ ID NO: 1631230 - protein, 5 aa, Staphylococcus aureus
DVKRT

SEQ ID NO: 1631231 - protein, 6 aa, Staphylococcus aureus
DVKSND

SEQ ID NO: 1631232 - protein, 14 aa, Staphylococcus aureus
DVKTGSKAKADSYV

SEQ ID NO: 1631233 - protein, 11 aa, Staphylococcus aureus
DVLESEKEEAL

SEQ ID NO: 1631234 - protein, 5 aa, Staphylococcus aureus
DVPNS

SEQ ID NO: 1631235 - protein, 9 aa, Staphylococcus aureus
DVQAQTKQV

SEQ ID NO: 1631236 - protein, 8 aa, Staphylococcus aureus
DVQEASDI

SEQ ID NO: 1631237 - protein, 7 aa, Staphylococcus aureus
DVRDGLK

SEQ ID NO: 1631238 - protein, 33 aa, Staphylococcus aureus; identical to SEQ ID NO: 1565829

SEQ ID NO: 1631239 - protein, 22 aa, Staphylococcus aureus
DVTTYTNEEDGAAKYLAKHFLA

SEQ ID NO: 1631240 - protein, 13 aa, Staphylococcus aureus
DVVASEQGEGKVS

SEQ ID NO: 1631241 - protein, 22 aa, Staphylococcus aureus
DWEETTAKDGKEIKKAIGQDAT

SEQ ID NO: 1631242 - protein, 24 aa, Staphylococcus aureus
DWNDKRRKGLNDKPVIAEGKHTPI

SEQ ID NO: 1631243 - protein, 11 aa, Staphylococcus aureus
DYASNRPASDL

SEQ ID NO: 1631244 - protein, 9 aa, Staphylococcus aureus
DYCKENNKG

SEQ ID NO: 1631245 - protein, 8 aa, Staphylococcus aureus
DYDVPVEE

SEQ ID NO: 1631246 - protein, 9 aa, Staphylococcus aureus
DYDVPVEES

SEQ ID NO: 1631247 - protein, 5 aa, Staphylococcus aureus
DYKEE

SEQ ID NO: 1631248 - protein, 21 aa, Staphylococcus aureus
DYTQADSDKQKAYKQAIADAE

SEQ ID NO: 1631249 - protein, 12 aa, Staphylococcus aureus
EADHTSSDAQEF

SEQ ID NO: 1631250 - protein, 7 aa, Staphylococcus aureus
EAEQTGY

SEQ ID NO: 1631251 - protein, 14 aa, Staphylococcus aureus
EAESLEEAENEARD

SEQ ID NO: 1631252 - protein, 14 aa, Staphylococcus aureus
EAGMTKQQSSKKAI

SEQ ID NO: 1631253 - protein, 49 aa, Staphylococcus aureus
EAHAEASKQATSNDSSEAKAENDSTASQSEMAEPKPQEEKKGFFARLFN

SEQ ID NO: 1631254 - protein, 14 aa, Staphylococcus aureus
EAHRTTGAHEMNKD

SEQ ID NO: 1631255 - protein, 9 aa, Staphylococcus aureus
EAIAANKDS

SEQ ID NO: 1631256 - protein, 8 aa, Staphylococcus aureus
EAITSTEI

SEQ ID NO: 1631257 - protein, 8 aa, Staphylococcus aureus
EAKESRQR

SEQ ID NO: 1631258 - protein, 19 aa, Staphylococcus aureus
EAKESRQRVMESKITDRTK

SEQ ID NO: 1631259 - protein, 10 aa, Staphylococcus aureus
EAKKAARLGE

SEQ ID NO: 1631260 - protein, 5 aa, Staphylococcus aureus
EANNI

SEQ ID NO: 1631261 - protein, 8 aa, Staphylococcus aureus
EANPGSAI

SEQ ID NO: 1631262 - protein, 6 aa, Staphylococcus aureus
EANQTL

SEQ ID NO: 1631263 - protein, 10 aa, Staphylococcus aureus
EAPGYRVKES

SEQ ID NO: 1631264 - protein, 20 aa, Staphylococcus aureus
EAREREIARQRRKEAELRRK

SEQ ID NO: 1631265 - protein, 12 aa, Staphylococcus aureus
EARSHDPERIKT

SEQ ID NO: 1631266 - protein, 15 aa, Staphylococcus aureus
EASENHKKRVQSSTL

SEQ ID NO: 1631267 - protein, 7 aa, Staphylococcus aureus
EASQLTD

SEQ ID NO: 1631268 - protein, 8 aa, Staphylococcus aureus
EASSEIDD

SEQ ID NO: 1631269 - protein, 17 aa, Staphylococcus aureus
EAVKDAQLDINDNTADR

SEQ ID NO: 1631270 - protein, 15 aa, Staphylococcus aureus
EDAEKKNNGYFNKKR

SEQ ID NO: 1631271 - protein, 5 aa, Staphylococcus aureus
EDANT

SEQ ID NO: 1631272 - protein, 6 aa, Staphylococcus aureus
EDASIK

SEQ ID NO: 1631273 - protein, 7 aa, Staphylococcus aureus
EDDLSYN

SEQ ID NO: 1631274 - protein, 8 aa, Staphylococcus aureus
EDENLKQK

SEQ ID NO: 1631275 - protein, 11 aa, Staphylococcus aureus
EDGEYEKDTTF

SEQ ID NO: 1631276 - protein, 4 aa, Staphylococcus aureus
EDGL

SEQ ID NO: 1631277 - protein, 13 aa, Staphylococcus aureus
EDGLKLGKNDQFG

SEQ ID NO: 1631278 - protein, 8 aa, Staphylococcus aureus
EDIEEKEN

SEQ ID NO: 1631279 - protein, 12 aa, Staphylococcus aureus
EDIIREKEKKLT

SEQ ID NO: 1631280 - protein, 11 aa, Staphylococcus aureus
EDISDEEYRSK

SEQ ID NO: 1631281 - protein, 10 aa, Staphylococcus aureus
EDKIPKGKVQ

SEQ ID NO: 1631282 - protein, 17 aa, Staphylococcus aureus
EDKLSNTYKKVEETQPR

SEQ ID NO: 1631283 - protein, 7 aa, Staphylococcus aureus
EDKNGQL

SEQ ID NO: 1631284 - protein, 7 aa, Staphylococcus aureus
EDLSERG

SEQ ID NO: 1631285 - protein, 14 aa, Staphylococcus aureus
EDLTEAKAAIQDKD

SEQ ID NO: 1631286 - protein, 12 aa, Staphylococcus aureus
EDNGMMGQIKVT

SEQ ID NO: 1631287 - protein, 5 aa, Staphylococcus aureus
EDNVN

SEQ ID NO: 1631288 - protein, 6 aa, Staphylococcus aureus
EDQLNQ

SEQ ID NO: 1631289 - protein, 10 aa, Staphylococcus aureus
EDSDGMTHNH

SEQ ID NO: 1631290 - protein, 17 aa, Staphylococcus aureus
EDSEGKVYSDERKYPVK

SEQ ID NO: 1631291 - protein, 9 aa, Staphylococcus aureus
EDTKEHNLE

SEQ ID NO: 1631292 - protein, 9 aa, Staphylococcus aureus
EDTSSNEKG

SEQ ID NO: 1631293 - protein, 13 aa, Staphylococcus aureus
EEAYNQNNQYQDK

SEQ ID NO: 1631294 - protein, 14 aa, Staphylococcus aureus
EEGLTTAATQLTKQ

SEQ ID NO: 1631295 - protein, 6 aa, Staphylococcus aureus
EEHNGN

SEQ ID NO: 1631296 - protein, 7 aa, Staphylococcus aureus
EEIEDDK

SEQ ID NO: 1631297 - protein, 8 aa, Staphylococcus aureus
EEITEETK

SEQ ID NO: 1631298 - protein, 15 aa, Staphylococcus aureus
EEKENDDPYMKFASD

SEQ ID NO: 1631299 - protein, 24 aa, Staphylococcus aureus
EEKNYGYSPQETTKNVKKLKRYRN

SEQ ID NO: 1631300 - protein, 21 aa, Staphylococcus aureus
EEKSKKRNRSYNNYELLRIIN

SEQ ID NO: 1631301 - protein, 10 aa, Staphylococcus aureus
EEKSNEKITN

SEQ ID NO: 1631302 - protein, 10 aa, Staphylococcus aureus
EEKTTQEFSK

SEQ ID NO: 1631303 - protein, 20 aa, Staphylococcus aureus
EELKNQNSELETKYKETQLN

SEQ ID NO: 1631304 - protein, 20 aa, Staphylococcus aureus
EELKNQNSEWETKYKETQLN

SEQ ID NO: 1631305 - protein, 20 aa, Staphylococcus aureus
EENKKLSENIDKLEKRNKEL

SEQ ID NO: 1631306 - protein, 12 aa, Staphylococcus aureus
EENSHVDIKSEL

SEQ ID NO: 1631307 - protein, 8 aa, Staphylococcus aureus
EEPDEHGG

SEQ ID NO: 1631308 - protein, 9 aa, Staphylococcus aureus
EEPSDNPEL

SEQ ID NO: 1631309 - protein, 4 aa, Staphylococcus aureus
EEQK

SEQ ID NO: 1631310 - protein, 9 aa, Staphylococcus aureus
EEQKENPLD

SEQ ID NO: 1631311 - protein, 5 aa, Staphylococcus aureus
EEQNK

SEQ ID NO: 1631312 - protein, 18 aa, Staphylococcus aureus
EERKIESSKKNNNQVPNG

SEQ ID NO: 1631313 - protein, 23 aa, Staphylococcus aureus
EERVNASKSLNGPQASFDGNKEE

SEQ ID NO: 1631314 - protein, 33 aa, Staphylococcus aureus
EESDGDNGKSKDNNDDEGKDKQDKKTNSEEEIE

SEQ ID NO: 1631315 - protein, 24 aa, Staphylococcus aureus
EESKTDVLHGKQSSSLTNEREDKL

SEQ ID NO: 1631316 - protein, 90 aa, Staphylococcus aureus
EESQDDNQLENEQVDQSTSSSVSEVSDITEESEETTHPNNTSGQQDNDDQQKDLQSSFSNKNEDTANENRPRTNQQDVATNQAVQTSKPM

SEQ ID NO: 1631317 - protein, 99 aa, Staphylococcus aureus
EESQDDNQLENEQVHQSTSSSVSEVSDITEESEETTHPNNTSGQQDNDDQQKDLQPSFSNQNEDTANENRPRTNQPDVATNQAVQTSKPMIRKGPNIKL

SEQ ID NO: 1631318 - protein, 14 aa, Staphylococcus aureus
EESYNSEKKRIENE

SEQ ID NO: 1631319 - protein, 6 aa, Staphylococcus aureus
EETGDI

SEQ ID NO: 1631320 - protein, 19 aa, Staphylococcus aureus
EETKNSNEENKEINEINHN

SEQ ID NO: 1631321 - protein, 12 aa, Staphylococcus aureus
EETTMQNNHANL

SEQ ID NO: 1631322 - protein, 16 aa, Staphylococcus aureus
EETYQSRLAKTTPTKA

SEQ ID NO: 1631323 - protein, 46 aa, Staphylococcus aureus
EEVEESSTESSGVEEESTDAKATYTTPRYENAYKVPEKQLNKENGH

SEQ ID NO: 1631324 - protein, 12 aa, Staphylococcus aureus
EEVEKKTARTTF

SEQ ID NO: 1631325 - protein, 15 aa, Staphylococcus aureus
EEVKKKASVLSGGEK

SEQ ID NO: 1631326 - protein, 9 aa, Staphylococcus aureus
EEVNEKLRE

SEQ ID NO: 1631327 - protein, 8 aa, Staphylococcus aureus
EEVTEDTE

SEQ ID NO: 1631328 - protein, 11 aa, Staphylococcus aureus
EEYEGSNLTTS

SEQ ID NO: 1631329 - protein, 8 aa, Staphylococcus aureus
EFDPNSNI

SEQ ID NO: 1631330 - protein, 10 aa, Staphylococcus aureus
EFGPSGKENY

SEQ ID NO: 1631331 - protein, 10 aa, Staphylococcus aureus
EGAWKDEELA

SEQ ID NO: 1631332 - protein, 12 aa, Staphylococcus aureus
EGDYNSTLYENT

SEQ ID NO: 1631333 - protein, 6 aa, Staphylococcus aureus
EGFTEE

SEQ ID NO: 1631334 - protein, 12 aa, Staphylococcus aureus
EGGHLEKTKKLK

SEQ ID NO: 1631335 - protein, 5 aa, Staphylococcus aureus
EGGHQ

SEQ ID NO: 1631336 - protein, 13 aa, Staphylococcus aureus
EGGKRGRKPTTIS

SEQ ID NO: 1631337 - protein, 12 aa, Staphylococcus aureus
EGITNPSDEQGI

SEQ ID NO: 1631338 - protein, 4 aa, Staphylococcus aureus
EGKG

SEQ ID NO: 1631339 - protein, 10 aa, Staphylococcus aureus
EGKKDPIGAM

SEQ ID NO: 1631340 - protein, 20 aa, Staphylococcus aureus
EGKRYRKKGFRTKREANYAG

SEQ ID NO: 1631341 - protein, 5 aa, Staphylococcus aureus
EGKSK

SEQ ID NO: 1631342 - protein, 8 aa, Staphylococcus aureus
EGQENQLL

SEQ ID NO: 1631343 - protein, 35 aa, Staphylococcus aureus
EGQQGVSNEEVAAEQNIDLDEKEKSEETEATEATE

SEQ ID NO: 1631344 - protein, 19 aa, Staphylococcus aureus
EGQTKSKLGTSEARSAVDS

SEQ ID NO: 1631345 - protein, 6 aa, Staphylococcus aureus
EGSKLT

SEQ ID NO: 1631346 - protein, 9 aa, Staphylococcus aureus
EGTYKPQAV

SEQ ID NO: 1631347 - protein, 5 aa, Staphylococcus aureus
EGVEL

SEQ ID NO: 1631348 - protein, 4 aa, Staphylococcus aureus
EHGT

SEQ ID NO: 1631349 - protein, 8 aa, Staphylococcus aureus
EHSDGEAF

SEQ ID NO: 1631350 - protein, 7 aa, Staphylococcus aureus
EIAQESS

SEQ ID NO: 1631351 - protein, 9 aa, Staphylococcus aureus
EIDSYRTAT

SEQ ID NO: 1631352 - protein, 12 aa, Staphylococcus aureus
EIEQAEKEMEKK

SEQ ID NO: 1631353 - protein, 10 aa, Staphylococcus aureus
EIGSDEVTLS

SEQ ID NO: 1631354 - protein, 5 aa, Staphylococcus aureus
EIIQT

SEQ ID NO: 1631355 - protein, 10 aa, Staphylococcus aureus
EIKDASAGSW

SEQ ID NO: 1631356 - protein, 15 aa, Staphylococcus aureus
EIKEPAKEKESEEEP

SEQ ID NO: 1631357 - protein, 6 aa, Staphylococcus aureus
EIKQFQ

SEQ ID NO: 1631358 - protein, 7 aa, Staphylococcus aureus
EIKQQTD

SEQ ID NO: 1631359 - protein, 7 aa, Staphylococcus aureus
EINGKSE

SEQ ID NO: 1631360 - protein, 7 aa, Staphylococcus aureus
EINTSSG

SEQ ID NO: 1631361 - protein, 4 aa, Staphylococcus aureus
EIPG

SEQ ID NO: 1631362 - protein, 10 aa, Staphylococcus aureus
EIPKANGKKR

SEQ ID NO: 1631363 - protein, 26 aa, Staphylococcus aureus
EIPNAEQTVNYQNADDNAKTNFDDAK

SEQ ID NO: 1631364 - protein, 6 aa, Staphylococcus aureus
EIPPEK

SEQ ID NO: 1631365 - protein, 9 aa, Staphylococcus aureus
EIQEDSEIE

SEQ ID NO: 1631366 - protein, 7 aa, Staphylococcus aureus
EIQENND

SEQ ID NO: 1631367 - protein, 13 aa, Staphylococcus aureus
EIQPIPPQPDNKL

SEQ ID NO: 1631368 - protein, 7 aa, Staphylococcus aureus
EISEPDH

SEQ ID NO: 1631369 - protein, 4 aa, Staphylococcus aureus
EITG

SEQ ID NO: 1631370 - protein, 23 aa, Staphylococcus aureus
EKASSDVSLATESDDAKNSIKVA

SEQ ID NO: 1631371 - protein, 22 aa, Staphylococcus aureus
EKASSENFDEESDDAKNSIKVA

SEQ ID NO: 1631372 - protein, 21 aa, Staphylococcus aureus
EKASSENFGEESDDAQKLKIT

SEQ ID NO: 1631373 - protein, 9 aa, Staphylococcus aureus
EKATEEDVA

SEQ ID NO: 1631374 - protein, 14 aa, Staphylococcus aureus
EKDDFKNAKEKGEY

SEQ ID NO: 1631375 - protein, 25 aa, Staphylococcus aureus
EKEDETDNETTSDVLTENNEHESQI

SEQ ID NO: 1631376 - protein, 35 aa, Staphylococcus aureus
EKEGRDAANVAQEKAEKEGRDAANVAQEKAEKEGK

SEQ ID NO: 1631377 - protein, 16 aa, Staphylococcus aureus
EKELTDTKKAQNEYEE

SEQ ID NO: 1631378 - protein, 36 aa, Staphylococcus aureus
EKFKNSDNEQVKNVKDKINEYTGPNNEEKKENEDKE

SEQ ID NO: 1631379 - protein, 13 aa, Staphylococcus aureus
EKGNNLSGGERQR

SEQ ID NO: 1631380 - protein, 8 aa, Staphylococcus aureus
EKGTEITS

SEQ ID NO: 1631381 - protein, 13 aa, Staphylococcus aureus
EKGVDSDSTTETF

SEQ ID NO: 1631382 - protein, 13 aa, Staphylococcus aureus
EKGWGQKEDDVEK

SEQ ID NO: 1631383 - protein, 16 aa, Staphylococcus aureus
EKIKENLREVSGQPYV

SEQ ID NO: 1631384 - protein, 7 aa, Staphylococcus aureus
EKKIEDK

SEQ ID NO: 1631385 - protein, 12 aa, Staphylococcus aureus
EKKVERKSPKLE

SEQ ID NO: 1631386 - protein, 5 aa, Staphylococcus aureus
EKLSK

SEQ ID NO: 1631387 - protein, 5 aa, Staphylococcus aureus
EKPNS

SEQ ID NO: 1631388 - protein, 22 aa, Staphylococcus aureus
EKQFTNSGVSTGTASHETFEKS

SEQ ID NO: 1631389 - protein, 5 aa, Staphylococcus aureus
EKQNG

SEQ ID NO: 1631390 - protein, 16 aa, Staphylococcus aureus
EKTGKKFKHNTTKTKD

SEQ ID NO: 1631391 - protein, 7 aa, Staphylococcus aureus
EKTQDAM

SEQ ID NO: 1631392 - protein, 12 aa, Staphylococcus aureus
EKVGNGAEHSKT

SEQ ID NO: 1631393 - protein, 13 aa, Staphylococcus aureus
EKVSGRKVNRTEL

SEQ ID NO: 1631394 - protein, 15 aa, Staphylococcus aureus
EKYEEPEYKEAVKKY

SEQ ID NO: 1631395 - protein, 9 aa, Staphylococcus aureus
EKYTDEQVK

SEQ ID NO: 1631396 - protein, 7 aa, Staphylococcus aureus
EKYTKDL

SEQ ID NO: 1631397 - protein, 25 aa, Staphylococcus aureus
ELAKHTSKRERRAIEAERDTDELKK

SEQ ID NO: 1631398 - protein, 7 aa, Staphylococcus aureus
ELAYDDT

SEQ ID NO: 1631399 - protein, 5 aa, Staphylococcus aureus
ELEDE

SEQ ID NO: 1631400 - protein, 5 aa, Staphylococcus aureus
ELEKR

SEQ ID NO: 1631401 - protein, 14 aa, Staphylococcus aureus
ELGADKLSTIKEEH

SEQ ID NO: 1631402 - protein, 12 aa, Staphylococcus aureus
ELKAGKTNTEGD

SEQ ID NO: 1631403 - protein, 30 aa, Staphylococcus aureus
ELKEKSLSDGQISENERKEIEKLENQRRDI

SEQ ID NO: 1631404 - protein, 9 aa, Staphylococcus aureus
ELKENGKIK

SEQ ID NO: 1631405 - protein, 36 aa, Staphylococcus aureus
ELKKKQKRKNYKEKRDAFQKRKREIKKVKAKEKHKG

SEQ ID NO: 1631406 - protein, 6 aa, Staphylococcus aureus
ELNEDK

SEQ ID NO: 1631407 - protein, 8 aa, Staphylococcus aureus
ELNENDDV

SEQ ID NO: 1631408 - protein, 10 aa, Staphylococcus aureus
ELNKKNRKYK

SEQ ID NO: 1631409 - protein, 4 aa, Staphylococcus aureus
ELPE

SEQ ID NO: 1631410 - protein, 11 aa, Staphylococcus aureus
ELSKDHPARES

SEQ ID NO: 1631411 - protein, 7 aa, Staphylococcus aureus
ELSKGKT

SEQ ID NO: 1631412 - protein, 6 aa, Staphylococcus aureus
ELSSAS

SEQ ID NO: 1631413 - protein, 5 aa, Staphylococcus aureus
ELTEP

SEQ ID NO: 1631414 - protein, 7 aa, Staphylococcus aureus
ELTPSVE

SEQ ID NO: 1631415 - protein, 13 aa, Staphylococcus aureus
EMDKKEKEKLSQQ

SEQ ID NO: 1631416 - protein, 10 aa, Staphylococcus aureus
EMEPDEDSYK

SEQ ID NO: 1631417 - protein, 4 aa, Staphylococcus aureus
EMIK

SEQ ID NO: 1631418 - protein, 5 aa, Staphylococcus aureus
EMQNE

SEQ ID NO: 1631419 - protein, 7 aa, Staphylococcus aureus
EMSTKDT

SEQ ID NO: 1631420 - protein, 15 aa, Staphylococcus aureus
ENADEQDRLINLVMK

SEQ ID NO: 1631421 - protein, 15 aa, Staphylococcus aureus
ENANNNGLKKRKIDT

SEQ ID NO: 1631422 - protein, 11 aa, Staphylococcus aureus
ENANNNKLTKN

SEQ ID NO: 1631423 - protein, 5 aa, Staphylococcus aureus
ENDDY

SEQ ID NO: 1631424 - protein, 12 aa, Staphylococcus aureus
ENDIRNVRAQMQ

SEQ ID NO: 1631425 - protein, 16 aa, Staphylococcus aureus
ENDSDEKKAAYYACME

SEQ ID NO: 1631426 - protein, 64 aa, Staphylococcus aureus
ENENVKQSADTISDEKEQYHRDYRKQSHDSRSQKRHRRRRNQTTEEQNYSEQRGNSKISQQSIK

SEQ ID NO: 1631427 - protein, 29 aa, Staphylococcus aureus
ENEPEINQENSNLSVKETTDTLSQKDFEQ

SEQ ID NO: 1631428 - protein, 10 aa, Staphylococcus aureus
ENEPLKPNHE

SEQ ID NO: 1631429 - protein, 32 aa, Staphylococcus aureus
ENFKNTNEEYESKSAKSLNGQGIKEATDVTTY

SEQ ID NO: 1631430 - protein, 7 aa, Staphylococcus aureus
ENGDTQK

SEQ ID NO: 1631431 - protein, 8 aa, Staphylococcus aureus
ENGKQNIN

SEQ ID NO: 1631432 - protein, 8 aa, Staphylococcus aureus
ENGNVSNI

SEQ ID NO: 1631433 - protein, 8 aa, Staphylococcus aureus
ENGTETDE

SEQ ID NO: 1631434 - protein, 10 aa, Staphylococcus aureus
ENIKNHPIDN

SEQ ID NO: 1631435 - protein, 4 aa, Staphylococcus aureus
ENIS

SEQ ID NO: 1631436 - protein, 4 aa, Staphylococcus aureus
ENIY

SEQ ID NO: 1631437 - protein, 6 aa, Staphylococcus aureus
ENKCSE

SEQ ID NO: 1631438 - protein, 6 aa, Staphylococcus aureus
ENKKDD

SEQ ID NO: 1631439 - protein, 8 aa, Staphylococcus aureus
ENKKEDLE

SEQ ID NO: 1631440 - protein, 8 aa, Staphylococcus aureus
ENKKRAIL

SEQ ID NO: 1631441 - protein, 8 aa, Staphylococcus aureus
ENNSAYEE

SEQ ID NO: 1631442 - protein, 6 aa, Staphylococcus aureus
ENNSEY

SEQ ID NO: 1631443 - protein, 7 aa, Staphylococcus aureus
ENPELSQ

SEQ ID NO: 1631444 - protein, 27 aa, Staphylococcus aureus
ENRDKPSEEDSAKDNSVDDQQLEQDRQ

SEQ ID NO: 1631445 - protein, 4 aa, Staphylococcus aureus
ENRV

SEQ ID NO: 1631446 - protein, 13 aa, Staphylococcus aureus
ENSRNTKTGGSGL

SEQ ID NO: 1631447 - protein, 5 aa, Staphylococcus aureus
ENVPF

SEQ ID NO: 1631448 - protein, 8 aa, Staphylococcus aureus
ENYESEMS

SEQ ID NO: 1631449 - protein, 16 aa, Staphylococcus aureus
ENYKDGEVTYNPEAPI

SEQ ID NO: 1631450 - protein, 9 aa, Staphylococcus aureus
EPADVEPNY

SEQ ID NO: 1631451 - protein, 4 aa, Staphylococcus aureus
EPET

SEQ ID NO: 1631452 - protein, 5 aa, Staphylococcus aureus
EPFES

SEQ ID NO: 1631453 - protein, 4 aa, Staphylococcus aureus
EPGQ

SEQ ID NO: 1631454 - protein, 38 aa, Staphylococcus aureus
EPKNSNQQPNNNYHQQRQTQTGNNPFDNTTAITDDDLP

SEQ ID NO: 1631455 - protein, 9 aa, Staphylococcus aureus
EPKSIQARA

SEQ ID NO: 1631456 - protein, 12 aa, Staphylococcus aureus
EPKTKSSHRTIS

SEQ ID NO: 1631457 - protein, 5 aa, Staphylococcus aureus
EPMYT

SEQ ID NO: 1631458 - protein, 8 aa, Staphylococcus aureus
EPNITTAG

SEQ ID NO: 1631459 - protein, 8 aa, Staphylococcus aureus
EPSARDTV

SEQ ID NO: 1631460 - protein, 12 aa, Staphylococcus aureus
EPTGALDPETGQ

SEQ ID NO: 1631461 - protein, 10 aa, Staphylococcus aureus
EPTKRNQMYQ

SEQ ID NO: 1631462 - protein, 12 aa, Staphylococcus aureus
EPTPKATTPYQQ

SEQ ID NO: 1631463 - protein, 5 aa, Staphylococcus aureus
EPTTV

SEQ ID NO: 1631464 - protein, 11 aa, Staphylococcus aureus
EPYFDSPSEAV

SEQ ID NO: 1631465 - protein, 11 aa, Staphylococcus aureus
EPYPISGSHGL

SEQ ID NO: 1631466 - protein, 7 aa, Staphylococcus aureus
EQAINAG

SEQ ID NO: 1631467 - protein, 4 aa, Staphylococcus aureus
EQEI

SEQ ID NO: 1631468 - protein, 14 aa, Staphylococcus aureus
EQGEDISAKKMSDI

SEQ ID NO: 1631469 - protein, 8 aa, Staphylococcus aureus
EQHAKPIE

SEQ ID NO: 1631470 - protein, 11 aa, Staphylococcus aureus
EQKGKASQSVR

SEQ ID NO: 1631471 - protein, 18 aa, Staphylococcus aureus
EQLDEQNKVTSIDEYKES

SEQ ID NO: 1631472 - protein, 4 aa, Staphylococcus aureus
EQNL

SEQ ID NO: 1631473 - protein, 6 aa, Staphylococcus aureus
EQQNGD

SEQ ID NO: 1631474 - protein, 8 aa, Staphylococcus aureus
EQRDKEIT

SEQ ID NO: 1631475 - protein, 7 aa, Staphylococcus aureus
EQSIEME

SEQ ID NO: 1631476 - protein, 12 aa, Staphylococcus aureus
EQTNQIANKPQA

SEQ ID NO: 1631477 - protein, 4 aa, Staphylococcus aureus
EQYQ

SEQ ID NO: 1631478 - protein, 7 aa, Staphylococcus aureus
ERAGNAP

SEQ ID NO: 1631479 - protein, 48 aa, Staphylococcus aureus; identical to SEQ ID NO: 1565664

SEQ ID NO: 1631480 - protein, 20 aa, Staphylococcus aureus
ERANKKGLRIAGEESDLNDL

SEQ ID NO: 1631481 - protein, 5 aa, Staphylococcus aureus
ERAYG

SEQ ID NO: 1631482 - protein, 20 aa, Staphylococcus aureus
EREGKYQVEDDTTKDELQQA

SEQ ID NO: 1631483 - protein, 24 aa, Staphylococcus aureus
EREGKYQVEEKEAKLQEKAKNQMK

SEQ ID NO: 1631484 - protein, 11 aa, Staphylococcus aureus
ERIENADDNFN

SEQ ID NO: 1631485 - protein, 4 aa, Staphylococcus aureus
ERIS

SEQ ID NO: 1631486 - protein, 13 aa, Staphylococcus aureus
ERKVKTEKKVDKA

SEQ ID NO: 1631487 - protein, 4 aa, Staphylococcus aureus
ERLI

SEQ ID NO: 1631488 - protein, 5 aa, Staphylococcus aureus
ERNSM

SEQ ID NO: 1631489 - protein, 17 aa, Staphylococcus aureus
ERPEQTTIKQPKSLRPY

SEQ ID NO: 1631490 - protein, 6 aa, Staphylococcus aureus
ERTGAI

SEQ ID NO: 1631491 - protein, 6 aa, Staphylococcus aureus
ESAGVI

SEQ ID NO: 1631492 - protein, 4 aa, Staphylococcus aureus
ESAV

SEQ ID NO: 1631493 - protein, 10 aa, Staphylococcus aureus
ESDALSAVED

SEQ ID NO: 1631494 - protein, 4 aa, Staphylococcus aureus
ESDL

SEQ ID NO: 1631495 - protein, 23 aa, Staphylococcus aureus
ESDNIGEQVKNGLREKAKQGKLI

SEQ ID NO: 1631496 - protein, 8 aa, Staphylococcus aureus
ESESEINS

SEQ ID NO: 1631497 - protein, 8 aa, Staphylococcus aureus
ESETIEDT

SEQ ID NO: 1631498 - protein, 8 aa, Staphylococcus aureus
ESETNVNE

SEQ ID NO: 1631499 - protein, 8 aa, Staphylococcus aureus
ESFAENQS

SEQ ID NO: 1631500 - protein, 4 aa, Staphylococcus aureus
ESFE

SEQ ID NO: 1631501 - protein, 5 aa, Staphylococcus aureus
ESFEY

SEQ ID NO: 1631502 - protein, 5 aa, Staphylococcus aureus
ESFGT

SEQ ID NO: 1631503 - protein, 8 aa, Staphylococcus aureus
ESIEKESN

SEQ ID NO: 1631504 - protein, 13 aa, Staphylococcus aureus
ESIGQREISDDQS

SEQ ID NO: 1631505 - protein, 20 aa, Staphylococcus aureus
ESIHPNDDVNKSQSSNDTFP

SEQ ID NO: 1631506 - protein, 15 aa, Staphylococcus aureus
ESKEEAKEKYEAQVK

SEQ ID NO: 1631507 - protein, 16 aa, Staphylococcus aureus
ESKEEAKEKYESQNTP

SEQ ID NO: 1631508 - protein, 16 aa, Staphylococcus aureus
ESKSGGKSGDFQRQSD

SEQ ID NO: 1631509 - protein, 6 aa, Staphylococcus aureus
ESMEGS

SEQ ID NO: 1631510 - protein, 4 aa, Staphylococcus aureus
ESNA

SEQ ID NO: 1631511 - protein, 8 aa, Staphylococcus aureus
ESNEENIE

SEQ ID NO: 1631512 - protein, 23 aa, Staphylococcus aureus
ESNSWENEKNKKRILDDENDQNI

SEQ ID NO: 1631513 - protein, 6 aa, Staphylococcus aureus
ESPYSS

SEQ ID NO: 1631514 - protein, 6 aa, Staphylococcus aureus
ESQNET

SEQ ID NO: 1631515 - protein, 5 aa, Staphylococcus aureus
ESQRK

SEQ ID NO: 1631516 - protein, 14 aa, Staphylococcus aureus
ESQVNNIDKTVDNE

SEQ ID NO: 1631517 - protein, 7 aa, Staphylococcus aureus
ESRANKA

SEQ ID NO: 1631518 - protein, 14 aa, Staphylococcus aureus
ESTGAKGVIQQGTG

SEQ ID NO: 1631519 - protein, 9 aa, Staphylococcus aureus
ESTTPSIQK

SEQ ID NO: 1631520 - protein, 9 aa, Staphylococcus aureus
ESVANNKSE

SEQ ID NO: 1631521 - protein, 7 aa, Staphylococcus aureus
ESVTDEA

SEQ ID NO: 1631522 - protein, 7 aa, Staphylococcus aureus
ESYQISE

SEQ ID NO: 1631523 - protein, 9 aa, Staphylococcus aureus
ETAAAQEDL

SEQ ID NO: 1631524 - protein, 5 aa, Staphylococcus aureus
ETAGE

SEQ ID NO: 1631525 - protein, 18 aa, Staphylococcus aureus
ETDEVVPDKNAISEDSEE

SEQ ID NO: 1631526 - protein, 4 aa, Staphylococcus aureus
ETDL

SEQ ID NO: 1631527 - protein, 8 aa, Staphylococcus aureus
ETEKAGLQ

SEQ ID NO: 1631528 - protein, 24 aa, Staphylococcus aureus
ETEKQNNINHQKKKKKQERNNQMR

SEQ ID NO: 1631529 - protein, 18 aa, Staphylococcus aureus
ETKDIDGNTSFENEQTSY

SEQ ID NO: 1631530 - protein, 13 aa, Staphylococcus aureus
ETKEGSKETQIKK

SEQ ID NO: 1631531 - protein, 10 aa, Staphylococcus aureus
ETKKHINNIS

SEQ ID NO: 1631532 - protein, 15 aa, Staphylococcus aureus
ETNTETKSVPEEMEA

SEQ ID NO: 1631533 - protein, 5 aa, Staphylococcus aureus
ETQEK

SEQ ID NO: 1631534 - protein, 9 aa, Staphylococcus aureus
ETRVDKRID

SEQ ID NO: 1631535 - protein, 13 aa, Staphylococcus aureus
ETSALPGRKSGSL

SEQ ID NO: 1631536 - protein, 6 aa, Staphylococcus aureus
ETSKSD

SEQ ID NO: 1631537 - protein, 11 aa, Staphylococcus aureus
ETSTTPEERER

SEQ ID NO: 1631538 - protein, 14 aa, Staphylococcus aureus
ETTELSSDDHHTTV

SEQ ID NO: 1631539 - protein, 9 aa, Staphylococcus aureus
EVGEGDKPE

SEQ ID NO: 1631540 - protein, 8 aa, Staphylococcus aureus
EVKEHTSN

SEQ ID NO: 1631541 - protein, 8 aa, Staphylococcus aureus
EVKGDKNN

SEQ ID NO: 1631542 - protein, 5 aa, Staphylococcus aureus
EVSEE

SEQ ID NO: 1631543 - protein, 12 aa, Staphylococcus aureus
EVSEKKNEDQKE

SEQ ID NO: 1631544 - protein, 16 aa, Staphylococcus aureus
EYERTENRQSQRNGYY

SEQ ID NO: 1631545 - protein, 12 aa, Staphylococcus aureus
EYHNRQKQLQYN

SEQ ID NO: 1631546 - protein, 8 aa, Staphylococcus aureus
EYPTDTEG

SEQ ID NO: 1631547 - protein, 7 aa, Staphylococcus aureus
EYQTDKR

SEQ ID NO: 1631548 - protein, 12 aa, Staphylococcus aureus
EYSLDDVEKNSQ

SEQ ID NO: 1631549 - protein, 11 aa, Staphylococcus aureus
EYVESETYKKK

SEQ ID NO: 1631550 - protein, 7 aa, Staphylococcus aureus
FADNQSA

SEQ ID NO: 1631551 - protein, 5 aa, Staphylococcus aureus
FAEQA

SEQ ID NO: 1631552 - protein, 95 aa, Staphylococcus aureus
FAGGTGLPGSAGTSGVGGTGVPGSLGTSGVGGVGVSGSLGTSGVGGVGVSGSLGTSGVGGVGVSGSLGTSGVGGVGVSGSLGTSGVGGVVSSSIV

SEQ ID NO: 1631553 - protein, 13 aa, Staphylococcus aureus
FAKSNKQGEMNSE

SEQ ID NO: 1631554 - protein, 5 aa, Staphylococcus aureus
FASEK

SEQ ID NO: 1631555 - protein, 5 aa, Staphylococcus aureus
FASKA

SEQ ID NO: 1631556 - protein, 7 aa, Staphylococcus aureus
FATSSGM

SEQ ID NO: 1631557 - protein, 10 aa, Staphylococcus aureus
FDEEQDAVHE

SEQ ID NO: 1631558 - protein, 8 aa, Staphylococcus aureus
FDGQNVSR

SEQ ID NO: 1631559 - protein, 5 aa, Staphylococcus aureus
FDNET

SEQ ID NO: 1631560 - protein, 4 aa, Staphylococcus aureus
FDPI

SEQ ID NO: 1631561 - protein, 4 aa, Staphylococcus aureus
FDQV

SEQ ID NO: 1631562 - protein, 11 aa, Staphylococcus aureus
FDRQVQKGAKS

SEQ ID NO: 1631563 - protein, 8 aa, Staphylococcus aureus
FDSEQEEE

SEQ ID NO: 1631564 - protein, 10 aa, Staphylococcus aureus
FDSSDGSKVS

SEQ ID NO: 1631565 - protein, 8 aa, Staphylococcus aureus
FDSSSEAV

SEQ ID NO: 1631566 - protein, 10 aa, Staphylococcus aureus
FDVTETKGNY

SEQ ID NO: 1631567 - protein, 14 aa, Staphylococcus aureus
FEDFGTTDSLRSDA

SEQ ID NO: 1631568 - protein, 6 aa, Staphylococcus aureus
FEGKGV

SEQ ID NO: 1631569 - protein, 11 aa, Staphylococcus aureus
FENGHGKAELY

SEQ ID NO: 1631570 - protein, 9 aa, Staphylococcus aureus
FEPKEQEPE

SEQ ID NO: 1631571 - protein, 18 aa, Staphylococcus aureus
FEPKEQEPEFITDLSPYT

SEQ ID NO: 1631572 - protein, 5 aa, Staphylococcus aureus
FEQDD

SEQ ID NO: 1631573 - protein, 4 aa, Staphylococcus aureus
FETL

SEQ ID NO: 1631574 - protein, 10 aa, Staphylococcus aureus
FGDSGNDEAY

SEQ ID NO: 1631575 - protein, 8 aa, Staphylococcus aureus
FGDSPLTE

SEQ ID NO: 1631576 - protein, 5 aa, Staphylococcus aureus
FGEPE

SEQ ID NO: 1631577 - protein, 6 aa, Staphylococcus aureus
FGGNAW

SEQ ID NO: 1631578 - protein, 17 aa, Staphylococcus aureus
FGGNDLGSDALKDKLNS

SEQ ID NO: 1631579 - protein, 12 aa, Staphylococcus aureus
FGKDKQTSEQTY

SEQ ID NO: 1631580 - protein, 12 aa, Staphylococcus aureus
FGKDLKSAEDLN

SEQ ID NO: 1631581 - protein, 25 aa, Staphylococcus aureus
FGKPQKVITDQAPSTKVAMAKVIKA

SEQ ID NO: 1631582 - protein, 6 aa, Staphylococcus aureus
FGPMGR

SEQ ID NO: 1631583 - protein, 5 aa, Staphylococcus aureus
FGTPT

SEQ ID NO: 1631584 - protein, 15 aa, Staphylococcus aureus
FKDERDEYKKQRDEL

SEQ ID NO: 1631585 - protein, 8 aa, Staphylococcus aureus
FKEQHKDS

SEQ ID NO: 1631586 - protein, 6 aa, Staphylococcus aureus
FKEVTT

SEQ ID NO: 1631587 - protein, 9 aa, Staphylococcus aureus
FKKEGHEPW

SEQ ID NO: 1631588 - protein, 6 aa, Staphylococcus aureus
FKQNAP

SEQ ID NO: 1631589 - protein, 6 aa, Staphylococcus aureus
FKSNKQ

SEQ ID NO: 1631590 - protein, 16 aa, Staphylococcus aureus
FKTNKKINGDTKDIAE

SEQ ID NO: 1631591 - protein, 12 aa, Staphylococcus aureus
FNDNGTYLKTGE

SEQ ID NO: 1631592 - protein, 14 aa, Staphylococcus aureus
FNETNVSTKWQNIL

SEQ ID NO: 1631593 - protein, 11 aa, Staphylococcus aureus
FNKDKKRKADT

SEQ ID NO: 1631594 - protein, 8 aa, Staphylococcus aureus
FNQKSPEI

SEQ ID NO: 1631595 - protein, 16 aa, Staphylococcus aureus
FNTDESLKSHIPKENF

SEQ ID NO: 1631596 - protein, 9 aa, Staphylococcus aureus
FNVTENGTL

SEQ ID NO: 1631597 - protein, 4 aa, Staphylococcus aureus
FPGK

SEQ ID NO: 1631598 - protein, 17 aa, Staphylococcus aureus
FQNEVTHRNYDKTANFA

SEQ ID NO: 1631599 - protein, 7 aa, Staphylococcus aureus
FQRQNSN

SEQ ID NO: 1631600 - protein, 10 aa, Staphylococcus aureus
FRAEKSKTRR

SEQ ID NO: 1631601 - protein, 12 aa, Staphylococcus aureus
FRPTTEAKRNLK

SEQ ID NO: 1631602 - protein, 7 aa, Staphylococcus aureus
FRTNNDY

SEQ ID NO: 1631603 - protein, 11 aa, Staphylococcus aureus
FSDEDGIRAAE

SEQ ID NO: 1631604 - protein, 8 aa, Staphylococcus aureus
FSDTNNNI

SEQ ID NO: 1631605 - protein, 11 aa, Staphylococcus aureus
FSEYKKDALAK

SEQ ID NO: 1631606 - protein, 12 aa, Staphylococcus aureus
FSEYKKDALAKI

SEQ ID NO: 1631607 - protein, 5 aa, Staphylococcus aureus
FSGNL

SEQ ID NO: 1631608 - protein, 10 aa, Staphylococcus aureus
FSKEKDDETF

SEQ ID NO: 1631609 - protein, 4 aa, Staphylococcus aureus
FSKI

SEQ ID NO: 1631610 - protein, 18 aa, Staphylococcus aureus
FSKNENISLKGEETTTGD

SEQ ID NO: 1631611 - protein, 8 aa, Staphylococcus aureus
FSPPAKDI

SEQ ID NO: 1631612 - protein, 4 aa, Staphylococcus aureus
FTEA

SEQ ID NO: 1631613 - protein, 12 aa, Staphylococcus aureus
FTKESKGASMED

SEQ ID NO: 1631614 - protein, 37 aa, Staphylococcus aureus
FTPETKSITVNTDDNVEPNIAPSTATNKTLKYTSEHP

SEQ ID NO: 1631615 - protein, 39 aa, Staphylococcus aureus; identical to SEQ ID NO: 1565846

SEQ ID NO: 1631616 - protein, 18 aa, Staphylococcus aureus
FTQQGDNHSAEQSAQAFQ

SEQ ID NO: 1631617 - protein, 4 aa, Staphylococcus aureus
FTQS

SEQ ID NO: 1631618 - protein, 11 aa, Staphylococcus aureus
FTQSPTKGALE

SEQ ID NO: 1631619 - protein, 15 aa, Staphylococcus aureus
FTSTANRNETTSSGM

SEQ ID NO: 1631620 - protein, 12 aa, Staphylococcus aureus
FTTNATNADNIK

SEQ ID NO: 1631621 - protein, 10 aa, Staphylococcus aureus
GAADGPIKTL

SEQ ID NO: 1631622 - protein, 18 aa, Staphylococcus aureus
GAEEVSTSAFADELIKNL

SEQ ID NO: 1631623 - protein, 5 aa, Staphylococcus aureus
GAGKS

SEQ ID NO: 1631624 - protein, 13 aa, Staphylococcus aureus
GAHQTINSKEENL

SEQ ID NO: 1631625 - protein, 21 aa, Staphylococcus aureus
GAQALPELTPGGDVVAPSPIS

SEQ ID NO: 1631626 - protein, 5 aa, Staphylococcus aureus
GAQSI

SEQ ID NO: 1631627 - protein, 4 aa, Staphylococcus aureus
GARY

SEQ ID NO: 1631628 - protein, 10 aa, Staphylococcus aureus
GATNNHTPIE

SEQ ID NO: 1631629 - protein, 11 aa, Staphylococcus aureus
GATTTKEDITK

SEQ ID NO: 1631630 - protein, 30 aa, Staphylococcus aureus
GDDEELDKAVKDVSNNNPNHTVIVDDIPLE

SEQ ID NO: 1631631 - protein, 9 aa, Staphylococcus aureus
GDENSNEWM

SEQ ID NO: 1631632 - protein, 7 aa, Staphylococcus aureus
GDFEVSK

SEQ ID NO: 1631633 - protein, 6 aa, Staphylococcus aureus
GDFPEK

SEQ ID NO: 1631634 - protein, 13 aa, Staphylococcus aureus
GDGDLKGSSIGSK

SEQ ID NO: 1631635 - protein, 7 aa, Staphylococcus aureus
GDIAESI

SEQ ID NO: 1631636 - protein, 15 aa, Staphylococcus aureus
GDKFKYDNDIKNSIG

SEQ ID NO: 1631637 - protein, 7 aa, Staphylococcus aureus
GDKPEIT

SEQ ID NO: 1631638 - protein, 15 aa, Staphylococcus aureus
GDNGDENVNKKGGKR

SEQ ID NO: 1631639 - protein, 7 aa, Staphylococcus aureus
GDNSIDI

SEQ ID NO: 1631640 - protein, 6 aa, Staphylococcus aureus
GDQKLT

SEQ ID NO: 1631641 - protein, 38 aa, Staphylococcus aureus
GDSEDAVQTEHVGEDTASSKVHEQHTTNVKVRDIGDDK

SEQ ID NO: 1631642 - protein, 4 aa, Staphylococcus aureus
GDSM

SEQ ID NO: 1631643 - protein, 10 aa, Staphylococcus aureus
GDSNTANPNY

SEQ ID NO: 1631644 - protein, 10 aa, Staphylococcus aureus
GDTANDMKTA

SEQ ID NO: 1631645 - protein, 14 aa, Staphylococcus aureus
GDYATGGDTTIESG

SEQ ID NO: 1631646 - protein, 7 aa, Staphylococcus aureus
GEAESSL

SEQ ID NO: 1631647 - protein, 15 aa, Staphylococcus aureus
GEEGHGHDIDTSKGT

SEQ ID NO: 1631648 - protein, 16 aa, Staphylococcus aureus
GEGDDKAAIDNDTTNK

SEQ ID NO: 1631649 - protein, 12 aa, Staphylococcus aureus
GEGRVACTPENV

SEQ ID NO: 1631650 - protein, 12 aa, Staphylococcus aureus
GEGYKATNFSDA

SEQ ID NO: 1631651 - protein, 4 aa, Staphylococcus aureus
GEHA

SEQ ID NO: 1631652 - protein, 27 aa, Staphylococcus aureus
GEHKKDESADFNKNDQYWGEKSKLNKV

SEQ ID NO: 1631653 - protein, 15 aa, Staphylococcus aureus
GEKEVRKSNTNDTDF

SEQ ID NO: 1631654 - protein, 24 aa, Staphylococcus aureus
GEKEVRKSNVQKFENRTSRSSKIE

SEQ ID NO: 1631655 - protein, 9 aa, Staphylococcus aureus
GEKHAINQQ

SEQ ID NO: 1631656 - protein, 9 aa, Staphylococcus aureus
GEKRRQPSP

SEQ ID NO: 1631657 - protein, 25 aa, Staphylococcus aureus
GEKVGTFENQKKASVVSDSHTEDHS

SEQ ID NO: 1631658 - protein, 61 aa, Staphylococcus aureus
GENPPIPSKEHTAPLKEHTEPIKRNKESFKDAMERKDQLKQAEMPKIEEKDEEMVDISIDD

SEQ ID NO: 1631659 - protein, 8 aa, Staphylococcus aureus
GENVAEPF

SEQ ID NO: 1631660 - protein, 6 aa, Staphylococcus aureus
GESSER

SEQ ID NO: 1631661 - protein, 4 aa, Staphylococcus aureus
GEVL

SEQ ID NO: 1631662 - protein, 32 aa, Staphylococcus aureus
GEWEEKKLGDLTTKIGSGKTPKGGSENYTNKG

SEQ ID NO: 1631663 - protein, 10 aa, Staphylococcus aureus
GFAKEQENLA

SEQ ID NO: 1631664 - protein, 20 aa, Staphylococcus aureus
GFGYKDTTKTISSKRSISIN

SEQ ID NO: 1631665 - protein, 12 aa, Staphylococcus aureus
GFNTNNSQDQAK

SEQ ID NO: 1631666 - protein, 5 aa, Staphylococcus aureus
GGAGH

SEQ ID NO: 1631667 - protein, 6 aa, Staphylococcus aureus
GGDAKN

SEQ ID NO: 1631668 - protein, 6 aa, Staphylococcus aureus
GGGGIP

SEQ ID NO: 1631669 - protein, 14 aa, Staphylococcus aureus
GGGYTVSAARTERR

SEQ ID NO: 1631670 - protein, 9 aa, Staphylococcus aureus
GGHSNDTDI

SEQ ID NO: 1631671 - protein, 11 aa, Staphylococcus aureus
GGIQEETPSFN

SEQ ID NO: 1631672 - protein, 8 aa, Staphylococcus aureus
GGKAANII

SEQ ID NO: 1631673 - protein, 5 aa, Staphylococcus aureus
GGLEP

SEQ ID NO: 1631674 - protein, 13 aa, Staphylococcus aureus
GGNGPANKSTKGY

SEQ ID NO: 1631675 - protein, 16 aa, Staphylococcus aureus
GGNKITGDSKETQIKK

SEQ ID NO: 1631676 - protein, 5 aa, Staphylococcus aureus
GGTET

SEQ ID NO: 1631677 - protein, 9 aa, Staphylococcus aureus
GGTKNQYEK

SEQ ID NO: 1631678 - protein, 9 aa, Staphylococcus aureus
GHADSNEVY

SEQ ID NO: 1631679 - protein, 16 aa, Staphylococcus aureus
GHDDGGQLTEKVRRKP

SEQ ID NO: 1631680 - protein, 7 aa, Staphylococcus aureus
GHHNNDR

SEQ ID NO: 1631681 - protein, 4 aa, Staphylococcus aureus
GHLT

SEQ ID NO: 1631682 - protein, 24 aa, Staphylococcus aureus
GHNDINNAMTKEEIEQAKAQLGQA

SEQ ID NO: 1631683 - protein, 8 aa, Staphylococcus aureus
GHNGINNA

SEQ ID NO: 1631684 - protein, 18 aa, Staphylococcus aureus
GHRSQQDPEFNEQYKEEM

SEQ ID NO: 1631685 - protein, 7 aa, Staphylococcus aureus
GHTSVKG

SEQ ID NO: 1631686 - protein, 8 aa, Staphylococcus aureus
GIAGSYAE

SEQ ID NO: 1631687 - protein, 4 aa, Staphylococcus aureus
GIAP

SEQ ID NO: 1631688 - protein, 15 aa, Staphylococcus aureus
GIDENTTSHHLSNQK

SEQ ID NO: 1631689 - protein, 5 aa, Staphylococcus aureus
GIDNP

SEQ ID NO: 1631690 - protein, 15 aa, Staphylococcus aureus
GIEDRGQYYDSTGAL

SEQ ID NO: 1631691 - protein, 5 aa, Staphylococcus aureus
GIEGK

SEQ ID NO: 1631692 - protein, 6 aa, Staphylococcus aureus
GIEPNK

SEQ ID NO: 1631693 - protein, 12 aa, Staphylococcus aureus
GIPDNAKYEQVK

SEQ ID NO: 1631694 - protein, 11 aa, Staphylococcus aureus
GIQANAGTLNQ

SEQ ID NO: 1631695 - protein, 6 aa, Staphylococcus aureus
GIQGHN

SEQ ID NO: 1631696 - protein, 6 aa, Staphylococcus aureus
GISPST

SEQ ID NO: 1631697 - protein, 7 aa, Staphylococcus aureus
GITNEET

SEQ ID NO: 1631698 - protein, 13 aa, Staphylococcus aureus
GIYNGGGKAEGPY

SEQ ID NO: 1631699 - protein, 7 aa, Staphylococcus aureus
GKATGSL

SEQ ID NO: 1631700 - protein, 10 aa, Staphylococcus aureus
GKDAPSYETS

SEQ ID NO: 1631701 - protein, 15 aa, Staphylococcus aureus
GKDFGEENVVGPNDN

SEQ ID NO: 1631702 - protein, 9 aa, Staphylococcus aureus
GKEDKVKAW

SEQ ID NO: 1631703 - protein, 9 aa, Staphylococcus aureus
GKIEEGESR

SEQ ID NO: 1631704 - protein, 12 aa, Staphylococcus aureus
GKIEKNETEKDA

SEQ ID NO: 1631705 - protein, 8 aa, Staphylococcus aureus
GKLSKENK

SEQ ID NO: 1631706 - protein, 12 aa, Staphylococcus aureus
GKLSNDNPNVKQ

SEQ ID NO: 1631707 - protein, 6 aa, Staphylococcus aureus
GKNVKK

SEQ ID NO: 1631708 - protein, 10 aa, Staphylococcus aureus
GKPFGENGNR

SEQ ID NO: 1631709 - protein, 15 aa, Staphylococcus aureus
GKPGDTVVDDHTDDE

SEQ ID NO: 1631710 - protein, 9 aa, Staphylococcus aureus
GKPRDLQYE

SEQ ID NO: 1631711 - protein, 16 aa, Staphylococcus aureus
GKQAMQAKSDRALNEA

SEQ ID NO: 1631712 - protein, 8 aa, Staphylococcus aureus
GKQFNPDG

SEQ ID NO: 1631713 - protein, 16 aa, Staphylococcus aureus
GKRAQHSEIGSSISTD

SEQ ID NO: 1631714 - protein, 6 aa, Staphylococcus aureus
GKRQEE

SEQ ID NO: 1631715 - protein, 5 aa, Staphylococcus aureus
GKSHD

SEQ ID NO: 1631716 - protein, 4 aa, Staphylococcus aureus
GKVI

SEQ ID NO: 1631717 - protein, 8 aa, Staphylococcus aureus
GLDYEKRQ

SEQ ID NO: 1631718 - protein, 9 aa, Staphylococcus aureus
GLNSDGAYS

SEQ ID NO: 1631719 - protein, 18 aa, Staphylococcus aureus
GMQRARKELDYTANSNTV

SEQ ID NO: 1631720 - protein, 16 aa, Staphylococcus aureus
GMSPKTHEAAEKGLPN

SEQ ID NO: 1631721 - protein, 5 aa, Staphylococcus aureus
GMTED

SEQ ID NO: 1631722 - protein, 8 aa, Staphylococcus aureus
GNAAATAY

SEQ ID NO: 1631723 - protein, 5 aa, Staphylococcus aureus
GNDEI

SEQ ID NO: 1631724 - protein, 15 aa, Staphylococcus aureus
GNEIKEDAKEEQIKK

SEQ ID NO: 1631725 - protein, 6 aa, Staphylococcus aureus
GNEIKQ

SEQ ID NO: 1631726 - protein, 5 aa, Staphylococcus aureus
GNENK

SEQ ID NO: 1631727 - protein, 12 aa, Staphylococcus aureus
GNFTGNKKKGVG

SEQ ID NO: 1631728 - protein, 10 aa, Staphylococcus aureus
GNGDSSQTRI

SEQ ID NO: 1631729 - protein, 9 aa, Staphylococcus aureus
GNGERDEPV

SEQ ID NO: 1631730 - protein, 32 aa, Staphylococcus aureus
GNHKLSSKKSEESKQETVKKESEEEKDPDLEK

SEQ ID NO: 1631731 - protein, 37 aa, Staphylococcus aureus
GNHKLSSKKSEESKQETVKKESEEEKDPDLEKYEEIE

SEQ ID NO: 1631732 - protein, 9 aa, Staphylococcus aureus
GNISKYTGK

SEQ ID NO: 1631733 - protein, 7 aa, Staphylococcus aureus
GNKRDKY

SEQ ID NO: 1631734 - protein, 12 aa, Staphylococcus aureus
GNNDVDKKEGIH

SEQ ID NO: 1631735 - protein, 6 aa, Staphylococcus aureus
GNNGYY

SEQ ID NO: 1631736 - protein, 19 aa, Staphylococcus aureus
GNRLTKDGSTKWDPSKSYI

SEQ ID NO: 1631737 - protein, 20 aa, Staphylococcus aureus
GNRLTNDGSTTWDPSKSYIK

SEQ ID NO: 1631738 - protein, 18 aa, Staphylococcus aureus
GNRMVDEDATLNDIKKDT

SEQ ID NO: 1631739 - protein, 7 aa, Staphylococcus aureus
GNSEQLP

SEQ ID NO: 1631740 - protein, 12 aa, Staphylococcus aureus
GNSGGIVSSEPL

SEQ ID NO: 1631741 - protein, 4 aa, Staphylococcus aureus
GNSI

SEQ ID NO: 1631742 - protein, 13 aa, Staphylococcus aureus
GPDYTDLTEQNTH

SEQ ID NO: 1631743 - protein, 21 aa, Staphylococcus aureus
GPNTEADEKSAYNNVQVGGAP

SEQ ID NO: 1631744 - protein, 21 aa, Staphylococcus aureus
GPNTEKFEKNSTNNASWAQTF

SEQ ID NO: 1631745 - protein, 6 aa, Staphylococcus aureus
GPNTEN

SEQ ID NO: 1631746 - protein, 12 aa, Staphylococcus aureus
GPQHRSWPIVSF

SEQ ID NO: 1631747 - protein, 6 aa, Staphylococcus aureus
GPQQRE

SEQ ID NO: 1631748 - protein, 6 aa, Staphylococcus aureus
GPRVIT

SEQ ID NO: 1631749 - protein, 6 aa, Staphylococcus aureus
GPSTEN

SEQ ID NO: 1631750 - protein, 5 aa, Staphylococcus aureus
GQAYY

SEQ ID NO: 1631751 - protein, 16 aa, Staphylococcus aureus
GQGNFGSMDGDGAAAM

SEQ ID NO: 1631752 - protein, 7 aa, Staphylococcus aureus
GQHETQS

SEQ ID NO: 1631753 - protein, 7 aa, Staphylococcus aureus
GQLENPD

SEQ ID NO: 1631754 - protein, 12 aa, Staphylococcus aureus
GQSSTGKSTAAA

SEQ ID NO: 1631755 - protein, 5 aa, Staphylococcus aureus
GREFS

SEQ ID NO: 1631756 - protein, 7 aa, Staphylococcus aureus
GRGERTI

SEQ ID NO: 1631757 - protein, 9 aa, Staphylococcus aureus
GRINTPSNV

SEQ ID NO: 1631758 - protein, 7 aa, Staphylococcus aureus
GRLKDAK

SEQ ID NO: 1631759 - protein, 7 aa, Staphylococcus aureus
GRNVGEA

SEQ ID NO: 1631760 - protein, 6 aa, Staphylococcus aureus
GRPRNE

SEQ ID NO: 1631761 - protein, 8 aa, Staphylococcus aureus
GRSEGAKV

SEQ ID NO: 1631762 - protein, 7 aa, Staphylococcus aureus
GRSRRMI

SEQ ID NO: 1631763 - protein, 14 aa, Staphylococcus aureus
GRSTTTEDQTGDTL

SEQ ID NO: 1631764 - protein, 9 aa, Staphylococcus aureus
GRTGRGNYK

SEQ ID NO: 1631765 - protein, 6 aa, Staphylococcus aureus
GRYSKE

SEQ ID NO: 1631766 - protein, 17 aa, Staphylococcus aureus
GSEISKQYGEAGLPENT

SEQ ID NO: 1631767 - protein, 6 aa, Staphylococcus aureus
GSESPF

SEQ ID NO: 1631768 - protein, 5 aa, Staphylococcus aureus
GSGCR

SEQ ID NO: 1631769 - protein, 5 aa, Staphylococcus aureus
GSGTG

SEQ ID NO: 1631770 - protein, 11 aa, Staphylococcus aureus
GSHPGNDTAVD

SEQ ID NO: 1631771 - protein, 26 aa, Staphylococcus aureus
GSKTPGHPEYRHTDGVEVTTGPLGQG

SEQ ID NO: 1631772 - protein, 6 aa, Staphylococcus aureus
GSMPKE

SEQ ID NO: 1631773 - protein, 7 aa, Staphylococcus aureus
GSNARDL

SEQ ID NO: 1631774 - protein, 10 aa, Staphylococcus aureus
GSSYSDSKYE

SEQ ID NO: 1631775 - protein, 30 aa, Staphylococcus aureus
GTDPVELGKKVSNKLKEQGAYEIIKCLNEQ

SEQ ID NO: 1631776 - protein, 8 aa, Staphylococcus aureus
GTFNPADT

SEQ ID NO: 1631777 - protein, 8 aa, Staphylococcus aureus
GTGEQKIN

SEQ ID NO: 1631778 - protein, 10 aa, Staphylococcus aureus
GTGIDDESAI

SEQ ID NO: 1631779 - protein, 8 aa, Staphylococcus aureus
GTGPQHRE

SEQ ID NO: 1631780 - protein, 4 aa, Staphylococcus aureus
GTGV

SEQ ID NO: 1631781 - protein, 6 aa, Staphylococcus aureus
GTHGVD

SEQ ID NO: 1631782 - protein, 4 aa, Staphylococcus aureus
GTIQ

SEQ ID NO: 1631783 - protein, 6 aa, Staphylococcus aureus
GTKNGS

SEQ ID NO: 1631784 - protein, 4 aa, Staphylococcus aureus
GTLE

SEQ ID NO: 1631785 - protein, 4 aa, Staphylococcus aureus
GTLG

SEQ ID NO: 1631786 - protein, 4 aa, Staphylococcus aureus
GTLS

SEQ ID NO: 1631787 - protein, 10 aa, Staphylococcus aureus
GTLSGNPLAM

SEQ ID NO: 1631788 - protein, 6 aa, Staphylococcus aureus
GTNNKI

SEQ ID NO: 1631789 - protein, 6 aa, Staphylococcus aureus
GTNPFS

SEQ ID NO: 1631790 - protein, 15 aa, Staphylococcus aureus
GTSKNNKPFSKYGHG

SEQ ID NO: 1631791 - protein, 8 aa, Staphylococcus aureus
GTVEMRDG

SEQ ID NO: 1631792 - protein, 9 aa, Staphylococcus aureus
GTYKGEKVS

SEQ ID NO: 1631793 - protein, 8 aa, Staphylococcus aureus
GVDPSIKT

SEQ ID NO: 1631794 - protein, 23 aa, Staphylococcus aureus
GVGPQTKRISKGNSTDNVSWGRT

SEQ ID NO: 1631795 - protein, 6 aa, Staphylococcus aureus
GVGVQT

SEQ ID NO: 1631796 - protein, 11 aa, Staphylococcus aureus
GVKDKGNTLNT

SEQ ID NO: 1631797 - protein, 12 aa, Staphylococcus aureus
GVKNGVPTPGFS

SEQ ID NO: 1631798 - protein, 9 aa, Staphylococcus aureus
GVNSNGSVR

SEQ ID NO: 1631799 - protein, 22 aa, Staphylococcus aureus
GVQEPTHKRTFTNKKNKEIKGY

SEQ ID NO: 1631800 - protein, 8 aa, Staphylococcus aureus
GVSGNSIS

SEQ ID NO: 1631801 - protein, 9 aa, Staphylococcus aureus
GVSTRPGHE

SEQ ID NO: 1631802 - protein, 13 aa, Staphylococcus aureus
GWQEGDDSILQQG

SEQ ID NO: 1631803 - protein, 6 aa, Staphylococcus aureus
GYDTVT

SEQ ID NO: 1631804 - protein, 6 aa, Staphylococcus aureus
GYERRN

SEQ ID NO: 1631805 - protein, 5 aa, Staphylococcus aureus
GYKAF

SEQ ID NO: 1631806 - protein, 11 aa, Staphylococcus aureus
GYKASSTNSDT

SEQ ID NO: 1631807 - protein, 7 aa, Staphylococcus aureus
GYNGHQG

SEQ ID NO: 1631808 - protein, 13 aa, Staphylococcus aureus
GYSEAQAKEEGLA

SEQ ID NO: 1631809 - protein, 19 aa, Staphylococcus aureus
GYTRDGKNIHQEVLELLQK

SEQ ID NO: 1631810 - protein, 19 aa, Staphylococcus aureus
GYVEENNKSFVKNSNNAMS

SEQ ID NO: 1631811 - protein, 13 aa, Staphylococcus aureus
HAGGRGKAGGVKI

SEQ ID NO: 1631812 - protein, 17 aa, Staphylococcus aureus
HANDNDKSNIKRIRVIK

SEQ ID NO: 1631813 - protein, 35 aa, Staphylococcus aureus
HATKDTRTRDTHRHLDGESVEIDQNFKSSGCVGQA

SEQ ID NO: 1631814 - protein, 9 aa, Staphylococcus aureus
HDAGYNVKE

SEQ ID NO: 1631815 - protein, 16 aa, Staphylococcus aureus
HDEDGRPKSKDKEYPV

SEQ ID NO: 1631816 - protein, 5 aa, Staphylococcus aureus
HDGFK

SEQ ID NO: 1631817 - protein, 37 aa, Staphylococcus aureus; identical to SEQ ID NO: 1567090

SEQ ID NO: 1631818 - protein, 8 aa, Staphylococcus aureus
HDSEYRFT

SEQ ID NO: 1631819 - protein, 4 aa, Staphylococcus aureus
HDSY

SEQ ID NO: 1631820 - protein, 10 aa, Staphylococcus aureus
HEHNKDKQTA

SEQ ID NO: 1631821 - protein, 6 aa, Staphylococcus aureus
HEIKES

SEQ ID NO: 1631822 - protein, 11 aa, Staphylococcus aureus
HEQTPWKNKEK

SEQ ID NO: 1631823 - protein, 4 aa, Staphylococcus aureus
HETD

SEQ ID NO: 1631824 - protein, 14 aa, Staphylococcus aureus
HFKNREKAQKILEP

SEQ ID NO: 1631825 - protein, 21 aa, Staphylococcus aureus
HGESGLDGPKLPSTPSRQAVA

SEQ ID NO: 1631826 - protein, 5 aa, Staphylococcus aureus
HGETG

SEQ ID NO: 1631827 - protein, 13 aa, Staphylococcus aureus
HGFRPNRSTGTAL

SEQ ID NO: 1631828 - protein, 14 aa, Staphylococcus aureus
HGHGKEDIQLQESD

SEQ ID NO: 1631829 - protein, 15 aa, Staphylococcus aureus
HGHGKEDVQLQDSDV

SEQ ID NO: 1631830 - protein, 10 aa, Staphylococcus aureus
HGKGTENKTV

SEQ ID NO: 1631831 - protein, 6 aa, Staphylococcus aureus
HGKTTL

SEQ ID NO: 1631832 - protein, 7 aa, Staphylococcus aureus
HGNQLEN

SEQ ID NO: 1631833 - protein, 8 aa, Staphylococcus aureus
HGNQLENT

SEQ ID NO: 1631834 - protein, 5 aa, Staphylococcus aureus
HGRQN

SEQ ID NO: 1631835 - protein, 7 aa, Staphylococcus aureus
HGSDDKI

SEQ ID NO: 1631836 - protein, 6 aa, Staphylococcus aureus
HGSDFT

SEQ ID NO: 1631837 - protein, 6 aa, Staphylococcus aureus
HGTENT

SEQ ID NO: 1631838 - protein, 4 aa, Staphylococcus aureus
HGVT

SEQ ID NO: 1631839 - protein, 18 aa, Staphylococcus aureus
HHDKQAEQLVEETKDNID

SEQ ID NO: 1631840 - protein, 4 aa, Staphylococcus aureus
HHNN

SEQ ID NO: 1631841 - protein, 7 aa, Staphylococcus aureus
HHQNQNA

SEQ ID NO: 1631842 - protein, 6 aa, Staphylococcus aureus
HHTTTA

SEQ ID NO: 1631843 - protein, 21 aa, Staphylococcus aureus
HIDGQNSPEKPTDKNTDNKQL

SEQ ID NO: 1631844 - protein, 15 aa, Staphylococcus aureus
HIPNGDADDMNAEAS

SEQ ID NO: 1631845 - protein, 6 aa, Staphylococcus aureus
HKFDDK

SEQ ID NO: 1631846 - protein, 4 aa, Staphylococcus aureus
HKKA

SEQ ID NO: 1631847 - protein, 13 aa, Staphylococcus aureus
HKKEQGQRVRELF

SEQ ID NO: 1631848 - protein, 32 aa, Staphylococcus aureus
HKNLNLDDAEDGNLINTSDEDKTTDEEEKAHS

SEQ ID NO: 1631849 - protein, 7 aa, Staphylococcus aureus
HKRVDDE

SEQ ID NO: 1631850 - protein, 8 aa, Staphylococcus aureus
HKRVDDET

SEQ ID NO: 1631851 - protein, 15 aa, Staphylococcus aureus
HLDRDKDNRACEPDK

SEQ ID NO: 1631852 - protein, 7 aa, Staphylococcus aureus
HNDNNRI

SEQ ID NO: 1631853 - protein, 21 aa, Staphylococcus aureus
HNEKGRKKTKIYTQHRKYCKK

SEQ ID NO: 1631854 - protein, 5 aa, Staphylococcus aureus
HNGYF

SEQ ID NO: 1631855 - protein, 7 aa, Staphylococcus aureus
HNPKDYN

SEQ ID NO: 1631856 - protein, 4 aa, Staphylococcus aureus
HPDV

SEQ ID NO: 1631857 - protein, 11 aa, Staphylococcus aureus
HPKKDRVAYEA

SEQ ID NO: 1631858 - protein, 6 aa, Staphylococcus aureus
HPSNQP

SEQ ID NO: 1631859 - protein, 13 aa, Staphylococcus aureus
HPTTGGVSASFAS

SEQ ID NO: 1631860 - protein, 15 aa, Staphylococcus aureus
HQEKRSQVLATFKAL

SEQ ID NO: 1631861 - protein, 8 aa, Staphylococcus aureus
HQQGQTGF

SEQ ID NO: 1631862 - protein, 9 aa, Staphylococcus aureus
HQRNGKKYQ

SEQ ID NO: 1631863 - protein, 4 aa, Staphylococcus aureus
HQSM

SEQ ID NO: 1631864 - protein, 5 aa, Staphylococcus aureus
HRQNK

SEQ ID NO: 1631865 - protein, 23 aa, Staphylococcus aureus
HSDESIHPNDDVNKSQSSNDTFP

SEQ ID NO: 1631866 - protein, 6 aa, Staphylococcus aureus
HSESPE

SEQ ID NO: 1631867 - protein, 5 aa, Staphylococcus aureus
HSNAY

SEQ ID NO: 1631868 - protein, 8 aa, Staphylococcus aureus
HSNAYQKG

SEQ ID NO: 1631869 - protein, 16 aa, Staphylococcus aureus
HSPEKVLPLSKKCIST

SEQ ID NO: 1631870 - protein, 11 aa, Staphylococcus aureus
HSQITQPTHQV

SEQ ID NO: 1631871 - protein, 6 aa, Staphylococcus aureus
HSYAEK

SEQ ID NO: 1631872 - protein, 7 aa, Staphylococcus aureus
HTAGDDR

SEQ ID NO: 1631873 - protein, 9 aa, Staphylococcus aureus
HTDKSTIEE

SEQ ID NO: 1631874 - protein, 14 aa, Staphylococcus aureus
HTGVSDELGGQGVG

SEQ ID NO: 1631875 - protein, 9 aa, Staphylococcus aureus
HTSHKAMSD

SEQ ID NO: 1631876 - protein, 6 aa, Staphylococcus aureus
HTYKDN

SEQ ID NO: 1631877 - protein, 5 aa, Staphylococcus aureus
HTYRG

SEQ ID NO: 1631878 - protein, 14 aa, Staphylococcus aureus
HYSKTGAHIVPYID

SEQ ID NO: 1631879 - protein, 7 aa, Staphylococcus aureus
IAANKDS

SEQ ID NO: 1631880 - protein, 34 aa, Staphylococcus aureus; identical to SEQ ID NO: 1566835

SEQ ID NO: 1631881 - protein, 34 aa, Staphylococcus aureus; identical to SEQ ID NO: 1567094

SEQ ID NO: 1631882 - protein, 30 aa, Staphylococcus aureus
IADNQATLASEDYHDATAQRQNDYNQAVTA

SEQ ID NO: 1631883 - protein, 5 aa, Staphylococcus aureus
IAEND

SEQ ID NO: 1631884 - protein, 9 aa, Staphylococcus aureus
IAKDRNKVT

SEQ ID NO: 1631885 - protein, 13 aa, Staphylococcus aureus
IAKNKSEETSLSG

SEQ ID NO: 1631886 - protein, 5 aa, Staphylococcus aureus
IAKRQ

SEQ ID NO: 1631887 - protein, 6 aa, Staphylococcus aureus
IAKTSM

SEQ ID NO: 1631888 - protein, 7 aa, Staphylococcus aureus
IAKTTAK

SEQ ID NO: 1631889 - protein, 8 aa, Staphylococcus aureus
IAKTTTKI

SEQ ID NO: 1631890 - protein, 20 aa, Staphylococcus aureus
IANADDPVEAAKQCRDAIEG

SEQ ID NO: 1631891 - protein, 12 aa, Staphylococcus aureus
IANGQELNKLNQ

SEQ ID NO: 1631892 - protein, 15 aa, Staphylococcus aureus
IANRPTDGGLSWSDD

SEQ ID NO: 1631893 - protein, 23 aa, Staphylococcus aureus
IAQSDKSSKDESFAVGNTKNPKN

SEQ ID NO: 1631894 - protein, 5 aa, Staphylococcus aureus
IASSR

SEQ ID NO: 1631895 - protein, 9 aa, Staphylococcus aureus
IATDKKENK

SEQ ID NO: 1631896 - protein, 17 aa, Staphylococcus aureus
IATHDSDFAKNEDGSYY

SEQ ID NO: 1631897 - protein, 6 aa, Staphylococcus aureus
IATNET

SEQ ID NO: 1631898 - protein, 11 aa, Staphylococcus aureus
IATQTATQTQT

SEQ ID NO: 1631899 - protein, 13 aa, Staphylococcus aureus
IDAGSSQAHEQEK

SEQ ID NO: 1631900 - protein, 75 aa, Staphylococcus aureus
IDAQDDLKEKESQAYADGKISEEEQRAIQDAQAKLEEAKQNAELKARNAEKKANAYTDNKVKESTDAQRKTLTRY

SEQ ID NO: 1631901 - protein, 7 aa, Staphylococcus aureus
IDEEEMA

SEQ ID NO: 1631902 - protein, 8 aa, Staphylococcus aureus
IDETTNEY

SEQ ID NO: 1631903 - protein, 6 aa, Staphylococcus aureus
IDSDQM

SEQ ID NO: 1631904 - protein, 14 aa, Staphylococcus aureus
IDSDVKNNTQKSTL

SEQ ID NO: 1631905 - protein, 9 aa, Staphylococcus aureus
IDTGDGDFL

SEQ ID NO: 1631906 - protein, 18 aa, Staphylococcus aureus
IDTKQTVALSDKERKVYE

SEQ ID NO: 1631907 - protein, 25 aa, Staphylococcus aureus
IDTPDNITKVTSEQYQNAAITGGIK

SEQ ID NO: 1631908 - protein, 5 aa, Staphylococcus aureus
IEAMS

SEQ ID NO: 1631909 - protein, 12 aa, Staphylococcus aureus
IEARKNGEKSIE

SEQ ID NO: 1631910 - protein, 4 aa, Staphylococcus aureus
IEAT

SEQ ID NO: 1631911 - protein, 14 aa, Staphylococcus aureus
IEATTTAQDLDRVK

SEQ ID NO: 1631912 - protein, 11 aa, Staphylococcus aureus
IEDEKRLTQSL

SEQ ID NO: 1631913 - protein, 13 aa, Staphylococcus aureus
IEDENSAMKPREI

SEQ ID NO: 1631914 - protein, 10 aa, Staphylococcus aureus
IEDRKEVKTY

SEQ ID NO: 1631915 - protein, 10 aa, Staphylococcus aureus
IEEAHKNNKQ

SEQ ID NO: 1631916 - protein, 4 aa, Staphylococcus aureus
IEED

SEQ ID NO: 1631917 - protein, 4 aa, Staphylococcus aureus
IEEP

SEQ ID NO: 1631918 - protein, 16 aa, Staphylococcus aureus
IEETPEQKADREFDER

SEQ ID NO: 1631919 - protein, 53 aa, Staphylococcus aureus
IEEVTNKDTAPQGVEAKSEVTSNKDTIEHEPSVKAEDISKKEDTPKEVADVAE

SEQ ID NO: 1631920 - protein, 6 aa, Staphylococcus aureus
IEGTPI

SEQ ID NO: 1631921 - protein, 6 aa, Staphylococcus aureus
IEKGTA

SEQ ID NO: 1631922 - protein, 5 aa, Staphylococcus aureus
IELQG

SEQ ID NO: 1631923 - protein, 7 aa, Staphylococcus aureus
IENKCSE

SEQ ID NO: 1631924 - protein, 16 aa, Staphylococcus aureus
IENNQNLKVSKESGFR

SEQ ID NO: 1631925 - protein, 6 aa, Staphylococcus aureus
IENNYE

SEQ ID NO: 1631926 - protein, 8 aa, Staphylococcus aureus
IEQGGKSG

SEQ ID NO: 1631927 - protein, 21 aa, Staphylococcus aureus
IERTKTDRYQKKHSSRGQSKL

SEQ ID NO: 1631928 - protein, 4 aa, Staphylococcus aureus
IESD

SEQ ID NO: 1631929 - protein, 6 aa, Staphylococcus aureus
IESGIH

SEQ ID NO: 1631930 - protein, 4 aa, Staphylococcus aureus
IEST

SEQ ID NO: 1631931 - protein, 15 aa, Staphylococcus aureus
IETLEDEGLKSTLKE

SEQ ID NO: 1631932 - protein, 4 aa, Staphylococcus aureus
IETQ

SEQ ID NO: 1631933 - protein, 10 aa, Staphylococcus aureus
IEVNERKDIE

SEQ ID NO: 1631934 - protein, 20 aa, Staphylococcus aureus
IGAEGMTSEAVDGRSNSYEL

SEQ ID NO: 1631935 - protein, 21 aa, Staphylococcus aureus
IGAYSNDPGAVANGENERDFN

SEQ ID NO: 1631936 - protein, 7 aa, Staphylococcus aureus
IGDGDIK

SEQ ID NO: 1631937 - protein, 11 aa, Staphylococcus aureus
IGGITRNEDIY

SEQ ID NO: 1631938 - protein, 4 aa, Staphylococcus aureus
IGKR

SEQ ID NO: 1631939 - protein, 9 aa, Staphylococcus aureus
IGPGGKKIN

SEQ ID NO: 1631940 - protein, 9 aa, Staphylococcus aureus
IGQTTSPSM

SEQ ID NO: 1631941 - protein, 46 aa, Staphylococcus aureus; identical to SEQ ID NO: 1566839

SEQ ID NO: 1631942 - protein, 11 aa, Staphylococcus aureus
IGRKTNENNQL

SEQ ID NO: 1631943 - protein, 7 aa, Staphylococcus aureus
IGRTEPE

SEQ ID NO: 1631944 - protein, 34 aa, Staphylococcus aureus
IGSPIPTDNASWRGPNIEAGEKSAYKNVQVGVGH

SEQ ID NO: 1631945 - protein, 33 aa, Staphylococcus aureus
IGSTISTGNASWGVGPNTENFEKRNSTGNASWG

SEQ ID NO: 1631946 - protein, 6 aa, Staphylococcus aureus
IGTVGS

SEQ ID NO: 1631947 - protein, 10 aa, Staphylococcus aureus
IHGGTGAGND

SEQ ID NO: 1631948 - protein, 8 aa, Staphylococcus aureus
IKCKTNRE

SEQ ID NO: 1631949 - protein, 12 aa, Staphylococcus aureus
IKDEEKGREKIR

SEQ ID NO: 1631950 - protein, 13 aa, Staphylococcus aureus
IKEADNTEKQTVT

SEQ ID NO: 1631951 - protein, 7 aa, Staphylococcus aureus
IKEGEVP

SEQ ID NO: 1631952 - protein, 4 aa, Staphylococcus aureus
IKEN

SEQ ID NO: 1631953 - protein, 13 aa, Staphylococcus aureus
IKETEESLTVEPD

SEQ ID NO: 1631954 - protein, 11 aa, Staphylococcus aureus
IKEVTTKTTIR

SEQ ID NO: 1631955 - protein, 7 aa, Staphylococcus aureus
IKGENTL

SEQ ID NO: 1631956 - protein, 30 aa, Staphylococcus aureus
IKGNSTTNWQKSKITDDYGKAIESSEQSID

SEQ ID NO: 1631957 - protein, 29 aa, Staphylococcus aureus
IKGVSSKEKDNKYSDKYEFGKKTEYDESK

SEQ ID NO: 1631958 - protein, 10 aa, Staphylococcus aureus
IKHETTPRVL

SEQ ID NO: 1631959 - protein, 15 aa, Staphylococcus aureus
IKKKNGEKYLSKHDY

SEQ ID NO: 1631960 - protein, 6 aa, Staphylococcus aureus
IKKTPV

SEQ ID NO: 1631961 - protein, 9 aa, Staphylococcus aureus
IKLPKGKKP

SEQ ID NO: 1631962 - protein, 11 aa, Staphylococcus aureus
IKNGANDQGEI

SEQ ID NO: 1631963 - protein, 7 aa, Staphylococcus aureus
IKNNCDR

SEQ ID NO: 1631964 - protein, 15 aa, Staphylococcus aureus
IKPNNDTTSSTSIPI

SEQ ID NO: 1631965 - protein, 40 aa, Staphylococcus aureus
IKPNRKGDKDIESAIKETSKYSVKSSDFLTDDDEKNQEIV

SEQ ID NO: 1631966 - protein, 11 aa, Staphylococcus aureus
IKQAKDHLNQD

SEQ ID NO: 1631967 - protein, 8 aa, Staphylococcus aureus
IKQENTSF

SEQ ID NO: 1631968 - protein, 12 aa, Staphylococcus aureus
IKQTTQSLNTAM

SEQ ID NO: 1631969 - protein, 16 aa, Staphylococcus aureus
IKRKDNKITKDDSNVE

SEQ ID NO: 1631970 - protein, 12 aa, Staphylococcus aureus
IKRQERQNKREE

SEQ ID NO: 1631971 - protein, 10 aa, Staphylococcus aureus
IKSEQQEKTE

SEQ ID NO: 1631972 - protein, 17 aa, Staphylococcus aureus
IKVEGLSKKQKVQAQIT

SEQ ID NO: 1631973 - protein, 12 aa, Staphylococcus aureus
ILPTKSKQASQL

SEQ ID NO: 1631974 - protein, 18 aa, Staphylococcus aureus
INASDEDKTTDEEEKAHS

SEQ ID NO: 1631975 - protein, 19 aa, Staphylococcus aureus
INDEDTRSLPKSDKKIKES

SEQ ID NO: 1631976 - protein, 7 aa, Staphylococcus aureus
INDNDDL

SEQ ID NO: 1631977 - protein, 31 aa, Staphylococcus aureus; identical to SEQ ID NO: 1568968

SEQ ID NO: 1631978 - protein, 31 aa, Staphylococcus aureus; identical to SEQ ID NO: 1570834

SEQ ID NO: 1631979 - protein, 24 aa, Staphylococcus aureus
INEEVKNKESIQKVAKEKVSTNNI

SEQ ID NO: 1631980 - protein, 10 aa, Staphylococcus aureus
INEPETAARE

SEQ ID NO: 1631981 - protein, 18 aa, Staphylococcus aureus
INGETSDKIAERRTSGDY

SEQ ID NO: 1631982 - protein, 22 aa, Staphylococcus aureus
INHKQQAKEKQDTGDSASEDVQ

SEQ ID NO: 1631983 - protein, 5 aa, Staphylococcus aureus
INKRR

SEQ ID NO: 1631984 - protein, 12 aa, Staphylococcus aureus
INNERKVKTIEN

SEQ ID NO: 1631985 - protein, 6 aa, Staphylococcus aureus
INNNEG

SEQ ID NO: 1631986 - protein, 8 aa, Staphylococcus aureus
INPEKQQR

SEQ ID NO: 1631987 - protein, 6 aa, Staphylococcus aureus
INPSKI

SEQ ID NO: 1631988 - protein, 19 aa, Staphylococcus aureus
INQADTNAEVDQAQQLGTK

SEQ ID NO: 1631989 - protein, 18 aa, Staphylococcus aureus
INQNQTNDQVDATTNQAI

SEQ ID NO: 1631990 - protein, 14 aa, Staphylococcus aureus
INQTSNPTMEPNTI

SEQ ID NO: 1631991 - protein, 47 aa, Staphylococcus aureus; identical to SEQ ID NO: 1565398

SEQ ID NO: 1631992 - protein, 6 aa, Staphylococcus aureus
INRRKK

SEQ ID NO: 1631993 - protein, 5 aa, Staphylococcus aureus
INSEY

SEQ ID NO: 1631994 - protein, 6 aa, Staphylococcus aureus
IPDASE

SEQ ID NO: 1631995 - protein, 8 aa, Staphylococcus aureus
IPDQDTIN

SEQ ID NO: 1631996 - protein, 11 aa, Staphylococcus aureus
IPKKNSKSFRE

SEQ ID NO: 1631997 - protein, 5 aa, Staphylococcus aureus
IPKQT

SEQ ID NO: 1631998 - protein, 45 aa, Staphylococcus aureus; identical to SEQ ID NO: 1564318

SEQ ID NO: 1631999 - protein, 14 aa, Staphylococcus aureus
IPTKEIKDENIKAE

SEQ ID NO: 1632000 - protein, 14 aa, Staphylococcus aureus
IPTKGIKDENIKKE

SEQ ID NO: 1632001 - protein, 4 aa, Staphylococcus aureus
IPYN

SEQ ID NO: 1632002 - protein, 7 aa, Staphylococcus aureus
IQARSEE

SEQ ID NO: 1632003 - protein, 12 aa, Staphylococcus aureus
IQATRSAKYKSE

SEQ ID NO: 1632004 - protein, 16 aa, Staphylococcus aureus
IQEEDEQSARLATEKL

SEQ ID NO: 1632005 - protein, 16 aa, Staphylococcus aureus
IQGGKKDYSRNSVEEE

SEQ ID NO: 1632006 - protein, 12 aa, Staphylococcus aureus
IQNGKERSDAYK

SEQ ID NO: 1632007 - protein, 9 aa, Staphylococcus aureus
IQRIDEPDK

SEQ ID NO: 1632008 - protein, 12 aa, Staphylococcus aureus
IQRRDDLEKRLK

SEQ ID NO: 1632009 - protein, 7 aa, Staphylococcus aureus
IQTESLR

SEQ ID NO: 1632010 - protein, 14 aa, Staphylococcus aureus
IREPEVDSPVQNGP

SEQ ID NO: 1632011 - protein, 8 aa, Staphylococcus aureus
IRNEKGNA

SEQ ID NO: 1632012 - protein, 8 aa, Staphylococcus aureus
IRQGESIA

SEQ ID NO: 1632013 - protein, 8 aa, Staphylococcus aureus
IRTNTNEI

SEQ ID NO: 1632014 - protein, 5 aa, Staphylococcus aureus
IRVGS

SEQ ID NO: 1632015 - protein, 14 aa, Staphylococcus aureus
ISAKEKQLSTIGSS

SEQ ID NO: 1632016 - protein, 9 aa, Staphylococcus aureus
ISANDYRNY

SEQ ID NO: 1632017 - protein, 6 aa, Staphylococcus aureus
ISDDEL

SEQ ID NO: 1632018 - protein, 6 aa, Staphylococcus aureus
ISDEQV

SEQ ID NO: 1632019 - protein, 9 aa, Staphylococcus aureus
ISEQLKNSN

SEQ ID NO: 1632020 - protein, 20 aa, Staphylococcus aureus
ISESIKSAKEKKYSKLNPYQ

SEQ ID NO: 1632021 - protein, 9 aa, Staphylococcus aureus
ISGGQDSTL

SEQ ID NO: 1632022 - protein, 16 aa, Staphylococcus aureus
ISGSSSSKGRGSGLPV

SEQ ID NO: 1632023 - protein, 10 aa, Staphylococcus aureus
ISGTPNATLT

SEQ ID NO: 1632024 - protein, 4 aa, Staphylococcus aureus
ISKA

SEQ ID NO: 1632025 - protein, 8 aa, Staphylococcus aureus
ISQEEAEK

SEQ ID NO: 1632026 - protein, 12 aa, Staphylococcus aureus
ISQSGLSDTNGF

SEQ ID NO: 1632027 - protein, 24 aa, Staphylococcus aureus
ISREEQDTFAVNSQQKAVRAQQNC

SEQ ID NO: 1632028 - protein, 28 aa, Staphylococcus aureus
ISRQLTKEKHDQVSRYKQKTEYHKQMHM

SEQ ID NO: 1632029 - protein, 11 aa, Staphylococcus aureus
ISSNDDSTISD

SEQ ID NO: 1632030 - protein, 5 aa, Staphylococcus aureus
ISSNI

SEQ ID NO: 1632031 - protein, 72 aa, Staphylococcus aureus; identical to SEQ ID NO: 1566041

SEQ ID NO: 1632032 - protein, 61 aa, Staphylococcus aureus; identical to SEQ ID NO: 1564793

SEQ ID NO: 1632033 - protein, 19 aa, Staphylococcus aureus
ISSSISTDNASWRGPNTEN

SEQ ID NO: 1632034 - protein, 12 aa, Staphylococcus aureus
ISTDNASWRGPN

SEQ ID NO: 1632035 - protein, 7 aa, Staphylococcus aureus
ISTTQDL

SEQ ID NO: 1632036 - protein, 14 aa, Staphylococcus aureus
ISYQSINTAKNTIK

SEQ ID NO: 1632037 - protein, 4 aa, Staphylococcus aureus
ITAS

SEQ ID NO: 1632038 - protein, 16 aa, Staphylococcus aureus
ITATRQKNLNGVNEDL

SEQ ID NO: 1632039 - protein, 5 aa, Staphylococcus aureus
ITDER

SEQ ID NO: 1632040 - protein, 20 aa, Staphylococcus aureus
ITDKENNKTKIKGTNTLEDD

SEQ ID NO: 1632041 - protein, 18 aa, Staphylococcus aureus
ITELGSVDKGTTRTDNTL

SEQ ID NO: 1632042 - protein, 6 aa, Staphylococcus aureus
ITGGYG

SEQ ID NO: 1632043 - protein, 9 aa, Staphylococcus aureus
ITGKRLSGQ

SEQ ID NO: 1632044 - protein, 5 aa, Staphylococcus aureus
ITKDN

SEQ ID NO: 1632045 - protein, 4 aa, Staphylococcus aureus
ITKN

SEQ ID NO: 1632046 - protein, 11 aa, Staphylococcus aureus
ITMNDQNSIRT

SEQ ID NO: 1632047 - protein, 11 aa, Staphylococcus aureus
ITNDDSEDGYQ

SEQ ID NO: 1632048 - protein, 5 aa, Staphylococcus aureus
ITNGQ

SEQ ID NO: 1632049 - protein, 10 aa, Staphylococcus aureus
ITNKSNLDDE

SEQ ID NO: 1632050 - protein, 10 aa, Staphylococcus aureus
ITNPEKAKGI

SEQ ID NO: 1632051 - protein, 9 aa, Staphylococcus aureus
ITPNNPSGH

SEQ ID NO: 1632052 - protein, 6 aa, Staphylococcus aureus
ITPNTG

SEQ ID NO: 1632053 - protein, 16 aa, Staphylococcus aureus
ITRPKEITKRFVQIME

SEQ ID NO: 1632054 - protein, 15 aa, Staphylococcus aureus
ITSNEQARKIFEVEK

SEQ ID NO: 1632055 - protein, 14 aa, Staphylococcus aureus
ITVEEKSQIDSKNK

SEQ ID NO: 1632056 - protein, 28 aa, Staphylococcus aureus
IVANGGNSEGGAGAKYQGAKHPNEKVVA

SEQ ID NO: 1632057 - protein, 11 aa, Staphylococcus aureus
IYDRNSDSLDG

SEQ ID NO: 1632058 - protein, 5 aa, Staphylococcus aureus
IYNSK

SEQ ID NO: 1632059 - protein, 4 aa, Staphylococcus aureus
IYSQ

SEQ ID NO: 1632060 - protein, 8 aa, Staphylococcus aureus
KADKRELI

SEQ ID NO: 1632061 - protein, 6 aa, Staphylococcus aureus
KADLQA

SEQ ID NO: 1632062 - protein, 9 aa, Staphylococcus aureus
KADLTSTTD

SEQ ID NO: 1632063 - protein, 10 aa, Staphylococcus aureus
KAEELGKGKT

SEQ ID NO: 1632064 - protein, 34 aa, Staphylococcus aureus
KAENEVEALQDKEVSKGHVQKCQKDTSRNVKRTR

SEQ ID NO: 1632065 - protein, 10 aa, Staphylococcus aureus
KAETLKGQRP

SEQ ID NO: 1632066 - protein, 7 aa, Staphylococcus aureus
KAGKTLA

SEQ ID NO: 1632067 - protein, 9 aa, Staphylococcus aureus
KAGNSTAEK

SEQ ID NO: 1632068 - protein, 4 aa, Staphylococcus aureus
KAGY

SEQ ID NO: 1632069 - protein, 5 aa, Staphylococcus aureus
KAGYL

SEQ ID NO: 1632070 - protein, 9 aa, Staphylococcus aureus
KAISTEEAE

SEQ ID NO: 1632071 - protein, 9 aa, Staphylococcus aureus
KAKDGISEK

SEQ ID NO: 1632072 - protein, 7 aa, Staphylococcus aureus
KAKFDKT

SEQ ID NO: 1632073 - protein, 13 aa, Staphylococcus aureus
KAKKVLAGEALID

SEQ ID NO: 1632074 - protein, 14 aa, Staphylococcus aureus
KAKSEYNDQHSQFP

SEQ ID NO: 1632075 - protein, 6 aa, Staphylococcus aureus
KAKSVD

SEQ ID NO: 1632076 - protein, 7 aa, Staphylococcus aureus
KALAESG

SEQ ID NO: 1632077 - protein, 10 aa, Staphylococcus aureus
KALEENDKQL

SEQ ID NO: 1632078 - protein, 12 aa, Staphylococcus aureus
KANGQNMTKAQV

SEQ ID NO: 1632079 - protein, 7 aa, Staphylococcus aureus
KANIKAA

SEQ ID NO: 1632080 - protein, 18 aa, Staphylococcus aureus
KAPKKVSIEPVDNETATH

SEQ ID NO: 1632081 - protein, 5 aa, Staphylococcus aureus
KAPTV

SEQ ID NO: 1632082 - protein, 9 aa, Staphylococcus aureus
KAQAVKTFD

SEQ ID NO: 1632083 - protein, 15 aa, Staphylococcus aureus
KAQGPNTAKDGVETA

SEQ ID NO: 1632084 - protein, 15 aa, Staphylococcus aureus
KAQGPNTSKDGVETA

SEQ ID NO: 1632085 - protein, 8 aa, Staphylococcus aureus
KAQKEGFP

SEQ ID NO: 1632086 - protein, 12 aa, Staphylococcus aureus
KAQTVNVKKQGI

SEQ ID NO: 1632087 - protein, 14 aa, Staphylococcus aureus
KARKELSSDKLEEN

SEQ ID NO: 1632088 - protein, 12 aa, Staphylococcus aureus
KARQKELDDLNN

SEQ ID NO: 1632089 - protein, 11 aa, Staphylococcus aureus
KARTRKMGGTG

SEQ ID NO: 1632090 - protein, 8 aa, Staphylococcus aureus
KASAREQL

SEQ ID NO: 1632091 - protein, 7 aa, Staphylococcus aureus
KASEDHE

SEQ ID NO: 1632092 - protein, 14 aa, Staphylococcus aureus
KASQNFRYGEKYTD

SEQ ID NO: 1632093 - protein, 8 aa, Staphylococcus aureus
KATESKSG

SEQ ID NO: 1632094 - protein, 52 aa, Staphylococcus aureus
KDDEVVNKPEPKTDEMKQKEQQANGKQTPMSQQSNPFANANGPIEINDDDLP

SEQ ID NO: 1632095 - protein, 10 aa, Staphylococcus aureus
KDDKSNTGNR

SEQ ID NO: 1632096 - protein, 6 aa, Staphylococcus aureus
KDDKTV

SEQ ID NO: 1632097 - protein, 6 aa, Staphylococcus aureus
KDDVSK

SEQ ID NO: 1632098 - protein, 7 aa, Staphylococcus aureus
KDDYHSN

SEQ ID NO: 1632099 - protein, 7 aa, Staphylococcus aureus
KDEISNT

SEQ ID NO: 1632100 - protein, 10 aa, Staphylococcus aureus
KDENGNDYPE

SEQ ID NO: 1632101 - protein, 5 aa, Staphylococcus aureus
KDETL

SEQ ID NO: 1632102 - protein, 19 aa, Staphylococcus aureus
KDGKDIPGVELKVTESLVI

SEQ ID NO: 1632103 - protein, 7 aa, Staphylococcus aureus
KDGVQAQ

SEQ ID NO: 1632104 - protein, 45 aa, Staphylococcus aureus
KDIEKRPENKKAHNKRDNLQQQLDANEQKIEEGKRLQEEHGNEFP

SEQ ID NO: 1632105 - protein, 20 aa, Staphylococcus aureus
KDIKKAIDDVKETKKDEFAK

SEQ ID NO: 1632106 - protein, 14 aa, Staphylococcus aureus
KDISEEDANDASGL

SEQ ID NO: 1632107 - protein, 11 aa, Staphylococcus aureus
KDISEEDANYA

SEQ ID NO: 1632108 - protein, 10 aa, Staphylococcus aureus
KDKDSEFYSP

SEQ ID NO: 1632109 - protein, 14 aa, Staphylococcus aureus
KDKEVEKLQSGKEY

SEQ ID NO: 1632110 - protein, 7 aa, Staphylococcus aureus
KDKPSAH

SEQ ID NO: 1632111 - protein, 21 aa, Staphylococcus aureus
KDKTAQFQEKHDLEPKKNEFE

SEQ ID NO: 1632112 - protein, 6 aa, Staphylococcus aureus
KDLGRK

SEQ ID NO: 1632113 - protein, 20 aa, Staphylococcus aureus
KDLNSERENVEDRKDNAQSG

SEQ ID NO: 1632114 - protein, 22 aa, Staphylococcus aureus
KDLQSTEEVPANENTENNQHEI

SEQ ID NO: 1632115 - protein, 8 aa, Staphylococcus aureus
KDNANEVY

SEQ ID NO: 1632116 - protein, 18 aa, Staphylococcus aureus
KDNDGKSLKASGLTLDTK

SEQ ID NO: 1632117 - protein, 5 aa, Staphylococcus aureus
KDNEV

SEQ ID NO: 1632118 - protein, 8 aa, Staphylococcus aureus
KDPHYKNT

SEQ ID NO: 1632119 - protein, 7 aa, Staphylococcus aureus
KDQIQGE

SEQ ID NO: 1632120 - protein, 7 aa, Staphylococcus aureus
KDSISGV

SEQ ID NO: 1632121 - protein, 9 aa, Staphylococcus aureus
KDSSKRSDV

SEQ ID NO: 1632122 - protein, 6 aa, Staphylococcus aureus
KDSYAE

SEQ ID NO: 1632123 - protein, 7 aa, Staphylococcus aureus
KDTIDRT

SEQ ID NO: 1632124 - protein, 9 aa, Staphylococcus aureus
KDTKQSQKE

SEQ ID NO: 1632125 - protein, 7 aa, Staphylococcus aureus
KDTKRGT

SEQ ID NO: 1632126 - protein, 5 aa, Staphylococcus aureus
KDTSP

SEQ ID NO: 1632127 - protein, 13 aa, Staphylococcus aureus
KDVEVETNIGPRG

SEQ ID NO: 1632128 - protein, 12 aa, Staphylococcus aureus
KDYDSDSKVTKT

SEQ ID NO: 1632129 - protein, 21 aa, Staphylococcus aureus
KEAAKATTGKVVNNTGQVCTA

SEQ ID NO: 1632130 - protein, 11 aa, Staphylococcus aureus
KEADNTEKQTV

SEQ ID NO: 1632131 - protein, 18 aa, Staphylococcus aureus
KEAEFKGFAGERSIDEQA

SEQ ID NO: 1632132 - protein, 8 aa, Staphylococcus aureus
KEAGSWSD

SEQ ID NO: 1632133 - protein, 14 aa, Staphylococcus aureus
KEAINKTQNSGYEN

SEQ ID NO: 1632134 - protein, 4 aa, Staphylococcus aureus
KEAK

SEQ ID NO: 1632135 - protein, 17 aa, Staphylococcus aureus
KEALTDDNVEGVAGYDG

SEQ ID NO: 1632136 - protein, 7 aa, Staphylococcus aureus
KEAVDKA

SEQ ID NO: 1632137 - protein, 6 aa, Staphylococcus aureus
KEDDEK

SEQ ID NO: 1632138 - protein, 11 aa, Staphylococcus aureus
KEDHDNELTKE

SEQ ID NO: 1632139 - protein, 6 aa, Staphylococcus aureus
KEDKYS

SEQ ID NO: 1632140 - protein, 8 aa, Staphylococcus aureus
KEEAAELA

SEQ ID NO: 1632141 - protein, 10 aa, Staphylococcus aureus
KEEQYPKTEL

SEQ ID NO: 1632142 - protein, 14 aa, Staphylococcus aureus
KEFSSQKNKFNPQN

SEQ ID NO: 1632143 - protein, 17 aa, Staphylococcus aureus
KEGFRDQEFEKGDKGTW

SEQ ID NO: 1632144 - protein, 38 aa, Staphylococcus aureus
KEGGRQIGQFSSKDNDYNPPGYSTLPTVKADENGNATI

SEQ ID NO: 1632145 - protein, 15 aa, Staphylococcus aureus
KEGKKVSEKDQTYQN

SEQ ID NO: 1632146 - protein, 6 aa, Staphylococcus aureus
KEGVEL

SEQ ID NO: 1632147 - protein, 5 aa, Staphylococcus aureus
KEHEE

SEQ ID NO: 1632148 - protein, 4 aa, Staphylococcus aureus
KEIG

SEQ ID NO: 1632149 - protein, 8 aa, Staphylococcus aureus
KEIKENPA

SEQ ID NO: 1632150 - protein, 12 aa, Staphylococcus aureus
KEIKRNKTNINL

SEQ ID NO: 1632151 - protein, 15 aa, Staphylococcus aureus
KEILPSTAKDKNGKN

SEQ ID NO: 1632152 - protein, 10 aa, Staphylococcus aureus
KEINPSTVGN

SEQ ID NO: 1632153 - protein, 5 aa, Staphylococcus aureus
KEIQK

SEQ ID NO: 1632154 - protein, 17 aa, Staphylococcus aureus
KEISSYQINKDTGISYG

SEQ ID NO: 1632155 - protein, 9 aa, Staphylococcus aureus
KEKAKDLDI

SEQ ID NO: 1632156 - protein, 16 aa, Staphylococcus aureus
KEKAKDLDVNYSAKGT

SEQ ID NO: 1632157 - protein, 15 aa, Staphylococcus aureus
KEKDEKSADVEKQTK

SEQ ID NO: 1632158 - protein, 29 aa, Staphylococcus aureus
KEKGDTQKKVASKLGISPQRYQLKESGKA

SEQ ID NO: 1632159 - protein, 6 aa, Staphylococcus aureus
KEKPKA

SEQ ID NO: 1632160 - protein, 7 aa, Staphylococcus aureus
KEKQTFD

SEQ ID NO: 1632161 - protein, 9 aa, Staphylococcus aureus
KEKSISPKT

SEQ ID NO: 1632162 - protein, 15 aa, Staphylococcus aureus
KEKSTNKDTTPKVDK

SEQ ID NO: 1632163 - protein, 5 aa, Staphylococcus aureus
KELDK

SEQ ID NO: 1632164 - protein, 6 aa, Staphylococcus aureus
KELEDK

SEQ ID NO: 1632165 - protein, 29 aa, Staphylococcus aureus
KELEKRDAEAKREKLRSNALGKAQQLNLP

SEQ ID NO: 1632166 - protein, 5 aa, Staphylococcus aureus
KELGY

SEQ ID NO: 1632167 - protein, 9 aa, Staphylococcus aureus
KELQKQNET

SEQ ID NO: 1632168 - protein, 4 aa, Staphylococcus aureus
KELS

SEQ ID NO: 1632169 - protein, 8 aa, Staphylococcus aureus
KELSETTL

SEQ ID NO: 1632170 - protein, 15 aa, Staphylococcus aureus
KEMKKEDKKLSKSDF

SEQ ID NO: 1632171 - protein, 4 aa, Staphylococcus aureus
KEND

SEQ ID NO: 1632172 - protein, 14 aa, Staphylococcus aureus
KENEFKDYSNKQCD

SEQ ID NO: 1632173 - protein, 18 aa, Staphylococcus aureus
KENGAIAGKLTGAGRGGS

SEQ ID NO: 1632174 - protein, 97 aa, Staphylococcus aureus
KENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQ

SEQ ID NO: 1632175 - protein, 31 aa, Staphylococcus aureus
KENKNEFERKTQDIESRNPDLKKFDRDKDYE

SEQ ID NO: 1632176 - protein, 5 aa, Staphylococcus aureus
KENLT

SEQ ID NO: 1632177 - protein, 16 aa, Staphylococcus aureus
KENNTSINNTSNNNIN

SEQ ID NO: 1632178 - protein, 18 aa, Staphylococcus aureus
KEPKKVSIEPIDNETATH

SEQ ID NO: 1632179 - protein, 7 aa, Staphylococcus aureus
KEQDSKF

SEQ ID NO: 1632180 - protein, 5 aa, Staphylococcus aureus
KEQLS

SEQ ID NO: 1632181 - protein, 10 aa, Staphylococcus aureus
KEQRGPLDGD

SEQ ID NO: 1632182 - protein, 16 aa, Staphylococcus aureus
KEQTNISRATLYRHLD

SEQ ID NO: 1632183 - protein, 5 aa, Staphylococcus aureus
KERKN

SEQ ID NO: 1632184 - protein, 9 aa, Staphylococcus aureus
KESAEIDKE

SEQ ID NO: 1632185 - protein, 7 aa, Staphylococcus aureus
KESEKML

SEQ ID NO: 1632186 - protein, 11 aa, Staphylococcus aureus
KESIPIANSRE

SEQ ID NO: 1632187 - protein, 5 aa, Staphylococcus aureus
KETAI

SEQ ID NO: 1632188 - protein, 4 aa, Staphylococcus aureus
KETK

SEQ ID NO: 1632189 - protein, 8 aa, Staphylococcus aureus
KETTFQPK

SEQ ID NO: 1632190 - protein, 14 aa, Staphylococcus aureus
KETVKNFDEKQVQT

SEQ ID NO: 1632191 - protein, 6 aa, Staphylococcus aureus
KEVKQD

SEQ ID NO: 1632192 - protein, 5 aa, Staphylococcus aureus
KEVQP

SEQ ID NO: 1632193 - protein, 5 aa, Staphylococcus aureus
KEVSF

SEQ ID NO: 1632194 - protein, 6 aa, Staphylococcus aureus
KEVTGS

SEQ ID NO: 1632195 - protein, 9 aa, Staphylococcus aureus
KEVTTQTTI

SEQ ID NO: 1632196 - protein, 11 aa, Staphylococcus aureus
KFDDKEVPSGV

SEQ ID NO: 1632197 - protein, 4 aa, Staphylococcus aureus
KGAE

SEQ ID NO: 1632198 - protein, 17 aa, Staphylococcus aureus
KGASSLSPLKEERVEGK

SEQ ID NO: 1632199 - protein, 12 aa, Staphylococcus aureus
KGDGRNQSIQED

SEQ ID NO: 1632200 - protein, 5 aa, Staphylococcus aureus
KGDHF

SEQ ID NO: 1632201 - protein, 6 aa, Staphylococcus aureus
KGDKGI

SEQ ID NO: 1632202 - protein, 5 aa, Staphylococcus aureus
KGDKK

SEQ ID NO: 1632203 - protein, 5 aa, Staphylococcus aureus
KGDLD

SEQ ID NO: 1632204 - protein, 19 aa, Staphylococcus aureus
KGDLYPQKAYPKYIERKLV

SEQ ID NO: 1632205 - protein, 8 aa, Staphylococcus aureus
KGDQSLEN

SEQ ID NO: 1632206 - protein, 31 aa, Staphylococcus aureus
KGDSKESKNKISQLESKNQQLEAENEKLKKE

SEQ ID NO: 1632207 - protein, 6 aa, Staphylococcus aureus
KGEDDL

SEQ ID NO: 1632208 - protein, 15 aa, Staphylococcus aureus
KGEKVEAKVAKLDKD

SEQ ID NO: 1632209 - protein, 6 aa, Staphylococcus aureus
KGESLA

SEQ ID NO: 1632210 - protein, 6 aa, Staphylococcus aureus
KGETNF

SEQ ID NO: 1632211 - protein, 15 aa, Staphylococcus aureus
KGGTVTAANSCMKND

SEQ ID NO: 1632212 - protein, 11 aa, Staphylococcus aureus
KGISQETLSKE

SEQ ID NO: 1632213 - protein, 6 aa, Staphylococcus aureus
KGKGDI

SEQ ID NO: 1632214 - protein, 8 aa, Staphylococcus aureus
KGKNPTWR

SEQ ID NO: 1632215 - protein, 8 aa, Staphylococcus aureus
KGKTTYQF

SEQ ID NO: 1632216 - protein, 4 aa, Staphylococcus aureus
KGKY

SEQ ID NO: 1632217 - protein, 10 aa, Staphylococcus aureus
KGLGTPATRA

SEQ ID NO: 1632218 - protein, 6 aa, Staphylococcus aureus
KGNKLT

SEQ ID NO: 1632219 - protein, 16 aa, Staphylococcus aureus
KGNNNTNDSAGDERLT

SEQ ID NO: 1632220 - protein, 6 aa, Staphylococcus aureus
KGNPVT

SEQ ID NO: 1632221 - protein, 4 aa, Staphylococcus aureus
KGQT

SEQ ID NO: 1632222 - protein, 8 aa, Staphylococcus aureus
KGSAKETI

SEQ ID NO: 1632223 - protein, 12 aa, Staphylococcus aureus
KGSSSQKEQAEY

SEQ ID NO: 1632224 - protein, 11 aa, Staphylococcus aureus
KGTEKSKDEKF

SEQ ID NO: 1632225 - protein, 8 aa, Staphylococcus aureus
KGTENKTY

SEQ ID NO: 1632226 - protein, 6 aa, Staphylococcus aureus
KGVYDE

SEQ ID NO: 1632227 - protein, 7 aa, Staphylococcus aureus
KGYMPDQ

SEQ ID NO: 1632228 - protein, 11 aa, Staphylococcus aureus
KGYNDETSYAV

SEQ ID NO: 1632229 - protein, 11 aa, Staphylococcus aureus
KGYQHKDQDFK

SEQ ID NO: 1632230 - protein, 20 aa, Staphylococcus aureus
KGYQQFKDDSQIRNSTSASK

SEQ ID NO: 1632231 - protein, 19 aa, Staphylococcus aureus
KGYQQYKDDSQIRNSTSAS

SEQ ID NO: 1632232 - protein, 4 aa, Staphylococcus aureus
KGYT

SEQ ID NO: 1632233 - protein, 16 aa, Staphylococcus aureus
KGYTIDKEKFKKEDEY

SEQ ID NO: 1632234 - protein, 9 aa, Staphylococcus aureus
KHGVKTKEL

SEQ ID NO: 1632235 - protein, 7 aa, Staphylococcus aureus
KHLEKNG

SEQ ID NO: 1632236 - protein, 6 aa, Staphylococcus aureus
KHNANK

SEQ ID NO: 1632237 - protein, 8 aa, Staphylococcus aureus
KHQVEQAQ

SEQ ID NO: 1632238 - protein, 7 aa, Staphylococcus aureus
KHSGSYM

SEQ ID NO: 1632239 - protein, 5 aa, Staphylococcus aureus
KIDRN

SEQ ID NO: 1632240 - protein, 7 aa, Staphylococcus aureus
KIHASSH

SEQ ID NO: 1632241 - protein, 6 aa, Staphylococcus aureus
KIHPRS

SEQ ID NO: 1632242 - protein, 4 aa, Staphylococcus aureus
KIIE

SEQ ID NO: 1632243 - protein, 12 aa, Staphylococcus aureus
KIKSTKDNNPNN

SEQ ID NO: 1632244 - protein, 6 aa, Staphylococcus aureus
KIMTES

SEQ ID NO: 1632245 - protein, 8 aa, Staphylococcus aureus
KINETANA

SEQ ID NO: 1632246 - protein, 6 aa, Staphylococcus aureus
KINGKH

SEQ ID NO: 1632247 - protein, 5 aa, Staphylococcus aureus
KIPDL

SEQ ID NO: 1632248 - protein, 9 aa, Staphylococcus aureus
KIPTNKAPK

SEQ ID NO: 1632249 - protein, 15 aa, Staphylococcus aureus
KITKKGKLISAFYKL

SEQ ID NO: 1632250 - protein, 12 aa, Staphylococcus aureus
KIWTSDDNAAYD

SEQ ID NO: 1632251 - protein, 8 aa, Staphylococcus aureus
KKAATKDT

SEQ ID NO: 1632252 - protein, 7 aa, Staphylococcus aureus
KKAESLL

SEQ ID NO: 1632253 - protein, 7 aa, Staphylococcus aureus
KKASNSN

SEQ ID NO: 1632254 - protein, 4 aa, Staphylococcus aureus
KKDE

SEQ ID NO: 1632255 - protein, 16 aa, Staphylococcus aureus
KKDGAINKGDYNNSNV

SEQ ID NO: 1632256 - protein, 5 aa, Staphylococcus aureus
KKDKV

SEQ ID NO: 1632257 - protein, 7 aa, Staphylococcus aureus
KKDPTYD

SEQ ID NO: 1632258 - protein, 18 aa, Staphylococcus aureus
KKEKDEKSADVEKQTKAL

SEQ ID NO: 1632259 - protein, 9 aa, Staphylococcus aureus
KKESRSNTL

SEQ ID NO: 1632260 - protein, 6 aa, Staphylococcus aureus
KKFPSN

SEQ ID NO: 1632261 - protein, 7 aa, Staphylococcus aureus
KKGENTF

SEQ ID NO: 1632262 - protein, 14 aa, Staphylococcus aureus
KKHIENKAKRNYQV

SEQ ID NO: 1632263 - protein, 6 aa, Staphylococcus aureus
KKHKDT

SEQ ID NO: 1632264 - protein, 12 aa, Staphylococcus aureus
KKIPDNNLQEPE

SEQ ID NO: 1632265 - protein, 13 aa, Staphylococcus aureus
KKKERKDNADAEV

SEQ ID NO: 1632266 - protein, 8 aa, Staphylococcus aureus
KKKFPSNL

SEQ ID NO: 1632267 - protein, 13 aa, Staphylococcus aureus
KKKQNENSKIESD

SEQ ID NO: 1632268 - protein, 22 aa, Staphylococcus aureus
KKKSKAEQKEFRNKLDESRFVI

SEQ ID NO: 1632269 - protein, 9 aa, Staphylococcus aureus
KKLTSEDKQ

SEQ ID NO: 1632270 - protein, 6 aa, Staphylococcus aureus
KKNDDI

SEQ ID NO: 1632271 - protein, 10 aa, Staphylococcus aureus
KKNEEKINEI

SEQ ID NO: 1632272 - protein, 10 aa, Staphylococcus aureus
KKNLNNKQKN

SEQ ID NO: 1632273 - protein, 6 aa, Staphylococcus aureus
KKNPMG

SEQ ID NO: 1632274 - protein, 9 aa, Staphylococcus aureus
KKNYDSARN

SEQ ID NO: 1632275 - protein, 7 aa, Staphylococcus aureus
KKQAIEA

SEQ ID NO: 1632276 - protein, 6 aa, Staphylococcus aureus
KKQAND

SEQ ID NO: 1632277 - protein, 11 aa, Staphylococcus aureus
KKQDDTFVTSG

SEQ ID NO: 1632278 - protein, 23 aa, Staphylococcus aureus
KKQNLQKKRNSKSLESENVYKDK

SEQ ID NO: 1632279 - protein, 11 aa, Staphylococcus aureus
KKQTNSTSYNA

SEQ ID NO: 1632280 - protein, 7 aa, Staphylococcus aureus
KKREGMD

SEQ ID NO: 1632281 - protein, 6 aa, Staphylococcus aureus
KKRGLI

SEQ ID NO: 1632282 - protein, 5 aa, Staphylococcus aureus
KKRID

SEQ ID NO: 1632283 - protein, 12 aa, Staphylococcus aureus
KKSDWDKGDQYK

SEQ ID NO: 1632284 - protein, 7 aa, Staphylococcus aureus
KKSFNNK

SEQ ID NO: 1632285 - protein, 10 aa, Staphylococcus aureus
KKSKELETIQ

SEQ ID NO: 1632286 - protein, 6 aa, Staphylococcus aureus
KKSKLK

SEQ ID NO: 1632287 - protein, 11 aa, Staphylococcus aureus
KKSLNTKKTYA

SEQ ID NO: 1632288 - protein, 10 aa, Staphylococcus aureus
KKSLSETKSL

SEQ ID NO: 1632289 - protein, 6 aa, Staphylococcus aureus
KKSQVD

SEQ ID NO: 1632290 - protein, 15 aa, Staphylococcus aureus
KKTIKEVQKETGIKG

SEQ ID NO: 1632291 - protein, 6 aa, Staphylococcus aureus
KKTVQD

SEQ ID NO: 1632292 - protein, 5 aa, Staphylococcus aureus
KKYSD

SEQ ID NO: 1632293 - protein, 19 aa, Staphylococcus aureus
KLDNQEKVDGTKRQDKGKI

SEQ ID NO: 1632294 - protein, 5 aa, Staphylococcus aureus
KLDNT

SEQ ID NO: 1632295 - protein, 7 aa, Staphylococcus aureus
KLEQSYG

SEQ ID NO: 1632296 - protein, 5 aa, Staphylococcus aureus
KLGAI

SEQ ID NO: 1632297 - protein, 5 aa, Staphylococcus aureus
KLHKR

SEQ ID NO: 1632298 - protein, 9 aa, Staphylococcus aureus
KLKEGYSGD

SEQ ID NO: 1632299 - protein, 4 aa, Staphylococcus aureus
KLKN

SEQ ID NO: 1632300 - protein, 6 aa, Staphylococcus aureus
KLNNSG

SEQ ID NO: 1632301 - protein, 9 aa, Staphylococcus aureus
KLQGGYGQF

SEQ ID NO: 1632302 - protein, 6 aa, Staphylococcus aureus
KLREQN

SEQ ID NO: 1632303 - protein, 5 aa, Staphylococcus aureus
KLSDD

SEQ ID NO: 1632304 - protein, 13 aa, Staphylococcus aureus
KLTEEEISNETVE

SEQ ID NO: 1632305 - protein, 16 aa, Staphylococcus aureus
KLTQEGYKKARQLPEN

SEQ ID NO: 1632306 - protein, 16 aa, Staphylococcus aureus
KLTSKDEFLTDFDSSI

SEQ ID NO: 1632307 - protein, 6 aa, Staphylococcus aureus
KLYGED

SEQ ID NO: 1632308 - protein, 6 aa, Staphylococcus aureus
KMDDDG

SEQ ID NO: 1632309 - protein, 19 aa, Staphylococcus aureus
KMKRNHERQDGTTDAGKGY

SEQ ID NO: 1632310 - protein, 6 aa, Staphylococcus aureus
KMNDNV

SEQ ID NO: 1632311 - protein, 12 aa, Staphylococcus aureus
KNAIDGDTLEQS

SEQ ID NO: 1632312 - protein, 8 aa, Staphylococcus aureus
KNAIENGC

SEQ ID NO: 1632313 - protein, 8 aa, Staphylococcus aureus
KNAQKENI

SEQ ID NO: 1632314 - protein, 4 aa, Staphylococcus aureus
KNAT

SEQ ID NO: 1632315 - protein, 9 aa, Staphylococcus aureus
KNDHPEGTI

SEQ ID NO: 1632316 - protein, 13 aa, Staphylococcus aureus
KNDPHAKEMTPTA

SEQ ID NO: 1632317 - protein, 13 aa, Staphylococcus aureus
KNEISNHSNHSNQ

SEQ ID NO: 1632318 - protein, 6 aa, Staphylococcus aureus
KNETQQ

SEQ ID NO: 1632319 - protein, 8 aa, Staphylococcus aureus
KNGEQAEK

SEQ ID NO: 1632320 - protein, 9 aa, Staphylococcus aureus
KNGIKGSEL

SEQ ID NO: 1632321 - protein, 16 aa, Staphylococcus aureus
KNGKQSQKEAQRRLNE

SEQ ID NO: 1632322 - protein, 6 aa, Staphylococcus aureus
KNGSPV

SEQ ID NO: 1632323 - protein, 9 aa, Staphylococcus aureus
KNGTKLSTE

SEQ ID NO: 1632324 - protein, 11 aa, Staphylococcus aureus
KNGTPEEKAKI

SEQ ID NO: 1632325 - protein, 9 aa, Staphylococcus aureus
KNHSNNRKR

SEQ ID NO: 1632326 - protein, 22 aa, Staphylococcus aureus
KNIDGSKDISDVTKDVIDILDH

SEQ ID NO: 1632327 - protein, 14 aa, Staphylococcus aureus
KNIESGHYQPTTTQ

SEQ ID NO: 1632328 - protein, 10 aa, Staphylococcus aureus
KNIKKNSAKE

SEQ ID NO: 1632329 - protein, 10 aa, Staphylococcus aureus
KNIKKNSSKD

SEQ ID NO: 1632330 - protein, 6 aa, Staphylococcus aureus
KNIPHD

SEQ ID NO: 1632331 - protein, 12 aa, Staphylococcus aureus
KNIRKDNSGNYN

SEQ ID NO: 1632332 - protein, 6 aa, Staphylococcus aureus
KNITKE

SEQ ID NO: 1632333 - protein, 10 aa, Staphylococcus aureus
KNIVSTNPAM

SEQ ID NO: 1632334 - protein, 12 aa, Staphylococcus aureus
KNKAPEEKAKIE

SEQ ID NO: 1632335 - protein, 7 aa, Staphylococcus aureus
KNKDDLE

SEQ ID NO: 1632336 - protein, 6 aa, Staphylococcus aureus
KNKLDR

SEQ ID NO: 1632337 - protein, 9 aa, Staphylococcus aureus
KNKPEKSTI

SEQ ID NO: 1632338 - protein, 10 aa, Staphylococcus aureus
KNNAKEADQF

SEQ ID NO: 1632339 - protein, 12 aa, Staphylococcus aureus
KNNFPDYEYSRH

SEQ ID NO: 1632340 - protein, 4 aa, Staphylococcus aureus
KNNI

SEQ ID NO: 1632341 - protein, 15 aa, Staphylococcus aureus
KNNQLEIEKDTDIDS

SEQ ID NO: 1632342 - protein, 11 aa, Staphylococcus aureus
KNNVEVTTSKE

SEQ ID NO: 1632343 - protein, 14 aa, Staphylococcus aureus
KNNVPYKKETGNYT

SEQ ID NO: 1632344 - protein, 6 aa, Staphylococcus aureus
KNPIDQ

SEQ ID NO: 1632345 - protein, 10 aa, Staphylococcus aureus
KNQQNEDKTL

SEQ ID NO: 1632346 - protein, 5 aa, Staphylococcus aureus
KNQSN

SEQ ID NO: 1632347 - protein, 4 aa, Staphylococcus aureus
KNQV

SEQ ID NO: 1632348 - protein, 7 aa, Staphylococcus aureus
KNRNEEI

SEQ ID NO: 1632349 - protein, 8 aa, Staphylococcus aureus
KNSEEGLE

SEQ ID NO: 1632350 - protein, 10 aa, Staphylococcus aureus
KNSEYSGGFV

SEQ ID NO: 1632351 - protein, 11 aa, Staphylococcus aureus
KNSGYNSYKAV

SEQ ID NO: 1632352 - protein, 6 aa, Staphylococcus aureus
KNSIQA

SEQ ID NO: 1632353 - protein, 31 aa, Staphylococcus aureus
KNSLNDKDTTLGSQNFADADPEKKNAYNEAV

SEQ ID NO: 1632354 - protein, 6 aa, Staphylococcus aureus
KNTRQH

SEQ ID NO: 1632355 - protein, 17 aa, Staphylococcus aureus
KNYKDGDISYNPESPIY

SEQ ID NO: 1632356 - protein, 11 aa, Staphylococcus aureus
KPEIDGKGATV

SEQ ID NO: 1632357 - protein, 10 aa, Staphylococcus aureus
KPESRNSKDI

SEQ ID NO: 1632358 - protein, 7 aa, Staphylococcus aureus
KPGNDEL

SEQ ID NO: 1632359 - protein, 15 aa, Staphylococcus aureus
KPKDYDIENNKEKIL

SEQ ID NO: 1632360 - protein, 6 aa, Staphylococcus aureus
KPKNQL

SEQ ID NO: 1632361 - protein, 4 aa, Staphylococcus aureus
KPLN

SEQ ID NO: 1632362 - protein, 18 aa, Staphylococcus aureus
KPSTYPPLSYTFDRIIIK

SEQ ID NO: 1632363 - protein, 7 aa, Staphylococcus aureus
KPTDEGY

SEQ ID NO: 1632364 - protein, 6 aa, Staphylococcus aureus
KPTEME

SEQ ID NO: 1632365 - protein, 11 aa, Staphylococcus aureus
KQAARDKITAE

SEQ ID NO: 1632366 - protein, 9 aa, Staphylococcus aureus
KQADNVNNY

SEQ ID NO: 1632367 - protein, 7 aa, Staphylococcus aureus
KQAQQLG

SEQ ID NO: 1632368 - protein, 36 aa, Staphylococcus aureus; identical to SEQ ID NO: 1566866

SEQ ID NO: 1632369 - protein, 11 aa, Staphylococcus aureus
KQGRNITLTSE

SEQ ID NO: 1632370 - protein, 8 aa, Staphylococcus aureus
KQGSCNQQ

SEQ ID NO: 1632371 - protein, 6 aa, Staphylococcus aureus
KQGYNV

SEQ ID NO: 1632372 - protein, 21 aa, Staphylococcus aureus
KQHQNTGSFNHQDNLKSGEKE

SEQ ID NO: 1632373 - protein, 11 aa, Staphylococcus aureus
KQHTKSNKALN

SEQ ID NO: 1632374 - protein, 7 aa, Staphylococcus aureus
KQKDKIS

SEQ ID NO: 1632375 - protein, 9 aa, Staphylococcus aureus
KQKELDAEK

SEQ ID NO: 1632376 - protein, 19 aa, Staphylococcus aureus
KQKTSEETIPNFEKNEEVD

SEQ ID NO: 1632377 - protein, 28 aa, Staphylococcus aureus
KQLAGLNGESHDFTTTHQSPTTSNHTHN

SEQ ID NO: 1632378 - protein, 9 aa, Staphylococcus aureus
KQLPQKNST

SEQ ID NO: 1632379 - protein, 9 aa, Staphylococcus aureus
KQNEKINAK

SEQ ID NO: 1632380 - protein, 4 aa, Staphylococcus aureus
KQNG

SEQ ID NO: 1632381 - protein, 9 aa, Staphylococcus aureus
KQPHEKAHK

SEQ ID NO: 1632382 - protein, 12 aa, Staphylococcus aureus
KQPLKDKNNPFY

SEQ ID NO: 1632383 - protein, 5 aa, Staphylococcus aureus
KQPME

SEQ ID NO: 1632384 - protein, 8 aa, Staphylococcus aureus
KQPRGGYL

SEQ ID NO: 1632385 - protein, 11 aa, Staphylococcus aureus
KQQIASAVTNA

SEQ ID NO: 1632386 - protein, 4 aa, Staphylococcus aureus
KQQM

SEQ ID NO: 1632387 - protein, 8 aa, Staphylococcus aureus
KQQPTNQN

SEQ ID NO: 1632388 - protein, 6 aa, Staphylococcus aureus
KQRGVL

SEQ ID NO: 1632389 - protein, 7 aa, Staphylococcus aureus
KQSDAFN

SEQ ID NO: 1632390 - protein, 10 aa, Staphylococcus aureus
KQTLKSQSHN

SEQ ID NO: 1632391 - protein, 4 aa, Staphylococcus aureus
KQTY

SEQ ID NO: 1632392 - protein, 10 aa, Staphylococcus aureus
KQVEAPKGVI

SEQ ID NO: 1632393 - protein, 7 aa, Staphylococcus aureus
KQYEETH

SEQ ID NO: 1632394 - protein, 6 aa, Staphylococcus aureus
KQYGSQ

SEQ ID NO: 1632395 - protein, 9 aa, Staphylococcus aureus
KQYKDSEFK

SEQ ID NO: 1632396 - protein, 14 aa, Staphylococcus aureus
KQYTYGKGLEELSE

SEQ ID NO: 1632397 - protein, 7 aa, Staphylococcus aureus
KRAGERV

SEQ ID NO: 1632398 - protein, 6 aa, Staphylococcus aureus
KRATQF

SEQ ID NO: 1632399 - protein, 6 aa, Staphylococcus aureus
KRDEES

SEQ ID NO: 1632400 - protein, 4 aa, Staphylococcus aureus
KRDR

SEQ ID NO: 1632401 - protein, 11 aa, Staphylococcus aureus
KREIESSKKQL

SEQ ID NO: 1632402 - protein, 12 aa, Staphylococcus aureus
KRENATTDKTAY

SEQ ID NO: 1632403 - protein, 7 aa, Staphylococcus aureus
KRIKEAQ

SEQ ID NO: 1632404 - protein, 6 aa, Staphylococcus aureus
KRKGMP

SEQ ID NO: 1632405 - protein, 10 aa, Staphylococcus aureus
KRKGYTQSSF

SEQ ID NO: 1632406 - protein, 8 aa, Staphylococcus aureus
KRLGKKAT

SEQ ID NO: 1632407 - protein, 8 aa, Staphylococcus aureus
KRNIEKEK

SEQ ID NO: 1632408 - protein, 13 aa, Staphylococcus aureus
KRQAITNPNTVQS

SEQ ID NO: 1632409 - protein, 10 aa, Staphylococcus aureus
KRQSTCSTCS

SEQ ID NO: 1632410 - protein, 9 aa, Staphylococcus aureus
KRREAIRQQ

SEQ ID NO: 1632411 - protein, 15 aa, Staphylococcus aureus
KRSVSTISREISRNN

SEQ ID NO: 1632412 - protein, 39 aa, Staphylococcus aureus
KRTDASQVDGQDDTSKDDDNESEKADSKSADSESKGGAY

SEQ ID NO: 1632413 - protein, 4 aa, Staphylococcus aureus
KRTV

SEQ ID NO: 1632414 - protein, 8 aa, Staphylococcus aureus
KRTYSAPA

SEQ ID NO: 1632415 - protein, 17 aa, Staphylococcus aureus
KRVQEAQANTESEKRRL

SEQ ID NO: 1632416 - protein, 7 aa, Staphylococcus aureus
KSDSEIK

SEQ ID NO: 1632417 - protein, 9 aa, Staphylococcus aureus
KSDSTTLKN

SEQ ID NO: 1632418 - protein, 50 aa, Staphylococcus aureus
KSEDEEMPENTATNDTGASQTTIDDQVEASLSSNDSEEVTSDSTKTDTNV

SEQ ID NO: 1632419 - protein, 11 aa, Staphylococcus aureus
KSEGDHEMQEE

SEQ ID NO: 1632420 - protein, 28 aa, Staphylococcus aureus
KSETAPRSIQSPTQAPKKETAKPQPKAV

SEQ ID NO: 1632421 - protein, 27 aa, Staphylococcus aureus
KSETAPRSVQSPTQAPKKETAKPQPKA

SEQ ID NO: 1632422 - protein, 7 aa, Staphylococcus aureus
KSGTTNF

SEQ ID NO: 1632423 - protein, 8 aa, Staphylococcus aureus
KSHRGQGM

SEQ ID NO: 1632424 - protein, 10 aa, Staphylococcus aureus
KSITQEAKQG

SEQ ID NO: 1632425 - protein, 9 aa, Staphylococcus aureus
KSKAKDLSL

SEQ ID NO: 1632426 - protein, 11 aa, Staphylococcus aureus
KSLHGKESYSN

SEQ ID NO: 1632427 - protein, 7 aa, Staphylococcus aureus
KSLKDWT

SEQ ID NO: 1632428 - protein, 17 aa, Staphylococcus aureus
KSLNSIEESFDDNPEMS

SEQ ID NO: 1632429 - protein, 16 aa, Staphylococcus aureus
KSLSAKELKDGFKDVP

SEQ ID NO: 1632430 - protein, 7 aa, Staphylococcus aureus
KSLSDKP

SEQ ID NO: 1632431 - protein, 8 aa, Staphylococcus aureus
KSLSEVET

SEQ ID NO: 1632432 - protein, 8 aa, Staphylococcus aureus
KSLSITKA

SEQ ID NO: 1632433 - protein, 11 aa, Staphylococcus aureus
KSLSTSKLEKK

SEQ ID NO: 1632434 - protein, 24 aa, Staphylococcus aureus
KSNGEDVKKSVKKYTPTSNNNNEE

SEQ ID NO: 1632435 - protein, 8 aa, Staphylococcus aureus
KSNGYETV

SEQ ID NO: 1632436 - protein, 22 aa, Staphylococcus aureus
KSNVTIPQYKPGSFGPKESDQL

SEQ ID NO: 1632437 - protein, 17 aa, Staphylococcus aureus
KSQMSDDEIKRLEEQGI

SEQ ID NO: 1632438 - protein, 5 aa, Staphylococcus aureus
KSQPE

SEQ ID NO: 1632439 - protein, 21 aa, Staphylococcus aureus
KSSDTSEKSKGDSKEAQIKKS

SEQ ID NO: 1632440 - protein, 10 aa, Staphylococcus aureus
KSSEIPESDL

SEQ ID NO: 1632441 - protein, 6 aa, Staphylococcus aureus
KSSQDT

SEQ ID NO: 1632442 - protein, 16 aa, Staphylococcus aureus
KSTFQKTHDKSSNMID

SEQ ID NO: 1632443 - protein, 14 aa, Staphylococcus aureus
KSTIPVAQKSNQSI

SEQ ID NO: 1632444 - protein, 6 aa, Staphylococcus aureus
KSTNIN

SEQ ID NO: 1632445 - protein, 10 aa, Staphylococcus aureus
KSTSKGGVHP

SEQ ID NO: 1632446 - protein, 7 aa, Staphylococcus aureus
KSTSKHA

SEQ ID NO: 1632447 - protein, 7 aa, Staphylococcus aureus
KSYSDDV

SEQ ID NO: 1632448 - protein, 10 aa, Staphylococcus aureus
KTAGLTGTVV

SEQ ID NO: 1632449 - protein, 6 aa, Staphylococcus aureus
KTAVIG

SEQ ID NO: 1632450 - protein, 13 aa, Staphylococcus aureus
KTDDIQNNYPTTK

SEQ ID NO: 1632451 - protein, 6 aa, Staphylococcus aureus
KTDRNR

SEQ ID NO: 1632452 - protein, 49 aa, Staphylococcus aureus
KTEDFSHRAETREEVEKKEKEFEEEYKKEQEREKEKEKQKDDDHSGLDE

SEQ ID NO: 1632453 - protein, 5 aa, Staphylococcus aureus
KTEIG

SEQ ID NO: 1632454 - protein, 9 aa, Staphylococcus aureus
KTFNTAEEL

SEQ ID NO: 1632455 - protein, 25 aa, Staphylococcus aureus
KTHSGSKPTTIKEKKSNANTVKNAI

SEQ ID NO: 1632456 - protein, 8 aa, Staphylococcus aureus
KTKTGYST

SEQ ID NO: 1632457 - protein, 12 aa, Staphylococcus aureus
KTKYKKGIGKND

SEQ ID NO: 1632458 - protein, 5 aa, Staphylococcus aureus
KTLDI

SEQ ID NO: 1632459 - protein, 8 aa, Staphylococcus aureus
KTNPNSRR

SEQ ID NO: 1632460 - protein, 23 aa, Staphylococcus aureus
KTPATSSSTAKSSEVNPKPQSDE

SEQ ID NO: 1632461 - protein, 21 aa, Staphylococcus aureus
KTPGREDKAAAQQVEATERAQ

SEQ ID NO: 1632462 - protein, 12 aa, Staphylococcus aureus
KTPMQNSKGEFN

SEQ ID NO: 1632463 - protein, 7 aa, Staphylococcus aureus
KTPTISA

SEQ ID NO: 1632464 - protein, 6 aa, Staphylococcus aureus
KTRSAV

SEQ ID NO: 1632465 - protein, 6 aa, Staphylococcus aureus
KTSALR

SEQ ID NO: 1632466 - protein, 17 aa, Staphylococcus aureus
KTTVTSTSVFPTKEAAQ

SEQ ID NO: 1632467 - protein, 9 aa, Staphylococcus aureus
KTVTTSDGT

SEQ ID NO: 1632468 - protein, 10 aa, Staphylococcus aureus
KTYKNDTVTQ

SEQ ID NO: 1632469 - protein, 4 aa, Staphylococcus aureus
KVAN

SEQ ID NO: 1632470 - protein, 9 aa, Staphylococcus aureus
KVANKTTSM

SEQ ID NO: 1632471 - protein, 17 aa, Staphylococcus aureus
KVDDGLADEIIEAYNSL

SEQ ID NO: 1632472 - protein, 34 aa, Staphylococcus aureus
KVDEHTQKSTKKASATVEQTSTAKQNQPRNNGRF

SEQ ID NO: 1632473 - protein, 10 aa, Staphylococcus aureus
KVDESHLSKG

SEQ ID NO: 1632474 - protein, 13 aa, Staphylococcus aureus
KVDGKKADQMARE

SEQ ID NO: 1632475 - protein, 5 aa, Staphylococcus aureus
KVDTG

SEQ ID NO: 1632476 - protein, 5 aa, Staphylococcus aureus
KVENT

SEQ ID NO: 1632477 - protein, 15 aa, Staphylococcus aureus
KVETYRRSKKFKEKK

SEQ ID NO: 1632478 - protein, 15 aa, Staphylococcus aureus
KVGEAIAKKATDKGI

SEQ ID NO: 1632479 - protein, 10 aa, Staphylococcus aureus
KVGKGKAAFI

SEQ ID NO: 1632480 - protein, 5 aa, Staphylococcus aureus
KVGTG

SEQ ID NO: 1632481 - protein, 13 aa, Staphylococcus aureus
KVKKNKGAPGIDG

SEQ ID NO: 1632482 - protein, 11 aa, Staphylococcus aureus
KVNSLEKEKKM

SEQ ID NO: 1632483 - protein, 8 aa, Staphylococcus aureus
KVQNDQYG

SEQ ID NO: 1632484 - protein, 19 aa, Staphylococcus aureus
KVRATKAKDDNSASAIAND

SEQ ID NO: 1632485 - protein, 12 aa, Staphylococcus aureus
KVSGRKVNRTEL

SEQ ID NO: 1632486 - protein, 5 aa, Staphylococcus aureus
KVSRE

SEQ ID NO: 1632487 - protein, 23 aa, Staphylococcus aureus
KVTGNASTNSGSATTTNRGYNTP

SEQ ID NO: 1632488 - protein, 15 aa, Staphylococcus aureus
KWERSDYVFPGNQVD

SEQ ID NO: 1632489 - protein, 8 aa, Staphylococcus aureus
KYDPETDE

SEQ ID NO: 1632490 - protein, 5 aa, Staphylococcus aureus
KYEKQ

SEQ ID NO: 1632491 - protein, 5 aa, Staphylococcus aureus
KYKDQ

SEQ ID NO: 1632492 - protein, 20 aa, Staphylococcus aureus
KYKDWTEHNQDQIKKGKTAQ

SEQ ID NO: 1632493 - protein, 5 aa, Staphylococcus aureus
KYKEM

SEQ ID NO: 1632494 - protein, 7 aa, Staphylococcus aureus
KYKKYKP

SEQ ID NO: 1632495 - protein, 6 aa, Staphylococcus aureus
KYNESN

SEQ ID NO: 1632496 - protein, 6 aa, Staphylococcus aureus
KYNKSI

SEQ ID NO: 1632497 - protein, 9 aa, Staphylococcus aureus
KYNNTDIEY

SEQ ID NO: 1632498 - protein, 28 aa, Staphylococcus aureus
KYNSNFEKEDVPNASNQQSASDLSDEEL

SEQ ID NO: 1632499 - protein, 10 aa, Staphylococcus aureus
KYQLTNDDYN

SEQ ID NO: 1632500 - protein, 5 aa, Staphylococcus aureus
KYQPT

SEQ ID NO: 1632501 - protein, 10 aa, Staphylococcus aureus
KYSDEDRKYI

SEQ ID NO: 1632502 - protein, 8 aa, Staphylococcus aureus
KYSDENEF

SEQ ID NO: 1632503 - protein, 9 aa, Staphylococcus aureus
KYSESERYK

SEQ ID NO: 1632504 - protein, 6 aa, Staphylococcus aureus
KYSKKY

SEQ ID NO: 1632505 - protein, 9 aa, Staphylococcus aureus
KYSKVRKRY

SEQ ID NO: 1632506 - protein, 8 aa, Staphylococcus aureus
KYSRGDKR

SEQ ID NO: 1632507 - protein, 17 aa, Staphylococcus aureus
LAAPSANLSGRPSPTNF

SEQ ID NO: 1632508 - protein, 28 aa, Staphylococcus aureus
LAEGSATVTATSGKQTDTVQITVQSNLE

SEQ ID NO: 1632509 - protein, 148 aa, Staphylococcus aureus
LAESTNKVEKNAVTEDKADSKDSKVAGVNTSTDAKTDTKADNAGDGTTTKVDKEDQISATEAIEKASVEQSKNGNAAETSNKEATIDAEAQHDAEQQVAEAHAEASKQATSNDSLEAKAENDSTASQSEMSEPKPQEEKKGFFARLFN

SEQ ID NO: 1632510 - protein, 95 aa, Staphylococcus aureus
LAESTNKVESNAVTEDKADSKDSKVAGVNTSTDAKTDTKAENAGDGTATKVDKEDQISATEAIEKASVEQSKNDKAVETSNKEATVDAEAQHDAV

SEQ ID NO: 1632511 - protein, 8 aa, Staphylococcus aureus
LAGANKED

SEQ ID NO: 1632512 - protein, 9 aa, Staphylococcus aureus
LAGELQTAE

SEQ ID NO: 1632513 - protein, 11 aa, Staphylococcus aureus
LAKTNGKHDIE

SEQ ID NO: 1632514 - protein, 7 aa, Staphylococcus aureus
LAPAGMG

SEQ ID NO: 1632515 - protein, 7 aa, Staphylococcus aureus
LAPSARK

SEQ ID NO: 1632516 - protein, 19 aa, Staphylococcus aureus
LAQQNNAKISVSSDIDVGT

SEQ ID NO: 1632517 - protein, 9 aa, Staphylococcus aureus
LATEGAKAA

SEQ ID NO: 1632518 - protein, 9 aa, Staphylococcus aureus
LDADNEDIQ

SEQ ID NO: 1632519 - protein, 4 aa, Staphylococcus aureus
LDAQ

SEQ ID NO: 1632520 - protein, 7 aa, Staphylococcus aureus
LDAVSDR

SEQ ID NO: 1632521 - protein, 9 aa, Staphylococcus aureus
LDDTEEGDL

SEQ ID NO: 1632522 - protein, 10 aa, Staphylococcus aureus
LDGDGTGRRI

SEQ ID NO: 1632523 - protein, 10 aa, Staphylococcus aureus
LDGQEKPATQ

SEQ ID NO: 1632524 - protein, 19 aa, Staphylococcus aureus
LDKSEYEAEPPLFFFSGPI

SEQ ID NO: 1632525 - protein, 19 aa, Staphylococcus aureus
LDKSEYEAEPPLFFFSGSL

SEQ ID NO: 1632526 - protein, 9 aa, Staphylococcus aureus
LDNKQNQRL

SEQ ID NO: 1632527 - protein, 6 aa, Staphylococcus aureus
LDPDQY

SEQ ID NO: 1632528 - protein, 5 aa, Staphylococcus aureus
LDQAA

SEQ ID NO: 1632529 - protein, 7 aa, Staphylococcus aureus
LDQNKKD

SEQ ID NO: 1632530 - protein, 5 aa, Staphylococcus aureus
LDQSS

SEQ ID NO: 1632531 - protein, 5 aa, Staphylococcus aureus
LDRND

SEQ ID NO: 1632532 - protein, 6 aa, Staphylococcus aureus
LDSRSF

SEQ ID NO: 1632533 - protein, 14 aa, Staphylococcus aureus
LDSRSFKSFSKPEW

SEQ ID NO: 1632534 - protein, 5 aa, Staphylococcus aureus
LDYGA

SEQ ID NO: 1632535 - protein, 7 aa, Staphylococcus aureus
LEDDPEG

SEQ ID NO: 1632536 - protein, 5 aa, Staphylococcus aureus
LEDKL

SEQ ID NO: 1632537 - protein, 4 aa, Staphylococcus aureus
LEED

SEQ ID NO: 1632538 - protein, 15 aa, Staphylococcus aureus
LEGKSFEASYNRKND

SEQ ID NO: 1632539 - protein, 16 aa, Staphylococcus aureus
LEGKSFEASYNRKNDV

SEQ ID NO: 1632540 - protein, 16 aa, Staphylococcus aureus
LEGKTFEESYNRKNDV

SEQ ID NO: 1632541 - protein, 4 aa, Staphylococcus aureus
LEGM

SEQ ID NO: 1632542 - protein, 9 aa, Staphylococcus aureus
LEKEYTGKE

SEQ ID NO: 1632543 - protein, 9 aa, Staphylococcus aureus
LEKLAKQGQ

SEQ ID NO: 1632544 - protein, 15 aa, Staphylococcus aureus
LENAGADATKVGIGP

SEQ ID NO: 1632545 - protein, 4 aa, Staphylococcus aureus
LENE

SEQ ID NO: 1632546 - protein, 10 aa, Staphylococcus aureus
LENGKRNFPS

SEQ ID NO: 1632547 - protein, 6 aa, Staphylococcus aureus
LENTPA

SEQ ID NO: 1632548 - protein, 9 aa, Staphylococcus aureus
LENTPAARA

SEQ ID NO: 1632549 - protein, 11 aa, Staphylococcus aureus
LEPELQDEQPI

SEQ ID NO: 1632550 - protein, 14 aa, Staphylococcus aureus
LEQAIKDNESLSTG

SEQ ID NO: 1632551 - protein, 9 aa, Staphylococcus aureus
LEQSKTDNV

SEQ ID NO: 1632552 - protein, 10 aa, Staphylococcus aureus
LERDKIEAEY

SEQ ID NO: 1632553 - protein, 20 aa, Staphylococcus aureus
LEREREMARQRRKEAELRRK

SEQ ID NO: 1632554 - protein, 12 aa, Staphylococcus aureus
LESKNRKNVPFT

SEQ ID NO: 1632555 - protein, 11 aa, Staphylococcus aureus
LESMTPETATI

SEQ ID NO: 1632556 - protein, 5 aa, Staphylococcus aureus
LESNP

SEQ ID NO: 1632557 - protein, 21 aa, Staphylococcus aureus
LETEDGSKINPTLSMTEGGYE

SEQ ID NO: 1632558 - protein, 10 aa, Staphylococcus aureus
LETETRNYST

SEQ ID NO: 1632559 - protein, 4 aa, Staphylococcus aureus
LETG

SEQ ID NO: 1632560 - protein, 5 aa, Staphylococcus aureus
LETVN

SEQ ID NO: 1632561 - protein, 7 aa, Staphylococcus aureus
LEYYTPN

SEQ ID NO: 1632562 - protein, 4 aa, Staphylococcus aureus
LGEP

SEQ ID NO: 1632563 - protein, 9 aa, Staphylococcus aureus
LGETGLNGA

SEQ ID NO: 1632564 - protein, 7 aa, Staphylococcus aureus
LGGKDNI

SEQ ID NO: 1632565 - protein, 8 aa, Staphylococcus aureus
LGKETGVY

SEQ ID NO: 1632566 - protein, 18 aa, Staphylococcus aureus
LGPSDEGNEKLKQQFSNS

SEQ ID NO: 1632567 - protein, 5 aa, Staphylococcus aureus
LGSKK

SEQ ID NO: 1632568 - protein, 6 aa, Staphylococcus aureus
LGSKKI

SEQ ID NO: 1632569 - protein, 9 aa, Staphylococcus aureus
LGSLPTTTL

SEQ ID NO: 1632570 - protein, 7 aa, Staphylococcus aureus
LGTQITT

SEQ ID NO: 1632571 - protein, 12 aa, Staphylococcus aureus
LHGTKSSEFKPN

SEQ ID NO: 1632572 - protein, 4 aa, Staphylococcus aureus
LIEN

SEQ ID NO: 1632573 - protein, 50 aa, Staphylococcus aureus
LKADTEEAKTNTAKRSKRSLNTQNYKSASQEVSEQQKAEYERKAEERKEK

SEQ ID NO: 1632574 - protein, 30 aa, Staphylococcus aureus
LKAQGVSVAPAQKSSKKPARGIQKSKNAFS

SEQ ID NO: 1632575 - protein, 9 aa, Staphylococcus aureus
LKDNSVKEV

SEQ ID NO: 1632576 - protein, 11 aa, Staphylococcus aureus
LKDREEYKKQR

SEQ ID NO: 1632577 - protein, 7 aa, Staphylococcus aureus
LKEDLQA

SEQ ID NO: 1632578 - protein, 4 aa, Staphylococcus aureus
LKES

SEQ ID NO: 1632579 - protein, 10 aa, Staphylococcus aureus
LKESELEEDI

SEQ ID NO: 1632580 - protein, 6 aa, Staphylococcus aureus
LKETEG

SEQ ID NO: 1632581 - protein, 17 aa, Staphylococcus aureus
LKGGGGKVGGSGYENAK

SEQ ID NO: 1632582 - protein, 22 aa, Staphylococcus aureus
LKKEPRANTQAAERILQDLRSQ

SEQ ID NO: 1632583 - protein, 16 aa, Staphylococcus aureus
LKKHASDNQQAISSNQ

SEQ ID NO: 1632584 - protein, 35 aa, Staphylococcus aureus
LKKKQKRKHYKEKRDAFQKRKREIKKVKAKEKHKG

SEQ ID NO: 1632585 - protein, 19 aa, Staphylococcus aureus
LKKYKAENKYRKATGQAPI

SEQ ID NO: 1632586 - protein, 17 aa, Staphylococcus aureus
LKNKNDELSQKATDPNI

SEQ ID NO: 1632587 - protein, 7 aa, Staphylococcus aureus
LKNKTID

SEQ ID NO: 1632588 - protein, 8 aa, Staphylococcus aureus
LKNKTIDI

SEQ ID NO: 1632589 - protein, 49 aa, Staphylococcus aureus
LKPVQSKQAVSERMPASQATPSSSTDSQESNTNAYKTNNMTSNNVENNQ

SEQ ID NO: 1632590 - protein, 4 aa, Staphylococcus aureus
LKQK

SEQ ID NO: 1632591 - protein, 11 aa, Staphylococcus aureus
LKQPLTTKRSR

SEQ ID NO: 1632592 - protein, 12 aa, Staphylococcus aureus
LKRELNQTQSAI

SEQ ID NO: 1632593 - protein, 11 aa, Staphylococcus aureus
LKRNNAINDKD

SEQ ID NO: 1632594 - protein, 52 aa, Staphylococcus aureus
LKSDTEAAKSDESKRSKRSKRSLNTQNHKPASQEVSEQQKAEYDKRAEERKA

SEQ ID NO: 1632595 - protein, 7 aa, Staphylococcus aureus
LKSTQAL

SEQ ID NO: 1632596 - protein, 5 aa, Staphylococcus aureus
LKSYK

SEQ ID NO: 1632597 - protein, 18 aa, Staphylococcus aureus
LKTESELKRLGQKQGLSE

SEQ ID NO: 1632598 - protein, 9 aa, Staphylococcus aureus
LKVKSDDQV

SEQ ID NO: 1632599 - protein, 10 aa, Staphylococcus aureus
LKVKSDDQVV

SEQ ID NO: 1632600 - protein, 14 aa, Staphylococcus aureus
LLNTDIKTKFDMVT

SEQ ID NO: 1632601 - protein, 13 aa, Staphylococcus aureus
LLPQRKKIENPHP

SEQ ID NO: 1632602 - protein, 4 aa, Staphylococcus aureus
LLSE

SEQ ID NO: 1632603 - protein, 15 aa, Staphylococcus aureus
LMAPPKELATAGRLN

SEQ ID NO: 1632604 - protein, 6 aa, Staphylococcus aureus
LMDPEQ

SEQ ID NO: 1632605 - protein, 17 aa, Staphylococcus aureus
LNADPDKQNAYKQAVAK

SEQ ID NO: 1632606 - protein, 10 aa, Staphylococcus aureus
LNDKENRRDQ

SEQ ID NO: 1632607 - protein, 11 aa, Staphylococcus aureus
LNGAVKLSTDN

SEQ ID NO: 1632608 - protein, 10 aa, Staphylococcus aureus
LNGDPLTDKE

SEQ ID NO: 1632609 - protein, 4 aa, Staphylococcus aureus
LNGK

SEQ ID NO: 1632610 - protein, 9 aa, Staphylococcus aureus
LNLTDDNDI

SEQ ID NO: 1632611 - protein, 51 aa, Staphylococcus aureus; identical to SEQ ID NO: 1566423

SEQ ID NO: 1632612 - protein, 15 aa, Staphylococcus aureus
LNQDKRIGPDPKKFE

SEQ ID NO: 1632613 - protein, 8 aa, Staphylococcus aureus
LNQNDNYS

SEQ ID NO: 1632614 - protein, 15 aa, Staphylococcus aureus
LNRNDDKDNQDSSHI

SEQ ID NO: 1632615 - protein, 4 aa, Staphylococcus aureus
LNRQ

SEQ ID NO: 1632616 - protein, 10 aa, Staphylococcus aureus
LNSAQEISKK

SEQ ID NO: 1632617 - protein, 15 aa, Staphylococcus aureus
LNSDNSLTFNVEKIH

SEQ ID NO: 1632618 - protein, 16 aa, Staphylococcus aureus
LNTPYGKVTARKGSKV

SEQ ID NO: 1632619 - protein, 7 aa, Staphylococcus aureus
LPANRNT

SEQ ID NO: 1632620 - protein, 10 aa, Staphylococcus aureus
LPARSYAEKY

SEQ ID NO: 1632621 - protein, 11 aa, Staphylococcus aureus
LPDDTQPITDI

SEQ ID NO: 1632622 - protein, 11 aa, Staphylococcus aureus
LPDGTQPITDI

SEQ ID NO: 1632623 - protein, 4 aa, Staphylococcus aureus
LPIP

SEQ ID NO: 1632624 - protein, 17 aa, Staphylococcus aureus
LPITKSEFEEQESKNEF

SEQ ID NO: 1632625 - protein, 12 aa, Staphylococcus aureus
LPKERKKKRSDL

SEQ ID NO: 1632626 - protein, 6 aa, Staphylococcus aureus
LPKKDR

SEQ ID NO: 1632627 - protein, 75 aa, Staphylococcus aureus
LPKNDRSQRPARGKTIQAKTRGKSLDKSKSDDKGHKKKGKQRKGKNERKNDRSGNSKHKPFYKDKSVKKKARRKK

SEQ ID NO: 1632628 - protein, 12 aa, Staphylococcus aureus
LPKNENIQTQQK

SEQ ID NO: 1632629 - protein, 4 aa, Staphylococcus aureus
LPKQ

SEQ ID NO: 1632630 - protein, 18 aa, Staphylococcus aureus
LPLSDSPKISKSLGTRHR

SEQ ID NO: 1632631 - protein, 5 aa, Staphylococcus aureus
LPNES

SEQ ID NO: 1632632 - protein, 9 aa, Staphylococcus aureus
LPQEKSGVI

SEQ ID NO: 1632633 - protein, 12 aa, Staphylococcus aureus
LPTIEATRHSHP

SEQ ID NO: 1632634 - protein, 12 aa, Staphylococcus aureus
LQAEGQSPLDSL

SEQ ID NO: 1632635 - protein, 30 aa, Staphylococcus aureus; identical to SEQ ID NO: 1564144

SEQ ID NO: 1632636 - protein, 10 aa, Staphylococcus aureus
LQDKRYPNFK

SEQ ID NO: 1632637 - protein, 19 aa, Staphylococcus aureus
LQNEEDNEEDEENEEEVNN

SEQ ID NO: 1632638 - protein, 23 aa, Staphylococcus aureus
LQNEEDNKEDEEDKEDENDVLQN

SEQ ID NO: 1632639 - protein, 6 aa, Staphylococcus aureus
LQPHRM

SEQ ID NO: 1632640 - protein, 11 aa, Staphylococcus aureus
LQPKSGKQRPI

SEQ ID NO: 1632641 - protein, 6 aa, Staphylococcus aureus
LQRRGV

SEQ ID NO: 1632642 - protein, 9 aa, Staphylococcus aureus
LQTSNNRIY

SEQ ID NO: 1632643 - protein, 15 aa, Staphylococcus aureus
LRDRGRDNLEKASYN

SEQ ID NO: 1632644 - protein, 11 aa, Staphylococcus aureus
LRDSVSSEEDI

SEQ ID NO: 1632645 - protein, 79 aa, Staphylococcus aureus
LREEWDKKQEKNKQQKLEEYKEEQRQKELEKEQQPQEEQQNEKVKESKDKNDQEDKKDEQQKINDSKKAFYEKLKQKQA

SEQ ID NO: 1632646 - protein, 15 aa, Staphylococcus aureus
LRHTSKKLGTILKGD

SEQ ID NO: 1632647 - protein, 11 aa, Staphylococcus aureus
LRNGKTSLSDA

SEQ ID NO: 1632648 - protein, 17 aa, Staphylococcus aureus
LRPYGQEKFGTKAELKN

SEQ ID NO: 1632649 - protein, 10 aa, Staphylococcus aureus
LRQQTGLHNQ

SEQ ID NO: 1632650 - protein, 9 aa, Staphylococcus aureus
LSAARTKIQ

SEQ ID NO: 1632651 - protein, 11 aa, Staphylococcus aureus
LSDGQSKGSTF

SEQ ID NO: 1632652 - protein, 6 aa, Staphylococcus aureus
LSEHNS

SEQ ID NO: 1632653 - protein, 20 aa, Staphylococcus aureus
LSEQGIDEATRAGEKVRENN

SEQ ID NO: 1632654 - protein, 5 aa, Staphylococcus aureus
LSERN

SEQ ID NO: 1632655 - protein, 6 aa, Staphylococcus aureus
LSERNK

SEQ ID NO: 1632656 - protein, 8 aa, Staphylococcus aureus
LSESSKGN

SEQ ID NO: 1632657 - protein, 9 aa, Staphylococcus aureus
LSFASQNKG

SEQ ID NO: 1632658 - protein, 6 aa, Staphylococcus aureus
LSGAGK

SEQ ID NO: 1632659 - protein, 4 aa, Staphylococcus aureus
LSKD

SEQ ID NO: 1632660 - protein, 23 aa, Staphylococcus aureus
LSKGSLAGVDGRLQTRSYENKVG

SEQ ID NO: 1632661 - protein, 18 aa, Staphylococcus aureus
LSKKEELEKEINQSNSKD

SEQ ID NO: 1632662 - protein, 8 aa, Staphylococcus aureus
LSKRKDYQ

SEQ ID NO: 1632663 - protein, 7 aa, Staphylococcus aureus
LSKSGHY

SEQ ID NO: 1632664 - protein, 5 aa, Staphylococcus aureus
LSNDI

SEQ ID NO: 1632665 - protein, 11 aa, Staphylococcus aureus
LSNKEREEAQN

SEQ ID NO: 1632666 - protein, 9 aa, Staphylococcus aureus
LSNRQAKDI

SEQ ID NO: 1632667 - protein, 17 aa, Staphylococcus aureus
LSPARRDKLQKMYNRTL

SEQ ID NO: 1632668 - protein, 10 aa, Staphylococcus aureus
LSPINDKNDF

SEQ ID NO: 1632669 - protein, 4 aa, Staphylococcus aureus
LSQL

SEQ ID NO: 1632670 - protein, 4 aa, Staphylococcus aureus
LSSP

SEQ ID NO: 1632671 - protein, 9 aa, Staphylococcus aureus
LSTEGCPYD

SEQ ID NO: 1632672 - protein, 9 aa, Staphylococcus aureus
LTGPSKGGH

SEQ ID NO: 1632673 - protein, 4 aa, Staphylococcus aureus
LTKN

SEQ ID NO: 1632674 - protein, 7 aa, Staphylococcus aureus
LTNDDYN

SEQ ID NO: 1632675 - protein, 7 aa, Staphylococcus aureus
LTPDELE

SEQ ID NO: 1632676 - protein, 10 aa, Staphylococcus aureus
LTQDMEKTYD

SEQ ID NO: 1632677 - protein, 6 aa, Staphylococcus aureus
LTSGGY

SEQ ID NO: 1632678 - protein, 9 aa, Staphylococcus aureus
LTSTERGKI

SEQ ID NO: 1632679 - protein, 6 aa, Staphylococcus aureus
LTTKEA

SEQ ID NO: 1632680 - protein, 10 aa, Staphylococcus aureus
LTTPKQAPYL

SEQ ID NO: 1632681 - protein, 15 aa, Staphylococcus aureus
LTTQETQIKNDHEEF

SEQ ID NO: 1632682 - protein, 32 aa, Staphylococcus aureus
LVEDSSPKYVREDNGEKKKTYDGFKEQDNGKL

SEQ ID NO: 1632683 - protein, 12 aa, Staphylococcus aureus
LYENGNKKYDID

SEQ ID NO: 1632684 - protein, 11 aa, Staphylococcus aureus
MAKGEDPEKVI

SEQ ID NO: 1632685 - protein, 7 aa, Staphylococcus aureus
MAQSEGL

SEQ ID NO: 1632686 - protein, 14 aa, Staphylococcus aureus
MDGPHPKVVESFKD

SEQ ID NO: 1632687 - protein, 5 aa, Staphylococcus aureus
MDKSQ

SEQ ID NO: 1632688 - protein, 9 aa, Staphylococcus aureus
MDNESDQIN

SEQ ID NO: 1632689 - protein, 9 aa, Staphylococcus aureus
MDNRKTNDV

SEQ ID NO: 1632690 - protein, 4 aa, Staphylococcus aureus
MEDL

SEQ ID NO: 1632691 - protein, 53 aa, Staphylococcus aureus
MEENSNSKNDNKSTTNQQQMDNKWTTNQQQINTNKNVKNGDNVKNGENEKKKV

SEQ ID NO: 1632692 - protein, 46 aa, Staphylococcus aureus
MEKPEVDSEYATTDNEEHIQEQSNQDKSYFDSESIGNQSGGVRQRE

SEQ ID NO: 1632693 - protein, 19 aa, Staphylococcus aureus
MEPDAPVDKSEMKSEDALY

SEQ ID NO: 1632694 - protein, 4 aa, Staphylococcus aureus
MGGQ

SEQ ID NO: 1632695 - protein, 11 aa, Staphylococcus aureus
MGGQVNDTAGI

SEQ ID NO: 1632696 - protein, 9 aa, Staphylococcus aureus
MGPNTEKLD

SEQ ID NO: 1632697 - protein, 6 aa, Staphylococcus aureus
MGPSFN

SEQ ID NO: 1632698 - protein, 16 aa, Staphylococcus aureus
MGRKGHKLTEDERNTF

SEQ ID NO: 1632699 - protein, 10 aa, Staphylococcus aureus
MGRRADNNRI

SEQ ID NO: 1632700 - protein, 14 aa, Staphylococcus aureus
MIKNGKKVKKLLKS

SEQ ID NO: 1632701 - protein, 5 aa, Staphylococcus aureus
MKEEK

SEQ ID NO: 1632702 - protein, 12 aa, Staphylococcus aureus
MKEETLNQSKIG

SEQ ID NO: 1632703 - protein, 4 aa, Staphylococcus aureus
MKHA

SEQ ID NO: 1632704 - protein, 10 aa, Staphylococcus aureus
MKRGLTREQV

SEQ ID NO: 1632705 - protein, 8 aa, Staphylococcus aureus
MKTNQDTV

SEQ ID NO: 1632706 - protein, 13 aa, Staphylococcus aureus
MLANGATKTQINK

SEQ ID NO: 1632707 - protein, 11 aa, Staphylococcus aureus
MNAKQISSTIH

SEQ ID NO: 1632708 - protein, 4 aa, Staphylococcus aureus
MNSE

SEQ ID NO: 1632709 - protein, 5 aa, Staphylococcus aureus
MPAGE

SEQ ID NO: 1632710 - protein, 58 aa, Staphylococcus aureus
MPAPKQEQSQTTTESTTPKTKVTTPPSTNTPQPMQSTKSDTPQSPTIKQAQTDMTPKY

SEQ ID NO: 1632711 - protein, 8 aa, Staphylococcus aureus
MPDITKDK

SEQ ID NO: 1632712 - protein, 6 aa, Staphylococcus aureus
MPGSVT

SEQ ID NO: 1632713 - protein, 13 aa, Staphylococcus aureus
MPQASDSDKLDGL

SEQ ID NO: 1632714 - protein, 33 aa, Staphylococcus aureus
MQEISSELQQAEQSKQKQYGTTLQNLAKQNRII

SEQ ID NO: 1632715 - protein, 10 aa, Staphylococcus aureus
MQQRAQNDEI

SEQ ID NO: 1632716 - protein, 5 aa, Staphylococcus aureus
MQQSA

SEQ ID NO: 1632717 - protein, 5 aa, Staphylococcus aureus
MQSSD

SEQ ID NO: 1632718 - protein, 4 aa, Staphylococcus aureus
MREE

SEQ ID NO: 1632719 - protein, 12 aa, Staphylococcus aureus
MSDLKGNNHQDQ

SEQ ID NO: 1632720 - protein, 7 aa, Staphylococcus aureus
MSNKDEI

SEQ ID NO: 1632721 - protein, 5 aa, Staphylococcus aureus
MSPDN

SEQ ID NO: 1632722 - protein, 5 aa, Staphylococcus aureus
MSPKD

SEQ ID NO: 1632723 - protein, 7 aa, Staphylococcus aureus
MSREDQD

SEQ ID NO: 1632724 - protein, 7 aa, Staphylococcus aureus
MTDEYGN

SEQ ID NO: 1632725 - protein, 11 aa, Staphylococcus aureus
MTESKSIDPRI

SEQ ID NO: 1632726 - protein, 18 aa, Staphylococcus aureus
MTKPDTTSNELELSANDE

SEQ ID NO: 1632727 - protein, 19 aa, Staphylococcus aureus
MTKPETTSNELELSAKDEL

SEQ ID NO: 1632728 - protein, 7 aa, Staphylococcus aureus
MTTDEKR

SEQ ID NO: 1632729 - protein, 10 aa, Staphylococcus aureus
NAATGTNDAN

SEQ ID NO: 1632730 - protein, 17 aa, Staphylococcus aureus
NADDDSPKKLKYKENSA

SEQ ID NO: 1632731 - protein, 6 aa, Staphylococcus aureus
NADEGR

SEQ ID NO: 1632732 - protein, 7 aa, Staphylococcus aureus
NADEGRI

SEQ ID NO: 1632733 - protein, 9 aa, Staphylococcus aureus
NADNAFDAA

SEQ ID NO: 1632734 - protein, 48 aa, Staphylococcus aureus
NADRNLNRIDSSEAMNGYRRGAYEDMSKGMNAEEKSSAAMQGVKSSDW

SEQ ID NO: 1632735 - protein, 6 aa, Staphylococcus aureus
NADSEI

SEQ ID NO: 1632736 - protein, 42 aa, Staphylococcus aureus
NAEITENVENEAAESEQNVEEKTIENVNPKKQTEKVSTLSKR

SEQ ID NO: 1632737 - protein, 7 aa, Staphylococcus aureus
NAEPGIG

SEQ ID NO: 1632738 - protein, 22 aa, Staphylococcus aureus
NAETLNKASRAINRATKLDNAM

SEQ ID NO: 1632739 - protein, 19 aa, Staphylococcus aureus
NAEVKKKPRKLSEADFDDD

SEQ ID NO: 1632740 - protein, 5 aa, Staphylococcus aureus
NAGQT

SEQ ID NO: 1632741 - protein, 7 aa, Staphylococcus aureus
NAIENGC

SEQ ID NO: 1632742 - protein, 20 aa, Staphylococcus aureus
NAKAPSRDVKGQNLTNGTDA

SEQ ID NO: 1632743 - protein, 13 aa, Staphylococcus aureus
NAKNNVALKSQTL

SEQ ID NO: 1632744 - protein, 10 aa, Staphylococcus aureus
NAKRISSTIH

SEQ ID NO: 1632745 - protein, 4 aa, Staphylococcus aureus
NAMQ

SEQ ID NO: 1632746 - protein, 9 aa, Staphylococcus aureus
NANFGERKH

SEQ ID NO: 1632747 - protein, 9 aa, Staphylococcus aureus
NAPTAKEPL

SEQ ID NO: 1632748 - protein, 8 aa, Staphylococcus aureus
NAPTSKDI

SEQ ID NO: 1632749 - protein, 18 aa, Staphylococcus aureus
NAQKANLTEQIERGTTVA

SEQ ID NO: 1632750 - protein, 33 aa, Staphylococcus aureus; identical to SEQ ID NO: 1565432

SEQ ID NO: 1632751 - protein, 16 aa, Staphylococcus aureus
NAQQQINTAKTEAQQV

SEQ ID NO: 1632752 - protein, 33 aa, Staphylococcus aureus; identical to SEQ ID NO: 1565578

SEQ ID NO: 1632753 - protein, 5 aa, Staphylococcus aureus
NARAN

SEQ ID NO: 1632754 - protein, 5 aa, Staphylococcus aureus
NASLS

SEQ ID NO: 1632755 - protein, 44 aa, Staphylococcus aureus; identical to SEQ ID NO: 1567150

SEQ ID NO: 1632756 - protein, 6 aa, Staphylococcus aureus
NCDPRT

SEQ ID NO: 1632757 - protein, 13 aa, Staphylococcus aureus
NDADVKTSQPPIG

SEQ ID NO: 1632758 - protein, 7 aa, Staphylococcus aureus
NDDGENE

SEQ ID NO: 1632759 - protein, 4 aa, Staphylococcus aureus
NDDN

SEQ ID NO: 1632760 - protein, 6 aa, Staphylococcus aureus
NDDYNV

SEQ ID NO: 1632761 - protein, 13 aa, Staphylococcus aureus
NDEDTRSLPKSDK

SEQ ID NO: 1632762 - protein, 6 aa, Staphylococcus aureus
NDENYN

SEQ ID NO: 1632763 - protein, 8 aa, Staphylococcus aureus
NDFTTITN

SEQ ID NO: 1632764 - protein, 22 aa, Staphylococcus aureus
NDIAQNKTNAEVDRTETDGNDN

SEQ ID NO: 1632765 - protein, 25 aa, Staphylococcus aureus
NDKEFKEGMQQARKELNYTANTDAV

SEQ ID NO: 1632766 - protein, 6 aa, Staphylococcus aureus
NDKEGF

SEQ ID NO: 1632767 - protein, 8 aa, Staphylococcus aureus
NDKNKLDN

SEQ ID NO: 1632768 - protein, 9 aa, Staphylococcus aureus
NDKSISNYR

SEQ ID NO: 1632769 - protein, 5 aa, Staphylococcus aureus
NDLKT

SEQ ID NO: 1632770 - protein, 7 aa, Staphylococcus aureus
NDPIAEE

SEQ ID NO: 1632771 - protein, 11 aa, Staphylococcus aureus
NDPIDQKGRFE

SEQ ID NO: 1632772 - protein, 6 aa, Staphylococcus aureus
NDQPEE

SEQ ID NO: 1632773 - protein, 5 aa, Staphylococcus aureus
NDREN

SEQ ID NO: 1632774 - protein, 7 aa, Staphylococcus aureus
NDSPYNS

SEQ ID NO: 1632775 - protein, 4 aa, Staphylococcus aureus
NDVE

SEQ ID NO: 1632776 - protein, 13 aa, Staphylococcus aureus
NEAEERSERIQNK

SEQ ID NO: 1632777 - protein, 6 aa, Staphylococcus aureus
NEAHQH

SEQ ID NO: 1632778 - protein, 5 aa, Staphylococcus aureus
NEATV

SEQ ID NO: 1632779 - protein, 7 aa, Staphylococcus aureus
NEDLENT

SEQ ID NO: 1632780 - protein, 8 aa, Staphylococcus aureus
NEDTQQDD

SEQ ID NO: 1632781 - protein, 6 aa, Staphylococcus aureus
NEENPH

SEQ ID NO: 1632782 - protein, 11 aa, Staphylococcus aureus
NEFPTKHNTAL

SEQ ID NO: 1632783 - protein, 12 aa, Staphylococcus aureus
NEGFEKAGPINI

SEQ ID NO: 1632784 - protein, 7 aa, Staphylococcus aureus
NEGGALQ

SEQ ID NO: 1632785 - protein, 4 aa, Staphylococcus aureus
NEGK

SEQ ID NO: 1632786 - protein, 26 aa, Staphylococcus aureus
NEHANVEQTVDYTQADSDKQNAYKQA

SEQ ID NO: 1632787 - protein, 6 aa, Staphylococcus aureus
NEIEKM

SEQ ID NO: 1632788 - protein, 9 aa, Staphylococcus aureus
NEKKYQYKG

SEQ ID NO: 1632789 - protein, 10 aa, Staphylococcus aureus
NEKQQNYGKV

SEQ ID NO: 1632790 - protein, 10 aa, Staphylococcus aureus
NEKQQQYSKI

SEQ ID NO: 1632791 - protein, 8 aa, Staphylococcus aureus
NELTNNSL

SEQ ID NO: 1632792 - protein, 6 aa, Staphylococcus aureus
NEMPGG

SEQ ID NO: 1632793 - protein, 10 aa, Staphylococcus aureus
NEMSGGQKQR

SEQ ID NO: 1632794 - protein, 6 aa, Staphylococcus aureus
NENETF

SEQ ID NO: 1632795 - protein, 9 aa, Staphylococcus aureus
NENKAKEIL

SEQ ID NO: 1632796 - protein, 9 aa, Staphylococcus aureus
NENKKRAIL

SEQ ID NO: 1632797 - protein, 9 aa, Staphylococcus aureus
NENNQYNNV

SEQ ID NO: 1632798 - protein, 7 aa, Staphylococcus aureus
NENPQNI

SEQ ID NO: 1632799 - protein, 5 aa, Staphylococcus aureus
NENSA

SEQ ID NO: 1632800 - protein, 6 aa, Staphylococcus aureus
NEPEDV

SEQ ID NO: 1632801 - protein, 7 aa, Staphylococcus aureus
NEPTYKN

SEQ ID NO: 1632802 - protein, 5 aa, Staphylococcus aureus
NEQQD

SEQ ID NO: 1632803 - protein, 11 aa, Staphylococcus aureus
NEQTATLDNNA

SEQ ID NO: 1632804 - protein, 4 aa, Staphylococcus aureus
NESF

SEQ ID NO: 1632805 - protein, 5 aa, Staphylococcus aureus
NEVSD

SEQ ID NO: 1632806 - protein, 5 aa, Staphylococcus aureus
NFDGK

SEQ ID NO: 1632807 - protein, 11 aa, Staphylococcus aureus
NFRSRKEVLST

SEQ ID NO: 1632808 - protein, 6 aa, Staphylococcus aureus
NGAEEV

SEQ ID NO: 1632809 - protein, 20 aa, Staphylococcus aureus
NGAKKGTGGYKYGAKDIPPD

SEQ ID NO: 1632810 - protein, 9 aa, Staphylococcus aureus
NGAKLSTEI

SEQ ID NO: 1632811 - protein, 10 aa, Staphylococcus aureus
NGDDENSIYE

SEQ ID NO: 1632812 - protein, 4 aa, Staphylococcus aureus
NGDH

SEQ ID NO: 1632813 - protein, 9 aa, Staphylococcus aureus
NGDIKNGKE

SEQ ID NO: 1632814 - protein, 8 aa, Staphylococcus aureus
NGDNKLSE

SEQ ID NO: 1632815 - protein, 5 aa, Staphylococcus aureus
NGDSM

SEQ ID NO: 1632816 - protein, 7 aa, Staphylococcus aureus
NGEGHSM

SEQ ID NO: 1632817 - protein, 4 aa, Staphylococcus aureus
NGEQ

SEQ ID NO: 1632818 - protein, 13 aa, Staphylococcus aureus
NGEYIAPSTSTFK

SEQ ID NO: 1632819 - protein, 30 aa, Staphylococcus aureus
NGGAPTASNESAASATNEEVADTPAAPAAV

SEQ ID NO: 1632820 - protein, 39 aa, Staphylococcus aureus
NGGTTAQSDKQVQTQSTSVATSSNQSTEGNSENSTIPVN

SEQ ID NO: 1632821 - protein, 39 aa, Staphylococcus aureus
NGGTTVQSDKQVQTKSTSVDTSSNQSSEDNSENSTIPVN

SEQ ID NO: 1632822 - protein, 7 aa, Staphylococcus aureus
NGKTQVV

SEQ ID NO: 1632823 - protein, 8 aa, Staphylococcus aureus
NGNKEEIA

SEQ ID NO: 1632824 - protein, 10 aa, Staphylococcus aureus
NGNNGKGTFQ

SEQ ID NO: 1632825 - protein, 9 aa, Staphylococcus aureus
NGNPTVQNI

SEQ ID NO: 1632826 - protein, 8 aa, Staphylococcus aureus
NGSAIPDA

SEQ ID NO: 1632827 - protein, 10 aa, Staphylococcus aureus
NGSAKLNNMT

SEQ ID NO: 1632828 - protein, 17 aa, Staphylococcus aureus
NGSSPPNQILGDLWGEI

SEQ ID NO: 1632829 - protein, 11 aa, Staphylococcus aureus
NGTDQIPTQTT

SEQ ID NO: 1632830 - protein, 7 aa, Staphylococcus aureus
NGTSTNI

SEQ ID NO: 1632831 - protein, 9 aa, Staphylococcus aureus
NGTSTPIAS

SEQ ID NO: 1632832 - protein, 4 aa, Staphylococcus aureus
NGYV

SEQ ID NO: 1632833 - protein, 17 aa, Staphylococcus aureus
NHADKTAQVNQDSINAQ

SEQ ID NO: 1632834 - protein, 5 aa, Staphylococcus aureus
NHEGV

SEQ ID NO: 1632835 - protein, 5 aa, Staphylococcus aureus
NHHPE

SEQ ID NO: 1632836 - protein, 12 aa, Staphylococcus aureus
NHHPRKSLGYRT

SEQ ID NO: 1632837 - protein, 8 aa, Staphylococcus aureus
NHKHTTVQ

SEQ ID NO: 1632838 - protein, 5 aa, Staphylococcus aureus
NHQGD

SEQ ID NO: 1632839 - protein, 5 aa, Staphylococcus aureus
NIESK

SEQ ID NO: 1632840 - protein, 5 aa, Staphylococcus aureus
NIETI

SEQ ID NO: 1632841 - protein, 9 aa, Staphylococcus aureus
NIEYTTPTG

SEQ ID NO: 1632842 - protein, 5 aa, Staphylococcus aureus
NIKSA

SEQ ID NO: 1632843 - protein, 5 aa, Staphylococcus aureus
NINIE

SEQ ID NO: 1632844 - protein, 4 aa, Staphylococcus aureus
NIPS

SEQ ID NO: 1632845 - protein, 8 aa, Staphylococcus aureus
NIPTEKAP

SEQ ID NO: 1632846 - protein, 4 aa, Staphylococcus aureus
NIQT

SEQ ID NO: 1632847 - protein, 12 aa, Staphylococcus aureus
NITKDSEETSTI

SEQ ID NO: 1632848 - protein, 10 aa, Staphylococcus aureus
NITKESKDGY

SEQ ID NO: 1632849 - protein, 5 aa, Staphylococcus aureus
NITKG

SEQ ID NO: 1632850 - protein, 14 aa, Staphylococcus aureus
NITSNSEETSSVSK

SEQ ID NO: 1632851 - protein, 19 aa, Staphylococcus aureus
NKATSNQAVSQVQTAGNHA

SEQ ID NO: 1632852 - protein, 15 aa, Staphylococcus aureus
NKDHGTNKDKQAVEQ

SEQ ID NO: 1632853 - protein, 38 aa, Staphylococcus aureus
NKEGVSDKESAENKLKPRNSKKETTDDVIAQMEKELSD

SEQ ID NO: 1632854 - protein, 18 aa, Staphylococcus aureus
NKEISSYQINKDTGISYG

SEQ ID NO: 1632855 - protein, 6 aa, Staphylococcus aureus
NKGDKL

SEQ ID NO: 1632856 - protein, 10 aa, Staphylococcus aureus
NKGKIGKSEI

SEQ ID NO: 1632857 - protein, 24 aa, Staphylococcus aureus
NKKAFDKGTTTEDIAQSISPGLRK

SEQ ID NO: 1632858 - protein, 15 aa, Staphylococcus aureus
NKKGVKRKEVTTYDG

SEQ ID NO: 1632859 - protein, 7 aa, Staphylococcus aureus
NKKIETE

SEQ ID NO: 1632860 - protein, 16 aa, Staphylococcus aureus
NKKIQKLESQLEEERQ

SEQ ID NO: 1632861 - protein, 6 aa, Staphylococcus aureus
NKKNYK

SEQ ID NO: 1632862 - protein, 5 aa, Staphylococcus aureus
NKKSV

SEQ ID NO: 1632863 - protein, 5 aa, Staphylococcus aureus
NKKYY

SEQ ID NO: 1632864 - protein, 7 aa, Staphylococcus aureus
NKLGHKS

SEQ ID NO: 1632865 - protein, 9 aa, Staphylococcus aureus
NKNNKYPGL

SEQ ID NO: 1632866 - protein, 11 aa, Staphylococcus aureus
NKQSGTNEVQA

SEQ ID NO: 1632867 - protein, 8 aa, Staphylococcus aureus
NKSGDTLI

SEQ ID NO: 1632868 - protein, 10 aa, Staphylococcus aureus
NKSNRNNRSH

SEQ ID NO: 1632869 - protein, 16 aa, Staphylococcus aureus
NKSTLSRYENGSRKIP

SEQ ID NO: 1632870 - protein, 17 aa, Staphylococcus aureus
NKTAEQTQKWQCKYFFE

SEQ ID NO: 1632871 - protein, 14 aa, Staphylococcus aureus
NKTDHTQAPVGNEN

SEQ ID NO: 1632872 - protein, 10 aa, Staphylococcus aureus
NKTHKNDTVT

SEQ ID NO: 1632873 - protein, 4 aa, Staphylococcus aureus
NKVE

SEQ ID NO: 1632874 - protein, 7 aa, Staphylococcus aureus
NKVNGRK

SEQ ID NO: 1632875 - protein, 10 aa, Staphylococcus aureus
NLDNKNRSYA

SEQ ID NO: 1632876 - protein, 15 aa, Staphylococcus aureus
NLEQSTNKNMTIYDF

SEQ ID NO: 1632877 - protein, 6 aa, Staphylococcus aureus
NLKINE

SEQ ID NO: 1632878 - protein, 9 aa, Staphylococcus aureus
NMKDLKEKA

SEQ ID NO: 1632879 - protein, 7 aa, Staphylococcus aureus
NMSPERT

SEQ ID NO: 1632880 - protein, 5 aa, Staphylococcus aureus
NMTKA

SEQ ID NO: 1632881 - protein, 6 aa, Staphylococcus aureus
NMTNKQ

SEQ ID NO: 1632882 - protein, 10 aa, Staphylococcus aureus
NNADDKFKDR

SEQ ID NO: 1632883 - protein, 7 aa, Staphylococcus aureus
NNATIKY

SEQ ID NO: 1632884 - protein, 14 aa, Staphylococcus aureus
NNATIKYDGAYCIN

SEQ ID NO: 1632885 - protein, 7 aa, Staphylococcus aureus
NNDGPAI

SEQ ID NO: 1632886 - protein, 5 aa, Staphylococcus aureus
NNDGS

SEQ ID NO: 1632887 - protein, 12 aa, Staphylococcus aureus
NNEKCKPFSNET

SEQ ID NO: 1632888 - protein, 7 aa, Staphylococcus aureus
NNFNSEA

SEQ ID NO: 1632889 - protein, 5 aa, Staphylococcus aureus
NNIGI

SEQ ID NO: 1632890 - protein, 7 aa, Staphylococcus aureus
NNKAAEK

SEQ ID NO: 1632891 - protein, 7 aa, Staphylococcus aureus
NNKFPRN

SEQ ID NO: 1632892 - protein, 18 aa, Staphylococcus aureus
NNKKQRGSNYDTKLLENR

SEQ ID NO: 1632893 - protein, 6 aa, Staphylococcus aureus
NNKNYE

SEQ ID NO: 1632894 - protein, 13 aa, Staphylococcus aureus
NNKPNQDEEGSVE

SEQ ID NO: 1632895 - protein, 7 aa, Staphylococcus aureus
NNKVKNI

SEQ ID NO: 1632896 - protein, 6 aa, Staphylococcus aureus
NNNIPN

SEQ ID NO: 1632897 - protein, 11 aa, Staphylococcus aureus
NNNNKPTRRGQ

SEQ ID NO: 1632898 - protein, 15 aa, Staphylococcus aureus
NNNTLRYENNNEDTD

SEQ ID NO: 1632899 - protein, 4 aa, Staphylococcus aureus
NNPQ

SEQ ID NO: 1632900 - protein, 15 aa, Staphylococcus aureus
NNPTGCSLTNEQKQN

SEQ ID NO: 1632901 - protein, 7 aa, Staphylococcus aureus
NNPVSSA

SEQ ID NO: 1632902 - protein, 5 aa, Staphylococcus aureus
NNQRS

SEQ ID NO: 1632903 - protein, 17 aa, Staphylococcus aureus
NNQYSYQADKVGLASDN

SEQ ID NO: 1632904 - protein, 8 aa, Staphylococcus aureus
NNRISKTE

SEQ ID NO: 1632905 - protein, 8 aa, Staphylococcus aureus
NNRNITRK

SEQ ID NO: 1632906 - protein, 6 aa, Staphylococcus aureus
NNSQKL

SEQ ID NO: 1632907 - protein, 35 aa, Staphylococcus aureus
NNSSQSLEGTFEGKASEAAQQSINKLKNNNENLKE

SEQ ID NO: 1632908 - protein, 14 aa, Staphylococcus aureus
NNVNREHAYLSTKS

SEQ ID NO: 1632909 - protein, 25 aa, Staphylococcus aureus
NNVNRTASDVRAAFGKNGGNMGVSG

SEQ ID NO: 1632910 - protein, 24 aa, Staphylococcus aureus
NNVNSAKHALNGTQNLNNAKQAAI

SEQ ID NO: 1632911 - protein, 26 aa, Staphylococcus aureus
NNVQGCSDIGSMPDKITGYQSIEADD

SEQ ID NO: 1632912 - protein, 6 aa, Staphylococcus aureus
NPDPTN

SEQ ID NO: 1632913 - protein, 10 aa, Staphylococcus aureus
NPENPAQHQY

SEQ ID NO: 1632914 - protein, 7 aa, Staphylococcus aureus
NPEQVES

SEQ ID NO: 1632915 - protein, 14 aa, Staphylococcus aureus
NPESTNSASDIESK

SEQ ID NO: 1632916 - protein, 8 aa, Staphylococcus aureus
NPIESDTG

SEQ ID NO: 1632917 - protein, 14 aa, Staphylococcus aureus
NPKLSGNKRFYSND

SEQ ID NO: 1632918 - protein, 13 aa, Staphylococcus aureus
NPMYSYNEDGTEH

SEQ ID NO: 1632919 - protein, 6 aa, Staphylococcus aureus
NPNLTT

SEQ ID NO: 1632920 - protein, 6 aa, Staphylococcus aureus
NPNPEI

SEQ ID NO: 1632921 - protein, 11 aa, Staphylococcus aureus
NPNSPHKAGLQ

SEQ ID NO: 1632922 - protein, 6 aa, Staphylococcus aureus
NPPHGA

SEQ ID NO: 1632923 - protein, 5 aa, Staphylococcus aureus
NPRIN

SEQ ID NO: 1632924 - protein, 32 aa, Staphylococcus aureus; identical to SEQ ID NO: 1566242

SEQ ID NO: 1632925 - protein, 16 aa, Staphylococcus aureus
NQAKTNIDQSSTNEYV

SEQ ID NO: 1632926 - protein, 12 aa, Staphylococcus aureus
NQDKRIGPDPKK

SEQ ID NO: 1632927 - protein, 9 aa, Staphylococcus aureus
NQDKTLTAK

SEQ ID NO: 1632928 - protein, 21 aa, Staphylococcus aureus
NQDNKTLKDMTKSGKQRPWRE

SEQ ID NO: 1632929 - protein, 14 aa, Staphylococcus aureus
NQDRRIGPDPKTFE

SEQ ID NO: 1632930 - protein, 6 aa, Staphylococcus aureus
NQENQV

SEQ ID NO: 1632931 - protein, 5 aa, Staphylococcus aureus
NQERL

SEQ ID NO: 1632932 - protein, 15 aa, Staphylococcus aureus
NQFKPKEEDKPKTIE

SEQ ID NO: 1632933 - protein, 9 aa, Staphylococcus aureus
NQHEARENL

SEQ ID NO: 1632934 - protein, 11 aa, Staphylococcus aureus
NQHQEHSKEIE

SEQ ID NO: 1632935 - protein, 6 aa, Staphylococcus aureus
NQKDKN

SEQ ID NO: 1632936 - protein, 7 aa, Staphylococcus aureus
NQKDQGT

SEQ ID NO: 1632937 - protein, 34 aa, Staphylococcus aureus
NQLTTKIDSNSESLKAIQTSQEAIQEAQASQAKV

SEQ ID NO: 1632938 - protein, 4 aa, Staphylococcus aureus
NQMP

SEQ ID NO: 1632939 - protein, 11 aa, Staphylococcus aureus
NQNENKYQSQI

SEQ ID NO: 1632940 - protein, 5 aa, Staphylococcus aureus
NQNSQ

SEQ ID NO: 1632941 - protein, 12 aa, Staphylococcus aureus
NQPETIAKVLEN

SEQ ID NO: 1632942 - protein, 10 aa, Staphylococcus aureus
NQQEVTNEKL

SEQ ID NO: 1632943 - protein, 7 aa, Staphylococcus aureus
NQQQRQK

SEQ ID NO: 1632944 - protein, 39 aa, Staphylococcus aureus; identical to SEQ ID NO: 1561474

SEQ ID NO: 1632945 - protein, 5 aa, Staphylococcus aureus
NQTNQ

SEQ ID NO: 1632946 - protein, 9 aa, Staphylococcus aureus
NQTTNPTMS

SEQ ID NO: 1632947 - protein, 67 aa, Staphylococcus aureus; identical to SEQ ID NO: 1565918

SEQ ID NO: 1632948 - protein, 26 aa, Staphylococcus aureus
NQVSTTKQLSDDEVTVSNVTSQHQSA

SEQ ID NO: 1632949 - protein, 7 aa, Staphylococcus aureus
NRDDTTL

SEQ ID NO: 1632950 - protein, 10 aa, Staphylococcus aureus
NREKQNRHSL

SEQ ID NO: 1632951 - protein, 6 aa, Staphylococcus aureus
NRETTF

SEQ ID NO: 1632952 - protein, 12 aa, Staphylococcus aureus
NRGRKRESIICK

SEQ ID NO: 1632953 - protein, 5 aa, Staphylococcus aureus
NRKGK

SEQ ID NO: 1632954 - protein, 7 aa, Staphylococcus aureus
NRLTDGE

SEQ ID NO: 1632955 - protein, 7 aa, Staphylococcus aureus
NRNGDKI

SEQ ID NO: 1632956 - protein, 14 aa, Staphylococcus aureus
NRNHLTECVSIFNI

SEQ ID NO: 1632957 - protein, 34 aa, Staphylococcus aureus
NRNSYSIDEASKAIKEAEKARKAKKKEVDKQYED

SEQ ID NO: 1632958 - protein, 4 aa, Staphylococcus aureus
NRPL

SEQ ID NO: 1632959 - protein, 6 aa, Staphylococcus aureus
NRSASR

SEQ ID NO: 1632960 - protein, 20 aa, Staphylococcus aureus
NRTAEERQNIDTNQDSEYNS

SEQ ID NO: 1632961 - protein, 4 aa, Staphylococcus aureus
NSDI

SEQ ID NO: 1632962 - protein, 5 aa, Staphylococcus aureus
NSDTP

SEQ ID NO: 1632963 - protein, 5 aa, Staphylococcus aureus
NSFDE

SEQ ID NO: 1632964 - protein, 6 aa, Staphylococcus aureus
NSHYDK

SEQ ID NO: 1632965 - protein, 34 aa, Staphylococcus aureus; identical to SEQ ID NO: 1567180

SEQ ID NO: 1632966 - protein, 34 aa, Staphylococcus aureus; identical to SEQ ID NO: 1565446

SEQ ID NO: 1632967 - protein, 44 aa, Staphylococcus aureus
NSIQNNSNNQNQSQNNQLNNNSDPSNNTPANINKNDSQNTNLND

SEQ ID NO: 1632968 - protein, 5 aa, Staphylococcus aureus
NSKEA

SEQ ID NO: 1632969 - protein, 5 aa, Staphylococcus aureus
NSKEV

SEQ ID NO: 1632970 - protein, 7 aa, Staphylococcus aureus
NSKFDNC

SEQ ID NO: 1632971 - protein, 8 aa, Staphylococcus aureus
NSKNIESM

SEQ ID NO: 1632972 - protein, 4 aa, Staphylococcus aureus
NSLE

SEQ ID NO: 1632973 - protein, 25 aa, Staphylococcus aureus
NSNDLNQAQKDALKQQVQNATTVAG

SEQ ID NO: 1632974 - protein, 7 aa, Staphylococcus aureus
NSNIDPD

SEQ ID NO: 1632975 - protein, 10 aa, Staphylococcus aureus
NSNLEIRNNP

SEQ ID NO: 1632976 - protein, 11 aa, Staphylococcus aureus
NSPTLTEQPTY

SEQ ID NO: 1632977 - protein, 7 aa, Staphylococcus aureus
NSRTCTG

SEQ ID NO: 1632978 - protein, 7 aa, Staphylococcus aureus
NSYRQKI

SEQ ID NO: 1632979 - protein, 12 aa, Staphylococcus aureus
NTATDIARILKL

SEQ ID NO: 1632980 - protein, 4 aa, Staphylococcus aureus
NTDK

SEQ ID NO: 1632981 - protein, 7 aa, Staphylococcus aureus
NTENYVN

SEQ ID NO: 1632982 - protein, 12 aa, Staphylococcus aureus
NTKADEKSAYNN

SEQ ID NO: 1632983 - protein, 9 aa, Staphylococcus aureus
NTKKATGYY

SEQ ID NO: 1632984 - protein, 11 aa, Staphylococcus aureus
NTKKLSIRDNG

SEQ ID NO: 1632985 - protein, 9 aa, Staphylococcus aureus
NTKTTTGKY

SEQ ID NO: 1632986 - protein, 4 aa, Staphylococcus aureus
NTLD

SEQ ID NO: 1632987 - protein, 11 aa, Staphylococcus aureus
NTNDNTPINNS

SEQ ID NO: 1632988 - protein, 7 aa, Staphylococcus aureus
NTNEEVE

SEQ ID NO: 1632989 - protein, 4 aa, Staphylococcus aureus
NTNG

SEQ ID NO: 1632990 - protein, 17 aa, Staphylococcus aureus
NTNNGAKATLDSASSTT

SEQ ID NO: 1632991 - protein, 10 aa, Staphylococcus aureus
NTNPSDTFKD

SEQ ID NO: 1632992 - protein, 5 aa, Staphylococcus aureus
NTNTC

SEQ ID NO: 1632993 - protein, 7 aa, Staphylococcus aureus
NTQGINN

SEQ ID NO: 1632994 - protein, 7 aa, Staphylococcus aureus
NTQNEDD

SEQ ID NO: 1632995 - protein, 6 aa, Staphylococcus aureus
NTQWPV

SEQ ID NO: 1632996 - protein, 4 aa, Staphylococcus aureus
NTRP

SEQ ID NO: 1632997 - protein, 9 aa, Staphylococcus aureus
NTSNNVRKA

SEQ ID NO: 1632998 - protein, 16 aa, Staphylococcus aureus
NTSTAIVGPSGSGKST

SEQ ID NO: 1632999 - protein, 8 aa, Staphylococcus aureus
NTVRESTY

SEQ ID NO: 1633000 - protein, 7 aa, Staphylococcus aureus
NTYRGEE

SEQ ID NO: 1633001 - protein, 7 aa, Staphylococcus aureus
NVDDDNT

SEQ ID NO: 1633002 - protein, 13 aa, Staphylococcus aureus
NVDDGPAIFKAVN

SEQ ID NO: 1633003 - protein, 20 aa, Staphylococcus aureus
NVDNTDSKKSETKPLTTPMT

SEQ ID NO: 1633004 - protein, 11 aa, Staphylococcus aureus
NVEKRPKPDYE

SEQ ID NO: 1633005 - protein, 18 aa, Staphylococcus aureus
NVKTSAKNKKNPPVPAGY

SEQ ID NO: 1633006 - protein, 11 aa, Staphylococcus aureus
NVNLPNEDNEA

SEQ ID NO: 1633007 - protein, 28 aa, Staphylococcus aureus
NVQRAKNELNGNQNVANAKTTAKNALNN

SEQ ID NO: 1633008 - protein, 15 aa, Staphylococcus aureus
NVSSKSETDKVDITK

SEQ ID NO: 1633009 - protein, 16 aa, Staphylococcus aureus
NVSWGGTTIKKYFFYR

SEQ ID NO: 1633010 - protein, 38 aa, Staphylococcus aureus
NVTENDNANQSHSVSLNDTQAVDENNSELNQVGTSTKA

SEQ ID NO: 1633011 - protein, 13 aa, Staphylococcus aureus
NVTINGKKFDPNR

SEQ ID NO: 1633012 - protein, 28 aa, Staphylococcus aureus
NVTSAKNALNGDQNVTNAKNAAKNALNN

SEQ ID NO: 1633013 - protein, 15 aa, Staphylococcus aureus
NVTVNDGKDLSQDAH

SEQ ID NO: 1633014 - protein, 5 aa, Staphylococcus aureus
NWEPG

SEQ ID NO: 1633015 - protein, 37 aa, Staphylococcus aureus
NWGNGPQHRKIGSSISTNNVSWGNSPNTETGRKSASM

SEQ ID NO: 1633016 - protein, 5 aa, Staphylococcus aureus
NYEAD

SEQ ID NO: 1633017 - protein, 5 aa, Staphylococcus aureus
NYHQE

SEQ ID NO: 1633018 - protein, 4 aa, Staphylococcus aureus
NYIK

SEQ ID NO: 1633019 - protein, 8 aa, Staphylococcus aureus
NYIPNSSN

SEQ ID NO: 1633020 - protein, 16 aa, Staphylococcus aureus
NYNEENKAIEISEKDD

SEQ ID NO: 1633021 - protein, 6 aa, Staphylococcus aureus
NYNYTY

SEQ ID NO: 1633022 - protein, 6 aa, Staphylococcus aureus
NYRSGE

SEQ ID NO: 1633023 - protein, 4 aa, Staphylococcus aureus
NYSI

SEQ ID NO: 1633024 - protein, 6 aa, Staphylococcus aureus
NYSNDF

SEQ ID NO: 1633025 - protein, 15 aa, Staphylococcus aureus
NYTKTKDEDGTQGDT

SEQ ID NO: 1633026 - protein, 9 aa, Staphylococcus aureus
NYVQDGRGI

SEQ ID NO: 1633027 - protein, 10 aa, Staphylococcus aureus
NYYRKDSTNY

SEQ ID NO: 1633028 - protein, 4 aa, Staphylococcus aureus
PAAL

SEQ ID NO: 1633029 - protein, 16 aa, Staphylococcus aureus
PAGTKHDATGSDQPLG

SEQ ID NO: 1633030 - protein, 5 aa, Staphylococcus aureus
PAHGT

SEQ ID NO: 1633031 - protein, 5 aa, Staphylococcus aureus
PANRN

SEQ ID NO: 1633032 - protein, 18 aa, Staphylococcus aureus
PASPSLEKDGTFTNTERR

SEQ ID NO: 1633033 - protein, 9 aa, Staphylococcus aureus
PAYTGEGKQ

SEQ ID NO: 1633034 - protein, 19 aa, Staphylococcus aureus
PCNTKGLAISGGDVGGSKN

SEQ ID NO: 1633035 - protein, 5 aa, Staphylococcus aureus
PDADS

SEQ ID NO: 1633036 - protein, 14 aa, Staphylococcus aureus
PDAENESDENRYER

SEQ ID NO: 1633037 - protein, 12 aa, Staphylococcus aureus
PDAYADDNEFSR

SEQ ID NO: 1633038 - protein, 12 aa, Staphylococcus aureus
PDDETFSSAGTL

SEQ ID NO: 1633039 - protein, 8 aa, Staphylococcus aureus
PDEQNQGI

SEQ ID NO: 1633040 - protein, 13 aa, Staphylococcus aureus
PDSLSDGGKFNNV

SEQ ID NO: 1633041 - protein, 15 aa, Staphylococcus aureus
PDSLSDGGKFNNVES

SEQ ID NO: 1633042 - protein, 10 aa, Staphylococcus aureus
PEAIPTGNLK

SEQ ID NO: 1633043 - protein, 15 aa, Staphylococcus aureus
PEEHGQAQGPIEEIT

SEQ ID NO: 1633044 - protein, 11 aa, Staphylococcus aureus
PEEQGDREGTL

SEQ ID NO: 1633045 - protein, 8 aa, Staphylococcus aureus
PEGMPQED

SEQ ID NO: 1633046 - protein, 9 aa, Staphylococcus aureus
PEGMPQEDT

SEQ ID NO: 1633047 - protein, 5 aa, Staphylococcus aureus
PEHKH

SEQ ID NO: 1633048 - protein, 8 aa, Staphylococcus aureus
PENLKGIG

SEQ ID NO: 1633049 - protein, 12 aa, Staphylococcus aureus
PEQLPAKSKWSH

SEQ ID NO: 1633050 - protein, 14 aa, Staphylococcus aureus
PETEYEMEEIREVE

SEQ ID NO: 1633051 - protein, 9 aa, Staphylococcus aureus
PETKKIYSQ

SEQ ID NO: 1633052 - protein, 37 aa, Staphylococcus aureus
PETKVKPAAREKINQKANELRAKINQDKEATAEERQV

SEQ ID NO: 1633053 - protein, 8 aa, Staphylococcus aureus
PFKESEQA

SEQ ID NO: 1633054 - protein, 7 aa, Staphylococcus aureus
PGAETYK

SEQ ID NO: 1633055 - protein, 10 aa, Staphylococcus aureus
PGETEAEFQE

SEQ ID NO: 1633056 - protein, 13 aa, Staphylococcus aureus
PGFEDMKKDLEAR

SEQ ID NO: 1633057 - protein, 10 aa, Staphylococcus aureus
PGIGKKTARQ

SEQ ID NO: 1633058 - protein, 16 aa, Staphylococcus aureus
PGLSPRALKEKYGIEG

SEQ ID NO: 1633059 - protein, 6 aa, Staphylococcus aureus
PGQTAY

SEQ ID NO: 1633060 - protein, 13 aa, Staphylococcus aureus
PGSHGSTFGGNPL

SEQ ID NO: 1633061 - protein, 35 aa, Staphylococcus aureus
PGWTKDEQAKAFEEYKKGKEDEARAGASAVPGANI

SEQ ID NO: 1633062 - protein, 5 aa, Staphylococcus aureus
PHDIR

SEQ ID NO: 1633063 - protein, 12 aa, Staphylococcus aureus
PHNGCRPPKRRR

SEQ ID NO: 1633064 - protein, 12 aa, Staphylococcus aureus
PHVTKKQTATGV

SEQ ID NO: 1633065 - protein, 6 aa, Staphylococcus aureus
PIEPGK

SEQ ID NO: 1633066 - protein, 18 aa, Staphylococcus aureus
PIKQAKELSSDKKSNEKF

SEQ ID NO: 1633067 - protein, 32 aa, Staphylococcus aureus
PISADNASWGVGPNIEADEKSAYDNVQVGGAP

SEQ ID NO: 1633068 - protein, 7 aa, Staphylococcus aureus
PITEDTG

SEQ ID NO: 1633069 - protein, 8 aa, Staphylococcus aureus
PKDKQEVV

SEQ ID NO: 1633070 - protein, 4 aa, Staphylococcus aureus
PKDL

SEQ ID NO: 1633071 - protein, 7 aa, Staphylococcus aureus
PKDNSPI

SEQ ID NO: 1633072 - protein, 4 aa, Staphylococcus aureus
PKEY

SEQ ID NO: 1633073 - protein, 9 aa, Staphylococcus aureus
PKFGKQRPI

SEQ ID NO: 1633074 - protein, 11 aa, Staphylococcus aureus
PKFKESGEQIN

SEQ ID NO: 1633075 - protein, 8 aa, Staphylococcus aureus
PKGAGTKV

SEQ ID NO: 1633076 - protein, 7 aa, Staphylococcus aureus
PKKAWEE

SEQ ID NO: 1633077 - protein, 8 aa, Staphylococcus aureus
PKKGQKAK

SEQ ID NO: 1633078 - protein, 10 aa, Staphylococcus aureus
PKKNENLLRG

SEQ ID NO: 1633079 - protein, 23 aa, Staphylococcus aureus
PKKVQTRNEFQAKRNNYLEDSEV

SEQ ID NO: 1633080 - protein, 11 aa, Staphylococcus aureus
PKNENMLADPE

SEQ ID NO: 1633081 - protein, 8 aa, Staphylococcus aureus
PKNPRGSV

SEQ ID NO: 1633082 - protein, 27 aa, Staphylococcus aureus
PKPLAGLNGESHDFTTTHQSPATSNHT

SEQ ID NO: 1633083 - protein, 7 aa, Staphylococcus aureus
PKTKASV

SEQ ID NO: 1633084 - protein, 5 aa, Staphylococcus aureus
PKTTI

SEQ ID NO: 1633085 - protein, 32 aa, Staphylococcus aureus
PKYKKGVSKTTKNDSEIEKSNKENKLTGKVGE

SEQ ID NO: 1633086 - protein, 68 aa, Staphylococcus aureus
PLSRKGRNGKPSGSRNRNSKRGNPKFDSKSKRSKGYSNKKKSTKKFDRKEKSSGGSRPMKGRTFADHQ

SEQ ID NO: 1633087 - protein, 14 aa, Staphylococcus aureus
PMGSPRPRFRNTGR

SEQ ID NO: 1633088 - protein, 9 aa, Staphylococcus aureus
PMKDAETSL

SEQ ID NO: 1633089 - protein, 4 aa, Staphylococcus aureus
PNAM

SEQ ID NO: 1633090 - protein, 10 aa, Staphylococcus aureus
PNGEYNNGGF

SEQ ID NO: 1633091 - protein, 6 aa, Staphylococcus aureus
PNGTEE

SEQ ID NO: 1633092 - protein, 5 aa, Staphylococcus aureus
PNNLK

SEQ ID NO: 1633093 - protein, 6 aa, Staphylococcus aureus
PNTSLK

SEQ ID NO: 1633094 - protein, 10 aa, Staphylococcus aureus
PNVDVSEENL

SEQ ID NO: 1633095 - protein, 7 aa, Staphylococcus aureus
PNYHGSY

SEQ ID NO: 1633096 - protein, 5 aa, Staphylococcus aureus
PPEEL

SEQ ID NO: 1633097 - protein, 4 aa, Staphylococcus aureus
PPKV

SEQ ID NO: 1633098 - protein, 15 aa, Staphylococcus aureus
PPNNKNSKSCILKIV

SEQ ID NO: 1633099 - protein, 362 aa, Staphylococcus aureus
PQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTTTAPTTASTEAASSADSKDNAYVNDSKQNAEVNNSAESQSTNGKVAQPKSENKAKAEKDGRDSTNQSMVESTTETLPSADITEPNVPSNTSKDKEESTSNQTDAGQLKSETNVASNEADKSPSKADTEVSNKPSTSASSEAKEKMTSTNVSQKDDTATADTNDMQTSVGSVANNKAKDMQTNDTQTSVGPVANNKATQNDGANASPATVSNGSHSM

SEQ ID NO: 1633100 - protein, 7 aa, Staphylococcus aureus
PQSNNDH

SEQ ID NO: 1633101 - protein, 5 aa, Staphylococcus aureus
PQSTI

SEQ ID NO: 1633102 - protein, 4 aa, Staphylococcus aureus
PQTF

SEQ ID NO: 1633103 - protein, 20 aa, Staphylococcus aureus
PQVSMTDSGGRVKPLPVQNP

SEQ ID NO: 1633104 - protein, 5 aa, Staphylococcus aureus
PRERL

SEQ ID NO: 1633105 - protein, 13 aa, Staphylococcus aureus
PSDFKKSKGYERS

SEQ ID NO: 1633106 - protein, 17 aa, Staphylococcus aureus
PSDSIPADQEGMDIGPN

SEQ ID NO: 1633107 - protein, 9 aa, Staphylococcus aureus
PSEIKENSG

SEQ ID NO: 1633108 - protein, 7 aa, Staphylococcus aureus
PSMGPKS

SEQ ID NO: 1633109 - protein, 4 aa, Staphylococcus aureus
PSQR

SEQ ID NO: 1633110 - protein, 5 aa, Staphylococcus aureus
PSRNR

SEQ ID NO: 1633111 - protein, 17 aa, Staphylococcus aureus
PSSSHTAGAVKIGNSAR

SEQ ID NO: 1633112 - protein, 8 aa, Staphylococcus aureus
PSVGLSST

SEQ ID NO: 1633113 - protein, 42 aa, Staphylococcus aureus
PSYQNDTTSVSKRDDGVYQNDTTNTIDYTETNKHRETDDVSK

SEQ ID NO: 1633114 - protein, 36 aa, Staphylococcus aureus
PTEEPTEEEIEAMEGEQQTEEPEVVGESKEDEEKTE

SEQ ID NO: 1633115 - protein, 11 aa, Staphylococcus aureus
PTFNKEGSNQI

SEQ ID NO: 1633116 - protein, 5 aa, Staphylococcus aureus
PTGTN

SEQ ID NO: 1633117 - protein, 10 aa, Staphylococcus aureus
PTHTKEENQF

SEQ ID NO: 1633118 - protein, 11 aa, Staphylococcus aureus
PTIEATRHSHP

SEQ ID NO: 1633119 - protein, 9 aa, Staphylococcus aureus
PTIEPSNGV

SEQ ID NO: 1633120 - protein, 13 aa, Staphylococcus aureus
PTKKHPDGYEYKD

SEQ ID NO: 1633121 - protein, 14 aa, Staphylococcus aureus
PTKPIKDEKLKKEI

SEQ ID NO: 1633122 - protein, 5 aa, Staphylococcus aureus
PTMSE

SEQ ID NO: 1633123 - protein, 8 aa, Staphylococcus aureus
PTQMQNGD

SEQ ID NO: 1633124 - protein, 9 aa, Staphylococcus aureus
PTREPGISP

SEQ ID NO: 1633125 - protein, 13 aa, Staphylococcus aureus
PTSFKSKEIRPYK

SEQ ID NO: 1633126 - protein, 34 aa, Staphylococcus aureus
PTTFKAGSYGSEKGADPQPNTPDDHTPPNQTEKV

SEQ ID NO: 1633127 - protein, 8 aa, Staphylococcus aureus
PTTLQHKS

SEQ ID NO: 1633128 - protein, 7 aa, Staphylococcus aureus
PTYIKTD

SEQ ID NO: 1633129 - protein, 5 aa, Staphylococcus aureus
PVNKD

SEQ ID NO: 1633130 - protein, 6 aa, Staphylococcus aureus
PYDGIP

SEQ ID NO: 1633131 - protein, 7 aa, Staphylococcus aureus
PYEPQTI

SEQ ID NO: 1633132 - protein, 6 aa, Staphylococcus aureus
PYLDSG

SEQ ID NO: 1633133 - protein, 64 aa, Staphylococcus aureus
QAERYVGDSSLNDDSDLIDNSTDASQLHTNGIENETVSNDENKQASIQNEDTNDTHVDESPYNY

SEQ ID NO: 1633134 - protein, 8 aa, Staphylococcus aureus
QAGLGRSG

SEQ ID NO: 1633135 - protein, 9 aa, Staphylococcus aureus
QAINDKDQI

SEQ ID NO: 1633136 - protein, 9 aa, Staphylococcus aureus
QAKDEGVTS

SEQ ID NO: 1633137 - protein, 13 aa, Staphylococcus aureus
QAKSNSDTTPAMP

SEQ ID NO: 1633138 - protein, 5 aa, Staphylococcus aureus
QAKTQ

SEQ ID NO: 1633139 - protein, 9 aa, Staphylococcus aureus
QARNRDEAS

SEQ ID NO: 1633140 - protein, 6 aa, Staphylococcus aureus
QARSEE

SEQ ID NO: 1633141 - protein, 12 aa, Staphylococcus aureus
QCHSGNEKPNNF

SEQ ID NO: 1633142 - protein, 4 aa, Staphylococcus aureus
QCPM

SEQ ID NO: 1633143 - protein, 5 aa, Staphylococcus aureus
QDDGY

SEQ ID NO: 1633144 - protein, 9 aa, Staphylococcus aureus
QDEPNEQAE

SEQ ID NO: 1633145 - protein, 10 aa, Staphylococcus aureus
QDEPNEQAER

SEQ ID NO: 1633146 - protein, 6 aa, Staphylococcus aureus
QDESIT

SEQ ID NO: 1633147 - protein, 34 aa, Staphylococcus aureus
QDGTATYVHQSEDDIVTSSVKSTIPVAQKSNKTI

SEQ ID NO: 1633148 - protein, 5 aa, Staphylococcus aureus
QDITE

SEQ ID NO: 1633149 - protein, 7 aa, Staphylococcus aureus
QDKEKSF

SEQ ID NO: 1633150 - protein, 12 aa, Staphylococcus aureus
QDKEPLKPNPYL

SEQ ID NO: 1633151 - protein, 27 aa, Staphylococcus aureus
QDKIDAETFREQTQSLRQQSKPISSIS

SEQ ID NO: 1633152 - protein, 15 aa, Staphylococcus aureus
QDVKNHSEEQRVTAK

SEQ ID NO: 1633153 - protein, 5 aa, Staphylococcus aureus
QDVPA

SEQ ID NO: 1633154 - protein, 11 aa, Staphylococcus aureus
QEDDNSEAMNL

SEQ ID NO: 1633155 - protein, 41 aa, Staphylococcus aureus
QEGVESKFKSSGRDVKESQNQDLDPSNVKSIEEMAKEINIR

SEQ ID NO: 1633156 - protein, 9 aa, Staphylococcus aureus
QEKNVSDNV

SEQ ID NO: 1633157 - protein, 8 aa, Staphylococcus aureus
QEKSGVIA

SEQ ID NO: 1633158 - protein, 13 aa, Staphylococcus aureus
QELEQERNALESK

SEQ ID NO: 1633159 - protein, 7 aa, Staphylococcus aureus
QELTGGS

SEQ ID NO: 1633160 - protein, 6 aa, Staphylococcus aureus
QEMRNS

SEQ ID NO: 1633161 - protein, 16 aa, Staphylococcus aureus
QEQLYDDKEARKALNG

SEQ ID NO: 1633162 - protein, 6 aa, Staphylococcus aureus
QEQPTY

SEQ ID NO: 1633163 - protein, 11 aa, Staphylococcus aureus
QEQTAEAVKEA

SEQ ID NO: 1633164 - protein, 6 aa, Staphylococcus aureus
QERHRI

SEQ ID NO: 1633165 - protein, 18 aa, Staphylococcus aureus
QETDSSDTSYSSDTSYSS

SEQ ID NO: 1633166 - protein, 12 aa, Staphylococcus aureus
QETKKFQSSLNP

SEQ ID NO: 1633167 - protein, 17 aa, Staphylococcus aureus
QEVSPQTVKVTGGEEQL

SEQ ID NO: 1633168 - protein, 8 aa, Staphylococcus aureus
QFQEGDKF

SEQ ID NO: 1633169 - protein, 20 aa, Staphylococcus aureus
QFSNSTKSDLENRVNKSIED

SEQ ID NO: 1633170 - protein, 14 aa, Staphylococcus aureus
QGAINDKDATLRNQ

SEQ ID NO: 1633171 - protein, 10 aa, Staphylococcus aureus
QGATKKAAEQ

SEQ ID NO: 1633172 - protein, 6 aa, Staphylococcus aureus
QGDTNL

SEQ ID NO: 1633173 - protein, 6 aa, Staphylococcus aureus
QGEDAV

SEQ ID NO: 1633174 - protein, 17 aa, Staphylococcus aureus
QGGGQEYGIRSGTVNLP

SEQ ID NO: 1633175 - protein, 19 aa, Staphylococcus aureus
QGGTIETIRPTTISDPVYE

SEQ ID NO: 1633176 - protein, 11 aa, Staphylococcus aureus
QGGYDLTPQQK

SEQ ID NO: 1633177 - protein, 5 aa, Staphylococcus aureus
QGHYQ

SEQ ID NO: 1633178 - protein, 30 aa, Staphylococcus aureus; identical to SEQ ID NO: 1566256

SEQ ID NO: 1633179 - protein, 30 aa, Staphylococcus aureus; identical to SEQ ID NO: 1565934

SEQ ID NO: 1633180 - protein, 35 aa, Staphylococcus aureus
QGIANKDTVKASENYHDADADKQTAYTNAVSQAEG

SEQ ID NO: 1633181 - protein, 35 aa, Staphylococcus aureus; identical to SEQ ID NO: 1565454

SEQ ID NO: 1633182 - protein, 12 aa, Staphylococcus aureus
QGIRGHKSLRDT

SEQ ID NO: 1633183 - protein, 13 aa, Staphylococcus aureus
QGITGTPKEWTDG

SEQ ID NO: 1633184 - protein, 5 aa, Staphylococcus aureus
QGKPF

SEQ ID NO: 1633185 - protein, 19 aa, Staphylococcus aureus
QGSEERDKYVDTVSTKSSL

SEQ ID NO: 1633186 - protein, 7 aa, Staphylococcus aureus
QGSKDVK

SEQ ID NO: 1633187 - protein, 9 aa, Staphylococcus aureus
QGVSEEKAN

SEQ ID NO: 1633188 - protein, 10 aa, Staphylococcus aureus
QGVSEEKANQ

SEQ ID NO: 1633189 - protein, 5 aa, Staphylococcus aureus
QHAED

SEQ ID NO: 1633190 - protein, 6 aa, Staphylococcus aureus
QHHSSI

SEQ ID NO: 1633191 - protein, 7 aa, Staphylococcus aureus
QHKGEPI

SEQ ID NO: 1633192 - protein, 17 aa, Staphylococcus aureus
QIDQDRSNAQVDKTASL

SEQ ID NO: 1633193 - protein, 7 aa, Staphylococcus aureus
QINEGDK

SEQ ID NO: 1633194 - protein, 9 aa, Staphylococcus aureus
QIPEGEHKD

SEQ ID NO: 1633195 - protein, 8 aa, Staphylococcus aureus
QIQTQTVT

SEQ ID NO: 1633196 - protein, 5 aa, Staphylococcus aureus
QISRG

SEQ ID NO: 1633197 - protein, 13 aa, Staphylococcus aureus
QISRGSVIANGSR

SEQ ID NO: 1633198 - protein, 7 aa, Staphylococcus aureus
QKASTSL

SEQ ID NO: 1633199 - protein, 46 aa, Staphylococcus aureus
QKDAEKKVAPKVEAPQIQSPQIEKPKAESPKVEVPQIQSPKVEVPQ

SEQ ID NO: 1633200 - protein, 22 aa, Staphylococcus aureus
QKEWKQKHEKNNENNNQERQGL

SEQ ID NO: 1633201 - protein, 8 aa, Staphylococcus aureus
QKGEPIRT

SEQ ID NO: 1633202 - protein, 15 aa, Staphylococcus aureus
QKGKRQKPKETRGKF

SEQ ID NO: 1633203 - protein, 11 aa, Staphylococcus aureus
QKIKAGHESLA

SEQ ID NO: 1633204 - protein, 13 aa, Staphylococcus aureus
QKKNFANSKMKYE

SEQ ID NO: 1633205 - protein, 14 aa, Staphylococcus aureus
QKKNFANSKMKYED

SEQ ID NO: 1633206 - protein, 34 aa, Staphylococcus aureus
QKMETSEKQAKKAQNMINDAQNKIAKNEDLKRDL

SEQ ID NO: 1633207 - protein, 7 aa, Staphylococcus aureus
QKNPRGR

SEQ ID NO: 1633208 - protein, 5 aa, Staphylococcus aureus
QKRQR

SEQ ID NO: 1633209 - protein, 4 aa, Staphylococcus aureus
QLDT

SEQ ID NO: 1633210 - protein, 8 aa, Staphylococcus aureus
QLENRASF

SEQ ID NO: 1633211 - protein, 8 aa, Staphylococcus aureus
QLGDRGEI

SEQ ID NO: 1633212 - protein, 11 aa, Staphylococcus aureus
QLKGGNKEPYR

SEQ ID NO: 1633213 - protein, 13 aa, Staphylococcus aureus
QLNQEEVKTPRFS

SEQ ID NO: 1633214 - protein, 36 aa, Staphylococcus aureus; identical to SEQ ID NO: 1565938

SEQ ID NO: 1633215 - protein, 4 aa, Staphylococcus aureus
QLNV

SEQ ID NO: 1633216 - protein, 4 aa, Staphylococcus aureus
QLQG

SEQ ID NO: 1633217 - protein, 8 aa, Staphylococcus aureus
QLTNTSTF

SEQ ID NO: 1633218 - protein, 14 aa, Staphylococcus aureus
QMRSRKYDKDGQTH

SEQ ID NO: 1633219 - protein, 5 aa, Staphylococcus aureus
QNEAI

SEQ ID NO: 1633220 - protein, 35 aa, Staphylococcus aureus; identical to SEQ ID NO: 1567203

SEQ ID NO: 1633221 - protein, 6 aa, Staphylococcus aureus
QNGYKT

SEQ ID NO: 1633222 - protein, 4 aa, Staphylococcus aureus
QNIN

SEQ ID NO: 1633223 - protein, 5 aa, Staphylococcus aureus
QNINP

SEQ ID NO: 1633224 - protein, 8 aa, Staphylococcus aureus
QNKELTQE

SEQ ID NO: 1633225 - protein, 9 aa, Staphylococcus aureus
QNKNNELTG

SEQ ID NO: 1633226 - protein, 10 aa, Staphylococcus aureus
QNKQQQLEQA

SEQ ID NO: 1633227 - protein, 9 aa, Staphylococcus aureus
QNNGQPVIK

SEQ ID NO: 1633228 - protein, 4 aa, Staphylococcus aureus
QNTG

SEQ ID NO: 1633229 - protein, 12 aa, Staphylococcus aureus
QNTSRTPGEHFG

SEQ ID NO: 1633230 - protein, 5 aa, Staphylococcus aureus
QNVSA

SEQ ID NO: 1633231 - protein, 6 aa, Staphylococcus aureus
QPDFPL

SEQ ID NO: 1633232 - protein, 5 aa, Staphylococcus aureus
QPKPI

SEQ ID NO: 1633233 - protein, 5 aa, Staphylococcus aureus
QPKVG

SEQ ID NO: 1633234 - protein, 9 aa, Staphylococcus aureus
QPKYSKACA

SEQ ID NO: 1633235 - protein, 7 aa, Staphylococcus aureus
QPQSKET

SEQ ID NO: 1633236 - protein, 6 aa, Staphylococcus aureus
QPTNHQ

SEQ ID NO: 1633237 - protein, 4 aa, Staphylococcus aureus
QPTV

SEQ ID NO: 1633238 - protein, 4 aa, Staphylococcus aureus
QQAN

SEQ ID NO: 1633239 - protein, 6 aa, Staphylococcus aureus
QQGTPV

SEQ ID NO: 1633240 - protein, 5 aa, Staphylococcus aureus
QQGYQ

SEQ ID NO: 1633241 - protein, 8 aa, Staphylococcus aureus
QQKHELEE

SEQ ID NO: 1633242 - protein, 5 aa, Staphylococcus aureus
QQSIG

SEQ ID NO: 1633243 - protein, 19 aa, Staphylococcus aureus
QQTIDKLQSGQISIEEPGL

SEQ ID NO: 1633244 - protein, 7 aa, Staphylococcus aureus
QQVDQSR

SEQ ID NO: 1633245 - protein, 5 aa, Staphylococcus aureus
QQWEP

SEQ ID NO: 1633246 - protein, 17 aa, Staphylococcus aureus
QRDGTPAAKMKDNVPLD

SEQ ID NO: 1633247 - protein, 9 aa, Staphylococcus aureus
QREGSSTND

SEQ ID NO: 1633248 - protein, 5 aa, Staphylococcus aureus
QREMP

SEQ ID NO: 1633249 - protein, 9 aa, Staphylococcus aureus
QRENKNYEN

SEQ ID NO: 1633250 - protein, 4 aa, Staphylococcus aureus
QRGF

SEQ ID NO: 1633251 - protein, 7 aa, Staphylococcus aureus
QRGSHDE

SEQ ID NO: 1633252 - protein, 4 aa, Staphylococcus aureus
QRGT

SEQ ID NO: 1633253 - protein, 4 aa, Staphylococcus aureus
QRGV

SEQ ID NO: 1633254 - protein, 10 aa, Staphylococcus aureus
QRIDNENDKK

SEQ ID NO: 1633255 - protein, 20 aa, Staphylococcus aureus
QRLRSQKQTKQTSSDNQLKQ

SEQ ID NO: 1633256 - protein, 5 aa, Staphylococcus aureus
QRLSQ

SEQ ID NO: 1633257 - protein, 7 aa, Staphylococcus aureus
QRLSQSS

SEQ ID NO: 1633258 - protein, 5 aa, Staphylococcus aureus
QRMEQ

SEQ ID NO: 1633259 - protein, 5 aa, Staphylococcus aureus
QRNEK

SEQ ID NO: 1633260 - protein, 16 aa, Staphylococcus aureus
QRSSTLKVNSKAASID

SEQ ID NO: 1633261 - protein, 5 aa, Staphylococcus aureus
QRTEY

SEQ ID NO: 1633262 - protein, 24 aa, Staphylococcus aureus
QRTKEKEAQGSKRQKSSARKNTRT

SEQ ID NO: 1633263 - protein, 14 aa, Staphylococcus aureus
QRTNKKQKVTRSTS

SEQ ID NO: 1633264 - protein, 11 aa, Staphylococcus aureus
QSDLSTEEERL

SEQ ID NO: 1633265 - protein, 25 aa, Staphylococcus aureus
QSEDDIVTSSIKSNHPVAPSSNQSI

SEQ ID NO: 1633266 - protein, 11 aa, Staphylococcus aureus
QSEDDIVTSSV

SEQ ID NO: 1633267 - protein, 8 aa, Staphylococcus aureus
QSEGQPIN

SEQ ID NO: 1633268 - protein, 34 aa, Staphylococcus aureus; identical to SEQ ID NO: 1565459

SEQ ID NO: 1633269 - protein, 34 aa, Staphylococcus aureus; identical to SEQ ID NO: 1566092

SEQ ID NO: 1633270 - protein, 7 aa, Staphylococcus aureus
QSIPNKE

SEQ ID NO: 1633271 - protein, 12 aa, Staphylococcus aureus
QSKHTEESPYTG

SEQ ID NO: 1633272 - protein, 10 aa, Staphylococcus aureus
QSPFQMSGGQ

SEQ ID NO: 1633273 - protein, 13 aa, Staphylococcus aureus
QSPRLATTHPANT

SEQ ID NO: 1633274 - protein, 11 aa, Staphylococcus aureus
QSTIPSPKLCT

SEQ ID NO: 1633275 - protein, 16 aa, Staphylococcus aureus
QSTNEIENVSSTKQEI

SEQ ID NO: 1633276 - protein, 7 aa, Staphylococcus aureus
QSTSYQV

SEQ ID NO: 1633277 - protein, 25 aa, Staphylococcus aureus
QSVTSTENALNGDANLQRAKTEAIQ

SEQ ID NO: 1633278 - protein, 20 aa, Staphylococcus aureus
QSYLNETEVGQGIEASGIDR

SEQ ID NO: 1633279 - protein, 10 aa, Staphylococcus aureus
QTHNTSDSKY

SEQ ID NO: 1633280 - protein, 9 aa, Staphylococcus aureus
QTKEEELET

SEQ ID NO: 1633281 - protein, 4 aa, Staphylococcus aureus
QTKT

SEQ ID NO: 1633282 - protein, 7 aa, Staphylococcus aureus
QTLNTNA

SEQ ID NO: 1633283 - protein, 29 aa, Staphylococcus aureus
QTNLGSSELGISGVNSGVASKNINFSNPS

SEQ ID NO: 1633284 - protein, 5 aa, Staphylococcus aureus
QTQKR

SEQ ID NO: 1633285 - protein, 7 aa, Staphylococcus aureus
QTQTVSQ

SEQ ID NO: 1633286 - protein, 4 aa, Staphylococcus aureus
QTVE

SEQ ID NO: 1633287 - protein, 11 aa, Staphylococcus aureus
QTVTQTQTVSQ

SEQ ID NO: 1633288 - protein, 10 aa, Staphylococcus aureus
QTVTQTQTVT

SEQ ID NO: 1633289 - protein, 12 aa, Staphylococcus aureus
QVASNVSDKEAF

SEQ ID NO: 1633290 - protein, 26 aa, Staphylococcus aureus
QVNATKAALNGTQNLEKAKQHANTAI

SEQ ID NO: 1633291 - protein, 13 aa, Staphylococcus aureus
QVNSAKNNLDGTR

SEQ ID NO: 1633292 - protein, 26 aa, Staphylococcus aureus
QVSTTQQLSDDEVTVSDVTSQRQSAL

SEQ ID NO: 1633293 - protein, 28 aa, Staphylococcus aureus
QVTDAKNGLNGEAKLATEKQNAKDAVSG

SEQ ID NO: 1633294 - protein, 28 aa, Staphylococcus aureus
QVTDAKNSLNGEAKLATEKQNAKDAVSG

SEQ ID NO: 1633295 - protein, 19 aa, Staphylococcus aureus
QVTRTQKPVKRKPSENQLK

SEQ ID NO: 1633296 - protein, 26 aa, Staphylococcus aureus
QVTSTKDALNGDAKLAEAKAAARQNL

SEQ ID NO: 1633297 - protein, 5 aa, Staphylococcus aureus
QWKPS

SEQ ID NO: 1633298 - protein, 16 aa, Staphylococcus aureus
QYMTTSGNATYDQSTG

SEQ ID NO: 1633299 - protein, 15 aa, Staphylococcus aureus
QYNATTISTKWQNIL

SEQ ID NO: 1633300 - protein, 11 aa, Staphylococcus aureus
QYNSEDKRQDV

SEQ ID NO: 1633301 - protein, 10 aa, Staphylococcus aureus
QYQEHSNQIE

SEQ ID NO: 1633302 - protein, 6 aa, Staphylococcus aureus
QYSTQN

SEQ ID NO: 1633303 - protein, 19 aa, Staphylococcus aureus
QYTPSEDTSYESNGISNKS

SEQ ID NO: 1633304 - protein, 5 aa, Staphylococcus aureus
QYTYG

SEQ ID NO: 1633305 - protein, 7 aa, Staphylococcus aureus
RADKNFS

SEQ ID NO: 1633306 - protein, 9 aa, Staphylococcus aureus
RADKNYPMD

SEQ ID NO: 1633307 - protein, 5 aa, Staphylococcus aureus
RADKQ

SEQ ID NO: 1633308 - protein, 11 aa, Staphylococcus aureus
RAEYEEERKRR

SEQ ID NO: 1633309 - protein, 7 aa, Staphylococcus aureus
RAGVQSA

SEQ ID NO: 1633310 - protein, 6 aa, Staphylococcus aureus
RALDGD

SEQ ID NO: 1633311 - protein, 14 aa, Staphylococcus aureus
RAQKNPDTGELKGA

SEQ ID NO: 1633312 - protein, 6 aa, Staphylococcus aureus
RASADN

SEQ ID NO: 1633313 - protein, 5 aa, Staphylococcus aureus
RASAV

SEQ ID NO: 1633314 - protein, 7 aa, Staphylococcus aureus
RAVGTNG

SEQ ID NO: 1633315 - protein, 30 aa, Staphylococcus aureus
RAVTPQNHVTHGPKDSMVRSEGKHSVSSHE

SEQ ID NO: 1633316 - protein, 10 aa, Staphylococcus aureus
RCTNYTSNDY

SEQ ID NO: 1633317 - protein, 4 aa, Staphylococcus aureus
RDEQ

SEQ ID NO: 1633318 - protein, 4 aa, Staphylococcus aureus
RDGN

SEQ ID NO: 1633319 - protein, 10 aa, Staphylococcus aureus
RDKSPVVRRT

SEQ ID NO: 1633320 - protein, 5 aa, Staphylococcus aureus
RDNNG

SEQ ID NO: 1633321 - protein, 9 aa, Staphylococcus aureus
RDNSKAGDF

SEQ ID NO: 1633322 - protein, 32 aa, Staphylococcus aureus; identical to SEQ ID NO: 1566929

SEQ ID NO: 1633323 - protein, 4 aa, Staphylococcus aureus
RDYH

SEQ ID NO: 1633324 - protein, 19 aa, Staphylococcus aureus
REAAGEKTFNPVEERFVIK

SEQ ID NO: 1633325 - protein, 14 aa, Staphylococcus aureus
REAINGKKPISSGS

SEQ ID NO: 1633326 - protein, 5 aa, Staphylococcus aureus
REAKN

SEQ ID NO: 1633327 - protein, 9 aa, Staphylococcus aureus
REERVNPAQ

SEQ ID NO: 1633328 - protein, 5 aa, Staphylococcus aureus
REETE

SEQ ID NO: 1633329 - protein, 12 aa, Staphylococcus aureus
REGKNIKKMDII

SEQ ID NO: 1633330 - protein, 4 aa, Staphylococcus aureus
REGT

SEQ ID NO: 1633331 - protein, 26 aa, Staphylococcus aureus
REINRNNVNQSYQAETAQKNYEAKRK

SEQ ID NO: 1633332 - protein, 20 aa, Staphylococcus aureus
REKIESKIANSKKDISETNN

SEQ ID NO: 1633333 - protein, 6 aa, Staphylococcus aureus
RELESD

SEQ ID NO: 1633334 - protein, 7 aa, Staphylococcus aureus
RENIGEP

SEQ ID NO: 1633335 - protein, 14 aa, Staphylococcus aureus
RERNKDLEKKASAW

SEQ ID NO: 1633336 - protein, 13 aa, Staphylococcus aureus
RESKYKRRTFKYS

SEQ ID NO: 1633337 - protein, 14 aa, Staphylococcus aureus
RETGPTLKLRKVSL

SEQ ID NO: 1633338 - protein, 4 aa, Staphylococcus aureus
REYP

SEQ ID NO: 1633339 - protein, 11 aa, Staphylococcus aureus
RFGSDKPDTRF

SEQ ID NO: 1633340 - protein, 10 aa, Staphylococcus aureus
RGANGEVGEI

SEQ ID NO: 1633341 - protein, 10 aa, Staphylococcus aureus
RGARSNNLKG

SEQ ID NO: 1633342 - protein, 13 aa, Staphylococcus aureus
RGEYKENPKSGKV

SEQ ID NO: 1633343 - protein, 5 aa, Staphylococcus aureus
RGGFN

SEQ ID NO: 1633344 - protein, 32 aa, Staphylococcus aureus
RGIDHSEVKSSRVRKSVGTERTFATDVNDDEE

SEQ ID NO: 1633345 - protein, 4 aa, Staphylococcus aureus
RGIN

SEQ ID NO: 1633346 - protein, 12 aa, Staphylococcus aureus
RGISGKSMNRPE

SEQ ID NO: 1633347 - protein, 10 aa, Staphylococcus aureus
RGLLPGNGAI

SEQ ID NO: 1633348 - protein, 6 aa, Staphylococcus aureus
RGLQGT

SEQ ID NO: 1633349 - protein, 7 aa, Staphylococcus aureus
RGNPSIE

SEQ ID NO: 1633350 - protein, 7 aa, Staphylococcus aureus
RGPNTEN

SEQ ID NO: 1633351 - protein, 10 aa, Staphylococcus aureus
RGPTKRNLEP

SEQ ID NO: 1633352 - protein, 10 aa, Staphylococcus aureus
RGQHKNAPNK

SEQ ID NO: 1633353 - protein, 33 aa, Staphylococcus aureus
RGQYGEGYIDGKQVKTYRDEDRVADDSNTPTFV

SEQ ID NO: 1633354 - protein, 7 aa, Staphylococcus aureus
RGRGLYN

SEQ ID NO: 1633355 - protein, 33 aa, Staphylococcus aureus
RGTEPEETGDVRDVNDRKGHGTMVSGQTSANGR

SEQ ID NO: 1633356 - protein, 14 aa, Staphylococcus aureus
RGTTVERSDRDGLK

SEQ ID NO: 1633357 - protein, 7 aa, Staphylococcus aureus
RHAKYKN

SEQ ID NO: 1633358 - protein, 9 aa, Staphylococcus aureus
RHNNTSPWV

SEQ ID NO: 1633359 - protein, 4 aa, Staphylococcus aureus
RHRA

SEQ ID NO: 1633360 - protein, 5 aa, Staphylococcus aureus
RIKDK

SEQ ID NO: 1633361 - protein, 11 aa, Staphylococcus aureus
RIPNDSSFNDK

SEQ ID NO: 1633362 - protein, 4 aa, Staphylococcus aureus
RIQG

SEQ ID NO: 1633363 - protein, 4 aa, Staphylococcus aureus
RITA

SEQ ID NO: 1633364 - protein, 5 aa, Staphylococcus aureus
RITAE

SEQ ID NO: 1633365 - protein, 9 aa, Staphylococcus aureus
RITNQEELE

SEQ ID NO: 1633366 - protein, 11 aa, Staphylococcus aureus
RKDTYKNPFPS

SEQ ID NO: 1633367 - protein, 37 aa, Staphylococcus aureus
RKEDIDKKQQEPASTQTTQQAPAKEEKKYNQYPTKPV

SEQ ID NO: 1633368 - protein, 6 aa, Staphylococcus aureus
RKEFEK

SEQ ID NO: 1633369 - protein, 6 aa, Staphylococcus aureus
RKGAEL

SEQ ID NO: 1633370 - protein, 23 aa, Staphylococcus aureus
RKGVQNAIARRKKALEKEQALKE

SEQ ID NO: 1633371 - protein, 10 aa, Staphylococcus aureus
RKKMNKNQLK

SEQ ID NO: 1633372 - protein, 16 aa, Staphylococcus aureus
RKKNIESKTKAIKSLG

SEQ ID NO: 1633373 - protein, 12 aa, Staphylococcus aureus
RKLNRKNNTYDT

SEQ ID NO: 1633374 - protein, 4 aa, Staphylococcus aureus
RKNA

SEQ ID NO: 1633375 - protein, 5 aa, Staphylococcus aureus
RKNEI

SEQ ID NO: 1633376 - protein, 7 aa, Staphylococcus aureus
RKNQESD

SEQ ID NO: 1633377 - protein, 4 aa, Staphylococcus aureus
RKPY

SEQ ID NO: 1633378 - protein, 7 aa, Staphylococcus aureus
RKRNEEL

SEQ ID NO: 1633379 - protein, 8 aa, Staphylococcus aureus
RKSENEQI

SEQ ID NO: 1633380 - protein, 8 aa, Staphylococcus aureus
RKSKNEKS

SEQ ID NO: 1633381 - protein, 7 aa, Staphylococcus aureus
RKSPYTL

SEQ ID NO: 1633382 - protein, 7 aa, Staphylococcus aureus
RKSTRKF

SEQ ID NO: 1633383 - protein, 4 aa, Staphylococcus aureus
RKTI

SEQ ID NO: 1633384 - protein, 14 aa, Staphylococcus aureus
RKVEYGDIKTSTRF

SEQ ID NO: 1633385 - protein, 17 aa, Staphylococcus aureus
RKYNNGDVSINENVPSY

SEQ ID NO: 1633386 - protein, 8 aa, Staphylococcus aureus
RLGEPEAE

SEQ ID NO: 1633387 - protein, 4 aa, Staphylococcus aureus
RLGL

SEQ ID NO: 1633388 - protein, 5 aa, Staphylococcus aureus
RLPRR

SEQ ID NO: 1633389 - protein, 10 aa, Staphylococcus aureus
RLPSQTQNLY

SEQ ID NO: 1633390 - protein, 14 aa, Staphylococcus aureus
RLSNGEVGRIIMKM

SEQ ID NO: 1633391 - protein, 4 aa, Staphylococcus aureus
RLSP

SEQ ID NO: 1633392 - protein, 19 aa, Staphylococcus aureus
RLTEGKYDSEEKMSRSAEE

SEQ ID NO: 1633393 - protein, 7 aa, Staphylococcus aureus
RLTGKPG

SEQ ID NO: 1633394 - protein, 12 aa, Staphylococcus aureus
RLTSSTDIVGLA

SEQ ID NO: 1633395 - protein, 5 aa, Staphylococcus aureus
RNDGY

SEQ ID NO: 1633396 - protein, 9 aa, Staphylococcus aureus
RNKRTAKGS

SEQ ID NO: 1633397 - protein, 4 aa, Staphylococcus aureus
RNPS

SEQ ID NO: 1633398 - protein, 9 aa, Staphylococcus aureus
RNQAGRNAF

SEQ ID NO: 1633399 - protein, 5 aa, Staphylococcus aureus
RNSGG

SEQ ID NO: 1633400 - protein, 4 aa, Staphylococcus aureus
RNSQ

SEQ ID NO: 1633401 - protein, 10 aa, Staphylococcus aureus
RNTEYDQSYK

SEQ ID NO: 1633402 - protein, 21 aa, Staphylococcus aureus
RPERSTEPEKEPWSQPPSGYK

SEQ ID NO: 1633403 - protein, 15 aa, Staphylococcus aureus
RPEVKKNLKSRSMGT

SEQ ID NO: 1633404 - protein, 5 aa, Staphylococcus aureus
RPGEK

SEQ ID NO: 1633405 - protein, 6 aa, Staphylococcus aureus
RPGPME

SEQ ID NO: 1633406 - protein, 17 aa, Staphylococcus aureus
RPISQRPKEIKKRNTFG

SEQ ID NO: 1633407 - protein, 16 aa, Staphylococcus aureus
RPKTEELKRFLNVINE

SEQ ID NO: 1633408 - protein, 9 aa, Staphylococcus aureus
RPPLSNSDN

SEQ ID NO: 1633409 - protein, 23 aa, Staphylococcus aureus
RPTEVNDTVKYSTDMRDAREFDG

SEQ ID NO: 1633410 - protein, 12 aa, Staphylococcus aureus
RPTPTCIVCRIS

SEQ ID NO: 1633411 - protein, 34 aa, Staphylococcus aureus; identical to SEQ ID NO: 1566267

SEQ ID NO: 1633412 - protein, 4 aa, Staphylococcus aureus
RQPM

SEQ ID NO: 1633413 - protein, 12 aa, Staphylococcus aureus
RQRDIETKTTLN

SEQ ID NO: 1633414 - protein, 10 aa, Staphylococcus aureus
RQRRNNSHQF

SEQ ID NO: 1633415 - protein, 5 aa, Staphylococcus aureus
RRDSK

SEQ ID NO: 1633416 - protein, 7 aa, Staphylococcus aureus
RREERAR

SEQ ID NO: 1633417 - protein, 13 aa, Staphylococcus aureus
RRKGKTTEEQAQE

SEQ ID NO: 1633418 - protein, 8 aa, Staphylococcus aureus
RRKKFPSN

SEQ ID NO: 1633419 - protein, 13 aa, Staphylococcus aureus
RRKYKTKPYNYKN

SEQ ID NO: 1633420 - protein, 6 aa, Staphylococcus aureus
RRPTPT

SEQ ID NO: 1633421 - protein, 8 aa, Staphylococcus aureus
RRSRPGSF

SEQ ID NO: 1633422 - protein, 5 aa, Staphylococcus aureus
RRTCD

SEQ ID NO: 1633423 - protein, 8 aa, Staphylococcus aureus
RSDADSAH

SEQ ID NO: 1633424 - protein, 23 aa, Staphylococcus aureus
RSDDEREERHPQNDRLSKERVED

SEQ ID NO: 1633425 - protein, 9 aa, Staphylococcus aureus
RSDTTSRAY

SEQ ID NO: 1633426 - protein, 4 aa, Staphylococcus aureus
RSGE

SEQ ID NO: 1633427 - protein, 6 aa, Staphylococcus aureus
RSGLDK

SEQ ID NO: 1633428 - protein, 17 aa, Staphylococcus aureus
RSISNGYASGSNLYTSG

SEQ ID NO: 1633429 - protein, 29 aa, Staphylococcus aureus
RSNPLNKSFEKSGASQKLKSTLSEKAKKK

SEQ ID NO: 1633430 - protein, 15 aa, Staphylococcus aureus
RSSTLKVNSKAASID

SEQ ID NO: 1633431 - protein, 20 aa, Staphylococcus aureus
RSVSTISREISRNNLNQSYQ

SEQ ID NO: 1633432 - protein, 22 aa, Staphylococcus aureus
RSVSTISREISRNNLNQSYQAE

SEQ ID NO: 1633433 - protein, 24 aa, Staphylococcus aureus
RSVSTISREISRNNLNQSYQAETA

SEQ ID NO: 1633434 - protein, 9 aa, Staphylococcus aureus
RSYTSDSDF

SEQ ID NO: 1633435 - protein, 9 aa, Staphylococcus aureus
RTCTTGQTQ

SEQ ID NO: 1633436 - protein, 5 aa, Staphylococcus aureus
RTDEG

SEQ ID NO: 1633437 - protein, 6 aa, Staphylococcus aureus
RTDENE

SEQ ID NO: 1633438 - protein, 13 aa, Staphylococcus aureus
RTDHFGDDDEFEK

SEQ ID NO: 1633439 - protein, 6 aa, Staphylococcus aureus
RTDNAI

SEQ ID NO: 1633440 - protein, 8 aa, Staphylococcus aureus
RTGESNSS

SEQ ID NO: 1633441 - protein, 6 aa, Staphylococcus aureus
RTHLTK

SEQ ID NO: 1633442 - protein, 5 aa, Staphylococcus aureus
RTKDG

SEQ ID NO: 1633443 - protein, 5 aa, Staphylococcus aureus
RTPLT

SEQ ID NO: 1633444 - protein, 5 aa, Staphylococcus aureus
RTTVT

SEQ ID NO: 1633445 - protein, 7 aa, Staphylococcus aureus
RVDYGAA

SEQ ID NO: 1633446 - protein, 5 aa, Staphylococcus aureus
RVKGK

SEQ ID NO: 1633447 - protein, 15 aa, Staphylococcus aureus
RYDKSKLDLNDKESF

SEQ ID NO: 1633448 - protein, 14 aa, Staphylococcus aureus
RYDKSKLNLNDKES

SEQ ID NO: 1633449 - protein, 7 aa, Staphylococcus aureus
RYQNGKY

SEQ ID NO: 1633450 - protein, 17 aa, Staphylococcus aureus
RYSDVASKSAGSKMPRA

SEQ ID NO: 1633451 - protein, 8 aa, Staphylococcus aureus
SADGEPCN

SEQ ID NO: 1633452 - protein, 8 aa, Staphylococcus aureus
SAFGSNYD

SEQ ID NO: 1633453 - protein, 8 aa, Staphylococcus aureus
SAGDSKIN

SEQ ID NO: 1633454 - protein, 11 aa, Staphylococcus aureus
SAGKSKDANIV

SEQ ID NO: 1633455 - protein, 5 aa, Staphylococcus aureus
SAIGE

SEQ ID NO: 1633456 - protein, 9 aa, Staphylococcus aureus
SAKAQDGAS

SEQ ID NO: 1633457 - protein, 13 aa, Staphylococcus aureus
SAMLSKEKNTYSR

SEQ ID NO: 1633458 - protein, 6 aa, Staphylococcus aureus
SANQVK

SEQ ID NO: 1633459 - protein, 8 aa, Staphylococcus aureus
SANQVKRQ

SEQ ID NO: 1633460 - protein, 42 aa, Staphylococcus aureus
SAQSPAIDKVATEKRISELEHDKRKAVSAEEYKKADDIQNEI

SEQ ID NO: 1633461 - protein, 13 aa, Staphylococcus aureus
SARRQPEQTETYV

SEQ ID NO: 1633462 - protein, 9 aa, Staphylococcus aureus
SARRVENGD

SEQ ID NO: 1633463 - protein, 8 aa, Staphylococcus aureus
SASEDTIT

SEQ ID NO: 1633464 - protein, 22 aa, Staphylococcus aureus
SASRQGKKVAKGIKRMGRSENN

SEQ ID NO: 1633465 - protein, 18 aa, Staphylococcus aureus
SATRVSGVDTVKQNAQHL

SEQ ID NO: 1633466 - protein, 8 aa, Staphylococcus aureus
SCDHKLSS

SEQ ID NO: 1633467 - protein, 9 aa, Staphylococcus aureus
SDDGPPTNW

SEQ ID NO: 1633468 - protein, 7 aa, Staphylococcus aureus
SDDNYRL

SEQ ID NO: 1633469 - protein, 9 aa, Staphylococcus aureus
SDDYHGPDM

SEQ ID NO: 1633470 - protein, 11 aa, Staphylococcus aureus
SDEFKTNSYDL

SEQ ID NO: 1633471 - protein, 17 aa, Staphylococcus aureus
SDEGWRSRSNDSPVCTG

SEQ ID NO: 1633472 - protein, 6 aa, Staphylococcus aureus
SDENMT

SEQ ID NO: 1633473 - protein, 12 aa, Staphylococcus aureus
SDFKKTKGYERS

SEQ ID NO: 1633474 - protein, 4 aa, Staphylococcus aureus
SDGN

SEQ ID NO: 1633475 - protein, 12 aa, Staphylococcus aureus
SDGNPSGKNAEL

SEQ ID NO: 1633476 - protein, 16 aa, Staphylococcus aureus
SDHTTIEDTKEYTTES

SEQ ID NO: 1633477 - protein, 13 aa, Staphylococcus aureus
SDIQDELEKGTSY

SEQ ID NO: 1633478 - protein, 10 aa, Staphylococcus aureus
SDKEFKTTQK

SEQ ID NO: 1633479 - protein, 7 aa, Staphylococcus aureus
SDKNNYI

SEQ ID NO: 1633480 - protein, 23 aa, Staphylococcus aureus
SDLNQAQKNALTQQVNSAQNVQA

SEQ ID NO: 1633481 - protein, 15 aa, Staphylococcus aureus
SDLRADQSKEEFDKA

SEQ ID NO: 1633482 - protein, 5 aa, Staphylococcus aureus
SDLSH

SEQ ID NO: 1633483 - protein, 12 aa, Staphylococcus aureus
SDLTSAKNSANA

SEQ ID NO: 1633484 - protein, 7 aa, Staphylococcus aureus
SDQGITK

SEQ ID NO: 1633485 - protein, 4 aa, Staphylococcus aureus
SDRM

SEQ ID NO: 1633486 - protein, 11 aa, Staphylococcus aureus
SDSNNDRLNPA

SEQ ID NO: 1633487 - protein, 5 aa, Staphylococcus aureus
SDVDE

SEQ ID NO: 1633488 - protein, 7 aa, Staphylococcus aureus
SDWSRNQ

SEQ ID NO: 1633489 - protein, 8 aa, Staphylococcus aureus
SEAKENER

SEQ ID NO: 1633490 - protein, 12 aa, Staphylococcus aureus
SEAKKSLGIQEG

SEQ ID NO: 1633491 - protein, 10 aa, Staphylococcus aureus
SEAKRKKAIQ

SEQ ID NO: 1633492 - protein, 13 aa, Staphylococcus aureus
SEAPGAGKSTIAA

SEQ ID NO: 1633493 - protein, 13 aa, Staphylococcus aureus
SEASGIDISDDGY

SEQ ID NO: 1633494 - protein, 7 aa, Staphylococcus aureus
SEAYGYA

SEQ ID NO: 1633495 - protein, 8 aa, Staphylococcus aureus
SEFSKGRK

SEQ ID NO: 1633496 - protein, 26 aa, Staphylococcus aureus
SEITPRSVQSPTQAPKKETAIPQPKA

SEQ ID NO: 1633497 - protein, 7 aa, Staphylococcus aureus
SEKHLNE

SEQ ID NO: 1633498 - protein, 8 aa, Staphylococcus aureus
SEKHLNEN

SEQ ID NO: 1633499 - protein, 6 aa, Staphylococcus aureus
SEKNFD

SEQ ID NO: 1633500 - protein, 6 aa, Staphylococcus aureus
SEKNGE

SEQ ID NO: 1633501 - protein, 7 aa, Staphylococcus aureus
SEKQAQA

SEQ ID NO: 1633502 - protein, 16 aa, Staphylococcus aureus
SEKSTHESSEYRHENA

SEQ ID NO: 1633503 - protein, 5 aa, Staphylococcus aureus
SELDR

SEQ ID NO: 1633504 - protein, 17 aa, Staphylococcus aureus
SELSSLYESEKQSALGK

SEQ ID NO: 1633505 - protein, 12 aa, Staphylococcus aureus
SELTKAAGADFV

SEQ ID NO: 1633506 - protein, 11 aa, Staphylococcus aureus
SELTKATGADF

SEQ ID NO: 1633507 - protein, 6 aa, Staphylococcus aureus
SENEKL

SEQ ID NO: 1633508 - protein, 9 aa, Staphylococcus aureus
SENKDQDTI

SEQ ID NO: 1633509 - protein, 8 aa, Staphylococcus aureus
SENSLRSA

SEQ ID NO: 1633510 - protein, 8 aa, Staphylococcus aureus
SENSYDNL

SEQ ID NO: 1633511 - protein, 8 aa, Staphylococcus aureus
SENTGYPF

SEQ ID NO: 1633512 - protein, 15 aa, Staphylococcus aureus
SEQKNYRRNALSTLW

SEQ ID NO: 1633513 - protein, 9 aa, Staphylococcus aureus
SESEPTISQ

SEQ ID NO: 1633514 - protein, 8 aa, Staphylococcus aureus
SETLKNRE

SEQ ID NO: 1633515 - protein, 6 aa, Staphylococcus aureus
SETNYP

SEQ ID NO: 1633516 - protein, 8 aa, Staphylococcus aureus
SETTLPDL

SEQ ID NO: 1633517 - protein, 11 aa, Staphylococcus aureus
SEYPRLSDSEI

SEQ ID NO: 1633518 - protein, 6 aa, Staphylococcus aureus
SEYREN

SEQ ID NO: 1633519 - protein, 6 aa, Staphylococcus aureus
SEYYSD

SEQ ID NO: 1633520 - protein, 9 aa, Staphylococcus aureus
SFNTRHSSY

SEQ ID NO: 1633521 - protein, 21 aa, Staphylococcus aureus
SGAHGKAREITESIDPNHYYP

SEQ ID NO: 1633522 - protein, 9 aa, Staphylococcus aureus
SGAKRAGKT

SEQ ID NO: 1633523 - protein, 12 aa, Staphylococcus aureus
SGAQNTLVGKKF

SEQ ID NO: 1633524 - protein, 5 aa, Staphylococcus aureus
SGDKL

SEQ ID NO: 1633525 - protein, 4 aa, Staphylococcus aureus
SGDR

SEQ ID NO: 1633526 - protein, 5 aa, Staphylococcus aureus
SGEEP

SEQ ID NO: 1633527 - protein, 4 aa, Staphylococcus aureus
SGEL

SEQ ID NO: 1633528 - protein, 8 aa, Staphylococcus aureus
SGESEETW

SEQ ID NO: 1633529 - protein, 16 aa, Staphylococcus aureus
SGEVAERKIGAPQGGV

SEQ ID NO: 1633530 - protein, 24 aa, Staphylococcus aureus
SGGEVGALTGPSLMPGGQEAAYNK

SEQ ID NO: 1633531 - protein, 4 aa, Staphylococcus aureus
SGGS

SEQ ID NO: 1633532 - protein, 5 aa, Staphylococcus aureus
SGIRS

SEQ ID NO: 1633533 - protein, 6 aa, Staphylococcus aureus
SGKHAF

SEQ ID NO: 1633534 - protein, 14 aa, Staphylococcus aureus
SGKKDNAVSDKTVR

SEQ ID NO: 1633535 - protein, 8 aa, Staphylococcus aureus
SGKKEDDI

SEQ ID NO: 1633536 - protein, 10 aa, Staphylococcus aureus
SGLDYEKRQN

SEQ ID NO: 1633537 - protein, 6 aa, Staphylococcus aureus
SGLEPM

SEQ ID NO: 1633538 - protein, 12 aa, Staphylococcus aureus
SGLGTENGHGNY

SEQ ID NO: 1633539 - protein, 4 aa, Staphylococcus aureus
SGNF

SEQ ID NO: 1633540 - protein, 8 aa, Staphylococcus aureus
SGNPTRIP

SEQ ID NO: 1633541 - protein, 17 aa, Staphylococcus aureus
SGRALDDKDKEIREKDD

SEQ ID NO: 1633542 - protein, 7 aa, Staphylococcus aureus
SGSPEIA

SEQ ID NO: 1633543 - protein, 7 aa, Staphylococcus aureus
SGSPILN

SEQ ID NO: 1633544 - protein, 11 aa, Staphylococcus aureus
SGSPILNSKRE

SEQ ID NO: 1633545 - protein, 9 aa, Staphylococcus aureus
SGTTPSIDE

SEQ ID NO: 1633546 - protein, 5 aa, Staphylococcus aureus
SGVCS

SEQ ID NO: 1633547 - protein, 5 aa, Staphylococcus aureus
SHPNR

SEQ ID NO: 1633548 - protein, 8 aa, Staphylococcus aureus
SHPPQEIQ

SEQ ID NO: 1633549 - protein, 6 aa, Staphylococcus aureus
SHYSNR

SEQ ID NO: 1633550 - protein, 28 aa, Staphylococcus aureus
SIANKDATKASEDYVDANNDKQTAYNNA

SEQ ID NO: 1633551 - protein, 34 aa, Staphylococcus aureus; identical to SEQ ID NO: 1567233

SEQ ID NO: 1633552 - protein, 12 aa, Staphylococcus aureus
SIDKSAHSNDIT

SEQ ID NO: 1633553 - protein, 5 aa, Staphylococcus aureus
SIEQS

SEQ ID NO: 1633554 - protein, 9 aa, Staphylococcus aureus
SIGKPLPNR

SEQ ID NO: 1633555 - protein, 21 aa, Staphylococcus aureus
SIKNKTAEQMRTTDPKRNATI

SEQ ID NO: 1633556 - protein, 18 aa, Staphylococcus aureus
SIKNLGDSKIYKSIKGAR

SEQ ID NO: 1633557 - protein, 22 aa, Staphylococcus aureus
SINNAQKAALKSQIEGATTVAG

SEQ ID NO: 1633558 - protein, 34 aa, Staphylococcus aureus; identical to SEQ ID NO: 1566706

SEQ ID NO: 1633559 - protein, 6 aa, Staphylococcus aureus
SISLGE

SEQ ID NO: 1633560 - protein, 19 aa, Staphylococcus aureus
SITAKGQKLTIKTNSAYPE

SEQ ID NO: 1633561 - protein, 9 aa, Staphylococcus aureus
SITDAQKNN

SEQ ID NO: 1633562 - protein, 6 aa, Staphylococcus aureus
SITDEH

SEQ ID NO: 1633563 - protein, 7 aa, Staphylococcus aureus
SITNGRL

SEQ ID NO: 1633564 - protein, 14 aa, Staphylococcus aureus
SITNYYRGQANDWP

SEQ ID NO: 1633565 - protein, 14 aa, Staphylococcus aureus
SKAEPSETKAYINV

SEQ ID NO: 1633566 - protein, 7 aa, Staphylococcus aureus
SKANDPV

SEQ ID NO: 1633567 - protein, 15 aa, Staphylococcus aureus
SKANGGNATQAEVEQ

SEQ ID NO: 1633568 - protein, 20 aa, Staphylococcus aureus
SKANGQSATAKSAYNSASRI

SEQ ID NO: 1633569 - protein, 8 aa, Staphylococcus aureus
SKDEIGNT

SEQ ID NO: 1633570 - protein, 7 aa, Staphylococcus aureus
SKDKEQM

SEQ ID NO: 1633571 - protein, 12 aa, Staphylococcus aureus
SKDQQASSAATI

SEQ ID NO: 1633572 - protein, 10 aa, Staphylococcus aureus
SKDSIQKGEQ

SEQ ID NO: 1633573 - protein, 7 aa, Staphylococcus aureus
SKEDRDI

SEQ ID NO: 1633574 - protein, 4 aa, Staphylococcus aureus
SKEI

SEQ ID NO: 1633575 - protein, 16 aa, Staphylococcus aureus
SKEMKEKLASRSLDLN

SEQ ID NO: 1633576 - protein, 8 aa, Staphylococcus aureus
SKFNNRKF

SEQ ID NO: 1633577 - protein, 7 aa, Staphylococcus aureus
SKGNPLQ

SEQ ID NO: 1633578 - protein, 8 aa, Staphylococcus aureus
SKGNPLQI

SEQ ID NO: 1633579 - protein, 23 aa, Staphylococcus aureus
SKGSLAGVDGRLQSRSYENQEGR

SEQ ID NO: 1633580 - protein, 25 aa, Staphylococcus aureus
SKGSLTGVDGRLQTRNYENKEGQRV

SEQ ID NO: 1633581 - protein, 34 aa, Staphylococcus aureus
SKKENKKHDVSEDDAISPAEDSGNDKSISDDDLP

SEQ ID NO: 1633582 - protein, 6 aa, Staphylococcus aureus
SKKKKI

SEQ ID NO: 1633583 - protein, 10 aa, Staphylococcus aureus
SKKKPPGITK

SEQ ID NO: 1633584 - protein, 11 aa, Staphylococcus aureus
SKKNEEKINEI

SEQ ID NO: 1633585 - protein, 4 aa, Staphylococcus aureus
SKKV

SEQ ID NO: 1633586 - protein, 7 aa, Staphylococcus aureus
SKLERNK

SEQ ID NO: 1633587 - protein, 18 aa, Staphylococcus aureus
SKMAKHTKANTDLTTEDL

SEQ ID NO: 1633588 - protein, 7 aa, Staphylococcus aureus
SKNNNVS

SEQ ID NO: 1633589 - protein, 4 aa, Staphylococcus aureus
SKNT

SEQ ID NO: 1633590 - protein, 14 aa, Staphylococcus aureus
SKNVNDHTEQKKRI

SEQ ID NO: 1633591 - protein, 24 aa, Staphylococcus aureus
SKPVGKTPQGGGNPDSSVTKEKFD

SEQ ID NO: 1633592 - protein, 7 aa, Staphylococcus aureus
SKRATQF

SEQ ID NO: 1633593 - protein, 8 aa, Staphylococcus aureus
SKRIKANS

SEQ ID NO: 1633594 - protein, 7 aa, Staphylococcus aureus
SKRSKQF

SEQ ID NO: 1633595 - protein, 8 aa, Staphylococcus aureus
SKRSKQFK

SEQ ID NO: 1633596 - protein, 8 aa, Staphylococcus aureus
SKRYNPPL

SEQ ID NO: 1633597 - protein, 13 aa, Staphylococcus aureus
SKSDFKSKNNNVS

SEQ ID NO: 1633598 - protein, 11 aa, Staphylococcus aureus
SKTMNKQGEPY

SEQ ID NO: 1633599 - protein, 6 aa, Staphylococcus aureus
SKTQGR

SEQ ID NO: 1633600 - protein, 10 aa, Staphylococcus aureus
SKYGKEEAKK

SEQ ID NO: 1633601 - protein, 8 aa, Staphylococcus aureus
SKYGPDLE

SEQ ID NO: 1633602 - protein, 7 aa, Staphylococcus aureus
SKYGSDL

SEQ ID NO: 1633603 - protein, 19 aa, Staphylococcus aureus
SKYKEGDISYNPEVPSYSA

SEQ ID NO: 1633604 - protein, 40 aa, Staphylococcus aureus
SLAESESLAESESLAESESLAESEPLSDVESLPESEPLSE

SEQ ID NO: 1633605 - protein, 6 aa, Staphylococcus aureus
SLDKPV

SEQ ID NO: 1633606 - protein, 10 aa, Staphylococcus aureus
SLDSNGTKLI

SEQ ID NO: 1633607 - protein, 8 aa, Staphylococcus aureus
SLENETNS

SEQ ID NO: 1633608 - protein, 9 aa, Staphylococcus aureus
SLEPGQKAK

SEQ ID NO: 1633609 - protein, 6 aa, Staphylococcus aureus
SLKGWT

SEQ ID NO: 1633610 - protein, 8 aa, Staphylococcus aureus
SLLQGDKQ

SEQ ID NO: 1633611 - protein, 17 aa, Staphylococcus aureus
SLNPSNLPDNDGDGGGV

SEQ ID NO: 1633612 - protein, 26 aa, Staphylococcus aureus
SLTKDKELLDSDKLKDDYELKKGKMN

SEQ ID NO: 1633613 - protein, 25 aa, Staphylococcus aureus
SLTKDKELLDSDKLKDEYELKKEKM

SEQ ID NO: 1633614 - protein, 14 aa, Staphylococcus aureus
SMSQHTKSATPKII

SEQ ID NO: 1633615 - protein, 17 aa, Staphylococcus aureus
SNAKHTIAGAKQLHGKQ

SEQ ID NO: 1633616 - protein, 17 aa, Staphylococcus aureus
SNALTSDPKVFKQNAKD

SEQ ID NO: 1633617 - protein, 7 aa, Staphylococcus aureus
SNATYEE

SEQ ID NO: 1633618 - protein, 6 aa, Staphylococcus aureus
SNDEYY

SEQ ID NO: 1633619 - protein, 16 aa, Staphylococcus aureus
SNENLYGPSPKVKEAI

SEQ ID NO: 1633620 - protein, 5 aa, Staphylococcus aureus
SNGNY

SEQ ID NO: 1633621 - protein, 4 aa, Staphylococcus aureus
SNGQ

SEQ ID NO: 1633622 - protein, 9 aa, Staphylococcus aureus
SNKAKETKK

SEQ ID NO: 1633623 - protein, 8 aa, Staphylococcus aureus
SNKPWTNY

SEQ ID NO: 1633624 - protein, 16 aa, Staphylococcus aureus
SNKRTDHYGTDSLKNR

SEQ ID NO: 1633625 - protein, 8 aa, Staphylococcus aureus
SNLEQEAI

SEQ ID NO: 1633626 - protein, 4 aa, Staphylococcus aureus
SNNE

SEQ ID NO: 1633627 - protein, 6 aa, Staphylococcus aureus
SNNIPA

SEQ ID NO: 1633628 - protein, 5 aa, Staphylococcus aureus
SNNKQ

SEQ ID NO: 1633629 - protein, 9 aa, Staphylococcus aureus
SNNPSKFEG

SEQ ID NO: 1633630 - protein, 5 aa, Staphylococcus aureus
SNNQS

SEQ ID NO: 1633631 - protein, 15 aa, Staphylococcus aureus
SNQTNNRTINKNNIS

SEQ ID NO: 1633632 - protein, 12 aa, Staphylococcus aureus
SNQYQSSTRFKR

SEQ ID NO: 1633633 - protein, 11 aa, Staphylococcus aureus
SNSEITKENGQ

SEQ ID NO: 1633634 - protein, 11 aa, Staphylococcus aureus
SNSPIDLNSTE

SEQ ID NO: 1633635 - protein, 13 aa, Staphylococcus aureus
SNSTISDRDPNEL

SEQ ID NO: 1633636 - protein, 11 aa, Staphylococcus aureus
SNSYTTDEVKG

SEQ ID NO: 1633637 - protein, 6 aa, Staphylococcus aureus
SNTDNY

SEQ ID NO: 1633638 - protein, 9 aa, Staphylococcus aureus
SNTDRNKGN

SEQ ID NO: 1633639 - protein, 4 aa, Staphylococcus aureus
SNTI

SEQ ID NO: 1633640 - protein, 10 aa, Staphylococcus aureus
SNTNFAKNEE

SEQ ID NO: 1633641 - protein, 29 aa, Staphylococcus aureus
SNVNPSLRDATVNNYKPQNEKQVHAKQSA

SEQ ID NO: 1633642 - protein, 30 aa, Staphylococcus aureus
SNVNPSLRDATVNNYKPQNEKQVKAKQTAI

SEQ ID NO: 1633643 - protein, 7 aa, Staphylococcus aureus
SNVTDEF

SEQ ID NO: 1633644 - protein, 18 aa, Staphylococcus aureus
SPANDVKGSQPLSGELGK

SEQ ID NO: 1633645 - protein, 6 aa, Staphylococcus aureus
SPGKDQ

SEQ ID NO: 1633646 - protein, 4 aa, Staphylococcus aureus
SPKD

SEQ ID NO: 1633647 - protein, 5 aa, Staphylococcus aureus
SPNKV

SEQ ID NO: 1633648 - protein, 16 aa, Staphylococcus aureus
SQDNQSISKKMTGYGL

SEQ ID NO: 1633649 - protein, 25 aa, Staphylococcus aureus
SQEITGNEGRTKGSTNYVNADTQVK

SEQ ID NO: 1633650 - protein, 6 aa, Staphylococcus aureus
SQFDQA

SEQ ID NO: 1633651 - protein, 13 aa, Staphylococcus aureus
SQKAPEGESYEDV

SEQ ID NO: 1633652 - protein, 20 aa, Staphylococcus aureus
SQLNTNKTKKKNTDNSSLEQ

SEQ ID NO: 1633653 - protein, 6 aa, Staphylococcus aureus
SQMAEK

SEQ ID NO: 1633654 - protein, 5 aa, Staphylococcus aureus
SQQEG

SEQ ID NO: 1633655 - protein, 5 aa, Staphylococcus aureus
SQSQL

SEQ ID NO: 1633656 - protein, 16 aa, Staphylococcus aureus
SRENNTTYNAKYSNCY

SEQ ID NO: 1633657 - protein, 4 aa, Staphylococcus aureus
SRKV

SEQ ID NO: 1633658 - protein, 27 aa, Staphylococcus aureus
SRKVNPKKLQRQIAKEQKKPKYSTQAQ

SEQ ID NO: 1633659 - protein, 15 aa, Staphylococcus aureus
SRMISKNSDQPIDYN

SEQ ID NO: 1633660 - protein, 7 aa, Staphylococcus aureus
SRNQYQP

SEQ ID NO: 1633661 - protein, 7 aa, Staphylococcus aureus
SRPRSGY

SEQ ID NO: 1633662 - protein, 5 aa, Staphylococcus aureus
SRRQI

SEQ ID NO: 1633663 - protein, 9 aa, Staphylococcus aureus
SRYDNETIE

SEQ ID NO: 1633664 - protein, 11 aa, Staphylococcus aureus
SRYDNSLEKSK

SEQ ID NO: 1633665 - protein, 25 aa, Staphylococcus aureus
SSAGRIAARARGRYGGRPEKLKKKD

SEQ ID NO: 1633666 - protein, 4 aa, Staphylococcus aureus
SSDI

SEQ ID NO: 1633667 - protein, 12 aa, Staphylococcus aureus
SSELGKDDPFNP

SEQ ID NO: 1633668 - protein, 6 aa, Staphylococcus aureus
SSELNE

SEQ ID NO: 1633669 - protein, 10 aa, Staphylococcus aureus
SSENTEEQEK

SEQ ID NO: 1633670 - protein, 14 aa, Staphylococcus aureus
SSEVKKGESIKSAI

SEQ ID NO: 1633671 - protein, 17 aa, Staphylococcus aureus
SSHVTGYDVKGSTAGRD

SEQ ID NO: 1633672 - protein, 6 aa, Staphylococcus aureus
SSHYKG

SEQ ID NO: 1633673 - protein, 12 aa, Staphylococcus aureus
SSKEEAKEAGVE

SEQ ID NO: 1633674 - protein, 11 aa, Staphylococcus aureus
SSNFSKDKKLD

SEQ ID NO: 1633675 - protein, 8 aa, Staphylococcus aureus
SSNITGDN

SEQ ID NO: 1633676 - protein, 20 aa, Staphylococcus aureus
SSQTDSRTIIGTGGAEKLLG

SEQ ID NO: 1633677 - protein, 23 aa, Staphylococcus aureus
SSRGEQTTESVEKEMKKAEKVEV

SEQ ID NO: 1633678 - protein, 7 aa, Staphylococcus aureus
SSSKSQW

SEQ ID NO: 1633679 - protein, 6 aa, Staphylococcus aureus
SSSYTK

SEQ ID NO: 1633680 - protein, 13 aa, Staphylococcus aureus
SSVEGQLDEKNTI

SEQ ID NO: 1633681 - protein, 4 aa, Staphylococcus aureus
SSVK

SEQ ID NO: 1633682 - protein, 8 aa, Staphylococcus aureus
SSVRAREK

SEQ ID NO: 1633683 - protein, 12 aa, Staphylococcus aureus
SSYGSTHKAGAM

SEQ ID NO: 1633684 - protein, 13 aa, Staphylococcus aureus
STDASGNKTTTTF

SEQ ID NO: 1633685 - protein, 13 aa, Staphylococcus aureus
STDQANNKSTTTF

SEQ ID NO: 1633686 - protein, 5 aa, Staphylococcus aureus
STDRF

SEQ ID NO: 1633687 - protein, 13 aa, Staphylococcus aureus
STENKRHQNAQAK

SEQ ID NO: 1633688 - protein, 14 aa, Staphylococcus aureus
STESILEKWLNLFN

SEQ ID NO: 1633689 - protein, 5 aa, Staphylococcus aureus
STGLP

SEQ ID NO: 1633690 - protein, 7 aa, Staphylococcus aureus
STGNASW

SEQ ID NO: 1633691 - protein, 14 aa, Staphylococcus aureus
STGNGSWGRGPQHR

SEQ ID NO: 1633692 - protein, 17 aa, Staphylococcus aureus
STGRKHTHITKAKSNQR

SEQ ID NO: 1633693 - protein, 16 aa, Staphylococcus aureus
STGRKHTHITRAKSNQ

SEQ ID NO: 1633694 - protein, 18 aa, Staphylococcus aureus
STGRKHTHITRAKSNQKF

SEQ ID NO: 1633695 - protein, 6 aa, Staphylococcus aureus
STIADG

SEQ ID NO: 1633696 - protein, 6 aa, Staphylococcus aureus
STKEDK

SEQ ID NO: 1633697 - protein, 6 aa, Staphylococcus aureus
STKLKA

SEQ ID NO: 1633698 - protein, 9 aa, Staphylococcus aureus
STLEEAKGA

SEQ ID NO: 1633699 - protein, 9 aa, Staphylococcus aureus
STLSGVSQT

SEQ ID NO: 1633700 - protein, 9 aa, Staphylococcus aureus
STNKAKDLW

SEQ ID NO: 1633701 - protein, 6 aa, Staphylococcus aureus
STVDSS

SEQ ID NO: 1633702 - protein, 10 aa, Staphylococcus aureus
STYWKDKNDD

SEQ ID NO: 1633703 - protein, 4 aa, Staphylococcus aureus
STYY

SEQ ID NO: 1633704 - protein, 8 aa, Staphylococcus aureus
SVDQGGQH

SEQ ID NO: 1633705 - protein, 10 aa, Staphylococcus aureus
SVEEKPYNEP

SEQ ID NO: 1633706 - protein, 7 aa, Staphylococcus aureus
SVGHSKQ

SEQ ID NO: 1633707 - protein, 4 aa, Staphylococcus aureus
SVGY

SEQ ID NO: 1633708 - protein, 34 aa, Staphylococcus aureus
SVKVGAPTVEGATVTATVNKQGRGKKNHCIHIQT

SEQ ID NO: 1633709 - protein, 7 aa, Staphylococcus aureus
SVNEAQI

SEQ ID NO: 1633710 - protein, 14 aa, Staphylococcus aureus
SVNPNELNTDKPSM

SEQ ID NO: 1633711 - protein, 5 aa, Staphylococcus aureus
SVSKS

SEQ ID NO: 1633712 - protein, 9 aa, Staphylococcus aureus
SVSTKQIAE

SEQ ID NO: 1633713 - protein, 11 aa, Staphylococcus aureus
SVSYGGTGRTY

SEQ ID NO: 1633714 - protein, 8 aa, Staphylococcus aureus
SYGPSQGK

SEQ ID NO: 1633715 - protein, 8 aa, Staphylococcus aureus
SYGTGKSH

SEQ ID NO: 1633716 - protein, 5 aa, Staphylococcus aureus
SYPMS

SEQ ID NO: 1633717 - protein, 4 aa, Staphylococcus aureus
SYPP

SEQ ID NO: 1633718 - protein, 6 aa, Staphylococcus aureus
SYQQRA

SEQ ID NO: 1633719 - protein, 6 aa, Staphylococcus aureus
SYTNEN

SEQ ID NO: 1633720 - protein, 17 aa, Staphylococcus aureus
TADRATVKAELKDKYGI

SEQ ID NO: 1633721 - protein, 4 aa, Staphylococcus aureus
TADV

SEQ ID NO: 1633722 - protein, 5 aa, Staphylococcus aureus
TAEDI

SEQ ID NO: 1633723 - protein, 13 aa, Staphylococcus aureus
TAEEAGKPEAWGW

SEQ ID NO: 1633724 - protein, 9 aa, Staphylococcus aureus
TAFGKYGGT

SEQ ID NO: 1633725 - protein, 4 aa, Staphylococcus aureus
TAHS

SEQ ID NO: 1633726 - protein, 5 aa, Staphylococcus aureus
TAIQR

SEQ ID NO: 1633727 - protein, 15 aa, Staphylococcus aureus
TAPAPEGEGGSRAMQ

SEQ ID NO: 1633728 - protein, 12 aa, Staphylococcus aureus
TAPIKEQATDML

SEQ ID NO: 1633729 - protein, 7 aa, Staphylococcus aureus
TASAGVS

SEQ ID NO: 1633730 - protein, 10 aa, Staphylococcus aureus
TASTGGATNL

SEQ ID NO: 1633731 - protein, 12 aa, Staphylococcus aureus
TATQTSATQAVT

SEQ ID NO: 1633732 - protein, 11 aa, Staphylococcus aureus
TAVRNNGGGHL

SEQ ID NO: 1633733 - protein, 6 aa, Staphylococcus aureus
TCARGA

SEQ ID NO: 1633734 - protein, 15 aa, Staphylococcus aureus
TDADQAKKDAYTNAV

SEQ ID NO: 1633735 - protein, 15 aa, Staphylococcus aureus
TDADQAKKDDYTNAV

SEQ ID NO: 1633736 - protein, 8 aa, Staphylococcus aureus
TDDEDYKA

SEQ ID NO: 1633737 - protein, 17 aa, Staphylococcus aureus
TDDNVEPNIAPSTATNK

SEQ ID NO: 1633738 - protein, 32 aa, Staphylococcus aureus
TDDRGTDSLDKDSLKQLKDTGDYQVKRSQPMN

SEQ ID NO: 1633739 - protein, 17 aa, Staphylococcus aureus
TDDSNGRPKDDEKRYPV

SEQ ID NO: 1633740 - protein, 4 aa, Staphylococcus aureus
TDED

SEQ ID NO: 1633741 - protein, 13 aa, Staphylococcus aureus
TDEQDKLINLIMK

SEQ ID NO: 1633742 - protein, 9 aa, Staphylococcus aureus
TDEVSEGTA

SEQ ID NO: 1633743 - protein, 10 aa, Staphylococcus aureus
TDGKKNNGKV

SEQ ID NO: 1633744 - protein, 13 aa, Staphylococcus aureus
TDINNSKNIYESE

SEQ ID NO: 1633745 - protein, 10 aa, Staphylococcus aureus
TDKQWEDAKK

SEQ ID NO: 1633746 - protein, 9 aa, Staphylococcus aureus
TDKRDRKKH

SEQ ID NO: 1633747 - protein, 14 aa, Staphylococcus aureus
TDKWGSKRGNTTWG

SEQ ID NO: 1633748 - protein, 9 aa, Staphylococcus aureus
TDKYEPADI

SEQ ID NO: 1633749 - protein, 7 aa, Staphylococcus aureus
TDLASGD

SEQ ID NO: 1633750 - protein, 24 aa, Staphylococcus aureus
TDLENKAQSYSRTFDEQKRYMDEK

SEQ ID NO: 1633751 - protein, 9 aa, Staphylococcus aureus
TDNKGLDAT

SEQ ID NO: 1633752 - protein, 9 aa, Staphylococcus aureus
TDPAREGEN

SEQ ID NO: 1633753 - protein, 16 aa, Staphylococcus aureus
TDPSGEVYEKTSNIKR

SEQ ID NO: 1633754 - protein, 9 aa, Staphylococcus aureus
TDQSRNNDH

SEQ ID NO: 1633755 - protein, 7 aa, Staphylococcus aureus
TDSKDKL

SEQ ID NO: 1633756 - protein, 8 aa, Staphylococcus aureus
TDSKQNHS

SEQ ID NO: 1633757 - protein, 8 aa, Staphylococcus aureus
TDTNIGGE

SEQ ID NO: 1633758 - protein, 12 aa, Staphylococcus aureus
TDTSGNTATTSF

SEQ ID NO: 1633759 - protein, 8 aa, Staphylococcus aureus
TDVRKTDI

SEQ ID NO: 1633760 - protein, 17 aa, Staphylococcus aureus
TEDSKGYSHSKDTKYPV

SEQ ID NO: 1633761 - protein, 6 aa, Staphylococcus aureus
TEEHGH

SEQ ID NO: 1633762 - protein, 6 aa, Staphylococcus aureus
TEIPGL

SEQ ID NO: 1633763 - protein, 5 aa, Staphylococcus aureus
TENDG

SEQ ID NO: 1633764 - protein, 5 aa, Staphylococcus aureus
TENTV

SEQ ID NO: 1633765 - protein, 7 aa, Staphylococcus aureus
TEPDEIK

SEQ ID NO: 1633766 - protein, 8 aa, Staphylococcus aureus
TEQEASDI

SEQ ID NO: 1633767 - protein, 11 aa, Staphylococcus aureus
TEQQQVERERR

SEQ ID NO: 1633768 - protein, 5 aa, Staphylococcus aureus
TEQVK

SEQ ID NO: 1633769 - protein, 7 aa, Staphylococcus aureus
TEREEKM

SEQ ID NO: 1633770 - protein, 12 aa, Staphylococcus aureus
TERGKQIKTPLT

SEQ ID NO: 1633771 - protein, 5 aa, Staphylococcus aureus
TESGL

SEQ ID NO: 1633772 - protein, 41 aa, Staphylococcus aureus
TESTVEETNVKQNIDDSVEQTEESKGHLQDEAIEETSDENV

SEQ ID NO: 1633773 - protein, 18 aa, Staphylococcus aureus
TEVKPTHSIKALNRLHMI

SEQ ID NO: 1633774 - protein, 15 aa, Staphylococcus aureus
TFPPSDKSKHYEETQ

SEQ ID NO: 1633775 - protein, 4 aa, Staphylococcus aureus
TFST

SEQ ID NO: 1633776 - protein, 4 aa, Staphylococcus aureus
TGAG

SEQ ID NO: 1633777 - protein, 11 aa, Staphylococcus aureus
TGAYQIPSDPM

SEQ ID NO: 1633778 - protein, 16 aa, Staphylococcus aureus
TGDVTDTDLIMEKELK

SEQ ID NO: 1633779 - protein, 15 aa, Staphylococcus aureus
TGETYNNIEVIKSES

SEQ ID NO: 1633780 - protein, 4 aa, Staphylococcus aureus
TGEV

SEQ ID NO: 1633781 - protein, 19 aa, Staphylococcus aureus
TGEVDKAGNRISSFGNFSA

SEQ ID NO: 1633782 - protein, 16 aa, Staphylococcus aureus
TGGEPSETKKFVTENQ

SEQ ID NO: 1633783 - protein, 14 aa, Staphylococcus aureus
TGGKELTQEQIEEA

SEQ ID NO: 1633784 - protein, 11 aa, Staphylococcus aureus
TGIGTRNNKIP

SEQ ID NO: 1633785 - protein, 4 aa, Staphylococcus aureus
TGKD

SEQ ID NO: 1633786 - protein, 15 aa, Staphylococcus aureus
TGKDIIPPKTYSGNV

SEQ ID NO: 1633787 - protein, 10 aa, Staphylococcus aureus
TGKGSESGNA

SEQ ID NO: 1633788 - protein, 8 aa, Staphylococcus aureus
TGKTYPPE

SEQ ID NO: 1633789 - protein, 4 aa, Staphylococcus aureus
TGKV

SEQ ID NO: 1633790 - protein, 10 aa, Staphylococcus aureus
TGNTPSKKEN

SEQ ID NO: 1633791 - protein, 11 aa, Staphylococcus aureus
TGPISKSGVNH

SEQ ID NO: 1633792 - protein, 9 aa, Staphylococcus aureus
TGQRQRALE

SEQ ID NO: 1633793 - protein, 11 aa, Staphylococcus aureus
TGSGPTGSKIM

SEQ ID NO: 1633794 - protein, 4 aa, Staphylococcus aureus
TGTG

SEQ ID NO: 1633795 - protein, 7 aa, Staphylococcus aureus
TGTGIAP

SEQ ID NO: 1633796 - protein, 13 aa, Staphylococcus aureus
THDVQEESSRRAI

SEQ ID NO: 1633797 - protein, 12 aa, Staphylococcus aureus
THKLEDWIKKVN

SEQ ID NO: 1633798 - protein, 5 aa, Staphylococcus aureus
THYVD

SEQ ID NO: 1633799 - protein, 12 aa, Staphylococcus aureus
TIAKGKDAKGLQ

SEQ ID NO: 1633800 - protein, 14 aa, Staphylococcus aureus
TIDRTSDGKGRISD

SEQ ID NO: 1633801 - protein, 11 aa, Staphylococcus aureus
TIEDSKKVSHQ

SEQ ID NO: 1633802 - protein, 11 aa, Staphylococcus aureus
TIEEDSDDLDG

SEQ ID NO: 1633803 - protein, 12 aa, Staphylococcus aureus
TIEERHSNAYQK

SEQ ID NO: 1633804 - protein, 6 aa, Staphylococcus aureus
TIHHPE

SEQ ID NO: 1633805 - protein, 13 aa, Staphylococcus aureus
TIHRKDTDKNKLG

SEQ ID NO: 1633806 - protein, 11 aa, Staphylococcus aureus
TIKANGKARTG

SEQ ID NO: 1633807 - protein, 6 aa, Staphylococcus aureus
TIKDQV

SEQ ID NO: 1633808 - protein, 18 aa, Staphylococcus aureus
TIKEEEAVSSIEVNTDQT

SEQ ID NO: 1633809 - protein, 11 aa, Staphylococcus aureus
TIKENGKARTG

SEQ ID NO: 1633810 - protein, 4 aa, Staphylococcus aureus
TIKS

SEQ ID NO: 1633811 - protein, 22 aa, Staphylococcus aureus
TINKDEQEVKTELKNKFDSEDE

SEQ ID NO: 1633812 - protein, 17 aa, Staphylococcus aureus
TIPTSSFTPEESPDPGF

SEQ ID NO: 1633813 - protein, 18 aa, Staphylococcus aureus
TISEENKGKDGYSDEALN

SEQ ID NO: 1633814 - protein, 14 aa, Staphylococcus aureus
TISTGNASWRGPNI

SEQ ID NO: 1633815 - protein, 10 aa, Staphylococcus aureus
TKAKASKVSS

SEQ ID NO: 1633816 - protein, 8 aa, Staphylococcus aureus
TKDDSNVE

SEQ ID NO: 1633817 - protein, 7 aa, Staphylococcus aureus
TKDGDRE

SEQ ID NO: 1633818 - protein, 21 aa, Staphylococcus aureus
TKDGRLSAKEVVGNKKALTEF

SEQ ID NO: 1633819 - protein, 11 aa, Staphylococcus aureus
TKDKDNNKKRS

SEQ ID NO: 1633820 - protein, 13 aa, Staphylococcus aureus
TKDPEFRTTPNGV

SEQ ID NO: 1633821 - protein, 14 aa, Staphylococcus aureus
TKEEIEQAKAQLAQ

SEQ ID NO: 1633822 - protein, 8 aa, Staphylococcus aureus
TKEKHNEW

SEQ ID NO: 1633823 - protein, 5 aa, Staphylococcus aureus
TKETH

SEQ ID NO: 1633824 - protein, 6 aa, Staphylococcus aureus
TKGKYK

SEQ ID NO: 1633825 - protein, 20 aa, Staphylococcus aureus
TKGQAGTNSITRPSFRVPND

SEQ ID NO: 1633826 - protein, 7 aa, Staphylococcus aureus
TKHPNTV

SEQ ID NO: 1633827 - protein, 14 aa, Staphylococcus aureus
TKKDKNKLYHFIKE

SEQ ID NO: 1633828 - protein, 25 aa, Staphylococcus aureus
TKLEQERKQRLTDTNKVSENAKEDL

SEQ ID NO: 1633829 - protein, 8 aa, Staphylococcus aureus
TKPESEDL

SEQ ID NO: 1633830 - protein, 8 aa, Staphylococcus aureus
TKPNSDDL

SEQ ID NO: 1633831 - protein, 4 aa, Staphylococcus aureus
TKSC

SEQ ID NO: 1633832 - protein, 4 aa, Staphylococcus aureus
TKSK

SEQ ID NO: 1633833 - protein, 9 aa, Staphylococcus aureus
TKSPDVYPG

SEQ ID NO: 1633834 - protein, 4 aa, Staphylococcus aureus
TKSS

SEQ ID NO: 1633835 - protein, 9 aa, Staphylococcus aureus
TKTFSAPNG

SEQ ID NO: 1633836 - protein, 6 aa, Staphylococcus aureus
TKVEVK

SEQ ID NO: 1633837 - protein, 9 aa, Staphylococcus aureus
TKVSTLSSS

SEQ ID NO: 1633838 - protein, 4 aa, Staphylococcus aureus
TLAN

SEQ ID NO: 1633839 - protein, 5 aa, Staphylococcus aureus
TLDEI

SEQ ID NO: 1633840 - protein, 4 aa, Staphylococcus aureus
TLED

SEQ ID NO: 1633841 - protein, 9 aa, Staphylococcus aureus
TLGGKIQRG

SEQ ID NO: 1633842 - protein, 7 aa, Staphylococcus aureus
TLKNRER

SEQ ID NO: 1633843 - protein, 5 aa, Staphylococcus aureus
TLKPP

SEQ ID NO: 1633844 - protein, 12 aa, Staphylococcus aureus
TMTPRKPNSALR

SEQ ID NO: 1633845 - protein, 4 aa, Staphylococcus aureus
TNDE

SEQ ID NO: 1633846 - protein, 9 aa, Staphylococcus aureus
TNDEPATRR

SEQ ID NO: 1633847 - protein, 16 aa, Staphylococcus aureus
TNDEQAKKLKAAGVDR

SEQ ID NO: 1633848 - protein, 27 aa, Staphylococcus aureus
TNEDLKSAAKAAIDTHGVGAGAVRTIN

SEQ ID NO: 1633849 - protein, 7 aa, Staphylococcus aureus
TNEHNLD

SEQ ID NO: 1633850 - protein, 9 aa, Staphylococcus aureus
TNEPRVNEA

SEQ ID NO: 1633851 - protein, 5 aa, Staphylococcus aureus
TNGDV

SEQ ID NO: 1633852 - protein, 4 aa, Staphylococcus aureus
TNGF

SEQ ID NO: 1633853 - protein, 4 aa, Staphylococcus aureus
TNIS

SEQ ID NO: 1633854 - protein, 11 aa, Staphylococcus aureus
TNKANKFGNGH

SEQ ID NO: 1633855 - protein, 16 aa, Staphylococcus aureus
TNKQFKGDLGYKEDKI

SEQ ID NO: 1633856 - protein, 7 aa, Staphylococcus aureus
TNLNQNQ

SEQ ID NO: 1633857 - protein, 9 aa, Staphylococcus aureus
TNNSNMESR

SEQ ID NO: 1633858 - protein, 4 aa, Staphylococcus aureus
TNPE

SEQ ID NO: 1633859 - protein, 6 aa, Staphylococcus aureus
TNPYNG

SEQ ID NO: 1633860 - protein, 7 aa, Staphylococcus aureus
TNQLPEP

SEQ ID NO: 1633861 - protein, 7 aa, Staphylococcus aureus
TNQQETD

SEQ ID NO: 1633862 - protein, 8 aa, Staphylococcus aureus
TNSINEKM

SEQ ID NO: 1633863 - protein, 5 aa, Staphylococcus aureus
TNYFG

SEQ ID NO: 1633864 - protein, 12 aa, Staphylococcus aureus
TPEQFDESKKYP

SEQ ID NO: 1633865 - protein, 5 aa, Staphylococcus aureus
TPGDA

SEQ ID NO: 1633866 - protein, 13 aa, Staphylococcus aureus
TPGSHGSTFGGNP

SEQ ID NO: 1633867 - protein, 6 aa, Staphylococcus aureus
TPNKVF

SEQ ID NO: 1633868 - protein, 16 aa, Staphylococcus aureus
TPNSTIPNSLSKNGHL

SEQ ID NO: 1633869 - protein, 6 aa, Staphylococcus aureus
TPNTNY

SEQ ID NO: 1633870 - protein, 4 aa, Staphylococcus aureus
TPQL

SEQ ID NO: 1633871 - protein, 5 aa, Staphylococcus aureus
TPQMG

SEQ ID NO: 1633872 - protein, 6 aa, Staphylococcus aureus
TQADSE

SEQ ID NO: 1633873 - protein, 9 aa, Staphylococcus aureus
TQDQTTTQT

SEQ ID NO: 1633874 - protein, 4 aa, Staphylococcus aureus
TQED

SEQ ID NO: 1633875 - protein, 9 aa, Staphylococcus aureus
TQIQTQTVT

SEQ ID NO: 1633876 - protein, 9 aa, Staphylococcus aureus
TQKATQIQT

SEQ ID NO: 1633877 - protein, 15 aa, Staphylococcus aureus
TQKSGITCSRDVQRE

SEQ ID NO: 1633878 - protein, 13 aa, Staphylococcus aureus
TQKSNQVNENRIN

SEQ ID NO: 1633879 - protein, 27 aa, Staphylococcus aureus
TQQEAEAAENNIENPTTLKDNVQSKEV

SEQ ID NO: 1633880 - protein, 4 aa, Staphylococcus aureus
TQRI

SEQ ID NO: 1633881 - protein, 5 aa, Staphylococcus aureus
TQSDF

SEQ ID NO: 1633882 - protein, 8 aa, Staphylococcus aureus
TQTQTVSQ

SEQ ID NO: 1633883 - protein, 10 aa, Staphylococcus aureus
TRADKGTRKI

SEQ ID NO: 1633884 - protein, 6 aa, Staphylococcus aureus
TRIDSN

SEQ ID NO: 1633885 - protein, 15 aa, Staphylococcus aureus
TRNHYKNKFKNKEGY

SEQ ID NO: 1633886 - protein, 39 aa, Staphylococcus aureus; identical to SEQ ID NO: 1561911

SEQ ID NO: 1633887 - protein, 11 aa, Staphylococcus aureus
TRTPYAKRENG

SEQ ID NO: 1633888 - protein, 6 aa, Staphylococcus aureus
TSADLT

SEQ ID NO: 1633889 - protein, 12 aa, Staphylococcus aureus
TSALPGRKSGSL

SEQ ID NO: 1633890 - protein, 31 aa, Staphylococcus aureus
TSDQDDDGNEASEKNNNPKQQTRTQWASSET

SEQ ID NO: 1633891 - protein, 6 aa, Staphylococcus aureus
TSEATF

SEQ ID NO: 1633892 - protein, 9 aa, Staphylococcus aureus
TSEPDAQLD

SEQ ID NO: 1633893 - protein, 6 aa, Staphylococcus aureus
TSEVDS

SEQ ID NO: 1633894 - protein, 5 aa, Staphylococcus aureus
TSFKD

SEQ ID NO: 1633895 - protein, 22 aa, Staphylococcus aureus
TSGREEVENNLSKNIGELGKTF

SEQ ID NO: 1633896 - protein, 5 aa, Staphylococcus aureus
TSIKQ

SEQ ID NO: 1633897 - protein, 4 aa, Staphylococcus aureus
TSKA

SEQ ID NO: 1633898 - protein, 9 aa, Staphylococcus aureus
TSKDDQTID

SEQ ID NO: 1633899 - protein, 6 aa, Staphylococcus aureus
TSKEGF

SEQ ID NO: 1633900 - protein, 18 aa, Staphylococcus aureus
TSLEDIDKAETKYDHTKV

SEQ ID NO: 1633901 - protein, 7 aa, Staphylococcus aureus
TSLYNQS

SEQ ID NO: 1633902 - protein, 4 aa, Staphylococcus aureus
TSNL

SEQ ID NO: 1633903 - protein, 9 aa, Staphylococcus aureus
TSPKELFKD

SEQ ID NO: 1633904 - protein, 7 aa, Staphylococcus aureus
TSPSFSP

SEQ ID NO: 1633905 - protein, 7 aa, Staphylococcus aureus
TSQETAD

SEQ ID NO: 1633906 - protein, 30 aa, Staphylococcus aureus; identical to SEQ ID NO: 1567277

SEQ ID NO: 1633907 - protein, 19 aa, Staphylococcus aureus
TSRVPDDLDDFNREIVKQL

SEQ ID NO: 1633908 - protein, 6 aa, Staphylococcus aureus
TSTDDK

SEQ ID NO: 1633909 - protein, 11 aa, Staphylococcus aureus
TSVSKSFKKAK

SEQ ID NO: 1633910 - protein, 5 aa, Staphylococcus aureus
TSYHA

SEQ ID NO: 1633911 - protein, 5 aa, Staphylococcus aureus
TSYQD

SEQ ID NO: 1633912 - protein, 20 aa, Staphylococcus aureus
TTAPTVTPIGDQSSEVYSPI

SEQ ID NO: 1633913 - protein, 40 aa, Staphylococcus aureus; identical to SEQ ID NO: 1561341

SEQ ID NO: 1633914 - protein, 5 aa, Staphylococcus aureus
TTEIL

SEQ ID NO: 1633915 - protein, 10 aa, Staphylococcus aureus
TTELKNENMV

SEQ ID NO: 1633916 - protein, 6 aa, Staphylococcus aureus
TTGTSV

SEQ ID NO: 1633917 - protein, 16 aa, Staphylococcus aureus
TTKQQSLAAQKQTIEA

SEQ ID NO: 1633918 - protein, 25 aa, Staphylococcus aureus
TTMNQAKDALNGDEKLAQAKQDALA

SEQ ID NO: 1633919 - protein, 5 aa, Staphylococcus aureus
TTNDL

SEQ ID NO: 1633920 - protein, 7 aa, Staphylococcus aureus
TTNDNGL

SEQ ID NO: 1633921 - protein, 5 aa, Staphylococcus aureus
TTNKN

SEQ ID NO: 1633922 - protein, 9 aa, Staphylococcus aureus
TTPDEQEAL

SEQ ID NO: 1633923 - protein, 15 aa, Staphylococcus aureus
TTPNQDNPLTEGKTP

SEQ ID NO: 1633924 - protein, 45 aa, Staphylococcus aureus
TTQAANTRQERTPKLEKAPNTNEEKTSASKIEKISQPKQEEQKSL

SEQ ID NO: 1633925 - protein, 4 aa, Staphylococcus aureus
TTRD

SEQ ID NO: 1633926 - protein, 6 aa, Staphylococcus aureus
TTTDNV

SEQ ID NO: 1633927 - protein, 7 aa, Staphylococcus aureus
TTTVPGL

SEQ ID NO: 1633928 - protein, 5 aa, Staphylococcus aureus
TTYDE

SEQ ID NO: 1633929 - protein, 10 aa, Staphylococcus aureus
TVEQKPKMDG

SEQ ID NO: 1633930 - protein, 11 aa, Staphylococcus aureus
TVKSNERGEVN

SEQ ID NO: 1633931 - protein, 16 aa, Staphylococcus aureus
TVNRTTNGHGKVEDYT

SEQ ID NO: 1633932 - protein, 9 aa, Staphylococcus aureus
TVNTTKAAL

SEQ ID NO: 1633933 - protein, 4 aa, Staphylococcus aureus
TWSH

SEQ ID NO: 1633934 - protein, 11 aa, Staphylococcus aureus
TYGPKTHGIKN

SEQ ID NO: 1633935 - protein, 9 aa, Staphylococcus aureus
TYGPTEATV

SEQ ID NO: 1633936 - protein, 15 aa, Staphylococcus aureus
TYPKEYERFKSNETI

SEQ ID NO: 1633937 - protein, 14 aa, Staphylococcus aureus
TYPRTDSRYITEDE

SEQ ID NO: 1633938 - protein, 4 aa, Staphylococcus aureus
TYTT

SEQ ID NO: 1633939 - protein, 16 aa, Staphylococcus aureus
VADKNQKSNSRKRRLS

SEQ ID NO: 1633940 - protein, 31 aa, Staphylococcus aureus; identical to SEQ ID NO: 1565791

SEQ ID NO: 1633941 - protein, 30 aa, Staphylococcus aureus; identical to SEQ ID NO: 1566512

SEQ ID NO: 1633942 - protein, 6 aa, Staphylococcus aureus
VAENDT

SEQ ID NO: 1633943 - protein, 17 aa, Staphylococcus aureus
VAKGNKSDVDKAVEAAD

SEQ ID NO: 1633944 - protein, 12 aa, Staphylococcus aureus
VAKRSEIPVVIV

SEQ ID NO: 1633945 - protein, 10 aa, Staphylococcus aureus
VAPGENLPSM

SEQ ID NO: 1633946 - protein, 5 aa, Staphylococcus aureus
VARNI

SEQ ID NO: 1633947 - protein, 8 aa, Staphylococcus aureus
VDDDDVVE

SEQ ID NO: 1633948 - protein, 15 aa, Staphylococcus aureus
VDDYPKDVKEGKKQF

SEQ ID NO: 1633949 - protein, 5 aa, Staphylococcus aureus
VDETE

SEQ ID NO: 1633950 - protein, 18 aa, Staphylococcus aureus
VDETKQLSATTQPSGQKV

SEQ ID NO: 1633951 - protein, 9 aa, Staphylococcus aureus
VDKEKETLS

SEQ ID NO: 1633952 - protein, 8 aa, Staphylococcus aureus
VDLPEGLA

SEQ ID NO: 1633953 - protein, 8 aa, Staphylococcus aureus
VDNEKDAL

SEQ ID NO: 1633954 - protein, 8 aa, Staphylococcus aureus
VDNTEGKV

SEQ ID NO: 1633955 - protein, 5 aa, Staphylococcus aureus
VDPEK

SEQ ID NO: 1633956 - protein, 11 aa, Staphylococcus aureus
VDPKLTTKEGK

SEQ ID NO: 1633957 - protein, 5 aa, Staphylococcus aureus
VDPQK

SEQ ID NO: 1633958 - protein, 16 aa, Staphylococcus aureus
VDTAQKYKLNDRDKEM

SEQ ID NO: 1633959 - protein, 10 aa, Staphylococcus aureus
VDTPKLESDG

SEQ ID NO: 1633960 - protein, 7 aa, Staphylococcus aureus
VDTTVEN

SEQ ID NO: 1633961 - protein, 11 aa, Staphylococcus aureus
VEAPDDEAVKT

SEQ ID NO: 1633962 - protein, 6 aa, Staphylococcus aureus
VEDGNL

SEQ ID NO: 1633963 - protein, 8 aa, Staphylococcus aureus
VEDKTSWN

SEQ ID NO: 1633964 - protein, 9 aa, Staphylococcus aureus
VEEAHKNNK

SEQ ID NO: 1633965 - protein, 6 aa, Staphylococcus aureus
VEGDAL

SEQ ID NO: 1633966 - protein, 26 aa, Staphylococcus aureus
VEIKDDNGNIVRDNNGNPKTERKPVI

SEQ ID NO: 1633967 - protein, 12 aa, Staphylococcus aureus
VEKPTSYTVKVG

SEQ ID NO: 1633968 - protein, 12 aa, Staphylococcus aureus
VELNTPKSVEIR

SEQ ID NO: 1633969 - protein, 4 aa, Staphylococcus aureus
VEMK

SEQ ID NO: 1633970 - protein, 15 aa, Staphylococcus aureus
VENDENNDKAQTVIP

SEQ ID NO: 1633971 - protein, 10 aa, Staphylococcus aureus
VENRKNSQVA

SEQ ID NO: 1633972 - protein, 10 aa, Staphylococcus aureus
VEPGNSGSAV

SEQ ID NO: 1633973 - protein, 8 aa, Staphylococcus aureus
VEQDDMKK

SEQ ID NO: 1633974 - protein, 9 aa, Staphylococcus aureus
VESGDTHTV

SEQ ID NO: 1633975 - protein, 15 aa, Staphylococcus aureus
VETSTLGEESENDFI

SEQ ID NO: 1633976 - protein, 16 aa, Staphylococcus aureus
VETSTLGEESENDFIG

SEQ ID NO: 1633977 - protein, 7 aa, Staphylococcus aureus
VEYSNEK

SEQ ID NO: 1633978 - protein, 4 aa, Staphylococcus aureus
VGDE

SEQ ID NO: 1633979 - protein, 5 aa, Staphylococcus aureus
VGDRK

SEQ ID NO: 1633980 - protein, 7 aa, Staphylococcus aureus
VGEQRNK

SEQ ID NO: 1633981 - protein, 24 aa, Staphylococcus aureus
VGGATTERNRITNSNKQCKLAGAP

SEQ ID NO: 1633982 - protein, 6 aa, Staphylococcus aureus
VGINNS

SEQ ID NO: 1633983 - protein, 22 aa, Staphylococcus aureus
VGKKGGVFGTTQGLQQQYGEDR

SEQ ID NO: 1633984 - protein, 8 aa, Staphylococcus aureus
VGNGVTTP

SEQ ID NO: 1633985 - protein, 4 aa, Staphylococcus aureus
VGNR

SEQ ID NO: 1633986 - protein, 6 aa, Staphylococcus aureus
VGPQHR

SEQ ID NO: 1633987 - protein, 14 aa, Staphylococcus aureus
VGQGFQPPAEKDAI

SEQ ID NO: 1633988 - protein, 9 aa, Staphylococcus aureus
VGRDGEVQG

SEQ ID NO: 1633989 - protein, 7 aa, Staphylococcus aureus
VIEQGPV

SEQ ID NO: 1633990 - protein, 21 aa, Staphylococcus aureus
VIGPQKGSKPRQVLIDLNNDE

SEQ ID NO: 1633991 - protein, 17 aa, Staphylococcus aureus
VKAPVKNEKNPPVPAGY

SEQ ID NO: 1633992 - protein, 18 aa, Staphylococcus aureus
VKAPVKNEKNPPVPAGYT

SEQ ID NO: 1633993 - protein, 8 aa, Staphylococcus aureus
VKDDEVST

SEQ ID NO: 1633994 - protein, 12 aa, Staphylococcus aureus
VKDKADEDGGNF

SEQ ID NO: 1633995 - protein, 11 aa, Staphylococcus aureus
VKDPALKQKIE

SEQ ID NO: 1633996 - protein, 12 aa, Staphylococcus aureus
VKDTEIKNGKKV

SEQ ID NO: 1633997 - protein, 10 aa, Staphylococcus aureus
VKDYGNARKY

SEQ ID NO: 1633998 - protein, 17 aa, Staphylococcus aureus
VKEAPMPKDETAQLESV

SEQ ID NO: 1633999 - protein, 18 aa, Staphylococcus aureus
VKEAPMSKEETAQPESIE

SEQ ID NO: 1634000 - protein, 4 aa, Staphylococcus aureus
VKEG

SEQ ID NO: 1634001 - protein, 6 aa, Staphylococcus aureus
VKEKPM

SEQ ID NO: 1634002 - protein, 5 aa, Staphylococcus aureus
VKENL

SEQ ID NO: 1634003 - protein, 8 aa, Staphylococcus aureus
VKEPKKKI

SEQ ID NO: 1634004 - protein, 20 aa, Staphylococcus aureus
VKGSSDETIEVTNPATGETL

SEQ ID NO: 1634005 - protein, 9 aa, Staphylococcus aureus
VKGTTKKEV

SEQ ID NO: 1634006 - protein, 8 aa, Staphylococcus aureus
VKIQEDAS

SEQ ID NO: 1634007 - protein, 7 aa, Staphylococcus aureus
VKQSRKR

SEQ ID NO: 1634008 - protein, 5 aa, Staphylococcus aureus
VKSNY

SEQ ID NO: 1634009 - protein, 13 aa, Staphylococcus aureus
VKTGTKAKADSYV

SEQ ID NO: 1634010 - protein, 16 aa, Staphylococcus aureus
VKYTENNVRWGFKKLK

SEQ ID NO: 1634011 - protein, 24 aa, Staphylococcus aureus
VNAAKQALNGNANVQHAKDEATAL

SEQ ID NO: 1634012 - protein, 5 aa, Staphylococcus aureus
VNADN

SEQ ID NO: 1634013 - protein, 12 aa, Staphylococcus aureus
VNDQDELKNQSR

SEQ ID NO: 1634014 - protein, 16 aa, Staphylococcus aureus
VNEKRGIKEPESDVPE

SEQ ID NO: 1634015 - protein, 4 aa, Staphylococcus aureus
VNIK

SEQ ID NO: 1634016 - protein, 6 aa, Staphylococcus aureus
VNIQNK

SEQ ID NO: 1634017 - protein, 4 aa, Staphylococcus aureus
VNKD

SEQ ID NO: 1634018 - protein, 9 aa, Staphylococcus aureus
VNKGTPEFK

SEQ ID NO: 1634019 - protein, 13 aa, Staphylococcus aureus
VNNDKSKVGSPTR

SEQ ID NO: 1634020 - protein, 13 aa, Staphylococcus aureus
VNNNFKGDFQEAE

SEQ ID NO: 1634021 - protein, 11 aa, Staphylococcus aureus
VNNRKSQAIPE

SEQ ID NO: 1634022 - protein, 8 aa, Staphylococcus aureus
VNPTSDGE

SEQ ID NO: 1634023 - protein, 7 aa, Staphylococcus aureus
VNQPEDV

SEQ ID NO: 1634024 - protein, 7 aa, Staphylococcus aureus
VNRKETW

SEQ ID NO: 1634025 - protein, 4 aa, Staphylococcus aureus
VNRS

SEQ ID NO: 1634026 - protein, 7 aa, Staphylococcus aureus
VNSHTSA

SEQ ID NO: 1634027 - protein, 7 aa, Staphylococcus aureus
VNSLGST

SEQ ID NO: 1634028 - protein, 6 aa, Staphylococcus aureus
VNSNKL

SEQ ID NO: 1634029 - protein, 25 aa, Staphylococcus aureus
VNTAKTALNGDARLNEAKNTAKQQL

SEQ ID NO: 1634030 - protein, 26 aa, Staphylococcus aureus
VNTAKTALNGDERLNEAKNTAKQQVA

SEQ ID NO: 1634031 - protein, 6 aa, Staphylococcus aureus
VPESNV

SEQ ID NO: 1634032 - protein, 15 aa, Staphylococcus aureus
VPKSIAEDIIKKNKG

SEQ ID NO: 1634033 - protein, 7 aa, Staphylococcus aureus
VPKYPRN

SEQ ID NO: 1634034 - protein, 16 aa, Staphylococcus aureus
VPRKERKNILKGGELN

SEQ ID NO: 1634035 - protein, 9 aa, Staphylococcus aureus
VPTQKLTKS

SEQ ID NO: 1634036 - protein, 8 aa, Staphylococcus aureus
VPTSSANY

SEQ ID NO: 1634037 - protein, 31 aa, Staphylococcus aureus; identical to SEQ ID NO: 1565986

SEQ ID NO: 1634038 - protein, 8 aa, Staphylococcus aureus
VQKGTGKF

SEQ ID NO: 1634039 - protein, 16 aa, Staphylococcus aureus
VQKRNPEQSEEQKRIS

SEQ ID NO: 1634040 - protein, 34 aa, Staphylococcus aureus
VQNDNLSKSNEKIENSYAKTNTKLKQTEKEFNDL

SEQ ID NO: 1634041 - protein, 6 aa, Staphylococcus aureus
VQNQDM

SEQ ID NO: 1634042 - protein, 10 aa, Staphylococcus aureus
VQPARGPKKE

SEQ ID NO: 1634043 - protein, 27 aa, Staphylococcus aureus
VQRAKNELNGNQNVANAKTTAKNALNN

SEQ ID NO: 1634044 - protein, 18 aa, Staphylococcus aureus
VRATKAKDDNSANAIAND

SEQ ID NO: 1634045 - protein, 18 aa, Staphylococcus aureus
VRATKAKDDNSASAIAND

SEQ ID NO: 1634046 - protein, 9 aa, Staphylococcus aureus
VRQGKMDPV

SEQ ID NO: 1634047 - protein, 4 aa, Staphylococcus aureus
VSAP

SEQ ID NO: 1634048 - protein, 17 aa, Staphylococcus aureus
VSATSTLNDGSIFTIQF

SEQ ID NO: 1634049 - protein, 11 aa, Staphylococcus aureus
VSEKKNEDQKE

SEQ ID NO: 1634050 - protein, 9 aa, Staphylococcus aureus
VSERSLADK

SEQ ID NO: 1634051 - protein, 32 aa, Staphylococcus aureus; identical to SEQ ID NO: 1566983

SEQ ID NO: 1634052 - protein, 7 aa, Staphylococcus aureus
VSIEEKA

SEQ ID NO: 1634053 - protein, 6 aa, Staphylococcus aureus
VSNEQE

SEQ ID NO: 1634054 - protein, 6 aa, Staphylococcus aureus
VSNVTN

SEQ ID NO: 1634055 - protein, 5 aa, Staphylococcus aureus
VSRQT

SEQ ID NO: 1634056 - protein, 15 aa, Staphylococcus aureus
VSSQDNNLSSSDAIR

SEQ ID NO: 1634057 - protein, 13 aa, Staphylococcus aureus
VSTQQVAQSGRHS

SEQ ID NO: 1634058 - protein, 6 aa, Staphylococcus aureus
VSTRKV

SEQ ID NO: 1634059 - protein, 5 aa, Staphylococcus aureus
VTDED

SEQ ID NO: 1634060 - protein, 15 aa, Staphylococcus aureus
VTEGQTYASVSSTGL

SEQ ID NO: 1634061 - protein, 16 aa, Staphylococcus aureus
VTEQEEYKSKQEEIED

SEQ ID NO: 1634062 - protein, 26 aa, Staphylococcus aureus
VTETEPGIKGDTATGATKSATVETGY

SEQ ID NO: 1634063 - protein, 11 aa, Staphylococcus aureus
VTGHSAEVSFK

SEQ ID NO: 1634064 - protein, 10 aa, Staphylococcus aureus
VTHDPTTDYY

SEQ ID NO: 1634065 - protein, 12 aa, Staphylococcus aureus
VTINNKDNSYNQ

SEQ ID NO: 1634066 - protein, 4 aa, Staphylococcus aureus
VTKT

SEQ ID NO: 1634067 - protein, 9 aa, Staphylococcus aureus
VTLSNDTTN

SEQ ID NO: 1634068 - protein, 7 aa, Staphylococcus aureus
VTPSSKV

SEQ ID NO: 1634069 - protein, 32 aa, Staphylococcus aureus
VTSDRDASRGDDGTEDIKATDIGYPATTSKDQ

SEQ ID NO: 1634070 - protein, 12 aa, Staphylococcus aureus
VTSRDDKNEIAK

SEQ ID NO: 1634071 - protein, 38 aa, Staphylococcus aureus
VTSRDSHATEEDKELERDKEKDIDKNLSSNNSATDVTH

SEQ ID NO: 1634072 - protein, 10 aa, Staphylococcus aureus
VTTGDKDVEI

SEQ ID NO: 1634073 - protein, 27 aa, Staphylococcus aureus
VTTHANGQVSYGARLTQKKPSETNAYN

SEQ ID NO: 1634074 - protein, 27 aa, Staphylococcus aureus
VTTHANGQVSYGARPTQKKPSETNAYN

SEQ ID NO: 1634075 - protein, 8 aa, Staphylococcus aureus
VVERPSSV

SEQ ID NO: 1634076 - protein, 19 aa, Staphylococcus aureus
VVSETTDKKGHATYSDDND

SEQ ID NO: 1634077 - protein, 23 aa, Staphylococcus aureus
VYGNNKRKMQRGFSTKREAKSAE

SEQ ID NO: 1634078 - protein, 6 aa, Staphylococcus aureus
VYPNGH

SEQ ID NO: 1634079 - protein, 9 aa, Staphylococcus aureus
WDGSAKGDI

SEQ ID NO: 1634080 - protein, 10 aa, Staphylococcus aureus
WDKGDAKLSV

SEQ ID NO: 1634081 - protein, 27 aa, Staphylococcus aureus
WDNAAAADGYTIDNRPTVGSIAQTDVG

SEQ ID NO: 1634082 - protein, 4 aa, Staphylococcus aureus
WGKG

SEQ ID NO: 1634083 - protein, 21 aa, Staphylococcus aureus
WPKKPSKKRKTKYFGGKVKSG

SEQ ID NO: 1634084 - protein, 12 aa, Staphylococcus aureus
WRGGRNNVGNVQ

SEQ ID NO: 1634085 - protein, 10 aa, Staphylococcus aureus
WRGKRSTDDI

SEQ ID NO: 1634086 - protein, 11 aa, Staphylococcus aureus
WSKKKKNEMVG

SEQ ID NO: 1634087 - protein, 7 aa, Staphylococcus aureus
YADEDEL

SEQ ID NO: 1634088 - protein, 9 aa, Staphylococcus aureus
YADKNHSHT

SEQ ID NO: 1634089 - protein, 10 aa, Staphylococcus aureus
YAEGHPGRRY

SEQ ID NO: 1634090 - protein, 14 aa, Staphylococcus aureus
YAESFNDHTKLGTQ

SEQ ID NO: 1634091 - protein, 12 aa, Staphylococcus aureus
YAGSKEKAETVV

SEQ ID NO: 1634092 - protein, 7 aa, Staphylococcus aureus
YAHPNDK

SEQ ID NO: 1634093 - protein, 6 aa, Staphylococcus aureus
YAKDRD

SEQ ID NO: 1634094 - protein, 15 aa, Staphylococcus aureus
YAKEGADVAINYLPS

SEQ ID NO: 1634095 - protein, 8 aa, Staphylococcus aureus
YAKPATSL

SEQ ID NO: 1634096 - protein, 5 aa, Staphylococcus aureus
YAPNG

SEQ ID NO: 1634097 - protein, 16 aa, Staphylococcus aureus
YATGAGGSRAKKIPWS

SEQ ID NO: 1634098 - protein, 11 aa, Staphylococcus aureus
YATKREGEHMS

SEQ ID NO: 1634099 - protein, 8 aa, Staphylococcus aureus
YCKENNKG

SEQ ID NO: 1634100 - protein, 6 aa, Staphylococcus aureus
YDAKTK

SEQ ID NO: 1634101 - protein, 9 aa, Staphylococcus aureus
YDEELGARP

SEQ ID NO: 1634102 - protein, 20 aa, Staphylococcus aureus
YDKEGYRDGEFKKGDKGTWT

SEQ ID NO: 1634103 - protein, 11 aa, Staphylococcus aureus
YDNPKGYYDST

SEQ ID NO: 1634104 - protein, 11 aa, Staphylococcus aureus
YDSKTNTTTYT

SEQ ID NO: 1634105 - protein, 4 aa, Staphylococcus aureus
YDSQ

SEQ ID NO: 1634106 - protein, 11 aa, Staphylococcus aureus
YEAGKENELER

SEQ ID NO: 1634107 - protein, 6 aa, Staphylococcus aureus
YEAKTK

SEQ ID NO: 1634108 - protein, 4 aa, Staphylococcus aureus
YEDF

SEQ ID NO: 1634109 - protein, 4 aa, Staphylococcus aureus
YEDP

SEQ ID NO: 1634110 - protein, 9 aa, Staphylococcus aureus
YEEDESNYE

SEQ ID NO: 1634111 - protein, 16 aa, Staphylococcus aureus
YEEDTNPGGGQVTTES

SEQ ID NO: 1634112 - protein, 13 aa, Staphylococcus aureus
YEEGNRFNHDPLR

SEQ ID NO: 1634113 - protein, 22 aa, Staphylococcus aureus
YEEKGNNLNTEDIQNSNQEMND

SEQ ID NO: 1634114 - protein, 10 aa, Staphylococcus aureus
YEETKQSDPI

SEQ ID NO: 1634115 - protein, 11 aa, Staphylococcus aureus
YEGNKSGKIRF

SEQ ID NO: 1634116 - protein, 5 aa, Staphylococcus aureus
YENGE

SEQ ID NO: 1634117 - protein, 7 aa, Staphylococcus aureus
YEPATNG

SEQ ID NO: 1634118 - protein, 24 aa, Staphylococcus aureus
YEPKTTSKSEQQLKEIYNNILKQR

SEQ ID NO: 1634119 - protein, 6 aa, Staphylococcus aureus
YEQDEQ

SEQ ID NO: 1634120 - protein, 8 aa, Staphylococcus aureus
YEQNDRYD

SEQ ID NO: 1634121 - protein, 16 aa, Staphylococcus aureus
YERKDHEGVFHTQWDE

SEQ ID NO: 1634122 - protein, 5 aa, Staphylococcus aureus
YERKR

SEQ ID NO: 1634123 - protein, 4 aa, Staphylococcus aureus
YEVS

SEQ ID NO: 1634124 - protein, 16 aa, Staphylococcus aureus
YFGPYPNAYSAQETKK

SEQ ID NO: 1634125 - protein, 4 aa, Staphylococcus aureus
YGGP

SEQ ID NO: 1634126 - protein, 9 aa, Staphylococcus aureus
YGHNTSDKH

SEQ ID NO: 1634127 - protein, 4 aa, Staphylococcus aureus
YGKH

SEQ ID NO: 1634128 - protein, 13 aa, Staphylococcus aureus
YGNNDKDKKEGIH

SEQ ID NO: 1634129 - protein, 14 aa, Staphylococcus aureus
YGNQSRTTDNRGSV

SEQ ID NO: 1634130 - protein, 6 aa, Staphylococcus aureus
YGNVGS

SEQ ID NO: 1634131 - protein, 12 aa, Staphylococcus aureus
YGSISAEAHETL

SEQ ID NO: 1634132 - protein, 5 aa, Staphylococcus aureus
YGSSK

SEQ ID NO: 1634133 - protein, 12 aa, Staphylococcus aureus
YGTIDSEENISY

SEQ ID NO: 1634134 - protein, 11 aa, Staphylococcus aureus
YGVQKDADEVD

SEQ ID NO: 1634135 - protein, 11 aa, Staphylococcus aureus
YGVQKDADEVE

SEQ ID NO: 1634136 - protein, 11 aa, Staphylococcus aureus
YHNDKNKNLEI

SEQ ID NO: 1634137 - protein, 12 aa, Staphylococcus aureus
YHSKGLESWKEK

SEQ ID NO: 1634138 - protein, 12 aa, Staphylococcus aureus
YKDIENGLKGEE

SEQ ID NO: 1634139 - protein, 4 aa, Staphylococcus aureus
YKDK

SEQ ID NO: 1634140 - protein, 11 aa, Staphylococcus aureus
YKEAGKPTYPH

SEQ ID NO: 1634141 - protein, 4 aa, Staphylococcus aureus
YKEQ

SEQ ID NO: 1634142 - protein, 5 aa, Staphylococcus aureus
YKGKN

SEQ ID NO: 1634143 - protein, 20 aa, Staphylococcus aureus
YKGKNHSKQRHELKNKRGMH

SEQ ID NO: 1634144 - protein, 4 aa, Staphylococcus aureus
YKGN

SEQ ID NO: 1634145 - protein, 9 aa, Staphylococcus aureus
YKNEDFAES

SEQ ID NO: 1634146 - protein, 11 aa, Staphylococcus aureus
YKNNAETEKYR

SEQ ID NO: 1634147 - protein, 6 aa, Staphylococcus aureus
YKPNGE

SEQ ID NO: 1634148 - protein, 5 aa, Staphylococcus aureus
YKRNS

SEQ ID NO: 1634149 - protein, 4 aa, Staphylococcus aureus
YKSD

SEQ ID NO: 1634150 - protein, 11 aa, Staphylococcus aureus
YKSRKEEALSK

SEQ ID NO: 1634151 - protein, 5 aa, Staphylococcus aureus
YKTGS

SEQ ID NO: 1634152 - protein, 10 aa, Staphylococcus aureus
YKTKPYNYKN

SEQ ID NO: 1634153 - protein, 10 aa, Staphylococcus aureus
YLPGDEAGIK

SEQ ID NO: 1634154 - protein, 6 aa, Staphylococcus aureus
YLPTGE

SEQ ID NO: 1634155 - protein, 26 aa, Staphylococcus aureus
YNEKKKKFEKNWEDAQKAGNAVGKDI

SEQ ID NO: 1634156 - protein, 10 aa, Staphylococcus aureus
YNESSKRYKY

SEQ ID NO: 1634157 - protein, 6 aa, Staphylococcus aureus
YNGDTK

SEQ ID NO: 1634158 - protein, 9 aa, Staphylococcus aureus
YNISTEKSP

SEQ ID NO: 1634159 - protein, 10 aa, Staphylococcus aureus
YNKNKNIKKF

SEQ ID NO: 1634160 - protein, 12 aa, Staphylococcus aureus
YNKNTKETMPFN

SEQ ID NO: 1634161 - protein, 7 aa, Staphylococcus aureus
YNLTPKD

SEQ ID NO: 1634162 - protein, 12 aa, Staphylococcus aureus
YNQLSKQPNQIN

SEQ ID NO: 1634163 - protein, 5 aa, Staphylococcus aureus
YNQTI

SEQ ID NO: 1634164 - protein, 9 aa, Staphylococcus aureus
YNSNFEKED

SEQ ID NO: 1634165 - protein, 27 aa, Staphylococcus aureus
YNSNFEKEDVPNASKQQSESDLSDEEL

SEQ ID NO: 1634166 - protein, 27 aa, Staphylococcus aureus
YNSNFEKEDVPNASSQQSESDLSDEEL

SEQ ID NO: 1634167 - protein, 8 aa, Staphylococcus aureus
YNYDPRTV

SEQ ID NO: 1634168 - protein, 6 aa, Staphylococcus aureus
YPDEAY

SEQ ID NO: 1634169 - protein, 6 aa, Staphylococcus aureus
YPGISA

SEQ ID NO: 1634170 - protein, 32 aa, Staphylococcus aureus
YPISTDNASWRSPNTEAVGKSAYKNEQVGGAP

SEQ ID NO: 1634171 - protein, 17 aa, Staphylococcus aureus
YPKYARASYKNAKVPTL

SEQ ID NO: 1634172 - protein, 10 aa, Staphylococcus aureus
YPPQTLTEDE

SEQ ID NO: 1634173 - protein, 12 aa, Staphylococcus aureus
YPRKGYDPTDER

SEQ ID NO: 1634174 - protein, 9 aa, Staphylococcus aureus
YQATSDINT

SEQ ID NO: 1634175 - protein, 10 aa, Staphylococcus aureus
YQDGTTSTVT

SEQ ID NO: 1634176 - protein, 10 aa, Staphylococcus aureus
YQGNSELTLS

SEQ ID NO: 1634177 - protein, 8 aa, Staphylococcus aureus
YQQYSKDH

SEQ ID NO: 1634178 - protein, 5 aa, Staphylococcus aureus
YQTRR

SEQ ID NO: 1634179 - protein, 10 aa, Staphylococcus aureus
YRASTTNKKT

SEQ ID NO: 1634180 - protein, 10 aa, Staphylococcus aureus
YREETISGAN

SEQ ID NO: 1634181 - protein, 9 aa, Staphylococcus aureus
YRENGESQY

SEQ ID NO: 1634182 - protein, 11 aa, Staphylococcus aureus
YRGEEKDSDDV

SEQ ID NO: 1634183 - protein, 4 aa, Staphylococcus aureus
YRGN

SEQ ID NO: 1634184 - protein, 14 aa, Staphylococcus aureus
YRKDRSSKDKQYKM

SEQ ID NO: 1634185 - protein, 23 aa, Staphylococcus aureus
YRLPKSGISTQSVHSADMTGKEE

SEQ ID NO: 1634186 - protein, 18 aa, Staphylococcus aureus
YRPNAVARGLASKKTTTV

SEQ ID NO: 1634187 - protein, 6 aa, Staphylococcus aureus
YRPSDG

SEQ ID NO: 1634188 - protein, 8 aa, Staphylococcus aureus
YRQQADDL

SEQ ID NO: 1634189 - protein, 7 aa, Staphylococcus aureus
YRRPASD

SEQ ID NO: 1634190 - protein, 5 aa, Staphylococcus aureus
YRTSK

SEQ ID NO: 1634191 - protein, 4 aa, Staphylococcus aureus
YRVP

SEQ ID NO: 1634192 - protein, 10 aa, Staphylococcus aureus
YRVSDNPHTY

SEQ ID NO: 1634193 - protein, 4 aa, Staphylococcus aureus
YSDK

SEQ ID NO: 1634194 - protein, 16 aa, Staphylococcus aureus
YSDNGYVSNTSGFTKQ

SEQ ID NO: 1634195 - protein, 4 aa, Staphylococcus aureus
YSEF

SEQ ID NO: 1634196 - protein, 5 aa, Staphylococcus aureus
YSETL

SEQ ID NO: 1634197 - protein, 15 aa, Staphylococcus aureus
YSFSDDQTLLGAPSG

SEQ ID NO: 1634198 - protein, 6 aa, Staphylococcus aureus
YSIEAK

SEQ ID NO: 1634199 - protein, 33 aa, Staphylococcus aureus
YSKRELSKVEKTLNKNKYDSVDEAVKAGLQLVV

SEQ ID NO: 1634200 - protein, 5 aa, Staphylococcus aureus
YSKRQ

SEQ ID NO: 1634201 - protein, 17 aa, Staphylococcus aureus
YSPKSKKDTSTPAAFGK

SEQ ID NO: 1634202 - protein, 5 aa, Staphylococcus aureus
YSQDH

SEQ ID NO: 1634203 - protein, 5 aa, Staphylococcus aureus
YSRTG

SEQ ID NO: 1634204 - protein, 5 aa, Staphylococcus aureus
YSSNM

SEQ ID NO: 1634205 - protein, 8 aa, Staphylococcus aureus
YTEKEQKK

SEQ ID NO: 1634206 - protein, 13 aa, Staphylococcus aureus
YTENTPKSYDPTK

SEQ ID NO: 1634207 - protein, 17 aa, Staphylococcus aureus
YTGVSSHTGPLGYENPD

SEQ ID NO: 1634208 - protein, 13 aa, Staphylococcus aureus
YTIDDSVKEGDTF

SEQ ID NO: 1634209 - protein, 7 aa, Staphylococcus aureus
YTNAYDV

SEQ ID NO: 1634210 - protein, 11 aa, Staphylococcus aureus
YTNSDDTEKEF

SEQ ID NO: 1634211 - protein, 13 aa, Staphylococcus aureus
YTPRMEGANEEIR

SEQ ID NO: 1634212 - protein, 11 aa, Staphylococcus aureus
YTRSITNGRLE

SEQ ID NO: 1634213 - protein, 7 aa, Staphylococcus aureus
YTTPVPE

SEQ ID NO: 1634214 - protein, 10 aa, Staphylococcus aureus
YVTKKGNPFS

SEQ ID NO: 1634215 - protein, 12 aa, Staphylococcus aureus
YYEAGKENELER

SEQ ID NO: 1634216 - protein, 14 aa, Staphylococcus aureus
YYNRDEDDSITGKS

SEQ ID NO: 1634217 - protein, 10 aa, Staphylococcus aureus
YYSDKKDVMK

SEQ ID NO: 1634218 - protein, 10 aa, Staphylococcus aureus
AAALSGTTYP

SEQ ID NO: 1634219 - protein, 13 aa, Staphylococcus aureus
AAANNEKSQAIPE

SEQ ID NO: 1634220 - protein, 10 aa, Staphylococcus aureus
AAAPDIYDYD

SEQ ID NO: 1634221 - protein, 27 aa, Staphylococcus aureus
AAASAPPAAPATATGAAAVTPNSSSIA

SEQ ID NO: 1634222 - protein, 32 aa, Staphylococcus aureus; identical to SEQ ID NO: 1565495

SEQ ID NO: 1634223 - protein, 92 aa, Staphylococcus aureus; identical to SEQ ID NO: 1566529

SEQ ID NO: 1634224 - protein, 14 aa, Staphylococcus aureus
AADEKTNETTEEIQ

SEQ ID NO: 1634225 - protein, 116 aa, Staphylococcus aureus
AAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQ

SEQ ID NO: 1634226 - protein, 81 aa, Staphylococcus aureus
AAEHTNGELNQSKNETTAPSENKTTKKVDSHQQNNIEQSTTSDQPKVNESDNTSVKETTEEPQNTTSTQSTKQNNDATAKI

SEQ ID NO: 1634227 - protein, 12 aa, Staphylococcus aureus
AAEKLKNSETLT

SEQ ID NO: 1634228 - protein, 4 aa, Staphylococcus aureus
AAEL

SEQ ID NO: 1634229 - protein, 12 aa, Staphylococcus aureus
AAESHTVSTNPY

SEQ ID NO: 1634230 - protein, 20 aa, Staphylococcus aureus
AAESITDPTNGSNANKDAVD

SEQ ID NO: 1634231 - protein, 22 aa, Staphylococcus aureus
AAESITDPTNGSNANKDAVEQA

SEQ ID NO: 1634232 - protein, 20 aa, Staphylococcus aureus
AAGAYTAYSAANAATGKNII

SEQ ID NO: 1634233 - protein, 6 aa, Staphylococcus aureus
AAGDVE

SEQ ID NO: 1634234 - protein, 9 aa, Staphylococcus aureus
AAGENASGG

SEQ ID NO: 1634235 - protein, 8 aa, Staphylococcus aureus
AAGTGKST

SEQ ID NO: 1634236 - protein, 33 aa, Staphylococcus aureus
AAHSNQSNQSMNNNDLTASKAHDNSDVSTNDYH

SEQ ID NO: 1634237 - protein, 35 aa, Staphylococcus aureus
AAHSNQSNQSMNNNDLTASKVNDNSDVSTNDYHDI

SEQ ID NO: 1634238 - protein, 33 aa, Staphylococcus aureus
AAHSNQSNQSMNNNDLTVSKANDNSDVSTNDYH

SEQ ID NO: 1634239 - protein, 8 aa, Staphylococcus aureus
AAKDDSDV

SEQ ID NO: 1634240 - protein, 8 aa, Staphylococcus aureus
AAKEITGE

SEQ ID NO: 1634241 - protein, 7 aa, Staphylococcus aureus
AAKKHDV

SEQ ID NO: 1634242 - protein, 23 aa, Staphylococcus aureus
AAKTQNFHNQHQNSKHRNKTKCY

SEQ ID NO: 1634243 - protein, 27 aa, Staphylococcus aureus
AAKTQNFHNQHQNSKHRNKTKCYNKSI

SEQ ID NO: 1634244 - protein, 7 aa, Staphylococcus aureus
AAMSDNE

SEQ ID NO: 1634245 - protein, 8 aa, Staphylococcus aureus
AANKIKPD

SEQ ID NO: 1634246 - protein, 5 aa, Staphylococcus aureus
AANNI

SEQ ID NO: 1634247 - protein, 8 aa, Staphylococcus aureus
AAQASGIS

SEQ ID NO: 1634248 - protein, 14 aa, Staphylococcus aureus
AAQIAKKAHKESLT

SEQ ID NO: 1634249 - protein, 6 aa, Staphylococcus aureus
AAQNHA

SEQ ID NO: 1634250 - protein, 12 aa, Staphylococcus aureus
AARDAVSHDAQQ

SEQ ID NO: 1634251 - protein, 7 aa, Staphylococcus aureus
AARKRPG

SEQ ID NO: 1634252 - protein, 7 aa, Staphylococcus aureus
AARNKNI

SEQ ID NO: 1634253 - protein, 8 aa, Staphylococcus aureus
AASEQNDN

SEQ ID NO: 1634254 - protein, 7 aa, Staphylococcus aureus
AASEQSN

SEQ ID NO: 1634255 - protein, 10 aa, Staphylococcus aureus
AASGKAFAEV

SEQ ID NO: 1634256 - protein, 9 aa, Staphylococcus aureus
AASGNSIDT

SEQ ID NO: 1634257 - protein, 8 aa, Staphylococcus aureus
AASGVGTT

SEQ ID NO: 1634258 - protein, 7 aa, Staphylococcus aureus
AASYSNE

SEQ ID NO: 1634259 - protein, 5 aa, Staphylococcus aureus
AATKP

SEQ ID NO: 1634260 - protein, 14 aa, Staphylococcus aureus
AATNAANVALGLNA

SEQ ID NO: 1634261 - protein, 7 aa, Staphylococcus aureus
AATNATN

SEQ ID NO: 1634262 - protein, 6 aa, Staphylococcus aureus
AATRNQ

SEQ ID NO: 1634263 - protein, 5 aa, Staphylococcus aureus
AATTK

SEQ ID NO: 1634264 - protein, 9 aa, Staphylococcus aureus
AAVDNDTAA

SEQ ID NO: 1634265 - protein, 12 aa, Staphylococcus aureus
AAVGKSTIAKRV

SEQ ID NO: 1634266 - protein, 9 aa, Staphylococcus aureus
AAVKGDEAK

SEQ ID NO: 1634267 - protein, 10 aa, Staphylococcus aureus
AAVTLGTSAR

SEQ ID NO: 1634268 - protein, 7 aa, Staphylococcus aureus
AAYDQGA

SEQ ID NO: 1634269 - protein, 12 aa, Staphylococcus aureus
AAYTAATGRPFH

SEQ ID NO: 1634270 - protein, 5 aa, Staphylococcus aureus
ACGTG

SEQ ID NO: 1634271 - protein, 15 aa, Staphylococcus aureus
ACTNDAGTRATLYTF

SEQ ID NO: 1634272 - protein, 9 aa, Staphylococcus aureus
ADAGIQPED

SEQ ID NO: 1634273 - protein, 9 aa, Staphylococcus aureus
ADAKDPQKR

SEQ ID NO: 1634274 - protein, 7 aa, Staphylococcus aureus
ADDKAGL

SEQ ID NO: 1634275 - protein, 10 aa, Staphylococcus aureus
ADDPKGGCSS

SEQ ID NO: 1634276 - protein, 5 aa, Staphylococcus aureus
ADDRA

SEQ ID NO: 1634277 - protein, 4 aa, Staphylococcus aureus
ADDT

SEQ ID NO: 1634278 - protein, 22 aa, Staphylococcus aureus
ADEFSNQYKKKIEDANKLSKSE

SEQ ID NO: 1634279 - protein, 4 aa, Staphylococcus aureus
ADEI

SEQ ID NO: 1634280 - protein, 12 aa, Staphylococcus aureus
ADESFDGDALKY

SEQ ID NO: 1634281 - protein, 8 aa, Staphylococcus aureus
ADFNNDDI

SEQ ID NO: 1634282 - protein, 4 aa, Staphylococcus aureus
ADGA

SEQ ID NO: 1634283 - protein, 11 aa, Staphylococcus aureus
ADGSDESDAIQ

SEQ ID NO: 1634284 - protein, 15 aa, Staphylococcus aureus
ADGSMKRYEALKRIE

SEQ ID NO: 1634285 - protein, 7 aa, Staphylococcus aureus
ADGTMNA

SEQ ID NO: 1634286 - protein, 8 aa, Staphylococcus aureus
ADGTMNAL

SEQ ID NO: 1634287 - protein, 6 aa, Staphylococcus aureus
ADGVGI

SEQ ID NO: 1634288 - protein, 7 aa, Staphylococcus aureus
ADGWTPD

SEQ ID NO: 1634289 - protein, 5 aa, Staphylococcus aureus
ADIEN

SEQ ID NO: 1634290 - protein, 11 aa, Staphylococcus aureus
ADINKTQKRLV

SEQ ID NO: 1634291 - protein, 32 aa, Staphylococcus aureus
ADKERTKASGNYVNADQEKRQAYDSKVTNAEN

SEQ ID NO: 1634292 - protein, 19 aa, Staphylococcus aureus
ADKGKKALETLSKKSQEEI

SEQ ID NO: 1634293 - protein, 7 aa, Staphylococcus aureus
ADKKYKN

SEQ ID NO: 1634294 - protein, 9 aa, Staphylococcus aureus
ADKTTTLAS

SEQ ID NO: 1634295 - protein, 6 aa, Staphylococcus aureus
ADLGGK

SEQ ID NO: 1634296 - protein, 8 aa, Staphylococcus aureus
ADNAFDAA

SEQ ID NO: 1634297 - protein, 6 aa, Staphylococcus aureus
ADNMTL

SEQ ID NO: 1634298 - protein, 7 aa, Staphylococcus aureus
ADNTPLN

SEQ ID NO: 1634299 - protein, 11 aa, Staphylococcus aureus
ADPEVDGTKSE

SEQ ID NO: 1634300 - protein, 6 aa, Staphylococcus aureus
ADQART

SEQ ID NO: 1634301 - protein, 31 aa, Staphylococcus aureus
ADQKKNNISADTNATQDEKQQAIKQVDQNVQ

SEQ ID NO: 1634302 - protein, 5 aa, Staphylococcus aureus
ADQLA

SEQ ID NO: 1634303 - protein, 5 aa, Staphylococcus aureus
ADQPL

SEQ ID NO: 1634304 - protein, 14 aa, Staphylococcus aureus
ADRGVSGKSMNRPE

SEQ ID NO: 1634305 - protein, 6 aa, Staphylococcus aureus
ADRNRI

SEQ ID NO: 1634306 - protein, 8 aa, Staphylococcus aureus
ADSAEGKF

SEQ ID NO: 1634307 - protein, 5 aa, Staphylococcus aureus
ADSEF

SEQ ID NO: 1634308 - protein, 17 aa, Staphylococcus aureus
ADTNDTIAEKTVEGGPT

SEQ ID NO: 1634309 - protein, 5 aa, Staphylococcus aureus
ADTNE

SEQ ID NO: 1634310 - protein, 5 aa, Staphylococcus aureus
ADTTC

SEQ ID NO: 1634311 - protein, 9 aa, Staphylococcus aureus
ADYPDPTTY

SEQ ID NO: 1634312 - protein, 7 aa, Staphylococcus aureus
AEAKEQV

SEQ ID NO: 1634313 - protein, 8 aa, Staphylococcus aureus
AEAQANQI

SEQ ID NO: 1634314 - protein, 9 aa, Staphylococcus aureus
AEATHINEE

SEQ ID NO: 1634315 - protein, 14 aa, Staphylococcus aureus
AEATKVSPKVIQSA

SEQ ID NO: 1634316 - protein, 7 aa, Staphylococcus aureus
AEAVPDH

SEQ ID NO: 1634317 - protein, 4 aa, Staphylococcus aureus
AEDC

SEQ ID NO: 1634318 - protein, 4 aa, Staphylococcus aureus
AEDR

SEQ ID NO: 1634319 - protein, 5 aa, Staphylococcus aureus
AEEAG

SEQ ID NO: 1634320 - protein, 13 aa, Staphylococcus aureus
AEEAVEKAKEFNS

SEQ ID NO: 1634321 - protein, 5 aa, Staphylococcus aureus
AEEDY

SEQ ID NO: 1634322 - protein, 18 aa, Staphylococcus aureus
AEEFANSYRQKIKDASVL

SEQ ID NO: 1634323 - protein, 9 aa, Staphylococcus aureus
AEEKSNEMI

SEQ ID NO: 1634324 - protein, 12 aa, Staphylococcus aureus
AEELEEQKKKEL

SEQ ID NO: 1634325 - protein, 12 aa, Staphylococcus aureus
AEERKNKNWKKK

SEQ ID NO: 1634326 - protein, 17 aa, Staphylococcus aureus
AEEVSTSSFADELIKNL

SEQ ID NO: 1634327 - protein, 6 aa, Staphylococcus aureus
AEGGYE

SEQ ID NO: 1634328 - protein, 9 aa, Staphylococcus aureus
AEGQTYNER

SEQ ID NO: 1634329 - protein, 27 aa, Staphylococcus aureus
AEGTSIVTATSTDGSDKSGQITVTVTN

SEQ ID NO: 1634330 - protein, 5 aa, Staphylococcus aureus
AEHGE

SEQ ID NO: 1634331 - protein, 4 aa, Staphylococcus aureus
AEHP

SEQ ID NO: 1634332 - protein, 40 aa, Staphylococcus aureus
AEIAQQEMRKSHTNDTDLSNTGYIDTENHDMNDLNDIELK

SEQ ID NO: 1634333 - protein, 12 aa, Staphylococcus aureus
AEIDGSSTTSMK

SEQ ID NO: 1634334 - protein, 11 aa, Staphylococcus aureus
AEIEERGGGRQ

SEQ ID NO: 1634335 - protein, 6 aa, Staphylococcus aureus
AEIEKA

SEQ ID NO: 1634336 - protein, 5 aa, Staphylococcus aureus
AEIKP

SEQ ID NO: 1634337 - protein, 10 aa, Staphylococcus aureus
AEISEDNGFE

SEQ ID NO: 1634338 - protein, 11 aa, Staphylococcus aureus
AEISGGQQQRI

SEQ ID NO: 1634339 - protein, 8 aa, Staphylococcus aureus
AEKDEYGG

SEQ ID NO: 1634340 - protein, 47 aa, Staphylococcus aureus
AEKDNTKRSVNYTDADQPKQQAYDTAVTQAEGITNANGSNANETQVQ

SEQ ID NO: 1634341 - protein, 7 aa, Staphylococcus aureus
AEKGHAK

SEQ ID NO: 1634342 - protein, 10 aa, Staphylococcus aureus
AEKKKKNKFL

SEQ ID NO: 1634343 - protein, 14 aa, Staphylococcus aureus
AEKLKGLKKEYTNL

SEQ ID NO: 1634344 - protein, 7 aa, Staphylococcus aureus
AEKQEQH

SEQ ID NO: 1634345 - protein, 13 aa, Staphylococcus aureus
AEKSSLEKNTRDN

SEQ ID NO: 1634346 - protein, 4 aa, Staphylococcus aureus
AEKV

SEQ ID NO: 1634347 - protein, 6 aa, Staphylococcus aureus
AELGNS

SEQ ID NO: 1634348 - protein, 16 aa, Staphylococcus aureus
AELQQKLAEKLQQLNM

SEQ ID NO: 1634349 - protein, 4 aa, Staphylococcus aureus
AELR

SEQ ID NO: 1634350 - protein, 11 aa, Staphylococcus aureus
AELTGRNDIQV

SEQ ID NO: 1634351 - protein, 20 aa, Staphylococcus aureus
AELTGRNDIQVGQAKISGNA

SEQ ID NO: 1634352 - protein, 7 aa, Staphylococcus aureus
AENGYPV

SEQ ID NO: 1634353 - protein, 15 aa, Staphylococcus aureus
AENKEEAKEKYEAQV

SEQ ID NO: 1634354 - protein, 16 aa, Staphylococcus aureus
AENKEEAKEKYEAQVK

SEQ ID NO: 1634355 - protein, 4 aa, Staphylococcus aureus
AENR

SEQ ID NO: 1634356 - protein, 9 aa, Staphylococcus aureus
AENSLEDKR

SEQ ID NO: 1634357 - protein, 6 aa, Staphylococcus aureus
AENTLE

SEQ ID NO: 1634358 - protein, 11 aa, Staphylococcus aureus
AEPAQIASSPN

SEQ ID NO: 1634359 - protein, 6 aa, Staphylococcus aureus
AEPDVQ

SEQ ID NO: 1634360 - protein, 4 aa, Staphylococcus aureus
AEPF

SEQ ID NO: 1634361 - protein, 14 aa, Staphylococcus aureus
AEQLKQGQEIVGNR

SEQ ID NO: 1634362 - protein, 14 aa, Staphylococcus aureus
AEQRKAEANGAPQK

SEQ ID NO: 1634363 - protein, 12 aa, Staphylococcus aureus
AEQTSETKTSSQ

SEQ ID NO: 1634364 - protein, 13 aa, Staphylococcus aureus
AERDKKAEKDYSK

SEQ ID NO: 1634365 - protein, 9 aa, Staphylococcus aureus
AERKQHPLS

SEQ ID NO: 1634366 - protein, 25 aa, Staphylococcus aureus
AERLANAAKQKQAKLTPGSKESQLT

SEQ ID NO: 1634367 - protein, 35 aa, Staphylococcus aureus
AERYVGDSSLNDDSDLTDNSTEASQHHTNGIENEA

SEQ ID NO: 1634368 - protein, 63 aa, Staphylococcus aureus
AERYVGDSSLNDDSDLTDNSTEASQLHTNEIENEAVSNDENKQASIQNEDTNDAHVDESPYNY

SEQ ID NO: 1634369 - protein, 11 aa, Staphylococcus aureus
AESFNDHSKLG

SEQ ID NO: 1634370 - protein, 17 aa, Staphylococcus aureus
AESKEEAKEKYEAQVKR

SEQ ID NO: 1634371 - protein, 17 aa, Staphylococcus aureus
AESKEEAKEKYEEQVKR

SEQ ID NO: 1634372 - protein, 16 aa, Staphylococcus aureus
AESKEEAKEKYETQNA

SEQ ID NO: 1634373 - protein, 17 aa, Staphylococcus aureus
AESKEEAKEKYKAQVKR

SEQ ID NO: 1634374 - protein, 16 aa, Staphylococcus aureus
AESKEEAKERYEAQVK

SEQ ID NO: 1634375 - protein, 16 aa, Staphylococcus aureus
AESKEEAKKKYEAQVK

SEQ ID NO: 1634376 - protein, 9 aa, Staphylococcus aureus
AESLDNSEL

SEQ ID NO: 1634377 - protein, 7 aa, Staphylococcus aureus
AESLSDE

SEQ ID NO: 1634378 - protein, 27 aa, Staphylococcus aureus
AETENEYQNAQPYSEQKPSVDSTQTEI

SEQ ID NO: 1634379 - protein, 16 aa, Staphylococcus aureus
AETKNESSIPRNQPNY

SEQ ID NO: 1634380 - protein, 6 aa, Staphylococcus aureus
AETSHA

SEQ ID NO: 1634381 - protein, 8 aa, Staphylococcus aureus
AEVDSSDE

SEQ ID NO: 1634382 - protein, 5 aa, Staphylococcus aureus
AEVEQ

SEQ ID NO: 1634383 - protein, 10 aa, Staphylococcus aureus
AEVKGSGSNV

SEQ ID NO: 1634384 - protein, 17 aa, Staphylococcus aureus
AEYKHTHKQRGTSKGAD

SEQ ID NO: 1634385 - protein, 145 aa, Staphylococcus aureus
AFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPV

SEQ ID NO: 1634386 - protein, 145 aa, Staphylococcus aureus
AFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPI

SEQ ID NO: 1634387 - protein, 10 aa, Staphylococcus aureus
AFKEEGLDPW

SEQ ID NO: 1634388 - protein, 9 aa, Staphylococcus aureus
AFKEEGLEP

SEQ ID NO: 1634389 - protein, 6 aa, Staphylococcus aureus
AFKKSE

SEQ ID NO: 1634390 - protein, 17 aa, Staphylococcus aureus
AFYDDNDPIEYGVYRKD

SEQ ID NO: 1634391 - protein, 15 aa, Staphylococcus aureus
AGADVSDSINGNPIK

SEQ ID NO: 1634392 - protein, 4 aa, Staphylococcus aureus
AGAN

SEQ ID NO: 1634393 - protein, 9 aa, Staphylococcus aureus
AGANKEDIS

SEQ ID NO: 1634394 - protein, 13 aa, Staphylococcus aureus
AGARGLLDQESND

SEQ ID NO: 1634395 - protein, 4 aa, Staphylococcus aureus
AGAT

SEQ ID NO: 1634396 - protein, 10 aa, Staphylococcus aureus
AGDTESVKGA

SEQ ID NO: 1634397 - protein, 10 aa, Staphylococcus aureus
AGEERPLPTT

SEQ ID NO: 1634398 - protein, 8 aa, Staphylococcus aureus
AGENLNSQ

SEQ ID NO: 1634399 - protein, 6 aa, Staphylococcus aureus
AGGIPR

SEQ ID NO: 1634400 - protein, 9 aa, Staphylococcus aureus
AGGKSAYNN

SEQ ID NO: 1634401 - protein, 13 aa, Staphylococcus aureus
AGGKTFDKEDIKA

SEQ ID NO: 1634402 - protein, 7 aa, Staphylococcus aureus
AGGSTGS

SEQ ID NO: 1634403 - protein, 12 aa, Staphylococcus aureus
AGGVKGPAGPNS

SEQ ID NO: 1634404 - protein, 12 aa, Staphylococcus aureus
AGGVNRNRTGSH

SEQ ID NO: 1634405 - protein, 41 aa, Staphylococcus aureus
AGIEKGSGEPNKAKVATVTKDQVREIANSKMQDLNAADEEA

SEQ ID NO: 1634406 - protein, 26 aa, Staphylococcus aureus
AGIEKGSGEPNKTKVATVTKDQVREI

SEQ ID NO: 1634407 - protein, 6 aa, Staphylococcus aureus
AGIGKT

SEQ ID NO: 1634408 - protein, 8 aa, Staphylococcus aureus
AGITNDKE

SEQ ID NO: 1634409 - protein, 13 aa, Staphylococcus aureus
AGKSDEDPYENPH

SEQ ID NO: 1634410 - protein, 5 aa, Staphylococcus aureus
AGKSL

SEQ ID NO: 1634411 - protein, 12 aa, Staphylococcus aureus
AGLQNYKNRSIN

SEQ ID NO: 1634412 - protein, 15 aa, Staphylococcus aureus
AGNDGIDVNDKQKIN

SEQ ID NO: 1634413 - protein, 14 aa, Staphylococcus aureus
AGNDGIDVNDKQKL

SEQ ID NO: 1634414 - protein, 10 aa, Staphylococcus aureus
AGNHAQGVAY

SEQ ID NO: 1634415 - protein, 11 aa, Staphylococcus aureus
AGNIKGSSVGY

SEQ ID NO: 1634416 - protein, 13 aa, Staphylococcus aureus
AGNQSVDKNTTNA

SEQ ID NO: 1634417 - protein, 8 aa, Staphylococcus aureus
AGNSTAEK

SEQ ID NO: 1634418 - protein, 5 aa, Staphylococcus aureus
AGNYS

SEQ ID NO: 1634419 - protein, 7 aa, Staphylococcus aureus
AGPIRTL

SEQ ID NO: 1634420 - protein, 7 aa, Staphylococcus aureus
AGPQHNK

SEQ ID NO: 1634421 - protein, 24 aa, Staphylococcus aureus
AGPQHREIGTPISTGNASWRGPNI

SEQ ID NO: 1634422 - protein, 13 aa, Staphylococcus aureus
AGPQHRSLRKVSL

SEQ ID NO: 1634423 - protein, 5 aa, Staphylococcus aureus
AGQQE

SEQ ID NO: 1634424 - protein, 7 aa, Staphylococcus aureus
AGQSAVG

SEQ ID NO: 1634425 - protein, 26 aa, Staphylococcus aureus
AGSPTVDQINTNTSAANQAKSDLDHA

SEQ ID NO: 1634426 - protein, 26 aa, Staphylococcus aureus
AGSPTVEQINTNTSTANQAKSDLDHA

SEQ ID NO: 1634427 - protein, 15 aa, Staphylococcus aureus
AGTGTNDTEKSIQAS

SEQ ID NO: 1634428 - protein, 17 aa, Staphylococcus aureus
AGTKYDEHGSAQPLGSL

SEQ ID NO: 1634429 - protein, 15 aa, Staphylococcus aureus
AGTNPENILDDNKSY

SEQ ID NO: 1634430 - protein, 6 aa, Staphylococcus aureus
AGTQQA

SEQ ID NO: 1634431 - protein, 9 aa, Staphylococcus aureus
AGTVSNKDM

SEQ ID NO: 1634432 - protein, 7 aa, Staphylococcus aureus
AGVGESL

SEQ ID NO: 1634433 - protein, 15 aa, Staphylococcus aureus
AGVNGVKDKGNTLNT

SEQ ID NO: 1634434 - protein, 6 aa, Staphylococcus aureus
AGWDTH

SEQ ID NO: 1634435 - protein, 7 aa, Staphylococcus aureus
AGYASEE

SEQ ID NO: 1634436 - protein, 14 aa, Staphylococcus aureus
AGYHKTPDVNGFRQ

SEQ ID NO: 1634437 - protein, 13 aa, Staphylococcus aureus
AGYSTKGKSEKDI

SEQ ID NO: 1634438 - protein, 12 aa, Staphylococcus aureus
AGYSTKNKGEAY

SEQ ID NO: 1634439 - protein, 5 aa, Staphylococcus aureus
AHDAQ

SEQ ID NO: 1634440 - protein, 4 aa, Staphylococcus aureus
AHDN

SEQ ID NO: 1634441 - protein, 6 aa, Staphylococcus aureus
AHFSDE

SEQ ID NO: 1634442 - protein, 6 aa, Staphylococcus aureus
AHGEDD

SEQ ID NO: 1634443 - protein, 8 aa, Staphylococcus aureus
AHGHSKGV

SEQ ID NO: 1634444 - protein, 31 aa, Staphylococcus aureus
AHGKNGLVDGRGKGKPKSMMTPEEQKAAEIQ

SEQ ID NO: 1634445 - protein, 32 aa, Staphylococcus aureus
AHNNQSNQSMNNNDLTASKANDNSDVSTNDYH

SEQ ID NO: 1634446 - protein, 4 aa, Staphylococcus aureus
AHPN

SEQ ID NO: 1634447 - protein, 13 aa, Staphylococcus aureus
AHSSQTGSSAQKL

SEQ ID NO: 1634448 - protein, 8 aa, Staphylococcus aureus
AHTGQPRD

SEQ ID NO: 1634449 - protein, 24 aa, Staphylococcus aureus
AHTKAPRKKEAQQDASTKYYSSDE

SEQ ID NO: 1634450 - protein, 13 aa, Staphylococcus aureus
AHTKEDIEKTNSS

SEQ ID NO: 1634451 - protein, 5 aa, Staphylococcus aureus
AHYGN

SEQ ID NO: 1634452 - protein, 4 aa, Staphylococcus aureus
AHYT

SEQ ID NO: 1634453 - protein, 10 aa, Staphylococcus aureus
AIADKDATKA

SEQ ID NO: 1634454 - protein, 5 aa, Staphylococcus aureus
AIAND

SEQ ID NO: 1634455 - protein, 6 aa, Staphylococcus aureus
AIANQG

SEQ ID NO: 1634456 - protein, 9 aa, Staphylococcus aureus
AIAPGTIET

SEQ ID NO: 1634457 - protein, 9 aa, Staphylococcus aureus
AIDKVQQTK

SEQ ID NO: 1634458 - protein, 14 aa, Staphylococcus aureus
AIEDAQKNATINQC

SEQ ID NO: 1634459 - protein, 17 aa, Staphylococcus aureus
AIEETQTKKGFWSRLFG

SEQ ID NO: 1634460 - protein, 25 aa, Staphylococcus aureus
AIESGARRIEGTVNGIGERAGNAAL

SEQ ID NO: 1634461 - protein, 11 aa, Staphylococcus aureus
AIGAGTSKIKL

SEQ ID NO: 1634462 - protein, 5 aa, Staphylococcus aureus
AIKED

SEQ ID NO: 1634463 - protein, 11 aa, Staphylococcus aureus
AIKGEKPISSG

SEQ ID NO: 1634464 - protein, 17 aa, Staphylococcus aureus
AIKKTVTETIEYEEVEH

SEQ ID NO: 1634465 - protein, 17 aa, Staphylococcus aureus
AIKKTVTETIEYEKVEH

SEQ ID NO: 1634466 - protein, 9 aa, Staphylococcus aureus
AIKTPGIQE

SEQ ID NO: 1634467 - protein, 9 aa, Staphylococcus aureus
AIKYDDYSK

SEQ ID NO: 1634468 - protein, 7 aa, Staphylococcus aureus
AINAGIG

SEQ ID NO: 1634469 - protein, 42 aa, Staphylococcus aureus; identical to SEQ ID NO: 1566144

SEQ ID NO: 1634470 - protein, 42 aa, Staphylococcus aureus
AINGASDLNQNQKDALKVQANGAQRVSNAQDVQRNATELNTA

SEQ ID NO: 1634471 - protein, 8 aa, Staphylococcus aureus
AINNVQQS

SEQ ID NO: 1634472 - protein, 22 aa, Staphylococcus aureus
AINQINQNQTNDQVDTTTNQAV

SEQ ID NO: 1634473 - protein, 6 aa, Staphylococcus aureus
AIPNDT

SEQ ID NO: 1634474 - protein, 14 aa, Staphylococcus aureus
AIRTKNLDQMTKAK

SEQ ID NO: 1634475 - protein, 18 aa, Staphylococcus aureus
AISCTGQQGIDDAQQTQT

SEQ ID NO: 1634476 - protein, 22 aa, Staphylococcus aureus
AISDEGSFTEFDKGKTSANPLD

SEQ ID NO: 1634477 - protein, 28 aa, Staphylococcus aureus
AISKDGERYRKYADNPIKHPLATKDKGF

SEQ ID NO: 1634478 - protein, 15 aa, Staphylococcus aureus
AISNDEDLRIALGTT

SEQ ID NO: 1634479 - protein, 18 aa, Staphylococcus aureus
AISNQDVSQVQTAGNQAI

SEQ ID NO: 1634480 - protein, 31 aa, Staphylococcus aureus
AISTGNASWRGPNTEAGEKSAYKNVQVGGAP

SEQ ID NO: 1634481 - protein, 31 aa, Staphylococcus aureus
AISTGNASWRGPNTEAGENTAYNNVRVGRPP

SEQ ID NO: 1634482 - protein, 5 aa, Staphylococcus aureus
AITPN

SEQ ID NO: 1634483 - protein, 6 aa, Staphylococcus aureus
AITPNT

SEQ ID NO: 1634484 - protein, 7 aa, Staphylococcus aureus
AITPNTG

SEQ ID NO: 1634485 - protein, 12 aa, Staphylococcus aureus
AITTKENEINDL

SEQ ID NO: 1634486 - protein, 12 aa, Staphylococcus aureus
AITTKENEINEL

SEQ ID NO: 1634487 - protein, 7 aa, Staphylococcus aureus
AKAKGYR

SEQ ID NO: 1634488 - protein, 38 aa, Staphylococcus aureus
AKAQKNHQKPQNKTNFEKSKQIKPKQYNQTKNHQQQKK

SEQ ID NO: 1634489 - protein, 7 aa, Staphylococcus aureus
AKDDMHN

SEQ ID NO: 1634490 - protein, 15 aa, Staphylococcus aureus
AKDELATKAKEQKAL

SEQ ID NO: 1634491 - protein, 35 aa, Staphylococcus aureus
AKDFNSLSSKDREKLEKEIEKNGGKMFESILKKAS

SEQ ID NO: 1634492 - protein, 20 aa, Staphylococcus aureus
AKDNLHGDQKLADDKQHAVT

SEQ ID NO: 1634493 - protein, 8 aa, Staphylococcus aureus
AKDQLKET

SEQ ID NO: 1634494 - protein, 14 aa, Staphylococcus aureus
AKDQTQINDKIRSK

SEQ ID NO: 1634495 - protein, 8 aa, Staphylococcus aureus
AKDRNKVN

SEQ ID NO: 1634496 - protein, 7 aa, Staphylococcus aureus
AKDTDAS

SEQ ID NO: 1634497 - protein, 7 aa, Staphylococcus aureus
AKDTGLN

SEQ ID NO: 1634498 - protein, 8 aa, Staphylococcus aureus
AKEAYGNK

SEQ ID NO: 1634499 - protein, 16 aa, Staphylococcus aureus
AKEEIKADSAEQKSIA

SEQ ID NO: 1634500 - protein, 12 aa, Staphylococcus aureus
AKEGIEVSADKS

SEQ ID NO: 1634501 - protein, 13 aa, Staphylococcus aureus
AKEGMEVSTDKSV

SEQ ID NO: 1634502 - protein, 11 aa, Staphylococcus aureus
AKEHPEDDIPK

SEQ ID NO: 1634503 - protein, 11 aa, Staphylococcus aureus
AKEIAKAEKTY

SEQ ID NO: 1634504 - protein, 7 aa, Staphylococcus aureus
AKEIRDD

SEQ ID NO: 1634505 - protein, 9 aa, Staphylococcus aureus
AKEKEKALA

SEQ ID NO: 1634506 - protein, 6 aa, Staphylococcus aureus
AKEPEI

SEQ ID NO: 1634507 - protein, 8 aa, Staphylococcus aureus
AKESDAQI

SEQ ID NO: 1634508 - protein, 6 aa, Staphylococcus aureus
AKESGH

SEQ ID NO: 1634509 - protein, 10 aa, Staphylococcus aureus
AKESTTNQGF

SEQ ID NO: 1634510 - protein, 6 aa, Staphylococcus aureus
AKEVSF

SEQ ID NO: 1634511 - protein, 9 aa, Staphylococcus aureus
AKGADRPLI

SEQ ID NO: 1634512 - protein, 5 aa, Staphylococcus aureus
AKGEI

SEQ ID NO: 1634513 - protein, 8 aa, Staphylococcus aureus
AKGIDGLK

SEQ ID NO: 1634514 - protein, 28 aa, Staphylococcus aureus
AKGIKTQISGRLGGADIARAEQYSEGTV

SEQ ID NO: 1634515 - protein, 15 aa, Staphylococcus aureus
AKGKLGAKKDVSQNG

SEQ ID NO: 1634516 - protein, 5 aa, Staphylococcus aureus
AKGKT

SEQ ID NO: 1634517 - protein, 12 aa, Staphylococcus aureus
AKGNKSDELDDE

SEQ ID NO: 1634518 - protein, 14 aa, Staphylococcus aureus
AKGNPQWKTLNGNG

SEQ ID NO: 1634519 - protein, 4 aa, Staphylococcus aureus
AKGS

SEQ ID NO: 1634520 - protein, 12 aa, Staphylococcus aureus
AKGVSKVNDQTN

SEQ ID NO: 1634521 - protein, 9 aa, Staphylococcus aureus
AKGVSPLES

SEQ ID NO: 1634522 - protein, 11 aa, Staphylococcus aureus
AKHDLTADTHA

SEQ ID NO: 1634523 - protein, 6 aa, Staphylococcus aureus
AKHSME

SEQ ID NO: 1634524 - protein, 9 aa, Staphylococcus aureus
AKKELGKNE

SEQ ID NO: 1634525 - protein, 6 aa, Staphylococcus aureus
AKKELN

SEQ ID NO: 1634526 - protein, 19 aa, Staphylococcus aureus
AKKKKEVGLTQEEAKEQTV

SEQ ID NO: 1634527 - protein, 23 aa, Staphylococcus aureus
AKKLNESQAPKADNNFNKEQQNA

SEQ ID NO: 1634528 - protein, 16 aa, Staphylococcus aureus
AKKLSNKEETLSENDA

SEQ ID NO: 1634529 - protein, 6 aa, Staphylococcus aureus
AKKQMS

SEQ ID NO: 1634530 - protein, 24 aa, Staphylococcus aureus
AKKREIKGYSDMKKDELIKAIEGV

SEQ ID NO: 1634531 - protein, 13 aa, Staphylococcus aureus
AKKVSPSGWRCSR

SEQ ID NO: 1634532 - protein, 7 aa, Staphylococcus aureus
AKLDNGQ

SEQ ID NO: 1634533 - protein, 10 aa, Staphylococcus aureus
AKLKEAIERS

SEQ ID NO: 1634534 - protein, 5 aa, Staphylococcus aureus
AKLQY

SEQ ID NO: 1634535 - protein, 24 aa, Staphylococcus aureus
AKLSNGDDYVSSINSPLKYDKKEA

SEQ ID NO: 1634536 - protein, 18 aa, Staphylococcus aureus
AKMNKDQIAEYEREQMEK

SEQ ID NO: 1634537 - protein, 16 aa, Staphylococcus aureus
AKMSAQAVGGAVGSNP

SEQ ID NO: 1634538 - protein, 9 aa, Staphylococcus aureus
AKNAIKNGC

SEQ ID NO: 1634539 - protein, 15 aa, Staphylococcus aureus
AKNIEGHDVLLWKPI

SEQ ID NO: 1634540 - protein, 8 aa, Staphylococcus aureus
AKNKAEEL

SEQ ID NO: 1634541 - protein, 9 aa, Staphylococcus aureus
AKNKELKGI

SEQ ID NO: 1634542 - protein, 8 aa, Staphylococcus aureus
AKNNDEKS

SEQ ID NO: 1634543 - protein, 9 aa, Staphylococcus aureus
AKNNNRQDI

SEQ ID NO: 1634544 - protein, 7 aa, Staphylococcus aureus
AKNNYQD

SEQ ID NO: 1634545 - protein, 23 aa, Staphylococcus aureus
AKNVAKKALDAAKSALGIHSPSR

SEQ ID NO: 1634546 - protein, 8 aa, Staphylococcus aureus
AKQAGWDT

SEQ ID NO: 1634547 - protein, 8 aa, Staphylococcus aureus
AKQDFPKT

SEQ ID NO: 1634548 - protein, 5 aa, Staphylococcus aureus
AKQFV

SEQ ID NO: 1634549 - protein, 9 aa, Staphylococcus aureus
AKQNGYHEG

SEQ ID NO: 1634550 - protein, 8 aa, Staphylococcus aureus
AKQNTSNV

SEQ ID NO: 1634551 - protein, 6 aa, Staphylococcus aureus
AKQTMS

SEQ ID NO: 1634552 - protein, 12 aa, Staphylococcus aureus
AKREQIESKLHE

SEQ ID NO: 1634553 - protein, 18 aa, Staphylococcus aureus
AKRKNLNDTSVNNRCEEN

SEQ ID NO: 1634554 - protein, 12 aa, Staphylococcus aureus
AKRSETRQKRVE

SEQ ID NO: 1634555 - protein, 17 aa, Staphylococcus aureus
AKRSQSDHKLNKEKDTA

SEQ ID NO: 1634556 - protein, 13 aa, Staphylococcus aureus
AKRSTKNTRRTKT

SEQ ID NO: 1634557 - protein, 18 aa, Staphylococcus aureus
AKSDPRNNISRKKSIIQS

SEQ ID NO: 1634558 - protein, 16 aa, Staphylococcus aureus
AKSDVNQTPVGTGPYQ

SEQ ID NO: 1634559 - protein, 20 aa, Staphylococcus aureus
AKSEKGRPGRYEKSGFRSLF

SEQ ID NO: 1634560 - protein, 9 aa, Staphylococcus aureus
AKSGDTREV

SEQ ID NO: 1634561 - protein, 20 aa, Staphylococcus aureus
AKSMEEETGIKLSKTDLSQY

SEQ ID NO: 1634562 - protein, 4 aa, Staphylococcus aureus
AKSN

SEQ ID NO: 1634563 - protein, 12 aa, Staphylococcus aureus
AKSNEGKWGGVD

SEQ ID NO: 1634564 - protein, 12 aa, Staphylococcus aureus
AKSNKAGELDSE

SEQ ID NO: 1634565 - protein, 4 aa, Staphylococcus aureus
AKSR

SEQ ID NO: 1634566 - protein, 9 aa, Staphylococcus aureus
AKSSSVDEL

SEQ ID NO: 1634567 - protein, 6 aa, Staphylococcus aureus
AKSTDY

SEQ ID NO: 1634568 - protein, 9 aa, Staphylococcus aureus
AKTEATQAI

SEQ ID NO: 1634569 - protein, 11 aa, Staphylococcus aureus
AKTELNKRKSA

SEQ ID NO: 1634570 - protein, 10 aa, Staphylococcus aureus
AKTNATQAID

SEQ ID NO: 1634571 - protein, 13 aa, Staphylococcus aureus
AKTNPQCNTLKDN

SEQ ID NO: 1634572 - protein, 11 aa, Staphylococcus aureus
AKTQDKDYLTQ

SEQ ID NO: 1634573 - protein, 10 aa, Staphylococcus aureus
AKTQGKDYLT

SEQ ID NO: 1634574 - protein, 50 aa, Staphylococcus aureus
AKTQTSQNKQLEHEKQDDSVVKQGTASKSSDENVSSTTKSTPNYSKVDNT

SEQ ID NO: 1634575 - protein, 51 aa, Staphylococcus aureus
AKTQTSQNKQLEQEKQNDSVVKQGTASKSSDENVSSTTKSMPNYSKVDNTI

SEQ ID NO: 1634576 - protein, 9 aa, Staphylococcus aureus
AKTREEEAE

SEQ ID NO: 1634577 - protein, 4 aa, Staphylococcus aureus
AKVN

SEQ ID NO: 1634578 - protein, 9 aa, Staphylococcus aureus
AKVTPEEMD

SEQ ID NO: 1634579 - protein, 12 aa, Staphylococcus aureus
AKYEGEGYGKFK

SEQ ID NO: 1634580 - protein, 17 aa, Staphylococcus aureus
AKYKNHPKETNKKRIKN

SEQ ID NO: 1634581 - protein, 11 aa, Staphylococcus aureus
AKYKNHQKEIN

SEQ ID NO: 1634582 - protein, 8 aa, Staphylococcus aureus
ALASQDHN

SEQ ID NO: 1634583 - protein, 10 aa, Staphylococcus aureus
ALDANDRPLF

SEQ ID NO: 1634584 - protein, 5 aa, Staphylococcus aureus
ALDDE

SEQ ID NO: 1634585 - protein, 8 aa, Staphylococcus aureus
ALDKKTVN

SEQ ID NO: 1634586 - protein, 20 aa, Staphylococcus aureus
ALEEENERLKDQVQKLHGKL

SEQ ID NO: 1634587 - protein, 10 aa, Staphylococcus aureus
ALEKNKGNET

SEQ ID NO: 1634588 - protein, 20 aa, Staphylococcus aureus
ALENGKPARSIDFNDEDQKW

SEQ ID NO: 1634589 - protein, 6 aa, Staphylococcus aureus
ALEPNE

SEQ ID NO: 1634590 - protein, 9 aa, Staphylococcus aureus
ALESQKIES

SEQ ID NO: 1634591 - protein, 20 aa, Staphylococcus aureus
ALGRKTKQGFYKKDKETKTR

SEQ ID NO: 1634592 - protein, 14 aa, Staphylococcus aureus
ALGTSRRMTFIKHK

SEQ ID NO: 1634593 - protein, 22 aa, Staphylococcus aureus
ALKKEPRANTQEAEHILQEIRQ

SEQ ID NO: 1634594 - protein, 16 aa, Staphylococcus aureus
ALNQAKQNLTADTHEL

SEQ ID NO: 1634595 - protein, 11 aa, Staphylococcus aureus
ALNTPKSVEIR

SEQ ID NO: 1634596 - protein, 23 aa, Staphylococcus aureus
ALPKEEAEKLKEQLEEVGATVEI

SEQ ID NO: 1634597 - protein, 8 aa, Staphylococcus aureus
ALQGGAGA

SEQ ID NO: 1634598 - protein, 5 aa, Staphylococcus aureus
ALQQN

SEQ ID NO: 1634599 - protein, 5 aa, Staphylococcus aureus
ALRKK

SEQ ID NO: 1634600 - protein, 8 aa, Staphylococcus aureus
ALRNTNYC

SEQ ID NO: 1634601 - protein, 12 aa, Staphylococcus aureus
ALRNTRYCGTTK

SEQ ID NO: 1634602 - protein, 5 aa, Staphylococcus aureus
ALSKQ

SEQ ID NO: 1634603 - protein, 9 aa, Staphylococcus aureus
ALSKQSDKQ

SEQ ID NO: 1634604 - protein, 9 aa, Staphylococcus aureus
ALSKQSNRQ

SEQ ID NO: 1634605 - protein, 4 aa, Staphylococcus aureus
ALSN

SEQ ID NO: 1634606 - protein, 4 aa, Staphylococcus aureus
ALSQ

SEQ ID NO: 1634607 - protein, 18 aa, Staphylococcus aureus
ALTETDGDIDKAIDYLRE

SEQ ID NO: 1634608 - protein, 10 aa, Staphylococcus aureus
ALTGDDSVNY

SEQ ID NO: 1634609 - protein, 4 aa, Staphylococcus aureus
ALTR

SEQ ID NO: 1634610 - protein, 20 aa, Staphylococcus aureus
AMDPYNGGEISPGPEVQTDE

SEQ ID NO: 1634611 - protein, 22 aa, Staphylococcus aureus
AMEESKSQFKDEVYSLLNIFLK

SEQ ID NO: 1634612 - protein, 10 aa, Staphylococcus aureus
AMSAPSRERL

SEQ ID NO: 1634613 - protein, 12 aa, Staphylococcus aureus
ANADSKEQAQSL

SEQ ID NO: 1634614 - protein, 14 aa, Staphylococcus aureus
ANAGDGSGQHPTQS

SEQ ID NO: 1634615 - protein, 13 aa, Staphylococcus aureus
ANAMAQKSNYRGR

SEQ ID NO: 1634616 - protein, 21 aa, Staphylococcus aureus
ANANSCTGQQGIDDARQTQAW

SEQ ID NO: 1634617 - protein, 13 aa, Staphylococcus aureus
ANASKATKQDVED

SEQ ID NO: 1634618 - protein, 9 aa, Staphylococcus aureus
ANASKVHGK

SEQ ID NO: 1634619 - protein, 6 aa, Staphylococcus aureus
ANATGL

SEQ ID NO: 1634620 - protein, 24 aa, Staphylococcus aureus
ANAVGDAVKRGAINAGLSKGDAGI

SEQ ID NO: 1634621 - protein, 22 aa, Staphylococcus aureus
ANDLNQAQKDALKQQVDAAQTV

SEQ ID NO: 1634622 - protein, 9 aa, Staphylococcus aureus
ANDSKYGLA

SEQ ID NO: 1634623 - protein, 4 aa, Staphylococcus aureus
ANEA

SEQ ID NO: 1634624 - protein, 5 aa, Staphylococcus aureus
ANEDR

SEQ ID NO: 1634625 - protein, 11 aa, Staphylococcus aureus
ANEEERKQSKL

SEQ ID NO: 1634626 - protein, 79 aa, Staphylococcus aureus; identical to SEQ ID NO: 1566761

SEQ ID NO: 1634627 - protein, 10 aa, Staphylococcus aureus
ANFPDEAPGI

SEQ ID NO: 1634628 - protein, 5 aa, Staphylococcus aureus
ANFQS

SEQ ID NO: 1634629 - protein, 8 aa, Staphylococcus aureus
ANFTTPGA

SEQ ID NO: 1634630 - protein, 9 aa, Staphylococcus aureus
ANGDTSNDF

SEQ ID NO: 1634631 - protein, 6 aa, Staphylococcus aureus
ANGELF

SEQ ID NO: 1634632 - protein, 10 aa, Staphylococcus aureus
ANGKSPKEAV

SEQ ID NO: 1634633 - protein, 8 aa, Staphylococcus aureus
ANGLPTDG

SEQ ID NO: 1634634 - protein, 8 aa, Staphylococcus aureus
ANGQELTP

SEQ ID NO: 1634635 - protein, 7 aa, Staphylococcus aureus
ANGRIDT

SEQ ID NO: 1634636 - protein, 19 aa, Staphylococcus aureus
ANIAALGEKHKGAGEGADD

SEQ ID NO: 1634637 - protein, 4 aa, Staphylococcus aureus
ANII

SEQ ID NO: 1634638 - protein, 4 aa, Staphylococcus aureus
ANIR

SEQ ID NO: 1634639 - protein, 6 aa, Staphylococcus aureus
ANKDFN

SEQ ID NO: 1634640 - protein, 11 aa, Staphylococcus aureus
ANKKQETTANI

SEQ ID NO: 1634641 - protein, 36 aa, Staphylococcus aureus
ANKRTATIKNGTAMPTNLAGGSTTKRNKSQMAHQHL

SEQ ID NO: 1634642 - protein, 9 aa, Staphylococcus aureus
ANKSGVVPT

SEQ ID NO: 1634643 - protein, 16 aa, Staphylococcus aureus
ANKTNEIAGDGTTTAT

SEQ ID NO: 1634644 - protein, 17 aa, Staphylococcus aureus
ANKVTETIRKETDAKPL

SEQ ID NO: 1634645 - protein, 7 aa, Staphylococcus aureus
ANKYNEI

SEQ ID NO: 1634646 - protein, 10 aa, Staphylococcus aureus
ANLNKTVSAA

SEQ ID NO: 1634647 - protein, 7 aa, Staphylococcus aureus
ANLPRNA

SEQ ID NO: 1634648 - protein, 9 aa, Staphylococcus aureus
ANNAKALKD

SEQ ID NO: 1634649 - protein, 10 aa, Staphylococcus aureus
ANNAKALKDH

SEQ ID NO: 1634650 - protein, 12 aa, Staphylococcus aureus
ANNEATDEEQNA

SEQ ID NO: 1634651 - protein, 14 aa, Staphylococcus aureus
ANNEATDEEQNAAI

SEQ ID NO: 1634652 - protein, 5 aa, Staphylococcus aureus
ANNEK

SEQ ID NO: 1634653 - protein, 7 aa, Staphylococcus aureus
ANNKKRN

SEQ ID NO: 1634654 - protein, 9 aa, Staphylococcus aureus
ANNKKRNKL

SEQ ID NO: 1634655 - protein, 7 aa, Staphylococcus aureus
ANNKNDS

SEQ ID NO: 1634656 - protein, 9 aa, Staphylococcus aureus
ANNKRIEAQ

SEQ ID NO: 1634657 - protein, 8 aa, Staphylococcus aureus
ANNVQSTV

SEQ ID NO: 1634658 - protein, 6 aa, Staphylococcus aureus
ANPLAE

SEQ ID NO: 1634659 - protein, 7 aa, Staphylococcus aureus
ANPLDEL

SEQ ID NO: 1634660 - protein, 63 aa, Staphylococcus aureus
ANPVKKPAGKTELDQAAADKKTQIEQTPNASQQEINDAKQEVDAALNQAKTNIDQSSTNEYVD

SEQ ID NO: 1634661 - protein, 4 aa, Staphylococcus aureus
ANQK

SEQ ID NO: 1634662 - protein, 9 aa, Staphylococcus aureus
ANQSTLQPI

SEQ ID NO: 1634663 - protein, 6 aa, Staphylococcus aureus
ANRDTA

SEQ ID NO: 1634664 - protein, 8 aa, Staphylococcus aureus
ANRKGGKC

SEQ ID NO: 1634665 - protein, 8 aa, Staphylococcus aureus
ANRNDRYG

SEQ ID NO: 1634666 - protein, 7 aa, Staphylococcus aureus
ANSEQYG

SEQ ID NO: 1634667 - protein, 9 aa, Staphylococcus aureus
ANSGSLGPV

SEQ ID NO: 1634668 - protein, 9 aa, Staphylococcus aureus
ANSGTDDKY

SEQ ID NO: 1634669 - protein, 4 aa, Staphylococcus aureus
ANSI

SEQ ID NO: 1634670 - protein, 28 aa, Staphylococcus aureus
ANSRITDLENKAQAYSRTFDEQKRYMDE

SEQ ID NO: 1634671 - protein, 29 aa, Staphylococcus aureus
ANSRITDLENKAQAYSRTFDEQKRYMDEK

SEQ ID NO: 1634672 - protein, 24 aa, Staphylococcus aureus
ANSVGDAVKRGAINAGLSKGDAGI

SEQ ID NO: 1634673 - protein, 4 aa, Staphylococcus aureus
ANTD

SEQ ID NO: 1634674 - protein, 8 aa, Staphylococcus aureus
ANTIKAEL

SEQ ID NO: 1634675 - protein, 15 aa, Staphylococcus aureus
ANTNADVEQVKTNAI

SEQ ID NO: 1634676 - protein, 14 aa, Staphylococcus aureus
ANTRKSSDKKREVT

SEQ ID NO: 1634677 - protein, 8 aa, Staphylococcus aureus
ANTTDKET

SEQ ID NO: 1634678 - protein, 14 aa, Staphylococcus aureus
ANWTTEKYSRQQHA

SEQ ID NO: 1634679 - protein, 6 aa, Staphylococcus aureus
ANYQRT

SEQ ID NO: 1634680 - protein, 6 aa, Staphylococcus aureus
ANYSKA

SEQ ID NO: 1634681 - protein, 15 aa, Staphylococcus aureus
APAEKQSGKSIENRP

SEQ ID NO: 1634682 - protein, 6 aa, Staphylococcus aureus
APAKLT

SEQ ID NO: 1634683 - protein, 21 aa, Staphylococcus aureus
APANYYPDDEYGGYDEYGGYI

SEQ ID NO: 1634684 - protein, 4 aa, Staphylococcus aureus
APAP

SEQ ID NO: 1634685 - protein, 15 aa, Staphylococcus aureus
APAVNKWENGNSLPD

SEQ ID NO: 1634686 - protein, 4 aa, Staphylococcus aureus
APAY

SEQ ID NO: 1634687 - protein, 5 aa, Staphylococcus aureus
APDTI

SEQ ID NO: 1634688 - protein, 9 aa, Staphylococcus aureus
APEDDEDAL

SEQ ID NO: 1634689 - protein, 6 aa, Staphylococcus aureus
APGDFE

SEQ ID NO: 1634690 - protein, 13 aa, Staphylococcus aureus
APGDTPVSAVAVC

SEQ ID NO: 1634691 - protein, 4 aa, Staphylococcus aureus
APGF

SEQ ID NO: 1634692 - protein, 7 aa, Staphylococcus aureus
APGFGDR

SEQ ID NO: 1634693 - protein, 10 aa, Staphylococcus aureus
APINNSDEPL

SEQ ID NO: 1634694 - protein, 9 aa, Staphylococcus aureus
APKDERDAL

SEQ ID NO: 1634695 - protein, 8 aa, Staphylococcus aureus
APKQFQTE

SEQ ID NO: 1634696 - protein, 8 aa, Staphylococcus aureus
APLNDRDS

SEQ ID NO: 1634697 - protein, 11 aa, Staphylococcus aureus
APLNNGHEDLA

SEQ ID NO: 1634698 - protein, 18 aa, Staphylococcus aureus
APMAASNTTNTLKDGTKN

SEQ ID NO: 1634699 - protein, 12 aa, Staphylococcus aureus
APNFNRKGYNEI

SEQ ID NO: 1634700 - protein, 15 aa, Staphylococcus aureus
APNPMNHQNNWKGGN

SEQ ID NO: 1634701 - protein, 15 aa, Staphylococcus aureus
APNTKKEKQPKRGDD

SEQ ID NO: 1634702 - protein, 7 aa, Staphylococcus aureus
APPYSHP

SEQ ID NO: 1634703 - protein, 18 aa, Staphylococcus aureus
APSASKEELAGLEGRNFD

SEQ ID NO: 1634704 - protein, 24 aa, Staphylococcus aureus
APSASKEELAGLEGRNFDNQSDDK

SEQ ID NO: 1634705 - protein, 8 aa, Staphylococcus aureus
APSQTLSD

SEQ ID NO: 1634706 - protein, 17 aa, Staphylococcus aureus
APTAGQEASQLSSQYAL

SEQ ID NO: 1634707 - protein, 8 aa, Staphylococcus aureus
APTAKEPL

SEQ ID NO: 1634708 - protein, 37 aa, Staphylococcus aureus
APTEEPTEEEIEAMEGEQQTEEPEVVGESKEDEEKTE

SEQ ID NO: 1634709 - protein, 17 aa, Staphylococcus aureus
APTQRISKRNSTGNASL

SEQ ID NO: 1634710 - protein, 12 aa, Staphylococcus aureus
APTVTVGNQTIE

SEQ ID NO: 1634711 - protein, 13 aa, Staphylococcus aureus
APTVTVGNQTIEV

SEQ ID NO: 1634712 - protein, 20 aa, Staphylococcus aureus
APTYATAKEGVDASYNEGLT

SEQ ID NO: 1634713 - protein, 13 aa, Staphylococcus aureus
APVESLTENEGRL

SEQ ID NO: 1634714 - protein, 6 aa, Staphylococcus aureus
APVPPH

SEQ ID NO: 1634715 - protein, 8 aa, Staphylococcus aureus
APVYTTSS

SEQ ID NO: 1634716 - protein, 4 aa, Staphylococcus aureus
APYE

SEQ ID NO: 1634717 - protein, 6 aa, Staphylococcus aureus
APYEAR

SEQ ID NO: 1634718 - protein, 5 aa, Staphylococcus aureus
APYKE

SEQ ID NO: 1634719 - protein, 4 aa, Staphylococcus aureus
AQCE

SEQ ID NO: 1634720 - protein, 15 aa, Staphylococcus aureus
AQDEDANTDTPVNRL

SEQ ID NO: 1634721 - protein, 9 aa, Staphylococcus aureus
AQDLASEGI

SEQ ID NO: 1634722 - protein, 6 aa, Staphylococcus aureus
AQDLGY

SEQ ID NO: 1634723 - protein, 6 aa, Staphylococcus aureus
AQESKI

SEQ ID NO: 1634724 - protein, 16 aa, Staphylococcus aureus
AQEVGNEIGEKLTSEE

SEQ ID NO: 1634725 - protein, 7 aa, Staphylococcus aureus
AQEVQPT

SEQ ID NO: 1634726 - protein, 13 aa, Staphylococcus aureus
AQFDNSKINDTVG

SEQ ID NO: 1634727 - protein, 14 aa, Staphylococcus aureus
AQGDDADIEIYSRC

SEQ ID NO: 1634728 - protein, 10 aa, Staphylococcus aureus
AQGEAPIKET

SEQ ID NO: 1634729 - protein, 9 aa, Staphylococcus aureus
AQGKFAEGS

SEQ ID NO: 1634730 - protein, 23 aa, Staphylococcus aureus
AQGREARVSAVSSAGELLLARLA

SEQ ID NO: 1634731 - protein, 39 aa, Staphylococcus aureus
AQHSKFGSSISTDDASWRGSNTETGGKSAFNNVQVGGAP

SEQ ID NO: 1634732 - protein, 6 aa, Staphylococcus aureus
AQINPQ

SEQ ID NO: 1634733 - protein, 7 aa, Staphylococcus aureus
AQINSQT

SEQ ID NO: 1634734 - protein, 18 aa, Staphylococcus aureus
AQIRERKERRSSFKKYQI

SEQ ID NO: 1634735 - protein, 16 aa, Staphylococcus aureus
AQKAFGGGKGANQAIA

SEQ ID NO: 1634736 - protein, 8 aa, Staphylococcus aureus
AQKANVSK

SEQ ID NO: 1634737 - protein, 6 aa, Staphylococcus aureus
AQKGFK

SEQ ID NO: 1634738 - protein, 5 aa, Staphylococcus aureus
AQKVA

SEQ ID NO: 1634739 - protein, 15 aa, Staphylococcus aureus
AQKVGNEIGEKLTSA

SEQ ID NO: 1634740 - protein, 8 aa, Staphylococcus aureus
AQKVPNKY

SEQ ID NO: 1634741 - protein, 11 aa, Staphylococcus aureus
AQLTEQKDGLV

SEQ ID NO: 1634742 - protein, 7 aa, Staphylococcus aureus
AQMPGSV

SEQ ID NO: 1634743 - protein, 5 aa, Staphylococcus aureus
AQMQG

SEQ ID NO: 1634744 - protein, 7 aa, Staphylococcus aureus
AQMQKTP

SEQ ID NO: 1634745 - protein, 14 aa, Staphylococcus aureus
AQMVNSKEEANEIN

SEQ ID NO: 1634746 - protein, 5 aa, Staphylococcus aureus
AQNAL

SEQ ID NO: 1634747 - protein, 8 aa, Staphylococcus aureus
AQNEATRL

SEQ ID NO: 1634748 - protein, 13 aa, Staphylococcus aureus
AQNEEDASEVERY

SEQ ID NO: 1634749 - protein, 13 aa, Staphylococcus aureus
AQNEEDASEVESY

SEQ ID NO: 1634750 - protein, 8 aa, Staphylococcus aureus
AQNNSEEM

SEQ ID NO: 1634751 - protein, 9 aa, Staphylococcus aureus
AQQNAEGAT

SEQ ID NO: 1634752 - protein, 7 aa, Staphylococcus aureus
AQQQTLT

SEQ ID NO: 1634753 - protein, 8 aa, Staphylococcus aureus
AQQRPEDQ

SEQ ID NO: 1634754 - protein, 7 aa, Staphylococcus aureus
AQRGDLG

SEQ ID NO: 1634755 - protein, 9 aa, Staphylococcus aureus
AQRGDPSRG

SEQ ID NO: 1634756 - protein, 14 aa, Staphylococcus aureus
AQRRKERQENSNQI

SEQ ID NO: 1634757 - protein, 7 aa, Staphylococcus aureus
AQTYRND

SEQ ID NO: 1634758 - protein, 18 aa, Staphylococcus aureus
AQVEAQRMAESGWGKTSK

SEQ ID NO: 1634759 - protein, 9 aa, Staphylococcus aureus
AQYGDRNTI

SEQ ID NO: 1634760 - protein, 6 aa, Staphylococcus aureus
ARAEKD

SEQ ID NO: 1634761 - protein, 4 aa, Staphylococcus aureus
ARAG

SEQ ID NO: 1634762 - protein, 8 aa, Staphylococcus aureus
ARANDLAQ

SEQ ID NO: 1634763 - protein, 12 aa, Staphylococcus aureus
ARARQTTKEEYR

SEQ ID NO: 1634764 - protein, 29 aa, Staphylococcus aureus
ARDAVKQQYEAKKHEIEQAEHATDEEKQV

SEQ ID NO: 1634765 - protein, 29 aa, Staphylococcus aureus
ARDAVKQQYEAKKREIEQAEHATDEEKQV

SEQ ID NO: 1634766 - protein, 10 aa, Staphylococcus aureus
ARDQAVDTKE

SEQ ID NO: 1634767 - protein, 5 aa, Staphylococcus aureus
ARDSM

SEQ ID NO: 1634768 - protein, 6 aa, Staphylococcus aureus
AREAKN

SEQ ID NO: 1634769 - protein, 9 aa, Staphylococcus aureus
AREKAENGD

SEQ ID NO: 1634770 - protein, 5 aa, Staphylococcus aureus
ARENY

SEQ ID NO: 1634771 - protein, 23 aa, Staphylococcus aureus
ARERKKSDERIKDAKENNNSNEV

SEQ ID NO: 1634772 - protein, 20 aa, Staphylococcus aureus
ARERKKSDERIKDAKESNEV

SEQ ID NO: 1634773 - protein, 4 aa, Staphylococcus aureus
AREV

SEQ ID NO: 1634774 - protein, 14 aa, Staphylococcus aureus
ARGPVSKGLLTSNS

SEQ ID NO: 1634775 - protein, 21 aa, Staphylococcus aureus
ARIESSKEQIKGFKGTDNTVE

SEQ ID NO: 1634776 - protein, 4 aa, Staphylococcus aureus
ARIG

SEQ ID NO: 1634777 - protein, 9 aa, Staphylococcus aureus
ARIQDYGEA

SEQ ID NO: 1634778 - protein, 13 aa, Staphylococcus aureus
ARKAWTIKPLKET

SEQ ID NO: 1634779 - protein, 4 aa, Staphylococcus aureus
ARKQ

SEQ ID NO: 1634780 - protein, 9 aa, Staphylococcus aureus
ARKSKDNPY

SEQ ID NO: 1634781 - protein, 10 aa, Staphylococcus aureus
ARKSKDNSYR

SEQ ID NO: 1634782 - protein, 11 aa, Staphylococcus aureus
ARLQNYKKRSI

SEQ ID NO: 1634783 - protein, 12 aa, Staphylococcus aureus
ARLQNYKKRSIS

SEQ ID NO: 1634784 - protein, 14 aa, Staphylococcus aureus
ARNAQDIKNILKEH

SEQ ID NO: 1634785 - protein, 7 aa, Staphylococcus aureus
ARNNGYT

SEQ ID NO: 1634786 - protein, 13 aa, Staphylococcus aureus
ARPKKPENVENKS

SEQ ID NO: 1634787 - protein, 9 aa, Staphylococcus aureus
ARPNNNVNQ

SEQ ID NO: 1634788 - protein, 8 aa, Staphylococcus aureus
ARPQDVKG

SEQ ID NO: 1634789 - protein, 6 aa, Staphylococcus aureus
ARPQHS

SEQ ID NO: 1634790 - protein, 15 aa, Staphylococcus aureus
ARPRFNKPSETNAYN

SEQ ID NO: 1634791 - protein, 4 aa, Staphylococcus aureus
ARQD

SEQ ID NO: 1634792 - protein, 14 aa, Staphylococcus aureus
ARQDRKARSRKPIT

SEQ ID NO: 1634793 - protein, 11 aa, Staphylococcus aureus
ARQKELDDLNN

SEQ ID NO: 1634794 - protein, 7 aa, Staphylococcus aureus
ARRDANN

SEQ ID NO: 1634795 - protein, 7 aa, Staphylococcus aureus
ARRKKKI

SEQ ID NO: 1634796 - protein, 11 aa, Staphylococcus aureus
ARRSVNAPKDT

SEQ ID NO: 1634797 - protein, 15 aa, Staphylococcus aureus
ARSAGKEVEFQGKTY

SEQ ID NO: 1634798 - protein, 9 aa, Staphylococcus aureus
ARSKEGKLQ

SEQ ID NO: 1634799 - protein, 10 aa, Staphylococcus aureus
ARSYQQQANI

SEQ ID NO: 1634800 - protein, 8 aa, Staphylococcus aureus
ARTEDVRA

SEQ ID NO: 1634801 - protein, 4 aa, Staphylococcus aureus
ARVE

SEQ ID NO: 1634802 - protein, 20 aa, Staphylococcus aureus
ASAATTSAVTANTITVNKDN

SEQ ID NO: 1634803 - protein, 20 aa, Staphylococcus aureus
ASAATTTAVTANTITVNKDN

SEQ ID NO: 1634804 - protein, 9 aa, Staphylococcus aureus
ASAEKGEYV

SEQ ID NO: 1634805 - protein, 10 aa, Staphylococcus aureus
ASARGKGIAS

SEQ ID NO: 1634806 - protein, 22 aa, Staphylococcus aureus
ASAYNGNDTEGLLKEIEDVYKK

SEQ ID NO: 1634807 - protein, 7 aa, Staphylococcus aureus
ASAYSRT

SEQ ID NO: 1634808 - protein, 18 aa, Staphylococcus aureus
ASDDVEAPSKYKHRAEVS

SEQ ID NO: 1634809 - protein, 5 aa, Staphylococcus aureus
ASDEQ

SEQ ID NO: 1634810 - protein, 8 aa, Staphylococcus aureus
ASDKEQPI

SEQ ID NO: 1634811 - protein, 12 aa, Staphylococcus aureus
ASELTKAAGADF

SEQ ID NO: 1634812 - protein, 9 aa, Staphylococcus aureus
ASENKSQYQ

SEQ ID NO: 1634813 - protein, 8 aa, Staphylococcus aureus
ASENTLFS

SEQ ID NO: 1634814 - protein, 4 aa, Staphylococcus aureus
ASEQ

SEQ ID NO: 1634815 - protein, 19 aa, Staphylococcus aureus
ASEVQDTKKEIVAALRKLN

SEQ ID NO: 1634816 - protein, 6 aa, Staphylococcus aureus
ASFGKS

SEQ ID NO: 1634817 - protein, 9 aa, Staphylococcus aureus
ASFTPKPGD

SEQ ID NO: 1634818 - protein, 4 aa, Staphylococcus aureus
ASGF

SEQ ID NO: 1634819 - protein, 9 aa, Staphylococcus aureus
ASGHPYGVS

SEQ ID NO: 1634820 - protein, 12 aa, Staphylococcus aureus
ASGIDNAESKQK

SEQ ID NO: 1634821 - protein, 6 aa, Staphylococcus aureus
ASGKTI

SEQ ID NO: 1634822 - protein, 5 aa, Staphylococcus aureus
ASGQN

SEQ ID NO: 1634823 - protein, 6 aa, Staphylococcus aureus
ASGYSF

SEQ ID NO: 1634824 - protein, 12 aa, Staphylococcus aureus
ASHAHSAKVGNK

SEQ ID NO: 1634825 - protein, 7 aa, Staphylococcus aureus
ASIGKTA

SEQ ID NO: 1634826 - protein, 5 aa, Staphylococcus aureus
ASKEN

SEQ ID NO: 1634827 - protein, 12 aa, Staphylococcus aureus
ASKNVTKETHTS

SEQ ID NO: 1634828 - protein, 11 aa, Staphylococcus aureus
ASKPETTSHTY

SEQ ID NO: 1634829 - protein, 8 aa, Staphylococcus aureus
ASLNNKTI

SEQ ID NO: 1634830 - protein, 9 aa, Staphylococcus aureus
ASLNNKTIS

SEQ ID NO: 1634831 - protein, 4 aa, Staphylococcus aureus
ASLR

SEQ ID NO: 1634832 - protein, 19 aa, Staphylococcus aureus
ASLSTDQSESNANVQKYLI

SEQ ID NO: 1634833 - protein, 33 aa, Staphylococcus aureus
ASMNQSGVDSNSASQSASNSTSTSTSESDSQST

SEQ ID NO: 1634834 - protein, 8 aa, Staphylococcus aureus
ASNAQNTA

SEQ ID NO: 1634835 - protein, 8 aa, Staphylococcus aureus
ASNKAQDV

SEQ ID NO: 1634836 - protein, 14 aa, Staphylococcus aureus
ASNVPTSKTGAAIR

SEQ ID NO: 1634837 - protein, 7 aa, Staphylococcus aureus
ASPDFED

SEQ ID NO: 1634838 - protein, 7 aa, Staphylococcus aureus
ASPEEAN

SEQ ID NO: 1634839 - protein, 4 aa, Staphylococcus aureus
ASPI

SEQ ID NO: 1634840 - protein, 8 aa, Staphylococcus aureus
ASPKYTEG

SEQ ID NO: 1634841 - protein, 7 aa, Staphylococcus aureus
ASPQGIE

SEQ ID NO: 1634842 - protein, 20 aa, Staphylococcus aureus
ASPSLEKDGTFTNTERRIQR

SEQ ID NO: 1634843 - protein, 8 aa, Staphylococcus aureus
ASQEEKAP

SEQ ID NO: 1634844 - protein, 5 aa, Staphylococcus aureus
ASQLN

SEQ ID NO: 1634845 - protein, 18 aa, Staphylococcus aureus
ASRRGKLTSVDKENVLDS

SEQ ID NO: 1634846 - protein, 5 aa, Staphylococcus aureus
ASRVD

SEQ ID NO: 1634847 - protein, 10 aa, Staphylococcus aureus
ASSKQAPGII

SEQ ID NO: 1634848 - protein, 14 aa, Staphylococcus aureus
ASSLNTENIKNYEA

SEQ ID NO: 1634849 - protein, 15 aa, Staphylococcus aureus
ASSLSPLKQERVEGT

SEQ ID NO: 1634850 - protein, 6 aa, Staphylococcus aureus
ASSYVN

SEQ ID NO: 1634851 - protein, 9 aa, Staphylococcus aureus
ASTGQGEQL

SEQ ID NO: 1634852 - protein, 9 aa, Staphylococcus aureus
ASTGQGEQV

SEQ ID NO: 1634853 - protein, 6 aa, Staphylococcus aureus
ASTGTD

SEQ ID NO: 1634854 - protein, 8 aa, Staphylococcus aureus
ASTHPGAG

SEQ ID NO: 1634855 - protein, 5 aa, Staphylococcus aureus
ASTNN

SEQ ID NO: 1634856 - protein, 14 aa, Staphylococcus aureus
ASTSNRNFEGRQEH

SEQ ID NO: 1634857 - protein, 6 aa, Staphylococcus aureus
ASTYTK

SEQ ID NO: 1634858 - protein, 5 aa, Staphylococcus aureus
ASVAR

SEQ ID NO: 1634859 - protein, 23 aa, Staphylococcus aureus
ASVEESENTDNINSQDTSYTPQV

SEQ ID NO: 1634860 - protein, 18 aa, Staphylococcus aureus
ASWGNGPNSEAGGKSASM

SEQ ID NO: 1634861 - protein, 20 aa, Staphylococcus aureus
ASWRGPNTEADKKSAYDNVQ

SEQ ID NO: 1634862 - protein, 23 aa, Staphylococcus aureus
ASYQGESEGQPHNLENPSSRVED

SEQ ID NO: 1634863 - protein, 20 aa, Staphylococcus aureus
ATAKKQEINQNTNATTEEKQ

SEQ ID NO: 1634864 - protein, 21 aa, Staphylococcus aureus
ATAKKQEINQNTNATTEEKQV

SEQ ID NO: 1634865 - protein, 26 aa, Staphylococcus aureus
ATAKQNINAADTNQEVAQAKDQGTQN

SEQ ID NO: 1634866 - protein, 8 aa, Staphylococcus aureus
ATCGNGND

SEQ ID NO: 1634867 - protein, 38 aa, Staphylococcus aureus
ATDAPEKADIGTLEKPGQDGVDDGSSFDESTYTSSKSG

SEQ ID NO: 1634868 - protein, 11 aa, Staphylococcus aureus
ATDEDAERYAQ

SEQ ID NO: 1634869 - protein, 12 aa, Staphylococcus aureus
ATDKANPPANGA

SEQ ID NO: 1634870 - protein, 8 aa, Staphylococcus aureus
ATDKDYRQ

SEQ ID NO: 1634871 - protein, 24 aa, Staphylococcus aureus
ATDNVNNTTNDSQSKHVSIHVGKI

SEQ ID NO: 1634872 - protein, 16 aa, Staphylococcus aureus
ATEDISDQTTNAEIAT

SEQ ID NO: 1634873 - protein, 7 aa, Staphylococcus aureus
ATEGKSL

SEQ ID NO: 1634874 - protein, 16 aa, Staphylococcus aureus
ATEGQIEIDGKDVRRM

SEQ ID NO: 1634875 - protein, 5 aa, Staphylococcus aureus
ATEIG

SEQ ID NO: 1634876 - protein, 7 aa, Staphylococcus aureus
ATEISSI

SEQ ID NO: 1634877 - protein, 18 aa, Staphylococcus aureus
ATEKQRDQVADKFAKYIN

SEQ ID NO: 1634878 - protein, 8 aa, Staphylococcus aureus
ATENGDNI

SEQ ID NO: 1634879 - protein, 5 aa, Staphylococcus aureus
ATESR

SEQ ID NO: 1634880 - protein, 12 aa, Staphylococcus aureus
ATGETISGRGIG

SEQ ID NO: 1634881 - protein, 7 aa, Staphylococcus aureus
ATGLKEV

SEQ ID NO: 1634882 - protein, 8 aa, Staphylococcus aureus
ATGLPTDG

SEQ ID NO: 1634883 - protein, 25 aa, Staphylococcus aureus
ATGTPDEVKKQYHTDTIEGVFLNME

SEQ ID NO: 1634884 - protein, 17 aa, Staphylococcus aureus
ATKDNSLDTHGDDTLRD

SEQ ID NO: 1634885 - protein, 14 aa, Staphylococcus aureus
ATKDNSLDTHGDEA

SEQ ID NO: 1634886 - protein, 18 aa, Staphylococcus aureus
ATKDNSLDTHGDETLRAQ

SEQ ID NO: 1634887 - protein, 17 aa, Staphylococcus aureus
ATKDNSLNTHGDETLRD

SEQ ID NO: 1634888 - protein, 33 aa, Staphylococcus aureus
ATKDTRTRDTHRHLDGAKKRIDEPFKSSGCIGQ

SEQ ID NO: 1634889 - protein, 7 aa, Staphylococcus aureus
ATKEELH

SEQ ID NO: 1634890 - protein, 5 aa, Staphylococcus aureus
ATKEV

SEQ ID NO: 1634891 - protein, 8 aa, Staphylococcus aureus
ATKKNAND

SEQ ID NO: 1634892 - protein, 23 aa, Staphylococcus aureus
ATLDENKAQMADSVNNVKSGSLT

SEQ ID NO: 1634893 - protein, 6 aa, Staphylococcus aureus
ATLKEV

SEQ ID NO: 1634894 - protein, 42 aa, Staphylococcus aureus
ATLPNEDVVESDPSTTKAYLESGEEDNPTIGDMIGDKLKNLK

SEQ ID NO: 1634895 - protein, 9 aa, Staphylococcus aureus
ATNIENQQA

SEQ ID NO: 1634896 - protein, 9 aa, Staphylococcus aureus
ATNKIHNES

SEQ ID NO: 1634897 - protein, 4 aa, Staphylococcus aureus
ATNN

SEQ ID NO: 1634898 - protein, 12 aa, Staphylococcus aureus
ATPDVTEDEIQD

SEQ ID NO: 1634899 - protein, 7 aa, Staphylococcus aureus
ATPKEKT

SEQ ID NO: 1634900 - protein, 18 aa, Staphylococcus aureus
ATPKIYGDNAKKNAKDKS

SEQ ID NO: 1634901 - protein, 19 aa, Staphylococcus aureus
ATPKIYGEKAQKSAKEKSY

SEQ ID NO: 1634902 - protein, 18 aa, Staphylococcus aureus
ATPKIYSDDAKSKKNENS

SEQ ID NO: 1634903 - protein, 4 aa, Staphylococcus aureus
ATPL

SEQ ID NO: 1634904 - protein, 14 aa, Staphylococcus aureus
ATPNDVEKLGGITR

SEQ ID NO: 1634905 - protein, 9 aa, Staphylococcus aureus
ATQIKQEME

SEQ ID NO: 1634906 - protein, 5 aa, Staphylococcus aureus
ATQKE

SEQ ID NO: 1634907 - protein, 7 aa, Staphylococcus aureus
ATQNEIT

SEQ ID NO: 1634908 - protein, 10 aa, Staphylococcus aureus
ATQQRTQNQG

SEQ ID NO: 1634909 - protein, 4 aa, Staphylococcus aureus
ATQT

SEQ ID NO: 1634910 - protein, 13 aa, Staphylococcus aureus
ATQTQKATQIQTA

SEQ ID NO: 1634911 - protein, 20 aa, Staphylococcus aureus
ATQVKTDARNAVNEKAREAI

SEQ ID NO: 1634912 - protein, 21 aa, Staphylococcus aureus
ATQVKTDTRNVVNDKAREAIT

SEQ ID NO: 1634913 - protein, 20 aa, Staphylococcus aureus
ATRALNNDELERAEELEQEI

SEQ ID NO: 1634914 - protein, 4 aa, Staphylococcus aureus
ATRT

SEQ ID NO: 1634915 - protein, 12 aa, Staphylococcus aureus
ATSALDPSTTAS

SEQ ID NO: 1634916 - protein, 16 aa, Staphylococcus aureus
ATSEDSNLDEENKNTI

SEQ ID NO: 1634917 - protein, 6 aa, Staphylococcus aureus
ATSSGI

SEQ ID NO: 1634918 - protein, 5 aa, Staphylococcus aureus
ATSTT

SEQ ID NO: 1634919 - protein, 5 aa, Staphylococcus aureus
ATTAG

SEQ ID NO: 1634920 - protein, 7 aa, Staphylococcus aureus
ATTEKNP

SEQ ID NO: 1634921 - protein, 10 aa, Staphylococcus aureus
ATTKNNPTNF

SEQ ID NO: 1634922 - protein, 21 aa, Staphylococcus aureus
ATTKQDKIDSAETKKDLNSDV

SEQ ID NO: 1634923 - protein, 4 aa, Staphylococcus aureus
ATTN

SEQ ID NO: 1634924 - protein, 5 aa, Staphylococcus aureus
ATTNQ

SEQ ID NO: 1634925 - protein, 6 aa, Staphylococcus aureus
ATTSQL

SEQ ID NO: 1634926 - protein, 17 aa, Staphylococcus aureus
ATVGQNHKSNRKEAKQI

SEQ ID NO: 1634927 - protein, 11 aa, Staphylococcus aureus
ATVKPKANQAI

SEQ ID NO: 1634928 - protein, 37 aa, Staphylococcus aureus
ATVKPKANQAIDAKAQETKESIDQSDQLAAEEKTAAL

SEQ ID NO: 1634929 - protein, 39 aa, Staphylococcus aureus
ATVKPKANQAIDAKAQETKESIDQSDQLTAEEKNGCISN

SEQ ID NO: 1634930 - protein, 20 aa, Staphylococcus aureus
ATVSDESSASSNTVKPVASA

SEQ ID NO: 1634931 - protein, 14 aa, Staphylococcus aureus
ATYGKDPETKSEYW

SEQ ID NO: 1634932 - protein, 15 aa, Staphylococcus aureus
AVAAQRAVTDTTNEL

SEQ ID NO: 1634933 - protein, 11 aa, Staphylococcus aureus
AVAGGIKPDTI

SEQ ID NO: 1634934 - protein, 10 aa, Staphylococcus aureus
AVAGLSEEQL

SEQ ID NO: 1634935 - protein, 6 aa, Staphylococcus aureus
AVGANG

SEQ ID NO: 1634936 - protein, 13 aa, Staphylococcus aureus
AVGDETETKEVVV

SEQ ID NO: 1634937 - protein, 16 aa, Staphylococcus aureus
AVGDETETKEVVVKRG

SEQ ID NO: 1634938 - protein, 4 aa, Staphylococcus aureus
AVGG

SEQ ID NO: 1634939 - protein, 6 aa, Staphylococcus aureus
AVGNSS

SEQ ID NO: 1634940 - protein, 17 aa, Staphylococcus aureus
AVGSDQVSAYKPNPEGI

SEQ ID NO: 1634941 - protein, 6 aa, Staphylococcus aureus
AVGSNP

SEQ ID NO: 1634942 - protein, 4 aa, Staphylococcus aureus
AVIN

SEQ ID NO: 1634943 - protein, 5 aa, Staphylococcus aureus
AVKDP

SEQ ID NO: 1634944 - protein, 35 aa, Staphylococcus aureus
AVKNRSAVSGGGRKPWKQKGTGRARQGTIRAPQWR

SEQ ID NO: 1634945 - protein, 18 aa, Staphylococcus aureus
AVNGTASLDPDKQDDNLQ

SEQ ID NO: 1634946 - protein, 18 aa, Staphylococcus aureus
AVNGTASLDPEKQNDNLQ

SEQ ID NO: 1634947 - protein, 9 aa, Staphylococcus aureus
AVNKGTVMT

SEQ ID NO: 1634948 - protein, 17 aa, Staphylococcus aureus
AVSGSGKNGRIKKEDVD

SEQ ID NO: 1634949 - protein, 10 aa, Staphylococcus aureus
AVSNTSTQLN

SEQ ID NO: 1634950 - protein, 11 aa, Staphylococcus aureus
AVSQDGENGAE

SEQ ID NO: 1634951 - protein, 24 aa, Staphylococcus aureus
AVTAAKQALNGEERLNNRKSEALQ

SEQ ID NO: 1634952 - protein, 7 aa, Staphylococcus aureus
AVTAANT

SEQ ID NO: 1634953 - protein, 84 aa, Staphylococcus aureus
AVTDAKNNITAATDNNGVDTAKDADKNSIQSTQPATAVKSNAKNEVDQAVTTQNQAIDNTTGATTEEKNAAKDLVSKAKEKAYQ

SEQ ID NO: 1634954 - protein, 84 aa, Staphylococcus aureus
AVTDAKNNITAATNNNGVDTAKDAGKNSIQSTQPATAVKSNAKNEVDQAVTTQNQAIDNTTGATTEEKNAAKDLVSKAKEKAYQ

SEQ ID NO: 1634955 - protein, 9 aa, Staphylococcus aureus
AVTDKPSKY

SEQ ID NO: 1634956 - protein, 11 aa, Staphylococcus aureus
AVTNTPDIKGK

SEQ ID NO: 1634957 - protein, 8 aa, Staphylococcus aureus
AVTPNKAT

SEQ ID NO: 1634958 - protein, 6 aa, Staphylococcus aureus
AVTPRN

SEQ ID NO: 1634959 - protein, 29 aa, Staphylococcus aureus
AVTRAKAALNGADNLRNAKTSATNTIDGL

SEQ ID NO: 1634960 - protein, 27 aa, Staphylococcus aureus
AVTRAKAALNGAENLRNTKTSATNTIN

SEQ ID NO: 1634961 - protein, 15 aa, Staphylococcus aureus
AVTSAKNKATSLNTA

SEQ ID NO: 1634962 - protein, 7 aa, Staphylococcus aureus
AVTSDQA

SEQ ID NO: 1634963 - protein, 8 aa, Staphylococcus aureus
AYDKGDIK

SEQ ID NO: 1634964 - protein, 15 aa, Staphylococcus aureus
AYEIPEKQLEEKNGH

SEQ ID NO: 1634965 - protein, 4 aa, Staphylococcus aureus
AYGG

SEQ ID NO: 1634966 - protein, 7 aa, Staphylococcus aureus
AYHKDTE

SEQ ID NO: 1634967 - protein, 6 aa, Staphylococcus aureus
AYKGIT

SEQ ID NO: 1634968 - protein, 7 aa, Staphylococcus aureus
AYKRSSD

SEQ ID NO: 1634969 - protein, 14 aa, Staphylococcus aureus
AYNNVQVGDGPQQR

SEQ ID NO: 1634970 - protein, 26 aa, Staphylococcus aureus
AYQATFQSNPGFNETEKGSYGSPKIK

SEQ ID NO: 1634971 - protein, 13 aa, Staphylococcus aureus
AYRKKEKNFTPFK

SEQ ID NO: 1634972 - protein, 9 aa, Staphylococcus aureus
AYSGRYGGA

SEQ ID NO: 1634973 - protein, 6 aa, Staphylococcus aureus
AYVPST

SEQ ID NO: 1634974 - protein, 9 aa, Staphylococcus aureus
AYVPSTDTF

SEQ ID NO: 1634975 - protein, 6 aa, Staphylococcus aureus
CAGKST

SEQ ID NO: 1634976 - protein, 5 aa, Staphylococcus aureus
CAKAE

SEQ ID NO: 1634977 - protein, 9 aa, Staphylococcus aureus
CAKNATRQP

SEQ ID NO: 1634978 - protein, 5 aa, Staphylococcus aureus
CDEGE

SEQ ID NO: 1634979 - protein, 6 aa, Staphylococcus aureus
CDEPKN

SEQ ID NO: 1634980 - protein, 10 aa, Staphylococcus aureus
CEKESDNQKR

SEQ ID NO: 1634981 - protein, 4 aa, Staphylococcus aureus
CGAS

SEQ ID NO: 1634982 - protein, 12 aa, Staphylococcus aureus
CGEEEVAAITRV

SEQ ID NO: 1634983 - protein, 7 aa, Staphylococcus aureus
CGGNNAV

SEQ ID NO: 1634984 - protein, 6 aa, Staphylococcus aureus
CGGTIR

SEQ ID NO: 1634985 - protein, 7 aa, Staphylococcus aureus
CGPQQRE

SEQ ID NO: 1634986 - protein, 5 aa, Staphylococcus aureus
CGQEH

SEQ ID NO: 1634987 - protein, 14 aa, Staphylococcus aureus
CGTGKEAEIKKSFE

SEQ ID NO: 1634988 - protein, 7 aa, Staphylococcus aureus
CGVTEQA

SEQ ID NO: 1634989 - protein, 4 aa, Staphylococcus aureus
CKPT

SEQ ID NO: 1634990 - protein, 5 aa, Staphylococcus aureus
CMKND

SEQ ID NO: 1634991 - protein, 11 aa, Staphylococcus aureus
CNISNNNKPLD

SEQ ID NO: 1634992 - protein, 9 aa, Staphylococcus aureus
CNPPLNSRE

SEQ ID NO: 1634993 - protein, 15 aa, Staphylococcus aureus
CNQHGYGTQTTFSNN

SEQ ID NO: 1634994 - protein, 5 aa, Staphylococcus aureus
CNREG

SEQ ID NO: 1634995 - protein, 8 aa, Staphylococcus aureus
CPSPNNVA

SEQ ID NO: 1634996 - protein, 11 aa, Staphylococcus aureus
CPYGPRPGEQV

SEQ ID NO: 1634997 - protein, 11 aa, Staphylococcus aureus
CQTASSVKNYS

SEQ ID NO: 1634998 - protein, 24 aa, Staphylococcus aureus
CSVQRKNQKLIEESPCAALTEERR

SEQ ID NO: 1634999 - protein, 4 aa, Staphylococcus aureus
CSYK

SEQ ID NO: 1635000 - protein, 4 aa, Staphylococcus aureus
CTAS

SEQ ID NO: 1635001 - protein, 11 aa, Staphylococcus aureus
CTGAESYKEGV

SEQ ID NO: 1635002 - protein, 10 aa, Staphylococcus aureus
CTGTTGQTQY

SEQ ID NO: 1635003 - protein, 12 aa, Staphylococcus aureus
CTKAKEGKNRRL

SEQ ID NO: 1635004 - protein, 4 aa, Staphylococcus aureus
CVEG

SEQ ID NO: 1635005 - protein, 8 aa, Staphylococcus aureus
CVSPTGQR

SEQ ID NO: 1635006 - protein, 5 aa, Staphylococcus aureus
DAAEN

SEQ ID NO: 1635007 - protein, 9 aa, Staphylococcus aureus
DADDAVSQT

SEQ ID NO: 1635008 - protein, 19 aa, Staphylococcus aureus
DADQAKQQAYNTAVTNAEN

SEQ ID NO: 1635009 - protein, 11 aa, Staphylococcus aureus
DADTTYPKGTY

SEQ ID NO: 1635010 - protein, 4 aa, Staphylococcus aureus
DADV

SEQ ID NO: 1635011 - protein, 4 aa, Staphylococcus aureus
DAEA

SEQ ID NO: 1635012 - protein, 25 aa, Staphylococcus aureus
DAEDGNLINTSDEDKITDEEAKAHS

SEQ ID NO: 1635013 - protein, 25 aa, Staphylococcus aureus
DAEDGNLINTSDEDKTTDEEAKAHS

SEQ ID NO: 1635014 - protein, 7 aa, Staphylococcus aureus
DAEDQYE

SEQ ID NO: 1635015 - protein, 9 aa, Staphylococcus aureus
DAEGKEDNV

SEQ ID NO: 1635016 - protein, 8 aa, Staphylococcus aureus
DAEKKIMD

SEQ ID NO: 1635017 - protein, 9 aa, Staphylococcus aureus
DAEKKIMDT

SEQ ID NO: 1635018 - protein, 4 aa, Staphylococcus aureus
DAEN

SEQ ID NO: 1635019 - protein, 13 aa, Staphylococcus aureus
DAENAVNKKVDQM

SEQ ID NO: 1635020 - protein, 20 aa, Staphylococcus aureus
DAENKARQQSDDNYLASGST

SEQ ID NO: 1635021 - protein, 15 aa, Staphylococcus aureus
DAERQATKDAGKIAG

SEQ ID NO: 1635022 - protein, 7 aa, Staphylococcus aureus
DAFNGKI

SEQ ID NO: 1635023 - protein, 44 aa, Staphylococcus aureus
DAGCTVSGGNVSANGIDKFNENAKGGNLEGKGKEIQKIAEKNKV

SEQ ID NO: 1635024 - protein, 13 aa, Staphylococcus aureus
DAGGKGATAEAYR

SEQ ID NO: 1635025 - protein, 9 aa, Staphylococcus aureus
DAGIEADEY

SEQ ID NO: 1635026 - protein, 10 aa, Staphylococcus aureus
DAGNIKTAIT

SEQ ID NO: 1635027 - protein, 10 aa, Staphylococcus aureus
DAGNQDNWSY

SEQ ID NO: 1635028 - protein, 8 aa, Staphylococcus aureus
DAINAGVG

SEQ ID NO: 1635029 - protein, 11 aa, Staphylococcus aureus
DAINAGVGADT

SEQ ID NO: 1635030 - protein, 14 aa, Staphylococcus aureus
DAINNDKTSYSHNK

SEQ ID NO: 1635031 - protein, 9 aa, Staphylococcus aureus
DAINTGVGA

SEQ ID NO: 1635032 - protein, 7 aa, Staphylococcus aureus
DAIPKHD

SEQ ID NO: 1635033 - protein, 9 aa, Staphylococcus aureus
DAIQNYRPS

SEQ ID NO: 1635034 - protein, 5 aa, Staphylococcus aureus
DAKAD

SEQ ID NO: 1635035 - protein, 11 aa, Staphylococcus aureus
DAKENNDSNEV

SEQ ID NO: 1635036 - protein, 111 aa, Staphylococcus aureus; identical to SEQ ID NO: 1566154

SEQ ID NO: 1635037 - protein, 7 aa, Staphylococcus aureus
DAKNLAS

SEQ ID NO: 1635038 - protein, 10 aa, Staphylococcus aureus
DAKPLAKSYE

SEQ ID NO: 1635039 - protein, 6 aa, Staphylococcus aureus
DAKSAN

SEQ ID NO: 1635040 - protein, 17 aa, Staphylococcus aureus
DAKSDVNQTPVGTGPYQ

SEQ ID NO: 1635041 - protein, 15 aa, Staphylococcus aureus
DALPNGEIKARSSIS

SEQ ID NO: 1635042 - protein, 16 aa, Staphylococcus aureus
DALPNGGIKAKSSISM

SEQ ID NO: 1635043 - protein, 6 aa, Staphylococcus aureus
DANDIE

SEQ ID NO: 1635044 - protein, 4 aa, Staphylococcus aureus
DANE

SEQ ID NO: 1635045 - protein, 6 aa, Staphylococcus aureus
DANEGH

SEQ ID NO: 1635046 - protein, 7 aa, Staphylococcus aureus
DANEGQI

SEQ ID NO: 1635047 - protein, 5 aa, Staphylococcus aureus
DAPEI

SEQ ID NO: 1635048 - protein, 7 aa, Staphylococcus aureus
DAPKTQV

SEQ ID NO: 1635049 - protein, 7 aa, Staphylococcus aureus
DAPMEVN

SEQ ID NO: 1635050 - protein, 5 aa, Staphylococcus aureus
DAPPY

SEQ ID NO: 1635051 - protein, 7 aa, Staphylococcus aureus
DAPYTTT

SEQ ID NO: 1635052 - protein, 67 aa, Staphylococcus aureus
DAQDDLKEKESQAYADGKISEEEQRAIQDAQAKLEEAKQNAELKARNAEKKANAYTDNKVKESTDAQ

SEQ ID NO: 1635053 - protein, 68 aa, Staphylococcus aureus
DAQDDLKEKESQAYADGKISEEEQRAIQDAQAKLEEAKQNAELKARNAEKKANAYTDNKVKESTDAQR

SEQ ID NO: 1635054 - protein, 37 aa, Staphylococcus aureus
DAQDNLKEKESQAYADGKISEEEQRAIQDAQAKLEEA

SEQ ID NO: 1635055 - protein, 74 aa, Staphylococcus aureus
DAQDNLKEKESQAYADGKISEEEQRAIQDAQAKLEEAKQNAELKARNAEKKANAYTDNKVKESTDAQRKTLTRY

SEQ ID NO: 1635056 - protein, 19 aa, Staphylococcus aureus
DAQKQALKAQIDQSPEIAT

SEQ ID NO: 1635057 - protein, 32 aa, Staphylococcus aureus; identical to SEQ ID NO: 1566554

SEQ ID NO: 1635058 - protein, 12 aa, Staphylococcus aureus
DAQKQSVESQIT

SEQ ID NO: 1635059 - protein, 5 aa, Staphylococcus aureus
DAQTI

SEQ ID NO: 1635060 - protein, 5 aa, Staphylococcus aureus
DAREK

SEQ ID NO: 1635061 - protein, 6 aa, Staphylococcus aureus
DAREQR

SEQ ID NO: 1635062 - protein, 28 aa, Staphylococcus aureus
DARGQNDPTNTIDYTETNKHRETDDVSK

SEQ ID NO: 1635063 - protein, 14 aa, Staphylococcus aureus
DARNTVKKDQPNVF

SEQ ID NO: 1635064 - protein, 7 aa, Staphylococcus aureus
DASGDLK

SEQ ID NO: 1635065 - protein, 8 aa, Staphylococcus aureus
DASKNNES

SEQ ID NO: 1635066 - protein, 5 aa, Staphylococcus aureus
DASNK

SEQ ID NO: 1635067 - protein, 8 aa, Staphylococcus aureus
DATDEAAL

SEQ ID NO: 1635068 - protein, 8 aa, Staphylococcus aureus
DATGQSVE

SEQ ID NO: 1635069 - protein, 23 aa, Staphylococcus aureus
DATKASEDYVDANNDKQTAYNNA

SEQ ID NO: 1635070 - protein, 7 aa, Staphylococcus aureus
DATKNPI

SEQ ID NO: 1635071 - protein, 10 aa, Staphylococcus aureus
DATKPYDKTY

SEQ ID NO: 1635072 - protein, 8 aa, Staphylococcus aureus
DATTSKNI

SEQ ID NO: 1635073 - protein, 7 aa, Staphylococcus aureus
DAVGEQF

SEQ ID NO: 1635074 - protein, 14 aa, Staphylococcus aureus
DAVKKNIDAVQQNK

SEQ ID NO: 1635075 - protein, 13 aa, Staphylococcus aureus
DAYLGPDKMTSTD

SEQ ID NO: 1635076 - protein, 23 aa, Staphylococcus aureus
DAYRQAATEAGFDVSSKSLPVST

SEQ ID NO: 1635077 - protein, 8 aa, Staphylococcus aureus
DAYSETTK

SEQ ID NO: 1635078 - protein, 12 aa, Staphylococcus aureus
DCEEYKKQRDEL

SEQ ID NO: 1635079 - protein, 8 aa, Staphylococcus aureus
DCSPLKQD

SEQ ID NO: 1635080 - protein, 4 aa, Staphylococcus aureus
DDAE

SEQ ID NO: 1635081 - protein, 7 aa, Staphylococcus aureus
DDAKEVE

SEQ ID NO: 1635082 - protein, 26 aa, Staphylococcus aureus
DDAPKTQEHAVTESQVNNIDKTVDNE

SEQ ID NO: 1635083 - protein, 10 aa, Staphylococcus aureus
DDAPVKGSEF

SEQ ID NO: 1635084 - protein, 12 aa, Staphylococcus aureus
DDDDDINDSSNW

SEQ ID NO: 1635085 - protein, 4 aa, Staphylococcus aureus
DDDI

SEQ ID NO: 1635086 - protein, 11 aa, Staphylococcus aureus
DDDQDYKNPPK

SEQ ID NO: 1635087 - protein, 11 aa, Staphylococcus aureus
DDEDDNENDRQ

SEQ ID NO: 1635088 - protein, 5 aa, Staphylococcus aureus
DDEGV

SEQ ID NO: 1635089 - protein, 7 aa, Staphylococcus aureus
DDEHGAY

SEQ ID NO: 1635090 - protein, 7 aa, Staphylococcus aureus
DDEKNVE

SEQ ID NO: 1635091 - protein, 7 aa, Staphylococcus aureus
DDENEAI

SEQ ID NO: 1635092 - protein, 7 aa, Staphylococcus aureus
DDESKYG

SEQ ID NO: 1635093 - protein, 6 aa, Staphylococcus aureus
DDESLV

SEQ ID NO: 1635094 - protein, 6 aa, Staphylococcus aureus
DDGAYV

SEQ ID NO: 1635095 - protein, 5 aa, Staphylococcus aureus
DDGGD

SEQ ID NO: 1635096 - protein, 10 aa, Staphylococcus aureus
DDGQDYKKTP

SEQ ID NO: 1635097 - protein, 5 aa, Staphylococcus aureus
DDGSV

SEQ ID NO: 1635098 - protein, 6 aa, Staphylococcus aureus
DDGYVK

SEQ ID NO: 1635099 - protein, 12 aa, Staphylococcus aureus
DDIEDEPINNKQ

SEQ ID NO: 1635100 - protein, 14 aa, Staphylococcus aureus
DDIGTNIDTSTDAL

SEQ ID NO: 1635101 - protein, 11 aa, Staphylococcus aureus
DDKAAAFESNS

SEQ ID NO: 1635102 - protein, 7 aa, Staphylococcus aureus
DDKDIDK

SEQ ID NO: 1635103 - protein, 10 aa, Staphylococcus aureus
DDKKKKHSVN

SEQ ID NO: 1635104 - protein, 5 aa, Staphylococcus aureus
DDKQH

SEQ ID NO: 1635105 - protein, 16 aa, Staphylococcus aureus
DDKTFSDGMKNSKNNL

SEQ ID NO: 1635106 - protein, 20 aa, Staphylococcus aureus
DDKTRKDKKEIQSKIGQATA

SEQ ID NO: 1635107 - protein, 9 aa, Staphylococcus aureus
DDKTYSGET

SEQ ID NO: 1635108 - protein, 10 aa, Staphylococcus aureus
DDKVADTKGQ

SEQ ID NO: 1635109 - protein, 8 aa, Staphylococcus aureus
DDKYTNVG

SEQ ID NO: 1635110 - protein, 8 aa, Staphylococcus aureus
DDNATNVK

SEQ ID NO: 1635111 - protein, 4 aa, Staphylococcus aureus
DDNS

SEQ ID NO: 1635112 - protein, 7 aa, Staphylococcus aureus
DDNVSED

SEQ ID NO: 1635113 - protein, 6 aa, Staphylococcus aureus
DDNVTH

SEQ ID NO: 1635114 - protein, 8 aa, Staphylococcus aureus
DDNVTKNE

SEQ ID NO: 1635115 - protein, 9 aa, Staphylococcus aureus
DDPKGGCSG

SEQ ID NO: 1635116 - protein, 5 aa, Staphylococcus aureus
DDQEH

SEQ ID NO: 1635117 - protein, 8 aa, Staphylococcus aureus
DDQEYRDE

SEQ ID NO: 1635118 - protein, 13 aa, Staphylococcus aureus
DDRGNKKVNPAFN

SEQ ID NO: 1635119 - protein, 11 aa, Staphylococcus aureus
DDRGNQKVNPA

SEQ ID NO: 1635120 - protein, 12 aa, Staphylococcus aureus
DDRGNQKVNPAF

SEQ ID NO: 1635121 - protein, 27 aa, Staphylococcus aureus
DDRRDKSRKMNDKLTSVQKHLENSGEK

SEQ ID NO: 1635122 - protein, 7 aa, Staphylococcus aureus
DDSLNRD

SEQ ID NO: 1635123 - protein, 16 aa, Staphylococcus aureus
DDSMREELTRFIKALG

SEQ ID NO: 1635124 - protein, 16 aa, Staphylococcus aureus
DDSYKPKASDEAYDYA

SEQ ID NO: 1635125 - protein, 14 aa, Staphylococcus aureus
DDSYNPKASDESYD

SEQ ID NO: 1635126 - protein, 8 aa, Staphylococcus aureus
DDTEESDL

SEQ ID NO: 1635127 - protein, 5 aa, Staphylococcus aureus
DDTIP

SEQ ID NO: 1635128 - protein, 9 aa, Staphylococcus aureus
DDTNRKPKF

SEQ ID NO: 1635129 - protein, 10 aa, Staphylococcus aureus
DDTNRKPKFN

SEQ ID NO: 1635130 - protein, 4 aa, Staphylococcus aureus
DDTR

SEQ ID NO: 1635131 - protein, 7 aa, Staphylococcus aureus
DDTVTYD

SEQ ID NO: 1635132 - protein, 4 aa, Staphylococcus aureus
DDVD

SEQ ID NO: 1635133 - protein, 21 aa, Staphylococcus aureus
DDVDDEKDALAKRLDNNPDEL

SEQ ID NO: 1635134 - protein, 21 aa, Staphylococcus aureus
DDVDKEKDTLAKRLDDNPDEL

SEQ ID NO: 1635135 - protein, 17 aa, Staphylococcus aureus
DDVEAPSDFEKIRAEVS

SEQ ID NO: 1635136 - protein, 7 aa, Staphylococcus aureus
DDVEVPS

SEQ ID NO: 1635137 - protein, 17 aa, Staphylococcus aureus
DDVEVPSDFEKIRAEVS

SEQ ID NO: 1635138 - protein, 8 aa, Staphylococcus aureus
DDVTDEEM

SEQ ID NO: 1635139 - protein, 7 aa, Staphylococcus aureus
DDYPALY

SEQ ID NO: 1635140 - protein, 8 aa, Staphylococcus aureus
DDYYESKH

SEQ ID NO: 1635141 - protein, 11 aa, Staphylococcus aureus
DEAENSEDIGT

SEQ ID NO: 1635142 - protein, 8 aa, Staphylococcus aureus
DEALAGYA

SEQ ID NO: 1635143 - protein, 27 aa, Staphylococcus aureus
DEASKAIKEAEKARKARKKEVDKQYED

SEQ ID NO: 1635144 - protein, 5 aa, Staphylococcus aureus
DEDFE

SEQ ID NO: 1635145 - protein, 9 aa, Staphylococcus aureus
DEDKNQSFV

SEQ ID NO: 1635146 - protein, 13 aa, Staphylococcus aureus
DEDNVQDINETAA

SEQ ID NO: 1635147 - protein, 26 aa, Staphylococcus aureus
DEDNVQDINETAAPLAYGDSELSRTG

SEQ ID NO: 1635148 - protein, 10 aa, Staphylococcus aureus
DEEKLENNSI

SEQ ID NO: 1635149 - protein, 11 aa, Staphylococcus aureus
DEELSDIQSKK

SEQ ID NO: 1635150 - protein, 9 aa, Staphylococcus aureus
DEERQDETI

SEQ ID NO: 1635151 - protein, 16 aa, Staphylococcus aureus
DEETKLNNTFSDTTTY

SEQ ID NO: 1635152 - protein, 8 aa, Staphylococcus aureus
DEFDDDEV

SEQ ID NO: 1635153 - protein, 5 aa, Staphylococcus aureus
DEFST

SEQ ID NO: 1635154 - protein, 16 aa, Staphylococcus aureus
DEFTKKERKHYILESI

SEQ ID NO: 1635155 - protein, 5 aa, Staphylococcus aureus
DEGKT

SEQ ID NO: 1635156 - protein, 8 aa, Staphylococcus aureus
DEGNRTEF

SEQ ID NO: 1635157 - protein, 16 aa, Staphylococcus aureus
DEGQVNESSMVREPEQ

SEQ ID NO: 1635158 - protein, 18 aa, Staphylococcus aureus
DEGVADDVKEAVKNAVET

SEQ ID NO: 1635159 - protein, 20 aa, Staphylococcus aureus
DEGVKDATKTETSKHKGGTL

SEQ ID NO: 1635160 - protein, 12 aa, Staphylococcus aureus
DEHDTEISNSNI

SEQ ID NO: 1635161 - protein, 12 aa, Staphylococcus aureus
DEHDTEMSNSNI

SEQ ID NO: 1635162 - protein, 15 aa, Staphylococcus aureus
DEHNDDAERLFFIAK

SEQ ID NO: 1635163 - protein, 6 aa, Staphylococcus aureus
DEIHPE

SEQ ID NO: 1635164 - protein, 31 aa, Staphylococcus aureus
DEIQEDSEIEEIRTAQKDKTLKEVEAPKGII

SEQ ID NO: 1635165 - protein, 6 aa, Staphylococcus aureus
DEITNE

SEQ ID NO: 1635166 - protein, 60 aa, Staphylococcus aureus; identical to SEQ ID NO: 1564755

SEQ ID NO: 1635167 - protein, 8 aa, Staphylococcus aureus
DEKAPVRR

SEQ ID NO: 1635168 - protein, 11 aa, Staphylococcus aureus
DEKATQEDYKA

SEQ ID NO: 1635169 - protein, 17 aa, Staphylococcus aureus
DEKIEQNYKGKRKIRTD

SEQ ID NO: 1635170 - protein, 13 aa, Staphylococcus aureus
DEKQEEKNHKNIA

SEQ ID NO: 1635171 - protein, 13 aa, Staphylococcus aureus
DEKQEEKNHKNMA

SEQ ID NO: 1635172 - protein, 9 aa, Staphylococcus aureus
DEKQETIKS

SEQ ID NO: 1635173 - protein, 5 aa, Staphylococcus aureus
DEKQV

SEQ ID NO: 1635174 - protein, 19 aa, Staphylococcus aureus
DEKSAYNNVQVGDGPQQRE

SEQ ID NO: 1635175 - protein, 20 aa, Staphylococcus aureus
DEKSAYNNVQVGEGSQHREF

SEQ ID NO: 1635176 - protein, 18 aa, Staphylococcus aureus
DEKSAYNNVQVGVGRRNK

SEQ ID NO: 1635177 - protein, 15 aa, Staphylococcus aureus
DEKVEQITNDTSRQL

SEQ ID NO: 1635178 - protein, 7 aa, Staphylococcus aureus
DEKVEYD

SEQ ID NO: 1635179 - protein, 7 aa, Staphylococcus aureus
DEKVSVR

SEQ ID NO: 1635180 - protein, 17 aa, Staphylococcus aureus
DELPTEESDDLKEYQRY

SEQ ID NO: 1635181 - protein, 11 aa, Staphylococcus aureus
DELRSSKRVTT

SEQ ID NO: 1635182 - protein, 4 aa, Staphylococcus aureus
DELT

SEQ ID NO: 1635183 - protein, 6 aa, Staphylococcus aureus
DELTET

SEQ ID NO: 1635184 - protein, 4 aa, Staphylococcus aureus
DELV

SEQ ID NO: 1635185 - protein, 11 aa, Staphylococcus aureus
DELYGGQSEHF

SEQ ID NO: 1635186 - protein, 16 aa, Staphylococcus aureus
DENATQEDYKALESKL

SEQ ID NO: 1635187 - protein, 10 aa, Staphylococcus aureus
DENATQEDYT

SEQ ID NO: 1635188 - protein, 12 aa, Staphylococcus aureus
DENCKMGPRMTS

SEQ ID NO: 1635189 - protein, 6 aa, Staphylococcus aureus
DENDLD

SEQ ID NO: 1635190 - protein, 6 aa, Staphylococcus aureus
DENGDW

SEQ ID NO: 1635191 - protein, 5 aa, Staphylococcus aureus
DENKA

SEQ ID NO: 1635192 - protein, 15 aa, Staphylococcus aureus
DENNEFEPKRKGNKF

SEQ ID NO: 1635193 - protein, 6 aa, Staphylococcus aureus
DENNQY

SEQ ID NO: 1635194 - protein, 10 aa, Staphylococcus aureus
DENRNNVPLN

SEQ ID NO: 1635195 - protein, 7 aa, Staphylococcus aureus
DENSRKD

SEQ ID NO: 1635196 - protein, 7 aa, Staphylococcus aureus
DENSRMS

SEQ ID NO: 1635197 - protein, 6 aa, Staphylococcus aureus
DENYPG

SEQ ID NO: 1635198 - protein, 6 aa, Staphylococcus aureus
DEPEDV

SEQ ID NO: 1635199 - protein, 9 aa, Staphylococcus aureus
DEPGDMTTE

SEQ ID NO: 1635200 - protein, 6 aa, Staphylococcus aureus
DEPKDF

SEQ ID NO: 1635201 - protein, 9 aa, Staphylococcus aureus
DEPNEQAEK

SEQ ID NO: 1635202 - protein, 13 aa, Staphylococcus aureus
DEPTASLDADRAT

SEQ ID NO: 1635203 - protein, 14 aa, Staphylococcus aureus
DEPTASLDADRTTK

SEQ ID NO: 1635204 - protein, 12 aa, Staphylococcus aureus
DEPTASLDTENA

SEQ ID NO: 1635205 - protein, 6 aa, Staphylococcus aureus
DEQELP

SEQ ID NO: 1635206 - protein, 10 aa, Staphylococcus aureus
DEQKRYMDDK

SEQ ID NO: 1635207 - protein, 10 aa, Staphylococcus aureus
DEQKRYMDEK

SEQ ID NO: 1635208 - protein, 4 aa, Staphylococcus aureus
DEQL

SEQ ID NO: 1635209 - protein, 9 aa, Staphylococcus aureus
DEQTGEKYT

SEQ ID NO: 1635210 - protein, 8 aa, Staphylococcus aureus
DEQTVEQH

SEQ ID NO: 1635211 - protein, 14 aa, Staphylococcus aureus
DEREDHLDKQPIDT

SEQ ID NO: 1635212 - protein, 5 aa, Staphylococcus aureus
DERFP

SEQ ID NO: 1635213 - protein, 4 aa, Staphylococcus aureus
DERI

SEQ ID NO: 1635214 - protein, 7 aa, Staphylococcus aureus
DERKADL

SEQ ID NO: 1635215 - protein, 4 aa, Staphylococcus aureus
DESA

SEQ ID NO: 1635216 - protein, 9 aa, Staphylococcus aureus
DESDAHNHS

SEQ ID NO: 1635217 - protein, 7 aa, Staphylococcus aureus
DESEKHE

SEQ ID NO: 1635218 - protein, 7 aa, Staphylococcus aureus
DESKAQQ

SEQ ID NO: 1635219 - protein, 13 aa, Staphylococcus aureus
DESKVDKDALSNN

SEQ ID NO: 1635220 - protein, 28 aa, Staphylococcus aureus
DETGAQEASKDEAKQGSCTKRESSTTFD

SEQ ID NO: 1635221 - protein, 6 aa, Staphylococcus aureus
DETTVT

SEQ ID NO: 1635222 - protein, 21 aa, Staphylococcus aureus
DETVDKAKQALDKSTGQNLTA

SEQ ID NO: 1635223 - protein, 8 aa, Staphylococcus aureus
DETVTPAQ

SEQ ID NO: 1635224 - protein, 4 aa, Staphylococcus aureus
DEVD

SEQ ID NO: 1635225 - protein, 19 aa, Staphylococcus aureus
DEVGEQNITPSERKSSFTL

SEQ ID NO: 1635226 - protein, 23 aa, Staphylococcus aureus
DEVTAENGAKKDTMAGKGRLNNQ

SEQ ID NO: 1635227 - protein, 14 aa, Staphylococcus aureus
DEVTKEVKDYMPPV

SEQ ID NO: 1635228 - protein, 7 aa, Staphylococcus aureus
DEYEEKK

SEQ ID NO: 1635229 - protein, 4 aa, Staphylococcus aureus
DFAK

SEQ ID NO: 1635230 - protein, 21 aa, Staphylococcus aureus
DFASTKEELEAKASSLSTKTI

SEQ ID NO: 1635231 - protein, 8 aa, Staphylococcus aureus
DFEEKTKL

SEQ ID NO: 1635232 - protein, 7 aa, Staphylococcus aureus
DFGEGEV

SEQ ID NO: 1635233 - protein, 7 aa, Staphylococcus aureus
DFKENIG

SEQ ID NO: 1635234 - protein, 21 aa, Staphylococcus aureus
DFKKVNPSKYKYETGPKANSK

SEQ ID NO: 1635235 - protein, 11 aa, Staphylococcus aureus
DFNSTGDRKVT

SEQ ID NO: 1635236 - protein, 12 aa, Staphylococcus aureus
DFSDRNNLDSLD

SEQ ID NO: 1635237 - protein, 12 aa, Staphylococcus aureus
DFSEEANQSLKQ

SEQ ID NO: 1635238 - protein, 12 aa, Staphylococcus aureus
DFSESSEDYGVQ

SEQ ID NO: 1635239 - protein, 4 aa, Staphylococcus aureus
DFTN

SEQ ID NO: 1635240 - protein, 12 aa, Staphylococcus aureus
DGALQDCDGDTN

SEQ ID NO: 1635241 - protein, 16 aa, Staphylococcus aureus
DGAYTTATLGTDIQNG

SEQ ID NO: 1635242 - protein, 7 aa, Staphylococcus aureus
DGDAKDV

SEQ ID NO: 1635243 - protein, 9 aa, Staphylococcus aureus
DGDGTGRRM

SEQ ID NO: 1635244 - protein, 15 aa, Staphylococcus aureus
DGDISYNPEVPSYSA

SEQ ID NO: 1635245 - protein, 7 aa, Staphylococcus aureus
DGDKKVA

SEQ ID NO: 1635246 - protein, 12 aa, Staphylococcus aureus
DGDLKGSSIGSK

SEQ ID NO: 1635247 - protein, 7 aa, Staphylococcus aureus
DGDTLEQ

SEQ ID NO: 1635248 - protein, 18 aa, Staphylococcus aureus
DGDTTSGKYITEIWMPVK

SEQ ID NO: 1635249 - protein, 21 aa, Staphylococcus aureus
DGEGEDGGSSGTIQWWDKTYS

SEQ ID NO: 1635250 - protein, 5 aa, Staphylococcus aureus
DGEIS

SEQ ID NO: 1635251 - protein, 11 aa, Staphylococcus aureus
DGELPGNTLEQ

SEQ ID NO: 1635252 - protein, 5 aa, Staphylococcus aureus
DGELQ

SEQ ID NO: 1635253 - protein, 7 aa, Staphylococcus aureus
DGENVSR

SEQ ID NO: 1635254 - protein, 5 aa, Staphylococcus aureus
DGEQI

SEQ ID NO: 1635255 - protein, 8 aa, Staphylococcus aureus
DGESVQQG

SEQ ID NO: 1635256 - protein, 16 aa, Staphylococcus aureus
DGEYTTATLGTDIQNG

SEQ ID NO: 1635257 - protein, 26 aa, Staphylococcus aureus
DGGKYTLESHKELQKNRENVKINTAD

SEQ ID NO: 1635258 - protein, 8 aa, Staphylococcus aureus
DGGNGKGT

SEQ ID NO: 1635259 - protein, 5 aa, Staphylococcus aureus
DGGQV

SEQ ID NO: 1635260 - protein, 7 aa, Staphylococcus aureus
DGHALTT

SEQ ID NO: 1635261 - protein, 5 aa, Staphylococcus aureus
DGHTG

SEQ ID NO: 1635262 - protein, 13 aa, Staphylococcus aureus
DGIDPTYDSYDES

SEQ ID NO: 1635263 - protein, 6 aa, Staphylococcus aureus
DGIPTY

SEQ ID NO: 1635264 - protein, 10 aa, Staphylococcus aureus
DGKGEIPREE

SEQ ID NO: 1635265 - protein, 8 aa, Staphylococcus aureus
DGKIRNSN

SEQ ID NO: 1635266 - protein, 9 aa, Staphylococcus aureus
DGKMSGPNF

SEQ ID NO: 1635267 - protein, 6 aa, Staphylococcus aureus
DGKNPI

SEQ ID NO: 1635268 - protein, 4 aa, Staphylococcus aureus
DGKQ

SEQ ID NO: 1635269 - protein, 10 aa, Staphylococcus aureus
DGKRLYSDNG

SEQ ID NO: 1635270 - protein, 9 aa, Staphylococcus aureus
DGKSAYNNV

SEQ ID NO: 1635271 - protein, 9 aa, Staphylococcus aureus
DGKTFTESN

SEQ ID NO: 1635272 - protein, 7 aa, Staphylococcus aureus
DGKTYES

SEQ ID NO: 1635273 - protein, 11 aa, Staphylococcus aureus
DGLEEPPVEPG

SEQ ID NO: 1635274 - protein, 10 aa, Staphylococcus aureus
DGLEGKKKIE

SEQ ID NO: 1635275 - protein, 9 aa, Staphylococcus aureus
DGLTQPADV

SEQ ID NO: 1635276 - protein, 4 aa, Staphylococcus aureus
DGNE

SEQ ID NO: 1635277 - protein, 7 aa, Staphylococcus aureus
DGNKNNK

SEQ ID NO: 1635278 - protein, 10 aa, Staphylococcus aureus
DGNNGKGTFQ

SEQ ID NO: 1635279 - protein, 6 aa, Staphylococcus aureus
DGNPDL

SEQ ID NO: 1635280 - protein, 6 aa, Staphylococcus aureus
DGNSNI

SEQ ID NO: 1635281 - protein, 8 aa, Staphylococcus aureus
DGNSTSDI

SEQ ID NO: 1635282 - protein, 7 aa, Staphylococcus aureus
DGPELAP

SEQ ID NO: 1635283 - protein, 4 aa, Staphylococcus aureus
DGPI

SEQ ID NO: 1635284 - protein, 9 aa, Staphylococcus aureus
DGPTLNDCQ

SEQ ID NO: 1635285 - protein, 8 aa, Staphylococcus aureus
DGQESYTY

SEQ ID NO: 1635286 - protein, 7 aa, Staphylococcus aureus
DGQPKFI

SEQ ID NO: 1635287 - protein, 20 aa, Staphylococcus aureus
DGQQRISTNYQAYSNDESIQ

SEQ ID NO: 1635288 - protein, 7 aa, Staphylococcus aureus
DGSEEKI

SEQ ID NO: 1635289 - protein, 5 aa, Staphylococcus aureus
DGSIA

SEQ ID NO: 1635290 - protein, 7 aa, Staphylococcus aureus
DGSNAHS

SEQ ID NO: 1635291 - protein, 7 aa, Staphylococcus aureus
DGSNDHK

SEQ ID NO: 1635292 - protein, 9 aa, Staphylococcus aureus
DGSNPALNI

SEQ ID NO: 1635293 - protein, 7 aa, Staphylococcus aureus
DGSRFQD

SEQ ID NO: 1635294 - protein, 5 aa, Staphylococcus aureus
DGTED

SEQ ID NO: 1635295 - protein, 13 aa, Staphylococcus aureus
DGTHQTPKYTNEG

SEQ ID NO: 1635296 - protein, 45 aa, Staphylococcus aureus; identical to SEQ ID NO: 1563906

SEQ ID NO: 1635297 - protein, 19 aa, Staphylococcus aureus
DGTLSSKIVTSNNKSLDKV

SEQ ID NO: 1635298 - protein, 6 aa, Staphylococcus aureus
DGTMPQ

SEQ ID NO: 1635299 - protein, 14 aa, Staphylococcus aureus
DGTSIERIEVNLKS

SEQ ID NO: 1635300 - protein, 15 aa, Staphylococcus aureus
DGTTYDTDKDVKKGE

SEQ ID NO: 1635301 - protein, 4 aa, Staphylococcus aureus
DGVL

SEQ ID NO: 1635302 - protein, 6 aa, Staphylococcus aureus
DGVPTL

SEQ ID NO: 1635303 - protein, 22 aa, Staphylococcus aureus
DGVSKDCKVADKSGQAITYASR

SEQ ID NO: 1635304 - protein, 4 aa, Staphylococcus aureus
DGVT

SEQ ID NO: 1635305 - protein, 6 aa, Staphylococcus aureus
DGWTPD

SEQ ID NO: 1635306 - protein, 4 aa, Staphylococcus aureus
DHEA

SEQ ID NO: 1635307 - protein, 13 aa, Staphylococcus aureus
DHEDERESRFANE

SEQ ID NO: 1635308 - protein, 11 aa, Staphylococcus aureus
DHEDGKNGFDS

SEQ ID NO: 1635309 - protein, 24 aa, Staphylococcus aureus
DHGKSDQVLTDDDQPMTTHTTNPV

SEQ ID NO: 1635310 - protein, 5 aa, Staphylococcus aureus
DHIPE

SEQ ID NO: 1635311 - protein, 7 aa, Staphylococcus aureus
DHNSEDK

SEQ ID NO: 1635312 - protein, 5 aa, Staphylococcus aureus
DHPQW

SEQ ID NO: 1635313 - protein, 6 aa, Staphylococcus aureus
DHQQRL

SEQ ID NO: 1635314 - protein, 5 aa, Staphylococcus aureus
DHSDA

SEQ ID NO: 1635315 - protein, 6 aa, Staphylococcus aureus
DHSNSN

SEQ ID NO: 1635316 - protein, 6 aa, Staphylococcus aureus
DHSTNS

SEQ ID NO: 1635317 - protein, 5 aa, Staphylococcus aureus
DHVDY

SEQ ID NO: 1635318 - protein, 8 aa, Staphylococcus aureus
DIANTSYD

SEQ ID NO: 1635319 - protein, 21 aa, Staphylococcus aureus
DIAQNKTNAEVDQTEADGNNN

SEQ ID NO: 1635320 - protein, 7 aa, Staphylococcus aureus
DIDADEQ

SEQ ID NO: 1635321 - protein, 6 aa, Staphylococcus aureus
DIDAQT

SEQ ID NO: 1635322 - protein, 9 aa, Staphylococcus aureus
DIDENKLEQ

SEQ ID NO: 1635323 - protein, 12 aa, Staphylococcus aureus
DIDPNRIKDTGN

SEQ ID NO: 1635324 - protein, 11 aa, Staphylococcus aureus
DIDPRHTTGQY

SEQ ID NO: 1635325 - protein, 5 aa, Staphylococcus aureus
DIDPT

SEQ ID NO: 1635326 - protein, 5 aa, Staphylococcus aureus
DIEDL

SEQ ID NO: 1635327 - protein, 11 aa, Staphylococcus aureus
DIEDRQKKLES

SEQ ID NO: 1635328 - protein, 7 aa, Staphylococcus aureus
DIEEQDY

SEQ ID NO: 1635329 - protein, 8 aa, Staphylococcus aureus
DIEGSSSI

SEQ ID NO: 1635330 - protein, 6 aa, Staphylococcus aureus
DIEKEK

SEQ ID NO: 1635331 - protein, 7 aa, Staphylococcus aureus
DIEKEKY

SEQ ID NO: 1635332 - protein, 19 aa, Staphylococcus aureus
DIEQNSSNENKENLTEDKI

SEQ ID NO: 1635333 - protein, 18 aa, Staphylococcus aureus
DIESGTPTEVLTGENEGY

SEQ ID NO: 1635334 - protein, 5 aa, Staphylococcus aureus
DIGQN

SEQ ID NO: 1635335 - protein, 11 aa, Staphylococcus aureus
DIIREKEKKLT

SEQ ID NO: 1635336 - protein, 9 aa, Staphylococcus aureus
DIKKYQKVA

SEQ ID NO: 1635337 - protein, 16 aa, Staphylococcus aureus
DIKNNSDRIDVDGDIP

SEQ ID NO: 1635338 - protein, 13 aa, Staphylococcus aureus
DIKQTTQSLNTAM

SEQ ID NO: 1635339 - protein, 18 aa, Staphylococcus aureus
DIKRPKKKTSVEELEDTE

SEQ ID NO: 1635340 - protein, 11 aa, Staphylococcus aureus
DINGNEQGYTP

SEQ ID NO: 1635341 - protein, 5 aa, Staphylococcus aureus
DINNP

SEQ ID NO: 1635342 - protein, 12 aa, Staphylococcus aureus
DINTDEEKQITA

SEQ ID NO: 1635343 - protein, 22 aa, Staphylococcus aureus
DINTKEDFKATIERSDSCAAPA

SEQ ID NO: 1635344 - protein, 19 aa, Staphylococcus aureus
DIPKADDDPSTYSTSEQNG

SEQ ID NO: 1635345 - protein, 4 aa, Staphylococcus aureus
DIPP

SEQ ID NO: 1635346 - protein, 10 aa, Staphylococcus aureus
DIPPTINNPV

SEQ ID NO: 1635347 - protein, 13 aa, Staphylococcus aureus
DIPSNDLGGKVGG

SEQ ID NO: 1635348 - protein, 15 aa, Staphylococcus aureus
DIPSNDLGGKVGGDF

SEQ ID NO: 1635349 - protein, 9 aa, Staphylococcus aureus
DIPSSPVLG

SEQ ID NO: 1635350 - protein, 9 aa, Staphylococcus aureus
DIPTKQAPE

SEQ ID NO: 1635351 - protein, 5 aa, Staphylococcus aureus
DIQKG

SEQ ID NO: 1635352 - protein, 9 aa, Staphylococcus aureus
DIQTKKAPK

SEQ ID NO: 1635353 - protein, 6 aa, Staphylococcus aureus
DIRTRV

SEQ ID NO: 1635354 - protein, 51 aa, Staphylococcus aureus
DISGSQSDESTQGEEAQREDVSANPNDNDSDIEEKSEETEPKKGFWSRLFG

SEQ ID NO: 1635355 - protein, 14 aa, Staphylococcus aureus
DISKNQNEKKYRVE

SEQ ID NO: 1635356 - protein, 5 aa, Staphylococcus aureus
DISQT

SEQ ID NO: 1635357 - protein, 7 aa, Staphylococcus aureus
DISRKNK

SEQ ID NO: 1635358 - protein, 9 aa, Staphylococcus aureus
DISSINKSQ

SEQ ID NO: 1635359 - protein, 7 aa, Staphylococcus aureus
DITDAIK

SEQ ID NO: 1635360 - protein, 8 aa, Staphylococcus aureus
DITEEDID

SEQ ID NO: 1635361 - protein, 8 aa, Staphylococcus aureus
DITEETKV

SEQ ID NO: 1635362 - protein, 6 aa, Staphylococcus aureus
DITEMK

SEQ ID NO: 1635363 - protein, 9 aa, Staphylococcus aureus
DITENDIDT

SEQ ID NO: 1635364 - protein, 5 aa, Staphylococcus aureus
DIVDD

SEQ ID NO: 1635365 - protein, 5 aa, Staphylococcus aureus
DIVER

SEQ ID NO: 1635366 - protein, 6 aa, Staphylococcus aureus
DKAGIN

SEQ ID NO: 1635367 - protein, 15 aa, Staphylococcus aureus
DKALSSALDKTVGKI

SEQ ID NO: 1635368 - protein, 8 aa, Staphylococcus aureus
DKANLQNL

SEQ ID NO: 1635369 - protein, 7 aa, Staphylococcus aureus
DKANVDA

SEQ ID NO: 1635370 - protein, 7 aa, Staphylococcus aureus
DKAQEIN

SEQ ID NO: 1635371 - protein, 10 aa, Staphylococcus aureus
DKARVPAGGA

SEQ ID NO: 1635372 - protein, 7 aa, Staphylococcus aureus
DKAVKDA

SEQ ID NO: 1635373 - protein, 10 aa, Staphylococcus aureus
DKCDQAEQHY

SEQ ID NO: 1635374 - protein, 6 aa, Staphylococcus aureus
DKDARL

SEQ ID NO: 1635375 - protein, 7 aa, Staphylococcus aureus
DKDDSMG

SEQ ID NO: 1635376 - protein, 6 aa, Staphylococcus aureus
DKDEGM

SEQ ID NO: 1635377 - protein, 7 aa, Staphylococcus aureus
DKDETKD

SEQ ID NO: 1635378 - protein, 9 aa, Staphylococcus aureus
DKDFYDSKT

SEQ ID NO: 1635379 - protein, 11 aa, Staphylococcus aureus
DKDIKKYQKVA

SEQ ID NO: 1635380 - protein, 6 aa, Staphylococcus aureus
DKDKVE

SEQ ID NO: 1635381 - protein, 20 aa, Staphylococcus aureus
DKDNDGSTEKGSFDITSDQR

SEQ ID NO: 1635382 - protein, 9 aa, Staphylococcus aureus
DKDNTDNDG

SEQ ID NO: 1635383 - protein, 11 aa, Staphylococcus aureus
DKDRNAHPLTQ

SEQ ID NO: 1635384 - protein, 8 aa, Staphylococcus aureus
DKDTERIN

SEQ ID NO: 1635385 - protein, 23 aa, Staphylococcus aureus
DKDTKKRIDDAEQAERAEKNAQE

SEQ ID NO: 1635386 - protein, 9 aa, Staphylococcus aureus
DKDVTDDYK

SEQ ID NO: 1635387 - protein, 7 aa, Staphylococcus aureus
DKEAPDN

SEQ ID NO: 1635388 - protein, 8 aa, Staphylococcus aureus
DKEAPNHV

SEQ ID NO: 1635389 - protein, 6 aa, Staphylococcus aureus
DKEASD

SEQ ID NO: 1635390 - protein, 7 aa, Staphylococcus aureus
DKEGGVD

SEQ ID NO: 1635391 - protein, 17 aa, Staphylococcus aureus
DKEGYCDDQFDKNDKGT

SEQ ID NO: 1635392 - protein, 18 aa, Staphylococcus aureus
DKEGYRDDEFKKGDKGTW

SEQ ID NO: 1635393 - protein, 18 aa, Staphylococcus aureus
DKEGYRDDQFDKNDKGTW

SEQ ID NO: 1635394 - protein, 20 aa, Staphylococcus aureus
DKEGYRDGEFKKGDKGTWTI

SEQ ID NO: 1635395 - protein, 7 aa, Staphylococcus aureus
DKEIEEI

SEQ ID NO: 1635396 - protein, 4 aa, Staphylococcus aureus
DKEK

SEQ ID NO: 1635397 - protein, 7 aa, Staphylococcus aureus
DKEKEAL

SEQ ID NO: 1635398 - protein, 9 aa, Staphylococcus aureus
DKEKEQAQN

SEQ ID NO: 1635399 - protein, 7 aa, Staphylococcus aureus
DKEKESL

SEQ ID NO: 1635400 - protein, 12 aa, Staphylococcus aureus
DKEKYKEGIEGK

SEQ ID NO: 1635401 - protein, 11 aa, Staphylococcus aureus
DKELSNTTIQK

SEQ ID NO: 1635402 - protein, 17 aa, Staphylococcus aureus
DKEQKIKKEKYWGTIEW

SEQ ID NO: 1635403 - protein, 7 aa, Staphylococcus aureus
DKERRQA

SEQ ID NO: 1635404 - protein, 8 aa, Staphylococcus aureus
DKESKQLA

SEQ ID NO: 1635405 - protein, 8 aa, Staphylococcus aureus
DKETGAFG

SEQ ID NO: 1635406 - protein, 5 aa, Staphylococcus aureus
DKETH

SEQ ID NO: 1635407 - protein, 6 aa, Staphylococcus aureus
DKFGEV

SEQ ID NO: 1635408 - protein, 7 aa, Staphylococcus aureus
DKFHSNK

SEQ ID NO: 1635409 - protein, 15 aa, Staphylococcus aureus
DKFQSDKDYHYQDKA

SEQ ID NO: 1635410 - protein, 7 aa, Staphylococcus aureus
DKGAQSD

SEQ ID NO: 1635411 - protein, 4 aa, Staphylococcus aureus
DKGF

SEQ ID NO: 1635412 - protein, 6 aa, Staphylococcus aureus
DKGGQC

SEQ ID NO: 1635413 - protein, 8 aa, Staphylococcus aureus
DKGKNREG

SEQ ID NO: 1635414 - protein, 4 aa, Staphylococcus aureus
DKGL

SEQ ID NO: 1635415 - protein, 10 aa, Staphylococcus aureus
DKGLAGAYSA

SEQ ID NO: 1635416 - protein, 14 aa, Staphylococcus aureus
DKGMASYNAKISGK

SEQ ID NO: 1635417 - protein, 7 aa, Staphylococcus aureus
DKGNPRA

SEQ ID NO: 1635418 - protein, 14 aa, Staphylococcus aureus
DKGQVNESSMVREP

SEQ ID NO: 1635419 - protein, 19 aa, Staphylococcus aureus
DKGSFDPFPNSPRQDQKNP

SEQ ID NO: 1635420 - protein, 16 aa, Staphylococcus aureus
DKIAEAEAAGTDYVGE

SEQ ID NO: 1635421 - protein, 9 aa, Staphylococcus aureus
DKIGKGTKW

SEQ ID NO: 1635422 - protein, 53 aa, Staphylococcus aureus
DKKGYVDSVKNNGSIPSDTLTAKGIAKAPNGKDYASTMNSPLKYNPKEARAHW

SEQ ID NO: 1635423 - protein, 21 aa, Staphylococcus aureus
DKKKIATATVGEGSSNQGDFH

SEQ ID NO: 1635424 - protein, 10 aa, Staphylococcus aureus
DKKKNKGFKF

SEQ ID NO: 1635425 - protein, 6 aa, Staphylococcus aureus
DKKSYF

SEQ ID NO: 1635426 - protein, 8 aa, Staphylococcus aureus
DKLGARSI

SEQ ID NO: 1635427 - protein, 6 aa, Staphylococcus aureus
DKLHED

SEQ ID NO: 1635428 - protein, 13 aa, Staphylococcus aureus
DKLPDRKNYKVEM

SEQ ID NO: 1635429 - protein, 8 aa, Staphylococcus aureus
DKLPTSRL

SEQ ID NO: 1635430 - protein, 15 aa, Staphylococcus aureus
DKLQNGQISIEEPGL

SEQ ID NO: 1635431 - protein, 7 aa, Staphylococcus aureus
DKLSDLT

SEQ ID NO: 1635432 - protein, 15 aa, Staphylococcus aureus
DKLSSDAQRRIEHER

SEQ ID NO: 1635433 - protein, 8 aa, Staphylococcus aureus
DKLTREKK

SEQ ID NO: 1635434 - protein, 8 aa, Staphylococcus aureus
DKNDDELL

SEQ ID NO: 1635435 - protein, 17 aa, Staphylococcus aureus
DKNDPRFDNPTKPIGPF

SEQ ID NO: 1635436 - protein, 18 aa, Staphylococcus aureus
DKNEYEAEPPLFFFSGRL

SEQ ID NO: 1635437 - protein, 4 aa, Staphylococcus aureus
DKNN

SEQ ID NO: 1635438 - protein, 8 aa, Staphylococcus aureus
DKNNENFN

SEQ ID NO: 1635439 - protein, 8 aa, Staphylococcus aureus
DKNNRLER

SEQ ID NO: 1635440 - protein, 8 aa, Staphylococcus aureus
DKNSQNVD

SEQ ID NO: 1635441 - protein, 10 aa, Staphylococcus aureus
DKNTKGNEEI

SEQ ID NO: 1635442 - protein, 5 aa, Staphylococcus aureus
DKNYG

SEQ ID NO: 1635443 - protein, 13 aa, Staphylococcus aureus
DKPIERDEHGKHV

SEQ ID NO: 1635444 - protein, 14 aa, Staphylococcus aureus
DKPQETNRTFDTAV

SEQ ID NO: 1635445 - protein, 6 aa, Staphylococcus aureus
DKPVDC

SEQ ID NO: 1635446 - protein, 14 aa, Staphylococcus aureus
DKPVDRDKHGKRVK

SEQ ID NO: 1635447 - protein, 6 aa, Staphylococcus aureus
DKQEVD

SEQ ID NO: 1635448 - protein, 8 aa, Staphylococcus aureus
DKQGYIDA

SEQ ID NO: 1635449 - protein, 6 aa, Staphylococcus aureus
DKQKFE

SEQ ID NO: 1635450 - protein, 4 aa, Staphylococcus aureus
DKQN

SEQ ID NO: 1635451 - protein, 15 aa, Staphylococcus aureus
DKQNRIKNTIDWYNI

SEQ ID NO: 1635452 - protein, 6 aa, Staphylococcus aureus
DKQRKI

SEQ ID NO: 1635453 - protein, 6 aa, Staphylococcus aureus
DKQRRV

SEQ ID NO: 1635454 - protein, 16 aa, Staphylococcus aureus
DKQSGRTDNRTGYQQV

SEQ ID NO: 1635455 - protein, 8 aa, Staphylococcus aureus
DKQSYTSR

SEQ ID NO: 1635456 - protein, 26 aa, Staphylococcus aureus
DKQWQRQVETNSRVKERLEQIIGSLT

SEQ ID NO: 1635457 - protein, 5 aa, Staphylococcus aureus
DKRGG

SEQ ID NO: 1635458 - protein, 8 aa, Staphylococcus aureus
DKRNLNNK

SEQ ID NO: 1635459 - protein, 15 aa, Staphylococcus aureus
DKRREEFHPQGSRSH

SEQ ID NO: 1635460 - protein, 10 aa, Staphylococcus aureus
DKSDSTTLKD

SEQ ID NO: 1635461 - protein, 7 aa, Staphylococcus aureus
DKSGYLE

SEQ ID NO: 1635462 - protein, 23 aa, Staphylococcus aureus
DKSKLDLNDKESFISETKSAVKI

SEQ ID NO: 1635463 - protein, 10 aa, Staphylococcus aureus
DKSKPTGQQT

SEQ ID NO: 1635464 - protein, 9 aa, Staphylococcus aureus
DKSPERQGK

SEQ ID NO: 1635465 - protein, 7 aa, Staphylococcus aureus
DKSPKAD

SEQ ID NO: 1635466 - protein, 17 aa, Staphylococcus aureus
DKSSHQEVQENNSAYEE

SEQ ID NO: 1635467 - protein, 5 aa, Staphylococcus aureus
DKSWD

SEQ ID NO: 1635468 - protein, 7 aa, Staphylococcus aureus
DKTDDEL

SEQ ID NO: 1635469 - protein, 9 aa, Staphylococcus aureus
DKTDNENVK

SEQ ID NO: 1635470 - protein, 7 aa, Staphylococcus aureus
DKTMQQE

SEQ ID NO: 1635471 - protein, 8 aa, Staphylococcus aureus
DKTPETLK

SEQ ID NO: 1635472 - protein, 16 aa, Staphylococcus aureus
DKTSSNNDNKYKSEPL

SEQ ID NO: 1635473 - protein, 9 aa, Staphylococcus aureus
DKVEQEITN

SEQ ID NO: 1635474 - protein, 16 aa, Staphylococcus aureus
DKVQGSAIAKAEAEQL

SEQ ID NO: 1635475 - protein, 6 aa, Staphylococcus aureus
DKVRGD

SEQ ID NO: 1635476 - protein, 7 aa, Staphylococcus aureus
DKVRNEA

SEQ ID NO: 1635477 - protein, 20 aa, Staphylococcus aureus
DKVTEANQAKDQLNTARQGL

SEQ ID NO: 1635478 - protein, 6 aa, Staphylococcus aureus
DKYQNL

SEQ ID NO: 1635479 - protein, 8 aa, Staphylococcus aureus
DLAETPFQ

SEQ ID NO: 1635480 - protein, 27 aa, Staphylococcus aureus
DLAPKATNNKEYTINTETGNNGNFGAS

SEQ ID NO: 1635481 - protein, 7 aa, Staphylococcus aureus
DLASNDE

SEQ ID NO: 1635482 - protein, 18 aa, Staphylococcus aureus
DLEDRGKHFPEQLSGGMK

SEQ ID NO: 1635483 - protein, 6 aa, Staphylococcus aureus
DLEETT

SEQ ID NO: 1635484 - protein, 11 aa, Staphylococcus aureus
DLEKGEYLESG

SEQ ID NO: 1635485 - protein, 14 aa, Staphylococcus aureus
DLEKKEKVKPTKMV

SEQ ID NO: 1635486 - protein, 16 aa, Staphylococcus aureus
DLEKKQKEKVKPTKMV

SEQ ID NO: 1635487 - protein, 5 aa, Staphylococcus aureus
DLEPW

SEQ ID NO: 1635488 - protein, 15 aa, Staphylococcus aureus
DLGGEQPDKPNSAID

SEQ ID NO: 1635489 - protein, 23 aa, Staphylococcus aureus
DLGKEMEQISDQNDQEKNSEEDS

SEQ ID NO: 1635490 - protein, 8 aa, Staphylococcus aureus
DLGKHSKS

SEQ ID NO: 1635491 - protein, 7 aa, Staphylococcus aureus
DLGRKGY

SEQ ID NO: 1635492 - protein, 10 aa, Staphylococcus aureus
DLKDCKRKAK

SEQ ID NO: 1635493 - protein, 11 aa, Staphylococcus aureus
DLKESEYDEAS

SEQ ID NO: 1635494 - protein, 11 aa, Staphylococcus aureus
DLKNTASDQFQ

SEQ ID NO: 1635495 - protein, 8 aa, Staphylococcus aureus
DLKPDEVA

SEQ ID NO: 1635496 - protein, 10 aa, Staphylococcus aureus
DLKQHSRQYA

SEQ ID NO: 1635497 - protein, 12 aa, Staphylococcus aureus
DLMPNPKTGTVT

SEQ ID NO: 1635498 - protein, 9 aa, Staphylococcus aureus
DLNAADEEA

SEQ ID NO: 1635499 - protein, 6 aa, Staphylococcus aureus
DLNEHQ

SEQ ID NO: 1635500 - protein, 5 aa, Staphylococcus aureus
DLNNE

SEQ ID NO: 1635501 - protein, 10 aa, Staphylococcus aureus
DLPEGLASEG

SEQ ID NO: 1635502 - protein, 7 aa, Staphylococcus aureus
DLPESPD

SEQ ID NO: 1635503 - protein, 9 aa, Staphylococcus aureus
DLPNDPKMT

SEQ ID NO: 1635504 - protein, 17 aa, Staphylococcus aureus
DLPTTTIGSFPQNREVR

SEQ ID NO: 1635505 - protein, 4 aa, Staphylococcus aureus
DLQA

SEQ ID NO: 1635506 - protein, 4 aa, Staphylococcus aureus
DLQG

SEQ ID NO: 1635507 - protein, 9 aa, Staphylococcus aureus
DLQINDSTK

SEQ ID NO: 1635508 - protein, 6 aa, Staphylococcus aureus
DLQQMG

SEQ ID NO: 1635509 - protein, 11 aa, Staphylococcus aureus
DLRDCKRKAKR

SEQ ID NO: 1635510 - protein, 21 aa, Staphylococcus aureus
DLRQGGKKFNKSTEKRGKIKV

SEQ ID NO: 1635511 - protein, 21 aa, Staphylococcus aureus
DLRQGGKKYNKSTEKRGKIKV

SEQ ID NO: 1635512 - protein, 6 aa, Staphylococcus aureus
DLSDSV

SEQ ID NO: 1635513 - protein, 10 aa, Staphylococcus aureus
DLSEQDSQNM

SEQ ID NO: 1635514 - protein, 6 aa, Staphylococcus aureus
DLSEQQ

SEQ ID NO: 1635515 - protein, 7 aa, Staphylococcus aureus
DLSGEEQ

SEQ ID NO: 1635516 - protein, 8 aa, Staphylococcus aureus
DLSGGEKV

SEQ ID NO: 1635517 - protein, 17 aa, Staphylococcus aureus
DLSGLEDEETKENQTEL

SEQ ID NO: 1635518 - protein, 19 aa, Staphylococcus aureus
DLTAPTAVKPTTSAAKDYN

SEQ ID NO: 1635519 - protein, 6 aa, Staphylococcus aureus
DLTGRE

SEQ ID NO: 1635520 - protein, 11 aa, Staphylococcus aureus
DLTPSDTSQLN

SEQ ID NO: 1635521 - protein, 4 aa, Staphylococcus aureus
DLTR

SEQ ID NO: 1635522 - protein, 6 aa, Staphylococcus aureus
DLTSKA

SEQ ID NO: 1635523 - protein, 7 aa, Staphylococcus aureus
DMANYRY

SEQ ID NO: 1635524 - protein, 18 aa, Staphylococcus aureus
DMDDLSAKAKEAVESGQY

SEQ ID NO: 1635525 - protein, 14 aa, Staphylococcus aureus
DMESMQEQTDEEEL

SEQ ID NO: 1635526 - protein, 11 aa, Staphylococcus aureus
DMKSTNEGEFK

SEQ ID NO: 1635527 - protein, 10 aa, Staphylococcus aureus
DMQDSGQLPQ

SEQ ID NO: 1635528 - protein, 4 aa, Staphylococcus aureus
DMRN

SEQ ID NO: 1635529 - protein, 8 aa, Staphylococcus aureus
DMSTASDL

SEQ ID NO: 1635530 - protein, 5 aa, Staphylococcus aureus
DMTPG

SEQ ID NO: 1635531 - protein, 12 aa, Staphylococcus aureus
DNANKKSIPKFP

SEQ ID NO: 1635532 - protein, 7 aa, Staphylococcus aureus
DNANQKF

SEQ ID NO: 1635533 - protein, 9 aa, Staphylococcus aureus
DNASWRGPN

SEQ ID NO: 1635534 - protein, 15 aa, Staphylococcus aureus
DNDAKQQIAKQIQAQ

SEQ ID NO: 1635535 - protein, 4 aa, Staphylococcus aureus
DNDM

SEQ ID NO: 1635536 - protein, 8 aa, Staphylococcus aureus
DNDPLREG

SEQ ID NO: 1635537 - protein, 8 aa, Staphylococcus aureus
DNDSDNQP

SEQ ID NO: 1635538 - protein, 6 aa, Staphylococcus aureus
DNDVDT

SEQ ID NO: 1635539 - protein, 4 aa, Staphylococcus aureus
DNDY

SEQ ID NO: 1635540 - protein, 26 aa, Staphylococcus aureus
DNEFESGMKNQGRNKKGSKDNWCEGG

SEQ ID NO: 1635541 - protein, 4 aa, Staphylococcus aureus
DNEG

SEQ ID NO: 1635542 - protein, 8 aa, Staphylococcus aureus
DNEKSKNN

SEQ ID NO: 1635543 - protein, 7 aa, Staphylococcus aureus
DNEVADG

SEQ ID NO: 1635544 - protein, 4 aa, Staphylococcus aureus
DNFK

SEQ ID NO: 1635545 - protein, 8 aa, Staphylococcus aureus
DNGANDYM

SEQ ID NO: 1635546 - protein, 14 aa, Staphylococcus aureus
DNGEALKKYYRMRG

SEQ ID NO: 1635547 - protein, 16 aa, Staphylococcus aureus
DNGEISGFNHSKAKRK

SEQ ID NO: 1635548 - protein, 12 aa, Staphylococcus aureus
DNHCNEKTINVD

SEQ ID NO: 1635549 - protein, 6 aa, Staphylococcus aureus
DNHSSK

SEQ ID NO: 1635550 - protein, 12 aa, Staphylococcus aureus
DNIDESNNNQLD

SEQ ID NO: 1635551 - protein, 8 aa, Staphylococcus aureus
DNINYEDK

SEQ ID NO: 1635552 - protein, 9 aa, Staphylococcus aureus
DNKDSIKRD

SEQ ID NO: 1635553 - protein, 12 aa, Staphylococcus aureus
DNKKARDRAREE

SEQ ID NO: 1635554 - protein, 7 aa, Staphylococcus aureus
DNKNEEA

SEQ ID NO: 1635555 - protein, 9 aa, Staphylococcus aureus
DNKNGDVFT

SEQ ID NO: 1635556 - protein, 8 aa, Staphylococcus aureus
DNKPLYPE

SEQ ID NO: 1635557 - protein, 7 aa, Staphylococcus aureus
DNKQNAL

SEQ ID NO: 1635558 - protein, 8 aa, Staphylococcus aureus
DNKTVETD

SEQ ID NO: 1635559 - protein, 37 aa, Staphylococcus aureus; identical to SEQ ID NO: 1567038

SEQ ID NO: 1635560 - protein, 38 aa, Staphylococcus aureus; identical to SEQ ID NO: 1566786

SEQ ID NO: 1635561 - protein, 7 aa, Staphylococcus aureus
DNLPDDI

SEQ ID NO: 1635562 - protein, 5 aa, Staphylococcus aureus
DNMKN

SEQ ID NO: 1635563 - protein, 10 aa, Staphylococcus aureus
DNMSQYAEDV

SEQ ID NO: 1635564 - protein, 21 aa, Staphylococcus aureus
DNMSQYSEDVTSYYSAPSDLS

SEQ ID NO: 1635565 - protein, 4 aa, Staphylococcus aureus
DNMT

SEQ ID NO: 1635566 - protein, 5 aa, Staphylococcus aureus
DNMTI

SEQ ID NO: 1635567 - protein, 7 aa, Staphylococcus aureus
DNNGIKS

SEQ ID NO: 1635568 - protein, 13 aa, Staphylococcus aureus
DNNHEYKYTSADS

SEQ ID NO: 1635569 - protein, 5 aa, Staphylococcus aureus
DNNNL

SEQ ID NO: 1635570 - protein, 5 aa, Staphylococcus aureus
DNNNS

SEQ ID NO: 1635571 - protein, 10 aa, Staphylococcus aureus
DNNQLEEEKK

SEQ ID NO: 1635572 - protein, 7 aa, Staphylococcus aureus
DNNSIIN

SEQ ID NO: 1635573 - protein, 4 aa, Staphylococcus aureus
DNNY

SEQ ID NO: 1635574 - protein, 9 aa, Staphylococcus aureus
DNPAGKPWS

SEQ ID NO: 1635575 - protein, 16 aa, Staphylococcus aureus
DNPDTWKNTVGNTHKT

SEQ ID NO: 1635576 - protein, 7 aa, Staphylococcus aureus
DNPEKIK

SEQ ID NO: 1635577 - protein, 5 aa, Staphylococcus aureus
DNPFT

SEQ ID NO: 1635578 - protein, 14 aa, Staphylococcus aureus
DNQITKITSSKRYG

SEQ ID NO: 1635579 - protein, 10 aa, Staphylococcus aureus
DNQTPEDTKQ

SEQ ID NO: 1635580 - protein, 10 aa, Staphylococcus aureus
DNRNKSFETY

SEQ ID NO: 1635581 - protein, 7 aa, Staphylococcus aureus
DNRQTED

SEQ ID NO: 1635582 - protein, 75 aa, Staphylococcus aureus; identical to SEQ ID NO: 1568735

SEQ ID NO: 1635583 - protein, 75 aa, Staphylococcus aureus
DNSALRTAKTKLDEEINKSVTTDGMTQSSIQAYENAKRAGQTESTNAQNVINNGDATDQQIAAEKTKVEEKYNGL

SEQ ID NO: 1635584 - protein, 9 aa, Staphylococcus aureus
DNSGRNQYK

SEQ ID NO: 1635585 - protein, 9 aa, Staphylococcus aureus
DNSIKSTRR

SEQ ID NO: 1635586 - protein, 10 aa, Staphylococcus aureus
DNSNSNSASI

SEQ ID NO: 1635587 - protein, 6 aa, Staphylococcus aureus
DNSNTI

SEQ ID NO: 1635588 - protein, 7 aa, Staphylococcus aureus
DNSNVKY

SEQ ID NO: 1635589 - protein, 14 aa, Staphylococcus aureus
DNSTNTSDGKFHGQ

SEQ ID NO: 1635590 - protein, 15 aa, Staphylococcus aureus
DNSYSMPEDGYNGKD

SEQ ID NO: 1635591 - protein, 7 aa, Staphylococcus aureus
DNTAGRS

SEQ ID NO: 1635592 - protein, 6 aa, Staphylococcus aureus
DNTAQD

SEQ ID NO: 1635593 - protein, 7 aa, Staphylococcus aureus
DNTDNDG

SEQ ID NO: 1635594 - protein, 5 aa, Staphylococcus aureus
DNTPI

SEQ ID NO: 1635595 - protein, 7 aa, Staphylococcus aureus
DNTPLTI

SEQ ID NO: 1635596 - protein, 6 aa, Staphylococcus aureus
DNTPTC

SEQ ID NO: 1635597 - protein, 20 aa, Staphylococcus aureus
DNWKKAQKVGNEIGEKLTSA

SEQ ID NO: 1635598 - protein, 11 aa, Staphylococcus aureus
DNYDSNSASID

SEQ ID NO: 1635599 - protein, 14 aa, Staphylococcus aureus
DPALSSGAKGYYVP

SEQ ID NO: 1635600 - protein, 7 aa, Staphylococcus aureus
DPANIES

SEQ ID NO: 1635601 - protein, 8 aa, Staphylococcus aureus
DPAREGEN

SEQ ID NO: 1635602 - protein, 7 aa, Staphylococcus aureus
DPARRND

SEQ ID NO: 1635603 - protein, 7 aa, Staphylococcus aureus
DPDADRL

SEQ ID NO: 1635604 - protein, 16 aa, Staphylococcus aureus
DPDNTSKKNTKYIPFW

SEQ ID NO: 1635605 - protein, 6 aa, Staphylococcus aureus
DPEQTL

SEQ ID NO: 1635606 - protein, 7 aa, Staphylococcus aureus
DPHAAKQ

SEQ ID NO: 1635607 - protein, 6 aa, Staphylococcus aureus
DPIADG

SEQ ID NO: 1635608 - protein, 6 aa, Staphylococcus aureus
DPKQTL

SEQ ID NO: 1635609 - protein, 8 aa, Staphylococcus aureus
DPKRGPSL

SEQ ID NO: 1635610 - protein, 8 aa, Staphylococcus aureus
DPKTNEPM

SEQ ID NO: 1635611 - protein, 24 aa, Staphylococcus aureus
DPNGRLSTVGGVTKKNNKSSETNT

SEQ ID NO: 1635612 - protein, 6 aa, Staphylococcus aureus
DPNKQK

SEQ ID NO: 1635613 - protein, 11 aa, Staphylococcus aureus
DPNKSSDEARI

SEQ ID NO: 1635614 - protein, 7 aa, Staphylococcus aureus
DPNVNGK

SEQ ID NO: 1635615 - protein, 8 aa, Staphylococcus aureus
DPQGNATQ

SEQ ID NO: 1635616 - protein, 8 aa, Staphylococcus aureus
DPRTNNQE

SEQ ID NO: 1635617 - protein, 6 aa, Staphylococcus aureus
DPTEDC

SEQ ID NO: 1635618 - protein, 9 aa, Staphylococcus aureus
DPTNTDKAV

SEQ ID NO: 1635619 - protein, 7 aa, Staphylococcus aureus
DPTPAIK

SEQ ID NO: 1635620 - protein, 4 aa, Staphylococcus aureus
DPTY

SEQ ID NO: 1635621 - protein, 7 aa, Staphylococcus aureus
DPYGGTK

SEQ ID NO: 1635622 - protein, 10 aa, Staphylococcus aureus
DPYHGSNQAH

SEQ ID NO: 1635623 - protein, 7 aa, Staphylococcus aureus
DPYSGFN

SEQ ID NO: 1635624 - protein, 8 aa, Staphylococcus aureus
DQAKQREK

SEQ ID NO: 1635625 - protein, 15 aa, Staphylococcus aureus
DQAKQRKKESMYYCY

SEQ ID NO: 1635626 - protein, 4 aa, Staphylococcus aureus
DQDI

SEQ ID NO: 1635627 - protein, 7 aa, Staphylococcus aureus
DQDMKNE

SEQ ID NO: 1635628 - protein, 16 aa, Staphylococcus aureus
DQDMKNEYKKYLQGRE

SEQ ID NO: 1635629 - protein, 8 aa, Staphylococcus aureus
DQEDKIAK

SEQ ID NO: 1635630 - protein, 13 aa, Staphylococcus aureus
DQEHSDLTGSEQE

SEQ ID NO: 1635631 - protein, 13 aa, Staphylococcus aureus
DQETGIKATHEEG

SEQ ID NO: 1635632 - protein, 7 aa, Staphylococcus aureus
DQETPIG

SEQ ID NO: 1635633 - protein, 13 aa, Staphylococcus aureus
DQFTPKIKSSDPV

SEQ ID NO: 1635634 - protein, 8 aa, Staphylococcus aureus
DQGDPTGQ

SEQ ID NO: 1635635 - protein, 7 aa, Staphylococcus aureus
DQGEASY

SEQ ID NO: 1635636 - protein, 5 aa, Staphylococcus aureus
DQIKA

SEQ ID NO: 1635637 - protein, 11 aa, Staphylococcus aureus
DQIKNQNDIYG

SEQ ID NO: 1635638 - protein, 4 aa, Staphylococcus aureus
DQIN

SEQ ID NO: 1635639 - protein, 14 aa, Staphylococcus aureus
DQINGQQETRTRLA

SEQ ID NO: 1635640 - protein, 8 aa, Staphylococcus aureus
DQKAKEKI

SEQ ID NO: 1635641 - protein, 23 aa, Staphylococcus aureus
DQLDDLAKQQEQDDSESRQVDPR

SEQ ID NO: 1635642 - protein, 7 aa, Staphylococcus aureus
DQPIDTK

SEQ ID NO: 1635643 - protein, 7 aa, Staphylococcus aureus
DQPSVSH

SEQ ID NO: 1635644 - protein, 7 aa, Staphylococcus aureus
DQPYPDN

SEQ ID NO: 1635645 - protein, 4 aa, Staphylococcus aureus
DQRG

SEQ ID NO: 1635646 - protein, 9 aa, Staphylococcus aureus
DQSASIEDA

SEQ ID NO: 1635647 - protein, 26 aa, Staphylococcus aureus
DQSGGSTPKALKEYGINEDQYSNEDE

SEQ ID NO: 1635648 - protein, 26 aa, Staphylococcus aureus
DQSGGSTPKALKEYGVDEDQYSNEDE

SEQ ID NO: 1635649 - protein, 12 aa, Staphylococcus aureus
DQSRGDQIDNAN

SEQ ID NO: 1635650 - protein, 17 aa, Staphylococcus aureus
DQTALSSHEVAQGYKNV

SEQ ID NO: 1635651 - protein, 5 aa, Staphylococcus aureus
DQYGN

SEQ ID NO: 1635652 - protein, 7 aa, Staphylococcus aureus
DQYHEEN

SEQ ID NO: 1635653 - protein, 15 aa, Staphylococcus aureus
DRANQNVTTANGIEV

SEQ ID NO: 1635654 - protein, 5 aa, Staphylococcus aureus
DRDEA

SEQ ID NO: 1635655 - protein, 13 aa, Staphylococcus aureus
DRDKEAIKTAPRI

SEQ ID NO: 1635656 - protein, 7 aa, Staphylococcus aureus
DRDKEID

SEQ ID NO: 1635657 - protein, 25 aa, Staphylococcus aureus
DRDKEKDLKATQKNLKQQGIPQAKK

SEQ ID NO: 1635658 - protein, 12 aa, Staphylococcus aureus
DRDVQGGSTITQ

SEQ ID NO: 1635659 - protein, 14 aa, Staphylococcus aureus
DREKAKNKKGEIGV

SEQ ID NO: 1635660 - protein, 15 aa, Staphylococcus aureus
DREKEAAKINERNRL

SEQ ID NO: 1635661 - protein, 5 aa, Staphylococcus aureus
DRHET

SEQ ID NO: 1635662 - protein, 14 aa, Staphylococcus aureus
DRHPYTKELTQAFT

SEQ ID NO: 1635663 - protein, 34 aa, Staphylococcus aureus
DRHSGLKSTTITTLPSGWTSNLTKSDNKNGSLAI

SEQ ID NO: 1635664 - protein, 6 aa, Staphylococcus aureus
DRIGDT

SEQ ID NO: 1635665 - protein, 6 aa, Staphylococcus aureus
DRIGSK

SEQ ID NO: 1635666 - protein, 6 aa, Staphylococcus aureus
DRIQGF

SEQ ID NO: 1635667 - protein, 6 aa, Staphylococcus aureus
DRITEE

SEQ ID NO: 1635668 - protein, 4 aa, Staphylococcus aureus
DRLN

SEQ ID NO: 1635669 - protein, 4 aa, Staphylococcus aureus
DRNI

SEQ ID NO: 1635670 - protein, 7 aa, Staphylococcus aureus
DRNTGND

SEQ ID NO: 1635671 - protein, 32 aa, Staphylococcus aureus
DRQETTYQVATDNARDNRDNQQLNQNTATTNM

SEQ ID NO: 1635672 - protein, 10 aa, Staphylococcus aureus
DRQVQKGAKS

SEQ ID NO: 1635673 - protein, 15 aa, Staphylococcus aureus
DRSAHGYGGKITPKV

SEQ ID NO: 1635674 - protein, 6 aa, Staphylococcus aureus
DRSFTR

SEQ ID NO: 1635675 - protein, 13 aa, Staphylococcus aureus
DRTDLSSDKSVDS

SEQ ID NO: 1635676 - protein, 4 aa, Staphylococcus aureus
DRYL

SEQ ID NO: 1635677 - protein, 6 aa, Staphylococcus aureus
DSAEKR

SEQ ID NO: 1635678 - protein, 6 aa, Staphylococcus aureus
DSAKQF

SEQ ID NO: 1635679 - protein, 9 aa, Staphylococcus aureus
DSAPWNNKR

SEQ ID NO: 1635680 - protein, 6 aa, Staphylococcus aureus
DSASNV

SEQ ID NO: 1635681 - protein, 8 aa, Staphylococcus aureus
DSDDLEEI

SEQ ID NO: 1635682 - protein, 6 aa, Staphylococcus aureus
DSDEYK

SEQ ID NO: 1635683 - protein, 4 aa, Staphylococcus aureus
DSDG

SEQ ID NO: 1635684 - protein, 15 aa, Staphylococcus aureus
DSDSSLRSEDKGDDM

SEQ ID NO: 1635685 - protein, 9 aa, Staphylococcus aureus
DSDTENAKA

SEQ ID NO: 1635686 - protein, 14 aa, Staphylococcus aureus
DSDTVSNYENGPKF

SEQ ID NO: 1635687 - protein, 7 aa, Staphylococcus aureus
DSEDIDT

SEQ ID NO: 1635688 - protein, 14 aa, Staphylococcus aureus
DSEGLTITQATEPH

SEQ ID NO: 1635689 - protein, 6 aa, Staphylococcus aureus
DSELLS

SEQ ID NO: 1635690 - protein, 6 aa, Staphylococcus aureus
DSENDL

SEQ ID NO: 1635691 - protein, 7 aa, Staphylococcus aureus
DSENRTI

SEQ ID NO: 1635692 - protein, 18 aa, Staphylococcus aureus
DSETTRTAVKQDLTEAQA

SEQ ID NO: 1635693 - protein, 6 aa, Staphylococcus aureus
DSFDAG

SEQ ID NO: 1635694 - protein, 25 aa, Staphylococcus aureus
DSFNHSSKNKPQNLAEIARQKRIIK

SEQ ID NO: 1635695 - protein, 21 aa, Staphylococcus aureus
DSGGGSMPSGLTTVPNPMVTY

SEQ ID NO: 1635696 - protein, 10 aa, Staphylococcus aureus
DSGVYDEENS

SEQ ID NO: 1635697 - protein, 7 aa, Staphylococcus aureus
DSGYGQG

SEQ ID NO: 1635698 - protein, 10 aa, Staphylococcus aureus
DSHDANEGYS

SEQ ID NO: 1635699 - protein, 7 aa, Staphylococcus aureus
DSHEDTY

SEQ ID NO: 1635700 - protein, 11 aa, Staphylococcus aureus
DSHTDKKYGVT

SEQ ID NO: 1635701 - protein, 38 aa, Staphylococcus aureus
DSHTPPQTSPSNPLTPAIPNVEDNDDELNNAFSKDNKR

SEQ ID NO: 1635702 - protein, 13 aa, Staphylococcus aureus
DSIEENNKNQLDA

SEQ ID NO: 1635703 - protein, 13 aa, Staphylococcus aureus
DSIGKEGTKGDSY

SEQ ID NO: 1635704 - protein, 5 aa, Staphylococcus aureus
DSIKD

SEQ ID NO: 1635705 - protein, 10 aa, Staphylococcus aureus
DSIKPSDAKE

SEQ ID NO: 1635706 - protein, 6 aa, Staphylococcus aureus
DSISAN

SEQ ID NO: 1635707 - protein, 198 aa, Staphylococcus aureus
DSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAF

SEQ ID NO: 1635708 - protein, 9 aa, Staphylococcus aureus
DSITKYGAP

SEQ ID NO: 1635709 - protein, 4 aa, Staphylococcus aureus
DSIV

SEQ ID NO: 1635710 - protein, 17 aa, Staphylococcus aureus
DSKISSGPWTLHEGRII

SEQ ID NO: 1635711 - protein, 19 aa, Staphylococcus aureus
DSKMAKHTKANTDLTTEDL

SEQ ID NO: 1635712 - protein, 7 aa, Staphylococcus aureus
DSKNKEQ

SEQ ID NO: 1635713 - protein, 7 aa, Staphylococcus aureus
DSKQLNE

SEQ ID NO: 1635714 - protein, 15 aa, Staphylococcus aureus
DSKVAKHTKANTDLT

SEQ ID NO: 1635715 - protein, 7 aa, Staphylococcus aureus
DSKVAPT

SEQ ID NO: 1635716 - protein, 9 aa, Staphylococcus aureus
DSKYHEEKN

SEQ ID NO: 1635717 - protein, 10 aa, Staphylococcus aureus
DSLKKADALF

SEQ ID NO: 1635718 - protein, 7 aa, Staphylococcus aureus
DSLPSTD

SEQ ID NO: 1635719 - protein, 7 aa, Staphylococcus aureus
DSLQSHD

SEQ ID NO: 1635720 - protein, 9 aa, Staphylococcus aureus
DSLRTQEKI

SEQ ID NO: 1635721 - protein, 8 aa, Staphylococcus aureus
DSLSEALN

SEQ ID NO: 1635722 - protein, 4 aa, Staphylococcus aureus
DSLT

SEQ ID NO: 1635723 - protein, 4 aa, Staphylococcus aureus
DSME

SEQ ID NO: 1635724 - protein, 12 aa, Staphylococcus aureus
DSNARAGTPSKG

SEQ ID NO: 1635725 - protein, 20 aa, Staphylococcus aureus
DSNGKELDRTTTDENGKYQF

SEQ ID NO: 1635726 - protein, 9 aa, Staphylococcus aureus
DSNGNNIER

SEQ ID NO: 1635727 - protein, 10 aa, Staphylococcus aureus
DSNKPSDEAR

SEQ ID NO: 1635728 - protein, 6 aa, Staphylococcus aureus
DSNLSD

SEQ ID NO: 1635729 - protein, 36 aa, Staphylococcus aureus
DSNMNEIEKQNAEVTESVQNEAAESEQNVEEKTIEN

SEQ ID NO: 1635730 - protein, 8 aa, Staphylococcus aureus
DSNMSTQY

SEQ ID NO: 1635731 - protein, 4 aa, Staphylococcus aureus
DSNY

SEQ ID NO: 1635732 - protein, 16 aa, Staphylococcus aureus
DSPDTWKNTVGNTHKT

SEQ ID NO: 1635733 - protein, 10 aa, Staphylococcus aureus
DSQDEVQDEA

SEQ ID NO: 1635734 - protein, 7 aa, Staphylococcus aureus
DSQLQSG

SEQ ID NO: 1635735 - protein, 8 aa, Staphylococcus aureus
DSQTNKDF

SEQ ID NO: 1635736 - protein, 10 aa, Staphylococcus aureus
DSRQRQNDEN

SEQ ID NO: 1635737 - protein, 14 aa, Staphylococcus aureus
DSRSFNSFSKPKWS

SEQ ID NO: 1635738 - protein, 6 aa, Staphylococcus aureus
DSRSIS

SEQ ID NO: 1635739 - protein, 14 aa, Staphylococcus aureus
DSRTIDAKHKPAVV

SEQ ID NO: 1635740 - protein, 8 aa, Staphylococcus aureus
DSSDYKIG

SEQ ID NO: 1635741 - protein, 8 aa, Staphylococcus aureus
DSSQTITR

SEQ ID NO: 1635742 - protein, 10 aa, Staphylococcus aureus
DSSTEITTPF

SEQ ID NO: 1635743 - protein, 10 aa, Staphylococcus aureus
DSSTEITTPL

SEQ ID NO: 1635744 - protein, 6 aa, Staphylococcus aureus
DSTASS

SEQ ID NO: 1635745 - protein, 10 aa, Staphylococcus aureus
DSTISTNGLT

SEQ ID NO: 1635746 - protein, 10 aa, Staphylococcus aureus
DSTKENVKVN

SEQ ID NO: 1635747 - protein, 7 aa, Staphylococcus aureus
DSTKSYK

SEQ ID NO: 1635748 - protein, 7 aa, Staphylococcus aureus
DSTNKEH

SEQ ID NO: 1635749 - protein, 18 aa, Staphylococcus aureus
DSVGEKDVVTTSRFPGTT

SEQ ID NO: 1635750 - protein, 13 aa, Staphylococcus aureus
DSVKGDSEIQKEL

SEQ ID NO: 1635751 - protein, 4 aa, Staphylococcus aureus
DSVR

SEQ ID NO: 1635752 - protein, 7 aa, Staphylococcus aureus
DSVSDLA

SEQ ID NO: 1635753 - protein, 7 aa, Staphylococcus aureus
DSVSKEE

SEQ ID NO: 1635754 - protein, 23 aa, Staphylococcus aureus
DSVTTDHISPAGAIGKDTPAGKY

SEQ ID NO: 1635755 - protein, 8 aa, Staphylococcus aureus
DTDDKDTF

SEQ ID NO: 1635756 - protein, 4 aa, Staphylococcus aureus
DTDG

SEQ ID NO: 1635757 - protein, 7 aa, Staphylococcus aureus
DTDSESL

SEQ ID NO: 1635758 - protein, 12 aa, Staphylococcus aureus
DTDVNHDALQLS

SEQ ID NO: 1635759 - protein, 12 aa, Staphylococcus aureus
DTEEANEIKLGQ

SEQ ID NO: 1635760 - protein, 29 aa, Staphylococcus aureus
DTEEEEREEEREGEKEEEYKNKEEEREAV

SEQ ID NO: 1635761 - protein, 7 aa, Staphylococcus aureus
DTEEINV

SEQ ID NO: 1635762 - protein, 11 aa, Staphylococcus aureus
DTEGLPITQGN

SEQ ID NO: 1635763 - protein, 9 aa, Staphylococcus aureus
DTENSYDSR

SEQ ID NO: 1635764 - protein, 5 aa, Staphylococcus aureus
DTEPF

SEQ ID NO: 1635765 - protein, 10 aa, Staphylococcus aureus
DTESNDMNNM

SEQ ID NO: 1635766 - protein, 23 aa, Staphylococcus aureus
DTEVDEDTTSNSEDNTNGDASKM

SEQ ID NO: 1635767 - protein, 23 aa, Staphylococcus aureus
DTEVDEDTTSNSEDNTNRNASEM

SEQ ID NO: 1635768 - protein, 13 aa, Staphylococcus aureus
DTFKQEMGGTGRI

SEQ ID NO: 1635769 - protein, 7 aa, Staphylococcus aureus
DTGDNNI

SEQ ID NO: 1635770 - protein, 18 aa, Staphylococcus aureus
DTGNEQRQDLEKVEKAIN

SEQ ID NO: 1635771 - protein, 9 aa, Staphylococcus aureus
DTHQNESEL

SEQ ID NO: 1635772 - protein, 4 aa, Staphylococcus aureus
DTID

SEQ ID NO: 1635773 - protein, 13 aa, Staphylococcus aureus
DTIDERENGETVG

SEQ ID NO: 1635774 - protein, 4 aa, Staphylococcus aureus
DTKE

SEQ ID NO: 1635775 - protein, 8 aa, Staphylococcus aureus
DTKEQEVE

SEQ ID NO: 1635776 - protein, 7 aa, Staphylococcus aureus
DTKGYQY

SEQ ID NO: 1635777 - protein, 16 aa, Staphylococcus aureus
DTKLPKKKRRTAEAMT

SEQ ID NO: 1635778 - protein, 6 aa, Staphylococcus aureus
DTKNKV

SEQ ID NO: 1635779 - protein, 8 aa, Staphylococcus aureus
DTKPTTFS

SEQ ID NO: 1635780 - protein, 8 aa, Staphylococcus aureus
DTLPTPFE

SEQ ID NO: 1635781 - protein, 16 aa, Staphylococcus aureus
DTLQKYTDEMSEITGR

SEQ ID NO: 1635782 - protein, 9 aa, Staphylococcus aureus
DTNFATPGA

SEQ ID NO: 1635783 - protein, 7 aa, Staphylococcus aureus
DTNGGYS

SEQ ID NO: 1635784 - protein, 6 aa, Staphylococcus aureus
DTNGKQ

SEQ ID NO: 1635785 - protein, 16 aa, Staphylococcus aureus
DTNKDGKQDANEKGIK

SEQ ID NO: 1635786 - protein, 9 aa, Staphylococcus aureus
DTQHHGPGK

SEQ ID NO: 1635787 - protein, 13 aa, Staphylococcus aureus
DTRNFDTDKGGQC

SEQ ID NO: 1635788 - protein, 12 aa, Staphylococcus aureus
DTSDIPINEPYQ

SEQ ID NO: 1635789 - protein, 5 aa, Staphylococcus aureus
DTSYV

SEQ ID NO: 1635790 - protein, 12 aa, Staphylococcus aureus
DTTKADALTSED

SEQ ID NO: 1635791 - protein, 12 aa, Staphylococcus aureus
DTTKEDALTSED

SEQ ID NO: 1635792 - protein, 4 aa, Staphylococcus aureus
DTTL

SEQ ID NO: 1635793 - protein, 8 aa, Staphylococcus aureus
DTVTEQAK

SEQ ID NO: 1635794 - protein, 5 aa, Staphylococcus aureus
DTYET

SEQ ID NO: 1635795 - protein, 4 aa, Staphylococcus aureus
DTYI

SEQ ID NO: 1635796 - protein, 6 aa, Staphylococcus aureus
DVAPNQ

SEQ ID NO: 1635797 - protein, 8 aa, Staphylococcus aureus
DVDDDDVV

SEQ ID NO: 1635798 - protein, 14 aa, Staphylococcus aureus
DVDDFTQQDEYSDD

SEQ ID NO: 1635799 - protein, 18 aa, Staphylococcus aureus
DVDEKQTKAEIISAFESL

SEQ ID NO: 1635800 - protein, 5 aa, Staphylococcus aureus
DVDSG

SEQ ID NO: 1635801 - protein, 17 aa, Staphylococcus aureus
DVDYNSKKTYGKYYNPT

SEQ ID NO: 1635802 - protein, 11 aa, Staphylococcus aureus
DVEAPDDEAVK

SEQ ID NO: 1635803 - protein, 4 aa, Staphylococcus aureus
DVEK

SEQ ID NO: 1635804 - protein, 25 aa, Staphylococcus aureus
DVENGQLAHPSEVNATVRPEEEYDS

SEQ ID NO: 1635805 - protein, 6 aa, Staphylococcus aureus
DVEPDS

SEQ ID NO: 1635806 - protein, 13 aa, Staphylococcus aureus
DVEPDSDVLSDTD

SEQ ID NO: 1635807 - protein, 11 aa, Staphylococcus aureus
DVEQVKPDPEL

SEQ ID NO: 1635808 - protein, 4 aa, Staphylococcus aureus
DVES

SEQ ID NO: 1635809 - protein, 5 aa, Staphylococcus aureus
DVESL

SEQ ID NO: 1635810 - protein, 23 aa, Staphylococcus aureus
DVGRKGGVFGTTQGLQQKYGEDR

SEQ ID NO: 1635811 - protein, 24 aa, Staphylococcus aureus
DVGYSEAKETIKNTFDSASTFGRK

SEQ ID NO: 1635812 - protein, 5 aa, Staphylococcus aureus
DVHQS

SEQ ID NO: 1635813 - protein, 22 aa, Staphylococcus aureus
DVIDDDNKLQDVKIEPTIQDTE

SEQ ID NO: 1635814 - protein, 7 aa, Staphylococcus aureus
DVKDAEE

SEQ ID NO: 1635815 - protein, 18 aa, Staphylococcus aureus
DVKDTGKEISVPVGDETL

SEQ ID NO: 1635816 - protein, 11 aa, Staphylococcus aureus
DVKNDDNRNAY

SEQ ID NO: 1635817 - protein, 5 aa, Staphylococcus aureus
DVNEI

SEQ ID NO: 1635818 - protein, 12 aa, Staphylococcus aureus
DVNGSEAYKTRL

SEQ ID NO: 1635819 - protein, 16 aa, Staphylococcus aureus
DVNQTEQDTYAKFEGS

SEQ ID NO: 1635820 - protein, 32 aa, Staphylococcus aureus
DVNSATSAVTTNKNALNGDEKLAQSKTDAARA

SEQ ID NO: 1635821 - protein, 33 aa, Staphylococcus aureus; identical to SEQ ID NO: 1567374

SEQ ID NO: 1635822 - protein, 9 aa, Staphylococcus aureus
DVPEEQYQG

SEQ ID NO: 1635823 - protein, 11 aa, Staphylococcus aureus
DVPEIGQPMEP

SEQ ID NO: 1635824 - protein, 17 aa, Staphylococcus aureus
DVQDKGMASYNAKISGK

SEQ ID NO: 1635825 - protein, 10 aa, Staphylococcus aureus
DVQEKESNTD

SEQ ID NO: 1635826 - protein, 9 aa, Staphylococcus aureus
DVQEQTKQV

SEQ ID NO: 1635827 - protein, 10 aa, Staphylococcus aureus
DVQKKESNTD

SEQ ID NO: 1635828 - protein, 25 aa, Staphylococcus aureus
DVQKTLQNDVDNGSFYKNKDQQVGA

SEQ ID NO: 1635829 - protein, 9 aa, Staphylococcus aureus
DVQTAKQQS

SEQ ID NO: 1635830 - protein, 4 aa, Staphylococcus aureus
DVRD

SEQ ID NO: 1635831 - protein, 5 aa, Staphylococcus aureus
DVRRD

SEQ ID NO: 1635832 - protein, 8 aa, Staphylococcus aureus
DVSKGNAI

SEQ ID NO: 1635833 - protein, 19 aa, Staphylococcus aureus
DVSNANPNHTVIVDDIPLE

SEQ ID NO: 1635834 - protein, 9 aa, Staphylococcus aureus
DVSRQKRKQ

SEQ ID NO: 1635835 - protein, 13 aa, Staphylococcus aureus
DVSRTSQSEGMLG

SEQ ID NO: 1635836 - protein, 14 aa, Staphylococcus aureus
DVSTQQVAQSGRYS

SEQ ID NO: 1635837 - protein, 4 aa, Staphylococcus aureus
DVSY

SEQ ID NO: 1635838 - protein, 5 aa, Staphylococcus aureus
DVTDD

SEQ ID NO: 1635839 - protein, 18 aa, Staphylococcus aureus
DVTGQDTTEWSKSTSQKL

SEQ ID NO: 1635840 - protein, 4 aa, Staphylococcus aureus
DVTQ

SEQ ID NO: 1635841 - protein, 8 aa, Staphylococcus aureus
DVTSTAGY

SEQ ID NO: 1635842 - protein, 4 aa, Staphylococcus aureus
DVYK

SEQ ID NO: 1635843 - protein, 11 aa, Staphylococcus aureus
DWEDKNGNHYD

SEQ ID NO: 1635844 - protein, 12 aa, Staphylococcus aureus
DWEDKNGNHYDQ

SEQ ID NO: 1635845 - protein, 18 aa, Staphylococcus aureus
DWNEKRRKGLNDKPIIAD

SEQ ID NO: 1635846 - protein, 22 aa, Staphylococcus aureus
DWNEKRRKGLNDKPIIAEGKHS

SEQ ID NO: 1635847 - protein, 24 aa, Staphylococcus aureus
DWNEKRRKGLNDNPVVADGKHSPI

SEQ ID NO: 1635848 - protein, 10 aa, Staphylococcus aureus
DYCKENNKGL

SEQ ID NO: 1635849 - protein, 7 aa, Staphylococcus aureus
DYDPTGH

SEQ ID NO: 1635850 - protein, 8 aa, Staphylococcus aureus
DYEEDAEK

SEQ ID NO: 1635851 - protein, 6 aa, Staphylococcus aureus
DYEEFN

SEQ ID NO: 1635852 - protein, 36 aa, Staphylococcus aureus
DYESYKKSLDKNKSTLKQQSKSYTTVRKKNGLSYKE

SEQ ID NO: 1635853 - protein, 36 aa, Staphylococcus aureus
DYESYKKSLDKNKSTLNQQSKSSTTVRKKNGLSYKE

SEQ ID NO: 1635854 - protein, 13 aa, Staphylococcus aureus
DYGPTENTTFTTT

SEQ ID NO: 1635855 - protein, 4 aa, Staphylococcus aureus
DYGR

SEQ ID NO: 1635856 - protein, 11 aa, Staphylococcus aureus
DYISEQSPGAS

SEQ ID NO: 1635857 - protein, 9 aa, Staphylococcus aureus
DYKDDLRRE

SEQ ID NO: 1635858 - protein, 20 aa, Staphylococcus aureus
DYKDKLRREYLKQSDRIEGD

SEQ ID NO: 1635859 - protein, 6 aa, Staphylococcus aureus
DYKEEI

SEQ ID NO: 1635860 - protein, 12 aa, Staphylococcus aureus
DYKGQGAYTSAV

SEQ ID NO: 1635861 - protein, 10 aa, Staphylococcus aureus
DYKKTSKGGL

SEQ ID NO: 1635862 - protein, 8 aa, Staphylococcus aureus
DYKPNQFA

SEQ ID NO: 1635863 - protein, 8 aa, Staphylococcus aureus
DYKPPKSI

SEQ ID NO: 1635864 - protein, 9 aa, Staphylococcus aureus
DYKSPSGSL

SEQ ID NO: 1635865 - protein, 6 aa, Staphylococcus aureus
DYNDDD

SEQ ID NO: 1635866 - protein, 13 aa, Staphylococcus aureus
DYNMPTQYSMERE

SEQ ID NO: 1635867 - protein, 5 aa, Staphylococcus aureus
DYNSI

SEQ ID NO: 1635868 - protein, 24 aa, Staphylococcus aureus
DYPEEKDDLHQQIDSEEQNTVASD

SEQ ID NO: 1635869 - protein, 6 aa, Staphylococcus aureus
DYPQYK

SEQ ID NO: 1635870 - protein, 6 aa, Staphylococcus aureus
DYQAEV

SEQ ID NO: 1635871 - protein, 14 aa, Staphylococcus aureus
DYRDEADKMADYDK

SEQ ID NO: 1635872 - protein, 24 aa, Staphylococcus aureus
DYSEEKDDLHQQIDGEEQNTVASD

SEQ ID NO: 1635873 - protein, 26 aa, Staphylococcus aureus
DYSEEKDDTHQQIDNEENSTGASDDI

SEQ ID NO: 1635874 - protein, 7 aa, Staphylococcus aureus
DYSTPLT

SEQ ID NO: 1635875 - protein, 14 aa, Staphylococcus aureus
DYTDSKYNISPNEL

SEQ ID NO: 1635876 - protein, 8 aa, Staphylococcus aureus
DYTKGENY

SEQ ID NO: 1635877 - protein, 9 aa, Staphylococcus aureus
DYTSPNGSL

SEQ ID NO: 1635878 - protein, 4 aa, Staphylococcus aureus
DYVN

SEQ ID NO: 1635879 - protein, 6 aa, Staphylococcus aureus
EAALSQ

SEQ ID NO: 1635880 - protein, 10 aa, Staphylococcus aureus
EAAREFTKEQ

SEQ ID NO: 1635881 - protein, 10 aa, Staphylococcus aureus
EAAVDDDTAA

SEQ ID NO: 1635882 - protein, 27 aa, Staphylococcus aureus
EADTDTEDTMDGSYNTGGSVESTMSGT

SEQ ID NO: 1635883 - protein, 9 aa, Staphylococcus aureus
EADTKKDIR

SEQ ID NO: 1635884 - protein, 9 aa, Staphylococcus aureus
EAESLEEAE

SEQ ID NO: 1635885 - protein, 8 aa, Staphylococcus aureus
EAESQFES

SEQ ID NO: 1635886 - protein, 15 aa, Staphylococcus aureus
EAFSQKNESKEGEED

SEQ ID NO: 1635887 - protein, 14 aa, Staphylococcus aureus
EAGDLDQYDISGQG

SEQ ID NO: 1635888 - protein, 11 aa, Staphylococcus aureus
EAGHGKKGAQH

SEQ ID NO: 1635889 - protein, 8 aa, Staphylococcus aureus
EAGINATK

SEQ ID NO: 1635890 - protein, 5 aa, Staphylococcus aureus
EAGTL

SEQ ID NO: 1635891 - protein, 11 aa, Staphylococcus aureus
EAGYNDDIDEE

SEQ ID NO: 1635892 - protein, 49 aa, Staphylococcus aureus
EAHAEASKQATSNDSSEAKAENDNTASQSEMAEPKPQEEKKGFFARLFN

SEQ ID NO: 1635893 - protein, 9 aa, Staphylococcus aureus
EAHTGQPRD

SEQ ID NO: 1635894 - protein, 10 aa, Staphylococcus aureus
EAIKNGEDYA

SEQ ID NO: 1635895 - protein, 13 aa, Staphylococcus aureus
EAINKTQNSGYEN

SEQ ID NO: 1635896 - protein, 6 aa, Staphylococcus aureus
EAITSA

SEQ ID NO: 1635897 - protein, 9 aa, Staphylococcus aureus
EAKAAKKIE

SEQ ID NO: 1635898 - protein, 14 aa, Staphylococcus aureus
EAKESHQRVMESKN

SEQ ID NO: 1635899 - protein, 7 aa, Staphylococcus aureus
EAKKQSI

SEQ ID NO: 1635900 - protein, 8 aa, Staphylococcus aureus
EAKRYELT

SEQ ID NO: 1635901 - protein, 13 aa, Staphylococcus aureus
EAKYEGEGYGKFK

SEQ ID NO: 1635902 - protein, 6 aa, Staphylococcus aureus
EALTDQ

SEQ ID NO: 1635903 - protein, 7 aa, Staphylococcus aureus
EAMGGGD

SEQ ID NO: 1635904 - protein, 4 aa, Staphylococcus aureus
EAMT

SEQ ID NO: 1635905 - protein, 5 aa, Staphylococcus aureus
EANAN

SEQ ID NO: 1635906 - protein, 4 aa, Staphylococcus aureus
EANI

SEQ ID NO: 1635907 - protein, 4 aa, Staphylococcus aureus
EANQ

SEQ ID NO: 1635908 - protein, 13 aa, Staphylococcus aureus
EANRVIAKSSLRK

SEQ ID NO: 1635909 - protein, 15 aa, Staphylococcus aureus
EAPGFTIDTPVEQLG

SEQ ID NO: 1635910 - protein, 9 aa, Staphylococcus aureus
EAPPTQHKM

SEQ ID NO: 1635911 - protein, 5 aa, Staphylococcus aureus
EAQEI

SEQ ID NO: 1635912 - protein, 5 aa, Staphylococcus aureus
EAQGI

SEQ ID NO: 1635913 - protein, 32 aa, Staphylococcus aureus
EAQQAIKASAENQVESIKDTPHATVDELDEAN

SEQ ID NO: 1635914 - protein, 28 aa, Staphylococcus aureus
EAQYKATKKMQNKQKQNYKSKEKTPSWL

SEQ ID NO: 1635915 - protein, 6 aa, Staphylococcus aureus
EARGFS

SEQ ID NO: 1635916 - protein, 15 aa, Staphylococcus aureus
EARKIKPSIPEMGEN

SEQ ID NO: 1635917 - protein, 16 aa, Staphylococcus aureus
EARKIKPSIPTIGKNG

SEQ ID NO: 1635918 - protein, 15 aa, Staphylococcus aureus
EARPTIGQSDEDEKS

SEQ ID NO: 1635919 - protein, 11 aa, Staphylococcus aureus
EARTYRNQANI

SEQ ID NO: 1635920 - protein, 18 aa, Staphylococcus aureus
EASAANVAGIAGTNNGIT

SEQ ID NO: 1635921 - protein, 18 aa, Staphylococcus aureus
EASAATVAGIAGTNNGIT

SEQ ID NO: 1635922 - protein, 18 aa, Staphylococcus aureus
EASAATVAGITGTNNGIT

SEQ ID NO: 1635923 - protein, 9 aa, Staphylococcus aureus
EASHKEGKW

SEQ ID NO: 1635924 - protein, 12 aa, Staphylococcus aureus
EASTINTDPFQY

SEQ ID NO: 1635925 - protein, 4 aa, Staphylococcus aureus
EATR

SEQ ID NO: 1635926 - protein, 17 aa, Staphylococcus aureus
EATTLEDSNYKERWNSG

SEQ ID NO: 1635927 - protein, 20 aa, Staphylococcus aureus
EAVDKAKEALNKATGQNLTA

SEQ ID NO: 1635928 - protein, 7 aa, Staphylococcus aureus
EAVERGA

SEQ ID NO: 1635929 - protein, 8 aa, Staphylococcus aureus
EAVERGAK

SEQ ID NO: 1635930 - protein, 6 aa, Staphylococcus aureus
EAVGDK

SEQ ID NO: 1635931 - protein, 4 aa, Staphylococcus aureus
EAYQ

SEQ ID NO: 1635932 - protein, 6 aa, Staphylococcus aureus
ECPNQN

SEQ ID NO: 1635933 - protein, 13 aa, Staphylococcus aureus
EDACNKVNQPKIE

SEQ ID NO: 1635934 - protein, 11 aa, Staphylococcus aureus
EDAGNIKTAIT

SEQ ID NO: 1635935 - protein, 12 aa, Staphylococcus aureus
EDAGQGEDTDKH

SEQ ID NO: 1635936 - protein, 12 aa, Staphylococcus aureus
EDAGSKLTKAQS

SEQ ID NO: 1635937 - protein, 6 aa, Staphylococcus aureus
EDAIEG

SEQ ID NO: 1635938 - protein, 18 aa, Staphylococcus aureus
EDASIKSAIEEAHNNGKE

SEQ ID NO: 1635939 - protein, 18 aa, Staphylococcus aureus
EDASIKTAIEEAHKNNKQ

SEQ ID NO: 1635940 - protein, 5 aa, Staphylococcus aureus
EDAVN

SEQ ID NO: 1635941 - protein, 24 aa, Staphylococcus aureus
EDDKSFRDGMRNSKKQLKDKSRPY

SEQ ID NO: 1635942 - protein, 17 aa, Staphylococcus aureus
EDDKTFSDGMKNSKNNL

SEQ ID NO: 1635943 - protein, 12 aa, Staphylococcus aureus
EDDPDSESPQLS

SEQ ID NO: 1635944 - protein, 9 aa, Staphylococcus aureus
EDDSDSAIV

SEQ ID NO: 1635945 - protein, 8 aa, Staphylococcus aureus
EDEAPSNA

SEQ ID NO: 1635946 - protein, 5 aa, Staphylococcus aureus
EDEEI

SEQ ID NO: 1635947 - protein, 16 aa, Staphylococcus aureus
EDEEKVETIKSYIEVV

SEQ ID NO: 1635948 - protein, 21 aa, Staphylococcus aureus
EDEHNSSSKAVADVMKEIYPY

SEQ ID NO: 1635949 - protein, 14 aa, Staphylococcus aureus
EDEIKKYKKDIDDA

SEQ ID NO: 1635950 - protein, 5 aa, Staphylococcus aureus
EDEKL

SEQ ID NO: 1635951 - protein, 9 aa, Staphylococcus aureus
EDEKLKQKI

SEQ ID NO: 1635952 - protein, 32 aa, Staphylococcus aureus
EDEMDDDDDIPAQTDDQEELNDSEDEQVEEEI

SEQ ID NO: 1635953 - protein, 6 aa, Staphylococcus aureus
EDENLK

SEQ ID NO: 1635954 - protein, 5 aa, Staphylococcus aureus
EDERT

SEQ ID NO: 1635955 - protein, 10 aa, Staphylococcus aureus
EDESNASSVA

SEQ ID NO: 1635956 - protein, 15 aa, Staphylococcus aureus
EDETLENLDNESIDT

SEQ ID NO: 1635957 - protein, 5 aa, Staphylococcus aureus
EDEYS

SEQ ID NO: 1635958 - protein, 6 aa, Staphylococcus aureus
EDFSGY

SEQ ID NO: 1635959 - protein, 7 aa, Staphylococcus aureus
EDGAEDI

SEQ ID NO: 1635960 - protein, 15 aa, Staphylococcus aureus
EDGNNIEDNKKFKEY

SEQ ID NO: 1635961 - protein, 7 aa, Staphylococcus aureus
EDGQQTD

SEQ ID NO: 1635962 - protein, 6 aa, Staphylococcus aureus
EDGTED

SEQ ID NO: 1635963 - protein, 7 aa, Staphylococcus aureus
EDIEEKE

SEQ ID NO: 1635964 - protein, 8 aa, Staphylococcus aureus
EDIQQYPK

SEQ ID NO: 1635965 - protein, 5 aa, Staphylococcus aureus
EDIYK

SEQ ID NO: 1635966 - protein, 7 aa, Staphylococcus aureus
EDKKEKI

SEQ ID NO: 1635967 - protein, 10 aa, Staphylococcus aureus
EDKTLRSDEV

SEQ ID NO: 1635968 - protein, 12 aa, Staphylococcus aureus
EDLKNGNAHSGY

SEQ ID NO: 1635969 - protein, 5 aa, Staphylococcus aureus
EDLKT

SEQ ID NO: 1635970 - protein, 6 aa, Staphylococcus aureus
EDLKTQ

SEQ ID NO: 1635971 - protein, 6 aa, Staphylococcus aureus
EDLQEG

SEQ ID NO: 1635972 - protein, 17 aa, Staphylococcus aureus
EDLSQDEIEESRNILNK

SEQ ID NO: 1635973 - protein, 4 aa, Staphylococcus aureus
EDMT

SEQ ID NO: 1635974 - protein, 27 aa, Staphylococcus aureus
EDNDEESEDKQSEQKVITGTDLRKLFG

SEQ ID NO: 1635975 - protein, 9 aa, Staphylococcus aureus
EDNEEHNLE

SEQ ID NO: 1635976 - protein, 5 aa, Staphylococcus aureus
EDNEI

SEQ ID NO: 1635977 - protein, 9 aa, Staphylococcus aureus
EDNKKFKEY

SEQ ID NO: 1635978 - protein, 11 aa, Staphylococcus aureus
EDNKKSVSYTK

SEQ ID NO: 1635979 - protein, 16 aa, Staphylococcus aureus
EDNLKDNKREDNPKAK

SEQ ID NO: 1635980 - protein, 10 aa, Staphylococcus aureus
EDNPDLTSAL

SEQ ID NO: 1635981 - protein, 7 aa, Staphylococcus aureus
EDNPKFL

SEQ ID NO: 1635982 - protein, 28 aa, Staphylococcus aureus
EDNRLKKRNYKTNIKQSKRGTDKNNLRG

SEQ ID NO: 1635983 - protein, 24 aa, Staphylococcus aureus
EDNVQDINETAAPLTYGDSELSRT

SEQ ID NO: 1635984 - protein, 7 aa, Staphylococcus aureus
EDNYSAV

SEQ ID NO: 1635985 - protein, 8 aa, Staphylococcus aureus
EDPNTSYK

SEQ ID NO: 1635986 - protein, 8 aa, Staphylococcus aureus
EDQGKPLA

SEQ ID NO: 1635987 - protein, 5 aa, Staphylococcus aureus
EDQTF

SEQ ID NO: 1635988 - protein, 6 aa, Staphylococcus aureus
EDRLNQ

SEQ ID NO: 1635989 - protein, 8 aa, Staphylococcus aureus
EDSDEDLG

SEQ ID NO: 1635990 - protein, 4 aa, Staphylococcus aureus
EDSF

SEQ ID NO: 1635991 - protein, 8 aa, Staphylococcus aureus
EDSKLNTK

SEQ ID NO: 1635992 - protein, 10 aa, Staphylococcus aureus
EDSNEKYQTP

SEQ ID NO: 1635993 - protein, 20 aa, Staphylococcus aureus
EDSQGTVNQTFKDSESGSER

SEQ ID NO: 1635994 - protein, 9 aa, Staphylococcus aureus
EDSSNFKSV

SEQ ID NO: 1635995 - protein, 12 aa, Staphylococcus aureus
EDTKNVGDVSLE

SEQ ID NO: 1635996 - protein, 19 aa, Staphylococcus aureus
EDTNQVNYAASQKEALQTA

SEQ ID NO: 1635997 - protein, 5 aa, Staphylococcus aureus
EDTTV

SEQ ID NO: 1635998 - protein, 4 aa, Staphylococcus aureus
EDVQ

SEQ ID NO: 1635999 - protein, 5 aa, Staphylococcus aureus
EDVTD

SEQ ID NO: 1636000 - protein, 7 aa, Staphylococcus aureus
EDVTGHE

SEQ ID NO: 1636001 - protein, 9 aa, Staphylococcus aureus
EDVTPNDFG

SEQ ID NO: 1636002 - protein, 4 aa, Staphylococcus aureus
EDYD

SEQ ID NO: 1636003 - protein, 17 aa, Staphylococcus aureus
EEAEALKAQQEEQSVNV

SEQ ID NO: 1636004 - protein, 9 aa, Staphylococcus aureus
EEAEQIQKE

SEQ ID NO: 1636005 - protein, 16 aa, Staphylococcus aureus
EEAGEPLTPTRMNEEY

SEQ ID NO: 1636006 - protein, 5 aa, Staphylococcus aureus
EEAPI

SEQ ID NO: 1636007 - protein, 7 aa, Staphylococcus aureus
EEAQAGD

SEQ ID NO: 1636008 - protein, 8 aa, Staphylococcus aureus
EEAVDPDD

SEQ ID NO: 1636009 - protein, 9 aa, Staphylococcus aureus
EEDANYASG

SEQ ID NO: 1636010 - protein, 5 aa, Staphylococcus aureus
EEDSL

SEQ ID NO: 1636011 - protein, 4 aa, Staphylococcus aureus
EEEA

SEQ ID NO: 1636012 - protein, 7 aa, Staphylococcus aureus
EEEAARL

SEQ ID NO: 1636013 - protein, 15 aa, Staphylococcus aureus
EEEAARLQKNLLVTQ

SEQ ID NO: 1636014 - protein, 19 aa, Staphylococcus aureus
EEEDPYDEDTIRLSVLDDQ

SEQ ID NO: 1636015 - protein, 6 aa, Staphylococcus aureus
EEEEPI

SEQ ID NO: 1636016 - protein, 6 aa, Staphylococcus aureus
EEEKQI

SEQ ID NO: 1636017 - protein, 7 aa, Staphylococcus aureus
EEETARM

SEQ ID NO: 1636018 - protein, 61 aa, Staphylococcus aureus
EEEVEVPDKQQQVNEAPAKEQSQQTTKQNAIKSVPQKSASRYTTTSEERNNRMSNYSKNNL

SEQ ID NO: 1636019 - protein, 4 aa, Staphylococcus aureus
EEFE

SEQ ID NO: 1636020 - protein, 7 aa, Staphylococcus aureus
EEFEKDR

SEQ ID NO: 1636021 - protein, 5 aa, Staphylococcus aureus
EEGGV

SEQ ID NO: 1636022 - protein, 7 aa, Staphylococcus aureus
EEGHDPW

SEQ ID NO: 1636023 - protein, 8 aa, Staphylococcus aureus
EEGHEPLT

SEQ ID NO: 1636024 - protein, 17 aa, Staphylococcus aureus
EEGHEPWTSCEFDFTRE

SEQ ID NO: 1636025 - protein, 5 aa, Staphylococcus aureus
EEGKI

SEQ ID NO: 1636026 - protein, 10 aa, Staphylococcus aureus
EEGLDKGAKN

SEQ ID NO: 1636027 - protein, 5 aa, Staphylococcus aureus
EEGLT

SEQ ID NO: 1636028 - protein, 12 aa, Staphylococcus aureus
EEGLTTAATQLA

SEQ ID NO: 1636029 - protein, 8 aa, Staphylococcus aureus
EEGNRRPI

SEQ ID NO: 1636030 - protein, 11 aa, Staphylococcus aureus
EEGVRKGAYTV

SEQ ID NO: 1636031 - protein, 6 aa, Staphylococcus aureus
EEIDDP

SEQ ID NO: 1636032 - protein, 5 aa, Staphylococcus aureus
EEIGY

SEQ ID NO: 1636033 - protein, 4 aa, Staphylococcus aureus
EEIQ

SEQ ID NO: 1636034 - protein, 13 aa, Staphylococcus aureus
EEISESVRRDPIH

SEQ ID NO: 1636035 - protein, 4 aa, Staphylococcus aureus
EEIT

SEQ ID NO: 1636036 - protein, 6 aa, Staphylococcus aureus
EEKDSK

SEQ ID NO: 1636037 - protein, 15 aa, Staphylococcus aureus
EEKEDDDPYMKFASD

SEQ ID NO: 1636038 - protein, 15 aa, Staphylococcus aureus
EEKGYIEGDPTKPRA

SEQ ID NO: 1636039 - protein, 16 aa, Staphylococcus aureus
EEKKIKNADISRKSND

SEQ ID NO: 1636040 - protein, 15 aa, Staphylococcus aureus
EEKKIKNRNTNTSNY

SEQ ID NO: 1636041 - protein, 12 aa, Staphylococcus aureus
EEKRGRKPTTIS

SEQ ID NO: 1636042 - protein, 8 aa, Staphylococcus aureus
EEKSDEMI

SEQ ID NO: 1636043 - protein, 9 aa, Staphylococcus aureus
EELENTFEG

SEQ ID NO: 1636044 - protein, 10 aa, Staphylococcus aureus
EELENTFEGS

SEQ ID NO: 1636045 - protein, 5 aa, Staphylococcus aureus
EELEP

SEQ ID NO: 1636046 - protein, 5 aa, Staphylococcus aureus
EELNE

SEQ ID NO: 1636047 - protein, 7 aa, Staphylococcus aureus
EELNEGS

SEQ ID NO: 1636048 - protein, 13 aa, Staphylococcus aureus
EEMDKNGATNEEL

SEQ ID NO: 1636049 - protein, 8 aa, Staphylococcus aureus
EENEETIY

SEQ ID NO: 1636050 - protein, 11 aa, Staphylococcus aureus
EENEQDGEKSY

SEQ ID NO: 1636051 - protein, 34 aa, Staphylococcus aureus
EENGELNSKLGDAAEKLNDTGQLKVEKPKPDEIM

SEQ ID NO: 1636052 - protein, 15 aa, Staphylococcus aureus
EENGKESSKVDVPQF

SEQ ID NO: 1636053 - protein, 37 aa, Staphylococcus aureus
EENKANAKSDQQGKVNKPKQQAKTLPDTGMSHNDDLP

SEQ ID NO: 1636054 - protein, 8 aa, Staphylococcus aureus
EENKTQNT

SEQ ID NO: 1636055 - protein, 9 aa, Staphylococcus aureus
EENNDWKDT

SEQ ID NO: 1636056 - protein, 13 aa, Staphylococcus aureus
EENNRIEIVGLDK

SEQ ID NO: 1636057 - protein, 7 aa, Staphylococcus aureus
EENNYTL

SEQ ID NO: 1636058 - protein, 9 aa, Staphylococcus aureus
EENSDWKDT

SEQ ID NO: 1636059 - protein, 8 aa, Staphylococcus aureus
EENTDYTA

SEQ ID NO: 1636060 - protein, 4 aa, Staphylococcus aureus
EENV

SEQ ID NO: 1636061 - protein, 4 aa, Staphylococcus aureus
EEPD

SEQ ID NO: 1636062 - protein, 9 aa, Staphylococcus aureus
EEQEASPKF

SEQ ID NO: 1636063 - protein, 14 aa, Staphylococcus aureus
EEQGQEMTPNNKQQ

SEQ ID NO: 1636064 - protein, 10 aa, Staphylococcus aureus
EEQNLQNEEY

SEQ ID NO: 1636065 - protein, 8 aa, Staphylococcus aureus
EEQNSTNV

SEQ ID NO: 1636066 - protein, 9 aa, Staphylococcus aureus
EERAERRYK

SEQ ID NO: 1636067 - protein, 8 aa, Staphylococcus aureus
EERGGRRQ

SEQ ID NO: 1636068 - protein, 11 aa, Staphylococcus aureus
EERYGKEEAQK

SEQ ID NO: 1636069 - protein, 34 aa, Staphylococcus aureus
EESDEDNGELKDNNDDEGKDKQDTKTNSEEEIEK

SEQ ID NO: 1636070 - protein, 10 aa, Staphylococcus aureus
EESDSIGQHP

SEQ ID NO: 1636071 - protein, 6 aa, Staphylococcus aureus
EESELE

SEQ ID NO: 1636072 - protein, 4 aa, Staphylococcus aureus
EESH

SEQ ID NO: 1636073 - protein, 15 aa, Staphylococcus aureus
EESKRFTDFPKDYKG

SEQ ID NO: 1636074 - protein, 6 aa, Staphylococcus aureus
EESKTD

SEQ ID NO: 1636075 - protein, 89 aa, Staphylococcus aureus
EESQDDNQLENEQVDQSTSSSVSEVSDITEESEETTHPNNTSGQQDNDDQQKDLQPSFSNQNEDTANENRPRTNQQDVATNQAVHTSKP

SEQ ID NO: 1636076 - protein, 57 aa, Staphylococcus aureus
EESQDDNQLENEQVHQSTSSSVSEVSDITEESEATTHLNNTSGQQDNDDQQKDLQPS

SEQ ID NO: 1636077 - protein, 9 aa, Staphylococcus aureus
EESSGIKAE

SEQ ID NO: 1636078 - protein, 11 aa, Staphylococcus aureus
EESTHENSKHH

SEQ ID NO: 1636079 - protein, 67 aa, Staphylococcus aureus
EETKKAVKEADDSWKKKTVKKYGETETKSPVVKEEKKVEEPQAPKVDNQQEVKTTAGKAEETTQPVA

SEQ ID NO: 1636080 - protein, 4 aa, Staphylococcus aureus
EETL

SEQ ID NO: 1636081 - protein, 15 aa, Staphylococcus aureus
EETPNDVEKLGGITR

SEQ ID NO: 1636082 - protein, 43 aa, Staphylococcus aureus; identical to SEQ ID NO: 1567954

SEQ ID NO: 1636083 - protein, 16 aa, Staphylococcus aureus
EETSNNALNQAKQYVD

SEQ ID NO: 1636084 - protein, 8 aa, Staphylococcus aureus
EETTELSA

SEQ ID NO: 1636085 - protein, 10 aa, Staphylococcus aureus
EETVTNKGEV

SEQ ID NO: 1636086 - protein, 7 aa, Staphylococcus aureus
EETYEKN

SEQ ID NO: 1636087 - protein, 17 aa, Staphylococcus aureus
EETYQSRLAKKTPTKTG

SEQ ID NO: 1636088 - protein, 24 aa, Staphylococcus aureus
EEVEELQKEQPDSVFKEDAGRGYR

SEQ ID NO: 1636089 - protein, 5 aa, Staphylococcus aureus
EEVGT

SEQ ID NO: 1636090 - protein, 11 aa, Staphylococcus aureus
EEVKETSTDLT

SEQ ID NO: 1636091 - protein, 10 aa, Staphylococcus aureus
EEVKSKQTQF

SEQ ID NO: 1636092 - protein, 4 aa, Staphylococcus aureus
EEVP

SEQ ID NO: 1636093 - protein, 5 aa, Staphylococcus aureus
EEVPD

SEQ ID NO: 1636094 - protein, 9 aa, Staphylococcus aureus
EEVPPGGAK

SEQ ID NO: 1636095 - protein, 8 aa, Staphylococcus aureus
EEVVEPEK

SEQ ID NO: 1636096 - protein, 7 aa, Staphylococcus aureus
EEYEKAE

SEQ ID NO: 1636097 - protein, 5 aa, Staphylococcus aureus
EEYGN

SEQ ID NO: 1636098 - protein, 5 aa, Staphylococcus aureus
EFAQG

SEQ ID NO: 1636099 - protein, 6 aa, Staphylococcus aureus
EFDKSN

SEQ ID NO: 1636100 - protein, 8 aa, Staphylococcus aureus
EFDPNKNI

SEQ ID NO: 1636101 - protein, 20 aa, Staphylococcus aureus
EFEQSNGSPNIKGYTRRDSA

SEQ ID NO: 1636102 - protein, 12 aa, Staphylococcus aureus
EFKEKGYSPTLN

SEQ ID NO: 1636103 - protein, 4 aa, Staphylococcus aureus
EFND

SEQ ID NO: 1636104 - protein, 18 aa, Staphylococcus aureus
EFNEKEHQKNIMLNLKII

SEQ ID NO: 1636105 - protein, 16 aa, Staphylococcus aureus
EFPKPDKSKYNGQSYP

SEQ ID NO: 1636106 - protein, 18 aa, Staphylococcus aureus
EFQKRNSTGNAGWRGPNI

SEQ ID NO: 1636107 - protein, 4 aa, Staphylococcus aureus
EFRN

SEQ ID NO: 1636108 - protein, 11 aa, Staphylococcus aureus
EGAGGGHTPDL

SEQ ID NO: 1636109 - protein, 9 aa, Staphylococcus aureus
EGAQSDEGD

SEQ ID NO: 1636110 - protein, 11 aa, Staphylococcus aureus
EGAREKAENGG

SEQ ID NO: 1636111 - protein, 32 aa, Staphylococcus aureus
EGAVPVEDRGPNTEADEKSAYNNVQVGVAETA

SEQ ID NO: 1636112 - protein, 16 aa, Staphylococcus aureus
EGCSEEESTPFNEPKQ

SEQ ID NO: 1636113 - protein, 8 aa, Staphylococcus aureus
EGDDGEWY

SEQ ID NO: 1636114 - protein, 4 aa, Staphylococcus aureus
EGDI

SEQ ID NO: 1636115 - protein, 6 aa, Staphylococcus aureus
EGEDDF

SEQ ID NO: 1636116 - protein, 5 aa, Staphylococcus aureus
EGEFT

SEQ ID NO: 1636117 - protein, 20 aa, Staphylococcus aureus
EGEYSPTSNRNTSINESLND

SEQ ID NO: 1636118 - protein, 5 aa, Staphylococcus aureus
EGFDN

SEQ ID NO: 1636119 - protein, 4 aa, Staphylococcus aureus
EGGA

SEQ ID NO: 1636120 - protein, 10 aa, Staphylococcus aureus
EGGEMLSGGQ

SEQ ID NO: 1636121 - protein, 9 aa, Staphylococcus aureus
EGGSGGALG

SEQ ID NO: 1636122 - protein, 11 aa, Staphylococcus aureus
EGGYDKGGKGL

SEQ ID NO: 1636123 - protein, 15 aa, Staphylococcus aureus
EGHNNTNKVEPHAGQ

SEQ ID NO: 1636124 - protein, 16 aa, Staphylococcus aureus
EGHVNESSMVGEPKQM

SEQ ID NO: 1636125 - protein, 5 aa, Staphylococcus aureus
EGIDN

SEQ ID NO: 1636126 - protein, 4 aa, Staphylococcus aureus
EGIE

SEQ ID NO: 1636127 - protein, 6 aa, Staphylococcus aureus
EGIEDN

SEQ ID NO: 1636128 - protein, 5 aa, Staphylococcus aureus
EGIKA

SEQ ID NO: 1636129 - protein, 7 aa, Staphylococcus aureus
EGKCSES

SEQ ID NO: 1636130 - protein, 12 aa, Staphylococcus aureus
EGKDAEKALQDS

SEQ ID NO: 1636131 - protein, 8 aa, Staphylococcus aureus
EGKEFKTN

SEQ ID NO: 1636132 - protein, 11 aa, Staphylococcus aureus
EGKKGGIVTTD

SEQ ID NO: 1636133 - protein, 17 aa, Staphylococcus aureus
EGKNESVPQDDTQATFA

SEQ ID NO: 1636134 - protein, 11 aa, Staphylococcus aureus
EGKPVSPEEQK

SEQ ID NO: 1636135 - protein, 6 aa, Staphylococcus aureus
EGKRFG

SEQ ID NO: 1636136 - protein, 24 aa, Staphylococcus aureus
EGKRYKKKGFTTKREAVQAESIAR

SEQ ID NO: 1636137 - protein, 7 aa, Staphylococcus aureus
EGKTIKK

SEQ ID NO: 1636138 - protein, 6 aa, Staphylococcus aureus
EGLQGT

SEQ ID NO: 1636139 - protein, 5 aa, Staphylococcus aureus
EGMED

SEQ ID NO: 1636140 - protein, 13 aa, Staphylococcus aureus
EGNEVDKAEEEAK

SEQ ID NO: 1636141 - protein, 15 aa, Staphylococcus aureus
EGNPGYMTDTEPGSL

SEQ ID NO: 1636142 - protein, 9 aa, Staphylococcus aureus
EGPGISLEE

SEQ ID NO: 1636143 - protein, 10 aa, Staphylococcus aureus
EGQDSEYRFT

SEQ ID NO: 1636144 - protein, 22 aa, Staphylococcus aureus
EGQGRQRSNVHGEVKAPKNWGT

SEQ ID NO: 1636145 - protein, 23 aa, Staphylococcus aureus
EGQGRQRSNVHGEVKAPKNWGTS

SEQ ID NO: 1636146 - protein, 6 aa, Staphylococcus aureus
EGQISR

SEQ ID NO: 1636147 - protein, 8 aa, Staphylococcus aureus
EGQTYNER

SEQ ID NO: 1636148 - protein, 9 aa, Staphylococcus aureus
EGQVGASDI

SEQ ID NO: 1636149 - protein, 18 aa, Staphylococcus aureus
EGREQFKPVGEANPTIGQ

SEQ ID NO: 1636150 - protein, 5 aa, Staphylococcus aureus
EGRGA

SEQ ID NO: 1636151 - protein, 9 aa, Staphylococcus aureus
EGRNTDKAY

SEQ ID NO: 1636152 - protein, 5 aa, Staphylococcus aureus
EGSHQ

SEQ ID NO: 1636153 - protein, 10 aa, Staphylococcus aureus
EGSPNAMQDA

SEQ ID NO: 1636154 - protein, 16 aa, Staphylococcus aureus
EGSQGHRSTLSLMRLL

SEQ ID NO: 1636155 - protein, 5 aa, Staphylococcus aureus
EGSRT

SEQ ID NO: 1636156 - protein, 15 aa, Staphylococcus aureus
EGSVKDKIAKMIEDK

SEQ ID NO: 1636157 - protein, 17 aa, Staphylococcus aureus
EGSVKEKIAKKNIDKKL

SEQ ID NO: 1636158 - protein, 10 aa, Staphylococcus aureus
EGTEPTVPNS

SEQ ID NO: 1636159 - protein, 7 aa, Staphylococcus aureus
EGTIPAI

SEQ ID NO: 1636160 - protein, 7 aa, Staphylococcus aureus
EGTYDKV

SEQ ID NO: 1636161 - protein, 8 aa, Staphylococcus aureus
EGVEAPKY

SEQ ID NO: 1636162 - protein, 5 aa, Staphylococcus aureus
EGVIT

SEQ ID NO: 1636163 - protein, 5 aa, Staphylococcus aureus
EGVQP

SEQ ID NO: 1636164 - protein, 7 aa, Staphylococcus aureus
EGYEADG

SEQ ID NO: 1636165 - protein, 7 aa, Staphylococcus aureus
EGYIDGK

SEQ ID NO: 1636166 - protein, 9 aa, Staphylococcus aureus
EGYKKGLRK

SEQ ID NO: 1636167 - protein, 16 aa, Staphylococcus aureus
EGYKNSDNSIKISSDE

SEQ ID NO: 1636168 - protein, 11 aa, Staphylococcus aureus
EGYTETKDSNF

SEQ ID NO: 1636169 - protein, 8 aa, Staphylococcus aureus
EHDGTTYP

SEQ ID NO: 1636170 - protein, 4 aa, Staphylococcus aureus
EHDI

SEQ ID NO: 1636171 - protein, 7 aa, Staphylococcus aureus
EHDLDTP

SEQ ID NO: 1636172 - protein, 9 aa, Staphylococcus aureus
EHDSEQWDD

SEQ ID NO: 1636173 - protein, 7 aa, Staphylococcus aureus
EHEKGQY

SEQ ID NO: 1636174 - protein, 11 aa, Staphylococcus aureus
EHFPEAKPRIG

SEQ ID NO: 1636175 - protein, 7 aa, Staphylococcus aureus
EHGTIES

SEQ ID NO: 1636176 - protein, 10 aa, Staphylococcus aureus
EHKNEEKRIE

SEQ ID NO: 1636177 - protein, 10 aa, Staphylococcus aureus
EHKNEEQKIE

SEQ ID NO: 1636178 - protein, 5 aa, Staphylococcus aureus
EHKNS

SEQ ID NO: 1636179 - protein, 7 aa, Staphylococcus aureus
EHKPARS

SEQ ID NO: 1636180 - protein, 36 aa, Staphylococcus aureus
EHKQHHNELRESHKELKDKQDKVVDENLEQTKILNR

SEQ ID NO: 1636181 - protein, 6 aa, Staphylococcus aureus
EHKSGL

SEQ ID NO: 1636182 - protein, 21 aa, Staphylococcus aureus
EHNEEGKPSESASNRQQQMEK

SEQ ID NO: 1636183 - protein, 8 aa, Staphylococcus aureus
EHPPAEAQ

SEQ ID NO: 1636184 - protein, 4 aa, Staphylococcus aureus
EHRM

SEQ ID NO: 1636185 - protein, 5 aa, Staphylococcus aureus
EHRPH

SEQ ID NO: 1636186 - protein, 6 aa, Staphylococcus aureus
EHTNKQ

SEQ ID NO: 1636187 - protein, 7 aa, Staphylococcus aureus
EIADNAD

SEQ ID NO: 1636188 - protein, 4 aa, Staphylococcus aureus
EIAK

SEQ ID NO: 1636189 - protein, 12 aa, Staphylococcus aureus
EIAQSEAHNHAP

SEQ ID NO: 1636190 - protein, 5 aa, Staphylococcus aureus
EIDGD

SEQ ID NO: 1636191 - protein, 13 aa, Staphylococcus aureus
EIDNIKDDLKKIN

SEQ ID NO: 1636192 - protein, 6 aa, Staphylococcus aureus
EIELGS

SEQ ID NO: 1636193 - protein, 12 aa, Staphylococcus aureus
EIENSDDAWSET

SEQ ID NO: 1636194 - protein, 13 aa, Staphylococcus aureus
EIERTPDIASATS

SEQ ID NO: 1636195 - protein, 4 aa, Staphylococcus aureus
EIGF

SEQ ID NO: 1636196 - protein, 12 aa, Staphylococcus aureus
EIGIEPGRSIVG

SEQ ID NO: 1636197 - protein, 9 aa, Staphylococcus aureus
EIGQSKINQ

SEQ ID NO: 1636198 - protein, 18 aa, Staphylococcus aureus
EIGTPISTDNAGWRGPNI

SEQ ID NO: 1636199 - protein, 22 aa, Staphylococcus aureus
EIIEDSKNTNEENKEINETNHN

SEQ ID NO: 1636200 - protein, 12 aa, Staphylococcus aureus
EIKAGKTNTEED

SEQ ID NO: 1636201 - protein, 8 aa, Staphylococcus aureus
EIKDVGTH

SEQ ID NO: 1636202 - protein, 5 aa, Staphylococcus aureus
EIKQE

SEQ ID NO: 1636203 - protein, 34 aa, Staphylococcus aureus
EINESGEQKMKEAESTATGACTGGSVDGSGISAF

SEQ ID NO: 1636204 - protein, 25 aa, Staphylococcus aureus
EINETGRKPDLPFGGYKQSGLGREW

SEQ ID NO: 1636205 - protein, 9 aa, Staphylococcus aureus
EINGDEQGY

SEQ ID NO: 1636206 - protein, 27 aa, Staphylococcus aureus
EIPNAEQTVNYQNADDNAKTNFDDAKR

SEQ ID NO: 1636207 - protein, 27 aa, Staphylococcus aureus
EIPTAEQTVNYQNADDVAKSNFDDAKR

SEQ ID NO: 1636208 - protein, 7 aa, Staphylococcus aureus
EIQETGN

SEQ ID NO: 1636209 - protein, 12 aa, Staphylococcus aureus
EIQSTEGYSIDG

SEQ ID NO: 1636210 - protein, 11 aa, Staphylococcus aureus
EIQSTEGYSIN

SEQ ID NO: 1636211 - protein, 9 aa, Staphylococcus aureus
EIQTPNSYR

SEQ ID NO: 1636212 - protein, 9 aa, Staphylococcus aureus
EIQTPNSYS

SEQ ID NO: 1636213 - protein, 6 aa, Staphylococcus aureus
EISDSR

SEQ ID NO: 1636214 - protein, 8 aa, Staphylococcus aureus
EISESDHE

SEQ ID NO: 1636215 - protein, 22 aa, Staphylococcus aureus
EISSIRTNGQDLKQSNGNVNLS

SEQ ID NO: 1636216 - protein, 5 aa, Staphylococcus aureus
EITDA

SEQ ID NO: 1636217 - protein, 15 aa, Staphylococcus aureus
EITQNMNDTQRSEIN

SEQ ID NO: 1636218 - protein, 4 aa, Staphylococcus aureus
EITR

SEQ ID NO: 1636219 - protein, 12 aa, Staphylococcus aureus
EITTSDVNAQET

SEQ ID NO: 1636220 - protein, 5 aa, Staphylococcus aureus
EKAEC

SEQ ID NO: 1636221 - protein, 6 aa, Staphylococcus aureus
EKAENH

SEQ ID NO: 1636222 - protein, 6 aa, Staphylococcus aureus
EKAGLT

SEQ ID NO: 1636223 - protein, 19 aa, Staphylococcus aureus
EKAKEVEEKLKDKKEEKQK

SEQ ID NO: 1636224 - protein, 32 aa, Staphylococcus aureus
EKAKKVEEKLKDKKEEKTEDINQTKQDIQDTL

SEQ ID NO: 1636225 - protein, 8 aa, Staphylococcus aureus
EKANIADV

SEQ ID NO: 1636226 - protein, 9 aa, Staphylococcus aureus
EKANNGSIT

SEQ ID NO: 1636227 - protein, 13 aa, Staphylococcus aureus
EKASGRKTKRTEL

SEQ ID NO: 1636228 - protein, 22 aa, Staphylococcus aureus
EKASSENFGEESDDAKNSIKVA

SEQ ID NO: 1636229 - protein, 20 aa, Staphylococcus aureus
EKASSENFGEVSDDAKNVKK

SEQ ID NO: 1636230 - protein, 7 aa, Staphylococcus aureus
EKAVDEH

SEQ ID NO: 1636231 - protein, 10 aa, Staphylococcus aureus
EKDDSRPNKE

SEQ ID NO: 1636232 - protein, 7 aa, Staphylococcus aureus
EKDFNKS

SEQ ID NO: 1636233 - protein, 6 aa, Staphylococcus aureus
EKDLKE

SEQ ID NO: 1636234 - protein, 9 aa, Staphylococcus aureus
EKEATPEDI

SEQ ID NO: 1636235 - protein, 26 aa, Staphylococcus aureus
EKEDETDNETTSDVLTENNEQESQID

SEQ ID NO: 1636236 - protein, 25 aa, Staphylococcus aureus
EKEENDVEPYGEKEVRKSNTNDTDF

SEQ ID NO: 1636237 - protein, 8 aa, Staphylococcus aureus
EKEFSGKE

SEQ ID NO: 1636238 - protein, 7 aa, Staphylococcus aureus
EKEGDYY

SEQ ID NO: 1636239 - protein, 20 aa, Staphylococcus aureus
EKEGGDAANAAQEKAEKEGK

SEQ ID NO: 1636240 - protein, 5 aa, Staphylococcus aureus
EKELV

SEQ ID NO: 1636241 - protein, 5 aa, Staphylococcus aureus
EKEPK

SEQ ID NO: 1636242 - protein, 8 aa, Staphylococcus aureus
EKERQEAV

SEQ ID NO: 1636243 - protein, 6 aa, Staphylococcus aureus
EKESFT

SEQ ID NO: 1636244 - protein, 14 aa, Staphylococcus aureus
EKESRKRYSPNSTY

SEQ ID NO: 1636245 - protein, 17 aa, Staphylococcus aureus
EKETGYKIAKNSGLPYQ

SEQ ID NO: 1636246 - protein, 5 aa, Staphylococcus aureus
EKETI

SEQ ID NO: 1636247 - protein, 9 aa, Staphylococcus aureus
EKETTFQPK

SEQ ID NO: 1636248 - protein, 12 aa, Staphylococcus aureus
EKEWTETVNREQ

SEQ ID NO: 1636249 - protein, 36 aa, Staphylococcus aureus
EKFKNSDNEQVKNVKDKINEYTGSNNEEKKEKEDKE

SEQ ID NO: 1636250 - protein, 38 aa, Staphylococcus aureus
EKFKNSDNEQVKNVKDKINEYTGSNNEEKKMKIKRNKI

SEQ ID NO: 1636251 - protein, 19 aa, Staphylococcus aureus
EKFNENGIDYSNINSDNFK

SEQ ID NO: 1636252 - protein, 6 aa, Staphylococcus aureus
EKFNGD

SEQ ID NO: 1636253 - protein, 17 aa, Staphylococcus aureus
EKFSKDMKDGYKSLSDD

SEQ ID NO: 1636254 - protein, 7 aa, Staphylococcus aureus
EKGAITT

SEQ ID NO: 1636255 - protein, 8 aa, Staphylococcus aureus
EKGAITTQ

SEQ ID NO: 1636256 - protein, 7 aa, Staphylococcus aureus
EKGESYK

SEQ ID NO: 1636257 - protein, 7 aa, Staphylococcus aureus
EKGKSEL

SEQ ID NO: 1636258 - protein, 4 aa, Staphylococcus aureus
EKGQ

SEQ ID NO: 1636259 - protein, 6 aa, Staphylococcus aureus
EKGQSQ

SEQ ID NO: 1636260 - protein, 17 aa, Staphylococcus aureus
EKGTVAKEGKVEGTTEE

SEQ ID NO: 1636261 - protein, 13 aa, Staphylococcus aureus
EKGTVAKEGTTEE

SEQ ID NO: 1636262 - protein, 7 aa, Staphylococcus aureus
EKGYSLT

SEQ ID NO: 1636263 - protein, 9 aa, Staphylococcus aureus
EKHDKNGNV

SEQ ID NO: 1636264 - protein, 7 aa, Staphylococcus aureus
EKIAPTI

SEQ ID NO: 1636265 - protein, 27 aa, Staphylococcus aureus
EKIDKASKILAKSPNLAISSSSRGNIE

SEQ ID NO: 1636266 - protein, 7 aa, Staphylococcus aureus
EKISTKP

SEQ ID NO: 1636267 - protein, 9 aa, Staphylococcus aureus
EKITDSNGE

SEQ ID NO: 1636268 - protein, 7 aa, Staphylococcus aureus
EKKATDI

SEQ ID NO: 1636269 - protein, 25 aa, Staphylococcus aureus
EKKAYENLKSYDQGVYRPKRYPSID

SEQ ID NO: 1636270 - protein, 8 aa, Staphylococcus aureus
EKKEMKKE

SEQ ID NO: 1636271 - protein, 6 aa, Staphylococcus aureus
EKKGCK

SEQ ID NO: 1636272 - protein, 5 aa, Staphylococcus aureus
EKKLG

SEQ ID NO: 1636273 - protein, 11 aa, Staphylococcus aureus
EKKRAHKQNQF

SEQ ID NO: 1636274 - protein, 4 aa, Staphylococcus aureus
EKKS

SEQ ID NO: 1636275 - protein, 5 aa, Staphylococcus aureus
EKKSY

SEQ ID NO: 1636276 - protein, 4 aa, Staphylococcus aureus
EKKV

SEQ ID NO: 1636277 - protein, 12 aa, Staphylococcus aureus
EKKVERKAPKLE

SEQ ID NO: 1636278 - protein, 12 aa, Staphylococcus aureus
EKKVERTTPKLE

SEQ ID NO: 1636279 - protein, 11 aa, Staphylococcus aureus
EKLAPKLKKGD

SEQ ID NO: 1636280 - protein, 12 aa, Staphylococcus aureus
EKLAQAKQDALA

SEQ ID NO: 1636281 - protein, 7 aa, Staphylococcus aureus
EKLQSEY

SEQ ID NO: 1636282 - protein, 13 aa, Staphylococcus aureus
EKLTKIKKGLEND

SEQ ID NO: 1636283 - protein, 15 aa, Staphylococcus aureus
EKNAKGGALEGKGKD

SEQ ID NO: 1636284 - protein, 9 aa, Staphylococcus aureus
EKNDRSYPT

SEQ ID NO: 1636285 - protein, 12 aa, Staphylococcus aureus
EKNEKELAKIRG

SEQ ID NO: 1636286 - protein, 18 aa, Staphylococcus aureus
EKNKLESREEKRKEIYQS

SEQ ID NO: 1636287 - protein, 16 aa, Staphylococcus aureus
EKNKTLKELSSNTGLS

SEQ ID NO: 1636288 - protein, 4 aa, Staphylococcus aureus
EKNL

SEQ ID NO: 1636289 - protein, 4 aa, Staphylococcus aureus
EKNR

SEQ ID NO: 1636290 - protein, 8 aa, Staphylococcus aureus
EKNVSVGK

SEQ ID NO: 1636291 - protein, 11 aa, Staphylococcus aureus
EKPAQGTAPSN

SEQ ID NO: 1636292 - protein, 29 aa, Staphylococcus aureus
EKPQGKLTLATESDKRPAIKSSAEDDFDE

SEQ ID NO: 1636293 - protein, 6 aa, Staphylococcus aureus
EKPSQI

SEQ ID NO: 1636294 - protein, 8 aa, Staphylococcus aureus
EKQDSYVK

SEQ ID NO: 1636295 - protein, 11 aa, Staphylococcus aureus
EKQKAGKAKMK

SEQ ID NO: 1636296 - protein, 8 aa, Staphylococcus aureus
EKQNEAMN

SEQ ID NO: 1636297 - protein, 4 aa, Staphylococcus aureus
EKQR

SEQ ID NO: 1636298 - protein, 56 aa, Staphylococcus aureus
EKQRLSQASKAKRNQAQQMAQASSKQKNKSIAPDRLSASKQKGTVEKAAQKQAKHI

SEQ ID NO: 1636299 - protein, 9 aa, Staphylococcus aureus
EKQRQQQAE

SEQ ID NO: 1636300 - protein, 7 aa, Staphylococcus aureus
EKQYNKN

SEQ ID NO: 1636301 - protein, 5 aa, Staphylococcus aureus
EKRCP

SEQ ID NO: 1636302 - protein, 10 aa, Staphylococcus aureus
EKRDLQYNED

SEQ ID NO: 1636303 - protein, 11 aa, Staphylococcus aureus
EKREKEIPFED

SEQ ID NO: 1636304 - protein, 6 aa, Staphylococcus aureus
EKRGLR

SEQ ID NO: 1636305 - protein, 13 aa, Staphylococcus aureus
EKRQSRRNIEKKD

SEQ ID NO: 1636306 - protein, 20 aa, Staphylococcus aureus
EKRTNNVVKKSDWDKGDQYK

SEQ ID NO: 1636307 - protein, 8 aa, Staphylococcus aureus
EKSAYNNV

SEQ ID NO: 1636308 - protein, 7 aa, Staphylococcus aureus
EKSEELY

SEQ ID NO: 1636309 - protein, 13 aa, Staphylococcus aureus
EKSIEQLSDNYEQ

SEQ ID NO: 1636310 - protein, 6 aa, Staphylococcus aureus
EKSKYL

SEQ ID NO: 1636311 - protein, 8 aa, Staphylococcus aureus
EKSNYEAS

SEQ ID NO: 1636312 - protein, 6 aa, Staphylococcus aureus
EKSPQA

SEQ ID NO: 1636313 - protein, 4 aa, Staphylococcus aureus
EKTE

SEQ ID NO: 1636314 - protein, 10 aa, Staphylococcus aureus
EKTEGKSRDE

SEQ ID NO: 1636315 - protein, 10 aa, Staphylococcus aureus
EKTESPDTKT

SEQ ID NO: 1636316 - protein, 17 aa, Staphylococcus aureus
EKTGKKFSHKSKANQKL

SEQ ID NO: 1636317 - protein, 7 aa, Staphylococcus aureus
EKTQAEI

SEQ ID NO: 1636318 - protein, 16 aa, Staphylococcus aureus
EKTVSELKKKINKKDE

SEQ ID NO: 1636319 - protein, 13 aa, Staphylococcus aureus
EKVEHIAKKGSFN

SEQ ID NO: 1636320 - protein, 23 aa, Staphylococcus aureus
EKVGNGAEHSKTLNAVRGQNNQW

SEQ ID NO: 1636321 - protein, 24 aa, Staphylococcus aureus
EKVGTFENQKKASVVSGSHTEDHS

SEQ ID NO: 1636322 - protein, 18 aa, Staphylococcus aureus
EKVTDNRHSKDSSFHNDD

SEQ ID NO: 1636323 - protein, 8 aa, Staphylococcus aureus
EKVTEEDI

SEQ ID NO: 1636324 - protein, 18 aa, Staphylococcus aureus
EKYEKELRDQDAQKDAFE

SEQ ID NO: 1636325 - protein, 19 aa, Staphylococcus aureus
EKYELYGKTGTGIVNGKYN

SEQ ID NO: 1636326 - protein, 12 aa, Staphylococcus aureus
EKYGIPKQDTGV

SEQ ID NO: 1636327 - protein, 12 aa, Staphylococcus aureus
EKYPEPKDEKSQ

SEQ ID NO: 1636328 - protein, 6 aa, Staphylococcus aureus
EKYQGF

SEQ ID NO: 1636329 - protein, 7 aa, Staphylococcus aureus
EKYQREN

SEQ ID NO: 1636330 - protein, 14 aa, Staphylococcus aureus
EKYSELKKNDTKHE

SEQ ID NO: 1636331 - protein, 14 aa, Staphylococcus aureus
EKYSELKKQDTKHE

SEQ ID NO: 1636332 - protein, 14 aa, Staphylococcus aureus
EKYSELKKQDTKYE

SEQ ID NO: 1636333 - protein, 7 aa, Staphylococcus aureus
EKYSRFD

SEQ ID NO: 1636334 - protein, 11 aa, Staphylococcus aureus
ELADDGTVKGL

SEQ ID NO: 1636335 - protein, 8 aa, Staphylococcus aureus
ELDDPQYT

SEQ ID NO: 1636336 - protein, 8 aa, Staphylococcus aureus
ELDEQGRV

SEQ ID NO: 1636337 - protein, 5 aa, Staphylococcus aureus
ELDKL

SEQ ID NO: 1636338 - protein, 4 aa, Staphylococcus aureus
ELDN

SEQ ID NO: 1636339 - protein, 10 aa, Staphylococcus aureus
ELDNTPLAKR

SEQ ID NO: 1636340 - protein, 4 aa, Staphylococcus aureus
ELEG

SEQ ID NO: 1636341 - protein, 5 aa, Staphylococcus aureus
ELEGK

SEQ ID NO: 1636342 - protein, 5 aa, Staphylococcus aureus
ELENE

SEQ ID NO: 1636343 - protein, 7 aa, Staphylococcus aureus
ELENSQS

SEQ ID NO: 1636344 - protein, 5 aa, Staphylococcus aureus
ELERE

SEQ ID NO: 1636345 - protein, 7 aa, Staphylococcus aureus
ELETKQE

SEQ ID NO: 1636346 - protein, 13 aa, Staphylococcus aureus
ELGADKLSTIEED

SEQ ID NO: 1636347 - protein, 13 aa, Staphylococcus aureus
ELGADKLSTIKEE

SEQ ID NO: 1636348 - protein, 4 aa, Staphylococcus aureus
ELGG

SEQ ID NO: 1636349 - protein, 7 aa, Staphylococcus aureus
ELGGKSA

SEQ ID NO: 1636350 - protein, 8 aa, Staphylococcus aureus
ELGKDDAE

SEQ ID NO: 1636351 - protein, 9 aa, Staphylococcus aureus
ELGNKNGLE

SEQ ID NO: 1636352 - protein, 9 aa, Staphylococcus aureus
ELHEGKKED

SEQ ID NO: 1636353 - protein, 30 aa, Staphylococcus aureus
ELKEKALSDGQISENERKEIENLENQRRDI

SEQ ID NO: 1636354 - protein, 17 aa, Staphylococcus aureus
ELKGVEGLSPKTRRKYD

SEQ ID NO: 1636355 - protein, 13 aa, Staphylococcus aureus
ELKKEKAQIENRY

SEQ ID NO: 1636356 - protein, 9 aa, Staphylococcus aureus
ELKSEQPDF

SEQ ID NO: 1636357 - protein, 9 aa, Staphylococcus aureus
ELKSKVSQT

SEQ ID NO: 1636358 - protein, 21 aa, Staphylococcus aureus
ELKSQYKESNKFKYPKRRDNE

SEQ ID NO: 1636359 - protein, 7 aa, Staphylococcus aureus
ELNDENK

SEQ ID NO: 1636360 - protein, 5 aa, Staphylococcus aureus
ELNSD

SEQ ID NO: 1636361 - protein, 8 aa, Staphylococcus aureus
ELNTRYDK

SEQ ID NO: 1636362 - protein, 9 aa, Staphylococcus aureus
ELPEDAGER

SEQ ID NO: 1636363 - protein, 7 aa, Staphylococcus aureus
ELPGPIV

SEQ ID NO: 1636364 - protein, 12 aa, Staphylococcus aureus
ELPKDHPARESY

SEQ ID NO: 1636365 - protein, 41 aa, Staphylococcus aureus
ELPNSQFQNNEFGSSRTVNLSGQELPNSQSNDTDYNDTDYI

SEQ ID NO: 1636366 - protein, 11 aa, Staphylococcus aureus
ELPSPSNPPQG

SEQ ID NO: 1636367 - protein, 6 aa, Staphylococcus aureus
ELPSQI

SEQ ID NO: 1636368 - protein, 7 aa, Staphylococcus aureus
ELQDDIG

SEQ ID NO: 1636369 - protein, 10 aa, Staphylococcus aureus
ELQELSSKGQ

SEQ ID NO: 1636370 - protein, 7 aa, Staphylococcus aureus
ELQKRNE

SEQ ID NO: 1636371 - protein, 6 aa, Staphylococcus aureus
ELREQS

SEQ ID NO: 1636372 - protein, 9 aa, Staphylococcus aureus
ELRGDDSKV

SEQ ID NO: 1636373 - protein, 8 aa, Staphylococcus aureus
ELSEEDQV

SEQ ID NO: 1636374 - protein, 6 aa, Staphylococcus aureus
ELSKGK

SEQ ID NO: 1636375 - protein, 11 aa, Staphylococcus aureus
ELSNQDELDPT

SEQ ID NO: 1636376 - protein, 5 aa, Staphylococcus aureus
ELSTG

SEQ ID NO: 1636377 - protein, 12 aa, Staphylococcus aureus
ELSTYGPKGRFG

SEQ ID NO: 1636378 - protein, 6 aa, Staphylococcus aureus
ELTGGS

SEQ ID NO: 1636379 - protein, 8 aa, Staphylococcus aureus
ELTPSVEE

SEQ ID NO: 1636380 - protein, 22 aa, Staphylococcus aureus
ELTQEKSEIEVSRSIEKSNKHL

SEQ ID NO: 1636381 - protein, 5 aa, Staphylococcus aureus
ELTSL

SEQ ID NO: 1636382 - protein, 11 aa, Staphylococcus aureus
ELTTAQSKSLN

SEQ ID NO: 1636383 - protein, 5 aa, Staphylococcus aureus
EMGGG

SEQ ID NO: 1636384 - protein, 5 aa, Staphylococcus aureus
EMGSW

SEQ ID NO: 1636385 - protein, 9 aa, Staphylococcus aureus
EMKAKDYKN

SEQ ID NO: 1636386 - protein, 5 aa, Staphylococcus aureus
EMSNN

SEQ ID NO: 1636387 - protein, 4 aa, Staphylococcus aureus
EMTG

SEQ ID NO: 1636388 - protein, 40 aa, Staphylococcus aureus
ENAANLRDKQTKLEKQYEEAKNEWKNAQNGMSTSLSEEDI

SEQ ID NO: 1636389 - protein, 10 aa, Staphylococcus aureus
ENANDLPASL

SEQ ID NO: 1636390 - protein, 24 aa, Staphylococcus aureus
ENASNRLKQSLDDCQKNISKITSK

SEQ ID NO: 1636391 - protein, 10 aa, Staphylococcus aureus
ENAYERALEP

SEQ ID NO: 1636392 - protein, 5 aa, Staphylococcus aureus
ENCVN

SEQ ID NO: 1636393 - protein, 4 aa, Staphylococcus aureus
ENDE

SEQ ID NO: 1636394 - protein, 7 aa, Staphylococcus aureus
ENDGESI

SEQ ID NO: 1636395 - protein, 7 aa, Staphylococcus aureus
ENDVKKY

SEQ ID NO: 1636396 - protein, 4 aa, Staphylococcus aureus
ENEA

SEQ ID NO: 1636397 - protein, 5 aa, Staphylococcus aureus
ENEAI

SEQ ID NO: 1636398 - protein, 6 aa, Staphylococcus aureus
ENEDVA

SEQ ID NO: 1636399 - protein, 7 aa, Staphylococcus aureus
ENEEKRQ

SEQ ID NO: 1636400 - protein, 13 aa, Staphylococcus aureus
ENEFPTKHNTALK

SEQ ID NO: 1636401 - protein, 10 aa, Staphylococcus aureus
ENEGEISSED

SEQ ID NO: 1636402 - protein, 6 aa, Staphylococcus aureus
ENEGVA

SEQ ID NO: 1636403 - protein, 10 aa, Staphylococcus aureus
ENEKQYQYTG

SEQ ID NO: 1636404 - protein, 64 aa, Staphylococcus aureus
ENENVEQSADIISDEKEQYHRDYRKQSHDSRSQKRHRRRRNQTTEEQNYSEQRGNSKISQQSIK

SEQ ID NO: 1636405 - protein, 11 aa, Staphylococcus aureus
ENEPEINQENS

SEQ ID NO: 1636406 - protein, 30 aa, Staphylococcus aureus
ENEPEINQENSNVSVEETTDTLSQKDFEQA

SEQ ID NO: 1636407 - protein, 11 aa, Staphylococcus aureus
ENETSHSASAT

SEQ ID NO: 1636408 - protein, 11 aa, Staphylococcus aureus
ENETSHTASAT

SEQ ID NO: 1636409 - protein, 16 aa, Staphylococcus aureus
ENEVNQQYKDDKGELN

SEQ ID NO: 1636410 - protein, 33 aa, Staphylococcus aureus
ENFKNTNEEYESKSAKSLNGQGIKEATDVTTYA

SEQ ID NO: 1636411 - protein, 13 aa, Staphylococcus aureus
ENFTQRVSTNLEK

SEQ ID NO: 1636412 - protein, 6 aa, Staphylococcus aureus
ENGFTT

SEQ ID NO: 1636413 - protein, 8 aa, Staphylococcus aureus
ENGKKNIN

SEQ ID NO: 1636414 - protein, 7 aa, Staphylococcus aureus
ENGKSRY

SEQ ID NO: 1636415 - protein, 54 aa, Staphylococcus aureus
ENGLSANGFSENGKTENRKGRTTNNNSTNNDLTNNNNTNNEGSILSGNPTVSSI

SEQ ID NO: 1636416 - protein, 10 aa, Staphylococcus aureus
ENGPKRDEYI

SEQ ID NO: 1636417 - protein, 20 aa, Staphylococcus aureus
ENGQLNPTHSNDVCDIWLFK

SEQ ID NO: 1636418 - protein, 7 aa, Staphylococcus aureus
ENGSGTE

SEQ ID NO: 1636419 - protein, 5 aa, Staphylococcus aureus
ENGSI

SEQ ID NO: 1636420 - protein, 8 aa, Staphylococcus aureus
ENHNHSDA

SEQ ID NO: 1636421 - protein, 6 aa, Staphylococcus aureus
ENIAPQ

SEQ ID NO: 1636422 - protein, 9 aa, Staphylococcus aureus
ENIHPNNRQ

SEQ ID NO: 1636423 - protein, 10 aa, Staphylococcus aureus
ENIKNGSVHS

SEQ ID NO: 1636424 - protein, 4 aa, Staphylococcus aureus
ENIP

SEQ ID NO: 1636425 - protein, 19 aa, Staphylococcus aureus
ENIQGAKDYHEGKTDHISG

SEQ ID NO: 1636426 - protein, 9 aa, Staphylococcus aureus
ENKAERNEK

SEQ ID NO: 1636427 - protein, 19 aa, Staphylococcus aureus
ENKDNNYSFYNSEKSVYDN

SEQ ID NO: 1636428 - protein, 16 aa, Staphylococcus aureus
ENKEFSDRANEELKKY

SEQ ID NO: 1636429 - protein, 19 aa, Staphylococcus aureus
ENKEISSYQINKDTGISYG

SEQ ID NO: 1636430 - protein, 7 aa, Staphylococcus aureus
ENKKDDF

SEQ ID NO: 1636431 - protein, 4 aa, Staphylococcus aureus
ENKL

SEQ ID NO: 1636432 - protein, 9 aa, Staphylococcus aureus
ENKNKINKP

SEQ ID NO: 1636433 - protein, 7 aa, Staphylococcus aureus
ENKSENI

SEQ ID NO: 1636434 - protein, 13 aa, Staphylococcus aureus
ENKSLKSKISDLK

SEQ ID NO: 1636435 - protein, 9 aa, Staphylococcus aureus
ENKSSTREI

SEQ ID NO: 1636436 - protein, 9 aa, Staphylococcus aureus
ENKVDDQEL

SEQ ID NO: 1636437 - protein, 6 aa, Staphylococcus aureus
ENLEEA

SEQ ID NO: 1636438 - protein, 7 aa, Staphylococcus aureus
ENLERQK

SEQ ID NO: 1636439 - protein, 29 aa, Staphylococcus aureus
ENLGKKAGDFGSKAKNTAHNIKKGAEEMV

SEQ ID NO: 1636440 - protein, 30 aa, Staphylococcus aureus
ENLGKKAGGFGSKAKNTAHNIKKGAEEMVE

SEQ ID NO: 1636441 - protein, 10 aa, Staphylococcus aureus
ENLSDKGNYD

SEQ ID NO: 1636442 - protein, 11 aa, Staphylococcus aureus
ENLSTSYNAAK

SEQ ID NO: 1636443 - protein, 9 aa, Staphylococcus aureus
ENNDLKEKI

SEQ ID NO: 1636444 - protein, 13 aa, Staphylococcus aureus
ENNEKEEKVRVFI

SEQ ID NO: 1636445 - protein, 6 aa, Staphylococcus aureus
ENNEKL

SEQ ID NO: 1636446 - protein, 8 aa, Staphylococcus aureus
ENNGNINA

SEQ ID NO: 1636447 - protein, 10 aa, Staphylococcus aureus
ENNGQHPSTQ

SEQ ID NO: 1636448 - protein, 8 aa, Staphylococcus aureus
ENNKTEND

SEQ ID NO: 1636449 - protein, 8 aa, Staphylococcus aureus
ENNPKGSV

SEQ ID NO: 1636450 - protein, 6 aa, Staphylococcus aureus
ENNPQA

SEQ ID NO: 1636451 - protein, 8 aa, Staphylococcus aureus
ENNPTSRQ

SEQ ID NO: 1636452 - protein, 8 aa, Staphylococcus aureus
ENNQEDGC

SEQ ID NO: 1636453 - protein, 8 aa, Staphylococcus aureus
ENPAAENV

SEQ ID NO: 1636454 - protein, 8 aa, Staphylococcus aureus
ENPELSQG

SEQ ID NO: 1636455 - protein, 4 aa, Staphylococcus aureus
ENPM

SEQ ID NO: 1636456 - protein, 7 aa, Staphylococcus aureus
ENPMDGY

SEQ ID NO: 1636457 - protein, 6 aa, Staphylococcus aureus
ENPQKV

SEQ ID NO: 1636458 - protein, 6 aa, Staphylococcus aureus
ENPVSK

SEQ ID NO: 1636459 - protein, 7 aa, Staphylococcus aureus
ENQEGVF

SEQ ID NO: 1636460 - protein, 6 aa, Staphylococcus aureus
ENQLKQ

SEQ ID NO: 1636461 - protein, 6 aa, Staphylococcus aureus
ENQSVG

SEQ ID NO: 1636462 - protein, 7 aa, Staphylococcus aureus
ENRDATG

SEQ ID NO: 1636463 - protein, 27 aa, Staphylococcus aureus
ENRDKPSEQDSAKDNSVDDQQLEQDRQ

SEQ ID NO: 1636464 - protein, 13 aa, Staphylococcus aureus
ENRKKHKQPSTLN

SEQ ID NO: 1636465 - protein, 12 aa, Staphylococcus aureus
ENSDNDNLNKKS

SEQ ID NO: 1636466 - protein, 8 aa, Staphylococcus aureus
ENSHDKHT

SEQ ID NO: 1636467 - protein, 9 aa, Staphylococcus aureus
ENSKKIAEK

SEQ ID NO: 1636468 - protein, 5 aa, Staphylococcus aureus
ENSNA

SEQ ID NO: 1636469 - protein, 4 aa, Staphylococcus aureus
ENTK

SEQ ID NO: 1636470 - protein, 6 aa, Staphylococcus aureus
ENTQMQ

SEQ ID NO: 1636471 - protein, 16 aa, Staphylococcus aureus
ENTVKQITNTNVAPYS

SEQ ID NO: 1636472 - protein, 12 aa, Staphylococcus aureus
ENVDGRSGAIYK

SEQ ID NO: 1636473 - protein, 7 aa, Staphylococcus aureus
ENVNSSA

SEQ ID NO: 1636474 - protein, 6 aa, Staphylococcus aureus
ENVPTW

SEQ ID NO: 1636475 - protein, 4 aa, Staphylococcus aureus
ENVR

SEQ ID NO: 1636476 - protein, 4 aa, Staphylococcus aureus
ENVT

SEQ ID NO: 1636477 - protein, 9 aa, Staphylococcus aureus
ENYESEMSV

SEQ ID NO: 1636478 - protein, 11 aa, Staphylococcus aureus
ENYPITAKKSP

SEQ ID NO: 1636479 - protein, 21 aa, Staphylococcus aureus
ENYSKDGKTLGRPKRDDKNLR

SEQ ID NO: 1636480 - protein, 13 aa, Staphylococcus aureus
ENYSRSTAKQTRQ

SEQ ID NO: 1636481 - protein, 7 aa, Staphylococcus aureus
EPATTGD

SEQ ID NO: 1636482 - protein, 8 aa, Staphylococcus aureus
EPATTGGV

SEQ ID NO: 1636483 - protein, 4 aa, Staphylococcus aureus
EPDQ

SEQ ID NO: 1636484 - protein, 23 aa, Staphylococcus aureus
EPEGSVLNEGPAHAHDTEGIGSE

SEQ ID NO: 1636485 - protein, 13 aa, Staphylococcus aureus
EPEHGSDVAGGLE

SEQ ID NO: 1636486 - protein, 4 aa, Staphylococcus aureus
EPER

SEQ ID NO: 1636487 - protein, 5 aa, Staphylococcus aureus
EPFEP

SEQ ID NO: 1636488 - protein, 6 aa, Staphylococcus aureus
EPFKDG

SEQ ID NO: 1636489 - protein, 29 aa, Staphylococcus aureus
EPFKDGKVTDQETMNKELQSRLKKSLKQS

SEQ ID NO: 1636490 - protein, 19 aa, Staphylococcus aureus
EPIESGKNYKSYEKVKLKA

SEQ ID NO: 1636491 - protein, 5 aa, Staphylococcus aureus
EPIRT

SEQ ID NO: 1636492 - protein, 13 aa, Staphylococcus aureus
EPKDVSDSRKSRW

SEQ ID NO: 1636493 - protein, 10 aa, Staphylococcus aureus
EPKGKDMETR

SEQ ID NO: 1636494 - protein, 35 aa, Staphylococcus aureus
EPKNNNKQNNQQHNGQTQTGNNPFDNTEEDFSDLP

SEQ ID NO: 1636495 - protein, 37 aa, Staphylococcus aureus
EPKNNNQQPNNNYHQQGQTQTGNNPFDNTEEDFSDLP

SEQ ID NO: 1636496 - protein, 37 aa, Staphylococcus aureus
EPKNNNQQPNNNYQQQGQTQSGNNPFDNNADSIEDLP

SEQ ID NO: 1636497 - protein, 38 aa, Staphylococcus aureus
EPKNNNQQPSNNYHQQRQTQTGNNPFDNTTAITDDDLP

SEQ ID NO: 1636498 - protein, 8 aa, Staphylococcus aureus
EPMKGTEK

SEQ ID NO: 1636499 - protein, 7 aa, Staphylococcus aureus
EPNNRSY

SEQ ID NO: 1636500 - protein, 16 aa, Staphylococcus aureus
EPPTNSIEANLSEKEE

SEQ ID NO: 1636501 - protein, 5 aa, Staphylococcus aureus
EPQEK

SEQ ID NO: 1636502 - protein, 4 aa, Staphylococcus aureus
EPQF

SEQ ID NO: 1636503 - protein, 7 aa, Staphylococcus aureus
EPQPPEN

SEQ ID NO: 1636504 - protein, 9 aa, Staphylococcus aureus
EPSDAYPTI

SEQ ID NO: 1636505 - protein, 5 aa, Staphylococcus aureus
EPSDL

SEQ ID NO: 1636506 - protein, 17 aa, Staphylococcus aureus
EPSGKVKTKGGDVNNYH

SEQ ID NO: 1636507 - protein, 6 aa, Staphylococcus aureus
EPSGYN

SEQ ID NO: 1636508 - protein, 12 aa, Staphylococcus aureus
EPTPKETTPYKQ

SEQ ID NO: 1636509 - protein, 10 aa, Staphylococcus aureus
EPTSGLDPIA

SEQ ID NO: 1636510 - protein, 10 aa, Staphylococcus aureus
EPVPGPNAGL

SEQ ID NO: 1636511 - protein, 8 aa, Staphylococcus aureus
EPVTGEGA

SEQ ID NO: 1636512 - protein, 9 aa, Staphylococcus aureus
EPVTGEGAL

SEQ ID NO: 1636513 - protein, 8 aa, Staphylococcus aureus
EPYPISGA

SEQ ID NO: 1636514 - protein, 4 aa, Staphylococcus aureus
EPYS

SEQ ID NO: 1636515 - protein, 6 aa, Staphylococcus aureus
EQADYI

SEQ ID NO: 1636516 - protein, 10 aa, Staphylococcus aureus
EQAGKSLKDK

SEQ ID NO: 1636517 - protein, 8 aa, Staphylococcus aureus
EQAKNGGA

SEQ ID NO: 1636518 - protein, 4 aa, Staphylococcus aureus
EQAQ

SEQ ID NO: 1636519 - protein, 11 aa, Staphylococcus aureus
EQATTNMPNIN

SEQ ID NO: 1636520 - protein, 5 aa, Staphylococcus aureus
EQDER

SEQ ID NO: 1636521 - protein, 11 aa, Staphylococcus aureus
EQDNKSNPATR

SEQ ID NO: 1636522 - protein, 7 aa, Staphylococcus aureus
EQDRDPK

SEQ ID NO: 1636523 - protein, 19 aa, Staphylococcus aureus
EQEASEKQENALSDYYSFK

SEQ ID NO: 1636524 - protein, 5 aa, Staphylococcus aureus
EQEKI

SEQ ID NO: 1636525 - protein, 5 aa, Staphylococcus aureus
EQEKL

SEQ ID NO: 1636526 - protein, 7 aa, Staphylococcus aureus
EQEKQQA

SEQ ID NO: 1636527 - protein, 16 aa, Staphylococcus aureus
EQERNENKRRQAQGIK

SEQ ID NO: 1636528 - protein, 16 aa, Staphylococcus aureus
EQERNESKRRQAQGIK

SEQ ID NO: 1636529 - protein, 4 aa, Staphylococcus aureus
EQGF

SEQ ID NO: 1636530 - protein, 4 aa, Staphylococcus aureus
EQGQ

SEQ ID NO: 1636531 - protein, 5 aa, Staphylococcus aureus
EQGTS

SEQ ID NO: 1636532 - protein, 8 aa, Staphylococcus aureus
EQGYRSID

SEQ ID NO: 1636533 - protein, 28 aa, Staphylococcus aureus
EQHKFKDVKGKPSRYKMTGSSKDKGHKG

SEQ ID NO: 1636534 - protein, 4 aa, Staphylococcus aureus
EQHP

SEQ ID NO: 1636535 - protein, 15 aa, Staphylococcus aureus
EQISEAKKSLGIQEG

SEQ ID NO: 1636536 - protein, 4 aa, Staphylococcus aureus
EQKE

SEQ ID NO: 1636537 - protein, 4 aa, Staphylococcus aureus
EQKI

SEQ ID NO: 1636538 - protein, 8 aa, Staphylococcus aureus
EQKIKRDK

SEQ ID NO: 1636539 - protein, 14 aa, Staphylococcus aureus
EQKLKDADTLKSSD

SEQ ID NO: 1636540 - protein, 9 aa, Staphylococcus aureus
EQKNQKTQY

SEQ ID NO: 1636541 - protein, 10 aa, Staphylococcus aureus
EQKTGIKPDI

SEQ ID NO: 1636542 - protein, 6 aa, Staphylococcus aureus
EQLGNH

SEQ ID NO: 1636543 - protein, 7 aa, Staphylococcus aureus
EQLRGTA

SEQ ID NO: 1636544 - protein, 18 aa, Staphylococcus aureus
EQLRSEKQLNEMRSEARE

SEQ ID NO: 1636545 - protein, 10 aa, Staphylococcus aureus
EQMDEDTKVF

SEQ ID NO: 1636546 - protein, 7 aa, Staphylococcus aureus
EQMPEDT

SEQ ID NO: 1636547 - protein, 6 aa, Staphylococcus aureus
EQNANT

SEQ ID NO: 1636548 - protein, 8 aa, Staphylococcus aureus
EQNHDDNG

SEQ ID NO: 1636549 - protein, 6 aa, Staphylococcus aureus
EQNPDV

SEQ ID NO: 1636550 - protein, 5 aa, Staphylococcus aureus
EQPAV

SEQ ID NO: 1636551 - protein, 8 aa, Staphylococcus aureus
EQPKSERL

SEQ ID NO: 1636552 - protein, 13 aa, Staphylococcus aureus
EQPSWNPKDFAPS

SEQ ID NO: 1636553 - protein, 17 aa, Staphylococcus aureus
EQQEKRKRNEKETKNYQ

SEQ ID NO: 1636554 - protein, 5 aa, Staphylococcus aureus
EQQER

SEQ ID NO: 1636555 - protein, 5 aa, Staphylococcus aureus
EQQKI

SEQ ID NO: 1636556 - protein, 7 aa, Staphylococcus aureus
EQQPITT

SEQ ID NO: 1636557 - protein, 4 aa, Staphylococcus aureus
EQQR

SEQ ID NO: 1636558 - protein, 18 aa, Staphylococcus aureus
EQQVNGKQTPMSQQSNPF

SEQ ID NO: 1636559 - protein, 10 aa, Staphylococcus aureus
EQRAAELDKM

SEQ ID NO: 1636560 - protein, 24 aa, Staphylococcus aureus
EQRQNTEDNQEKTFSSEESNRKPF

SEQ ID NO: 1636561 - protein, 32 aa, Staphylococcus aureus
EQRQNTENKQERTFSSEESNSKPFMAENQNDE

SEQ ID NO: 1636562 - protein, 32 aa, Staphylococcus aureus
EQRQSTENNQEKTFSSEESNSKPFMEENQNDE

SEQ ID NO: 1636563 - protein, 5 aa, Staphylococcus aureus
EQSAE

SEQ ID NO: 1636564 - protein, 7 aa, Staphylococcus aureus
EQSDVNN

SEQ ID NO: 1636565 - protein, 10 aa, Staphylococcus aureus
EQTGISRNSI

SEQ ID NO: 1636566 - protein, 13 aa, Staphylococcus aureus
EQVDGKSDKPSMT

SEQ ID NO: 1636567 - protein, 6 aa, Staphylococcus aureus
EQVNQG

SEQ ID NO: 1636568 - protein, 8 aa, Staphylococcus aureus
ERAANAPI

SEQ ID NO: 1636569 - protein, 21 aa, Staphylococcus aureus
ERANKKGLRIAGEESDLNDLK

SEQ ID NO: 1636570 - protein, 20 aa, Staphylococcus aureus
ERANKKGLRIAGENSDLNDL

SEQ ID NO: 1636571 - protein, 21 aa, Staphylococcus aureus
ERANKKGLRIAGTDSDLNDLK

SEQ ID NO: 1636572 - protein, 9 aa, Staphylococcus aureus
ERDASSIEP

SEQ ID NO: 1636573 - protein, 9 aa, Staphylococcus aureus
ERDNQPDTD

SEQ ID NO: 1636574 - protein, 13 aa, Staphylococcus aureus
ERDSQKRNCHWKR

SEQ ID NO: 1636575 - protein, 12 aa, Staphylococcus aureus
EREESTKQDTIA

SEQ ID NO: 1636576 - protein, 4 aa, Staphylococcus aureus
EREG

SEQ ID NO: 1636577 - protein, 7 aa, Staphylococcus aureus
ERELSRD

SEQ ID NO: 1636578 - protein, 19 aa, Staphylococcus aureus
EREREMARQRRKEAELRRK

SEQ ID NO: 1636579 - protein, 22 aa, Staphylococcus aureus
ERESKECEMARQRRKEAELRRK

SEQ ID NO: 1636580 - protein, 22 aa, Staphylococcus aureus
ERESKERAMARQRRKEAELRRK

SEQ ID NO: 1636581 - protein, 22 aa, Staphylococcus aureus
ERESKEREIARQRRKEAELRRK

SEQ ID NO: 1636582 - protein, 23 aa, Staphylococcus aureus
ERESKEREMARQRRKEAELRKKK

SEQ ID NO: 1636583 - protein, 23 aa, Staphylococcus aureus
ERESKEREMSRQRRKEAELRKKK

SEQ ID NO: 1636584 - protein, 6 aa, Staphylococcus aureus
ERFEEA

SEQ ID NO: 1636585 - protein, 9 aa, Staphylococcus aureus
ERGNVSTGY

SEQ ID NO: 1636586 - protein, 11 aa, Staphylococcus aureus
ERGQHKNAPNK

SEQ ID NO: 1636587 - protein, 7 aa, Staphylococcus aureus
ERGSGVD

SEQ ID NO: 1636588 - protein, 6 aa, Staphylococcus aureus
ERHKSG

SEQ ID NO: 1636589 - protein, 5 aa, Staphylococcus aureus
ERHNI

SEQ ID NO: 1636590 - protein, 9 aa, Staphylococcus aureus
ERHQREKEL

SEQ ID NO: 1636591 - protein, 4 aa, Staphylococcus aureus
ERIA

SEQ ID NO: 1636592 - protein, 10 aa, Staphylococcus aureus
ERIGDNAASI

SEQ ID NO: 1636593 - protein, 5 aa, Staphylococcus aureus
ERIQQ

SEQ ID NO: 1636594 - protein, 7 aa, Staphylococcus aureus
ERITRTG

SEQ ID NO: 1636595 - protein, 26 aa, Staphylococcus aureus
ERKAEQAVLSDDEVKTITEYREKYNN

SEQ ID NO: 1636596 - protein, 12 aa, Staphylococcus aureus
ERKAKSPLLFGS

SEQ ID NO: 1636597 - protein, 7 aa, Staphylococcus aureus
ERKEYGH

SEQ ID NO: 1636598 - protein, 14 aa, Staphylococcus aureus
ERKGKYRVENNTEM

SEQ ID NO: 1636599 - protein, 16 aa, Staphylococcus aureus
ERKGRDKKQVSVYTVA

SEQ ID NO: 1636600 - protein, 7 aa, Staphylococcus aureus
ERKHESK

SEQ ID NO: 1636601 - protein, 8 aa, Staphylococcus aureus
ERKKNKEI

SEQ ID NO: 1636602 - protein, 18 aa, Staphylococcus aureus
ERKPITKTFNTKSEARKW

SEQ ID NO: 1636603 - protein, 8 aa, Staphylococcus aureus
ERKSNSQY

SEQ ID NO: 1636604 - protein, 14 aa, Staphylococcus aureus
ERKSSSNYYEGGNE

SEQ ID NO: 1636605 - protein, 7 aa, Staphylococcus aureus
ERKTQKG

SEQ ID NO: 1636606 - protein, 14 aa, Staphylococcus aureus
ERKVKTEKKVDKAI

SEQ ID NO: 1636607 - protein, 13 aa, Staphylococcus aureus
ERKVKTEQKVSKA

SEQ ID NO: 1636608 - protein, 4 aa, Staphylococcus aureus
ERLA

SEQ ID NO: 1636609 - protein, 6 aa, Staphylococcus aureus
ERLDDS

SEQ ID NO: 1636610 - protein, 6 aa, Staphylococcus aureus
ERLKRQ

SEQ ID NO: 1636611 - protein, 4 aa, Staphylococcus aureus
ERLY

SEQ ID NO: 1636612 - protein, 10 aa, Staphylococcus aureus
ERNGEGKSSL

SEQ ID NO: 1636613 - protein, 21 aa, Staphylococcus aureus
ERNTKAEDEPNILNSEKPEEN

SEQ ID NO: 1636614 - protein, 5 aa, Staphylococcus aureus
ERPID

SEQ ID NO: 1636615 - protein, 10 aa, Staphylococcus aureus
ERPQRDENGD

SEQ ID NO: 1636616 - protein, 5 aa, Staphylococcus aureus
ERQGM

SEQ ID NO: 1636617 - protein, 13 aa, Staphylococcus aureus
ERQKIDENASEKN

SEQ ID NO: 1636618 - protein, 8 aa, Staphylococcus aureus
ERQNNYPV

SEQ ID NO: 1636619 - protein, 4 aa, Staphylococcus aureus
ERQY

SEQ ID NO: 1636620 - protein, 14 aa, Staphylococcus aureus
ERSIDKASSEMKTF

SEQ ID NO: 1636621 - protein, 6 aa, Staphylococcus aureus
ERSNYN

SEQ ID NO: 1636622 - protein, 19 aa, Staphylococcus aureus
ERTGQSIEKIQKDTDRDNF

SEQ ID NO: 1636623 - protein, 6 aa, Staphylococcus aureus
ERTIDV

SEQ ID NO: 1636624 - protein, 5 aa, Staphylococcus aureus
ERTIT

SEQ ID NO: 1636625 - protein, 13 aa, Staphylococcus aureus
ERTPRGRKATPLA

SEQ ID NO: 1636626 - protein, 6 aa, Staphylococcus aureus
ERVGPF

SEQ ID NO: 1636627 - protein, 5 aa, Staphylococcus aureus
ERYEV

SEQ ID NO: 1636628 - protein, 13 aa, Staphylococcus aureus
ESACENDEVLEYF

SEQ ID NO: 1636629 - protein, 8 aa, Staphylococcus aureus
ESADIEPN

SEQ ID NO: 1636630 - protein, 6 aa, Staphylococcus aureus
ESAKSA

SEQ ID NO: 1636631 - protein, 22 aa, Staphylococcus aureus
ESDNIGEQVKNGIKEKAKQGKM

SEQ ID NO: 1636632 - protein, 23 aa, Staphylococcus aureus
ESDNIGEQVKNGIKEKAKQGKMI

SEQ ID NO: 1636633 - protein, 22 aa, Staphylococcus aureus
ESDNIGEQVKNGIKEKARQGKL

SEQ ID NO: 1636634 - protein, 7 aa, Staphylococcus aureus
ESDPMGG

SEQ ID NO: 1636635 - protein, 15 aa, Staphylococcus aureus
ESDSSLRSEDKSGDM

SEQ ID NO: 1636636 - protein, 6 aa, Staphylococcus aureus
ESDVID

SEQ ID NO: 1636637 - protein, 11 aa, Staphylococcus aureus
ESEAPGFEKGE

SEQ ID NO: 1636638 - protein, 7 aa, Staphylococcus aureus
ESEEAMS

SEQ ID NO: 1636639 - protein, 12 aa, Staphylococcus aureus
ESEETDEDGRIE

SEQ ID NO: 1636640 - protein, 16 aa, Staphylococcus aureus
ESEFRKEKGTGQSIGH

SEQ ID NO: 1636641 - protein, 14 aa, Staphylococcus aureus
ESENEDIRTSTADS

SEQ ID NO: 1636642 - protein, 9 aa, Staphylococcus aureus
ESENPYDEK

SEQ ID NO: 1636643 - protein, 12 aa, Staphylococcus aureus
ESESDVLNDSES

SEQ ID NO: 1636644 - protein, 118 aa, Staphylococcus aureus
ESESESLAESESLSESEALSESESLSESESLSDSESLSESESLSESEALSESESLSESESLSESKSLSESESLSESESLSESESLSESESLSESKSLSESESLSESESLSESESLSES

SEQ ID NO: 1636645 - protein, 150 aa, Staphylococcus aureus
ESESESLAESESLSESEALSESESLSESESLSDSESLSESESLSESEALSESESLSESESLSESKSLSESESLSESESLSESESLSESESLSESKSLSESESLSESESLSESESLSESESLSDSESLSESESLSESESLSESESLSESES

SEQ ID NO: 1636646 - protein, 223 aa, Staphylococcus aureus
ESESESLAESESLSESEALSESESLSESESLSDSESLSESESLSESEALSESESLSESESLSESKSLSESESLSESESLSESESLSESESLSESKSLSESESLSESESLSESESLSESESLSDSESLSESESLSESESLSESESLSESESLSESESLSESESLSESESLSESESLSESDSLSESESLSESESLSESDSLSESESLSESETLSESLSESESLSE

SEQ ID NO: 1636647 - protein, 109 aa, Staphylococcus aureus
ESESLSDSESLSESESLSESESLSDSESLSDSESLSESESLSESESLSDSESLSEPESLSEPESLSESESGSGSGLGSGSGSGLGSGSGVGSGSGSGLGSGSTGGPGVG

SEQ ID NO: 1636648 - protein, 78 aa, Staphylococcus aureus
ESESLSESESLSESESLSESESLSESESLSESESLSESESLSESESLSESESLSESLSESESLSDVSSSKYPLSSVKS

SEQ ID NO: 1636649 - protein, 5 aa, Staphylococcus aureus
ESEVP

SEQ ID NO: 1636650 - protein, 15 aa, Staphylococcus aureus
ESEVRDTKLGPEEIT

SEQ ID NO: 1636651 - protein, 18 aa, Staphylococcus aureus
ESEWGRGANATKQKNPLS

SEQ ID NO: 1636652 - protein, 8 aa, Staphylococcus aureus
ESFDGDTK

SEQ ID NO: 1636653 - protein, 4 aa, Staphylococcus aureus
ESFT

SEQ ID NO: 1636654 - protein, 16 aa, Staphylococcus aureus
ESGISNALNENKGTID

SEQ ID NO: 1636655 - protein, 4 aa, Staphylococcus aureus
ESGL

SEQ ID NO: 1636656 - protein, 8 aa, Staphylococcus aureus
ESGQQHVE

SEQ ID NO: 1636657 - protein, 8 aa, Staphylococcus aureus
ESGRWGAY

SEQ ID NO: 1636658 - protein, 4 aa, Staphylococcus aureus
ESGV

SEQ ID NO: 1636659 - protein, 5 aa, Staphylococcus aureus
ESHER

SEQ ID NO: 1636660 - protein, 8 aa, Staphylococcus aureus
ESHQEHFT

SEQ ID NO: 1636661 - protein, 8 aa, Staphylococcus aureus
ESHSEGGF

SEQ ID NO: 1636662 - protein, 14 aa, Staphylococcus aureus
ESIDPKSVMGSGSL

SEQ ID NO: 1636663 - protein, 7 aa, Staphylococcus aureus
ESIEDSK

SEQ ID NO: 1636664 - protein, 9 aa, Staphylococcus aureus
ESIGKPLPN

SEQ ID NO: 1636665 - protein, 33 aa, Staphylococcus aureus
ESIKDQPQTEASSKFINEDQAQKDAYTQAVQHA

SEQ ID NO: 1636666 - protein, 17 aa, Staphylococcus aureus
ESISTANYDAKEASKKR

SEQ ID NO: 1636667 - protein, 17 aa, Staphylococcus aureus
ESISTANYDKKEASKKR

SEQ ID NO: 1636668 - protein, 30 aa, Staphylococcus aureus
ESITNEVNAAKQALNGNDNLANAKQQVKQQ

SEQ ID NO: 1636669 - protein, 11 aa, Staphylococcus aureus
ESKKKPPGITK

SEQ ID NO: 1636670 - protein, 33 aa, Staphylococcus aureus
ESKRIDDKERDKFNQHQETIAGHANKDEFTPEE

SEQ ID NO: 1636671 - protein, 9 aa, Staphylococcus aureus
ESKSIDPRI

SEQ ID NO: 1636672 - protein, 7 aa, Staphylococcus aureus
ESKYHDR

SEQ ID NO: 1636673 - protein, 8 aa, Staphylococcus aureus
ESKYSKKY

SEQ ID NO: 1636674 - protein, 4 aa, Staphylococcus aureus
ESLA

SEQ ID NO: 1636675 - protein, 4 aa, Staphylococcus aureus
ESLD

SEQ ID NO: 1636676 - protein, 6 aa, Staphylococcus aureus
ESLKSR

SEQ ID NO: 1636677 - protein, 13 aa, Staphylococcus aureus
ESLNDVDDESDSL

SEQ ID NO: 1636678 - protein, 43 aa, Staphylococcus aureus
ESLPESEPGSESESSGIGSISPGSSGCSGTTGLSIPSPEPDPL

SEQ ID NO: 1636679 - protein, 44 aa, Staphylococcus aureus
ESLPESEPGSESESSGIGSISPGSSGCSGTTGLSIPSPEPDPLL

SEQ ID NO: 1636680 - protein, 7 aa, Staphylococcus aureus
ESLRKVK

SEQ ID NO: 1636681 - protein, 4 aa, Staphylococcus aureus
ESMY

SEQ ID NO: 1636682 - protein, 9 aa, Staphylococcus aureus
ESNTSGYLS

SEQ ID NO: 1636683 - protein, 5 aa, Staphylococcus aureus
ESNYK

SEQ ID NO: 1636684 - protein, 5 aa, Staphylococcus aureus
ESPYS

SEQ ID NO: 1636685 - protein, 25 aa, Staphylococcus aureus
ESQIRDYESKSKKVKEKAKSYIKEY

SEQ ID NO: 1636686 - protein, 7 aa, Staphylococcus aureus
ESREEVA

SEQ ID NO: 1636687 - protein, 6 aa, Staphylococcus aureus
ESRGIK

SEQ ID NO: 1636688 - protein, 9 aa, Staphylococcus aureus
ESRLTEDEN

SEQ ID NO: 1636689 - protein, 19 aa, Staphylococcus aureus
ESRLTEDENVRLKPYFDVL

SEQ ID NO: 1636690 - protein, 9 aa, Staphylococcus aureus
ESSGAKATI

SEQ ID NO: 1636691 - protein, 9 aa, Staphylococcus aureus
ESSNHQKTI

SEQ ID NO: 1636692 - protein, 6 aa, Staphylococcus aureus
ESSNMY

SEQ ID NO: 1636693 - protein, 6 aa, Staphylococcus aureus
ESTDDI

SEQ ID NO: 1636694 - protein, 7 aa, Staphylococcus aureus
ESTDMDK

SEQ ID NO: 1636695 - protein, 5 aa, Staphylococcus aureus
ESTGK

SEQ ID NO: 1636696 - protein, 10 aa, Staphylococcus aureus
ESTHENSKHH

SEQ ID NO: 1636697 - protein, 9 aa, Staphylococcus aureus
ESTNGIKDD

SEQ ID NO: 1636698 - protein, 9 aa, Staphylococcus aureus
ESTSSTLEK

SEQ ID NO: 1636699 - protein, 13 aa, Staphylococcus aureus
ESVPQDDTQATFA

SEQ ID NO: 1636700 - protein, 5 aa, Staphylococcus aureus
ESVYE

SEQ ID NO: 1636701 - protein, 16 aa, Staphylococcus aureus
ESYDDCKKSCKTYDGW

SEQ ID NO: 1636702 - protein, 6 aa, Staphylococcus aureus
ESYQIT

SEQ ID NO: 1636703 - protein, 8 aa, Staphylococcus aureus
ESYYDPSK

SEQ ID NO: 1636704 - protein, 16 aa, Staphylococcus aureus
ESYYDPSKKITKGMKN

SEQ ID NO: 1636705 - protein, 20 aa, Staphylococcus aureus
ETAEELDQNSGQTPGIPTGY

SEQ ID NO: 1636706 - protein, 16 aa, Staphylococcus aureus
ETAPQAKQQATKGYGT

SEQ ID NO: 1636707 - protein, 7 aa, Staphylococcus aureus
ETATKTY

SEQ ID NO: 1636708 - protein, 10 aa, Staphylococcus aureus
ETAVDDETAA

SEQ ID NO: 1636709 - protein, 4 aa, Staphylococcus aureus
ETDA

SEQ ID NO: 1636710 - protein, 9 aa, Staphylococcus aureus
ETDARTAEM

SEQ ID NO: 1636711 - protein, 6 aa, Staphylococcus aureus
ETDGTS

SEQ ID NO: 1636712 - protein, 20 aa, Staphylococcus aureus
ETEDGSKINPTLSMTDGGYE

SEQ ID NO: 1636713 - protein, 20 aa, Staphylococcus aureus
ETEDGSKINPTLSMTEGGYE

SEQ ID NO: 1636714 - protein, 7 aa, Staphylococcus aureus
ETEENAV

SEQ ID NO: 1636715 - protein, 10 aa, Staphylococcus aureus
ETEESWDPNH

SEQ ID NO: 1636716 - protein, 8 aa, Staphylococcus aureus
ETESTPII

SEQ ID NO: 1636717 - protein, 13 aa, Staphylococcus aureus
ETETRRNGQPTEE

SEQ ID NO: 1636718 - protein, 7 aa, Staphylococcus aureus
ETFNNDY

SEQ ID NO: 1636719 - protein, 4 aa, Staphylococcus aureus
ETGH

SEQ ID NO: 1636720 - protein, 16 aa, Staphylococcus aureus
ETGNGTSQLAKGADVV

SEQ ID NO: 1636721 - protein, 6 aa, Staphylococcus aureus
ETGQHN

SEQ ID NO: 1636722 - protein, 12 aa, Staphylococcus aureus
ETGQLGEVPSNL

SEQ ID NO: 1636723 - protein, 11 aa, Staphylococcus aureus
ETGQLGEVSSN

SEQ ID NO: 1636724 - protein, 9 aa, Staphylococcus aureus
ETGTYTHTE

SEQ ID NO: 1636725 - protein, 21 aa, Staphylococcus aureus
ETGVTFEENAKLKSEAAAKAL

SEQ ID NO: 1636726 - protein, 16 aa, Staphylococcus aureus
ETGYPRNDKLSHKRND

SEQ ID NO: 1636727 - protein, 13 aa, Staphylococcus aureus
ETHANNKKRNELN

SEQ ID NO: 1636728 - protein, 6 aa, Staphylococcus aureus
ETHDDV

SEQ ID NO: 1636729 - protein, 12 aa, Staphylococcus aureus
ETHNDRKKALAE

SEQ ID NO: 1636730 - protein, 6 aa, Staphylococcus aureus
ETHRTA

SEQ ID NO: 1636731 - protein, 4 aa, Staphylococcus aureus
ETIA

SEQ ID NO: 1636732 - protein, 11 aa, Staphylococcus aureus
ETIDKYSYSAT

SEQ ID NO: 1636733 - protein, 7 aa, Staphylococcus aureus
ETINNSE

SEQ ID NO: 1636734 - protein, 4 aa, Staphylococcus aureus
ETIY

SEQ ID NO: 1636735 - protein, 7 aa, Staphylococcus aureus
ETKGSDA

SEQ ID NO: 1636736 - protein, 8 aa, Staphylococcus aureus
ETKKIYSQ

SEQ ID NO: 1636737 - protein, 8 aa, Staphylococcus aureus
ETKPNKDE

SEQ ID NO: 1636738 - protein, 4 aa, Staphylococcus aureus
ETKR

SEQ ID NO: 1636739 - protein, 9 aa, Staphylococcus aureus
ETKRKSVIN

SEQ ID NO: 1636740 - protein, 6 aa, Staphylococcus aureus
ETKSIA

SEQ ID NO: 1636741 - protein, 15 aa, Staphylococcus aureus
ETKTLEANEKKIDGN

SEQ ID NO: 1636742 - protein, 7 aa, Staphylococcus aureus
ETKVKKG

SEQ ID NO: 1636743 - protein, 8 aa, Staphylococcus aureus
ETLKESKP

SEQ ID NO: 1636744 - protein, 49 aa, Staphylococcus aureus
ETLNTTAKQYIADNADKFKGERGERGEKGEAGERGAQGIAGTSADITDA

SEQ ID NO: 1636745 - protein, 4 aa, Staphylococcus aureus
ETME

SEQ ID NO: 1636746 - protein, 5 aa, Staphylococcus aureus
ETNGQ

SEQ ID NO: 1636747 - protein, 5 aa, Staphylococcus aureus
ETNPE

SEQ ID NO: 1636748 - protein, 7 aa, Staphylococcus aureus
ETNQEAF

SEQ ID NO: 1636749 - protein, 5 aa, Staphylococcus aureus
ETPNM

SEQ ID NO: 1636750 - protein, 5 aa, Staphylococcus aureus
ETPSQ

SEQ ID NO: 1636751 - protein, 6 aa, Staphylococcus aureus
ETPTTY

SEQ ID NO: 1636752 - protein, 8 aa, Staphylococcus aureus
ETQPLQTK

SEQ ID NO: 1636753 - protein, 17 aa, Staphylococcus aureus
ETRDENTIKGGSLKTDS

SEQ ID NO: 1636754 - protein, 10 aa, Staphylococcus aureus
ETRNADQADP

SEQ ID NO: 1636755 - protein, 10 aa, Staphylococcus aureus
ETSDNEITDK

SEQ ID NO: 1636756 - protein, 10 aa, Staphylococcus aureus
ETSINTEDSE

SEQ ID NO: 1636757 - protein, 4 aa, Staphylococcus aureus
ETSL

SEQ ID NO: 1636758 - protein, 18 aa, Staphylococcus aureus
ETSNDTLKKTEDKEKRYP

SEQ ID NO: 1636759 - protein, 8 aa, Staphylococcus aureus
ETSNNPEL

SEQ ID NO: 1636760 - protein, 5 aa, Staphylococcus aureus
ETSQT

SEQ ID NO: 1636761 - protein, 8 aa, Staphylococcus aureus
ETSTEGLN

SEQ ID NO: 1636762 - protein, 5 aa, Staphylococcus aureus
ETSTT

SEQ ID NO: 1636763 - protein, 5 aa, Staphylococcus aureus
ETSYR

SEQ ID NO: 1636764 - protein, 13 aa, Staphylococcus aureus
ETTDTLSQKDFEQ

SEQ ID NO: 1636765 - protein, 7 aa, Staphylococcus aureus
ETTGLSE

SEQ ID NO: 1636766 - protein, 6 aa, Staphylococcus aureus
ETTIQK

SEQ ID NO: 1636767 - protein, 10 aa, Staphylococcus aureus
ETTPITKTAT

SEQ ID NO: 1636768 - protein, 13 aa, Staphylococcus aureus
ETTYQQRICIQEV

SEQ ID NO: 1636769 - protein, 11 aa, Staphylococcus aureus
ETYKGALSNYQ

SEQ ID NO: 1636770 - protein, 9 aa, Staphylococcus aureus
EVAGNQNNI

SEQ ID NO: 1636771 - protein, 15 aa, Staphylococcus aureus
EVDEGTATIKTSTLH

SEQ ID NO: 1636772 - protein, 5 aa, Staphylococcus aureus
EVENA

SEQ ID NO: 1636773 - protein, 19 aa, Staphylococcus aureus
EVEREAQIARGEMPRYGGQ

SEQ ID NO: 1636774 - protein, 8 aa, Staphylococcus aureus
EVESNKGT

SEQ ID NO: 1636775 - protein, 12 aa, Staphylococcus aureus
EVETPNYKVNLH

SEQ ID NO: 1636776 - protein, 8 aa, Staphylococcus aureus
EVFDTNSA

SEQ ID NO: 1636777 - protein, 17 aa, Staphylococcus aureus
EVGKPLKINQNGKPQIL

SEQ ID NO: 1636778 - protein, 7 aa, Staphylococcus aureus
EVHENGK

SEQ ID NO: 1636779 - protein, 16 aa, Staphylococcus aureus
EVKDARVDNTGYDHKT

SEQ ID NO: 1636780 - protein, 9 aa, Staphylococcus aureus
EVKDDGRGI

SEQ ID NO: 1636781 - protein, 8 aa, Staphylococcus aureus
EVKGDENN

SEQ ID NO: 1636782 - protein, 4 aa, Staphylococcus aureus
EVNK

SEQ ID NO: 1636783 - protein, 8 aa, Staphylococcus aureus
EVPETLKD

SEQ ID NO: 1636784 - protein, 16 aa, Staphylococcus aureus
EVQGSDIENYVFTDSC

SEQ ID NO: 1636785 - protein, 10 aa, Staphylococcus aureus
EVQKNSEKIS

SEQ ID NO: 1636786 - protein, 4 aa, Staphylococcus aureus
EVQQ

SEQ ID NO: 1636787 - protein, 4 aa, Staphylococcus aureus
EVRE

SEQ ID NO: 1636788 - protein, 18 aa, Staphylococcus aureus
EVRGKKASKNKRPSQLSD

SEQ ID NO: 1636789 - protein, 8 aa, Staphylococcus aureus
EVSFSDTD

SEQ ID NO: 1636790 - protein, 45 aa, Staphylococcus aureus
EVSSSSSDLGDDEEDEEVEESSTEKASVEEESTDAKATYTTPRYE

SEQ ID NO: 1636791 - protein, 11 aa, Staphylococcus aureus
EVSYQSAAMTE

SEQ ID NO: 1636792 - protein, 8 aa, Staphylococcus aureus
EVTEETKV

SEQ ID NO: 1636793 - protein, 5 aa, Staphylococcus aureus
EVTES

SEQ ID NO: 1636794 - protein, 8 aa, Staphylococcus aureus
EVTPPDGL

SEQ ID NO: 1636795 - protein, 4 aa, Staphylococcus aureus
EVTS

SEQ ID NO: 1636796 - protein, 8 aa, Staphylococcus aureus
EVTTSKEL

SEQ ID NO: 1636797 - protein, 6 aa, Staphylococcus aureus
EVVEAT

SEQ ID NO: 1636798 - protein, 26 aa, Staphylococcus aureus
EVVEETKATGTDVTNKVEVEEGSEIV

SEQ ID NO: 1636799 - protein, 5 aa, Staphylococcus aureus
EWEEK

SEQ ID NO: 1636800 - protein, 17 aa, Staphylococcus aureus
EWNSNARATIDKNEKGI

SEQ ID NO: 1636801 - protein, 11 aa, Staphylococcus aureus
EYAERTESEAV

SEQ ID NO: 1636802 - protein, 12 aa, Staphylococcus aureus
EYAKRQGKSLAD

SEQ ID NO: 1636803 - protein, 5 aa, Staphylococcus aureus
EYAPT

SEQ ID NO: 1636804 - protein, 7 aa, Staphylococcus aureus
EYDPNPE

SEQ ID NO: 1636805 - protein, 4 aa, Staphylococcus aureus
EYEP

SEQ ID NO: 1636806 - protein, 12 aa, Staphylococcus aureus
EYFTNRDDTTLK

SEQ ID NO: 1636807 - protein, 10 aa, Staphylococcus aureus
EYGQSTLDDG

SEQ ID NO: 1636808 - protein, 37 aa, Staphylococcus aureus
EYHNRQKQLQYNTQLEQERKQRLTDTNKVSENAKEDL

SEQ ID NO: 1636809 - protein, 14 aa, Staphylococcus aureus
EYKDEISANPKYDK

SEQ ID NO: 1636810 - protein, 10 aa, Staphylococcus aureus
EYKDYYDKKV

SEQ ID NO: 1636811 - protein, 18 aa, Staphylococcus aureus
EYKEDLKKSYENQLDKLS

SEQ ID NO: 1636812 - protein, 16 aa, Staphylococcus aureus
EYKEDTIKETLTGQYD

SEQ ID NO: 1636813 - protein, 8 aa, Staphylococcus aureus
EYNEGTAT

SEQ ID NO: 1636814 - protein, 7 aa, Staphylococcus aureus
EYNNGGI

SEQ ID NO: 1636815 - protein, 7 aa, Staphylococcus aureus
EYPGKED

SEQ ID NO: 1636816 - protein, 9 aa, Staphylococcus aureus
EYQDNEQSL

SEQ ID NO: 1636817 - protein, 12 aa, Staphylococcus aureus
EYQKEIAEKNRH

SEQ ID NO: 1636818 - protein, 9 aa, Staphylococcus aureus
EYQSTDYKR

SEQ ID NO: 1636819 - protein, 7 aa, Staphylococcus aureus
EYSDTTA

SEQ ID NO: 1636820 - protein, 8 aa, Staphylococcus aureus
EYSEKHNL

SEQ ID NO: 1636821 - protein, 8 aa, Staphylococcus aureus
EYSEMEQD

SEQ ID NO: 1636822 - protein, 6 aa, Staphylococcus aureus
EYTEGV

SEQ ID NO: 1636823 - protein, 14 aa, Staphylococcus aureus
EYTKVYAGNIQVWK

SEQ ID NO: 1636824 - protein, 4 aa, Staphylococcus aureus
EYVQ

SEQ ID NO: 1636825 - protein, 14 aa, Staphylococcus aureus
FADKGYAKAIDEEQ

SEQ ID NO: 1636826 - protein, 14 aa, Staphylococcus aureus
FAEGGNSGSPVFNN

SEQ ID NO: 1636827 - protein, 8 aa, Staphylococcus aureus
FAEVNGET

SEQ ID NO: 1636828 - protein, 13 aa, Staphylococcus aureus
FAKSNKPGEMDSE

SEQ ID NO: 1636829 - protein, 9 aa, Staphylococcus aureus
FAKTTAETL

SEQ ID NO: 1636830 - protein, 8 aa, Staphylococcus aureus
FANDQGEI

SEQ ID NO: 1636831 - protein, 6 aa, Staphylococcus aureus
FATGSP

SEQ ID NO: 1636832 - protein, 13 aa, Staphylococcus aureus
FAYNKSYSNGYPL

SEQ ID NO: 1636833 - protein, 10 aa, Staphylococcus aureus
FDDKAVPSGV

SEQ ID NO: 1636834 - protein, 8 aa, Staphylococcus aureus
FDEAYESI

SEQ ID NO: 1636835 - protein, 10 aa, Staphylococcus aureus
FDEEMKEDLE

SEQ ID NO: 1636836 - protein, 9 aa, Staphylococcus aureus
FDEGGTVPE

SEQ ID NO: 1636837 - protein, 4 aa, Staphylococcus aureus
FDEI

SEQ ID NO: 1636838 - protein, 10 aa, Staphylococcus aureus
FDEQQDAVHE

SEQ ID NO: 1636839 - protein, 16 aa, Staphylococcus aureus
FDEVKDDKVRDELNEL

SEQ ID NO: 1636840 - protein, 8 aa, Staphylococcus aureus
FDGDKRRI

SEQ ID NO: 1636841 - protein, 7 aa, Staphylococcus aureus
FDGSGTE

SEQ ID NO: 1636842 - protein, 10 aa, Staphylococcus aureus
FDKNAQITYE

SEQ ID NO: 1636843 - protein, 13 aa, Staphylococcus aureus
FDKNEKVTDVEGE

SEQ ID NO: 1636844 - protein, 6 aa, Staphylococcus aureus
FDKNNK

SEQ ID NO: 1636845 - protein, 8 aa, Staphylococcus aureus
FDKPSYKQ

SEQ ID NO: 1636846 - protein, 12 aa, Staphylococcus aureus
FDKSTNDRENFD

SEQ ID NO: 1636847 - protein, 6 aa, Staphylococcus aureus
FDKTIE

SEQ ID NO: 1636848 - protein, 16 aa, Staphylococcus aureus
FDPFPNSPRQDQKNPL

SEQ ID NO: 1636849 - protein, 5 aa, Staphylococcus aureus
FDPIS

SEQ ID NO: 1636850 - protein, 20 aa, Staphylococcus aureus
FDPVPLKKDKSASKHSHKHN

SEQ ID NO: 1636851 - protein, 9 aa, Staphylococcus aureus
FDQDSEGNW

SEQ ID NO: 1636852 - protein, 8 aa, Staphylococcus aureus
FDREVQTE

SEQ ID NO: 1636853 - protein, 22 aa, Staphylococcus aureus
FDSGGANIISESSKASEQSFCW

SEQ ID NO: 1636854 - protein, 15 aa, Staphylococcus aureus
FDSGGRISSVSPQRL

SEQ ID NO: 1636855 - protein, 6 aa, Staphylococcus aureus
FDSNNL

SEQ ID NO: 1636856 - protein, 5 aa, Staphylococcus aureus
FDSQK

SEQ ID NO: 1636857 - protein, 16 aa, Staphylococcus aureus
FDTDTLEDIQSSNTDV

SEQ ID NO: 1636858 - protein, 7 aa, Staphylococcus aureus
FDTQKEL

SEQ ID NO: 1636859 - protein, 37 aa, Staphylococcus aureus
FDTSTNTRQNVDAQEKTYTTNPVNINRDQEETRETEI

SEQ ID NO: 1636860 - protein, 9 aa, Staphylococcus aureus
FDTTKTAGE

SEQ ID NO: 1636861 - protein, 6 aa, Staphylococcus aureus
FEDENA

SEQ ID NO: 1636862 - protein, 7 aa, Staphylococcus aureus
FEDGVTE

SEQ ID NO: 1636863 - protein, 21 aa, Staphylococcus aureus
FEDKGVENSIPSLKAAAKANV

SEQ ID NO: 1636864 - protein, 5 aa, Staphylococcus aureus
FEDLK

SEQ ID NO: 1636865 - protein, 10 aa, Staphylococcus aureus
FEDLKDSNGW

SEQ ID NO: 1636866 - protein, 4 aa, Staphylococcus aureus
FEEK

SEQ ID NO: 1636867 - protein, 10 aa, Staphylococcus aureus
FEEQKENPLD

SEQ ID NO: 1636868 - protein, 100 aa, Staphylococcus aureus
FEESQDDNQLENEQVDQSTSSSVSEVSDITEESEETTHPNNTSGQQDNDDQQKDLQSSFSNQNEDTANENRPRTNQQDVATNQAVQTSKPMIRKGPNIKL

SEQ ID NO: 1636869 - protein, 100 aa, Staphylococcus aureus
FEESQDDNQLENEQVDQSTSSSVSEVSDITEESEETTHPNNTSGQQDNDDQQKDLQSSFSNQNEDTANENRPRTNQSDVATNQAVQTSKPMIRKGPNIKL

SEQ ID NO: 1636870 - protein, 100 aa, Staphylococcus aureus
FEESQDDNQLENEQVDQSTSSSVSEVSDITEESEETTHTNNTSEQQDNDDQQKDLQPSFSNQNEDTANENRPRTNQPDVGTNQAVQTSKPMIRKGPNIKL

SEQ ID NO: 1636871 - protein, 15 aa, Staphylococcus aureus
FEGEHGAKRTAAEQV

SEQ ID NO: 1636872 - protein, 10 aa, Staphylococcus aureus
FEGEMKEDLE

SEQ ID NO: 1636873 - protein, 4 aa, Staphylococcus aureus
FEGR

SEQ ID NO: 1636874 - protein, 9 aa, Staphylococcus aureus
FEKNRYKVE

SEQ ID NO: 1636875 - protein, 7 aa, Staphylococcus aureus
FEKSRQK

SEQ ID NO: 1636876 - protein, 9 aa, Staphylococcus aureus
FENDNTQIV

SEQ ID NO: 1636877 - protein, 7 aa, Staphylococcus aureus
FENDQDY

SEQ ID NO: 1636878 - protein, 9 aa, Staphylococcus aureus
FENDSDQIV

SEQ ID NO: 1636879 - protein, 4 aa, Staphylococcus aureus
FENE

SEQ ID NO: 1636880 - protein, 10 aa, Staphylococcus aureus
FENGHGTTEL

SEQ ID NO: 1636881 - protein, 14 aa, Staphylococcus aureus
FENNNNGSEDDESR

SEQ ID NO: 1636882 - protein, 5 aa, Staphylococcus aureus
FENSD

SEQ ID NO: 1636883 - protein, 5 aa, Staphylococcus aureus
FENSS

SEQ ID NO: 1636884 - protein, 5 aa, Staphylococcus aureus
FENST

SEQ ID NO: 1636885 - protein, 5 aa, Staphylococcus aureus
FEPQF

SEQ ID NO: 1636886 - protein, 4 aa, Staphylococcus aureus
FEQD

SEQ ID NO: 1636887 - protein, 18 aa, Staphylococcus aureus
FEQQKKEKEMKKKQKINQ

SEQ ID NO: 1636888 - protein, 12 aa, Staphylococcus aureus
FEQTNQSLKNYK

SEQ ID NO: 1636889 - protein, 10 aa, Staphylococcus aureus
FESTENDNTF

SEQ ID NO: 1636890 - protein, 10 aa, Staphylococcus aureus
FESTENDNTL

SEQ ID NO: 1636891 - protein, 5 aa, Staphylococcus aureus
FETNV

SEQ ID NO: 1636892 - protein, 15 aa, Staphylococcus aureus
FETSASSVSKGESLY

SEQ ID NO: 1636893 - protein, 4 aa, Staphylococcus aureus
FEVG

SEQ ID NO: 1636894 - protein, 10 aa, Staphylococcus aureus
FFTEGSPESV

SEQ ID NO: 1636895 - protein, 4 aa, Staphylococcus aureus
FGDI

SEQ ID NO: 1636896 - protein, 11 aa, Staphylococcus aureus
FGDSGNDEALK

SEQ ID NO: 1636897 - protein, 10 aa, Staphylococcus aureus
FGDSGNDETY

SEQ ID NO: 1636898 - protein, 10 aa, Staphylococcus aureus
FGDTSSEEMR

SEQ ID NO: 1636899 - protein, 13 aa, Staphylococcus aureus
FGEATRRAIESGF

SEQ ID NO: 1636900 - protein, 9 aa, Staphylococcus aureus
FGEGLSETK

SEQ ID NO: 1636901 - protein, 9 aa, Staphylococcus aureus
FGENGEQEI

SEQ ID NO: 1636902 - protein, 32 aa, Staphylococcus aureus
FGGGTSDEGLSEGVQDSEYRKRQADHRRAPAK

SEQ ID NO: 1636903 - protein, 15 aa, Staphylococcus aureus
FGGQEPGSGEEAAQN

SEQ ID NO: 1636904 - protein, 8 aa, Staphylococcus aureus
FGKDDERV

SEQ ID NO: 1636905 - protein, 12 aa, Staphylococcus aureus
FGKDDQTSEQTY

SEQ ID NO: 1636906 - protein, 23 aa, Staphylococcus aureus
FGKPQKVITDQAPSTKVAMAKVI

SEQ ID NO: 1636907 - protein, 10 aa, Staphylococcus aureus
FGKPSKEAQE

SEQ ID NO: 1636908 - protein, 27 aa, Staphylococcus aureus
FGNKASSLTVKKHGAQASIPLLEEVNQ

SEQ ID NO: 1636909 - protein, 14 aa, Staphylococcus aureus
FGPNEDFDTYPRQI

SEQ ID NO: 1636910 - protein, 18 aa, Staphylococcus aureus
FGQKQEHSAREMTAQEIE

SEQ ID NO: 1636911 - protein, 4 aa, Staphylococcus aureus
FGRA

SEQ ID NO: 1636912 - protein, 11 aa, Staphylococcus aureus
FGRSPSGIDGQ

SEQ ID NO: 1636913 - protein, 4 aa, Staphylococcus aureus
FGRT

SEQ ID NO: 1636914 - protein, 8 aa, Staphylococcus aureus
FGSKANDP

SEQ ID NO: 1636915 - protein, 4 aa, Staphylococcus aureus
FGSQ

SEQ ID NO: 1636916 - protein, 9 aa, Staphylococcus aureus
FGSSIGGEI

SEQ ID NO: 1636917 - protein, 5 aa, Staphylococcus aureus
FHPTY

SEQ ID NO: 1636918 - protein, 12 aa, Staphylococcus aureus
FKAAEKPGSEIQ

SEQ ID NO: 1636919 - protein, 10 aa, Staphylococcus aureus
FKAKQIKRKY

SEQ ID NO: 1636920 - protein, 15 aa, Staphylococcus aureus
FKEAKSEGKKYFDDD

SEQ ID NO: 1636921 - protein, 9 aa, Staphylococcus aureus
FKEGLSKDY

SEQ ID NO: 1636922 - protein, 5 aa, Staphylococcus aureus
FKEKI

SEQ ID NO: 1636923 - protein, 5 aa, Staphylococcus aureus
FKENG

SEQ ID NO: 1636924 - protein, 6 aa, Staphylococcus aureus
FKENGE

SEQ ID NO: 1636925 - protein, 9 aa, Staphylococcus aureus
FKGESLKSR

SEQ ID NO: 1636926 - protein, 9 aa, Staphylococcus aureus
FKKEGLEPW

SEQ ID NO: 1636927 - protein, 81 aa, Staphylococcus aureus
FKKEQKNDNKQSTQNNHQKSNNQNQNKGQQKDNKKNQQQNNKGNKGNKKNNRNNKKNNKNNKPQNQPAAPKEIPSKVTYQE

SEQ ID NO: 1636928 - protein, 33 aa, Staphylococcus aureus
FKKESHPKYTINQKKNRKEYSRSRTKKQYINDE

SEQ ID NO: 1636929 - protein, 9 aa, Staphylococcus aureus
FKKGVKDSK

SEQ ID NO: 1636930 - protein, 8 aa, Staphylococcus aureus
FKNAAQGA

SEQ ID NO: 1636931 - protein, 8 aa, Staphylococcus aureus
FKNGTKKV

SEQ ID NO: 1636932 - protein, 12 aa, Staphylococcus aureus
FKNKEAKLLGDN

SEQ ID NO: 1636933 - protein, 4 aa, Staphylococcus aureus
FKNR

SEQ ID NO: 1636934 - protein, 12 aa, Staphylococcus aureus
FKNSKATDLEKA

SEQ ID NO: 1636935 - protein, 8 aa, Staphylococcus aureus
FKNSTQSI

SEQ ID NO: 1636936 - protein, 4 aa, Staphylococcus aureus
FKNT

SEQ ID NO: 1636937 - protein, 12 aa, Staphylococcus aureus
FKPGDKLPSVTQ

SEQ ID NO: 1636938 - protein, 6 aa, Staphylococcus aureus
FKQGDF

SEQ ID NO: 1636939 - protein, 14 aa, Staphylococcus aureus
FKRNSTDNASWGST

SEQ ID NO: 1636940 - protein, 6 aa, Staphylococcus aureus
FKSDGQ

SEQ ID NO: 1636941 - protein, 10 aa, Staphylococcus aureus
FKSKASKVTV

SEQ ID NO: 1636942 - protein, 7 aa, Staphylococcus aureus
FKSNKQL

SEQ ID NO: 1636943 - protein, 7 aa, Staphylococcus aureus
FKSNTEV

SEQ ID NO: 1636944 - protein, 7 aa, Staphylococcus aureus
FKSSAQV

SEQ ID NO: 1636945 - protein, 17 aa, Staphylococcus aureus
FKTQEDSASSIAEEKFA

SEQ ID NO: 1636946 - protein, 6 aa, Staphylococcus aureus
FKTTSK

SEQ ID NO: 1636947 - protein, 13 aa, Staphylococcus aureus
FKYEDGEKTNEKV

SEQ ID NO: 1636948 - protein, 6 aa, Staphylococcus aureus
FMPRED

SEQ ID NO: 1636949 - protein, 12 aa, Staphylococcus aureus
FMTDDEEKNLKR

SEQ ID NO: 1636950 - protein, 10 aa, Staphylococcus aureus
FNDNTADLTH

SEQ ID NO: 1636951 - protein, 10 aa, Staphylococcus aureus
FNDSNENVDI

SEQ ID NO: 1636952 - protein, 9 aa, Staphylococcus aureus
FNEDNSKED

SEQ ID NO: 1636953 - protein, 14 aa, Staphylococcus aureus
FNEEDKKTIRILES

SEQ ID NO: 1636954 - protein, 23 aa, Staphylococcus aureus
FNFNGKDAKIYGNNATGKTTTAT

SEQ ID NO: 1636955 - protein, 4 aa, Staphylococcus aureus
FNGK

SEQ ID NO: 1636956 - protein, 14 aa, Staphylococcus aureus
FNGKKYRSKYYRHF

SEQ ID NO: 1636957 - protein, 9 aa, Staphylococcus aureus
FNIPSGKEL

SEQ ID NO: 1636958 - protein, 7 aa, Staphylococcus aureus
FNKEEQK

SEQ ID NO: 1636959 - protein, 6 aa, Staphylococcus aureus
FNKKDK

SEQ ID NO: 1636960 - protein, 20 aa, Staphylococcus aureus
FNKKKTKNRCFEGRIIYGQS

SEQ ID NO: 1636961 - protein, 9 aa, Staphylococcus aureus
FNNNGTKLI

SEQ ID NO: 1636962 - protein, 8 aa, Staphylococcus aureus
FNNNPTTI

SEQ ID NO: 1636963 - protein, 8 aa, Staphylococcus aureus
FNNQQSYE

SEQ ID NO: 1636964 - protein, 12 aa, Staphylococcus aureus
FNPHTEKKGGQL

SEQ ID NO: 1636965 - protein, 9 aa, Staphylococcus aureus
FNPQSKDYF

SEQ ID NO: 1636966 - protein, 11 aa, Staphylococcus aureus
FNRKTKQLEAF

SEQ ID NO: 1636967 - protein, 10 aa, Staphylococcus aureus
FNSKSNEYKD

SEQ ID NO: 1636968 - protein, 12 aa, Staphylococcus aureus
FNSNGTYLKTGE

SEQ ID NO: 1636969 - protein, 12 aa, Staphylococcus aureus
FNSNRKSFGTRR

SEQ ID NO: 1636970 - protein, 10 aa, Staphylococcus aureus
FNSQKNRGYA

SEQ ID NO: 1636971 - protein, 7 aa, Staphylococcus aureus
FNSTTKK

SEQ ID NO: 1636972 - protein, 7 aa, Staphylococcus aureus
FNTDESL

SEQ ID NO: 1636973 - protein, 19 aa, Staphylococcus aureus
FNTEYRNRKAQGMSLYKKV

SEQ ID NO: 1636974 - protein, 10 aa, Staphylococcus aureus
FNTTQTSGEF

SEQ ID NO: 1636975 - protein, 7 aa, Staphylococcus aureus
FNVTENG

SEQ ID NO: 1636976 - protein, 4 aa, Staphylococcus aureus
FPEE

SEQ ID NO: 1636977 - protein, 9 aa, Staphylococcus aureus
FPENDSPSY

SEQ ID NO: 1636978 - protein, 13 aa, Staphylococcus aureus
FPKREKKNSSQID

SEQ ID NO: 1636979 - protein, 8 aa, Staphylococcus aureus
FPLPNTEY

SEQ ID NO: 1636980 - protein, 16 aa, Staphylococcus aureus
FPPPTSKFSPSQHSQM

SEQ ID NO: 1636981 - protein, 12 aa, Staphylococcus aureus
FPTGTHERQDYP

SEQ ID NO: 1636982 - protein, 6 aa, Staphylococcus aureus
FPVGGE

SEQ ID NO: 1636983 - protein, 11 aa, Staphylococcus aureus
FQEQKDGTVEV

SEQ ID NO: 1636984 - protein, 11 aa, Staphylococcus aureus
FQNGHQRIEEA

SEQ ID NO: 1636985 - protein, 8 aa, Staphylococcus aureus
FQNGHQRL

SEQ ID NO: 1636986 - protein, 6 aa, Staphylococcus aureus
FQPTNH

SEQ ID NO: 1636987 - protein, 10 aa, Staphylococcus aureus
FQSEQKGLRN

SEQ ID NO: 1636988 - protein, 7 aa, Staphylococcus aureus
FRGGHSN

SEQ ID NO: 1636989 - protein, 20 aa, Staphylococcus aureus
FRKQTQSLRQQPQRTTSING

SEQ ID NO: 1636990 - protein, 10 aa, Staphylococcus aureus
FRKSAKTVGD

SEQ ID NO: 1636991 - protein, 16 aa, Staphylococcus aureus
FRNKGSKVCSANSVRA

SEQ ID NO: 1636992 - protein, 6 aa, Staphylococcus aureus
FRTEPS

SEQ ID NO: 1636993 - protein, 6 aa, Staphylococcus aureus
FRTSSL

SEQ ID NO: 1636994 - protein, 6 aa, Staphylococcus aureus
FRVPND

SEQ ID NO: 1636995 - protein, 6 aa, Staphylococcus aureus
FSDENG

SEQ ID NO: 1636996 - protein, 10 aa, Staphylococcus aureus
FSDENGIRAA

SEQ ID NO: 1636997 - protein, 14 aa, Staphylococcus aureus
FSDIKTTFKFPFIY

SEQ ID NO: 1636998 - protein, 13 aa, Staphylococcus aureus
FSDQSDLMRAEVS

SEQ ID NO: 1636999 - protein, 9 aa, Staphylococcus aureus
FSDSKPIIN

SEQ ID NO: 1637000 - protein, 7 aa, Staphylococcus aureus
FSDTNNN

SEQ ID NO: 1637001 - protein, 9 aa, Staphylococcus aureus
FSDTQKRNE

SEQ ID NO: 1637002 - protein, 8 aa, Staphylococcus aureus
FSEDEKEQ

SEQ ID NO: 1637003 - protein, 4 aa, Staphylococcus aureus
FSES

SEQ ID NO: 1637004 - protein, 10 aa, Staphylococcus aureus
FSETSRKQKQ

SEQ ID NO: 1637005 - protein, 5 aa, Staphylococcus aureus
FSGLD

SEQ ID NO: 1637006 - protein, 10 aa, Staphylococcus aureus
FSGNPGAGES

SEQ ID NO: 1637007 - protein, 15 aa, Staphylococcus aureus
FSGQSGSAIRDSKNN

SEQ ID NO: 1637008 - protein, 8 aa, Staphylococcus aureus
FSGTKQAG

SEQ ID NO: 1637009 - protein, 11 aa, Staphylococcus aureus
FSKDKGQETTL

SEQ ID NO: 1637010 - protein, 10 aa, Staphylococcus aureus
FSKGEKSELS

SEQ ID NO: 1637011 - protein, 10 aa, Staphylococcus aureus
FSKKAAELRL

SEQ ID NO: 1637012 - protein, 14 aa, Staphylococcus aureus
FSKSPPSGTMVKPG

SEQ ID NO: 1637013 - protein, 5 aa, Staphylococcus aureus
FSNPS

SEQ ID NO: 1637014 - protein, 6 aa, Staphylococcus aureus
FSNQKA

SEQ ID NO: 1637015 - protein, 6 aa, Staphylococcus aureus
FSNQQI

SEQ ID NO: 1637016 - protein, 16 aa, Staphylococcus aureus
FSPDHLRGDTEGRYGT

SEQ ID NO: 1637017 - protein, 6 aa, Staphylococcus aureus
FSPSRT

SEQ ID NO: 1637018 - protein, 6 aa, Staphylococcus aureus
FSRDED

SEQ ID NO: 1637019 - protein, 6 aa, Staphylococcus aureus
FSREAN

SEQ ID NO: 1637020 - protein, 7 aa, Staphylococcus aureus
FSTKEAK

SEQ ID NO: 1637021 - protein, 5 aa, Staphylococcus aureus
FSTNG

SEQ ID NO: 1637022 - protein, 25 aa, Staphylococcus aureus
FSTSPNLTAPVHNNTNNNTKPITDA

SEQ ID NO: 1637023 - protein, 5 aa, Staphylococcus aureus
FTAKG

SEQ ID NO: 1637024 - protein, 12 aa, Staphylococcus aureus
FTDADEAKRNVY

SEQ ID NO: 1637025 - protein, 25 aa, Staphylococcus aureus
FTDGGKGKKGKRNQMQNMLKGMNLP

SEQ ID NO: 1637026 - protein, 19 aa, Staphylococcus aureus
FTEAGTKHGRLGLMAGHKM

SEQ ID NO: 1637027 - protein, 9 aa, Staphylococcus aureus
FTEDQKEKI

SEQ ID NO: 1637028 - protein, 5 aa, Staphylococcus aureus
FTGAS

SEQ ID NO: 1637029 - protein, 16 aa, Staphylococcus aureus
FTGGVTPAAKPSDKTY

SEQ ID NO: 1637030 - protein, 11 aa, Staphylococcus aureus
FTGQKGSYVPV

SEQ ID NO: 1637031 - protein, 10 aa, Staphylococcus aureus
FTGQKGSYVS

SEQ ID NO: 1637032 - protein, 5 aa, Staphylococcus aureus
FTKST

SEQ ID NO: 1637033 - protein, 16 aa, Staphylococcus aureus
FTKVDPPILTASAPEG

SEQ ID NO: 1637034 - protein, 4 aa, Staphylococcus aureus
FTNA

SEQ ID NO: 1637035 - protein, 8 aa, Staphylococcus aureus
FTNPDANE

SEQ ID NO: 1637036 - protein, 9 aa, Staphylococcus aureus
FTNRKEDID

SEQ ID NO: 1637037 - protein, 6 aa, Staphylococcus aureus
FTNRTK

SEQ ID NO: 1637038 - protein, 13 aa, Staphylococcus aureus
FTPDTSKLKDVTG

SEQ ID NO: 1637039 - protein, 15 aa, Staphylococcus aureus
FTPEAPKTITELEKK

SEQ ID NO: 1637040 - protein, 10 aa, Staphylococcus aureus
FTPSKSNKKH

SEQ ID NO: 1637041 - protein, 39 aa, Staphylococcus aureus; identical to SEQ ID NO: 1568849

SEQ ID NO: 1637042 - protein, 39 aa, Staphylococcus aureus
FTQADQDKQQAYNNAANQAQQIANGTPTPVLTPDTVTQA

SEQ ID NO: 1637043 - protein, 10 aa, Staphylococcus aureus
FTSEEGNELA

SEQ ID NO: 1637044 - protein, 13 aa, Staphylococcus aureus
FTSTLDKKELQEM

SEQ ID NO: 1637045 - protein, 8 aa, Staphylococcus aureus
FTTGNGDG

SEQ ID NO: 1637046 - protein, 22 aa, Staphylococcus aureus
FTTSDSASYAQDFKSEENAKKI

SEQ ID NO: 1637047 - protein, 11 aa, Staphylococcus aureus
FTTSENGQQKL

SEQ ID NO: 1637048 - protein, 10 aa, Staphylococcus aureus
FVTPNGQVSA

SEQ ID NO: 1637049 - protein, 4 aa, Staphylococcus aureus
FYDD

SEQ ID NO: 1637050 - protein, 5 aa, Staphylococcus aureus
FYQSR

SEQ ID NO: 1637051 - protein, 6 aa, Staphylococcus aureus
GAADIP

SEQ ID NO: 1637052 - protein, 14 aa, Staphylococcus aureus
GADVNDSTSASVDD

SEQ ID NO: 1637053 - protein, 12 aa, Staphylococcus aureus
GAEGIRDKDVHD

SEQ ID NO: 1637054 - protein, 19 aa, Staphylococcus aureus
GAEYKKIGVPGEQELGGRG

SEQ ID NO: 1637055 - protein, 13 aa, Staphylococcus aureus
GAFAEKRKTSYPK

SEQ ID NO: 1637056 - protein, 17 aa, Staphylococcus aureus
GAFEPFPNSPRQEENNP

SEQ ID NO: 1637057 - protein, 8 aa, Staphylococcus aureus
GAFGGKKE

SEQ ID NO: 1637058 - protein, 11 aa, Staphylococcus aureus
GAGGDGTSDNR

SEQ ID NO: 1637059 - protein, 12 aa, Staphylococcus aureus
GAGGLPVGTGGK

SEQ ID NO: 1637060 - protein, 13 aa, Staphylococcus aureus
GAGSVSDKLVGGH

SEQ ID NO: 1637061 - protein, 7 aa, Staphylococcus aureus
GAGVDAG

SEQ ID NO: 1637062 - protein, 6 aa, Staphylococcus aureus
GAIEGI

SEQ ID NO: 1637063 - protein, 4 aa, Staphylococcus aureus
GAIR

SEQ ID NO: 1637064 - protein, 8 aa, Staphylococcus aureus
GAKAAGRD

SEQ ID NO: 1637065 - protein, 11 aa, Staphylococcus aureus
GAKAGPDLADA

SEQ ID NO: 1637066 - protein, 9 aa, Staphylococcus aureus
GAKDGTISK

SEQ ID NO: 1637067 - protein, 8 aa, Staphylococcus aureus
GAKDIPPD

SEQ ID NO: 1637068 - protein, 12 aa, Staphylococcus aureus
GAKLKEAIERSA

SEQ ID NO: 1637069 - protein, 8 aa, Staphylococcus aureus
GAKNDAES

SEQ ID NO: 1637070 - protein, 5 aa, Staphylococcus aureus
GALKS

SEQ ID NO: 1637071 - protein, 5 aa, Staphylococcus aureus
GALSG

SEQ ID NO: 1637072 - protein, 13 aa, Staphylococcus aureus
GANDQGKNVDDDK

SEQ ID NO: 1637073 - protein, 10 aa, Staphylococcus aureus
GANNSTGEQF

SEQ ID NO: 1637074 - protein, 5 aa, Staphylococcus aureus
GAPGA

SEQ ID NO: 1637075 - protein, 8 aa, Staphylococcus aureus
GAPGFEEE

SEQ ID NO: 1637076 - protein, 8 aa, Staphylococcus aureus
GAPIAYKP

SEQ ID NO: 1637077 - protein, 7 aa, Staphylococcus aureus
GAPIPVE

SEQ ID NO: 1637078 - protein, 7 aa, Staphylococcus aureus
GAPQHRE

SEQ ID NO: 1637079 - protein, 11 aa, Staphylococcus aureus
GAPTRAVEEAG

SEQ ID NO: 1637080 - protein, 6 aa, Staphylococcus aureus
GAQEEA

SEQ ID NO: 1637081 - protein, 30 aa, Staphylococcus aureus
GARDAVKQQYEAKKQEIEQAEHATDEEKQV

SEQ ID NO: 1637082 - protein, 5 aa, Staphylococcus aureus
GARFA

SEQ ID NO: 1637083 - protein, 8 aa, Staphylococcus aureus
GARSDGVD

SEQ ID NO: 1637084 - protein, 12 aa, Staphylococcus aureus
GASGSGKSTFAN

SEQ ID NO: 1637085 - protein, 11 aa, Staphylococcus aureus
GASLYDTESVD

SEQ ID NO: 1637086 - protein, 17 aa, Staphylococcus aureus
GASTTATKAFETEDAIQ

SEQ ID NO: 1637087 - protein, 13 aa, Staphylococcus aureus
GATSVKPNIKGLD

SEQ ID NO: 1637088 - protein, 22 aa, Staphylococcus aureus
GATVSAEVNQNDRRDIQKNHSA

SEQ ID NO: 1637089 - protein, 13 aa, Staphylococcus aureus
GAVEESKSQFKDE

SEQ ID NO: 1637090 - protein, 4 aa, Staphylococcus aureus
GAVG

SEQ ID NO: 1637091 - protein, 4 aa, Staphylococcus aureus
GAWN

SEQ ID NO: 1637092 - protein, 7 aa, Staphylococcus aureus
GAYPGQG

SEQ ID NO: 1637093 - protein, 8 aa, Staphylococcus aureus
GCANDTKA

SEQ ID NO: 1637094 - protein, 5 aa, Staphylococcus aureus
GCSYK

SEQ ID NO: 1637095 - protein, 6 aa, Staphylococcus aureus
GDARSK

SEQ ID NO: 1637096 - protein, 7 aa, Staphylococcus aureus
GDDEEYS

SEQ ID NO: 1637097 - protein, 17 aa, Staphylococcus aureus
GDDIKEKDSQLNEIDSK

SEQ ID NO: 1637098 - protein, 9 aa, Staphylococcus aureus
GDDLPAAGG

SEQ ID NO: 1637099 - protein, 5 aa, Staphylococcus aureus
GDDYY

SEQ ID NO: 1637100 - protein, 15 aa, Staphylococcus aureus
GDEDSNEWATDDNVD

SEQ ID NO: 1637101 - protein, 9 aa, Staphylococcus aureus
GDEGKGKIT

SEQ ID NO: 1637102 - protein, 5 aa, Staphylococcus aureus
GDEHG

SEQ ID NO: 1637103 - protein, 24 aa, Staphylococcus aureus
GDEVSRPGPRIDDGLKELRDAIYR

SEQ ID NO: 1637104 - protein, 4 aa, Staphylococcus aureus
GDFN

SEQ ID NO: 1637105 - protein, 14 aa, Staphylococcus aureus
GDGDIKGSSIGSKN

SEQ ID NO: 1637106 - protein, 14 aa, Staphylococcus aureus
GDGDLKGSSVGPKE

SEQ ID NO: 1637107 - protein, 14 aa, Staphylococcus aureus
GDGDLKGSSVGSRS

SEQ ID NO: 1637108 - protein, 10 aa, Staphylococcus aureus
GDGLSDYPKN

SEQ ID NO: 1637109 - protein, 5 aa, Staphylococcus aureus
GDGNI

SEQ ID NO: 1637110 - protein, 8 aa, Staphylococcus aureus
GDGRNNVA

SEQ ID NO: 1637111 - protein, 7 aa, Staphylococcus aureus
GDGTFEY

SEQ ID NO: 1637112 - protein, 8 aa, Staphylococcus aureus
GDGTVESK

SEQ ID NO: 1637113 - protein, 7 aa, Staphylococcus aureus
GDHAKYT

SEQ ID NO: 1637114 - protein, 15 aa, Staphylococcus aureus
GDHERKDTVKNAEET

SEQ ID NO: 1637115 - protein, 17 aa, Staphylococcus aureus
GDIKDVEQALQGTKMTR

SEQ ID NO: 1637116 - protein, 10 aa, Staphylococcus aureus
GDIKGSSIGY

SEQ ID NO: 1637117 - protein, 12 aa, Staphylococcus aureus
GDKDYGEHAKEL

SEQ ID NO: 1637118 - protein, 10 aa, Staphylococcus aureus
GDKSTVEKAK

SEQ ID NO: 1637119 - protein, 8 aa, Staphylococcus aureus
GDKVNKGD

SEQ ID NO: 1637120 - protein, 13 aa, Staphylococcus aureus
GDLGYKEDKIGEL

SEQ ID NO: 1637121 - protein, 7 aa, Staphylococcus aureus
GDLSEVA

SEQ ID NO: 1637122 - protein, 19 aa, Staphylococcus aureus
GDLSNDKRSEETKKYNDKL

SEQ ID NO: 1637123 - protein, 12 aa, Staphylococcus aureus
GDNEGKPFSRND

SEQ ID NO: 1637124 - protein, 15 aa, Staphylococcus aureus
GDNGAENVNKKGRKR

SEQ ID NO: 1637125 - protein, 4 aa, Staphylococcus aureus
GDNI

SEQ ID NO: 1637126 - protein, 20 aa, Staphylococcus aureus
GDNKITGDSKETQIKKSFSK

SEQ ID NO: 1637127 - protein, 10 aa, Staphylococcus aureus
GDNKKRLESS

SEQ ID NO: 1637128 - protein, 7 aa, Staphylococcus aureus
GDNKLSD

SEQ ID NO: 1637129 - protein, 5 aa, Staphylococcus aureus
GDQDN

SEQ ID NO: 1637130 - protein, 26 aa, Staphylococcus aureus
GDQRTQGEISRKEGGKIFGSGSRTPI

SEQ ID NO: 1637131 - protein, 26 aa, Staphylococcus aureus
GDQRTQGEKSRKEGGKIFGSGSRTPI

SEQ ID NO: 1637132 - protein, 47 aa, Staphylococcus aureus
GDQTTDDGVTRIKDQGIQTLSGDTATPVVKPNAKKAIRDKATKQREI

SEQ ID NO: 1637133 - protein, 16 aa, Staphylococcus aureus
GDRVTSETTFYVCNEC

SEQ ID NO: 1637134 - protein, 38 aa, Staphylococcus aureus
GDSEDTMQTEHVGKDTASSKVHEQHTTNVKVRDIGDDK

SEQ ID NO: 1637135 - protein, 38 aa, Staphylococcus aureus
GDSEDTVQTEHVGEGTASSKVHEQNTTNVKVRDIGDDK

SEQ ID NO: 1637136 - protein, 38 aa, Staphylococcus aureus
GDSEDTVQTEHVGKDTASSKVHEQHTTNVKVRDIGDDK

SEQ ID NO: 1637137 - protein, 7 aa, Staphylococcus aureus
GDSIPNQ

SEQ ID NO: 1637138 - protein, 10 aa, Staphylococcus aureus
GDSNPANPNY

SEQ ID NO: 1637139 - protein, 7 aa, Staphylococcus aureus
GDSPITE

SEQ ID NO: 1637140 - protein, 8 aa, Staphylococcus aureus
GDTENGYV

SEQ ID NO: 1637141 - protein, 5 aa, Staphylococcus aureus
GDTEV

SEQ ID NO: 1637142 - protein, 18 aa, Staphylococcus aureus
GDTFKAKSEYNDQHSQFP

SEQ ID NO: 1637143 - protein, 9 aa, Staphylococcus aureus
GDTFKYDND

SEQ ID NO: 1637144 - protein, 5 aa, Staphylococcus aureus
GDTPL

SEQ ID NO: 1637145 - protein, 4 aa, Staphylococcus aureus
GDVA

SEQ ID NO: 1637146 - protein, 12 aa, Staphylococcus aureus
GEADVTRSDSGM

SEQ ID NO: 1637147 - protein, 11 aa, Staphylococcus aureus
GEAHLTNPKVK

SEQ ID NO: 1637148 - protein, 28 aa, Staphylococcus aureus
GEAQKLNDSQAPKADAQQNNFNKDQQSA

SEQ ID NO: 1637149 - protein, 9 aa, Staphylococcus aureus
GEARQQVED

SEQ ID NO: 1637150 - protein, 17 aa, Staphylococcus aureus
GEATKSISNHINPMKWE

SEQ ID NO: 1637151 - protein, 17 aa, Staphylococcus aureus
GEATKSISNHINPMKWS

SEQ ID NO: 1637152 - protein, 7 aa, Staphylococcus aureus
GEDERQR

SEQ ID NO: 1637153 - protein, 6 aa, Staphylococcus aureus
GEDGHP

SEQ ID NO: 1637154 - protein, 4 aa, Staphylococcus aureus
GEED

SEQ ID NO: 1637155 - protein, 5 aa, Staphylococcus aureus
GEEDL

SEQ ID NO: 1637156 - protein, 12 aa, Staphylococcus aureus
GEEGNKDKQDPH

SEQ ID NO: 1637157 - protein, 9 aa, Staphylococcus aureus
GEEGRGYSD

SEQ ID NO: 1637158 - protein, 5 aa, Staphylococcus aureus
GEEIN

SEQ ID NO: 1637159 - protein, 15 aa, Staphylococcus aureus
GEEYTGNVTEGNEET

SEQ ID NO: 1637160 - protein, 16 aa, Staphylococcus aureus
GEFKSASAFPLPNTEY

SEQ ID NO: 1637161 - protein, 19 aa, Staphylococcus aureus
GEGAFRGNQRLEPLRSSNL

SEQ ID NO: 1637162 - protein, 7 aa, Staphylococcus aureus
GEGLAYE

SEQ ID NO: 1637163 - protein, 16 aa, Staphylococcus aureus
GEGNIEQRRINGRPTI

SEQ ID NO: 1637164 - protein, 11 aa, Staphylococcus aureus
GEGNITVNNRD

SEQ ID NO: 1637165 - protein, 5 aa, Staphylococcus aureus
GEGRM

SEQ ID NO: 1637166 - protein, 74 aa, Staphylococcus aureus
GEGSGNASKENSNDNTPQQNDETTNNKKEETTNNKKEETTNKSADKAEVNQTNDDNQQRVNATPSARRYARENG

SEQ ID NO: 1637167 - protein, 32 aa, Staphylococcus aureus
GEGSGNASKENSNDNTPQQNDETTNNKKRRNN

SEQ ID NO: 1637168 - protein, 65 aa, Staphylococcus aureus
GEGSGNASKENSNDNTPQQNEETNNKKEETTNKSADNAEVNQTNDYNQQRVNATPSARRYARENG

SEQ ID NO: 1637169 - protein, 7 aa, Staphylococcus aureus
GEGTFDD

SEQ ID NO: 1637170 - protein, 18 aa, Staphylococcus aureus
GEGVADDVKEAVKNAVET

SEQ ID NO: 1637171 - protein, 7 aa, Staphylococcus aureus
GEGYKAT

SEQ ID NO: 1637172 - protein, 13 aa, Staphylococcus aureus
GEGYKATNFSDAK

SEQ ID NO: 1637173 - protein, 13 aa, Staphylococcus aureus
GEHEDLREQSAKD

SEQ ID NO: 1637174 - protein, 5 aa, Staphylococcus aureus
GEHKD

SEQ ID NO: 1637175 - protein, 5 aa, Staphylococcus aureus
GEIPP

SEQ ID NO: 1637176 - protein, 4 aa, Staphylococcus aureus
GEIS

SEQ ID NO: 1637177 - protein, 9 aa, Staphylococcus aureus
GEITGNASN

SEQ ID NO: 1637178 - protein, 6 aa, Staphylococcus aureus
GEKANE

SEQ ID NO: 1637179 - protein, 10 aa, Staphylococcus aureus
GEKAPKDMTH

SEQ ID NO: 1637180 - protein, 14 aa, Staphylococcus aureus
GEKDRLQKQVKHQT

SEQ ID NO: 1637181 - protein, 5 aa, Staphylococcus aureus
GEKEF

SEQ ID NO: 1637182 - protein, 13 aa, Staphylococcus aureus
GEKERTETVNREQ

SEQ ID NO: 1637183 - protein, 5 aa, Staphylococcus aureus
GEKHV

SEQ ID NO: 1637184 - protein, 5 aa, Staphylococcus aureus
GEKNL

SEQ ID NO: 1637185 - protein, 28 aa, Staphylococcus aureus
GEKNNKAETKSYKMDDGKTVDIPKDPKR

SEQ ID NO: 1637186 - protein, 5 aa, Staphylococcus aureus
GEKRY

SEQ ID NO: 1637187 - protein, 9 aa, Staphylococcus aureus
GEKSAYNNV

SEQ ID NO: 1637188 - protein, 9 aa, Staphylococcus aureus
GELATTGSA

SEQ ID NO: 1637189 - protein, 6 aa, Staphylococcus aureus
GELKSA

SEQ ID NO: 1637190 - protein, 7 aa, Staphylococcus aureus
GELNESA

SEQ ID NO: 1637191 - protein, 7 aa, Staphylococcus aureus
GELQQFN

SEQ ID NO: 1637192 - protein, 14 aa, Staphylococcus aureus
GELQTIHDYKLKLI

SEQ ID NO: 1637193 - protein, 18 aa, Staphylococcus aureus
GELTQNGFTSLETSEAVS

SEQ ID NO: 1637194 - protein, 61 aa, Staphylococcus aureus
GENPPIPSKEHTAPLKEHTEPIKRNKESFKDAMERKDQLKQAETPKIEEKDEEMVDISIDD

SEQ ID NO: 1637195 - protein, 7 aa, Staphylococcus aureus
GENPTDK

SEQ ID NO: 1637196 - protein, 10 aa, Staphylococcus aureus
GENQNHKTTV

SEQ ID NO: 1637197 - protein, 7 aa, Staphylococcus aureus
GENRETV

SEQ ID NO: 1637198 - protein, 7 aa, Staphylococcus aureus
GENSMKE

SEQ ID NO: 1637199 - protein, 7 aa, Staphylococcus aureus
GENTAYN

SEQ ID NO: 1637200 - protein, 15 aa, Staphylococcus aureus
GEPADDENGAAKPHL

SEQ ID NO: 1637201 - protein, 11 aa, Staphylococcus aureus
GEPVDQGGQHE

SEQ ID NO: 1637202 - protein, 16 aa, Staphylococcus aureus
GEQDINDALTQFEIEK

SEQ ID NO: 1637203 - protein, 8 aa, Staphylococcus aureus
GERGPNIE

SEQ ID NO: 1637204 - protein, 4 aa, Staphylococcus aureus
GERI

SEQ ID NO: 1637205 - protein, 9 aa, Staphylococcus aureus
GERLESSFS

SEQ ID NO: 1637206 - protein, 8 aa, Staphylococcus aureus
GERQQDVN

SEQ ID NO: 1637207 - protein, 6 aa, Staphylococcus aureus
GERYDV

SEQ ID NO: 1637208 - protein, 10 aa, Staphylococcus aureus
GESDGRNDAL

SEQ ID NO: 1637209 - protein, 11 aa, Staphylococcus aureus
GESGCGKSTFG

SEQ ID NO: 1637210 - protein, 13 aa, Staphylococcus aureus
GESGSGKSVATKA

SEQ ID NO: 1637211 - protein, 6 aa, Staphylococcus aureus
GESITE

SEQ ID NO: 1637212 - protein, 5 aa, Staphylococcus aureus
GESKV

SEQ ID NO: 1637213 - protein, 7 aa, Staphylococcus aureus
GESTFDD

SEQ ID NO: 1637214 - protein, 6 aa, Staphylococcus aureus
GESVTP

SEQ ID NO: 1637215 - protein, 8 aa, Staphylococcus aureus
GETDYKPI

SEQ ID NO: 1637216 - protein, 9 aa, Staphylococcus aureus
GETGHKHKS

SEQ ID NO: 1637217 - protein, 14 aa, Staphylococcus aureus
GETGPTQKLAESQL

SEQ ID NO: 1637218 - protein, 8 aa, Staphylococcus aureus
GETKECNE

SEQ ID NO: 1637219 - protein, 11 aa, Staphylococcus aureus
GETTPITKTAT

SEQ ID NO: 1637220 - protein, 8 aa, Staphylococcus aureus
GETVKANQ

SEQ ID NO: 1637221 - protein, 4 aa, Staphylococcus aureus
GEVA

SEQ ID NO: 1637222 - protein, 18 aa, Staphylococcus aureus
GEVDKAGNRISGFGKFSA

SEQ ID NO: 1637223 - protein, 18 aa, Staphylococcus aureus
GEVDKAGNRISSFGNFSA

SEQ ID NO: 1637224 - protein, 18 aa, Staphylococcus aureus
GEVDKAGNRMSSFGKFSF

SEQ ID NO: 1637225 - protein, 4 aa, Staphylococcus aureus
GEVE

SEQ ID NO: 1637226 - protein, 4 aa, Staphylococcus aureus
GEWE

SEQ ID NO: 1637227 - protein, 8 aa, Staphylococcus aureus
GEWEEKKL

SEQ ID NO: 1637228 - protein, 32 aa, Staphylococcus aureus
GEWEEKKLGDLTTKIGSGKTPKGGSENYTNNG

SEQ ID NO: 1637229 - protein, 11 aa, Staphylococcus aureus
GEWEEKQLGDL

SEQ ID NO: 1637230 - protein, 29 aa, Staphylococcus aureus
GEWEEKQLGEVGTFTSGGTPLKSKSEYWN

SEQ ID NO: 1637231 - protein, 4 aa, Staphylococcus aureus
GEYD

SEQ ID NO: 1637232 - protein, 17 aa, Staphylococcus aureus
GEYDPSVTSASKQLEEY

SEQ ID NO: 1637233 - protein, 5 aa, Staphylococcus aureus
GEYGR

SEQ ID NO: 1637234 - protein, 6 aa, Staphylococcus aureus
GFAPSG

SEQ ID NO: 1637235 - protein, 19 aa, Staphylococcus aureus
GFDKTSTKEIAQRANVAEG

SEQ ID NO: 1637236 - protein, 17 aa, Staphylococcus aureus
GFDTDTLEGIQSSNTDV

SEQ ID NO: 1637237 - protein, 7 aa, Staphylococcus aureus
GFEDGVR

SEQ ID NO: 1637238 - protein, 5 aa, Staphylococcus aureus
GFENR

SEQ ID NO: 1637239 - protein, 8 aa, Staphylococcus aureus
GFETEQEA

SEQ ID NO: 1637240 - protein, 14 aa, Staphylococcus aureus
GFGGSSDGQDYETI

SEQ ID NO: 1637241 - protein, 16 aa, Staphylococcus aureus
GFGHKDTTKTAGSRRK

SEQ ID NO: 1637242 - protein, 8 aa, Staphylococcus aureus
GFGSDLGA

SEQ ID NO: 1637243 - protein, 24 aa, Staphylococcus aureus
GFGYKDTTKTISSKRSISNNSRTV

SEQ ID NO: 1637244 - protein, 18 aa, Staphylococcus aureus
GFKGDTPDNNKVSSHGNT

SEQ ID NO: 1637245 - protein, 7 aa, Staphylococcus aureus
GFKPSNK

SEQ ID NO: 1637246 - protein, 5 aa, Staphylococcus aureus
GFKTH

SEQ ID NO: 1637247 - protein, 12 aa, Staphylococcus aureus
GFNTNNSQDKAK

SEQ ID NO: 1637248 - protein, 8 aa, Staphylococcus aureus
GFPDSTLN

SEQ ID NO: 1637249 - protein, 22 aa, Staphylococcus aureus
GFPGDKSDNRQYKGKGKLESFD

SEQ ID NO: 1637250 - protein, 8 aa, Staphylococcus aureus
GGADISSI

SEQ ID NO: 1637251 - protein, 7 aa, Staphylococcus aureus
GGAKFAG

SEQ ID NO: 1637252 - protein, 9 aa, Staphylococcus aureus
GGANGVGTS

SEQ ID NO: 1637253 - protein, 7 aa, Staphylococcus aureus
GGAPNIE

SEQ ID NO: 1637254 - protein, 11 aa, Staphylococcus aureus
GGAPTQKLTKS

SEQ ID NO: 1637255 - protein, 6 aa, Staphylococcus aureus
GGARGL

SEQ ID NO: 1637256 - protein, 7 aa, Staphylococcus aureus
GGARSIK

SEQ ID NO: 1637257 - protein, 10 aa, Staphylococcus aureus
GGASGSQRQL

SEQ ID NO: 1637258 - protein, 7 aa, Staphylococcus aureus
GGDGTLN

SEQ ID NO: 1637259 - protein, 6 aa, Staphylococcus aureus
GGFESA

SEQ ID NO: 1637260 - protein, 4 aa, Staphylococcus aureus
GGFR

SEQ ID NO: 1637261 - protein, 11 aa, Staphylococcus aureus
GGFSGFGGGGF

SEQ ID NO: 1637262 - protein, 7 aa, Staphylococcus aureus
GGGAAKK

SEQ ID NO: 1637263 - protein, 4 aa, Staphylococcus aureus
GGGF

SEQ ID NO: 1637264 - protein, 8 aa, Staphylococcus aureus
GGGNAELQ

SEQ ID NO: 1637265 - protein, 10 aa, Staphylococcus aureus
GGGPPSTKNK

SEQ ID NO: 1637266 - protein, 11 aa, Staphylococcus aureus
GGGQAGTNATK

SEQ ID NO: 1637267 - protein, 5 aa, Staphylococcus aureus
GGGRY

SEQ ID NO: 1637268 - protein, 5 aa, Staphylococcus aureus
GGGYG

SEQ ID NO: 1637269 - protein, 15 aa, Staphylococcus aureus
GGGYTVSAARTERRI

SEQ ID NO: 1637270 - protein, 38 aa, Staphylococcus aureus
GGITAQSDKQVQTQSTSVDTSSNQSSEDNSENSTIPVN

SEQ ID NO: 1637271 - protein, 8 aa, Staphylococcus aureus
GGKENLEA

SEQ ID NO: 1637272 - protein, 9 aa, Staphylococcus aureus
GGKNNKNLT

SEQ ID NO: 1637273 - protein, 4 aa, Staphylococcus aureus
GGKR

SEQ ID NO: 1637274 - protein, 11 aa, Staphylococcus aureus
GGKSKKPTFND

SEQ ID NO: 1637275 - protein, 4 aa, Staphylococcus aureus
GGKV

SEQ ID NO: 1637276 - protein, 6 aa, Staphylococcus aureus
GGLPET

SEQ ID NO: 1637277 - protein, 4 aa, Staphylococcus aureus
GGLQ

SEQ ID NO: 1637278 - protein, 4 aa, Staphylococcus aureus
GGMS

SEQ ID NO: 1637279 - protein, 13 aa, Staphylococcus aureus
GGMTKEDSIFRLS

SEQ ID NO: 1637280 - protein, 6 aa, Staphylococcus aureus
GGNASV

SEQ ID NO: 1637281 - protein, 6 aa, Staphylococcus aureus
GGNLDA

SEQ ID NO: 1637282 - protein, 30 aa, Staphylococcus aureus
GGNVEEAAYTGEGKHINSGELNGLENEAAI

SEQ ID NO: 1637283 - protein, 10 aa, Staphylococcus aureus
GGPGTGKTTV

SEQ ID NO: 1637284 - protein, 10 aa, Staphylococcus aureus
GGPLSSSQQQ

SEQ ID NO: 1637285 - protein, 8 aa, Staphylococcus aureus
GGPNVERK

SEQ ID NO: 1637286 - protein, 15 aa, Staphylococcus aureus
GGPSASAIKAGKQGV

SEQ ID NO: 1637287 - protein, 16 aa, Staphylococcus aureus
GGQFEHGGKTPHSSHK

SEQ ID NO: 1637288 - protein, 7 aa, Staphylococcus aureus
GGQTISK

SEQ ID NO: 1637289 - protein, 11 aa, Staphylococcus aureus
GGRCEACKGDG

SEQ ID NO: 1637290 - protein, 17 aa, Staphylococcus aureus
GGRQRDPNASQKGDDLQ

SEQ ID NO: 1637291 - protein, 23 aa, Staphylococcus aureus
GGRTPAKFAPSQMDESDAFTESV

SEQ ID NO: 1637292 - protein, 23 aa, Staphylococcus aureus
GGRTPAKFAPSQMDESDTFTESV

SEQ ID NO: 1637293 - protein, 8 aa, Staphylococcus aureus
GGRTRPSL

SEQ ID NO: 1637294 - protein, 7 aa, Staphylococcus aureus
GGSTDQT

SEQ ID NO: 1637295 - protein, 6 aa, Staphylococcus aureus
GGSTNL

SEQ ID NO: 1637296 - protein, 7 aa, Staphylococcus aureus
GGTADVY

SEQ ID NO: 1637297 - protein, 7 aa, Staphylococcus aureus
GGTENVR

SEQ ID NO: 1637298 - protein, 7 aa, Staphylococcus aureus
GGTITAA

SEQ ID NO: 1637299 - protein, 6 aa, Staphylococcus aureus
GGTTGK

SEQ ID NO: 1637300 - protein, 7 aa, Staphylococcus aureus
GGTTLGK

SEQ ID NO: 1637301 - protein, 5 aa, Staphylococcus aureus
GGTYS

SEQ ID NO: 1637302 - protein, 8 aa, Staphylococcus aureus
GGVNSPVR

SEQ ID NO: 1637303 - protein, 4 aa, Staphylococcus aureus
GGYT

SEQ ID NO: 1637304 - protein, 32 aa, Staphylococcus aureus
GGYTAYEQQHHNDNLSKVKEDREIKDNRKTFN

SEQ ID NO: 1637305 - protein, 5 aa, Staphylococcus aureus
GHAEA

SEQ ID NO: 1637306 - protein, 40 aa, Staphylococcus aureus
GHDDDSSSKEEPAKEEAPAEQTPVATQTEEVDENRTVKAM

SEQ ID NO: 1637307 - protein, 40 aa, Staphylococcus aureus
GHDDDSSSKEGPAKEEAPAEQAPVATQTEEVDENRTVKAM

SEQ ID NO: 1637308 - protein, 4 aa, Staphylococcus aureus
GHDQ

SEQ ID NO: 1637309 - protein, 10 aa, Staphylococcus aureus
GHEDIETTLG

SEQ ID NO: 1637310 - protein, 9 aa, Staphylococcus aureus
GHEERTKME

SEQ ID NO: 1637311 - protein, 6 aa, Staphylococcus aureus
GHFSDE

SEQ ID NO: 1637312 - protein, 9 aa, Staphylococcus aureus
GHINETSAA

SEQ ID NO: 1637313 - protein, 6 aa, Staphylococcus aureus
GHKKTI

SEQ ID NO: 1637314 - protein, 16 aa, Staphylococcus aureus
GHKQDTNVVNPHNAER

SEQ ID NO: 1637315 - protein, 8 aa, Staphylococcus aureus
GHKSIKTT

SEQ ID NO: 1637316 - protein, 8 aa, Staphylococcus aureus
GHNDINNA

SEQ ID NO: 1637317 - protein, 33 aa, Staphylococcus aureus
GHNDINNALTKEEIEQAKAQLAQALQDIKDLVK

SEQ ID NO: 1637318 - protein, 24 aa, Staphylococcus aureus
GHNDINNAMTKEEIEQAKAQLAQA

SEQ ID NO: 1637319 - protein, 15 aa, Staphylococcus aureus
GHNGINNAMTKEEIE

SEQ ID NO: 1637320 - protein, 6 aa, Staphylococcus aureus
GHRAPF

SEQ ID NO: 1637321 - protein, 7 aa, Staphylococcus aureus
GHSDYKK

SEQ ID NO: 1637322 - protein, 8 aa, Staphylococcus aureus
GHSQQEYP

SEQ ID NO: 1637323 - protein, 9 aa, Staphylococcus aureus
GHSTISQTL

SEQ ID NO: 1637324 - protein, 13 aa, Staphylococcus aureus
GIAKAAKKADRFA

SEQ ID NO: 1637325 - protein, 18 aa, Staphylococcus aureus
GIANNQTGLYPTDSPGGW

SEQ ID NO: 1637326 - protein, 18 aa, Staphylococcus aureus
GIATQAKVEAKLNEQGIT

SEQ ID NO: 1637327 - protein, 12 aa, Staphylococcus aureus
GICGSDTSRYKK

SEQ ID NO: 1637328 - protein, 6 aa, Staphylococcus aureus
GIDKPK

SEQ ID NO: 1637329 - protein, 5 aa, Staphylococcus aureus
GIDPD

SEQ ID NO: 1637330 - protein, 5 aa, Staphylococcus aureus
GIEAI

SEQ ID NO: 1637331 - protein, 8 aa, Staphylococcus aureus
GIESGNKL

SEQ ID NO: 1637332 - protein, 6 aa, Staphylococcus aureus
GIETRL

SEQ ID NO: 1637333 - protein, 6 aa, Staphylococcus aureus
GIGDVR

SEQ ID NO: 1637334 - protein, 4 aa, Staphylococcus aureus
GIGI

SEQ ID NO: 1637335 - protein, 12 aa, Staphylococcus aureus
GIGNGKLSEKQL

SEQ ID NO: 1637336 - protein, 9 aa, Staphylococcus aureus
GIGRNSISD

SEQ ID NO: 1637337 - protein, 7 aa, Staphylococcus aureus
GIHGNSD

SEQ ID NO: 1637338 - protein, 7 aa, Staphylococcus aureus
GIHSNGY

SEQ ID NO: 1637339 - protein, 12 aa, Staphylococcus aureus
GIKDNKAEFEKK

SEQ ID NO: 1637340 - protein, 10 aa, Staphylococcus aureus
GIKQSKSNQL

SEQ ID NO: 1637341 - protein, 5 aa, Staphylococcus aureus
GINEP

SEQ ID NO: 1637342 - protein, 12 aa, Staphylococcus aureus
GINSTSGDTEEA

SEQ ID NO: 1637343 - protein, 16 aa, Staphylococcus aureus
GIPFEPKEIDNEAEIQ

SEQ ID NO: 1637344 - protein, 15 aa, Staphylococcus aureus
GIPPVGYNSKYGPSE

SEQ ID NO: 1637345 - protein, 4 aa, Staphylococcus aureus
GIPQ

SEQ ID NO: 1637346 - protein, 20 aa, Staphylococcus aureus
GIPSKLSSGWNSAKSSVGYH

SEQ ID NO: 1637347 - protein, 20 aa, Staphylococcus aureus
GIPSKLSSGWSSAKNSVGYH

SEQ ID NO: 1637348 - protein, 5 aa, Staphylococcus aureus
GIPTI

SEQ ID NO: 1637349 - protein, 5 aa, Staphylococcus aureus
GIQDH

SEQ ID NO: 1637350 - protein, 10 aa, Staphylococcus aureus
GISGAVSDSP

SEQ ID NO: 1637351 - protein, 18 aa, Staphylococcus aureus
GISGQFSAPSKLTPRDVE

SEQ ID NO: 1637352 - protein, 10 aa, Staphylococcus aureus
GISKEQVGAL

SEQ ID NO: 1637353 - protein, 11 aa, Staphylococcus aureus
GISPIPVDDET

SEQ ID NO: 1637354 - protein, 29 aa, Staphylococcus aureus
GISREEQDTFAVNSQQKAVRAQQNGEFDS

SEQ ID NO: 1637355 - protein, 15 aa, Staphylococcus aureus
GISTSKRQAREDVNN

SEQ ID NO: 1637356 - protein, 12 aa, Staphylococcus aureus
GITEGDEVKRTG

SEQ ID NO: 1637357 - protein, 16 aa, Staphylococcus aureus
GITPGMVSKRVKDGWE

SEQ ID NO: 1637358 - protein, 6 aa, Staphylococcus aureus
GITPRN

SEQ ID NO: 1637359 - protein, 11 aa, Staphylococcus aureus
GITSGDQKIAQ

SEQ ID NO: 1637360 - protein, 11 aa, Staphylococcus aureus
GIVPKDPDQFK

SEQ ID NO: 1637361 - protein, 7 aa, Staphylococcus aureus
GKAREVV

SEQ ID NO: 1637362 - protein, 9 aa, Staphylococcus aureus
GKDALQPNS

SEQ ID NO: 1637363 - protein, 11 aa, Staphylococcus aureus
GKDDKKYGEGV

SEQ ID NO: 1637364 - protein, 12 aa, Staphylococcus aureus
GKDDKKYGEGVH

SEQ ID NO: 1637365 - protein, 13 aa, Staphylococcus aureus
GKDDKSKESRRQM

SEQ ID NO: 1637366 - protein, 13 aa, Staphylococcus aureus
GKDGGTKLADELN

SEQ ID NO: 1637367 - protein, 6 aa, Staphylococcus aureus
GKDISD

SEQ ID NO: 1637368 - protein, 5 aa, Staphylococcus aureus
GKDNK

SEQ ID NO: 1637369 - protein, 7 aa, Staphylococcus aureus
GKDQQVG

SEQ ID NO: 1637370 - protein, 9 aa, Staphylococcus aureus
GKDSDYITG

SEQ ID NO: 1637371 - protein, 16 aa, Staphylococcus aureus
GKDSYLYDTNGNKYLD

SEQ ID NO: 1637372 - protein, 6 aa, Staphylococcus aureus
GKDTAT

SEQ ID NO: 1637373 - protein, 7 aa, Staphylococcus aureus
GKDTDIK

SEQ ID NO: 1637374 - protein, 4 aa, Staphylococcus aureus
GKDY

SEQ ID NO: 1637375 - protein, 8 aa, Staphylococcus aureus
GKEDKVKA

SEQ ID NO: 1637376 - protein, 19 aa, Staphylococcus aureus
GKEEGKFEQGGGTDDSKGY

SEQ ID NO: 1637377 - protein, 18 aa, Staphylococcus aureus
GKEEGKLEQGGGIDDSKG

SEQ ID NO: 1637378 - protein, 5 aa, Staphylococcus aureus
GKEGL

SEQ ID NO: 1637379 - protein, 6 aa, Staphylococcus aureus
GKEKTI

SEQ ID NO: 1637380 - protein, 9 aa, Staphylococcus aureus
GKELESATE

SEQ ID NO: 1637381 - protein, 8 aa, Staphylococcus aureus
GKEVSQEE

SEQ ID NO: 1637382 - protein, 6 aa, Staphylococcus aureus
GKEYQR

SEQ ID NO: 1637383 - protein, 19 aa, Staphylococcus aureus
GKFGGGGYKVSGGLHGVGS

SEQ ID NO: 1637384 - protein, 16 aa, Staphylococcus aureus
GKFGQSGYKTSGGLHG

SEQ ID NO: 1637385 - protein, 4 aa, Staphylococcus aureus
GKFI

SEQ ID NO: 1637386 - protein, 7 aa, Staphylococcus aureus
GKFTEDA

SEQ ID NO: 1637387 - protein, 20 aa, Staphylococcus aureus
GKGAYRGSQPLKPLNDSNLR

SEQ ID NO: 1637388 - protein, 10 aa, Staphylococcus aureus
GKGGEGKRAY

SEQ ID NO: 1637389 - protein, 10 aa, Staphylococcus aureus
GKGGQKKDPM

SEQ ID NO: 1637390 - protein, 7 aa, Staphylococcus aureus
GKGHEKL

SEQ ID NO: 1637391 - protein, 13 aa, Staphylococcus aureus
GKGLATYKGKDSL

SEQ ID NO: 1637392 - protein, 8 aa, Staphylococcus aureus
GKGSKERF

SEQ ID NO: 1637393 - protein, 13 aa, Staphylococcus aureus
GKGYQHKDQDFKR

SEQ ID NO: 1637394 - protein, 13 aa, Staphylococcus aureus
GKGYTIKSASEVD

SEQ ID NO: 1637395 - protein, 7 aa, Staphylococcus aureus
GKHPPII

SEQ ID NO: 1637396 - protein, 7 aa, Staphylococcus aureus
GKIGKAE

SEQ ID NO: 1637397 - protein, 30 aa, Staphylococcus aureus
GKIGSTWGNASNWANAAASSGYTVNNTPKV

SEQ ID NO: 1637398 - protein, 33 aa, Staphylococcus aureus
GKIGSTWGNASNWASAAASSGYTVNNTPKAGAI

SEQ ID NO: 1637399 - protein, 12 aa, Staphylococcus aureus
GKISNTYNSYKR

SEQ ID NO: 1637400 - protein, 4 aa, Staphylococcus aureus
GKIT

SEQ ID NO: 1637401 - protein, 7 aa, Staphylococcus aureus
GKITHED

SEQ ID NO: 1637402 - protein, 12 aa, Staphylococcus aureus
GKKATVVNAVLT

SEQ ID NO: 1637403 - protein, 20 aa, Staphylococcus aureus
GKKNHTSNYSPIPSDAKGSF

SEQ ID NO: 1637404 - protein, 4 aa, Staphylococcus aureus
GKKR

SEQ ID NO: 1637405 - protein, 30 aa, Staphylococcus aureus
GKKRIDVPEYRRPASDRKISIRGARSNNLK

SEQ ID NO: 1637406 - protein, 5 aa, Staphylococcus aureus
GKKTA

SEQ ID NO: 1637407 - protein, 38 aa, Staphylococcus aureus
GKKTGNTPDGRKAGEPFAPGANPMHGRDQKGALSSLSS

SEQ ID NO: 1637408 - protein, 5 aa, Staphylococcus aureus
GKKYK

SEQ ID NO: 1637409 - protein, 4 aa, Staphylococcus aureus
GKLK

SEQ ID NO: 1637410 - protein, 9 aa, Staphylococcus aureus
GKLNITDED

SEQ ID NO: 1637411 - protein, 10 aa, Staphylococcus aureus
GKLPDEKNYK

SEQ ID NO: 1637412 - protein, 6 aa, Staphylococcus aureus
GKLTEI

SEQ ID NO: 1637413 - protein, 9 aa, Staphylococcus aureus
GKMTREKNY

SEQ ID NO: 1637414 - protein, 9 aa, Staphylococcus aureus
GKNDAGKTT

SEQ ID NO: 1637415 - protein, 15 aa, Staphylococcus aureus
GKNDINSMTSDKALS

SEQ ID NO: 1637416 - protein, 7 aa, Staphylococcus aureus
GKNHNAE

SEQ ID NO: 1637417 - protein, 26 aa, Staphylococcus aureus
GKNPTWRDPKTKWTISKNKGQSHGGS

SEQ ID NO: 1637418 - protein, 12 aa, Staphylococcus aureus
GKPFDSSDIVFH

SEQ ID NO: 1637419 - protein, 15 aa, Staphylococcus aureus
GKPGDTVVDDHTDNE

SEQ ID NO: 1637420 - protein, 30 aa, Staphylococcus aureus
GKPKDLQYENASDRITVDDTATQLSKDLKQ

SEQ ID NO: 1637421 - protein, 13 aa, Staphylococcus aureus
GKPVLDREGEHNK

SEQ ID NO: 1637422 - protein, 5 aa, Staphylococcus aureus
GKQGM

SEQ ID NO: 1637423 - protein, 16 aa, Staphylococcus aureus
GKQNNITVNNDTSTVE

SEQ ID NO: 1637424 - protein, 4 aa, Staphylococcus aureus
GKQQ

SEQ ID NO: 1637425 - protein, 4 aa, Staphylococcus aureus
GKQV

SEQ ID NO: 1637426 - protein, 7 aa, Staphylococcus aureus
GKRKGMP

SEQ ID NO: 1637427 - protein, 8 aa, Staphylococcus aureus
GKRKGMPY

SEQ ID NO: 1637428 - protein, 7 aa, Staphylococcus aureus
GKRQEEV

SEQ ID NO: 1637429 - protein, 14 aa, Staphylococcus aureus
GKRTTFPKTANKIA

SEQ ID NO: 1637430 - protein, 14 aa, Staphylococcus aureus
GKRTTSPKTANKIA

SEQ ID NO: 1637431 - protein, 7 aa, Staphylococcus aureus
GKSGCGK

SEQ ID NO: 1637432 - protein, 9 aa, Staphylococcus aureus
GKSGTAELK

SEQ ID NO: 1637433 - protein, 5 aa, Staphylococcus aureus
GKSIA

SEQ ID NO: 1637434 - protein, 8 aa, Staphylococcus aureus
GKSQTETM

SEQ ID NO: 1637435 - protein, 8 aa, Staphylococcus aureus
GKSSYKRA

SEQ ID NO: 1637436 - protein, 17 aa, Staphylococcus aureus
GKSTEGMFDGEAPGQIG

SEQ ID NO: 1637437 - protein, 7 aa, Staphylococcus aureus
GKSVQQG

SEQ ID NO: 1637438 - protein, 11 aa, Staphylococcus aureus
GKTDPMEKRTR

SEQ ID NO: 1637439 - protein, 12 aa, Staphylococcus aureus
GKTDPMEKRTRV

SEQ ID NO: 1637440 - protein, 7 aa, Staphylococcus aureus
GKTETDQ

SEQ ID NO: 1637441 - protein, 6 aa, Staphylococcus aureus
GKTGAF

SEQ ID NO: 1637442 - protein, 13 aa, Staphylococcus aureus
GKTGTGIVNGKYN

SEQ ID NO: 1637443 - protein, 6 aa, Staphylococcus aureus
GKTHFP

SEQ ID NO: 1637444 - protein, 13 aa, Staphylococcus aureus
GKTKTYGYDPYAS

SEQ ID NO: 1637445 - protein, 13 aa, Staphylococcus aureus
GKTVAEKEVSYDD

SEQ ID NO: 1637446 - protein, 42 aa, Staphylococcus aureus
GKTVNGKTNNGKTVNGKSHTTNNNSTNNEGSILSGNPTVSSI

SEQ ID NO: 1637447 - protein, 9 aa, Staphylococcus aureus
GKVENYNGS

SEQ ID NO: 1637448 - protein, 8 aa, Staphylococcus aureus
GKVETTVS

SEQ ID NO: 1637449 - protein, 8 aa, Staphylococcus aureus
GKVNQAKQ

SEQ ID NO: 1637450 - protein, 11 aa, Staphylococcus aureus
GKVRSIKEEEL

SEQ ID NO: 1637451 - protein, 6 aa, Staphylococcus aureus
GKVTGC

SEQ ID NO: 1637452 - protein, 8 aa, Staphylococcus aureus
GKYEAKQD

SEQ ID NO: 1637453 - protein, 7 aa, Staphylococcus aureus
GKYNEQG

SEQ ID NO: 1637454 - protein, 7 aa, Staphylococcus aureus
GKYRPEL

SEQ ID NO: 1637455 - protein, 7 aa, Staphylococcus aureus
GLDPGQY

SEQ ID NO: 1637456 - protein, 5 aa, Staphylococcus aureus
GLDPW

SEQ ID NO: 1637457 - protein, 17 aa, Staphylococcus aureus
GLDTVTQATGATGGELK

SEQ ID NO: 1637458 - protein, 58 aa, Staphylococcus aureus
GLEGSSSKLEIKPQGTESTLKGTQGESSDIEVKPQATETTEASQYGPRPQFNKTPKYV

SEQ ID NO: 1637459 - protein, 9 aa, Staphylococcus aureus
GLENNTQSI

SEQ ID NO: 1637460 - protein, 13 aa, Staphylococcus aureus
GLEPWTSCEFDFT

SEQ ID NO: 1637461 - protein, 17 aa, Staphylococcus aureus
GLGATSAARYGDNRTNY

SEQ ID NO: 1637462 - protein, 6 aa, Staphylococcus aureus
GLGGAE

SEQ ID NO: 1637463 - protein, 12 aa, Staphylococcus aureus
GLGPTKDDLTKH

SEQ ID NO: 1637464 - protein, 4 aa, Staphylococcus aureus
GLGR

SEQ ID NO: 1637465 - protein, 16 aa, Staphylococcus aureus
GLGSSASALVGAIYIA

SEQ ID NO: 1637466 - protein, 12 aa, Staphylococcus aureus
GLINQPEDKYGE

SEQ ID NO: 1637467 - protein, 8 aa, Staphylococcus aureus
GLKAEDAL

SEQ ID NO: 1637468 - protein, 9 aa, Staphylococcus aureus
GLKAEDALK

SEQ ID NO: 1637469 - protein, 8 aa, Staphylococcus aureus
GLKDAMEN

SEQ ID NO: 1637470 - protein, 11 aa, Staphylococcus aureus
GLKDDKQDEQL

SEQ ID NO: 1637471 - protein, 12 aa, Staphylococcus aureus
GLKGKDAASELE

SEQ ID NO: 1637472 - protein, 8 aa, Staphylococcus aureus
GLKPGDKL

SEQ ID NO: 1637473 - protein, 4 aa, Staphylococcus aureus
GLKT

SEQ ID NO: 1637474 - protein, 34 aa, Staphylococcus aureus; identical to SEQ ID NO: 1565677

SEQ ID NO: 1637475 - protein, 35 aa, Staphylococcus aureus; identical to SEQ ID NO: 1566597

SEQ ID NO: 1637476 - protein, 33 aa, Staphylococcus aureus
GLNNPQRQALESQINNATTRDEVAQKLAEAKAL

SEQ ID NO: 1637477 - protein, 13 aa, Staphylococcus aureus
GLPKKTSSIKHGC

SEQ ID NO: 1637478 - protein, 5 aa, Staphylococcus aureus
GLQPG

SEQ ID NO: 1637479 - protein, 9 aa, Staphylococcus aureus
GLSGTYNTA

SEQ ID NO: 1637480 - protein, 8 aa, Staphylococcus aureus
GLSPSAKV

SEQ ID NO: 1637481 - protein, 6 aa, Staphylococcus aureus
GLTAEG

SEQ ID NO: 1637482 - protein, 4 aa, Staphylococcus aureus
GLTG

SEQ ID NO: 1637483 - protein, 13 aa, Staphylococcus aureus
GLTGKEAAAQHYD

SEQ ID NO: 1637484 - protein, 7 aa, Staphylococcus aureus
GLTIPQK

SEQ ID NO: 1637485 - protein, 7 aa, Staphylococcus aureus
GLTNSDI

SEQ ID NO: 1637486 - protein, 11 aa, Staphylococcus aureus
GLTQEEAINEQ

SEQ ID NO: 1637487 - protein, 25 aa, Staphylococcus aureus
GLTTPEKIGPKYAPVGASNDPDDLN

SEQ ID NO: 1637488 - protein, 9 aa, Staphylococcus aureus
GLVPKDPDQ

SEQ ID NO: 1637489 - protein, 7 aa, Staphylococcus aureus
GMEPNKA

SEQ ID NO: 1637490 - protein, 5 aa, Staphylococcus aureus
GMKTF

SEQ ID NO: 1637491 - protein, 6 aa, Staphylococcus aureus
GMPTEV

SEQ ID NO: 1637492 - protein, 11 aa, Staphylococcus aureus
GMQKSITQLGD

SEQ ID NO: 1637493 - protein, 19 aa, Staphylococcus aureus
GNAATNASAPDDILTATVS

SEQ ID NO: 1637494 - protein, 7 aa, Staphylococcus aureus
GNAEEYL

SEQ ID NO: 1637495 - protein, 19 aa, Staphylococcus aureus
GNAKTSAKNQKNPPVPAGY

SEQ ID NO: 1637496 - protein, 13 aa, Staphylococcus aureus
GNASDELKQYADE

SEQ ID NO: 1637497 - protein, 4 aa, Staphylococcus aureus
GNAV

SEQ ID NO: 1637498 - protein, 19 aa, Staphylococcus aureus
GNDDDRKKNCRSLASWTYS

SEQ ID NO: 1637499 - protein, 7 aa, Staphylococcus aureus
GNDGYYA

SEQ ID NO: 1637500 - protein, 6 aa, Staphylococcus aureus
GNDKDL

SEQ ID NO: 1637501 - protein, 7 aa, Staphylococcus aureus
GNDSHTI

SEQ ID NO: 1637502 - protein, 5 aa, Staphylococcus aureus
GNDTA

SEQ ID NO: 1637503 - protein, 7 aa, Staphylococcus aureus
GNDTYSE

SEQ ID NO: 1637504 - protein, 7 aa, Staphylococcus aureus
GNDTYSK

SEQ ID NO: 1637505 - protein, 5 aa, Staphylococcus aureus
GNELG

SEQ ID NO: 1637506 - protein, 6 aa, Staphylococcus aureus
GNEPDD

SEQ ID NO: 1637507 - protein, 8 aa, Staphylococcus aureus
GNESGFDA

SEQ ID NO: 1637508 - protein, 17 aa, Staphylococcus aureus
GNFQSAPSIGGSGSFNY

SEQ ID NO: 1637509 - protein, 9 aa, Staphylococcus aureus
GNGEREEPV

SEQ ID NO: 1637510 - protein, 6 aa, Staphylococcus aureus
GNGGHT

SEQ ID NO: 1637511 - protein, 5 aa, Staphylococcus aureus
GNGIT

SEQ ID NO: 1637512 - protein, 7 aa, Staphylococcus aureus
GNGPQIG

SEQ ID NO: 1637513 - protein, 12 aa, Staphylococcus aureus
GNGSSPDEWKDA

SEQ ID NO: 1637514 - protein, 15 aa, Staphylococcus aureus
GNGSSPDEWKDEIPS

SEQ ID NO: 1637515 - protein, 4 aa, Staphylococcus aureus
GNHY

SEQ ID NO: 1637516 - protein, 8 aa, Staphylococcus aureus
GNIDEQAQ

SEQ ID NO: 1637517 - protein, 4 aa, Staphylococcus aureus
GNIE

SEQ ID NO: 1637518 - protein, 29 aa, Staphylococcus aureus
GNIGKKAGEFGATAKNTAHNIKKGAEEMV

SEQ ID NO: 1637519 - protein, 30 aa, Staphylococcus aureus
GNIGKKAGEYGATAKNTAHNIKKGAEEMVE

SEQ ID NO: 1637520 - protein, 8 aa, Staphylococcus aureus
GNKAGFED

SEQ ID NO: 1637521 - protein, 6 aa, Staphylococcus aureus
GNKKHN

SEQ ID NO: 1637522 - protein, 11 aa, Staphylococcus aureus
GNKRDKYESYI

SEQ ID NO: 1637523 - protein, 5 aa, Staphylococcus aureus
GNKRN

SEQ ID NO: 1637524 - protein, 4 aa, Staphylococcus aureus
GNKS

SEQ ID NO: 1637525 - protein, 14 aa, Staphylococcus aureus
GNKSKGITAPHHNP

SEQ ID NO: 1637526 - protein, 8 aa, Staphylococcus aureus
GNNAGHTI

SEQ ID NO: 1637527 - protein, 7 aa, Staphylococcus aureus
GNNKPNC

SEQ ID NO: 1637528 - protein, 19 aa, Staphylococcus aureus
GNNRDKYESYSNKQDNIVN

SEQ ID NO: 1637529 - protein, 9 aa, Staphylococcus aureus
GNNVKERTA

SEQ ID NO: 1637530 - protein, 9 aa, Staphylococcus aureus
GNPGVGKTF

SEQ ID NO: 1637531 - protein, 7 aa, Staphylococcus aureus
GNPPLTL

SEQ ID NO: 1637532 - protein, 15 aa, Staphylococcus aureus
GNPPYGERIGDREEV

SEQ ID NO: 1637533 - protein, 7 aa, Staphylococcus aureus
GNPTRIP

SEQ ID NO: 1637534 - protein, 20 aa, Staphylococcus aureus
GNRLTKDGSTKWDPSKSYIK

SEQ ID NO: 1637535 - protein, 28 aa, Staphylococcus aureus
GNRLTKDGSTTWDPSKSYIKEAVKGSLK

SEQ ID NO: 1637536 - protein, 13 aa, Staphylococcus aureus
GNRMVDEDATLND

SEQ ID NO: 1637537 - protein, 8 aa, Staphylococcus aureus
GNRNQTKI

SEQ ID NO: 1637538 - protein, 13 aa, Staphylococcus aureus
GNRRDDRTHTGTI

SEQ ID NO: 1637539 - protein, 6 aa, Staphylococcus aureus
GNSKID

SEQ ID NO: 1637540 - protein, 5 aa, Staphylococcus aureus
GNTAI

SEQ ID NO: 1637541 - protein, 10 aa, Staphylococcus aureus
GNTKSVTVKR

SEQ ID NO: 1637542 - protein, 16 aa, Staphylococcus aureus
GNTPDEDGKLKGDVDY

SEQ ID NO: 1637543 - protein, 52 aa, Staphylococcus aureus
GNVKETIGNVTDNKNLENEGKEDKASGKAKEFVENAKEKATDFIDKVKGNKG

SEQ ID NO: 1637544 - protein, 51 aa, Staphylococcus aureus
GNVKETVGNVTDNKELEKEGQQDKATGKAKEVVENAKNKITDAIDKLKNKF

SEQ ID NO: 1637545 - protein, 36 aa, Staphylococcus aureus
GNVKETVGNVTDNKELEKEVVENAKNKITDAIDKLK

SEQ ID NO: 1637546 - protein, 11 aa, Staphylococcus aureus
GNVQDRAISKG

SEQ ID NO: 1637547 - protein, 5 aa, Staphylococcus aureus
GNVRD

SEQ ID NO: 1637548 - protein, 13 aa, Staphylococcus aureus
GNVTGDDTGKIGG

SEQ ID NO: 1637549 - protein, 14 aa, Staphylococcus aureus
GNYIETRGRDRHGI

SEQ ID NO: 1637550 - protein, 6 aa, Staphylococcus aureus
GNYKDG

SEQ ID NO: 1637551 - protein, 4 aa, Staphylococcus aureus
GNYL

SEQ ID NO: 1637552 - protein, 5 aa, Staphylococcus aureus
GNYSE

SEQ ID NO: 1637553 - protein, 7 aa, Staphylococcus aureus
GPADKNA

SEQ ID NO: 1637554 - protein, 12 aa, Staphylococcus aureus
GPDTTLKYVYID

SEQ ID NO: 1637555 - protein, 5 aa, Staphylococcus aureus
GPEAS

SEQ ID NO: 1637556 - protein, 39 aa, Staphylococcus aureus
GPEGGSGGGTIVATGTPEDIAQTKSSYTGKYLKEVLERD

SEQ ID NO: 1637557 - protein, 16 aa, Staphylococcus aureus
GPEYPTMENKTVQGEI

SEQ ID NO: 1637558 - protein, 11 aa, Staphylococcus aureus
GPFGGGVHTPE

SEQ ID NO: 1637559 - protein, 14 aa, Staphylococcus aureus
GPGDSSLDHTENEQ

SEQ ID NO: 1637560 - protein, 11 aa, Staphylococcus aureus
GPGRGSSAGSL

SEQ ID NO: 1637561 - protein, 6 aa, Staphylococcus aureus
GPGSFP

SEQ ID NO: 1637562 - protein, 7 aa, Staphylococcus aureus
GPHVTTP

SEQ ID NO: 1637563 - protein, 5 aa, Staphylococcus aureus
GPIDE

SEQ ID NO: 1637564 - protein, 20 aa, Staphylococcus aureus
GPILNPDTRYDSHGVYSGSA

SEQ ID NO: 1637565 - protein, 5 aa, Staphylococcus aureus
GPKDF

SEQ ID NO: 1637566 - protein, 6 aa, Staphylococcus aureus
GPMSGL

SEQ ID NO: 1637567 - protein, 24 aa, Staphylococcus aureus
GPNAGEARITNSPFETAEKMRSEV

SEQ ID NO: 1637568 - protein, 13 aa, Staphylococcus aureus
GPNEDFDTYPRQI

SEQ ID NO: 1637569 - protein, 14 aa, Staphylococcus aureus
GPNKEADEKSAYDN

SEQ ID NO: 1637570 - protein, 5 aa, Staphylococcus aureus
GPNNS

SEQ ID NO: 1637571 - protein, 14 aa, Staphylococcus aureus
GPNTEADEKSAYNN

SEQ ID NO: 1637572 - protein, 25 aa, Staphylococcus aureus
GPNTEADEKSAYNNVQVGDGPQQRE

SEQ ID NO: 1637573 - protein, 25 aa, Staphylococcus aureus
GPNTEADEKSAYNNVQVGEGPNIEK

SEQ ID NO: 1637574 - protein, 28 aa, Staphylococcus aureus
GPNTEADEKSAYNNVQVGEGPQHREIGF

SEQ ID NO: 1637575 - protein, 7 aa, Staphylococcus aureus
GPPKEMQ

SEQ ID NO: 1637576 - protein, 9 aa, Staphylococcus aureus
GPPTANGLP

SEQ ID NO: 1637577 - protein, 16 aa, Staphylococcus aureus
GPQHREIGTPISTGNA

SEQ ID NO: 1637578 - protein, 16 aa, Staphylococcus aureus
GPQHREIGTPISTGNV

SEQ ID NO: 1637579 - protein, 12 aa, Staphylococcus aureus
GPQHRSWWKASL

SEQ ID NO: 1637580 - protein, 7 aa, Staphylococcus aureus
GPSEAYT

SEQ ID NO: 1637581 - protein, 8 aa, Staphylococcus aureus
GPSEDNTH

SEQ ID NO: 1637582 - protein, 9 aa, Staphylococcus aureus
GPSGPGKST

SEQ ID NO: 1637583 - protein, 9 aa, Staphylococcus aureus
GPSGTGKTT

SEQ ID NO: 1637584 - protein, 9 aa, Staphylococcus aureus
GPSKTDEEL

SEQ ID NO: 1637585 - protein, 5 aa, Staphylococcus aureus
GPSPM

SEQ ID NO: 1637586 - protein, 6 aa, Staphylococcus aureus
GPTHVP

SEQ ID NO: 1637587 - protein, 7 aa, Staphylococcus aureus
GPTPLPD

SEQ ID NO: 1637588 - protein, 10 aa, Staphylococcus aureus
GPTQKLTKSQ

SEQ ID NO: 1637589 - protein, 11 aa, Staphylococcus aureus
GPVPPNPTELI

SEQ ID NO: 1637590 - protein, 12 aa, Staphylococcus aureus
GQAGGRSAITPE

SEQ ID NO: 1637591 - protein, 4 aa, Staphylococcus aureus
GQAK

SEQ ID NO: 1637592 - protein, 14 aa, Staphylococcus aureus
GQAPNKDNTRIGED

SEQ ID NO: 1637593 - protein, 14 aa, Staphylococcus aureus
GQAPNKNNTTIGQD

SEQ ID NO: 1637594 - protein, 6 aa, Staphylococcus aureus
GQARNL

SEQ ID NO: 1637595 - protein, 17 aa, Staphylococcus aureus
GQAVSGKSTAKQALNNP

SEQ ID NO: 1637596 - protein, 22 aa, Staphylococcus aureus
GQDDKADNLYQGTDADEKKLKA

SEQ ID NO: 1637597 - protein, 15 aa, Staphylococcus aureus
GQDFPTGNGASASDY

SEQ ID NO: 1637598 - protein, 18 aa, Staphylococcus aureus
GQDPHEYEVKPKDIKKLT

SEQ ID NO: 1637599 - protein, 12 aa, Staphylococcus aureus
GQDPSYPVSSPR

SEQ ID NO: 1637600 - protein, 5 aa, Staphylococcus aureus
GQENY

SEQ ID NO: 1637601 - protein, 9 aa, Staphylococcus aureus
GQESDDDMA

SEQ ID NO: 1637602 - protein, 5 aa, Staphylococcus aureus
GQHQR

SEQ ID NO: 1637603 - protein, 22 aa, Staphylococcus aureus
GQHTDDYDATETINASGKVVSP

SEQ ID NO: 1637604 - protein, 5 aa, Staphylococcus aureus
GQISQ

SEQ ID NO: 1637605 - protein, 12 aa, Staphylococcus aureus
GQKKDGEGGRLT

SEQ ID NO: 1637606 - protein, 9 aa, Staphylococcus aureus
GQLSDNGTH

SEQ ID NO: 1637607 - protein, 11 aa, Staphylococcus aureus
GQNISDDELKD

SEQ ID NO: 1637608 - protein, 6 aa, Staphylococcus aureus
GQNNQW

SEQ ID NO: 1637609 - protein, 9 aa, Staphylococcus aureus
GQPQEHQFS

SEQ ID NO: 1637610 - protein, 12 aa, Staphylococcus aureus
GQPQEHQFSKEE

SEQ ID NO: 1637611 - protein, 10 aa, Staphylococcus aureus
GQQAQNVKRT

SEQ ID NO: 1637612 - protein, 24 aa, Staphylococcus aureus
GQQDPPKNKTRQAYEDVIEWVGPK

SEQ ID NO: 1637613 - protein, 6 aa, Staphylococcus aureus
GQQKRG

SEQ ID NO: 1637614 - protein, 10 aa, Staphylococcus aureus
GQQQSKKSSF

SEQ ID NO: 1637615 - protein, 16 aa, Staphylococcus aureus
GQQVADKINAREAMNR

SEQ ID NO: 1637616 - protein, 16 aa, Staphylococcus aureus
GQQVADKINVREAKNR

SEQ ID NO: 1637617 - protein, 9 aa, Staphylococcus aureus
GQSEYRNND

SEQ ID NO: 1637618 - protein, 7 aa, Staphylococcus aureus
GQSLNGR

SEQ ID NO: 1637619 - protein, 7 aa, Staphylococcus aureus
GQSPTLN

SEQ ID NO: 1637620 - protein, 8 aa, Staphylococcus aureus
GQSSYIKN

SEQ ID NO: 1637621 - protein, 9 aa, Staphylococcus aureus
GQTDKEFQT

SEQ ID NO: 1637622 - protein, 8 aa, Staphylococcus aureus
GQTETTID

SEQ ID NO: 1637623 - protein, 4 aa, Staphylococcus aureus
GQTG

SEQ ID NO: 1637624 - protein, 14 aa, Staphylococcus aureus
GQTGTKSKFKQGNK

SEQ ID NO: 1637625 - protein, 5 aa, Staphylococcus aureus
GQTWT

SEQ ID NO: 1637626 - protein, 8 aa, Staphylococcus aureus
GQVAADTT

SEQ ID NO: 1637627 - protein, 12 aa, Staphylococcus aureus
GQVTNQGLASSH

SEQ ID NO: 1637628 - protein, 23 aa, Staphylococcus aureus
GQVTNQGLASSHDLDYKEILNVI

SEQ ID NO: 1637629 - protein, 17 aa, Staphylococcus aureus
GQVYQSKDFRGESKQGP

SEQ ID NO: 1637630 - protein, 4 aa, Staphylococcus aureus
GQYK

SEQ ID NO: 1637631 - protein, 5 aa, Staphylococcus aureus
GRAEL

SEQ ID NO: 1637632 - protein, 13 aa, Staphylococcus aureus
GRDQRDQRKLTIS

SEQ ID NO: 1637633 - protein, 5 aa, Staphylococcus aureus
GRDRN

SEQ ID NO: 1637634 - protein, 4 aa, Staphylococcus aureus
GREA

SEQ ID NO: 1637635 - protein, 5 aa, Staphylococcus aureus
GREEG

SEQ ID NO: 1637636 - protein, 7 aa, Staphylococcus aureus
GREGIRA

SEQ ID NO: 1637637 - protein, 11 aa, Staphylococcus aureus
GREPAPEEIGE

SEQ ID NO: 1637638 - protein, 6 aa, Staphylococcus aureus
GRFSSE

SEQ ID NO: 1637639 - protein, 5 aa, Staphylococcus aureus
GRGAP

SEQ ID NO: 1637640 - protein, 11 aa, Staphylococcus aureus
GRGMNRDKMNH

SEQ ID NO: 1637641 - protein, 5 aa, Staphylococcus aureus
GRGPV

SEQ ID NO: 1637642 - protein, 8 aa, Staphylococcus aureus
GRGSLSVK

SEQ ID NO: 1637643 - protein, 6 aa, Staphylococcus aureus
GRGVAK

SEQ ID NO: 1637644 - protein, 8 aa, Staphylococcus aureus
GRHFDPEP

SEQ ID NO: 1637645 - protein, 5 aa, Staphylococcus aureus
GRIHP

SEQ ID NO: 1637646 - protein, 11 aa, Staphylococcus aureus
GRKAPSPKLAK

SEQ ID NO: 1637647 - protein, 12 aa, Staphylococcus aureus
GRKDSKSKEEVE

SEQ ID NO: 1637648 - protein, 10 aa, Staphylococcus aureus
GRKETDKENS

SEQ ID NO: 1637649 - protein, 6 aa, Staphylococcus aureus
GRKTDE

SEQ ID NO: 1637650 - protein, 10 aa, Staphylococcus aureus
GRKTNENNQL

SEQ ID NO: 1637651 - protein, 7 aa, Staphylococcus aureus
GRLKDTK

SEQ ID NO: 1637652 - protein, 4 aa, Staphylococcus aureus
GRLP

SEQ ID NO: 1637653 - protein, 9 aa, Staphylococcus aureus
GRNGAGKTT

SEQ ID NO: 1637654 - protein, 6 aa, Staphylococcus aureus
GRNVGE

SEQ ID NO: 1637655 - protein, 9 aa, Staphylococcus aureus
GRPKGERVS

SEQ ID NO: 1637656 - protein, 8 aa, Staphylococcus aureus
GRPKGQRV

SEQ ID NO: 1637657 - protein, 15 aa, Staphylococcus aureus
GRPTQFGISEDDVDD

SEQ ID NO: 1637658 - protein, 15 aa, Staphylococcus aureus
GRPTQFGVSEDEVDD

SEQ ID NO: 1637659 - protein, 12 aa, Staphylococcus aureus
GRQSSSNAGQNF

SEQ ID NO: 1637660 - protein, 4 aa, Staphylococcus aureus
GRRH

SEQ ID NO: 1637661 - protein, 6 aa, Staphylococcus aureus
GRRTCD

SEQ ID NO: 1637662 - protein, 11 aa, Staphylococcus aureus
GRSDKHKKHIP

SEQ ID NO: 1637663 - protein, 7 aa, Staphylococcus aureus
GRSENKY

SEQ ID NO: 1637664 - protein, 5 aa, Staphylococcus aureus
GRSGK

SEQ ID NO: 1637665 - protein, 19 aa, Staphylococcus aureus
GRSKDKNGTSWVGENTRAP

SEQ ID NO: 1637666 - protein, 14 aa, Staphylococcus aureus
GRSRRVITDTKATL

SEQ ID NO: 1637667 - protein, 6 aa, Staphylococcus aureus
GRSYKD

SEQ ID NO: 1637668 - protein, 8 aa, Staphylococcus aureus
GRTKAGGD

SEQ ID NO: 1637669 - protein, 14 aa, Staphylococcus aureus
GRTKSGTLQLETDD

SEQ ID NO: 1637670 - protein, 7 aa, Staphylococcus aureus
GRTTPLT

SEQ ID NO: 1637671 - protein, 5 aa, Staphylococcus aureus
GRVTA

SEQ ID NO: 1637672 - protein, 9 aa, Staphylococcus aureus
GRYSGRIDN

SEQ ID NO: 1637673 - protein, 12 aa, Staphylococcus aureus
GRYSKETIHHPE

SEQ ID NO: 1637674 - protein, 13 aa, Staphylococcus aureus
GRYSKKTIRHPET

SEQ ID NO: 1637675 - protein, 28 aa, Staphylococcus aureus
GSAPNKENDLEDNVGNADTPNPKEFEPT

SEQ ID NO: 1637676 - protein, 8 aa, Staphylococcus aureus
GSDDLAES

SEQ ID NO: 1637677 - protein, 13 aa, Staphylococcus aureus
GSDGAQLSTDASE

SEQ ID NO: 1637678 - protein, 15 aa, Staphylococcus aureus
GSDQVSAYKPNPEGI

SEQ ID NO: 1637679 - protein, 10 aa, Staphylococcus aureus
GSDSLKSAER

SEQ ID NO: 1637680 - protein, 4 aa, Staphylococcus aureus
GSEF

SEQ ID NO: 1637681 - protein, 7 aa, Staphylococcus aureus
GSEGMQA

SEQ ID NO: 1637682 - protein, 5 aa, Staphylococcus aureus
GSEKR

SEQ ID NO: 1637683 - protein, 10 aa, Staphylococcus aureus
GSENNVTATT

SEQ ID NO: 1637684 - protein, 6 aa, Staphylococcus aureus
GSENTV

SEQ ID NO: 1637685 - protein, 6 aa, Staphylococcus aureus
GSESAE

SEQ ID NO: 1637686 - protein, 4 aa, Staphylococcus aureus
GSEV

SEQ ID NO: 1637687 - protein, 5 aa, Staphylococcus aureus
GSEVN

SEQ ID NO: 1637688 - protein, 5 aa, Staphylococcus aureus
GSEYP

SEQ ID NO: 1637689 - protein, 5 aa, Staphylococcus aureus
GSFNS

SEQ ID NO: 1637690 - protein, 5 aa, Staphylococcus aureus
GSGEV

SEQ ID NO: 1637691 - protein, 13 aa, Staphylococcus aureus
GSGGNYALSAGRA

SEQ ID NO: 1637692 - protein, 15 aa, Staphylococcus aureus
GSGGNYALSAGRALK

SEQ ID NO: 1637693 - protein, 7 aa, Staphylococcus aureus
GSGIGDI

SEQ ID NO: 1637694 - protein, 10 aa, Staphylococcus aureus
GSGKDESEKN

SEQ ID NO: 1637695 - protein, 11 aa, Staphylococcus aureus
GSGNLDGSSIG

SEQ ID NO: 1637696 - protein, 12 aa, Staphylococcus aureus
GSGSLKGSSVGY

SEQ ID NO: 1637697 - protein, 10 aa, Staphylococcus aureus
GSGSPENVEK

SEQ ID NO: 1637698 - protein, 7 aa, Staphylococcus aureus
GSIEPGK

SEQ ID NO: 1637699 - protein, 6 aa, Staphylococcus aureus
GSIETF

SEQ ID NO: 1637700 - protein, 11 aa, Staphylococcus aureus
GSISKKTSEKL

SEQ ID NO: 1637701 - protein, 8 aa, Staphylococcus aureus
GSISNYTG

SEQ ID NO: 1637702 - protein, 15 aa, Staphylococcus aureus
GSIVNTSSFSGQAAD

SEQ ID NO: 1637703 - protein, 11 aa, Staphylococcus aureus
GSKDTANIYKG

SEQ ID NO: 1637704 - protein, 6 aa, Staphylococcus aureus
GSKGKR

SEQ ID NO: 1637705 - protein, 8 aa, Staphylococcus aureus
GSKIDGSK

SEQ ID NO: 1637706 - protein, 6 aa, Staphylococcus aureus
GSKIGT

SEQ ID NO: 1637707 - protein, 4 aa, Staphylococcus aureus
GSKS

SEQ ID NO: 1637708 - protein, 10 aa, Staphylococcus aureus
GSKVDKNSGL

SEQ ID NO: 1637709 - protein, 11 aa, Staphylococcus aureus
GSKVSTEDFEG

SEQ ID NO: 1637710 - protein, 9 aa, Staphylococcus aureus
GSMGKSSTR

SEQ ID NO: 1637711 - protein, 12 aa, Staphylococcus aureus
GSPNRKGSNATY

SEQ ID NO: 1637712 - protein, 8 aa, Staphylococcus aureus
GSQGDKAV

SEQ ID NO: 1637713 - protein, 22 aa, Staphylococcus aureus
GSQHREIGTTISTGNASWGGTT

SEQ ID NO: 1637714 - protein, 48 aa, Staphylococcus aureus
GSQSDKSTQGEEAQREDVPANLNDNDSDIEEKSEETEPKKGFWSRLFG

SEQ ID NO: 1637715 - protein, 9 aa, Staphylococcus aureus
GSQTAKGIY

SEQ ID NO: 1637716 - protein, 14 aa, Staphylococcus aureus
GSRANINIPKDEFQ

SEQ ID NO: 1637717 - protein, 14 aa, Staphylococcus aureus
GSRARGTHTEDSDI

SEQ ID NO: 1637718 - protein, 10 aa, Staphylococcus aureus
GSRFPKNNEE

SEQ ID NO: 1637719 - protein, 13 aa, Staphylococcus aureus
GSRRITDRKRDRI

SEQ ID NO: 1637720 - protein, 8 aa, Staphylococcus aureus
GSRSSAIK

SEQ ID NO: 1637721 - protein, 6 aa, Staphylococcus aureus
GSRVPE

SEQ ID NO: 1637722 - protein, 14 aa, Staphylococcus aureus
GSSPMRKKSGPINK

SEQ ID NO: 1637723 - protein, 10 aa, Staphylococcus aureus
GSSRSGSEDF

SEQ ID NO: 1637724 - protein, 10 aa, Staphylococcus aureus
GSSSAQRTKK

SEQ ID NO: 1637725 - protein, 14 aa, Staphylococcus aureus
GSSTENLDKFPEKA

SEQ ID NO: 1637726 - protein, 10 aa, Staphylococcus aureus
GSSVSNATQI

SEQ ID NO: 1637727 - protein, 12 aa, Staphylococcus aureus
GSTFESISGNDI

SEQ ID NO: 1637728 - protein, 15 aa, Staphylococcus aureus
GSTPLKSNKKFYENG

SEQ ID NO: 1637729 - protein, 7 aa, Staphylococcus aureus
GSTSPLT

SEQ ID NO: 1637730 - protein, 17 aa, Staphylococcus aureus
GSTTTTIKQIDELEKVV

SEQ ID NO: 1637731 - protein, 8 aa, Staphylococcus aureus
GSVDAKSS

SEQ ID NO: 1637732 - protein, 9 aa, Staphylococcus aureus
GSYGRNSIS

SEQ ID NO: 1637733 - protein, 7 aa, Staphylococcus aureus
GSYPYYG

SEQ ID NO: 1637734 - protein, 19 aa, Staphylococcus aureus
GSYYGQRNRISKEKTPKWL

SEQ ID NO: 1637735 - protein, 6 aa, Staphylococcus aureus
GTATAF

SEQ ID NO: 1637736 - protein, 10 aa, Staphylococcus aureus
GTDKEAPQNI

SEQ ID NO: 1637737 - protein, 11 aa, Staphylococcus aureus
GTDKELSETTL

SEQ ID NO: 1637738 - protein, 6 aa, Staphylococcus aureus
GTDRSC

SEQ ID NO: 1637739 - protein, 8 aa, Staphylococcus aureus
GTEGPGVS

SEQ ID NO: 1637740 - protein, 15 aa, Staphylococcus aureus
GTEKGFDFREYFIQV

SEQ ID NO: 1637741 - protein, 4 aa, Staphylococcus aureus
GTEL

SEQ ID NO: 1637742 - protein, 13 aa, Staphylococcus aureus
GTENEWETGAGTR

SEQ ID NO: 1637743 - protein, 7 aa, Staphylococcus aureus
GTFNPAD

SEQ ID NO: 1637744 - protein, 8 aa, Staphylococcus aureus
GTFPKEYE

SEQ ID NO: 1637745 - protein, 12 aa, Staphylococcus aureus
GTGDLKGSSIGH

SEQ ID NO: 1637746 - protein, 8 aa, Staphylococcus aureus
GTGDYNAN

SEQ ID NO: 1637747 - protein, 9 aa, Staphylococcus aureus
GTGEQKINL

SEQ ID NO: 1637748 - protein, 16 aa, Staphylococcus aureus
GTGGNSGWSIIEGKVV

SEQ ID NO: 1637749 - protein, 16 aa, Staphylococcus aureus
GTGGNSGWSIIKGEEV

SEQ ID NO: 1637750 - protein, 11 aa, Staphylococcus aureus
GTGKTTFLTKD

SEQ ID NO: 1637751 - protein, 6 aa, Staphylococcus aureus
GTGNML

SEQ ID NO: 1637752 - protein, 4 aa, Staphylococcus aureus
GTGR

SEQ ID NO: 1637753 - protein, 16 aa, Staphylococcus aureus
GTGRVRNMPTAAHTKD

SEQ ID NO: 1637754 - protein, 9 aa, Staphylococcus aureus
GTGVGLPES

SEQ ID NO: 1637755 - protein, 5 aa, Staphylococcus aureus
GTGYI

SEQ ID NO: 1637756 - protein, 6 aa, Staphylococcus aureus
GTHAGG

SEQ ID NO: 1637757 - protein, 5 aa, Staphylococcus aureus
GTHDD

SEQ ID NO: 1637758 - protein, 4 aa, Staphylococcus aureus
GTHE

SEQ ID NO: 1637759 - protein, 7 aa, Staphylococcus aureus
GTHPNSK

SEQ ID NO: 1637760 - protein, 8 aa, Staphylococcus aureus
GTIKDHGD

SEQ ID NO: 1637761 - protein, 22 aa, Staphylococcus aureus
GTINEQRKTISTYSSTNKVDNE

SEQ ID NO: 1637762 - protein, 9 aa, Staphylococcus aureus
GTINTSDKA

SEQ ID NO: 1637763 - protein, 10 aa, Staphylococcus aureus
GTKAGADMKD

SEQ ID NO: 1637764 - protein, 16 aa, Staphylococcus aureus
GTKTETSDRTVDIPQN

SEQ ID NO: 1637765 - protein, 4 aa, Staphylococcus aureus
GTLD

SEQ ID NO: 1637766 - protein, 4 aa, Staphylococcus aureus
GTLP

SEQ ID NO: 1637767 - protein, 8 aa, Staphylococcus aureus
GTLQEASR

SEQ ID NO: 1637768 - protein, 5 aa, Staphylococcus aureus
GTLTN

SEQ ID NO: 1637769 - protein, 26 aa, Staphylococcus aureus
GTMDKVREREKDNSGTTNIDDIDWDN

SEQ ID NO: 1637770 - protein, 26 aa, Staphylococcus aureus
GTMDKVREREKDSSGTTNIDDIDWDN

SEQ ID NO: 1637771 - protein, 5 aa, Staphylococcus aureus
GTMGA

SEQ ID NO: 1637772 - protein, 13 aa, Staphylococcus aureus
GTNIDRIEVNLKS

SEQ ID NO: 1637773 - protein, 11 aa, Staphylococcus aureus
GTNISKNAINA

SEQ ID NO: 1637774 - protein, 17 aa, Staphylococcus aureus
GTNTQNYQDDFKKESQR

SEQ ID NO: 1637775 - protein, 14 aa, Staphylococcus aureus
GTNVHNDASETIKD

SEQ ID NO: 1637776 - protein, 5 aa, Staphylococcus aureus
GTNVN

SEQ ID NO: 1637777 - protein, 5 aa, Staphylococcus aureus
GTPGR

SEQ ID NO: 1637778 - protein, 8 aa, Staphylococcus aureus
GTPGTGKT

SEQ ID NO: 1637779 - protein, 23 aa, Staphylococcus aureus
GTPISTNNASWRGPNIKKYFFFR

SEQ ID NO: 1637780 - protein, 14 aa, Staphylococcus aureus
GTPQKHSRDPYWFD

SEQ ID NO: 1637781 - protein, 4 aa, Staphylococcus aureus
GTPV

SEQ ID NO: 1637782 - protein, 8 aa, Staphylococcus aureus
GTQEQVRA

SEQ ID NO: 1637783 - protein, 63 aa, Staphylococcus aureus
GTSGVGGVGVSGSLGTSGVGGVGVSGSLGTSGVGGVGVSGSLGTSGVGGVGGTIGGVVSSSIV

SEQ ID NO: 1637784 - protein, 12 aa, Staphylococcus aureus
GTSKNNKPFSRY

SEQ ID NO: 1637785 - protein, 13 aa, Staphylococcus aureus
GTSKNNKPFSRYG

SEQ ID NO: 1637786 - protein, 4 aa, Staphylococcus aureus
GTTD

SEQ ID NO: 1637787 - protein, 8 aa, Staphylococcus aureus
GTTSTKSV

SEQ ID NO: 1637788 - protein, 9 aa, Staphylococcus aureus
GTTSTKSVL

SEQ ID NO: 1637789 - protein, 11 aa, Staphylococcus aureus
GTTSTRTLETI

SEQ ID NO: 1637790 - protein, 22 aa, Staphylococcus aureus
GTTVSAEVNQNDRRDIQKNHSA

SEQ ID NO: 1637791 - protein, 5 aa, Staphylococcus aureus
GTVAH

SEQ ID NO: 1637792 - protein, 27 aa, Staphylococcus aureus
GTVDTPKEDGIDDGSDIPVAPNTLGKS

SEQ ID NO: 1637793 - protein, 27 aa, Staphylococcus aureus
GTVDTPKEDGVDDGSDIPAAPNTLGKS

SEQ ID NO: 1637794 - protein, 13 aa, Staphylococcus aureus
GTVEDDGIEYTEP

SEQ ID NO: 1637795 - protein, 22 aa, Staphylococcus aureus
GTVGGAGTGGLGGASAASVIPG

SEQ ID NO: 1637796 - protein, 19 aa, Staphylococcus aureus
GTVSGRKLNSLTSEMPKVR

SEQ ID NO: 1637797 - protein, 13 aa, Staphylococcus aureus
GTVTDDYYKEKSY

SEQ ID NO: 1637798 - protein, 4 aa, Staphylococcus aureus
GTWY

SEQ ID NO: 1637799 - protein, 11 aa, Staphylococcus aureus
GVAPKDKYEAL

SEQ ID NO: 1637800 - protein, 5 aa, Staphylococcus aureus
GVDEN

SEQ ID NO: 1637801 - protein, 17 aa, Staphylococcus aureus
GVDNGDVDDALTQGKAA

SEQ ID NO: 1637802 - protein, 6 aa, Staphylococcus aureus
GVDQTR

SEQ ID NO: 1637803 - protein, 7 aa, Staphylococcus aureus
GVGKTTV

SEQ ID NO: 1637804 - protein, 23 aa, Staphylococcus aureus
GVGPSTKRISKGNSTDNASWGRT

SEQ ID NO: 1637805 - protein, 9 aa, Staphylococcus aureus
GVKKATADA

SEQ ID NO: 1637806 - protein, 16 aa, Staphylococcus aureus
GVKKGEFTSMGKNKHT

SEQ ID NO: 1637807 - protein, 10 aa, Staphylococcus aureus
GVLARNGHTE

SEQ ID NO: 1637808 - protein, 11 aa, Staphylococcus aureus
GVLARNGHTEA

SEQ ID NO: 1637809 - protein, 11 aa, Staphylococcus aureus
GVLENQGAAFN

SEQ ID NO: 1637810 - protein, 7 aa, Staphylococcus aureus
GVNGGGW

SEQ ID NO: 1637811 - protein, 5 aa, Staphylococcus aureus
GVNGI

SEQ ID NO: 1637812 - protein, 11 aa, Staphylococcus aureus
GVNKNISESNF

SEQ ID NO: 1637813 - protein, 14 aa, Staphylococcus aureus
GVNKPNTDGDKPHW

SEQ ID NO: 1637814 - protein, 10 aa, Staphylococcus aureus
GVNVGNKKDY

SEQ ID NO: 1637815 - protein, 14 aa, Staphylococcus aureus
GVNVGNKKRLWLIL

SEQ ID NO: 1637816 - protein, 5 aa, Staphylococcus aureus
GVPAD

SEQ ID NO: 1637817 - protein, 6 aa, Staphylococcus aureus
GVPGCG

SEQ ID NO: 1637818 - protein, 15 aa, Staphylococcus aureus
GVPSSQGYIDASETL

SEQ ID NO: 1637819 - protein, 5 aa, Staphylococcus aureus
GVRSS

SEQ ID NO: 1637820 - protein, 13 aa, Staphylococcus aureus
GVSDELGGQGVGK

SEQ ID NO: 1637821 - protein, 5 aa, Staphylococcus aureus
GVSER

SEQ ID NO: 1637822 - protein, 11 aa, Staphylococcus aureus
GVSERGSHPVY

SEQ ID NO: 1637823 - protein, 13 aa, Staphylococcus aureus
GVSGDSVYPTSSV

SEQ ID NO: 1637824 - protein, 10 aa, Staphylococcus aureus
GVSKETEKAL

SEQ ID NO: 1637825 - protein, 8 aa, Staphylococcus aureus
GVSKSTVS

SEQ ID NO: 1637826 - protein, 13 aa, Staphylococcus aureus
GVSLSNDEKELIE

SEQ ID NO: 1637827 - protein, 15 aa, Staphylococcus aureus
GVSPSKRQAREDVNN

SEQ ID NO: 1637828 - protein, 19 aa, Staphylococcus aureus
GVTKIGDGDVEKVAKEKPD

SEQ ID NO: 1637829 - protein, 6 aa, Staphylococcus aureus
GVTSTT

SEQ ID NO: 1637830 - protein, 9 aa, Staphylococcus aureus
GWNNDTEYT

SEQ ID NO: 1637831 - protein, 6 aa, Staphylococcus aureus
GWRDSE

SEQ ID NO: 1637832 - protein, 9 aa, Staphylococcus aureus
GWSADYPDP

SEQ ID NO: 1637833 - protein, 12 aa, Staphylococcus aureus
GWTGNQDEKDIN

SEQ ID NO: 1637834 - protein, 5 aa, Staphylococcus aureus
GYDER

SEQ ID NO: 1637835 - protein, 4 aa, Staphylococcus aureus
GYDI

SEQ ID NO: 1637836 - protein, 26 aa, Staphylococcus aureus
GYDSKGKKIQKYRSGFNTKKEAREEY

SEQ ID NO: 1637837 - protein, 8 aa, Staphylococcus aureus
GYEEHDEE

SEQ ID NO: 1637838 - protein, 17 aa, Staphylococcus aureus
GYEKRSINEMSGGQKQR

SEQ ID NO: 1637839 - protein, 10 aa, Staphylococcus aureus
GYENTNSYDQ

SEQ ID NO: 1637840 - protein, 14 aa, Staphylococcus aureus
GYEQQYDDLNVVVA

SEQ ID NO: 1637841 - protein, 9 aa, Staphylococcus aureus
GYESREEGY

SEQ ID NO: 1637842 - protein, 10 aa, Staphylococcus aureus
GYEVKNKTKD

SEQ ID NO: 1637843 - protein, 5 aa, Staphylococcus aureus
GYGGG

SEQ ID NO: 1637844 - protein, 4 aa, Staphylococcus aureus
GYHD

SEQ ID NO: 1637845 - protein, 20 aa, Staphylococcus aureus
GYHEDKSGKLFKEKDPKYKL

SEQ ID NO: 1637846 - protein, 10 aa, Staphylococcus aureus
GYIDSASLNG

SEQ ID NO: 1637847 - protein, 7 aa, Staphylococcus aureus
GYKDDDV

SEQ ID NO: 1637848 - protein, 9 aa, Staphylococcus aureus
GYNGSGKSV

SEQ ID NO: 1637849 - protein, 5 aa, Staphylococcus aureus
GYQET

SEQ ID NO: 1637850 - protein, 9 aa, Staphylococcus aureus
GYQGNKNGT

SEQ ID NO: 1637851 - protein, 5 aa, Staphylococcus aureus
GYSDN

SEQ ID NO: 1637852 - protein, 11 aa, Staphylococcus aureus
GYTKNKKSRKY

SEQ ID NO: 1637853 - protein, 7 aa, Staphylococcus aureus
GYVSPSD

SEQ ID NO: 1637854 - protein, 8 aa, Staphylococcus aureus
HAADDVEY

SEQ ID NO: 1637855 - protein, 7 aa, Staphylococcus aureus
HADGEKC

SEQ ID NO: 1637856 - protein, 28 aa, Staphylococcus aureus
HAETENDYQNVQQYSEQKPSADSTQTEI

SEQ ID NO: 1637857 - protein, 6 aa, Staphylococcus aureus
HAETVS

SEQ ID NO: 1637858 - protein, 16 aa, Staphylococcus aureus
HAGKDADESETSESFK

SEQ ID NO: 1637859 - protein, 7 aa, Staphylococcus aureus
HAGVEAG

SEQ ID NO: 1637860 - protein, 7 aa, Staphylococcus aureus
HAHPSTS

SEQ ID NO: 1637861 - protein, 12 aa, Staphylococcus aureus
HAITNDSDFEQA

SEQ ID NO: 1637862 - protein, 9 aa, Staphylococcus aureus
HAKRKMTEK

SEQ ID NO: 1637863 - protein, 17 aa, Staphylococcus aureus
HANDNDKSNIKRIRVLK

SEQ ID NO: 1637864 - protein, 17 aa, Staphylococcus aureus
HANDNEKSNLKKIRVLK

SEQ ID NO: 1637865 - protein, 9 aa, Staphylococcus aureus
HANETGEIT

SEQ ID NO: 1637866 - protein, 9 aa, Staphylococcus aureus
HAPEWTKDR

SEQ ID NO: 1637867 - protein, 14 aa, Staphylococcus aureus
HAPVESLTENERRL

SEQ ID NO: 1637868 - protein, 18 aa, Staphylococcus aureus
HAQGSTGYNYDGEHFGDN

SEQ ID NO: 1637869 - protein, 8 aa, Staphylococcus aureus
HAQQQTLT

SEQ ID NO: 1637870 - protein, 5 aa, Staphylococcus aureus
HAREN

SEQ ID NO: 1637871 - protein, 7 aa, Staphylococcus aureus
HARREIT

SEQ ID NO: 1637872 - protein, 19 aa, Staphylococcus aureus
HARRKMTEKIGHDNQPVET

SEQ ID NO: 1637873 - protein, 15 aa, Staphylococcus aureus
HARSTKVKNLNSAIE

SEQ ID NO: 1637874 - protein, 4 aa, Staphylococcus aureus
HASN

SEQ ID NO: 1637875 - protein, 21 aa, Staphylococcus aureus
HATKDTRTRDTHRHLDGESVE

SEQ ID NO: 1637876 - protein, 34 aa, Staphylococcus aureus
HATKDTRTRDTHRHLDGESVEIDQNFKSSGCVGQ

SEQ ID NO: 1637877 - protein, 5 aa, Staphylococcus aureus
HATQQ

SEQ ID NO: 1637878 - protein, 9 aa, Staphylococcus aureus
HATSNNEDF

SEQ ID NO: 1637879 - protein, 7 aa, Staphylococcus aureus
HATSQLE

SEQ ID NO: 1637880 - protein, 10 aa, Staphylococcus aureus
HAYEKPNPKV

SEQ ID NO: 1637881 - protein, 7 aa, Staphylococcus aureus
HAYPESY

SEQ ID NO: 1637882 - protein, 7 aa, Staphylococcus aureus
HCNNDDN

SEQ ID NO: 1637883 - protein, 14 aa, Staphylococcus aureus
HCSKTGAHIVPYID

SEQ ID NO: 1637884 - protein, 8 aa, Staphylococcus aureus
HDAFKNRN

SEQ ID NO: 1637885 - protein, 11 aa, Staphylococcus aureus
HDAGYNVKEDF

SEQ ID NO: 1637886 - protein, 4 aa, Staphylococcus aureus
HDDP

SEQ ID NO: 1637887 - protein, 8 aa, Staphylococcus aureus
HDDSLNRD

SEQ ID NO: 1637888 - protein, 10 aa, Staphylococcus aureus
HDDSQNRDYN

SEQ ID NO: 1637889 - protein, 10 aa, Staphylococcus aureus
HDEGGQLTEA

SEQ ID NO: 1637890 - protein, 14 aa, Staphylococcus aureus
HDGSTNKYIHVGLQ

SEQ ID NO: 1637891 - protein, 24 aa, Staphylococcus aureus
HDKEDSHKCGDDSHAPRPPEGADW

SEQ ID NO: 1637892 - protein, 37 aa, Staphylococcus aureus; identical to SEQ ID NO: 1568064

SEQ ID NO: 1637893 - protein, 6 aa, Staphylococcus aureus
HDNQYE

SEQ ID NO: 1637894 - protein, 5 aa, Staphylococcus aureus
HDQGA

SEQ ID NO: 1637895 - protein, 9 aa, Staphylococcus aureus
HDQNTVKQS

SEQ ID NO: 1637896 - protein, 19 aa, Staphylococcus aureus
HDRITTKRTVKDGNGKKQS

SEQ ID NO: 1637897 - protein, 13 aa, Staphylococcus aureus
HDTTKEDALTGEE

SEQ ID NO: 1637898 - protein, 12 aa, Staphylococcus aureus
HDVQEESARRAV

SEQ ID NO: 1637899 - protein, 12 aa, Staphylococcus aureus
HDVQEESSRRAV

SEQ ID NO: 1637900 - protein, 4 aa, Staphylococcus aureus
HDYQ

SEQ ID NO: 1637901 - protein, 19 aa, Staphylococcus aureus
HEDNENEVYSLTGAHFSDE

SEQ ID NO: 1637902 - protein, 5 aa, Staphylococcus aureus
HEDTY

SEQ ID NO: 1637903 - protein, 10 aa, Staphylococcus aureus
HEFSGGQRQR

SEQ ID NO: 1637904 - protein, 5 aa, Staphylococcus aureus
HEGAL

SEQ ID NO: 1637905 - protein, 12 aa, Staphylococcus aureus
HEGALNEIETSR

SEQ ID NO: 1637906 - protein, 7 aa, Staphylococcus aureus
HEITRDQ

SEQ ID NO: 1637907 - protein, 12 aa, Staphylococcus aureus
HEKGKGDKSEFE

SEQ ID NO: 1637908 - protein, 6 aa, Staphylococcus aureus
HEKGQY

SEQ ID NO: 1637909 - protein, 7 aa, Staphylococcus aureus
HEKTNKP

SEQ ID NO: 1637910 - protein, 7 aa, Staphylococcus aureus
HELSGGM

SEQ ID NO: 1637911 - protein, 8 aa, Staphylococcus aureus
HENDDGDL

SEQ ID NO: 1637912 - protein, 5 aa, Staphylococcus aureus
HENRT

SEQ ID NO: 1637913 - protein, 9 aa, Staphylococcus aureus
HEPGNYNAI

SEQ ID NO: 1637914 - protein, 4 aa, Staphylococcus aureus
HEPH

SEQ ID NO: 1637915 - protein, 8 aa, Staphylococcus aureus
HEPNHNLN

SEQ ID NO: 1637916 - protein, 8 aa, Staphylococcus aureus
HEQEQPAY

SEQ ID NO: 1637917 - protein, 11 aa, Staphylococcus aureus
HEQTGISRNSI

SEQ ID NO: 1637918 - protein, 12 aa, Staphylococcus aureus
HEQTPWKNKEKL

SEQ ID NO: 1637919 - protein, 7 aa, Staphylococcus aureus
HESPEMT

SEQ ID NO: 1637920 - protein, 11 aa, Staphylococcus aureus
HETQSKTKQKT

SEQ ID NO: 1637921 - protein, 20 aa, Staphylococcus aureus
HEYAPSSIKDLQNNSINKID

SEQ ID NO: 1637922 - protein, 6 aa, Staphylococcus aureus
HEYEQS

SEQ ID NO: 1637923 - protein, 6 aa, Staphylococcus aureus
HFARKA

SEQ ID NO: 1637924 - protein, 6 aa, Staphylococcus aureus
HGDTEL

SEQ ID NO: 1637925 - protein, 6 aa, Staphylococcus aureus
HGEEEV

SEQ ID NO: 1637926 - protein, 9 aa, Staphylococcus aureus
HGEHSGEDF

SEQ ID NO: 1637927 - protein, 11 aa, Staphylococcus aureus
HGGARSNSTLQ

SEQ ID NO: 1637928 - protein, 21 aa, Staphylococcus aureus
HGGATNKTQCSYGGVTLSDNN

SEQ ID NO: 1637929 - protein, 49 aa, Staphylococcus aureus
HGGSDQGASSNTKYKSLEKDYTLKTAKELQRTLEKEGATVKMTRTDDTY

SEQ ID NO: 1637930 - protein, 15 aa, Staphylococcus aureus
HGHAKEDIQLQDSDV

SEQ ID NO: 1637931 - protein, 15 aa, Staphylococcus aureus
HGHGKEDLQLQDSDV

SEQ ID NO: 1637932 - protein, 15 aa, Staphylococcus aureus
HGHSKEDIQLQDSDV

SEQ ID NO: 1637933 - protein, 7 aa, Staphylococcus aureus
HGRERKG

SEQ ID NO: 1637934 - protein, 10 aa, Staphylococcus aureus
HGRGISKKDM

SEQ ID NO: 1637935 - protein, 15 aa, Staphylococcus aureus
HGSGQSSSYSNKKTK

SEQ ID NO: 1637936 - protein, 5 aa, Staphylococcus aureus
HGSNN

SEQ ID NO: 1637937 - protein, 5 aa, Staphylococcus aureus
HGSTQ

SEQ ID NO: 1637938 - protein, 13 aa, Staphylococcus aureus
HGTDTNDHGDFNG

SEQ ID NO: 1637939 - protein, 14 aa, Staphylococcus aureus
HGTNVEYDQALVRI

SEQ ID NO: 1637940 - protein, 7 aa, Staphylococcus aureus
HGTPTDK

SEQ ID NO: 1637941 - protein, 11 aa, Staphylococcus aureus
HGYDNTVKDPN

SEQ ID NO: 1637942 - protein, 17 aa, Staphylococcus aureus
HGYNDSGAVGNGTNERD

SEQ ID NO: 1637943 - protein, 11 aa, Staphylococcus aureus
HHGSKTSSSKE

SEQ ID NO: 1637944 - protein, 6 aa, Staphylococcus aureus
HHHNQN

SEQ ID NO: 1637945 - protein, 4 aa, Staphylococcus aureus
HHPE

SEQ ID NO: 1637946 - protein, 7 aa, Staphylococcus aureus
HHSSIDS

SEQ ID NO: 1637947 - protein, 19 aa, Staphylococcus aureus
HIPNGDAYDMNAEASKYND

SEQ ID NO: 1637948 - protein, 7 aa, Staphylococcus aureus
HISGETY

SEQ ID NO: 1637949 - protein, 5 aa, Staphylococcus aureus
HISTS

SEQ ID NO: 1637950 - protein, 5 aa, Staphylococcus aureus
HITTS

SEQ ID NO: 1637951 - protein, 14 aa, Staphylococcus aureus
HKAVRAQQNGEFDS

SEQ ID NO: 1637952 - protein, 8 aa, Staphylococcus aureus
HKDDRERM

SEQ ID NO: 1637953 - protein, 7 aa, Staphylococcus aureus
HKDHTQL

SEQ ID NO: 1637954 - protein, 8 aa, Staphylococcus aureus
HKDKLQNV

SEQ ID NO: 1637955 - protein, 4 aa, Staphylococcus aureus
HKDT

SEQ ID NO: 1637956 - protein, 6 aa, Staphylococcus aureus
HKEKVV

SEQ ID NO: 1637957 - protein, 13 aa, Staphylococcus aureus
HKETIDKYSYSAT

SEQ ID NO: 1637958 - protein, 7 aa, Staphylococcus aureus
HKGNYAP

SEQ ID NO: 1637959 - protein, 44 aa, Staphylococcus aureus
HKKAARDAINQATATKRQQINSNREATQEEKNAALNELTQATNH

SEQ ID NO: 1637960 - protein, 12 aa, Staphylococcus aureus
HKKAYYKWRIDE

SEQ ID NO: 1637961 - protein, 10 aa, Staphylococcus aureus
HKKIKSELSK

SEQ ID NO: 1637962 - protein, 7 aa, Staphylococcus aureus
HKKPTVS

SEQ ID NO: 1637963 - protein, 4 aa, Staphylococcus aureus
HKND

SEQ ID NO: 1637964 - protein, 11 aa, Staphylococcus aureus
HKNDTPPENPV

SEQ ID NO: 1637965 - protein, 7 aa, Staphylococcus aureus
HKNEWSK

SEQ ID NO: 1637966 - protein, 9 aa, Staphylococcus aureus
HKPEKYTEK

SEQ ID NO: 1637967 - protein, 12 aa, Staphylococcus aureus
HKPSGAKPGFVT

SEQ ID NO: 1637968 - protein, 14 aa, Staphylococcus aureus
HKQNDTKKSKIKVT

SEQ ID NO: 1637969 - protein, 4 aa, Staphylococcus aureus
HKQQ

SEQ ID NO: 1637970 - protein, 10 aa, Staphylococcus aureus
HKSSSTDLAH

SEQ ID NO: 1637971 - protein, 7 aa, Staphylococcus aureus
HKTEQVP

SEQ ID NO: 1637972 - protein, 15 aa, Staphylococcus aureus
HKTISTDKVSTNKKI

SEQ ID NO: 1637973 - protein, 19 aa, Staphylococcus aureus
HKVSATSTLNDGSIFTIQF

SEQ ID NO: 1637974 - protein, 18 aa, Staphylococcus aureus
HLDDPVSTDGKKPGTITQ

SEQ ID NO: 1637975 - protein, 18 aa, Staphylococcus aureus
HLDDPVSTEGKKPGTITQ

SEQ ID NO: 1637976 - protein, 5 aa, Staphylococcus aureus
HLDFP

SEQ ID NO: 1637977 - protein, 7 aa, Staphylococcus aureus
HLEDGQA

SEQ ID NO: 1637978 - protein, 9 aa, Staphylococcus aureus
HLEDKKGTT

SEQ ID NO: 1637979 - protein, 4 aa, Staphylococcus aureus
HLER

SEQ ID NO: 1637980 - protein, 7 aa, Staphylococcus aureus
HLKNSDG

SEQ ID NO: 1637981 - protein, 5 aa, Staphylococcus aureus
HLPES

SEQ ID NO: 1637982 - protein, 18 aa, Staphylococcus aureus
HLPGTKTKNSKRDVEVNP

SEQ ID NO: 1637983 - protein, 6 aa, Staphylococcus aureus
HLSGAE

SEQ ID NO: 1637984 - protein, 7 aa, Staphylococcus aureus
HLSGQEV

SEQ ID NO: 1637985 - protein, 10 aa, Staphylococcus aureus
HMKNGQLKPR

SEQ ID NO: 1637986 - protein, 7 aa, Staphylococcus aureus
HMSGGRN

SEQ ID NO: 1637987 - protein, 43 aa, Staphylococcus aureus
HNAEITENVQNEAAESEQNVEEKTIENVNPKKQTEKVSTLSKR

SEQ ID NO: 1637988 - protein, 5 aa, Staphylococcus aureus
HNENA

SEQ ID NO: 1637989 - protein, 14 aa, Staphylococcus aureus
HNEQHAIGVKSFDD

SEQ ID NO: 1637990 - protein, 4 aa, Staphylococcus aureus
HNGT

SEQ ID NO: 1637991 - protein, 6 aa, Staphylococcus aureus
HNGTLT

SEQ ID NO: 1637992 - protein, 30 aa, Staphylococcus aureus
HNINNNGSEANENFNNNKNRIENIEDKQKA

SEQ ID NO: 1637993 - protein, 9 aa, Staphylococcus aureus
HNIQDTEDL

SEQ ID NO: 1637994 - protein, 9 aa, Staphylococcus aureus
HNKKTSDDY

SEQ ID NO: 1637995 - protein, 29 aa, Staphylococcus aureus
HNKSYSQPSNQHQRLATDDDIGNGESIFD

SEQ ID NO: 1637996 - protein, 16 aa, Staphylococcus aureus
HNNDIGKTQISEHSRS

SEQ ID NO: 1637997 - protein, 26 aa, Staphylococcus aureus
HNNDIGKTQISEHSRSLKEIEAESSA

SEQ ID NO: 1637998 - protein, 18 aa, Staphylococcus aureus
HNNSNSSETLKTKVNELE

SEQ ID NO: 1637999 - protein, 5 aa, Staphylococcus aureus
HNQKS

SEQ ID NO: 1638000 - protein, 10 aa, Staphylococcus aureus
HNREHSGTIE

SEQ ID NO: 1638001 - protein, 7 aa, Staphylococcus aureus
HNSENMK

SEQ ID NO: 1638002 - protein, 7 aa, Staphylococcus aureus
HNSLKQG

SEQ ID NO: 1638003 - protein, 14 aa, Staphylococcus aureus
HNTHKLEDWIKKVN

SEQ ID NO: 1638004 - protein, 11 aa, Staphylococcus aureus
HNVHDAQRDAY

SEQ ID NO: 1638005 - protein, 9 aa, Staphylococcus aureus
HPARGPKKE

SEQ ID NO: 1638006 - protein, 16 aa, Staphylococcus aureus
HPDPSVALSDAGQQMN

SEQ ID NO: 1638007 - protein, 7 aa, Staphylococcus aureus
HPDQTPM

SEQ ID NO: 1638008 - protein, 6 aa, Staphylococcus aureus
HPENEL

SEQ ID NO: 1638009 - protein, 16 aa, Staphylococcus aureus
HPGQSSFSLTDLYLLY

SEQ ID NO: 1638010 - protein, 4 aa, Staphylococcus aureus
HPKH

SEQ ID NO: 1638011 - protein, 15 aa, Staphylococcus aureus
HPLNKEQVDQITAIF

SEQ ID NO: 1638012 - protein, 15 aa, Staphylococcus aureus
HPLNKEQVNQITAIF

SEQ ID NO: 1638013 - protein, 9 aa, Staphylococcus aureus
HPPGPSKRI

SEQ ID NO: 1638014 - protein, 7 aa, Staphylococcus aureus
HPPTPFD

SEQ ID NO: 1638015 - protein, 18 aa, Staphylococcus aureus
HPQSDYAKQLISEVPVIA

SEQ ID NO: 1638016 - protein, 6 aa, Staphylococcus aureus
HPRYNT

SEQ ID NO: 1638017 - protein, 25 aa, Staphylococcus aureus
HPSFKSGKKRKSGFKTKAEASNAAQ

SEQ ID NO: 1638018 - protein, 13 aa, Staphylococcus aureus
HPSPNTAKQVYNG

SEQ ID NO: 1638019 - protein, 13 aa, Staphylococcus aureus
HPSVSKKEAAEKD

SEQ ID NO: 1638020 - protein, 9 aa, Staphylococcus aureus
HPTKTHSDI

SEQ ID NO: 1638021 - protein, 4 aa, Staphylococcus aureus
HQAK

SEQ ID NO: 1638022 - protein, 8 aa, Staphylococcus aureus
HQAKMSGV

SEQ ID NO: 1638023 - protein, 7 aa, Staphylococcus aureus
HQDSSEY

SEQ ID NO: 1638024 - protein, 15 aa, Staphylococcus aureus
HQEKRSQVLATFKTL

SEQ ID NO: 1638025 - protein, 9 aa, Staphylococcus aureus
HQFSGGQRQ

SEQ ID NO: 1638026 - protein, 16 aa, Staphylococcus aureus
HQGTNLTQKRESKLQS

SEQ ID NO: 1638027 - protein, 8 aa, Staphylococcus aureus
HQKTPIFE

SEQ ID NO: 1638028 - protein, 5 aa, Staphylococcus aureus
HQMKT

SEQ ID NO: 1638029 - protein, 8 aa, Staphylococcus aureus
HQNSPHRN

SEQ ID NO: 1638030 - protein, 14 aa, Staphylococcus aureus
HQQNQEKPSYDTKQ

SEQ ID NO: 1638031 - protein, 11 aa, Staphylococcus aureus
HQQSNKNKPIK

SEQ ID NO: 1638032 - protein, 4 aa, Staphylococcus aureus
HQTK

SEQ ID NO: 1638033 - protein, 7 aa, Staphylococcus aureus
HQTRRKC

SEQ ID NO: 1638034 - protein, 17 aa, Staphylococcus aureus
HQYDAPNYIEIKSSLIL

SEQ ID NO: 1638035 - protein, 11 aa, Staphylococcus aureus
HRARKENERSY

SEQ ID NO: 1638036 - protein, 6 aa, Staphylococcus aureus
HRDNTV

SEQ ID NO: 1638037 - protein, 7 aa, Staphylococcus aureus
HRDPEKV

SEQ ID NO: 1638038 - protein, 24 aa, Staphylococcus aureus
HRGANHPVKNLETGKVDITSQNHG

SEQ ID NO: 1638039 - protein, 11 aa, Staphylococcus aureus
HRGEEKDSDDV

SEQ ID NO: 1638040 - protein, 8 aa, Staphylococcus aureus
HRKGSHEK

SEQ ID NO: 1638041 - protein, 21 aa, Staphylococcus aureus
HRLSNESNNETRILIVATASY

SEQ ID NO: 1638042 - protein, 6 aa, Staphylococcus aureus
HRNDNN

SEQ ID NO: 1638043 - protein, 5 aa, Staphylococcus aureus
HRPDQ

SEQ ID NO: 1638044 - protein, 14 aa, Staphylococcus aureus
HRQDGAKKSKITVT

SEQ ID NO: 1638045 - protein, 7 aa, Staphylococcus aureus
HRQTGSI

SEQ ID NO: 1638046 - protein, 7 aa, Staphylococcus aureus
HRTESPR

SEQ ID NO: 1638047 - protein, 10 aa, Staphylococcus aureus
HRTNEETGKV

SEQ ID NO: 1638048 - protein, 17 aa, Staphylococcus aureus
HRTTGITEEGKKSSHFT

SEQ ID NO: 1638049 - protein, 8 aa, Staphylococcus aureus
HSDFQPGN

SEQ ID NO: 1638050 - protein, 7 aa, Staphylococcus aureus
HSDRQNE

SEQ ID NO: 1638051 - protein, 6 aa, Staphylococcus aureus
HSDSDD

SEQ ID NO: 1638052 - protein, 7 aa, Staphylococcus aureus
HSEGQIE

SEQ ID NO: 1638053 - protein, 8 aa, Staphylococcus aureus
HSFTKAQR

SEQ ID NO: 1638054 - protein, 7 aa, Staphylococcus aureus
HSHHGSL

SEQ ID NO: 1638055 - protein, 13 aa, Staphylococcus aureus
HSHYHTNKPGTYV

SEQ ID NO: 1638056 - protein, 8 aa, Staphylococcus aureus
HSKDDNTH

SEQ ID NO: 1638057 - protein, 20 aa, Staphylococcus aureus
HSKEHAKETIRKTNGAIRSA

SEQ ID NO: 1638058 - protein, 5 aa, Staphylococcus aureus
HSKGD

SEQ ID NO: 1638059 - protein, 10 aa, Staphylococcus aureus
HSKKAPSRYG

SEQ ID NO: 1638060 - protein, 6 aa, Staphylococcus aureus
HSLGGT

SEQ ID NO: 1638061 - protein, 9 aa, Staphylococcus aureus
HSNEDQPIY

SEQ ID NO: 1638062 - protein, 14 aa, Staphylococcus aureus
HSNVSKATLYNNSK

SEQ ID NO: 1638063 - protein, 12 aa, Staphylococcus aureus
HSQLSKQDIKED

SEQ ID NO: 1638064 - protein, 8 aa, Staphylococcus aureus
HSRSDTLT

SEQ ID NO: 1638065 - protein, 16 aa, Staphylococcus aureus
HSSKEEVRKMSKETRV

SEQ ID NO: 1638066 - protein, 7 aa, Staphylococcus aureus
HSSRDVK

SEQ ID NO: 1638067 - protein, 13 aa, Staphylococcus aureus
HSTNEKGKSVAVK

SEQ ID NO: 1638068 - protein, 10 aa, Staphylococcus aureus
HSVENPHIAT

SEQ ID NO: 1638069 - protein, 23 aa, Staphylococcus aureus
HSVESNKLDDDSSETGKTPEYSL

SEQ ID NO: 1638070 - protein, 19 aa, Staphylococcus aureus
HSVKRNTNAYYRYDRDSIT

SEQ ID NO: 1638071 - protein, 17 aa, Staphylococcus aureus
HTAQSNANTLDQAMNTL

SEQ ID NO: 1638072 - protein, 14 aa, Staphylococcus aureus
HTDEQDRLINLVMK

SEQ ID NO: 1638073 - protein, 10 aa, Staphylococcus aureus
HTDTSDSTGY

SEQ ID NO: 1638074 - protein, 5 aa, Staphylococcus aureus
HTELD

SEQ ID NO: 1638075 - protein, 16 aa, Staphylococcus aureus
HTESGNSGSPVLNSNN

SEQ ID NO: 1638076 - protein, 4 aa, Staphylococcus aureus
HTHN

SEQ ID NO: 1638077 - protein, 23 aa, Staphylococcus aureus
HTKAPRKKEAQQDASTKYYSSDE

SEQ ID NO: 1638078 - protein, 4 aa, Staphylococcus aureus
HTMR

SEQ ID NO: 1638079 - protein, 7 aa, Staphylococcus aureus
HTPSQDK

SEQ ID NO: 1638080 - protein, 16 aa, Staphylococcus aureus
HTPVKEINGEDPIKAD

SEQ ID NO: 1638081 - protein, 6 aa, Staphylococcus aureus
HTSIKG

SEQ ID NO: 1638082 - protein, 11 aa, Staphylococcus aureus
HTTDDYTGAVT

SEQ ID NO: 1638083 - protein, 10 aa, Staphylococcus aureus
HTTETITSYD

SEQ ID NO: 1638084 - protein, 7 aa, Staphylococcus aureus
HTTETPR

SEQ ID NO: 1638085 - protein, 21 aa, Staphylococcus aureus
HTTKDTRTRDTHRHLDGESVE

SEQ ID NO: 1638086 - protein, 16 aa, Staphylococcus aureus
HTYGEKKEERFRGSKY

SEQ ID NO: 1638087 - protein, 5 aa, Staphylococcus aureus
HVDQE

SEQ ID NO: 1638088 - protein, 11 aa, Staphylococcus aureus
HVEDEDKLRTQ

SEQ ID NO: 1638089 - protein, 10 aa, Staphylococcus aureus
HVGQDDAKVK

SEQ ID NO: 1638090 - protein, 8 aa, Staphylococcus aureus
HVKPSTLK

SEQ ID NO: 1638091 - protein, 14 aa, Staphylococcus aureus
HVNESSMVGEPKQM

SEQ ID NO: 1638092 - protein, 10 aa, Staphylococcus aureus
HVNKTTGNTE

SEQ ID NO: 1638093 - protein, 10 aa, Staphylococcus aureus
HVNSTTGKTE

SEQ ID NO: 1638094 - protein, 10 aa, Staphylococcus aureus
HVSETNIKAQ

SEQ ID NO: 1638095 - protein, 6 aa, Staphylococcus aureus
HVSTSR

SEQ ID NO: 1638096 - protein, 28 aa, Staphylococcus aureus
HVTTGEPVCQPRRPNSRIDKVRYMFNKI

SEQ ID NO: 1638097 - protein, 7 aa, Staphylococcus aureus
HYEQDEQ

SEQ ID NO: 1638098 - protein, 16 aa, Staphylococcus aureus
HYNPNNEITKSRNTLD

SEQ ID NO: 1638099 - protein, 8 aa, Staphylococcus aureus
HYNPTTTN

SEQ ID NO: 1638100 - protein, 14 aa, Staphylococcus aureus
HYSRTGAHIVPYID

SEQ ID NO: 1638101 - protein, 8 aa, Staphylococcus aureus
IAAPGGSF

SEQ ID NO: 1638102 - protein, 20 aa, Staphylococcus aureus
IAASQSVSTSTSDSMSTSEI

SEQ ID NO: 1638103 - protein, 5 aa, Staphylococcus aureus
IADAE

SEQ ID NO: 1638104 - protein, 27 aa, Staphylococcus aureus
IADKADTKASGNYVNADANKRQAYDEK

SEQ ID NO: 1638105 - protein, 30 aa, Staphylococcus aureus; identical to SEQ ID NO: 1565862

SEQ ID NO: 1638106 - protein, 6 aa, Staphylococcus aureus
IADSKD

SEQ ID NO: 1638107 - protein, 5 aa, Staphylococcus aureus
IAEAE

SEQ ID NO: 1638108 - protein, 10 aa, Staphylococcus aureus
IAEDYEGKTL

SEQ ID NO: 1638109 - protein, 4 aa, Staphylococcus aureus
IAEG

SEQ ID NO: 1638110 - protein, 8 aa, Staphylococcus aureus
IAEGPRPY

SEQ ID NO: 1638111 - protein, 13 aa, Staphylococcus aureus
IAEQTSETKTPSQ

SEQ ID NO: 1638112 - protein, 7 aa, Staphylococcus aureus
IAERQGD

SEQ ID NO: 1638113 - protein, 6 aa, Staphylococcus aureus
IAGNDT

SEQ ID NO: 1638114 - protein, 13 aa, Staphylococcus aureus
IAKATGTSLQTVT

SEQ ID NO: 1638115 - protein, 11 aa, Staphylococcus aureus
IAKDTSKQEMQ

SEQ ID NO: 1638116 - protein, 6 aa, Staphylococcus aureus
IAKEAN

SEQ ID NO: 1638117 - protein, 15 aa, Staphylococcus aureus
IAKEQKKSKYSTQAQ

SEQ ID NO: 1638118 - protein, 9 aa, Staphylococcus aureus
IAKGTSITD

SEQ ID NO: 1638119 - protein, 4 aa, Staphylococcus aureus
IAKH

SEQ ID NO: 1638120 - protein, 4 aa, Staphylococcus aureus
IAKK

SEQ ID NO: 1638121 - protein, 8 aa, Staphylococcus aureus
IAKTTAKI

SEQ ID NO: 1638122 - protein, 12 aa, Staphylococcus aureus
IANADDATKEHL

SEQ ID NO: 1638123 - protein, 13 aa, Staphylococcus aureus
IANADDATKEHLE

SEQ ID NO: 1638124 - protein, 20 aa, Staphylococcus aureus
IANADDPIEAAKQCRAAIEG

SEQ ID NO: 1638125 - protein, 21 aa, Staphylococcus aureus
IANADDPKAAAKKCRDIIDGN

SEQ ID NO: 1638126 - protein, 7 aa, Staphylococcus aureus
IANKAMK

SEQ ID NO: 1638127 - protein, 27 aa, Staphylococcus aureus
IANKDQTKANENYIDADPTKKTAFDNA

SEQ ID NO: 1638128 - protein, 15 aa, Staphylococcus aureus
IANNDVKRVESNGIA

SEQ ID NO: 1638129 - protein, 14 aa, Staphylococcus aureus
IANNDVKRVETNGI

SEQ ID NO: 1638130 - protein, 7 aa, Staphylococcus aureus
IAPGANI

SEQ ID NO: 1638131 - protein, 19 aa, Staphylococcus aureus
IAPGANQTVNTHAGNVTTY

SEQ ID NO: 1638132 - protein, 7 aa, Staphylococcus aureus
IAPKTMD

SEQ ID NO: 1638133 - protein, 18 aa, Staphylococcus aureus
IAPPQENPLLNTLNMKMS

SEQ ID NO: 1638134 - protein, 22 aa, Staphylococcus aureus
IAPQVSMTDSGGRVKPLPIQNP

SEQ ID NO: 1638135 - protein, 23 aa, Staphylococcus aureus
IAQPSNVSEIKPRMKRSTDVTAV

SEQ ID NO: 1638136 - protein, 25 aa, Staphylococcus aureus
IARERKKSDERIKDAVQEAEKLAKM

SEQ ID NO: 1638137 - protein, 12 aa, Staphylococcus aureus
IARKTKEEYQFE

SEQ ID NO: 1638138 - protein, 14 aa, Staphylococcus aureus
IARQRRKEAELRRK

SEQ ID NO: 1638139 - protein, 8 aa, Staphylococcus aureus
IASENGGN

SEQ ID NO: 1638140 - protein, 9 aa, Staphylococcus aureus
IATDRKENK

SEQ ID NO: 1638141 - protein, 5 aa, Staphylococcus aureus
IATEP

SEQ ID NO: 1638142 - protein, 5 aa, Staphylococcus aureus
IATNE

SEQ ID NO: 1638143 - protein, 18 aa, Staphylococcus aureus
IATQAKVEAKLNEKGITR

SEQ ID NO: 1638144 - protein, 15 aa, Staphylococcus aureus
IATYGKDSETKGEYW

SEQ ID NO: 1638145 - protein, 9 aa, Staphylococcus aureus
IAYSNSGVS

SEQ ID NO: 1638146 - protein, 11 aa, Staphylococcus aureus
ICGSDTSRYKK

SEQ ID NO: 1638147 - protein, 13 aa, Staphylococcus aureus
ICRKSSHKNCDSK

SEQ ID NO: 1638148 - protein, 12 aa, Staphylococcus aureus
ICRKSSHRNCDS

SEQ ID NO: 1638149 - protein, 75 aa, Staphylococcus aureus
IDAQDDLKEKESQAYADGKISEEEQRAIQDAQAKLEEAKQNAELKARNAEKKANVYTDNKVKESTDAQRKTLTRY

SEQ ID NO: 1638150 - protein, 8 aa, Staphylococcus aureus
IDCPNATN

SEQ ID NO: 1638151 - protein, 10 aa, Staphylococcus aureus
IDDEKVEKEI

SEQ ID NO: 1638152 - protein, 10 aa, Staphylococcus aureus
IDDGPTNETE

SEQ ID NO: 1638153 - protein, 9 aa, Staphylococcus aureus
IDDNNGQFN

SEQ ID NO: 1638154 - protein, 8 aa, Staphylococcus aureus
IDDNQYGN

SEQ ID NO: 1638155 - protein, 9 aa, Staphylococcus aureus
IDEKSRKLN

SEQ ID NO: 1638156 - protein, 11 aa, Staphylococcus aureus
IDGDEAKKFRQ

SEQ ID NO: 1638157 - protein, 10 aa, Staphylococcus aureus
IDGDGTGRRI

SEQ ID NO: 1638158 - protein, 8 aa, Staphylococcus aureus
IDGGGGYV

SEQ ID NO: 1638159 - protein, 4 aa, Staphylococcus aureus
IDGN

SEQ ID NO: 1638160 - protein, 4 aa, Staphylococcus aureus
IDIT

SEQ ID NO: 1638161 - protein, 7 aa, Staphylococcus aureus
IDKAEKG

SEQ ID NO: 1638162 - protein, 8 aa, Staphylococcus aureus
IDKAEKGI

SEQ ID NO: 1638163 - protein, 8 aa, Staphylococcus aureus
IDKHNNNR

SEQ ID NO: 1638164 - protein, 4 aa, Staphylococcus aureus
IDKR

SEQ ID NO: 1638165 - protein, 4 aa, Staphylococcus aureus
IDNA

SEQ ID NO: 1638166 - protein, 7 aa, Staphylococcus aureus
IDNAVQK

SEQ ID NO: 1638167 - protein, 8 aa, Staphylococcus aureus
IDNEKQKY

SEQ ID NO: 1638168 - protein, 19 aa, Staphylococcus aureus
IDNGDATAQQISDEKHRVD

SEQ ID NO: 1638169 - protein, 20 aa, Staphylococcus aureus
IDNGDATAQQISDEKHRVDN

SEQ ID NO: 1638170 - protein, 7 aa, Staphylococcus aureus
IDNNEAR

SEQ ID NO: 1638171 - protein, 8 aa, Staphylococcus aureus
IDNPEQFA

SEQ ID NO: 1638172 - protein, 7 aa, Staphylococcus aureus
IDNQPSV

SEQ ID NO: 1638173 - protein, 5 aa, Staphylococcus aureus
IDPRF

SEQ ID NO: 1638174 - protein, 21 aa, Staphylococcus aureus
IDQETMDKELQSRLKKSLKQS

SEQ ID NO: 1638175 - protein, 9 aa, Staphylococcus aureus
IDRKKDNKI

SEQ ID NO: 1638176 - protein, 4 aa, Staphylococcus aureus
IDRR

SEQ ID NO: 1638177 - protein, 18 aa, Staphylococcus aureus
IDSDSSLRSEDKGDDMST

SEQ ID NO: 1638178 - protein, 5 aa, Staphylococcus aureus
IDSGK

SEQ ID NO: 1638179 - protein, 5 aa, Staphylococcus aureus
IDSNI

SEQ ID NO: 1638180 - protein, 6 aa, Staphylococcus aureus
IDSRSF

SEQ ID NO: 1638181 - protein, 6 aa, Staphylococcus aureus
IDTEEP

SEQ ID NO: 1638182 - protein, 14 aa, Staphylococcus aureus
IDTPSTATISDSLT

SEQ ID NO: 1638183 - protein, 19 aa, Staphylococcus aureus
IDTQTSTTGMTQDSINAYN

SEQ ID NO: 1638184 - protein, 11 aa, Staphylococcus aureus
IEAPGYRVKES

SEQ ID NO: 1638185 - protein, 18 aa, Staphylococcus aureus
IEDDENGLKTYQSKIDED

SEQ ID NO: 1638186 - protein, 10 aa, Staphylococcus aureus
IEDNPDLTSA

SEQ ID NO: 1638187 - protein, 11 aa, Staphylococcus aureus
IEDNPDLTSAL

SEQ ID NO: 1638188 - protein, 6 aa, Staphylococcus aureus
IEDTED

SEQ ID NO: 1638189 - protein, 6 aa, Staphylococcus aureus
IEDYPH

SEQ ID NO: 1638190 - protein, 10 aa, Staphylococcus aureus
IEEECKEKKK

SEQ ID NO: 1638191 - protein, 12 aa, Staphylococcus aureus
IEEEKLDIPPEA

SEQ ID NO: 1638192 - protein, 11 aa, Staphylococcus aureus
IEEINNKNPVL

SEQ ID NO: 1638193 - protein, 19 aa, Staphylococcus aureus
IEEKAKSHTDEKLNEEQIR

SEQ ID NO: 1638194 - protein, 9 aa, Staphylococcus aureus
IEEKITPKT

SEQ ID NO: 1638195 - protein, 9 aa, Staphylococcus aureus
IEEPKDAAD

SEQ ID NO: 1638196 - protein, 8 aa, Staphylococcus aureus
IEETDPTI

SEQ ID NO: 1638197 - protein, 9 aa, Staphylococcus aureus
IEETDSSAI

SEQ ID NO: 1638198 - protein, 23 aa, Staphylococcus aureus
IEETPEQKADREFDEKLENTPTY

SEQ ID NO: 1638199 - protein, 22 aa, Staphylococcus aureus
IEETPEQKADREFDERMENTPA

SEQ ID NO: 1638200 - protein, 6 aa, Staphylococcus aureus
IEGEPG

SEQ ID NO: 1638201 - protein, 11 aa, Staphylococcus aureus
IEGKAQGKETI

SEQ ID NO: 1638202 - protein, 11 aa, Staphylococcus aureus
IEGKDQGKETI

SEQ ID NO: 1638203 - protein, 11 aa, Staphylococcus aureus
IEGKTQGKETI

SEQ ID NO: 1638204 - protein, 6 aa, Staphylococcus aureus
IEGKTV

SEQ ID NO: 1638205 - protein, 7 aa, Staphylococcus aureus
IEGTPTL

SEQ ID NO: 1638206 - protein, 9 aa, Staphylococcus aureus
IEIEESKGI

SEQ ID NO: 1638207 - protein, 6 aa, Staphylococcus aureus
IEKASN

SEQ ID NO: 1638208 - protein, 14 aa, Staphylococcus aureus
IEKETHKPKTHNMY

SEQ ID NO: 1638209 - protein, 41 aa, Staphylococcus aureus
IEKETHKSKAHNMYSNNTNHRAKDSTPDYHKESFKTSEVPS

SEQ ID NO: 1638210 - protein, 41 aa, Staphylococcus aureus
IEKETHKSKTHNMYSNTTNHRAKDSTPDYHKESFKTSEVPS

SEQ ID NO: 1638211 - protein, 7 aa, Staphylococcus aureus
IEKGDQF

SEQ ID NO: 1638212 - protein, 15 aa, Staphylococcus aureus
IEKGGLMNETITFKV

SEQ ID NO: 1638213 - protein, 10 aa, Staphylococcus aureus
IEKLQSNKEY

SEQ ID NO: 1638214 - protein, 25 aa, Staphylococcus aureus
IEKNSDDLLNKAKDKAKDLNTEENR

SEQ ID NO: 1638215 - protein, 16 aa, Staphylococcus aureus
IEKQETELSDDDLQEA

SEQ ID NO: 1638216 - protein, 17 aa, Staphylococcus aureus
IEKTSSNQQRYKKTIDK

SEQ ID NO: 1638217 - protein, 15 aa, Staphylococcus aureus
IENANNNDLNNASIQ

SEQ ID NO: 1638218 - protein, 29 aa, Staphylococcus aureus
IENANNNGLNDESIKRQIKKAQNNNRFPE

SEQ ID NO: 1638219 - protein, 5 aa, Staphylococcus aureus
IENDK

SEQ ID NO: 1638220 - protein, 4 aa, Staphylococcus aureus
IENI

SEQ ID NO: 1638221 - protein, 9 aa, Staphylococcus aureus
IENQPKEIE

SEQ ID NO: 1638222 - protein, 21 aa, Staphylococcus aureus
IENRKKHKQPSTLNVKANLEK

SEQ ID NO: 1638223 - protein, 14 aa, Staphylococcus aureus
IENYDSTDKQLATR

SEQ ID NO: 1638224 - protein, 5 aa, Staphylococcus aureus
IEPAK

SEQ ID NO: 1638225 - protein, 7 aa, Staphylococcus aureus
IEPGSTH

SEQ ID NO: 1638226 - protein, 9 aa, Staphylococcus aureus
IEPKDDQFN

SEQ ID NO: 1638227 - protein, 8 aa, Staphylococcus aureus
IEPLPKKY

SEQ ID NO: 1638228 - protein, 4 aa, Staphylococcus aureus
IEPQ

SEQ ID NO: 1638229 - protein, 6 aa, Staphylococcus aureus
IEPRSK

SEQ ID NO: 1638230 - protein, 5 aa, Staphylococcus aureus
IEQGH

SEQ ID NO: 1638231 - protein, 12 aa, Staphylococcus aureus
IEQKAEKETLNK

SEQ ID NO: 1638232 - protein, 20 aa, Staphylococcus aureus
IEQKEKEKALDALENMTGTL

SEQ ID NO: 1638233 - protein, 9 aa, Staphylococcus aureus
IEQNANTLN

SEQ ID NO: 1638234 - protein, 23 aa, Staphylococcus aureus
IEQSEKKIESLKNRKQGFLQKLF

SEQ ID NO: 1638235 - protein, 12 aa, Staphylococcus aureus
IEQTNTPGSLNP

SEQ ID NO: 1638236 - protein, 10 aa, Staphylococcus aureus
IEQVGGNHSQ

SEQ ID NO: 1638237 - protein, 13 aa, Staphylococcus aureus
IEQYNENFSRPQD

SEQ ID NO: 1638238 - protein, 9 aa, Staphylococcus aureus
IERNDKGKV

SEQ ID NO: 1638239 - protein, 20 aa, Staphylococcus aureus
IESAQQYNATTISTKWQNIL

SEQ ID NO: 1638240 - protein, 8 aa, Staphylococcus aureus
IESATENN

SEQ ID NO: 1638241 - protein, 16 aa, Staphylococcus aureus
IESDEDWITDKKKELN

SEQ ID NO: 1638242 - protein, 9 aa, Staphylococcus aureus
IESGEASSI

SEQ ID NO: 1638243 - protein, 11 aa, Staphylococcus aureus
IESKADELKGN

SEQ ID NO: 1638244 - protein, 10 aa, Staphylococcus aureus
IESKGYSQQE

SEQ ID NO: 1638245 - protein, 6 aa, Staphylococcus aureus
IETDDT

SEQ ID NO: 1638246 - protein, 13 aa, Staphylococcus aureus
IETGKAVPTQQVK

SEQ ID NO: 1638247 - protein, 11 aa, Staphylococcus aureus
IETKEQVSQLT

SEQ ID NO: 1638248 - protein, 18 aa, Staphylococcus aureus
IETRTAKVQQELHEIVKS

SEQ ID NO: 1638249 - protein, 8 aa, Staphylococcus aureus
IEYTTPNG

SEQ ID NO: 1638250 - protein, 7 aa, Staphylococcus aureus
IFGSNSG

SEQ ID NO: 1638251 - protein, 5 aa, Staphylococcus aureus
IGAGS

SEQ ID NO: 1638252 - protein, 9 aa, Staphylococcus aureus
IGDAAGQSL

SEQ ID NO: 1638253 - protein, 5 aa, Staphylococcus aureus
IGDSK

SEQ ID NO: 1638254 - protein, 13 aa, Staphylococcus aureus
IGDYANENKSIGY

SEQ ID NO: 1638255 - protein, 8 aa, Staphylococcus aureus
IGEAPDAA

SEQ ID NO: 1638256 - protein, 11 aa, Staphylococcus aureus
IGESGAGKSLT

SEQ ID NO: 1638257 - protein, 5 aa, Staphylococcus aureus
IGGSI

SEQ ID NO: 1638258 - protein, 6 aa, Staphylococcus aureus
IGGSID

SEQ ID NO: 1638259 - protein, 15 aa, Staphylococcus aureus
IGHPVDEGSYQPSRA

SEQ ID NO: 1638260 - protein, 11 aa, Staphylococcus aureus
IGIKGKQDIEK

SEQ ID NO: 1638261 - protein, 8 aa, Staphylococcus aureus
IGISTNRD

SEQ ID NO: 1638262 - protein, 8 aa, Staphylococcus aureus
IGKAQRVA

SEQ ID NO: 1638263 - protein, 8 aa, Staphylococcus aureus
IGKATKNE

SEQ ID NO: 1638264 - protein, 4 aa, Staphylococcus aureus
IGKE

SEQ ID NO: 1638265 - protein, 4 aa, Staphylococcus aureus
IGLA

SEQ ID NO: 1638266 - protein, 11 aa, Staphylococcus aureus
IGQSQTGTGKS

SEQ ID NO: 1638267 - protein, 11 aa, Staphylococcus aureus
IGQSQTSTGKS

SEQ ID NO: 1638268 - protein, 46 aa, Staphylococcus aureus; identical to SEQ ID NO: 1570797

SEQ ID NO: 1638269 - protein, 47 aa, Staphylococcus aureus
IGQTTSPTMNAQEIDQAKDQVTAKQQALNGQENLRTAQTNAKQHLNG

SEQ ID NO: 1638270 - protein, 13 aa, Staphylococcus aureus
IGRKVDEGSYQPS

SEQ ID NO: 1638271 - protein, 30 aa, Staphylococcus aureus
IGRSTTTEDQTGDTLEKKGVHSADFNKDDI

SEQ ID NO: 1638272 - protein, 20 aa, Staphylococcus aureus
IGRTKDKNGTSWVGENTRAP

SEQ ID NO: 1638273 - protein, 7 aa, Staphylococcus aureus
IGRYSGR

SEQ ID NO: 1638274 - protein, 9 aa, Staphylococcus aureus
IGSGKGHFT

SEQ ID NO: 1638275 - protein, 4 aa, Staphylococcus aureus
IGSK

SEQ ID NO: 1638276 - protein, 5 aa, Staphylococcus aureus
IGSKD

SEQ ID NO: 1638277 - protein, 4 aa, Staphylococcus aureus
IGST

SEQ ID NO: 1638278 - protein, 10 aa, Staphylococcus aureus
IGTPISTDNA

SEQ ID NO: 1638279 - protein, 10 aa, Staphylococcus aureus
IGTPNIVSSN

SEQ ID NO: 1638280 - protein, 11 aa, Staphylococcus aureus
IGVDSNKQKVK

SEQ ID NO: 1638281 - protein, 6 aa, Staphylococcus aureus
IGYGGG

SEQ ID NO: 1638282 - protein, 20 aa, Staphylococcus aureus
IHGESGLDGPKLPATPSRQA

SEQ ID NO: 1638283 - protein, 25 aa, Staphylococcus aureus
IHSKDPSDEKVYGKVGDQDSNVKNR

SEQ ID NO: 1638284 - protein, 11 aa, Staphylococcus aureus
IIDKTDKETIK

SEQ ID NO: 1638285 - protein, 5 aa, Staphylococcus aureus
IIPAK

SEQ ID NO: 1638286 - protein, 5 aa, Staphylococcus aureus
IISQQ

SEQ ID NO: 1638287 - protein, 9 aa, Staphylococcus aureus
IKAAQTEKR

SEQ ID NO: 1638288 - protein, 8 aa, Staphylococcus aureus
IKAGKRHQ

SEQ ID NO: 1638289 - protein, 9 aa, Staphylococcus aureus
IKASPKLRE

SEQ ID NO: 1638290 - protein, 8 aa, Staphylococcus aureus
IKASSRRS

SEQ ID NO: 1638291 - protein, 7 aa, Staphylococcus aureus
IKCKTNR

SEQ ID NO: 1638292 - protein, 17 aa, Staphylococcus aureus
IKDAPKDGFSKGDTVKL

SEQ ID NO: 1638293 - protein, 10 aa, Staphylococcus aureus
IKDEKIKKEI

SEQ ID NO: 1638294 - protein, 9 aa, Staphylococcus aureus
IKDENIKTE

SEQ ID NO: 1638295 - protein, 11 aa, Staphylococcus aureus
IKDKDSEFYSP

SEQ ID NO: 1638296 - protein, 10 aa, Staphylococcus aureus
IKDKNIKKEI

SEQ ID NO: 1638297 - protein, 18 aa, Staphylococcus aureus
IKDVEQALQGTKMTREDL

SEQ ID NO: 1638298 - protein, 22 aa, Staphylococcus aureus
IKEDGDSDLTTKEIDLIGTHLD

SEQ ID NO: 1638299 - protein, 7 aa, Staphylococcus aureus
IKEGDTI

SEQ ID NO: 1638300 - protein, 8 aa, Staphylococcus aureus
IKEGHPNA

SEQ ID NO: 1638301 - protein, 6 aa, Staphylococcus aureus
IKEGSK

SEQ ID NO: 1638302 - protein, 38 aa, Staphylococcus aureus
IKENEKNDNNESSNNSNVNNNPFENTNNSIDISDDDLP

SEQ ID NO: 1638303 - protein, 10 aa, Staphylococcus aureus
IKENGDSDLT

SEQ ID NO: 1638304 - protein, 6 aa, Staphylococcus aureus
IKEPLS

SEQ ID NO: 1638305 - protein, 18 aa, Staphylococcus aureus
IKETVKGKIKEFGTSNRA

SEQ ID NO: 1638306 - protein, 7 aa, Staphylococcus aureus
IKGDERN

SEQ ID NO: 1638307 - protein, 15 aa, Staphylococcus aureus
IKGEFKGSELGGRHR

SEQ ID NO: 1638308 - protein, 6 aa, Staphylococcus aureus
IKGGRF

SEQ ID NO: 1638309 - protein, 5 aa, Staphylococcus aureus
IKGLS

SEQ ID NO: 1638310 - protein, 8 aa, Staphylococcus aureus
IKGSSIGY

SEQ ID NO: 1638311 - protein, 19 aa, Staphylococcus aureus
IKGYSDMKKDELIKALEGV

SEQ ID NO: 1638312 - protein, 12 aa, Staphylococcus aureus
IKKEDSLKKQWS

SEQ ID NO: 1638313 - protein, 10 aa, Staphylococcus aureus
IKKEKEIPNS

SEQ ID NO: 1638314 - protein, 10 aa, Staphylococcus aureus
IKKEQRKKEL

SEQ ID NO: 1638315 - protein, 4 aa, Staphylococcus aureus
IKKN

SEQ ID NO: 1638316 - protein, 7 aa, Staphylococcus aureus
IKKNNYD

SEQ ID NO: 1638317 - protein, 7 aa, Staphylococcus aureus
IKKPGNY

SEQ ID NO: 1638318 - protein, 8 aa, Staphylococcus aureus
IKKPTFND

SEQ ID NO: 1638319 - protein, 7 aa, Staphylococcus aureus
IKKTQSI

SEQ ID NO: 1638320 - protein, 18 aa, Staphylococcus aureus
IKLRTTKEEFNASKRTLS

SEQ ID NO: 1638321 - protein, 7 aa, Staphylococcus aureus
IKNEDIV

SEQ ID NO: 1638322 - protein, 4 aa, Staphylococcus aureus
IKNG

SEQ ID NO: 1638323 - protein, 10 aa, Staphylococcus aureus
IKNGANNHGE

SEQ ID NO: 1638324 - protein, 7 aa, Staphylococcus aureus
IKNNRDR

SEQ ID NO: 1638325 - protein, 4 aa, Staphylococcus aureus
IKNP

SEQ ID NO: 1638326 - protein, 7 aa, Staphylococcus aureus
IKNPYNK

SEQ ID NO: 1638327 - protein, 8 aa, Staphylococcus aureus
IKNRKGKM

SEQ ID NO: 1638328 - protein, 4 aa, Staphylococcus aureus
IKNT

SEQ ID NO: 1638329 - protein, 8 aa, Staphylococcus aureus
IKNYKDKR

SEQ ID NO: 1638330 - protein, 39 aa, Staphylococcus aureus
IKPNQKGDKDIQAAIKETSKYSVKSSDFLTDDDEKNQEI

SEQ ID NO: 1638331 - protein, 17 aa, Staphylococcus aureus
IKPPITGAGIQIRFKKL

SEQ ID NO: 1638332 - protein, 19 aa, Staphylococcus aureus
IKPSSHNNNSLNQSDEIDQ

SEQ ID NO: 1638333 - protein, 15 aa, Staphylococcus aureus
IKQANKLKKKRERDK

SEQ ID NO: 1638334 - protein, 21 aa, Staphylococcus aureus
IKQANTNAEVDQAATVAENNI

SEQ ID NO: 1638335 - protein, 17 aa, Staphylococcus aureus
IKQPKSTMNDGDKVEIS

SEQ ID NO: 1638336 - protein, 7 aa, Staphylococcus aureus
IKQSDQQ

SEQ ID NO: 1638337 - protein, 11 aa, Staphylococcus aureus
IKRSNAINDKD

SEQ ID NO: 1638338 - protein, 17 aa, Staphylococcus aureus
IKRTSNKLKNDDSELEK

SEQ ID NO: 1638339 - protein, 16 aa, Staphylococcus aureus
IKSEEKLSKEIENNKN

SEQ ID NO: 1638340 - protein, 9 aa, Staphylococcus aureus
IKSENPDYT

SEQ ID NO: 1638341 - protein, 9 aa, Staphylococcus aureus
IKSGKPIEN

SEQ ID NO: 1638342 - protein, 10 aa, Staphylococcus aureus
IKSGKSVDSI

SEQ ID NO: 1638343 - protein, 12 aa, Staphylococcus aureus
IKSINPADTSQV

SEQ ID NO: 1638344 - protein, 8 aa, Staphylococcus aureus
IKSNKNPK

SEQ ID NO: 1638345 - protein, 7 aa, Staphylococcus aureus
IKSNQKY

SEQ ID NO: 1638346 - protein, 6 aa, Staphylococcus aureus
IKSPEN

SEQ ID NO: 1638347 - protein, 18 aa, Staphylococcus aureus
IKSPKAHIEPKNDKISVR

SEQ ID NO: 1638348 - protein, 11 aa, Staphylococcus aureus
IKSPKTHIEPE

SEQ ID NO: 1638349 - protein, 22 aa, Staphylococcus aureus
IKSTDSSKNPVTSVENRKANGY

SEQ ID NO: 1638350 - protein, 23 aa, Staphylococcus aureus
IKSTDSSKNPVTTIENRKANDYK

SEQ ID NO: 1638351 - protein, 10 aa, Staphylococcus aureus
IKTATENERG

SEQ ID NO: 1638352 - protein, 11 aa, Staphylococcus aureus
IKTDKTIEDSI

SEQ ID NO: 1638353 - protein, 8 aa, Staphylococcus aureus
IKTDRNRI

SEQ ID NO: 1638354 - protein, 17 aa, Staphylococcus aureus
IKTEKYEVAQDNQKKYP

SEQ ID NO: 1638355 - protein, 4 aa, Staphylococcus aureus
IKTL

SEQ ID NO: 1638356 - protein, 20 aa, Staphylococcus aureus
IKTNKASGITDNPNDFSEDS

SEQ ID NO: 1638357 - protein, 7 aa, Staphylococcus aureus
IKTNNDF

SEQ ID NO: 1638358 - protein, 5 aa, Staphylococcus aureus
IKTST

SEQ ID NO: 1638359 - protein, 4 aa, Staphylococcus aureus
IKTY

SEQ ID NO: 1638360 - protein, 7 aa, Staphylococcus aureus
IKYDNEK

SEQ ID NO: 1638361 - protein, 13 aa, Staphylococcus aureus
ILKSKKKLNNRGD

SEQ ID NO: 1638362 - protein, 13 aa, Staphylococcus aureus
ILKTGESQRKDGR

SEQ ID NO: 1638363 - protein, 9 aa, Staphylococcus aureus
INASNGAVG

SEQ ID NO: 1638364 - protein, 28 aa, Staphylococcus aureus
INATPDATNDEKNAAINTLNQDRQQAIE

SEQ ID NO: 1638365 - protein, 17 aa, Staphylococcus aureus
INATPGATREEKQEAIN

SEQ ID NO: 1638366 - protein, 12 aa, Staphylococcus aureus
INDFSGGQKTRL

SEQ ID NO: 1638367 - protein, 9 aa, Staphylococcus aureus
INDHGDTVP

SEQ ID NO: 1638368 - protein, 9 aa, Staphylococcus aureus
INDKLTSKK

SEQ ID NO: 1638369 - protein, 8 aa, Staphylococcus aureus
INDKSNKI

SEQ ID NO: 1638370 - protein, 6 aa, Staphylococcus aureus
INDPTS

SEQ ID NO: 1638371 - protein, 29 aa, Staphylococcus aureus
INDSPQTNHSSHPNHQHNTEDTFNDQQVE

SEQ ID NO: 1638372 - protein, 31 aa, Staphylococcus aureus
INDYKDGDISYNPNVPSYSAKYQLSNNDYNV

SEQ ID NO: 1638373 - protein, 5 aa, Staphylococcus aureus
INEDE

SEQ ID NO: 1638374 - protein, 6 aa, Staphylococcus aureus
INEDSR

SEQ ID NO: 1638375 - protein, 7 aa, Staphylococcus aureus
INEGAEL

SEQ ID NO: 1638376 - protein, 22 aa, Staphylococcus aureus
INEIEQSESFSQKVKEGKSYPR

SEQ ID NO: 1638377 - protein, 5 aa, Staphylococcus aureus
INEPV

SEQ ID NO: 1638378 - protein, 4 aa, Staphylococcus aureus
INEQ

SEQ ID NO: 1638379 - protein, 14 aa, Staphylococcus aureus
INETAQDVQRERGT

SEQ ID NO: 1638380 - protein, 20 aa, Staphylococcus aureus
INETYARETSANLKNSLQDS

SEQ ID NO: 1638381 - protein, 12 aa, Staphylococcus aureus
INGKFTKGHEEL

SEQ ID NO: 1638382 - protein, 18 aa, Staphylococcus aureus
INGRQIDAPSSKPSTDKI

SEQ ID NO: 1638383 - protein, 34 aa, Staphylococcus aureus
INGTPNATLTANDVKSAASQVNAAKTALNGDNNL

SEQ ID NO: 1638384 - protein, 4 aa, Staphylococcus aureus
INHP

SEQ ID NO: 1638385 - protein, 4 aa, Staphylococcus aureus
INKD

SEQ ID NO: 1638386 - protein, 12 aa, Staphylococcus aureus
INKEELKKGVTI

SEQ ID NO: 1638387 - protein, 6 aa, Staphylococcus aureus
INKGEA

SEQ ID NO: 1638388 - protein, 17 aa, Staphylococcus aureus
INKNATKQTSKPLAESK

SEQ ID NO: 1638389 - protein, 7 aa, Staphylococcus aureus
INKNEIG

SEQ ID NO: 1638390 - protein, 13 aa, Staphylococcus aureus
INKNELSKYAQGK

SEQ ID NO: 1638391 - protein, 4 aa, Staphylococcus aureus
INKQ

SEQ ID NO: 1638392 - protein, 6 aa, Staphylococcus aureus
INKTQT

SEQ ID NO: 1638393 - protein, 5 aa, Staphylococcus aureus
INLSN

SEQ ID NO: 1638394 - protein, 22 aa, Staphylococcus aureus
INNGVDNSDVEDALTQGKATID

SEQ ID NO: 1638395 - protein, 4 aa, Staphylococcus aureus
INNN

SEQ ID NO: 1638396 - protein, 10 aa, Staphylococcus aureus
INNNDTPSDL

SEQ ID NO: 1638397 - protein, 22 aa, Staphylococcus aureus
INNPDGSSKVSRTPKVTGKGQQ

SEQ ID NO: 1638398 - protein, 9 aa, Staphylococcus aureus
INNPYSDKN

SEQ ID NO: 1638399 - protein, 14 aa, Staphylococcus aureus
INNQEIESIKSELN

SEQ ID NO: 1638400 - protein, 18 aa, Staphylococcus aureus
INPEKQNRHSLGHKLYLK

SEQ ID NO: 1638401 - protein, 5 aa, Staphylococcus aureus
INPHS

SEQ ID NO: 1638402 - protein, 12 aa, Staphylococcus aureus
INPNGNRFDAND

SEQ ID NO: 1638403 - protein, 11 aa, Staphylococcus aureus
INQDTGVSYGG

SEQ ID NO: 1638404 - protein, 16 aa, Staphylococcus aureus
INQTGNPTLDKAQVEQ

SEQ ID NO: 1638405 - protein, 17 aa, Staphylococcus aureus
INQTSNPTLDKAQVEQL

SEQ ID NO: 1638406 - protein, 10 aa, Staphylococcus aureus
INQTTSPTMI

SEQ ID NO: 1638407 - protein, 45 aa, Staphylococcus aureus
INQTTSPTMNPDDINRATTQVNNTKVALDGDENLAAAKQQANNRL

SEQ ID NO: 1638408 - protein, 10 aa, Staphylococcus aureus
INREKSPLEG

SEQ ID NO: 1638409 - protein, 7 aa, Staphylococcus aureus
INRRKKE

SEQ ID NO: 1638410 - protein, 24 aa, Staphylococcus aureus
INSEELKQKEYKGYKDDAVIGKKG

SEQ ID NO: 1638411 - protein, 13 aa, Staphylococcus aureus
INSNDAGVNFELT

SEQ ID NO: 1638412 - protein, 9 aa, Staphylococcus aureus
INSPTVEIG

SEQ ID NO: 1638413 - protein, 7 aa, Staphylococcus aureus
INTASSS

SEQ ID NO: 1638414 - protein, 5 aa, Staphylococcus aureus
INTGE

SEQ ID NO: 1638415 - protein, 6 aa, Staphylococcus aureus
INTGEK

SEQ ID NO: 1638416 - protein, 9 aa, Staphylococcus aureus
INTQNQSQI

SEQ ID NO: 1638417 - protein, 6 aa, Staphylococcus aureus
INTRPR

SEQ ID NO: 1638418 - protein, 12 aa, Staphylococcus aureus
INVNGSEGNADV

SEQ ID NO: 1638419 - protein, 4 aa, Staphylococcus aureus
INVQ

SEQ ID NO: 1638420 - protein, 5 aa, Staphylococcus aureus
IPAKP

SEQ ID NO: 1638421 - protein, 4 aa, Staphylococcus aureus
IPDP

SEQ ID NO: 1638422 - protein, 9 aa, Staphylococcus aureus
IPEEDDETK

SEQ ID NO: 1638423 - protein, 8 aa, Staphylococcus aureus
IPEGEGQS

SEQ ID NO: 1638424 - protein, 9 aa, Staphylococcus aureus
IPERRPEGA

SEQ ID NO: 1638425 - protein, 12 aa, Staphylococcus aureus
IPFTTTKELNGN

SEQ ID NO: 1638426 - protein, 8 aa, Staphylococcus aureus
IPGREDDD

SEQ ID NO: 1638427 - protein, 11 aa, Staphylococcus aureus
IPGTEGPIKSY

SEQ ID NO: 1638428 - protein, 8 aa, Staphylococcus aureus
IPGTPPNL

SEQ ID NO: 1638429 - protein, 10 aa, Staphylococcus aureus
IPIGSEAGKG

SEQ ID NO: 1638430 - protein, 6 aa, Staphylococcus aureus
IPIKRR

SEQ ID NO: 1638431 - protein, 8 aa, Staphylococcus aureus
IPIKRRSS

SEQ ID NO: 1638432 - protein, 4 aa, Staphylococcus aureus
IPIP

SEQ ID NO: 1638433 - protein, 7 aa, Staphylococcus aureus
IPKGRGK

SEQ ID NO: 1638434 - protein, 15 aa, Staphylococcus aureus
IPLKGVQNKPGLDTL

SEQ ID NO: 1638435 - protein, 41 aa, Staphylococcus aureus
IPMTKERKRSEKTRKKLEKHESKVKEKEKRKQQREEEIEKR

SEQ ID NO: 1638436 - protein, 25 aa, Staphylococcus aureus
IPNAEQTVNYQNAEDNAKTNFDDAK

SEQ ID NO: 1638437 - protein, 7 aa, Staphylococcus aureus
IPNGTEE

SEQ ID NO: 1638438 - protein, 11 aa, Staphylococcus aureus
IPQPDPQYERE

SEQ ID NO: 1638439 - protein, 10 aa, Staphylococcus aureus
IPSSGETAID

SEQ ID NO: 1638440 - protein, 11 aa, Staphylococcus aureus
IPSSKQNTSYI

SEQ ID NO: 1638441 - protein, 9 aa, Staphylococcus aureus
IPSSSANYD

SEQ ID NO: 1638442 - protein, 7 aa, Staphylococcus aureus
IPSSSQL

SEQ ID NO: 1638443 - protein, 17 aa, Staphylococcus aureus
IPTADYKEVERKKDALT

SEQ ID NO: 1638444 - protein, 18 aa, Staphylococcus aureus
IPTDNASWRGPNREKLEP

SEQ ID NO: 1638445 - protein, 14 aa, Staphylococcus aureus
IPTEDVKNEDLKRE

SEQ ID NO: 1638446 - protein, 15 aa, Staphylococcus aureus
IPTKEIKDEKIKKEI

SEQ ID NO: 1638447 - protein, 25 aa, Staphylococcus aureus
IPTLSTGTLSGKGVATDNSGALTQP

SEQ ID NO: 1638448 - protein, 8 aa, Staphylococcus aureus
IPTPPEEV

SEQ ID NO: 1638449 - protein, 8 aa, Staphylococcus aureus
IPTTAGEI

SEQ ID NO: 1638450 - protein, 15 aa, Staphylococcus aureus
IPYAGSSDIDGVPQD

SEQ ID NO: 1638451 - protein, 11 aa, Staphylococcus aureus
IQADAEATTEI

SEQ ID NO: 1638452 - protein, 23 aa, Staphylococcus aureus
IQATPDATDEEKQAAKDEIDQLQ

SEQ ID NO: 1638453 - protein, 5 aa, Staphylococcus aureus
IQDSN

SEQ ID NO: 1638454 - protein, 9 aa, Staphylococcus aureus
IQGAENAAK

SEQ ID NO: 1638455 - protein, 14 aa, Staphylococcus aureus
IQGEGGVNIPPNGY

SEQ ID NO: 1638456 - protein, 4 aa, Staphylococcus aureus
IQGR

SEQ ID NO: 1638457 - protein, 5 aa, Staphylococcus aureus
IQHND

SEQ ID NO: 1638458 - protein, 6 aa, Staphylococcus aureus
IQHSDN

SEQ ID NO: 1638459 - protein, 9 aa, Staphylococcus aureus
IQKEESCDT

SEQ ID NO: 1638460 - protein, 4 aa, Staphylococcus aureus
IQLG

SEQ ID NO: 1638461 - protein, 8 aa, Staphylococcus aureus
IQNGAEGI

SEQ ID NO: 1638462 - protein, 15 aa, Staphylococcus aureus
IQNGKEIKLRTTKEE

SEQ ID NO: 1638463 - protein, 8 aa, Staphylococcus aureus
IQNKGEAL

SEQ ID NO: 1638464 - protein, 4 aa, Staphylococcus aureus
IQNM

SEQ ID NO: 1638465 - protein, 14 aa, Staphylococcus aureus
IQNYESKLNENSKA

SEQ ID NO: 1638466 - protein, 10 aa, Staphylococcus aureus
IQPGTRGKTV

SEQ ID NO: 1638467 - protein, 7 aa, Staphylococcus aureus
IQPRSVT

SEQ ID NO: 1638468 - protein, 6 aa, Staphylococcus aureus
IQPTEL

SEQ ID NO: 1638469 - protein, 4 aa, Staphylococcus aureus
IQQD

SEQ ID NO: 1638470 - protein, 10 aa, Staphylococcus aureus
IQSQRIKKKG

SEQ ID NO: 1638471 - protein, 25 aa, Staphylococcus aureus
IQTATQIQKATQTQTATQIQTATQT

SEQ ID NO: 1638472 - protein, 9 aa, Staphylococcus aureus
IQTNTYGAN

SEQ ID NO: 1638473 - protein, 14 aa, Staphylococcus aureus
IQTQTAIQTQTVSQ

SEQ ID NO: 1638474 - protein, 16 aa, Staphylococcus aureus
IQTTKSKNDSALYGCL

SEQ ID NO: 1638475 - protein, 5 aa, Staphylococcus aureus
IRDRG

SEQ ID NO: 1638476 - protein, 6 aa, Staphylococcus aureus
IRDSNA

SEQ ID NO: 1638477 - protein, 10 aa, Staphylococcus aureus
IRESETDKVA

SEQ ID NO: 1638478 - protein, 8 aa, Staphylococcus aureus
IRETEKYG

SEQ ID NO: 1638479 - protein, 16 aa, Staphylococcus aureus
IRGKDGGYLANDQSAY

SEQ ID NO: 1638480 - protein, 9 aa, Staphylococcus aureus
IRGSYDSPD

SEQ ID NO: 1638481 - protein, 35 aa, Staphylococcus aureus
IRKQTRKKELRLRSSKSKFDDYSERKNKYEEQKSI

SEQ ID NO: 1638482 - protein, 4 aa, Staphylococcus aureus
IRKR

SEQ ID NO: 1638483 - protein, 8 aa, Staphylococcus aureus
IRKSQGLT

SEQ ID NO: 1638484 - protein, 7 aa, Staphylococcus aureus
IRQPPHP

SEQ ID NO: 1638485 - protein, 4 aa, Staphylococcus aureus
IRQY

SEQ ID NO: 1638486 - protein, 7 aa, Staphylococcus aureus
IRRENQD

SEQ ID NO: 1638487 - protein, 25 aa, Staphylococcus aureus
IRRNNPELERSLKDAKETFVNRKNQ

SEQ ID NO: 1638488 - protein, 6 aa, Staphylococcus aureus
IRSEEG

SEQ ID NO: 1638489 - protein, 9 aa, Staphylococcus aureus
IRSYEEAKE

SEQ ID NO: 1638490 - protein, 12 aa, Staphylococcus aureus
IRTKNLDQMTKA

SEQ ID NO: 1638491 - protein, 11 aa, Staphylococcus aureus
IRTTDKGPKIY

SEQ ID NO: 1638492 - protein, 4 aa, Staphylococcus aureus
ISAD

SEQ ID NO: 1638493 - protein, 61 aa, Staphylococcus aureus
ISATPAPKQEQSQTTTESTTPKTKVTTPPSTNTPQPMQSTKSDTPQSPTIKQAQTDMTPKY

SEQ ID NO: 1638494 - protein, 7 aa, Staphylococcus aureus
ISDEEIK

SEQ ID NO: 1638495 - protein, 8 aa, Staphylococcus aureus
ISDEEINA

SEQ ID NO: 1638496 - protein, 6 aa, Staphylococcus aureus
ISDGKF

SEQ ID NO: 1638497 - protein, 14 aa, Staphylococcus aureus
ISDIKTTFKFPFIY

SEQ ID NO: 1638498 - protein, 32 aa, Staphylococcus aureus
ISDKTSVDSASTRGPTASDEKPSIVTEKSPFT

SEQ ID NO: 1638499 - protein, 9 aa, Staphylococcus aureus
ISDNTVQSL

SEQ ID NO: 1638500 - protein, 31 aa, Staphylococcus aureus
ISDYKDGDISYNPNVPSYSAKYQLSNDDYNV

SEQ ID NO: 1638501 - protein, 10 aa, Staphylococcus aureus
ISEARSQSGT

SEQ ID NO: 1638502 - protein, 8 aa, Staphylococcus aureus
ISEEVKNK

SEQ ID NO: 1638503 - protein, 12 aa, Staphylococcus aureus
ISELTQEKSEIE

SEQ ID NO: 1638504 - protein, 4 aa, Staphylococcus aureus
ISER

SEQ ID NO: 1638505 - protein, 5 aa, Staphylococcus aureus
ISESK

SEQ ID NO: 1638506 - protein, 7 aa, Staphylococcus aureus
ISGETII

SEQ ID NO: 1638507 - protein, 19 aa, Staphylococcus aureus
ISGKKLKEKLQNSKEDALM

SEQ ID NO: 1638508 - protein, 18 aa, Staphylococcus aureus
ISGKKLKEKLQNSKENAL

SEQ ID NO: 1638509 - protein, 9 aa, Staphylococcus aureus
ISGSESAHD

SEQ ID NO: 1638510 - protein, 16 aa, Staphylococcus aureus
ISKDDLEKKVYSNEEF

SEQ ID NO: 1638511 - protein, 9 aa, Staphylococcus aureus
ISKDFDDTT

SEQ ID NO: 1638512 - protein, 20 aa, Staphylococcus aureus
ISKETGVPQSTIHRMRKKND

SEQ ID NO: 1638513 - protein, 17 aa, Staphylococcus aureus
ISKGNSTDNASWRGPNI

SEQ ID NO: 1638514 - protein, 4 aa, Staphylococcus aureus
ISKN

SEQ ID NO: 1638515 - protein, 12 aa, Staphylococcus aureus
ISKRNSTGNASW

SEQ ID NO: 1638516 - protein, 11 aa, Staphylococcus aureus
ISNDKKDAYNT

SEQ ID NO: 1638517 - protein, 4 aa, Staphylococcus aureus
ISNE

SEQ ID NO: 1638518 - protein, 8 aa, Staphylococcus aureus
ISNEDEEV

SEQ ID NO: 1638519 - protein, 13 aa, Staphylococcus aureus
ISNEELKDRAKQY

SEQ ID NO: 1638520 - protein, 8 aa, Staphylococcus aureus
ISNPGKSL

SEQ ID NO: 1638521 - protein, 4 aa, Staphylococcus aureus
ISNQ

SEQ ID NO: 1638522 - protein, 6 aa, Staphylococcus aureus
ISNQDF

SEQ ID NO: 1638523 - protein, 13 aa, Staphylococcus aureus
ISNTLRHSNGTKV

SEQ ID NO: 1638524 - protein, 16 aa, Staphylococcus aureus
ISNWGKAGKDPREEFK

SEQ ID NO: 1638525 - protein, 12 aa, Staphylococcus aureus
ISPKDITHITIE

SEQ ID NO: 1638526 - protein, 6 aa, Staphylococcus aureus
ISPNKV

SEQ ID NO: 1638527 - protein, 15 aa, Staphylococcus aureus
ISPPSDKSKHYEETQ

SEQ ID NO: 1638528 - protein, 8 aa, Staphylococcus aureus
ISQDFDDS

SEQ ID NO: 1638529 - protein, 4 aa, Staphylococcus aureus
ISQG

SEQ ID NO: 1638530 - protein, 4 aa, Staphylococcus aureus
ISQQ

SEQ ID NO: 1638531 - protein, 6 aa, Staphylococcus aureus
ISQQSN

SEQ ID NO: 1638532 - protein, 6 aa, Staphylococcus aureus
ISQSLE

SEQ ID NO: 1638533 - protein, 18 aa, Staphylococcus aureus
ISQVENSNFGERKHKLKQ

SEQ ID NO: 1638534 - protein, 10 aa, Staphylococcus aureus
ISREEQDTFA

SEQ ID NO: 1638535 - protein, 28 aa, Staphylococcus aureus
ISREEQDTFAVNSQKKAANAQQNGGFDS

SEQ ID NO: 1638536 - protein, 8 aa, Staphylococcus aureus
ISRERAAE

SEQ ID NO: 1638537 - protein, 28 aa, Staphylococcus aureus
ISRKVNPKKLQRQIAKEQKKPKYSTQAQ

SEQ ID NO: 1638538 - protein, 5 aa, Staphylococcus aureus
ISSEE

SEQ ID NO: 1638539 - protein, 7 aa, Staphylococcus aureus
ISSGKNN

SEQ ID NO: 1638540 - protein, 7 aa, Staphylococcus aureus
ISSSKKE

SEQ ID NO: 1638541 - protein, 5 aa, Staphylococcus aureus
ISSSR

SEQ ID NO: 1638542 - protein, 9 aa, Staphylococcus aureus
ISSTNKITD

SEQ ID NO: 1638543 - protein, 15 aa, Staphylococcus aureus
ISTDNASRRGPNTEA

SEQ ID NO: 1638544 - protein, 14 aa, Staphylococcus aureus
ISTDNASWRGPNIE

SEQ ID NO: 1638545 - protein, 8 aa, Staphylococcus aureus
ISTLSGGQ

SEQ ID NO: 1638546 - protein, 4 aa, Staphylococcus aureus
ISTS

SEQ ID NO: 1638547 - protein, 5 aa, Staphylococcus aureus
ISTSE

SEQ ID NO: 1638548 - protein, 5 aa, Staphylococcus aureus
ISVDN

SEQ ID NO: 1638549 - protein, 19 aa, Staphylococcus aureus
ISVKDKAKGIIKQATAKKR

SEQ ID NO: 1638550 - protein, 14 aa, Staphylococcus aureus
ISVTNTSNSANVST

SEQ ID NO: 1638551 - protein, 5 aa, Staphylococcus aureus
ISYDK

SEQ ID NO: 1638552 - protein, 6 aa, Staphylococcus aureus
ISYDKN

SEQ ID NO: 1638553 - protein, 4 aa, Staphylococcus aureus
ISYT

SEQ ID NO: 1638554 - protein, 10 aa, Staphylococcus aureus
ISYTNSATFP

SEQ ID NO: 1638555 - protein, 8 aa, Staphylococcus aureus
ITAASQLP

SEQ ID NO: 1638556 - protein, 10 aa, Staphylococcus aureus
ITDDGDKDHI

SEQ ID NO: 1638557 - protein, 4 aa, Staphylococcus aureus
ITDE

SEQ ID NO: 1638558 - protein, 7 aa, Staphylococcus aureus
ITDIGKT

SEQ ID NO: 1638559 - protein, 15 aa, Staphylococcus aureus
ITDRRGIIDKFRLPY

SEQ ID NO: 1638560 - protein, 34 aa, Staphylococcus aureus; identical to SEQ ID NO: 1566042

SEQ ID NO: 1638561 - protein, 6 aa, Staphylococcus aureus
ITENTV

SEQ ID NO: 1638562 - protein, 14 aa, Staphylococcus aureus
ITETGLTAGQQILD

SEQ ID NO: 1638563 - protein, 18 aa, Staphylococcus aureus
ITGESNRLKDYKTEKSLN

SEQ ID NO: 1638564 - protein, 7 aa, Staphylococcus aureus
ITGETSG

SEQ ID NO: 1638565 - protein, 23 aa, Staphylococcus aureus
ITGEYDTTTNDKKNATDSTYKSY

SEQ ID NO: 1638566 - protein, 23 aa, Staphylococcus aureus
ITGEYDTTTNDRKDATDSTYKSY

SEQ ID NO: 1638567 - protein, 6 aa, Staphylococcus aureus
ITGGGK

SEQ ID NO: 1638568 - protein, 10 aa, Staphylococcus aureus
ITGTSYATFE

SEQ ID NO: 1638569 - protein, 4 aa, Staphylococcus aureus
ITGY

SEQ ID NO: 1638570 - protein, 4 aa, Staphylococcus aureus
ITHE

SEQ ID NO: 1638571 - protein, 4 aa, Staphylococcus aureus
ITIQ

SEQ ID NO: 1638572 - protein, 4 aa, Staphylococcus aureus
ITIT

SEQ ID NO: 1638573 - protein, 5 aa, Staphylococcus aureus
ITITE

SEQ ID NO: 1638574 - protein, 10 aa, Staphylococcus aureus
ITKKGDNKLI

SEQ ID NO: 1638575 - protein, 5 aa, Staphylococcus aureus
ITKNK

SEQ ID NO: 1638576 - protein, 7 aa, Staphylococcus aureus
ITNGEQV

SEQ ID NO: 1638577 - protein, 19 aa, Staphylococcus aureus
ITNKNTSTSNESGVHFELT

SEQ ID NO: 1638578 - protein, 19 aa, Staphylococcus aureus
ITNKNTSTSNESGVRFELT

SEQ ID NO: 1638579 - protein, 4 aa, Staphylococcus aureus
ITNN

SEQ ID NO: 1638580 - protein, 6 aa, Staphylococcus aureus
ITNRGK

SEQ ID NO: 1638581 - protein, 24 aa, Staphylococcus aureus
ITPATKVKTDAKNAIDKSAETQHN

SEQ ID NO: 1638582 - protein, 72 aa, Staphylococcus aureus
ITPDANVKHQAKQAIADKVQAQETAIDANNGATTEEKTAAKQQVQTEKTTADTAIDGAHSNAEVEAAKNAEI

SEQ ID NO: 1638583 - protein, 72 aa, Staphylococcus aureus
ITPDANVKHQAKQAIADKVQAQETAIDANNGATTEEKTAAKQQVQTEKTTADTAIDGVHSNAEVEAAKNAEI

SEQ ID NO: 1638584 - protein, 4 aa, Staphylococcus aureus
ITPG

SEQ ID NO: 1638585 - protein, 8 aa, Staphylococcus aureus
ITQKGNAC

SEQ ID NO: 1638586 - protein, 7 aa, Staphylococcus aureus
ITQNQCQ

SEQ ID NO: 1638587 - protein, 16 aa, Staphylococcus aureus
ITQTASSIYDKQGDNV

SEQ ID NO: 1638588 - protein, 15 aa, Staphylococcus aureus
ITRLQGNKLRKSRQQ

SEQ ID NO: 1638589 - protein, 10 aa, Staphylococcus aureus
ITSKNKTEEK

SEQ ID NO: 1638590 - protein, 11 aa, Staphylococcus aureus
ITSTGKTGAGI

SEQ ID NO: 1638591 - protein, 4 aa, Staphylococcus aureus
ITTI

SEQ ID NO: 1638592 - protein, 16 aa, Staphylococcus aureus
ITTKENEVKELANSEI

SEQ ID NO: 1638593 - protein, 4 aa, Staphylococcus aureus
ITTQ

SEQ ID NO: 1638594 - protein, 9 aa, Staphylococcus aureus
ITTSESPTL

SEQ ID NO: 1638595 - protein, 12 aa, Staphylococcus aureus
ITVDNAKQQVKR

SEQ ID NO: 1638596 - protein, 30 aa, Staphylococcus aureus
ITVKKESHTGKWSDINKSQKDIQKTDEYYE

SEQ ID NO: 1638597 - protein, 10 aa, Staphylococcus aureus
ITYDSGGYSI

SEQ ID NO: 1638598 - protein, 8 aa, Staphylococcus aureus
ITYKPTGQ

SEQ ID NO: 1638599 - protein, 26 aa, Staphylococcus aureus
IVADGGNSEGGSGAKYQGAKHPNEKV

SEQ ID NO: 1638600 - protein, 22 aa, Staphylococcus aureus
IVKEPKPVDATGAVDPLKPDDR

SEQ ID NO: 1638601 - protein, 4 aa, Staphylococcus aureus
IVNN

SEQ ID NO: 1638602 - protein, 4 aa, Staphylococcus aureus
IVPS

SEQ ID NO: 1638603 - protein, 12 aa, Staphylococcus aureus
IVTEEKDDNHGT

SEQ ID NO: 1638604 - protein, 7 aa, Staphylococcus aureus
IVTETSE

SEQ ID NO: 1638605 - protein, 7 aa, Staphylococcus aureus
IVTTGGI

SEQ ID NO: 1638606 - protein, 8 aa, Staphylococcus aureus
IYGTSVKS

SEQ ID NO: 1638607 - protein, 29 aa, Staphylococcus aureus
IYSNKNNELITTQPADFEKNKKQVEKDLE

SEQ ID NO: 1638608 - protein, 4 aa, Staphylococcus aureus
IYSS

SEQ ID NO: 1638609 - protein, 13 aa, Staphylococcus aureus
IYYSTSKGETTNN

SEQ ID NO: 1638610 - protein, 9 aa, Staphylococcus aureus
KAADEAYKS

SEQ ID NO: 1638611 - protein, 14 aa, Staphylococcus aureus
KAAIDTHGVGAGAV

SEQ ID NO: 1638612 - protein, 12 aa, Staphylococcus aureus
KAAMAGDGQVTL

SEQ ID NO: 1638613 - protein, 6 aa, Staphylococcus aureus
KAAVTE

SEQ ID NO: 1638614 - protein, 8 aa, Staphylococcus aureus
KAAYPINA

SEQ ID NO: 1638615 - protein, 7 aa, Staphylococcus aureus
KADALKA

SEQ ID NO: 1638616 - protein, 6 aa, Staphylococcus aureus
KADDNQ

SEQ ID NO: 1638617 - protein, 10 aa, Staphylococcus aureus
KADETYSKNH

SEQ ID NO: 1638618 - protein, 9 aa, Staphylococcus aureus
KADGFKGSY

SEQ ID NO: 1638619 - protein, 9 aa, Staphylococcus aureus
KADLKSSAK

SEQ ID NO: 1638620 - protein, 8 aa, Staphylococcus aureus
KADNEPFH

SEQ ID NO: 1638621 - protein, 6 aa, Staphylococcus aureus
KADQLA

SEQ ID NO: 1638622 - protein, 8 aa, Staphylococcus aureus
KADSWDRR

SEQ ID NO: 1638623 - protein, 47 aa, Staphylococcus aureus
KADTEAAKNDVSKRSKRSLNTQNNKSTTQEISEEQKAEYQRKSEALK

SEQ ID NO: 1638624 - protein, 20 aa, Staphylococcus aureus
KAEGATIAVGGKRPDRDDLK

SEQ ID NO: 1638625 - protein, 19 aa, Staphylococcus aureus
KAEGATIAVGGKRPDRNDL

SEQ ID NO: 1638626 - protein, 10 aa, Staphylococcus aureus
KAEKAGKKVE

SEQ ID NO: 1638627 - protein, 11 aa, Staphylococcus aureus
KAEKNYSKQDA

SEQ ID NO: 1638628 - protein, 26 aa, Staphylococcus aureus
KAENDPKKSAKDLKAYYDKGYKTDIT

SEQ ID NO: 1638629 - protein, 19 aa, Staphylococcus aureus
KAENEVEPLQDKEMSKGHV

SEQ ID NO: 1638630 - protein, 6 aa, Staphylococcus aureus
KAENIN

SEQ ID NO: 1638631 - protein, 11 aa, Staphylococcus aureus
KAENNYSKQNA

SEQ ID NO: 1638632 - protein, 6 aa, Staphylococcus aureus
KAEPEL

SEQ ID NO: 1638633 - protein, 15 aa, Staphylococcus aureus
KAEQEYSDALAGEDI

SEQ ID NO: 1638634 - protein, 7 aa, Staphylococcus aureus
KAERGEC

SEQ ID NO: 1638635 - protein, 10 aa, Staphylococcus aureus
KAESINSTYE

SEQ ID NO: 1638636 - protein, 15 aa, Staphylococcus aureus
KAETDQKSKKTKQSM

SEQ ID NO: 1638637 - protein, 11 aa, Staphylococcus aureus
KAETLKGERPL

SEQ ID NO: 1638638 - protein, 11 aa, Staphylococcus aureus
KAETLKGQRPL

SEQ ID NO: 1638639 - protein, 5 aa, Staphylococcus aureus
KAETV

SEQ ID NO: 1638640 - protein, 12 aa, Staphylococcus aureus
KAEYNDQHSQFP

SEQ ID NO: 1638641 - protein, 4 aa, Staphylococcus aureus
KAFS

SEQ ID NO: 1638642 - protein, 11 aa, Staphylococcus aureus
KAGFEKEQDRL

SEQ ID NO: 1638643 - protein, 6 aa, Staphylococcus aureus
KAGIRM

SEQ ID NO: 1638644 - protein, 12 aa, Staphylococcus aureus
KAGKPTKSEKEK

SEQ ID NO: 1638645 - protein, 8 aa, Staphylococcus aureus
KAGNYKQQ

SEQ ID NO: 1638646 - protein, 6 aa, Staphylococcus aureus
KAGQNT

SEQ ID NO: 1638647 - protein, 15 aa, Staphylococcus aureus
KAGRAPYDKYDDEET

SEQ ID NO: 1638648 - protein, 13 aa, Staphylococcus aureus
KAHSSSGRSPSQL

SEQ ID NO: 1638649 - protein, 6 aa, Staphylococcus aureus
KAIEAG

SEQ ID NO: 1638650 - protein, 21 aa, Staphylococcus aureus
KAINDINQTAPATTAKAAALE

SEQ ID NO: 1638651 - protein, 14 aa, Staphylococcus aureus
KAIQELKQERNALE

SEQ ID NO: 1638652 - protein, 6 aa, Staphylococcus aureus
KAIQQG

SEQ ID NO: 1638653 - protein, 8 aa, Staphylococcus aureus
KAKASLSK

SEQ ID NO: 1638654 - protein, 9 aa, Staphylococcus aureus
KAKASYNHH

SEQ ID NO: 1638655 - protein, 9 aa, Staphylococcus aureus
KAKDTGREE

SEQ ID NO: 1638656 - protein, 58 aa, Staphylococcus aureus; identical to SEQ ID NO: 1563251

SEQ ID NO: 1638657 - protein, 13 aa, Staphylococcus aureus
KAKEDAKQDVDKQ

SEQ ID NO: 1638658 - protein, 16 aa, Staphylococcus aureus
KAKEDAKQDVDKQVQA

SEQ ID NO: 1638659 - protein, 13 aa, Staphylococcus aureus
KAKENAKQDVDKQ

SEQ ID NO: 1638660 - protein, 7 aa, Staphylococcus aureus
KAKEQGK

SEQ ID NO: 1638661 - protein, 8 aa, Staphylococcus aureus
KAKKEKGV

SEQ ID NO: 1638662 - protein, 9 aa, Staphylococcus aureus
KAKKSGYVT

SEQ ID NO: 1638663 - protein, 9 aa, Staphylococcus aureus
KAKPSPKMA

SEQ ID NO: 1638664 - protein, 5 aa, Staphylococcus aureus
KAKQQ

SEQ ID NO: 1638665 - protein, 7 aa, Staphylococcus aureus
KAKTDYA

SEQ ID NO: 1638666 - protein, 26 aa, Staphylococcus aureus
KALDSGVKVKDDKAESKHDKAISDGY

SEQ ID NO: 1638667 - protein, 11 aa, Staphylococcus aureus
KALEGDAKYEE

SEQ ID NO: 1638668 - protein, 48 aa, Staphylococcus aureus
KALKDIEKRPENKKAHNKRDNLQQQLDANEQKIEEGKRLQEEHGNELP

SEQ ID NO: 1638669 - protein, 5 aa, Staphylococcus aureus
KALNR

SEQ ID NO: 1638670 - protein, 13 aa, Staphylococcus aureus
KALPKGEGGKSLP

SEQ ID NO: 1638671 - protein, 4 aa, Staphylococcus aureus
KANE

SEQ ID NO: 1638672 - protein, 6 aa, Staphylococcus aureus
KANEIL

SEQ ID NO: 1638673 - protein, 7 aa, Staphylococcus aureus
KANLDRN

SEQ ID NO: 1638674 - protein, 6 aa, Staphylococcus aureus
KANNRF

SEQ ID NO: 1638675 - protein, 7 aa, Staphylococcus aureus
KANPNII

SEQ ID NO: 1638676 - protein, 11 aa, Staphylococcus aureus
KAPEGVDNEQQ

SEQ ID NO: 1638677 - protein, 4 aa, Staphylococcus aureus
KAPH

SEQ ID NO: 1638678 - protein, 13 aa, Staphylococcus aureus
KAPLENAKNQLQH

SEQ ID NO: 1638679 - protein, 33 aa, Staphylococcus aureus; identical to SEQ ID NO: 1569000

SEQ ID NO: 1638680 - protein, 8 aa, Staphylococcus aureus
KAPYTKSD

SEQ ID NO: 1638681 - protein, 15 aa, Staphylococcus aureus
KAQGPNTAKDNVETA

SEQ ID NO: 1638682 - protein, 7 aa, Staphylococcus aureus
KAQGVSV

SEQ ID NO: 1638683 - protein, 29 aa, Staphylococcus aureus
KAQGVSVAPTQNSSKKPARGIQKSKNAFS

SEQ ID NO: 1638684 - protein, 6 aa, Staphylococcus aureus
KAQINY

SEQ ID NO: 1638685 - protein, 7 aa, Staphylococcus aureus
KAQPSET

SEQ ID NO: 1638686 - protein, 6 aa, Staphylococcus aureus
KAREVR

SEQ ID NO: 1638687 - protein, 6 aa, Staphylococcus aureus
KARFEK

SEQ ID NO: 1638688 - protein, 6 aa, Staphylococcus aureus
KARKEI

SEQ ID NO: 1638689 - protein, 14 aa, Staphylococcus aureus
KARQKELDDLNNSR

SEQ ID NO: 1638690 - protein, 13 aa, Staphylococcus aureus
KARSRDSGGTGLG

SEQ ID NO: 1638691 - protein, 9 aa, Staphylococcus aureus
KASEQQAKN

SEQ ID NO: 1638692 - protein, 8 aa, Staphylococcus aureus
KASERQLK

SEQ ID NO: 1638693 - protein, 6 aa, Staphylococcus aureus
KASETI

SEQ ID NO: 1638694 - protein, 8 aa, Staphylococcus aureus
KASGGVRN

SEQ ID NO: 1638695 - protein, 6 aa, Staphylococcus aureus
KASRIR

SEQ ID NO: 1638696 - protein, 21 aa, Staphylococcus aureus
KASSDVSLATESDDAQKLKIT

SEQ ID NO: 1638697 - protein, 7 aa, Staphylococcus aureus
KASSFTG

SEQ ID NO: 1638698 - protein, 24 aa, Staphylococcus aureus
KASTESAEKSKKLDEFKTKVKENR

SEQ ID NO: 1638699 - protein, 25 aa, Staphylococcus aureus
KASTESAEKSKKLDEFKTKVKENRL

SEQ ID NO: 1638700 - protein, 8 aa, Staphylococcus aureus
KASTNAFE

SEQ ID NO: 1638701 - protein, 11 aa, Staphylococcus aureus
KATDAPNHGMR

SEQ ID NO: 1638702 - protein, 5 aa, Staphylococcus aureus
KATKD

SEQ ID NO: 1638703 - protein, 7 aa, Staphylococcus aureus
KATKRRK

SEQ ID NO: 1638704 - protein, 8 aa, Staphylococcus aureus
KATQTQIV

SEQ ID NO: 1638705 - protein, 6 aa, Staphylococcus aureus
KAVAGL

SEQ ID NO: 1638706 - protein, 20 aa, Staphylococcus aureus
KAVAGTIKRSQDEDADTKNV

SEQ ID NO: 1638707 - protein, 16 aa, Staphylococcus aureus
KAVGKEKEGEKRLEKH

SEQ ID NO: 1638708 - protein, 6 aa, Staphylococcus aureus
KAVGQE

SEQ ID NO: 1638709 - protein, 11 aa, Staphylococcus aureus
KAVKDNKVYDV

SEQ ID NO: 1638710 - protein, 23 aa, Staphylococcus aureus
KAVKEKQQQIDNSLDSTDNEKEV

SEQ ID NO: 1638711 - protein, 37 aa, Staphylococcus aureus
KAVKEKQQQIDNSLDSTDNEKEVASQALAKEKEKALA

SEQ ID NO: 1638712 - protein, 57 aa, Staphylococcus aureus
KAVKEKQQQIDNSLDSTDNEKEVASQALAKEKEKALATIDQAQTNSQVNQAATNGVS

SEQ ID NO: 1638713 - protein, 9 aa, Staphylococcus aureus
KAVTPNSND

SEQ ID NO: 1638714 - protein, 4 aa, Staphylococcus aureus
KAYI

SEQ ID NO: 1638715 - protein, 20 aa, Staphylococcus aureus
KAYNHTEKHKEESRKLDDRT

SEQ ID NO: 1638716 - protein, 5 aa, Staphylococcus aureus
KCAHS

SEQ ID NO: 1638717 - protein, 4 aa, Staphylococcus aureus
KCGH

SEQ ID NO: 1638718 - protein, 16 aa, Staphylococcus aureus
KCNDADVVERKSKKNR

SEQ ID NO: 1638719 - protein, 16 aa, Staphylococcus aureus
KCNDGDVVERKSKNNR

SEQ ID NO: 1638720 - protein, 12 aa, Staphylococcus aureus
KCNNEAELKEGV

SEQ ID NO: 1638721 - protein, 5 aa, Staphylococcus aureus
KCNTL

SEQ ID NO: 1638722 - protein, 13 aa, Staphylococcus aureus
KDAAEKAKKDLSG

SEQ ID NO: 1638723 - protein, 16 aa, Staphylococcus aureus
KDAAQAAIEKANSTED

SEQ ID NO: 1638724 - protein, 8 aa, Staphylococcus aureus
KDAEPIKA

SEQ ID NO: 1638725 - protein, 17 aa, Staphylococcus aureus
KDAKIYGNNATGKTITA

SEQ ID NO: 1638726 - protein, 18 aa, Staphylococcus aureus
KDASPTVTTFKPNTNDEV

SEQ ID NO: 1638727 - protein, 46 aa, Staphylococcus aureus
KDDAGCTVSGGNVSANGIDKFNENAKGGNLEGKGKEIQKIAEKNKV

SEQ ID NO: 1638728 - protein, 5 aa, Staphylococcus aureus
KDDEG

SEQ ID NO: 1638729 - protein, 5 aa, Staphylococcus aureus
KDDFG

SEQ ID NO: 1638730 - protein, 41 aa, Staphylococcus aureus
KDDIDSEKENKLPKLEQGDKVTATQIEPAQHYTQPPPRYTE

SEQ ID NO: 1638731 - protein, 9 aa, Staphylococcus aureus
KDDKGVVDS

SEQ ID NO: 1638732 - protein, 10 aa, Staphylococcus aureus
KDDPSQSANL

SEQ ID NO: 1638733 - protein, 11 aa, Staphylococcus aureus
KDDPSQSANVL

SEQ ID NO: 1638734 - protein, 13 aa, Staphylococcus aureus
KDDPSQSTNVLGE

SEQ ID NO: 1638735 - protein, 23 aa, Staphylococcus aureus
KDDQERLSVTESANKIYNKSAKE

SEQ ID NO: 1638736 - protein, 23 aa, Staphylococcus aureus
KDDQERLSVTESTNKIYNKSAKE

SEQ ID NO: 1638737 - protein, 16 aa, Staphylococcus aureus
KDDTQTTNSDNQETNS

SEQ ID NO: 1638738 - protein, 8 aa, Staphylococcus aureus
KDDVEGVK

SEQ ID NO: 1638739 - protein, 7 aa, Staphylococcus aureus
KDDYHSD

SEQ ID NO: 1638740 - protein, 13 aa, Staphylococcus aureus
KDDYVDGSEVKER

SEQ ID NO: 1638741 - protein, 17 aa, Staphylococcus aureus
KDEEGNIKTDKNGQYTV

SEQ ID NO: 1638742 - protein, 8 aa, Staphylococcus aureus
KDEGSHTL

SEQ ID NO: 1638743 - protein, 7 aa, Staphylococcus aureus
KDEIGNT

SEQ ID NO: 1638744 - protein, 6 aa, Staphylococcus aureus
KDEKWE

SEQ ID NO: 1638745 - protein, 13 aa, Staphylococcus aureus
KDENGEDYPDWKE

SEQ ID NO: 1638746 - protein, 12 aa, Staphylococcus aureus
KDENGEEYPEWE

SEQ ID NO: 1638747 - protein, 11 aa, Staphylococcus aureus
KDENGEEYPNW

SEQ ID NO: 1638748 - protein, 14 aa, Staphylococcus aureus
KDENGNDYPDWTNE

SEQ ID NO: 1638749 - protein, 10 aa, Staphylococcus aureus
KDENGNDYPN

SEQ ID NO: 1638750 - protein, 7 aa, Staphylococcus aureus
KDEQEKV

SEQ ID NO: 1638751 - protein, 16 aa, Staphylococcus aureus
KDEQVKDRELSDYAGE

SEQ ID NO: 1638752 - protein, 6 aa, Staphylococcus aureus
KDESGV

SEQ ID NO: 1638753 - protein, 6 aa, Staphylococcus aureus
KDESLD

SEQ ID NO: 1638754 - protein, 5 aa, Staphylococcus aureus
KDETG

SEQ ID NO: 1638755 - protein, 7 aa, Staphylococcus aureus
KDEVETP

SEQ ID NO: 1638756 - protein, 12 aa, Staphylococcus aureus
KDEYRKESYTYK

SEQ ID NO: 1638757 - protein, 11 aa, Staphylococcus aureus
KDFKKMSEAKY

SEQ ID NO: 1638758 - protein, 10 aa, Staphylococcus aureus
KDGAREQFSR

SEQ ID NO: 1638759 - protein, 10 aa, Staphylococcus aureus
KDGEKQEIDL

SEQ ID NO: 1638760 - protein, 4 aa, Staphylococcus aureus
KDGF

SEQ ID NO: 1638761 - protein, 8 aa, Staphylococcus aureus
KDGGPRDY

SEQ ID NO: 1638762 - protein, 4 aa, Staphylococcus aureus
KDGH

SEQ ID NO: 1638763 - protein, 6 aa, Staphylococcus aureus
KDGIGN

SEQ ID NO: 1638764 - protein, 15 aa, Staphylococcus aureus
KDGKKEWTETVNREQ

SEQ ID NO: 1638765 - protein, 9 aa, Staphylococcus aureus
KDGNRTIEA

SEQ ID NO: 1638766 - protein, 8 aa, Staphylococcus aureus
KDGRFDDV

SEQ ID NO: 1638767 - protein, 14 aa, Staphylococcus aureus
KDGRFDDVQQDIEA

SEQ ID NO: 1638768 - protein, 15 aa, Staphylococcus aureus
KDGRFDDVQQDIEAV

SEQ ID NO: 1638769 - protein, 17 aa, Staphylococcus aureus
KDGRFDDVQQDIEAVVK

SEQ ID NO: 1638770 - protein, 20 aa, Staphylococcus aureus
KDGRLSAKEVVGNKKALTEF

SEQ ID NO: 1638771 - protein, 20 aa, Staphylococcus aureus
KDGSKPDKKIAKEIFLREEK

SEQ ID NO: 1638772 - protein, 7 aa, Staphylococcus aureus
KDGTIGK

SEQ ID NO: 1638773 - protein, 9 aa, Staphylococcus aureus
KDGTLDPVI

SEQ ID NO: 1638774 - protein, 8 aa, Staphylococcus aureus
KDGTLDSV

SEQ ID NO: 1638775 - protein, 16 aa, Staphylococcus aureus
KDIDNYRTVEESYRQG

SEQ ID NO: 1638776 - protein, 6 aa, Staphylococcus aureus
KDIEEL

SEQ ID NO: 1638777 - protein, 8 aa, Staphylococcus aureus
KDINTDDI

SEQ ID NO: 1638778 - protein, 7 aa, Staphylococcus aureus
KDKAYTA

SEQ ID NO: 1638779 - protein, 15 aa, Staphylococcus aureus
KDKDPLSVDKLRAFG

SEQ ID NO: 1638780 - protein, 8 aa, Staphylococcus aureus
KDKEIEEI

SEQ ID NO: 1638781 - protein, 8 aa, Staphylococcus aureus
KDKGIYKG

SEQ ID NO: 1638782 - protein, 8 aa, Staphylococcus aureus
KDKKEHGV

SEQ ID NO: 1638783 - protein, 9 aa, Staphylococcus aureus
KDKKLKNEI

SEQ ID NO: 1638784 - protein, 10 aa, Staphylococcus aureus
KDKKTITAYK

SEQ ID NO: 1638785 - protein, 17 aa, Staphylococcus aureus
KDKKTITAYKEEIQSEQ

SEQ ID NO: 1638786 - protein, 6 aa, Staphylococcus aureus
KDKQAF

SEQ ID NO: 1638787 - protein, 9 aa, Staphylococcus aureus
KDKSEKTRI

SEQ ID NO: 1638788 - protein, 9 aa, Staphylococcus aureus
KDKSSAHTL

SEQ ID NO: 1638789 - protein, 9 aa, Staphylococcus aureus
KDKTAQFQE

SEQ ID NO: 1638790 - protein, 7 aa, Staphylococcus aureus
KDKYVEK

SEQ ID NO: 1638791 - protein, 19 aa, Staphylococcus aureus
KDLENGTPTEVLTGENEGY

SEQ ID NO: 1638792 - protein, 8 aa, Staphylococcus aureus
KDLKRNER

SEQ ID NO: 1638793 - protein, 6 aa, Staphylococcus aureus
KDLPTT

SEQ ID NO: 1638794 - protein, 50 aa, Staphylococcus aureus
KDLSEEKKNDSISEDGFTKEGKFVEETKSDPDDNREIEPPKKGFWSRFFG

SEQ ID NO: 1638795 - protein, 27 aa, Staphylococcus aureus
KDLSFTASTYADQNNQFEADYSSTSGF

SEQ ID NO: 1638796 - protein, 6 aa, Staphylococcus aureus
KDNADA

SEQ ID NO: 1638797 - protein, 5 aa, Staphylococcus aureus
KDNDL

SEQ ID NO: 1638798 - protein, 8 aa, Staphylococcus aureus
KDNELADG

SEQ ID NO: 1638799 - protein, 10 aa, Staphylococcus aureus
KDNFTKDNTI

SEQ ID NO: 1638800 - protein, 20 aa, Staphylococcus aureus
KDNIKNTKNKQLDSHESVPE

SEQ ID NO: 1638801 - protein, 5 aa, Staphylococcus aureus
KDNKN

SEQ ID NO: 1638802 - protein, 5 aa, Staphylococcus aureus
KDNLQ

SEQ ID NO: 1638803 - protein, 5 aa, Staphylococcus aureus
KDNMT

SEQ ID NO: 1638804 - protein, 15 aa, Staphylococcus aureus
KDNNVRDGYSTNSRI

SEQ ID NO: 1638805 - protein, 5 aa, Staphylococcus aureus
KDNPN

SEQ ID NO: 1638806 - protein, 10 aa, Staphylococcus aureus
KDNRDPQKIG

SEQ ID NO: 1638807 - protein, 8 aa, Staphylococcus aureus
KDNSAVTA

SEQ ID NO: 1638808 - protein, 8 aa, Staphylococcus aureus
KDNSKKVL

SEQ ID NO: 1638809 - protein, 8 aa, Staphylococcus aureus
KDNVKEVQ

SEQ ID NO: 1638810 - protein, 6 aa, Staphylococcus aureus
KDPEVY

SEQ ID NO: 1638811 - protein, 40 aa, Staphylococcus aureus
KDPGHHGGGGAGHEKRSNEPARKSYNNRTTELERPSESTM

SEQ ID NO: 1638812 - protein, 6 aa, Staphylococcus aureus
KDPTSF

SEQ ID NO: 1638813 - protein, 12 aa, Staphylococcus aureus
KDQKAVKAEHEL

SEQ ID NO: 1638814 - protein, 7 aa, Staphylococcus aureus
KDQQQFQ

SEQ ID NO: 1638815 - protein, 13 aa, Staphylococcus aureus
KDQRPHALSGGQQ

SEQ ID NO: 1638816 - protein, 15 aa, Staphylococcus aureus
KDQRPQALSGGQQQR

SEQ ID NO: 1638817 - protein, 6 aa, Staphylococcus aureus
KDQRTV

SEQ ID NO: 1638818 - protein, 4 aa, Staphylococcus aureus
KDQS

SEQ ID NO: 1638819 - protein, 18 aa, Staphylococcus aureus
KDQSSKLEGAFEGKTSDA

SEQ ID NO: 1638820 - protein, 7 aa, Staphylococcus aureus
KDREISS

SEQ ID NO: 1638821 - protein, 6 aa, Staphylococcus aureus
KDRIQK

SEQ ID NO: 1638822 - protein, 7 aa, Staphylococcus aureus
KDRKRTV

SEQ ID NO: 1638823 - protein, 15 aa, Staphylococcus aureus
KDRNKFCENIISVPI

SEQ ID NO: 1638824 - protein, 13 aa, Staphylococcus aureus
KDRPINETDEERY

SEQ ID NO: 1638825 - protein, 18 aa, Staphylococcus aureus
KDRPTDKQLNIDKKDLNK

SEQ ID NO: 1638826 - protein, 8 aa, Staphylococcus aureus
KDSENENV

SEQ ID NO: 1638827 - protein, 6 aa, Staphylococcus aureus
KDSFEY

SEQ ID NO: 1638828 - protein, 5 aa, Staphylococcus aureus
KDSGL

SEQ ID NO: 1638829 - protein, 13 aa, Staphylococcus aureus
KDSIKHSDSKTRN

SEQ ID NO: 1638830 - protein, 10 aa, Staphylococcus aureus
KDSIRKKENP

SEQ ID NO: 1638831 - protein, 4 aa, Staphylococcus aureus
KDSK

SEQ ID NO: 1638832 - protein, 7 aa, Staphylococcus aureus
KDSKENR

SEQ ID NO: 1638833 - protein, 8 aa, Staphylococcus aureus
KDSKIVSA

SEQ ID NO: 1638834 - protein, 6 aa, Staphylococcus aureus
KDSNIS

SEQ ID NO: 1638835 - protein, 7 aa, Staphylococcus aureus
KDSPLEN

SEQ ID NO: 1638836 - protein, 47 aa, Staphylococcus aureus; identical to SEQ ID NO: 1567490

SEQ ID NO: 1638837 - protein, 47 aa, Staphylococcus aureus; identical to SEQ ID NO: 1567491

SEQ ID NO: 1638838 - protein, 7 aa, Staphylococcus aureus
KDTDTKV

SEQ ID NO: 1638839 - protein, 16 aa, Staphylococcus aureus
KDTEHNQAVVLQQLLN

SEQ ID NO: 1638840 - protein, 5 aa, Staphylococcus aureus
KDTFN

SEQ ID NO: 1638841 - protein, 8 aa, Staphylococcus aureus
KDTPNTLI

SEQ ID NO: 1638842 - protein, 7 aa, Staphylococcus aureus
KDTPTYK

SEQ ID NO: 1638843 - protein, 8 aa, Staphylococcus aureus
KDTSIKAI

SEQ ID NO: 1638844 - protein, 14 aa, Staphylococcus aureus
KDTTLNDSKMYTDT

SEQ ID NO: 1638845 - protein, 12 aa, Staphylococcus aureus
KDVEVETNIGPR

SEQ ID NO: 1638846 - protein, 9 aa, Staphylococcus aureus
KDVKTGKYK

SEQ ID NO: 1638847 - protein, 8 aa, Staphylococcus aureus
KDVPNSIN

SEQ ID NO: 1638848 - protein, 13 aa, Staphylococcus aureus
KDVSGKTKKEKSR

SEQ ID NO: 1638849 - protein, 21 aa, Staphylococcus aureus
KDVSGKTKRKISSDAKKNGEF

SEQ ID NO: 1638850 - protein, 20 aa, Staphylococcus aureus
KDVSNTNPNHTVIVDDIPLE

SEQ ID NO: 1638851 - protein, 23 aa, Staphylococcus aureus
KDWEEKTAKDGKEIKKAIGQDAT

SEQ ID NO: 1638852 - protein, 10 aa, Staphylococcus aureus
KDYGDIPQNR

SEQ ID NO: 1638853 - protein, 30 aa, Staphylococcus aureus
KDYKDGDISYNPNVPSYSAKYQLSNDDYNV

SEQ ID NO: 1638854 - protein, 29 aa, Staphylococcus aureus
KDYKNGNISYNPNVPSYSAKYQLSNDDYN

SEQ ID NO: 1638855 - protein, 4 aa, Staphylococcus aureus
KDYN

SEQ ID NO: 1638856 - protein, 7 aa, Staphylococcus aureus
KDYNVSE

SEQ ID NO: 1638857 - protein, 10 aa, Staphylococcus aureus
KDYPKTSDDY

SEQ ID NO: 1638858 - protein, 18 aa, Staphylococcus aureus
KDYSNNFYNNTQNTIPTE

SEQ ID NO: 1638859 - protein, 4 aa, Staphylococcus aureus
KEAD

SEQ ID NO: 1638860 - protein, 7 aa, Staphylococcus aureus
KEAGTMQ

SEQ ID NO: 1638861 - protein, 24 aa, Staphylococcus aureus
KEALTDDNVEGVAGYDGLSLSQQI

SEQ ID NO: 1638862 - protein, 4 aa, Staphylococcus aureus
KEAN

SEQ ID NO: 1638863 - protein, 7 aa, Staphylococcus aureus
KEANVSK

SEQ ID NO: 1638864 - protein, 7 aa, Staphylococcus aureus
KEDAEKI

SEQ ID NO: 1638865 - protein, 9 aa, Staphylococcus aureus
KEDAPVLNG

SEQ ID NO: 1638866 - protein, 5 aa, Staphylococcus aureus
KEDEY

SEQ ID NO: 1638867 - protein, 11 aa, Staphylococcus aureus
KEDGTLRSDEV

SEQ ID NO: 1638868 - protein, 6 aa, Staphylococcus aureus
KEDIKK

SEQ ID NO: 1638869 - protein, 7 aa, Staphylococcus aureus
KEDITTY

SEQ ID NO: 1638870 - protein, 6 aa, Staphylococcus aureus
KEDLQA

SEQ ID NO: 1638871 - protein, 12 aa, Staphylococcus aureus
KEDNPTPTKDSV

SEQ ID NO: 1638872 - protein, 5 aa, Staphylococcus aureus
KEDRT

SEQ ID NO: 1638873 - protein, 12 aa, Staphylococcus aureus
KEDSKEEQIKKS

SEQ ID NO: 1638874 - protein, 13 aa, Staphylococcus aureus
KEEDQKEKVIRNV

SEQ ID NO: 1638875 - protein, 7 aa, Staphylococcus aureus
KEEEKYK

SEQ ID NO: 1638876 - protein, 7 aa, Staphylococcus aureus
KEEGHEV

SEQ ID NO: 1638877 - protein, 5 aa, Staphylococcus aureus
KEEGL

SEQ ID NO: 1638878 - protein, 8 aa, Staphylococcus aureus
KEEHNAAR

SEQ ID NO: 1638879 - protein, 8 aa, Staphylococcus aureus
KEEIKALE

SEQ ID NO: 1638880 - protein, 10 aa, Staphylococcus aureus
KEEKIKKEEK

SEQ ID NO: 1638881 - protein, 12 aa, Staphylococcus aureus
KEELRDDVEYGG

SEQ ID NO: 1638882 - protein, 17 aa, Staphylococcus aureus
KEENKNIEVTHTKSGTT

SEQ ID NO: 1638883 - protein, 5 aa, Staphylococcus aureus
KEENV

SEQ ID NO: 1638884 - protein, 10 aa, Staphylococcus aureus
KEEQKAIKKE

SEQ ID NO: 1638885 - protein, 7 aa, Staphylococcus aureus
KEETIEA

SEQ ID NO: 1638886 - protein, 5 aa, Staphylococcus aureus
KEEVS

SEQ ID NO: 1638887 - protein, 6 aa, Staphylococcus aureus
KEFAQG

SEQ ID NO: 1638888 - protein, 11 aa, Staphylococcus aureus
KEGEFSRQNVT

SEQ ID NO: 1638889 - protein, 16 aa, Staphylococcus aureus
KEGFRDQEFDKRDKGT

SEQ ID NO: 1638890 - protein, 17 aa, Staphylococcus aureus
KEGFRDQEFEKGDKGNW

SEQ ID NO: 1638891 - protein, 17 aa, Staphylococcus aureus
KEGFRDQEFKKGDKGTW

SEQ ID NO: 1638892 - protein, 7 aa, Staphylococcus aureus
KEGKMAK

SEQ ID NO: 1638893 - protein, 6 aa, Staphylococcus aureus
KEGNDI

SEQ ID NO: 1638894 - protein, 10 aa, Staphylococcus aureus
KEGQYPETEL

SEQ ID NO: 1638895 - protein, 10 aa, Staphylococcus aureus
KEGSSGQPYD

SEQ ID NO: 1638896 - protein, 10 aa, Staphylococcus aureus
KEHDSEQWDD

SEQ ID NO: 1638897 - protein, 5 aa, Staphylococcus aureus
KEHND

SEQ ID NO: 1638898 - protein, 12 aa, Staphylococcus aureus
KEIKSSKNEEYK

SEQ ID NO: 1638899 - protein, 16 aa, Staphylococcus aureus
KEILPSTAKDKNGKNV

SEQ ID NO: 1638900 - protein, 4 aa, Staphylococcus aureus
KEIN

SEQ ID NO: 1638901 - protein, 14 aa, Staphylococcus aureus
KEISEEDANDASGL

SEQ ID NO: 1638902 - protein, 9 aa, Staphylococcus aureus
KEKDIDKRV

SEQ ID NO: 1638903 - protein, 23 aa, Staphylococcus aureus
KEKDKKFKLNTPYGKVTSRKGAK

SEQ ID NO: 1638904 - protein, 9 aa, Staphylococcus aureus
KEKEIDSYK

SEQ ID NO: 1638905 - protein, 8 aa, Staphylococcus aureus
KEKEIESY

SEQ ID NO: 1638906 - protein, 12 aa, Staphylococcus aureus
KEKENENARHNL

SEQ ID NO: 1638907 - protein, 21 aa, Staphylococcus aureus
KEKGDTQKKVASKLDISPQRY

SEQ ID NO: 1638908 - protein, 29 aa, Staphylococcus aureus
KEKGDTQKKVASKLDISPQRYQLKESGKA

SEQ ID NO: 1638909 - protein, 7 aa, Staphylococcus aureus
KEKGDYD

SEQ ID NO: 1638910 - protein, 7 aa, Staphylococcus aureus
KEKGYTD

SEQ ID NO: 1638911 - protein, 5 aa, Staphylococcus aureus
KEKID

SEQ ID NO: 1638912 - protein, 11 aa, Staphylococcus aureus
KEKKPSKNQIP

SEQ ID NO: 1638913 - protein, 4 aa, Staphylococcus aureus
KEKL

SEQ ID NO: 1638914 - protein, 11 aa, Staphylococcus aureus
KEKLHDKSSSI

SEQ ID NO: 1638915 - protein, 11 aa, Staphylococcus aureus
KEKLNNQSSSI

SEQ ID NO: 1638916 - protein, 6 aa, Staphylococcus aureus
KEKPTA

SEQ ID NO: 1638917 - protein, 4 aa, Staphylococcus aureus
KEKQ

SEQ ID NO: 1638918 - protein, 7 aa, Staphylococcus aureus
KEKQERV

SEQ ID NO: 1638919 - protein, 51 aa, Staphylococcus aureus; identical to SEQ ID NO: 1559720

SEQ ID NO: 1638920 - protein, 5 aa, Staphylococcus aureus
KEKRF

SEQ ID NO: 1638921 - protein, 16 aa, Staphylococcus aureus
KEKTNISRATLYRHLD

SEQ ID NO: 1638922 - protein, 9 aa, Staphylococcus aureus
KEKVSSNNI

SEQ ID NO: 1638923 - protein, 6 aa, Staphylococcus aureus
KELDEI

SEQ ID NO: 1638924 - protein, 7 aa, Staphylococcus aureus
KELEDEG

SEQ ID NO: 1638925 - protein, 16 aa, Staphylococcus aureus
KELEGELEELTCEDWE

SEQ ID NO: 1638926 - protein, 7 aa, Staphylococcus aureus
KELESRG

SEQ ID NO: 1638927 - protein, 7 aa, Staphylococcus aureus
KELKDKF

SEQ ID NO: 1638928 - protein, 10 aa, Staphylococcus aureus
KELNEEKEQL

SEQ ID NO: 1638929 - protein, 6 aa, Staphylococcus aureus
KELNEP

SEQ ID NO: 1638930 - protein, 7 aa, Staphylococcus aureus
KELPEKL

SEQ ID NO: 1638931 - protein, 19 aa, Staphylococcus aureus
KELQRKKIRDTNKGKELQA

SEQ ID NO: 1638932 - protein, 10 aa, Staphylococcus aureus
KELSDIQSKK

SEQ ID NO: 1638933 - protein, 8 aa, Staphylococcus aureus
KELTDKNI

SEQ ID NO: 1638934 - protein, 6 aa, Staphylococcus aureus
KELTES

SEQ ID NO: 1638935 - protein, 10 aa, Staphylococcus aureus
KELVDGAPKV

SEQ ID NO: 1638936 - protein, 5 aa, Staphylococcus aureus
KELVE

SEQ ID NO: 1638937 - protein, 6 aa, Staphylococcus aureus
KEMKDS

SEQ ID NO: 1638938 - protein, 6 aa, Staphylococcus aureus
KEMPGK

SEQ ID NO: 1638939 - protein, 6 aa, Staphylococcus aureus
KEMYGN

SEQ ID NO: 1638940 - protein, 5 aa, Staphylococcus aureus
KENAN

SEQ ID NO: 1638941 - protein, 9 aa, Staphylococcus aureus
KENDSSIEN

SEQ ID NO: 1638942 - protein, 8 aa, Staphylococcus aureus
KENENNRA

SEQ ID NO: 1638943 - protein, 7 aa, Staphylococcus aureus
KENGREF

SEQ ID NO: 1638944 - protein, 7 aa, Staphylococcus aureus
KENGVNY

SEQ ID NO: 1638945 - protein, 4 aa, Staphylococcus aureus
KENI

SEQ ID NO: 1638946 - protein, 15 aa, Staphylococcus aureus
KENITSINNTSNNNI

SEQ ID NO: 1638947 - protein, 12 aa, Staphylococcus aureus
KENLKNEGYDIS

SEQ ID NO: 1638948 - protein, 18 aa, Staphylococcus aureus
KENQEQYNEQIQKIKSNI

SEQ ID NO: 1638949 - protein, 17 aa, Staphylococcus aureus
KENSSSTSCILSNTFKK

SEQ ID NO: 1638950 - protein, 34 aa, Staphylococcus aureus
KENVKTKEDAEHKIAPRKNTTDDVIAQMEKELSD

SEQ ID NO: 1638951 - protein, 9 aa, Staphylococcus aureus
KEPGGGTTD

SEQ ID NO: 1638952 - protein, 9 aa, Staphylococcus aureus
KEPHKSEYQ

SEQ ID NO: 1638953 - protein, 5 aa, Staphylococcus aureus
KEPIK

SEQ ID NO: 1638954 - protein, 11 aa, Staphylococcus aureus
KEPKSRHTYPT

SEQ ID NO: 1638955 - protein, 7 aa, Staphylococcus aureus
KEPPSLK

SEQ ID NO: 1638956 - protein, 4 aa, Staphylococcus aureus
KEPV

SEQ ID NO: 1638957 - protein, 10 aa, Staphylococcus aureus
KEQDLNTAMQ

SEQ ID NO: 1638958 - protein, 6 aa, Staphylococcus aureus
KEQGFR

SEQ ID NO: 1638959 - protein, 9 aa, Staphylococcus aureus
KEQKGLGHA

SEQ ID NO: 1638960 - protein, 17 aa, Staphylococcus aureus
KEQRGPLDGDYEHNDNN

SEQ ID NO: 1638961 - protein, 12 aa, Staphylococcus aureus
KERDEYKKQQDE

SEQ ID NO: 1638962 - protein, 10 aa, Staphylococcus aureus
KEREGKYQVE

SEQ ID NO: 1638963 - protein, 21 aa, Staphylococcus aureus
KEREGKYQVEDDTTKDELQQA

SEQ ID NO: 1638964 - protein, 5 aa, Staphylococcus aureus
KESDE

SEQ ID NO: 1638965 - protein, 5 aa, Staphylococcus aureus
KESDF

SEQ ID NO: 1638966 - protein, 10 aa, Staphylococcus aureus
KESGGGTTDY

SEQ ID NO: 1638967 - protein, 4 aa, Staphylococcus aureus
KESQ

SEQ ID NO: 1638968 - protein, 14 aa, Staphylococcus aureus
KESSIDRKQFENSI

SEQ ID NO: 1638969 - protein, 28 aa, Staphylococcus aureus
KESWTAGEISYSKETVDKIENSIKIRFL

SEQ ID NO: 1638970 - protein, 8 aa, Staphylococcus aureus
KESYQISE

SEQ ID NO: 1638971 - protein, 10 aa, Staphylococcus aureus
KETAASQDDL

SEQ ID NO: 1638972 - protein, 6 aa, Staphylococcus aureus
KETDDA

SEQ ID NO: 1638973 - protein, 13 aa, Staphylococcus aureus
KETGEITEPTEKA

SEQ ID NO: 1638974 - protein, 16 aa, Staphylococcus aureus
KETGYKIAKNSGLPYQ

SEQ ID NO: 1638975 - protein, 6 aa, Staphylococcus aureus
KETPKY

SEQ ID NO: 1638976 - protein, 8 aa, Staphylococcus aureus
KETQQAIN

SEQ ID NO: 1638977 - protein, 6 aa, Staphylococcus aureus
KETRRA

SEQ ID NO: 1638978 - protein, 8 aa, Staphylococcus aureus
KETSANQF

SEQ ID NO: 1638979 - protein, 6 aa, Staphylococcus aureus
KETSGI

SEQ ID NO: 1638980 - protein, 6 aa, Staphylococcus aureus
KETTYQ

SEQ ID NO: 1638981 - protein, 7 aa, Staphylococcus aureus
KETYGVS

SEQ ID NO: 1638982 - protein, 22 aa, Staphylococcus aureus
KETYTQFDKSKKRKRSNIPNGK

SEQ ID NO: 1638983 - protein, 6 aa, Staphylococcus aureus
KEVEKN

SEQ ID NO: 1638984 - protein, 5 aa, Staphylococcus aureus
KEVSV

SEQ ID NO: 1638985 - protein, 38 aa, Staphylococcus aureus
KEVTTKTSIRISDKTSVDSASTRGPTPSDKKPSIVTEK

SEQ ID NO: 1638986 - protein, 42 aa, Staphylococcus aureus
KEVTTKTSIRISDKTSVDSASTRGPTPSDKKPSIVTEKSPFT

SEQ ID NO: 1638987 - protein, 9 aa, Staphylococcus aureus
KEWNTDAKC

SEQ ID NO: 1638988 - protein, 8 aa, Staphylococcus aureus
KEYENEKP

SEQ ID NO: 1638989 - protein, 16 aa, Staphylococcus aureus
KEYGAGAGGSRNIGGS

SEQ ID NO: 1638990 - protein, 6 aa, Staphylococcus aureus
KFADKA

SEQ ID NO: 1638991 - protein, 14 aa, Staphylococcus aureus
KFAGTFDQHDKEYQ

SEQ ID NO: 1638992 - protein, 10 aa, Staphylococcus aureus
KFDDKQTSMT

SEQ ID NO: 1638993 - protein, 6 aa, Staphylococcus aureus
KFDQSI

SEQ ID NO: 1638994 - protein, 6 aa, Staphylococcus aureus
KFGQSI

SEQ ID NO: 1638995 - protein, 83 aa, Staphylococcus aureus
KFKKEQKNDNKQSTQNNHQKSNNQNQNKGQQKDNKKNQQQNNKGNKGNKKNNRNNKKNNKNNKPQSQPAAPKEIPSKVTYQEG

SEQ ID NO: 1638996 - protein, 8 aa, Staphylococcus aureus
KFKPANLQ

SEQ ID NO: 1638997 - protein, 5 aa, Staphylococcus aureus
KFKVP

SEQ ID NO: 1638998 - protein, 14 aa, Staphylococcus aureus
KFNANKSKELETIQ

SEQ ID NO: 1638999 - protein, 6 aa, Staphylococcus aureus
KFNGDY

SEQ ID NO: 1639000 - protein, 7 aa, Staphylococcus aureus
KFNPDAK

SEQ ID NO: 1639001 - protein, 8 aa, Staphylococcus aureus
KFSKTANN

SEQ ID NO: 1639002 - protein, 20 aa, Staphylococcus aureus
KFTDADKAKRDAYTNAVSRA

SEQ ID NO: 1639003 - protein, 11 aa, Staphylococcus aureus
KFTEDAEDTGV

SEQ ID NO: 1639004 - protein, 7 aa, Staphylococcus aureus
KGADRPL

SEQ ID NO: 1639005 - protein, 10 aa, Staphylococcus aureus
KGASSLSPLK

SEQ ID NO: 1639006 - protein, 5 aa, Staphylococcus aureus
KGATH

SEQ ID NO: 1639007 - protein, 27 aa, Staphylococcus aureus
KGAVKNRSQVKNPKTGRYVKRNSETGR

SEQ ID NO: 1639008 - protein, 6 aa, Staphylococcus aureus
KGAVTI

SEQ ID NO: 1639009 - protein, 5 aa, Staphylococcus aureus
KGCRQ

SEQ ID NO: 1639010 - protein, 6 aa, Staphylococcus aureus
KGDDYY

SEQ ID NO: 1639011 - protein, 7 aa, Staphylococcus aureus
KGDEMRF

SEQ ID NO: 1639012 - protein, 18 aa, Staphylococcus aureus
KGDEVVNKPEPKTDEMKQ

SEQ ID NO: 1639013 - protein, 12 aa, Staphylococcus aureus
KGDGRNQSIQDD

SEQ ID NO: 1639014 - protein, 4 aa, Staphylococcus aureus
KGDI

SEQ ID NO: 1639015 - protein, 25 aa, Staphylococcus aureus
KGDIDVANDATGAMAKDAKSSNAGL

SEQ ID NO: 1639016 - protein, 14 aa, Staphylococcus aureus
KGDNVQDAQRDAYK

SEQ ID NO: 1639017 - protein, 13 aa, Staphylococcus aureus
KGDNVQDAQRDVY

SEQ ID NO: 1639018 - protein, 32 aa, Staphylococcus aureus
KGDSKESKNKISQLESKNQQLEAENEKLKKEL

SEQ ID NO: 1639019 - protein, 13 aa, Staphylococcus aureus
KGEAETTRSESGM

SEQ ID NO: 1639020 - protein, 7 aa, Staphylococcus aureus
KGEDDLN

SEQ ID NO: 1639021 - protein, 13 aa, Staphylococcus aureus
KGEEKTGGRTRPS

SEQ ID NO: 1639022 - protein, 6 aa, Staphylococcus aureus
KGEHKD

SEQ ID NO: 1639023 - protein, 9 aa, Staphylococcus aureus
KGEKYQKDI

SEQ ID NO: 1639024 - protein, 7 aa, Staphylococcus aureus
KGELDNN

SEQ ID NO: 1639025 - protein, 8 aa, Staphylococcus aureus
KGELQQFN

SEQ ID NO: 1639026 - protein, 7 aa, Staphylococcus aureus
KGENGKL

SEQ ID NO: 1639027 - protein, 12 aa, Staphylococcus aureus
KGENNGRSIMDK

SEQ ID NO: 1639028 - protein, 12 aa, Staphylococcus aureus
KGENNGRSIVDK

SEQ ID NO: 1639029 - protein, 8 aa, Staphylococcus aureus
KGESISKI

SEQ ID NO: 1639030 - protein, 4 aa, Staphylococcus aureus
KGEY

SEQ ID NO: 1639031 - protein, 6 aa, Staphylococcus aureus
KGFDNP

SEQ ID NO: 1639032 - protein, 8 aa, Staphylococcus aureus
KGFEDERG

SEQ ID NO: 1639033 - protein, 21 aa, Staphylococcus aureus
KGFNSKKKKFTDLNSPQKRGV

SEQ ID NO: 1639034 - protein, 6 aa, Staphylococcus aureus
KGGGIK

SEQ ID NO: 1639035 - protein, 20 aa, Staphylococcus aureus
KGGNVHDAQRDAYEKVSQIQ

SEQ ID NO: 1639036 - protein, 6 aa, Staphylococcus aureus
KGHNPN

SEQ ID NO: 1639037 - protein, 16 aa, Staphylococcus aureus
KGIDPNVEMKESGNDW

SEQ ID NO: 1639038 - protein, 10 aa, Staphylococcus aureus
KGIKNDKNPY

SEQ ID NO: 1639039 - protein, 14 aa, Staphylococcus aureus
KGIQINGSTEKNQL

SEQ ID NO: 1639040 - protein, 13 aa, Staphylococcus aureus
KGIRKGKKYTQQE

SEQ ID NO: 1639041 - protein, 10 aa, Staphylococcus aureus
KGISQETLSK

SEQ ID NO: 1639042 - protein, 9 aa, Staphylococcus aureus
KGKATYQDI

SEQ ID NO: 1639043 - protein, 15 aa, Staphylococcus aureus
KGKEYQLEKNNGEHH

SEQ ID NO: 1639044 - protein, 9 aa, Staphylococcus aureus
KGKFPDRKN

SEQ ID NO: 1639045 - protein, 10 aa, Staphylococcus aureus
KGKGIPSLEN

SEQ ID NO: 1639046 - protein, 13 aa, Staphylococcus aureus
KGKGKKGEVKEVP

SEQ ID NO: 1639047 - protein, 15 aa, Staphylococcus aureus
KGKGTLNNQGKAFAE

SEQ ID NO: 1639048 - protein, 5 aa, Staphylococcus aureus
KGKHD

SEQ ID NO: 1639049 - protein, 31 aa, Staphylococcus aureus; identical to SEQ ID NO: 1561216

SEQ ID NO: 1639050 - protein, 5 aa, Staphylococcus aureus
KGKLK

SEQ ID NO: 1639051 - protein, 5 aa, Staphylococcus aureus
KGKMN

SEQ ID NO: 1639052 - protein, 4 aa, Staphylococcus aureus
KGKP

SEQ ID NO: 1639053 - protein, 7 aa, Staphylococcus aureus
KGKTASY

SEQ ID NO: 1639054 - protein, 7 aa, Staphylococcus aureus
KGKVPRS

SEQ ID NO: 1639055 - protein, 9 aa, Staphylococcus aureus
KGLGKGPTI

SEQ ID NO: 1639056 - protein, 11 aa, Staphylococcus aureus
KGLGYASTEAL

SEQ ID NO: 1639057 - protein, 13 aa, Staphylococcus aureus
KGLKDNQVKKSGY

SEQ ID NO: 1639058 - protein, 13 aa, Staphylococcus aureus
KGLKQPLATKRSR

SEQ ID NO: 1639059 - protein, 11 aa, Staphylococcus aureus
KGLNESSAKLI

SEQ ID NO: 1639060 - protein, 5 aa, Staphylococcus aureus
KGLRN

SEQ ID NO: 1639061 - protein, 13 aa, Staphylococcus aureus
KGMKEARKGVGYK

SEQ ID NO: 1639062 - protein, 7 aa, Staphylococcus aureus
KGNGSNT

SEQ ID NO: 1639063 - protein, 11 aa, Staphylococcus aureus
KGNKRISEATI

SEQ ID NO: 1639064 - protein, 7 aa, Staphylococcus aureus
KGNQKKI

SEQ ID NO: 1639065 - protein, 24 aa, Staphylococcus aureus
KGNQLQGVTNKGNLDINRQRKQYN

SEQ ID NO: 1639066 - protein, 5 aa, Staphylococcus aureus
KGNRY

SEQ ID NO: 1639067 - protein, 12 aa, Staphylococcus aureus
KGNSTKESLDAG

SEQ ID NO: 1639068 - protein, 15 aa, Staphylococcus aureus
KGPIGKGNAKATVDG

SEQ ID NO: 1639069 - protein, 10 aa, Staphylococcus aureus
KGPYPGEEEK

SEQ ID NO: 1639070 - protein, 13 aa, Staphylococcus aureus
KGQHTVEKDKSYQ

SEQ ID NO: 1639071 - protein, 11 aa, Staphylococcus aureus
KGQKKTGHEFE

SEQ ID NO: 1639072 - protein, 6 aa, Staphylococcus aureus
KGQSFN

SEQ ID NO: 1639073 - protein, 10 aa, Staphylococcus aureus
KGRAAINDDN

SEQ ID NO: 1639074 - protein, 18 aa, Staphylococcus aureus
KGRGQFKPVGEANPTIGQ

SEQ ID NO: 1639075 - protein, 8 aa, Staphylococcus aureus
KGRHEISD

SEQ ID NO: 1639076 - protein, 8 aa, Staphylococcus aureus
KGRIAKGI

SEQ ID NO: 1639077 - protein, 14 aa, Staphylococcus aureus
KGRIGAKEGPDAIK

SEQ ID NO: 1639078 - protein, 8 aa, Staphylococcus aureus
KGRLTKSF

SEQ ID NO: 1639079 - protein, 7 aa, Staphylococcus aureus
KGRSYKK

SEQ ID NO: 1639080 - protein, 7 aa, Staphylococcus aureus
KGRYEVS

SEQ ID NO: 1639081 - protein, 4 aa, Staphylococcus aureus
KGSE

SEQ ID NO: 1639082 - protein, 22 aa, Staphylococcus aureus
KGSGVRSGSGVNKAASAWAGDI

SEQ ID NO: 1639083 - protein, 27 aa, Staphylococcus aureus
KGSGVRSGSGVNKAASAWAGDIRRAAK

SEQ ID NO: 1639084 - protein, 7 aa, Staphylococcus aureus
KGSKIYG

SEQ ID NO: 1639085 - protein, 5 aa, Staphylococcus aureus
KGSKT

SEQ ID NO: 1639086 - protein, 11 aa, Staphylococcus aureus
KGSNQNGNQPK

SEQ ID NO: 1639087 - protein, 4 aa, Staphylococcus aureus
KGSS

SEQ ID NO: 1639088 - protein, 6 aa, Staphylococcus aureus
KGTDNF

SEQ ID NO: 1639089 - protein, 6 aa, Staphylococcus aureus
KGTETF

SEQ ID NO: 1639090 - protein, 11 aa, Staphylococcus aureus
KGTGALQKGVQ

SEQ ID NO: 1639091 - protein, 8 aa, Staphylococcus aureus
KGTIHTRS

SEQ ID NO: 1639092 - protein, 9 aa, Staphylococcus aureus
KGTLSQNKK

SEQ ID NO: 1639093 - protein, 6 aa, Staphylococcus aureus
KGTNGH

SEQ ID NO: 1639094 - protein, 35 aa, Staphylococcus aureus
KGTNRTYSNDPKQNITDSAAGGTAFSSGHKTYNGA

SEQ ID NO: 1639095 - protein, 46 aa, Staphylococcus aureus
KGTNRTYSNDPKQNITDSAAGGTAFSSGHKTYNGAIGVDSNKQKVK

SEQ ID NO: 1639096 - protein, 8 aa, Staphylococcus aureus
KGTSFRTK

SEQ ID NO: 1639097 - protein, 30 aa, Staphylococcus aureus
KGTTGDGVESVTGYTGHDAAKLRDYNESHH

SEQ ID NO: 1639098 - protein, 5 aa, Staphylococcus aureus
KGTTR

SEQ ID NO: 1639099 - protein, 12 aa, Staphylococcus aureus
KGTVAKEGTTEE

SEQ ID NO: 1639100 - protein, 9 aa, Staphylococcus aureus
KGVKGSTVR

SEQ ID NO: 1639101 - protein, 22 aa, Staphylococcus aureus
KGVQNTIARRRKALEKEQTLKE

SEQ ID NO: 1639102 - protein, 7 aa, Staphylococcus aureus
KGVSEYE

SEQ ID NO: 1639103 - protein, 13 aa, Staphylococcus aureus
KGYISGTEDHHSK

SEQ ID NO: 1639104 - protein, 15 aa, Staphylococcus aureus
KGYKAEGLHGDITQA

SEQ ID NO: 1639105 - protein, 5 aa, Staphylococcus aureus
KGYQD

SEQ ID NO: 1639106 - protein, 11 aa, Staphylococcus aureus
KGYQKLNGDEA

SEQ ID NO: 1639107 - protein, 20 aa, Staphylococcus aureus
KGYTSYTPQYEGHAAPPEEI

SEQ ID NO: 1639108 - protein, 18 aa, Staphylococcus aureus
KGYVDTTIKKSSNGGPRR

SEQ ID NO: 1639109 - protein, 12 aa, Staphylococcus aureus
KGYVTKKGNPFS

SEQ ID NO: 1639110 - protein, 14 aa, Staphylococcus aureus
KGYVTKKGNPFSTS

SEQ ID NO: 1639111 - protein, 18 aa, Staphylococcus aureus
KHALNGTQNLNNAKQAAI

SEQ ID NO: 1639112 - protein, 9 aa, Staphylococcus aureus
KHDAFKNRN

SEQ ID NO: 1639113 - protein, 4 aa, Staphylococcus aureus
KHDG

SEQ ID NO: 1639114 - protein, 6 aa, Staphylococcus aureus
KHENRT

SEQ ID NO: 1639115 - protein, 5 aa, Staphylococcus aureus
KHGGL

SEQ ID NO: 1639116 - protein, 8 aa, Staphylococcus aureus
KHKNAQKY

SEQ ID NO: 1639117 - protein, 25 aa, Staphylococcus aureus
KHKSVSDFRGGMPSEGGFGVTVATL

SEQ ID NO: 1639118 - protein, 7 aa, Staphylococcus aureus
KHLQSTK

SEQ ID NO: 1639119 - protein, 7 aa, Staphylococcus aureus
KHNANKK

SEQ ID NO: 1639120 - protein, 4 aa, Staphylococcus aureus
KHNH

SEQ ID NO: 1639121 - protein, 11 aa, Staphylococcus aureus
KHNLKDYEETY

SEQ ID NO: 1639122 - protein, 16 aa, Staphylococcus aureus
KHNTSDRLKRYLEFGR

SEQ ID NO: 1639123 - protein, 4 aa, Staphylococcus aureus
KHQF

SEQ ID NO: 1639124 - protein, 7 aa, Staphylococcus aureus
KHQKGQK

SEQ ID NO: 1639125 - protein, 26 aa, Staphylococcus aureus
KHQSLDSKAKHKEKNKLRQQRYRERQ

SEQ ID NO: 1639126 - protein, 4 aa, Staphylococcus aureus
KHQT

SEQ ID NO: 1639127 - protein, 6 aa, Staphylococcus aureus
KHTNKP

SEQ ID NO: 1639128 - protein, 9 aa, Staphylococcus aureus
KHTSTDTKI

SEQ ID NO: 1639129 - protein, 8 aa, Staphylococcus aureus
KIAAEQVK

SEQ ID NO: 1639130 - protein, 7 aa, Staphylococcus aureus
KIAEDEK

SEQ ID NO: 1639131 - protein, 13 aa, Staphylococcus aureus
KIAEDEKKVFRNL

SEQ ID NO: 1639132 - protein, 14 aa, Staphylococcus aureus
KIAENGAKALGIEN

SEQ ID NO: 1639133 - protein, 7 aa, Staphylococcus aureus
KIAKRGE

SEQ ID NO: 1639134 - protein, 21 aa, Staphylococcus aureus
KIARKSENTSITRDVSGEGVQ

SEQ ID NO: 1639135 - protein, 4 aa, Staphylococcus aureus
KIAT

SEQ ID NO: 1639136 - protein, 7 aa, Staphylococcus aureus
KIDAGYH

SEQ ID NO: 1639137 - protein, 9 aa, Staphylococcus aureus
KIDAGYQGN

SEQ ID NO: 1639138 - protein, 7 aa, Staphylococcus aureus
KIDAKVN

SEQ ID NO: 1639139 - protein, 20 aa, Staphylococcus aureus
KIDGETAEKDWDFSSEEVEG

SEQ ID NO: 1639140 - protein, 21 aa, Staphylococcus aureus
KIDGETAEKDWDFSSEEVEGE

SEQ ID NO: 1639141 - protein, 4 aa, Staphylococcus aureus
KIDS

SEQ ID NO: 1639142 - protein, 15 aa, Staphylococcus aureus
KIDSAETKKDLNSDV

SEQ ID NO: 1639143 - protein, 15 aa, Staphylococcus aureus
KIEDKLSDAVNREVK

SEQ ID NO: 1639144 - protein, 42 aa, Staphylococcus aureus
KIEEDEKESIKKAQKGIYKDPRDINDDEQDDDTKDTVDKKEG

SEQ ID NO: 1639145 - protein, 8 aa, Staphylococcus aureus
KIEEGESQ

SEQ ID NO: 1639146 - protein, 7 aa, Staphylococcus aureus
KIEQSTL

SEQ ID NO: 1639147 - protein, 8 aa, Staphylococcus aureus
KIETNPDK

SEQ ID NO: 1639148 - protein, 8 aa, Staphylococcus aureus
KIETNPNK

SEQ ID NO: 1639149 - protein, 5 aa, Staphylococcus aureus
KIGLP

SEQ ID NO: 1639150 - protein, 7 aa, Staphylococcus aureus
KIGTSKI

SEQ ID NO: 1639151 - protein, 7 aa, Staphylococcus aureus
KIHDGEN

SEQ ID NO: 1639152 - protein, 5 aa, Staphylococcus aureus
KIHPE

SEQ ID NO: 1639153 - protein, 11 aa, Staphylococcus aureus
KIHQTATQTQT

SEQ ID NO: 1639154 - protein, 10 aa, Staphylococcus aureus
KIKCNTPKSV

SEQ ID NO: 1639155 - protein, 15 aa, Staphylococcus aureus
KIKDTTNKPVDTSRP

SEQ ID NO: 1639156 - protein, 13 aa, Staphylococcus aureus
KIKEAVDAGAESM

SEQ ID NO: 1639157 - protein, 13 aa, Staphylococcus aureus
KIKESNKHIKTNE

SEQ ID NO: 1639158 - protein, 9 aa, Staphylococcus aureus
KIKKSATDW

SEQ ID NO: 1639159 - protein, 5 aa, Staphylococcus aureus
KIKRH

SEQ ID NO: 1639160 - protein, 6 aa, Staphylococcus aureus
KIKSKD

SEQ ID NO: 1639161 - protein, 11 aa, Staphylococcus aureus
KIKSNHKDVTD

SEQ ID NO: 1639162 - protein, 17 aa, Staphylococcus aureus
KIKSSLNNTYKPDISGT

SEQ ID NO: 1639163 - protein, 7 aa, Staphylococcus aureus
KILPTND

SEQ ID NO: 1639164 - protein, 7 aa, Staphylococcus aureus
KIMPEGG

SEQ ID NO: 1639165 - protein, 5 aa, Staphylococcus aureus
KINGV

SEQ ID NO: 1639166 - protein, 10 aa, Staphylococcus aureus
KINKKDSAIQ

SEQ ID NO: 1639167 - protein, 9 aa, Staphylococcus aureus
KINKKDSAL

SEQ ID NO: 1639168 - protein, 12 aa, Staphylococcus aureus
KINNSDGNVKKL

SEQ ID NO: 1639169 - protein, 8 aa, Staphylococcus aureus
KINPKNSN

SEQ ID NO: 1639170 - protein, 4 aa, Staphylococcus aureus
KINV

SEQ ID NO: 1639171 - protein, 15 aa, Staphylococcus aureus
KIRPDGRKPDEIRQL

SEQ ID NO: 1639172 - protein, 10 aa, Staphylococcus aureus
KISKTSETKN

SEQ ID NO: 1639173 - protein, 4 aa, Staphylococcus aureus
KITD

SEQ ID NO: 1639174 - protein, 10 aa, Staphylococcus aureus
KITDSIEDTI

SEQ ID NO: 1639175 - protein, 4 aa, Staphylococcus aureus
KITG

SEQ ID NO: 1639176 - protein, 6 aa, Staphylococcus aureus
KITGEG

SEQ ID NO: 1639177 - protein, 6 aa, Staphylococcus aureus
KITHES

SEQ ID NO: 1639178 - protein, 11 aa, Staphylococcus aureus
KITKKDNQGMI

SEQ ID NO: 1639179 - protein, 15 aa, Staphylococcus aureus
KITSVPQVFQEILAT

SEQ ID NO: 1639180 - protein, 31 aa, Staphylococcus aureus
KITVKKESHTGKWSEINKSQKKDDKKDEYYE

SEQ ID NO: 1639181 - protein, 8 aa, Staphylococcus aureus
KKAAPKAK

SEQ ID NO: 1639182 - protein, 24 aa, Staphylococcus aureus
KKAFDKGTTTEDIAQSISPGLRKK

SEQ ID NO: 1639183 - protein, 12 aa, Staphylococcus aureus
KKAIEETLKIEI

SEQ ID NO: 1639184 - protein, 12 aa, Staphylococcus aureus
KKAKRTPAERGD

SEQ ID NO: 1639185 - protein, 13 aa, Staphylococcus aureus
KKAPSGSGKYPVV

SEQ ID NO: 1639186 - protein, 4 aa, Staphylococcus aureus
KKAQ

SEQ ID NO: 1639187 - protein, 12 aa, Staphylococcus aureus
KKAQAVKKFDDS

SEQ ID NO: 1639188 - protein, 27 aa, Staphylococcus aureus
KKAQQEIENTNQDAAVTDVRNQTIKAI

SEQ ID NO: 1639189 - protein, 8 aa, Staphylococcus aureus
KKATAREQ

SEQ ID NO: 1639190 - protein, 9 aa, Staphylococcus aureus
KKATSSPDC

SEQ ID NO: 1639191 - protein, 7 aa, Staphylococcus aureus
KKAVNQK

SEQ ID NO: 1639192 - protein, 7 aa, Staphylococcus aureus
KKAVSEA

SEQ ID NO: 1639193 - protein, 10 aa, Staphylococcus aureus
KKAYESGKGR

SEQ ID NO: 1639194 - protein, 9 aa, Staphylococcus aureus
KKDDRAAFQ

SEQ ID NO: 1639195 - protein, 7 aa, Staphylococcus aureus
KKDEYYE

SEQ ID NO: 1639196 - protein, 5 aa, Staphylococcus aureus
KKDFR

SEQ ID NO: 1639197 - protein, 6 aa, Staphylococcus aureus
KKDGGI

SEQ ID NO: 1639198 - protein, 10 aa, Staphylococcus aureus
KKDISKTNNK

SEQ ID NO: 1639199 - protein, 4 aa, Staphylococcus aureus
KKDK

SEQ ID NO: 1639200 - protein, 7 aa, Staphylococcus aureus
KKDKIGY

SEQ ID NO: 1639201 - protein, 9 aa, Staphylococcus aureus
KKDKKLSDD

SEQ ID NO: 1639202 - protein, 14 aa, Staphylococcus aureus
KKDKNTGEYYNEPV

SEQ ID NO: 1639203 - protein, 7 aa, Staphylococcus aureus
KKDQVTS

SEQ ID NO: 1639204 - protein, 14 aa, Staphylococcus aureus
KKDYCKAQTISNKA

SEQ ID NO: 1639205 - protein, 19 aa, Staphylococcus aureus
KKDYSNNFYNNTQNTITTE

SEQ ID NO: 1639206 - protein, 6 aa, Staphylococcus aureus
KKEAPY

SEQ ID NO: 1639207 - protein, 8 aa, Staphylococcus aureus
KKEASEEA

SEQ ID NO: 1639208 - protein, 9 aa, Staphylococcus aureus
KKEDITKKV

SEQ ID NO: 1639209 - protein, 6 aa, Staphylococcus aureus
KKEFEK

SEQ ID NO: 1639210 - protein, 16 aa, Staphylococcus aureus
KKEIGKETNKGVNPDE

SEQ ID NO: 1639211 - protein, 5 aa, Staphylococcus aureus
KKEIS

SEQ ID NO: 1639212 - protein, 4 aa, Staphylococcus aureus
KKEL

SEQ ID NO: 1639213 - protein, 7 aa, Staphylococcus aureus
KKENQWN

SEQ ID NO: 1639214 - protein, 13 aa, Staphylococcus aureus
KKEQEQEQTTKSG

SEQ ID NO: 1639215 - protein, 7 aa, Staphylococcus aureus
KKEQKAY

SEQ ID NO: 1639216 - protein, 6 aa, Staphylococcus aureus
KKEQKV

SEQ ID NO: 1639217 - protein, 14 aa, Staphylococcus aureus
KKEQRRNNGERVEI

SEQ ID NO: 1639218 - protein, 9 aa, Staphylococcus aureus
KKERKDRVR

SEQ ID NO: 1639219 - protein, 7 aa, Staphylococcus aureus
KKESIED

SEQ ID NO: 1639220 - protein, 6 aa, Staphylococcus aureus
KKESVT

SEQ ID NO: 1639221 - protein, 6 aa, Staphylococcus aureus
KKEYSN

SEQ ID NO: 1639222 - protein, 19 aa, Staphylococcus aureus
KKFATEQEDNKGRKQTISG

SEQ ID NO: 1639223 - protein, 19 aa, Staphylococcus aureus
KKFEDRDKEISEIYHWFEG

SEQ ID NO: 1639224 - protein, 19 aa, Staphylococcus aureus
KKFEDRDKEISEIYRWFEG

SEQ ID NO: 1639225 - protein, 7 aa, Staphylococcus aureus
KKFEKGM

SEQ ID NO: 1639226 - protein, 8 aa, Staphylococcus aureus
KKFHESNP

SEQ ID NO: 1639227 - protein, 6 aa, Staphylococcus aureus
KKFSRG

SEQ ID NO: 1639228 - protein, 7 aa, Staphylococcus aureus
KKGENTY

SEQ ID NO: 1639229 - protein, 7 aa, Staphylococcus aureus
KKGFDNN

SEQ ID NO: 1639230 - protein, 8 aa, Staphylococcus aureus
KKGGHFPK

SEQ ID NO: 1639231 - protein, 10 aa, Staphylococcus aureus
KKGKEVSDYE

SEQ ID NO: 1639232 - protein, 17 aa, Staphylococcus aureus
KKGRGGNHVTSQNPEVN

SEQ ID NO: 1639233 - protein, 8 aa, Staphylococcus aureus
KKGSISKE

SEQ ID NO: 1639234 - protein, 7 aa, Staphylococcus aureus
KKGTPAF

SEQ ID NO: 1639235 - protein, 9 aa, Staphylococcus aureus
KKGTSDMNT

SEQ ID NO: 1639236 - protein, 17 aa, Staphylococcus aureus
KKGVKDVKGRAAINDDN

SEQ ID NO: 1639237 - protein, 7 aa, Staphylococcus aureus
KKINETK

SEQ ID NO: 1639238 - protein, 7 aa, Staphylococcus aureus
KKINRQK

SEQ ID NO: 1639239 - protein, 9 aa, Staphylococcus aureus
KKISQSDIK

SEQ ID NO: 1639240 - protein, 7 aa, Staphylococcus aureus
KKISYEQ

SEQ ID NO: 1639241 - protein, 6 aa, Staphylococcus aureus
KKITNH

SEQ ID NO: 1639242 - protein, 6 aa, Staphylococcus aureus
KKIYSQ

SEQ ID NO: 1639243 - protein, 7 aa, Staphylococcus aureus
KKKELRE

SEQ ID NO: 1639244 - protein, 9 aa, Staphylococcus aureus
KKKELRESY

SEQ ID NO: 1639245 - protein, 7 aa, Staphylococcus aureus
KKKGQLG

SEQ ID NO: 1639246 - protein, 31 aa, Staphylococcus aureus
KKKGRQESQNIDNDHDSLLPQNNDIYSRPRG

SEQ ID NO: 1639247 - protein, 10 aa, Staphylococcus aureus
KKKKDGKDIQ

SEQ ID NO: 1639248 - protein, 7 aa, Staphylococcus aureus
KKKLKIQ

SEQ ID NO: 1639249 - protein, 12 aa, Staphylococcus aureus
KKKLNNRGDNMT

SEQ ID NO: 1639250 - protein, 14 aa, Staphylococcus aureus
KKKNKGFKFPKESQ

SEQ ID NO: 1639251 - protein, 8 aa, Staphylococcus aureus
KKKNNVKN

SEQ ID NO: 1639252 - protein, 8 aa, Staphylococcus aureus
KKKPEAYT

SEQ ID NO: 1639253 - protein, 9 aa, Staphylococcus aureus
KKKPPGITK

SEQ ID NO: 1639254 - protein, 26 aa, Staphylococcus aureus
KKKRQTAGGRWQPSADDLIADDWILD

SEQ ID NO: 1639255 - protein, 8 aa, Staphylococcus aureus
KKKRTRSS

SEQ ID NO: 1639256 - protein, 22 aa, Staphylococcus aureus
KKKSKAEQKEFRNKLDEARFVI

SEQ ID NO: 1639257 - protein, 10 aa, Staphylococcus aureus
KKKSNENVSE

SEQ ID NO: 1639258 - protein, 8 aa, Staphylococcus aureus
KKKYEINQ

SEQ ID NO: 1639259 - protein, 7 aa, Staphylococcus aureus
KKKYEQL

SEQ ID NO: 1639260 - protein, 7 aa, Staphylococcus aureus
KKLKAAG

SEQ ID NO: 1639261 - protein, 5 aa, Staphylococcus aureus
KKLND

SEQ ID NO: 1639262 - protein, 16 aa, Staphylococcus aureus
KKLNESQAPKADNKFN

SEQ ID NO: 1639263 - protein, 12 aa, Staphylococcus aureus
KKLSKAIKSYES

SEQ ID NO: 1639264 - protein, 9 aa, Staphylococcus aureus
KKLSQSDIK

SEQ ID NO: 1639265 - protein, 7 aa, Staphylococcus aureus
KKLSSED

SEQ ID NO: 1639266 - protein, 16 aa, Staphylococcus aureus
KKLTKKKYASTFNSYT

SEQ ID NO: 1639267 - protein, 9 aa, Staphylococcus aureus
KKLTSKPFA

SEQ ID NO: 1639268 - protein, 6 aa, Staphylococcus aureus
KKMGAK

SEQ ID NO: 1639269 - protein, 20 aa, Staphylococcus aureus
KKMKGNHERQDGTADAGKGY

SEQ ID NO: 1639270 - protein, 20 aa, Staphylococcus aureus
KKMKRNHKRQDGTADAGKGY

SEQ ID NO: 1639271 - protein, 18 aa, Staphylococcus aureus
KKNDVSESETVNIDNKDT

SEQ ID NO: 1639272 - protein, 5 aa, Staphylococcus aureus
KKNGE

SEQ ID NO: 1639273 - protein, 21 aa, Staphylococcus aureus
KKNGSKSVDTNLRDTEDIPLT

SEQ ID NO: 1639274 - protein, 11 aa, Staphylococcus aureus
KKNIDAVQENK

SEQ ID NO: 1639275 - protein, 14 aa, Staphylococcus aureus
KKNKMTKLLLELHV

SEQ ID NO: 1639276 - protein, 7 aa, Staphylococcus aureus
KKNLPIN

SEQ ID NO: 1639277 - protein, 20 aa, Staphylococcus aureus
KKNPERYAEEQKIRQEYKNN

SEQ ID NO: 1639278 - protein, 31 aa, Staphylococcus aureus
KKNPSTYKNKTIKSDGGNSQGGASANHQGLI

SEQ ID NO: 1639279 - protein, 36 aa, Staphylococcus aureus; identical to SEQ ID NO: 1563670

SEQ ID NO: 1639280 - protein, 9 aa, Staphylococcus aureus
KKNRKEFEK

SEQ ID NO: 1639281 - protein, 8 aa, Staphylococcus aureus
KKNSDIEY

SEQ ID NO: 1639282 - protein, 8 aa, Staphylococcus aureus
KKNSQFDN

SEQ ID NO: 1639283 - protein, 13 aa, Staphylococcus aureus
KKNYTKKSNSENV

SEQ ID NO: 1639284 - protein, 4 aa, Staphylococcus aureus
KKPI

SEQ ID NO: 1639285 - protein, 6 aa, Staphylococcus aureus
KKPITT

SEQ ID NO: 1639286 - protein, 8 aa, Staphylococcus aureus
KKPLASST

SEQ ID NO: 1639287 - protein, 29 aa, Staphylococcus aureus
KKPQGKLTLATESDKRPAIKQSAEDDFDK

SEQ ID NO: 1639288 - protein, 4 aa, Staphylococcus aureus
KKPT

SEQ ID NO: 1639289 - protein, 7 aa, Staphylococcus aureus
KKPTFND

SEQ ID NO: 1639290 - protein, 7 aa, Staphylococcus aureus
KKPTFNE

SEQ ID NO: 1639291 - protein, 13 aa, Staphylococcus aureus
KKPVTKNAGNHEV

SEQ ID NO: 1639292 - protein, 6 aa, Staphylococcus aureus
KKPVVE

SEQ ID NO: 1639293 - protein, 8 aa, Staphylococcus aureus
KKPYTKHI

SEQ ID NO: 1639294 - protein, 8 aa, Staphylococcus aureus
KKQAIEAN

SEQ ID NO: 1639295 - protein, 4 aa, Staphylococcus aureus
KKQG

SEQ ID NO: 1639296 - protein, 11 aa, Staphylococcus aureus
KKQGKMDSRTK

SEQ ID NO: 1639297 - protein, 7 aa, Staphylococcus aureus
KKQKPGA

SEQ ID NO: 1639298 - protein, 7 aa, Staphylococcus aureus
KKQLSSK

SEQ ID NO: 1639299 - protein, 8 aa, Staphylococcus aureus
KKQQSKLA

SEQ ID NO: 1639300 - protein, 13 aa, Staphylococcus aureus
KKQTEKVSTLSKR

SEQ ID NO: 1639301 - protein, 11 aa, Staphylococcus aureus
KKQVKSKSKVK

SEQ ID NO: 1639302 - protein, 17 aa, Staphylococcus aureus
KKQVSQKPQVHGKGTNL

SEQ ID NO: 1639303 - protein, 6 aa, Staphylococcus aureus
KKRATI

SEQ ID NO: 1639304 - protein, 23 aa, Staphylococcus aureus
KKRQQNKKASKLDPFKEIINKKL

SEQ ID NO: 1639305 - protein, 8 aa, Staphylococcus aureus
KKRSKDKS

SEQ ID NO: 1639306 - protein, 7 aa, Staphylococcus aureus
KKSANKK

SEQ ID NO: 1639307 - protein, 6 aa, Staphylococcus aureus
KKSARI

SEQ ID NO: 1639308 - protein, 4 aa, Staphylococcus aureus
KKSD

SEQ ID NO: 1639309 - protein, 9 aa, Staphylococcus aureus
KKSFNNTHD

SEQ ID NO: 1639310 - protein, 7 aa, Staphylococcus aureus
KKSGEFP

SEQ ID NO: 1639311 - protein, 9 aa, Staphylococcus aureus
KKSGSVKAF

SEQ ID NO: 1639312 - protein, 9 aa, Staphylococcus aureus
KKSKTEIKQ

SEQ ID NO: 1639313 - protein, 11 aa, Staphylococcus aureus
KKSLKTDLENI

SEQ ID NO: 1639314 - protein, 9 aa, Staphylococcus aureus
KKSNNILKS

SEQ ID NO: 1639315 - protein, 9 aa, Staphylococcus aureus
KKSTKNVNK

SEQ ID NO: 1639316 - protein, 10 aa, Staphylococcus aureus
KKSTVSTVDS

SEQ ID NO: 1639317 - protein, 16 aa, Staphylococcus aureus
KKTENKIDDLTRIRNM

SEQ ID NO: 1639318 - protein, 17 aa, Staphylococcus aureus
KKTGKHFKHNTAKSKDF

SEQ ID NO: 1639319 - protein, 9 aa, Staphylococcus aureus
KKTLEENGV

SEQ ID NO: 1639320 - protein, 6 aa, Staphylococcus aureus
KKTNEN

SEQ ID NO: 1639321 - protein, 14 aa, Staphylococcus aureus
KKTNRKYGIHFTRR

SEQ ID NO: 1639322 - protein, 5 aa, Staphylococcus aureus
KKTNT

SEQ ID NO: 1639323 - protein, 13 aa, Staphylococcus aureus
KKTQTQSQSQDEL

SEQ ID NO: 1639324 - protein, 10 aa, Staphylococcus aureus
KKTYDTAEEL

SEQ ID NO: 1639325 - protein, 19 aa, Staphylococcus aureus
KKVEKAADEHYKEYQATEY

SEQ ID NO: 1639326 - protein, 10 aa, Staphylococcus aureus
KKVEKAVDEH

SEQ ID NO: 1639327 - protein, 16 aa, Staphylococcus aureus
KKVKETVEVPKNPKNA

SEQ ID NO: 1639328 - protein, 12 aa, Staphylococcus aureus
KKVKHKDKTLSD

SEQ ID NO: 1639329 - protein, 23 aa, Staphylococcus aureus
KKVSNSNHGQNVSNEYINKENPD

SEQ ID NO: 1639330 - protein, 7 aa, Staphylococcus aureus
KKVTDDF

SEQ ID NO: 1639331 - protein, 14 aa, Staphylococcus aureus
KKVYTRSITNGRLD

SEQ ID NO: 1639332 - protein, 6 aa, Staphylococcus aureus
KKWPTD

SEQ ID NO: 1639333 - protein, 8 aa, Staphylococcus aureus
KKWSQKNA

SEQ ID NO: 1639334 - protein, 7 aa, Staphylococcus aureus
KKYADDD

SEQ ID NO: 1639335 - protein, 13 aa, Staphylococcus aureus
KKYDNGKTREVRR

SEQ ID NO: 1639336 - protein, 13 aa, Staphylococcus aureus
KKYEGKDKETIDN

SEQ ID NO: 1639337 - protein, 18 aa, Staphylococcus aureus
KKYKAENKYRKATGQAPI

SEQ ID NO: 1639338 - protein, 21 aa, Staphylococcus aureus
KKYKDWTEHNQDQIKKGKTAQ

SEQ ID NO: 1639339 - protein, 6 aa, Staphylococcus aureus
KKYKLN

SEQ ID NO: 1639340 - protein, 17 aa, Staphylococcus aureus
KKYLTVQDSKNKDVPAG

SEQ ID NO: 1639341 - protein, 5 aa, Staphylococcus aureus
KKYPS

SEQ ID NO: 1639342 - protein, 5 aa, Staphylococcus aureus
KKYTA

SEQ ID NO: 1639343 - protein, 4 aa, Staphylococcus aureus
KKYV

SEQ ID NO: 1639344 - protein, 7 aa, Staphylococcus aureus
KLAREKK

SEQ ID NO: 1639345 - protein, 5 aa, Staphylococcus aureus
KLASR

SEQ ID NO: 1639346 - protein, 24 aa, Staphylococcus aureus
KLDERKKLTKTLKKHARLKKIRAN

SEQ ID NO: 1639347 - protein, 7 aa, Staphylococcus aureus
KLEKNSN

SEQ ID NO: 1639348 - protein, 26 aa, Staphylococcus aureus
KLENGRIPVSKPSEKVESDKQKYDKY

SEQ ID NO: 1639349 - protein, 15 aa, Staphylococcus aureus
KLERERKREAELRRK

SEQ ID NO: 1639350 - protein, 15 aa, Staphylococcus aureus
KLERKQKKEAELRRK

SEQ ID NO: 1639351 - protein, 16 aa, Staphylococcus aureus
KLERQRKKEAELRKKK

SEQ ID NO: 1639352 - protein, 8 aa, Staphylococcus aureus
KLGDITEQ

SEQ ID NO: 1639353 - protein, 12 aa, Staphylococcus aureus
KLGNDAGITGAA

SEQ ID NO: 1639354 - protein, 11 aa, Staphylococcus aureus
KLGNEDDEGDF

SEQ ID NO: 1639355 - protein, 9 aa, Staphylococcus aureus
KLGSNANQI

SEQ ID NO: 1639356 - protein, 9 aa, Staphylococcus aureus
KLKEEDHGR

SEQ ID NO: 1639357 - protein, 6 aa, Staphylococcus aureus
KLKETG

SEQ ID NO: 1639358 - protein, 8 aa, Staphylococcus aureus
KLKGDTVK

SEQ ID NO: 1639359 - protein, 8 aa, Staphylococcus aureus
KLKPNQHA

SEQ ID NO: 1639360 - protein, 8 aa, Staphylococcus aureus
KLKSKPPY

SEQ ID NO: 1639361 - protein, 11 aa, Staphylococcus aureus
KLKTQQTKHAE

SEQ ID NO: 1639362 - protein, 15 aa, Staphylococcus aureus
KLLSEDKALLYWATI

SEQ ID NO: 1639363 - protein, 6 aa, Staphylococcus aureus
KLMKED

SEQ ID NO: 1639364 - protein, 6 aa, Staphylococcus aureus
KLMKEE

SEQ ID NO: 1639365 - protein, 10 aa, Staphylococcus aureus
KLNDDTSHIK

SEQ ID NO: 1639366 - protein, 10 aa, Staphylococcus aureus
KLNDEKEEFG

SEQ ID NO: 1639367 - protein, 12 aa, Staphylococcus aureus
KLNDTNKLSKYN

SEQ ID NO: 1639368 - protein, 8 aa, Staphylococcus aureus
KLNENSKA

SEQ ID NO: 1639369 - protein, 9 aa, Staphylococcus aureus
KLNENSKTL

SEQ ID NO: 1639370 - protein, 5 aa, Staphylococcus aureus
KLNKG

SEQ ID NO: 1639371 - protein, 10 aa, Staphylococcus aureus
KLNNSDTNVK

SEQ ID NO: 1639372 - protein, 6 aa, Staphylococcus aureus
KLPDEI

SEQ ID NO: 1639373 - protein, 8 aa, Staphylococcus aureus
KLPEKRYN

SEQ ID NO: 1639374 - protein, 32 aa, Staphylococcus aureus
KLPNGGENSIEGTANLNELSNSNNKPINTDSV

SEQ ID NO: 1639375 - protein, 7 aa, Staphylococcus aureus
KLQDELQ

SEQ ID NO: 1639376 - protein, 11 aa, Staphylococcus aureus
KLQGGYGQFTN

SEQ ID NO: 1639377 - protein, 6 aa, Staphylococcus aureus
KLQGYK

SEQ ID NO: 1639378 - protein, 7 aa, Staphylococcus aureus
KLREQNN

SEQ ID NO: 1639379 - protein, 6 aa, Staphylococcus aureus
KLRRPN

SEQ ID NO: 1639380 - protein, 10 aa, Staphylococcus aureus
KLSDGSGAAH

SEQ ID NO: 1639381 - protein, 8 aa, Staphylococcus aureus
KLSDIQSK

SEQ ID NO: 1639382 - protein, 5 aa, Staphylococcus aureus
KLSDK

SEQ ID NO: 1639383 - protein, 8 aa, Staphylococcus aureus
KLSDSSGV

SEQ ID NO: 1639384 - protein, 14 aa, Staphylococcus aureus
KLSEPETKKIYSQR

SEQ ID NO: 1639385 - protein, 13 aa, Staphylococcus aureus
KLSKEGKESVTKI

SEQ ID NO: 1639386 - protein, 25 aa, Staphylococcus aureus
KLSQKQIAEAHQKLDAGLKQLDSEE

SEQ ID NO: 1639387 - protein, 26 aa, Staphylococcus aureus
KLSQKQIAEARQKLDAGLKQLDSEEK

SEQ ID NO: 1639388 - protein, 8 aa, Staphylococcus aureus
KLSQSEIK

SEQ ID NO: 1639389 - protein, 9 aa, Staphylococcus aureus
KLSTTKGDM

SEQ ID NO: 1639390 - protein, 9 aa, Staphylococcus aureus
KLTAARNKI

SEQ ID NO: 1639391 - protein, 10 aa, Staphylococcus aureus
KLTAARNKIQ

SEQ ID NO: 1639392 - protein, 16 aa, Staphylococcus aureus
KLTENADEGVSSEKIY

SEQ ID NO: 1639393 - protein, 10 aa, Staphylococcus aureus
KLTEPNGQSI

SEQ ID NO: 1639394 - protein, 19 aa, Staphylococcus aureus
KLTGNNFKYTEKSTHSYKQ

SEQ ID NO: 1639395 - protein, 6 aa, Staphylococcus aureus
KLTQAI

SEQ ID NO: 1639396 - protein, 16 aa, Staphylococcus aureus
KLTTKDIEVGGGIRTK

SEQ ID NO: 1639397 - protein, 14 aa, Staphylococcus aureus
KLTYSSNHTNHSNH

SEQ ID NO: 1639398 - protein, 14 aa, Staphylococcus aureus
KMAQEQEKLKEERI

SEQ ID NO: 1639399 - protein, 11 aa, Staphylococcus aureus
KMGNSDSNVKK

SEQ ID NO: 1639400 - protein, 5 aa, Staphylococcus aureus
KMGPE

SEQ ID NO: 1639401 - protein, 11 aa, Staphylococcus aureus
KMKKNDRNIQQ

SEQ ID NO: 1639402 - protein, 9 aa, Staphylococcus aureus
KMKQDPLGD

SEQ ID NO: 1639403 - protein, 33 aa, Staphylococcus aureus
KMKTSEKQAKKAQNMINDAQNKIAKNEDLKRDL

SEQ ID NO: 1639404 - protein, 6 aa, Staphylococcus aureus
KMPTDA

SEQ ID NO: 1639405 - protein, 14 aa, Staphylococcus aureus
KMTKEDFQNLILLF

SEQ ID NO: 1639406 - protein, 19 aa, Staphylococcus aureus
KMTKPDTTSNELELSANDE

SEQ ID NO: 1639407 - protein, 19 aa, Staphylococcus aureus
KMTKPDTTSNELELSANNE

SEQ ID NO: 1639408 - protein, 20 aa, Staphylococcus aureus
KMTKSETTSNELDLSANDEL

SEQ ID NO: 1639409 - protein, 8 aa, Staphylococcus aureus
KMTSAQDF

SEQ ID NO: 1639410 - protein, 6 aa, Staphylococcus aureus
KNADAF

SEQ ID NO: 1639411 - protein, 4 aa, Staphylococcus aureus
KNAE

SEQ ID NO: 1639412 - protein, 9 aa, Staphylococcus aureus
KNAEPGVGF

SEQ ID NO: 1639413 - protein, 9 aa, Staphylococcus aureus
KNAGEEYKD

SEQ ID NO: 1639414 - protein, 9 aa, Staphylococcus aureus
KNAIDGDHL

SEQ ID NO: 1639415 - protein, 8 aa, Staphylococcus aureus
KNAIERSA

SEQ ID NO: 1639416 - protein, 7 aa, Staphylococcus aureus
KNAKREL

SEQ ID NO: 1639417 - protein, 25 aa, Staphylococcus aureus
KNAPQTLEEVEANAAKLTDSKKKQY

SEQ ID NO: 1639418 - protein, 13 aa, Staphylococcus aureus
KNAQEITTILKEH

SEQ ID NO: 1639419 - protein, 8 aa, Staphylococcus aureus
KNASNTSI

SEQ ID NO: 1639420 - protein, 7 aa, Staphylococcus aureus
KNDDSIV

SEQ ID NO: 1639421 - protein, 9 aa, Staphylococcus aureus
KNDGSIYSN

SEQ ID NO: 1639422 - protein, 7 aa, Staphylococcus aureus
KNDGVEL

SEQ ID NO: 1639423 - protein, 22 aa, Staphylococcus aureus
KNDGYTSDKSRQTLTEKETHLE

SEQ ID NO: 1639424 - protein, 10 aa, Staphylococcus aureus
KNDHPEGTIA

SEQ ID NO: 1639425 - protein, 8 aa, Staphylococcus aureus
KNDKDELY

SEQ ID NO: 1639426 - protein, 10 aa, Staphylococcus aureus
KNDLQSQDTI

SEQ ID NO: 1639427 - protein, 9 aa, Staphylococcus aureus
KNDNAQGEY

SEQ ID NO: 1639428 - protein, 9 aa, Staphylococcus aureus
KNDNETLES

SEQ ID NO: 1639429 - protein, 9 aa, Staphylococcus aureus
KNDNKKSSM

SEQ ID NO: 1639430 - protein, 5 aa, Staphylococcus aureus
KNDQH

SEQ ID NO: 1639431 - protein, 21 aa, Staphylococcus aureus
KNDSSGNSQMVGENIDKSKTN

SEQ ID NO: 1639432 - protein, 9 aa, Staphylococcus aureus
KNDSSSHYN

SEQ ID NO: 1639433 - protein, 5 aa, Staphylococcus aureus
KNDTI

SEQ ID NO: 1639434 - protein, 8 aa, Staphylococcus aureus
KNDTTPTI

SEQ ID NO: 1639435 - protein, 15 aa, Staphylococcus aureus
KNDYGSGTAIHPQTG

SEQ ID NO: 1639436 - protein, 6 aa, Staphylococcus aureus
KNEIDK

SEQ ID NO: 1639437 - protein, 9 aa, Staphylococcus aureus
KNEISNHSN

SEQ ID NO: 1639438 - protein, 10 aa, Staphylococcus aureus
KNEKELPGLE

SEQ ID NO: 1639439 - protein, 4 aa, Staphylococcus aureus
KNEL

SEQ ID NO: 1639440 - protein, 13 aa, Staphylococcus aureus
KNENIEKDINNHT

SEQ ID NO: 1639441 - protein, 10 aa, Staphylococcus aureus
KNENTGEDIN

SEQ ID NO: 1639442 - protein, 7 aa, Staphylococcus aureus
KNERGCD

SEQ ID NO: 1639443 - protein, 35 aa, Staphylococcus aureus
KNESNITDVTQNEEQLDNSDEQSQQNEKTFSQEEV

SEQ ID NO: 1639444 - protein, 40 aa, Staphylococcus aureus
KNESRFKGAKGDKGEPGQPGAKGDTGKKGEQGAPGKNGTV

SEQ ID NO: 1639445 - protein, 40 aa, Staphylococcus aureus
KNESRFKGVKGDKGEPGQPGAKGETGKKGEQGAPGKNGTV

SEQ ID NO: 1639446 - protein, 40 aa, Staphylococcus aureus
KNESSFKGVKGDKGEPGQPGAKGEAGKKGEQGAPGKNGTV

SEQ ID NO: 1639447 - protein, 7 aa, Staphylococcus aureus
KNETDSI

SEQ ID NO: 1639448 - protein, 7 aa, Staphylococcus aureus
KNETVEA

SEQ ID NO: 1639449 - protein, 14 aa, Staphylococcus aureus
KNFEKVKDQTPNEK

SEQ ID NO: 1639450 - protein, 10 aa, Staphylococcus aureus
KNFKTRTFKS

SEQ ID NO: 1639451 - protein, 5 aa, Staphylococcus aureus
KNFNK

SEQ ID NO: 1639452 - protein, 12 aa, Staphylococcus aureus
KNFTNDNTEDDV

SEQ ID NO: 1639453 - protein, 8 aa, Staphylococcus aureus
KNGAEKST

SEQ ID NO: 1639454 - protein, 14 aa, Staphylococcus aureus
KNGAKYVTTSYDKL

SEQ ID NO: 1639455 - protein, 6 aa, Staphylococcus aureus
KNGHTL

SEQ ID NO: 1639456 - protein, 5 aa, Staphylococcus aureus
KNGKL

SEQ ID NO: 1639457 - protein, 16 aa, Staphylococcus aureus
KNGKQRPWREKKVLLQ

SEQ ID NO: 1639458 - protein, 12 aa, Staphylococcus aureus
KNGLQLGDTLNC

SEQ ID NO: 1639459 - protein, 13 aa, Staphylococcus aureus
KNGNELESSTKKL

SEQ ID NO: 1639460 - protein, 9 aa, Staphylococcus aureus
KNGPVPEDK

SEQ ID NO: 1639461 - protein, 5 aa, Staphylococcus aureus
KNGQY

SEQ ID NO: 1639462 - protein, 5 aa, Staphylococcus aureus
KNGRK

SEQ ID NO: 1639463 - protein, 7 aa, Staphylococcus aureus
KNGSEYD

SEQ ID NO: 1639464 - protein, 6 aa, Staphylococcus aureus
KNGSIK

SEQ ID NO: 1639465 - protein, 48 aa, Staphylococcus aureus
KNITEENKHDSTDELTKEDKFVEKTKNDSSDNREVEPPKKRFWSRLFG

SEQ ID NO: 1639466 - protein, 13 aa, Staphylococcus aureus
KNKAPEEKAKIED

SEQ ID NO: 1639467 - protein, 5 aa, Staphylococcus aureus
KNKDI

SEQ ID NO: 1639468 - protein, 7 aa, Staphylococcus aureus
KNKEYDA

SEQ ID NO: 1639469 - protein, 6 aa, Staphylococcus aureus
KNKIPP

SEQ ID NO: 1639470 - protein, 8 aa, Staphylococcus aureus
KNKKESYI

SEQ ID NO: 1639471 - protein, 7 aa, Staphylococcus aureus
KNKKPDK

SEQ ID NO: 1639472 - protein, 6 aa, Staphylococcus aureus
KNKLER

SEQ ID NO: 1639473 - protein, 9 aa, Staphylococcus aureus
KNKNDQING

SEQ ID NO: 1639474 - protein, 9 aa, Staphylococcus aureus
KNKNDQMNG

SEQ ID NO: 1639475 - protein, 14 aa, Staphylococcus aureus
KNKNLESKKPLTIS

SEQ ID NO: 1639476 - protein, 12 aa, Staphylococcus aureus
KNKNVMSNEDYE

SEQ ID NO: 1639477 - protein, 6 aa, Staphylococcus aureus
KNKQEF

SEQ ID NO: 1639478 - protein, 9 aa, Staphylococcus aureus
KNKSGKYPT

SEQ ID NO: 1639479 - protein, 13 aa, Staphylococcus aureus
KNKTPEEKAKIED

SEQ ID NO: 1639480 - protein, 13 aa, Staphylococcus aureus
KNKTPEEKAKIEN

SEQ ID NO: 1639481 - protein, 7 aa, Staphylococcus aureus
KNKYDQD

SEQ ID NO: 1639482 - protein, 10 aa, Staphylococcus aureus
KNKYQDANTM

SEQ ID NO: 1639483 - protein, 9 aa, Staphylococcus aureus
KNLEKDSFE

SEQ ID NO: 1639484 - protein, 11 aa, Staphylococcus aureus
KNLKTRDATAA

SEQ ID NO: 1639485 - protein, 4 aa, Staphylococcus aureus
KNLS

SEQ ID NO: 1639486 - protein, 7 aa, Staphylococcus aureus
KNMKKRL

SEQ ID NO: 1639487 - protein, 5 aa, Staphylococcus aureus
KNNEN

SEQ ID NO: 1639488 - protein, 10 aa, Staphylococcus aureus
KNNEPKKFTT

SEQ ID NO: 1639489 - protein, 6 aa, Staphylococcus aureus
KNNEYY

SEQ ID NO: 1639490 - protein, 4 aa, Staphylococcus aureus
KNNG

SEQ ID NO: 1639491 - protein, 7 aa, Staphylococcus aureus
KNNGDLA

SEQ ID NO: 1639492 - protein, 5 aa, Staphylococcus aureus
KNNHK

SEQ ID NO: 1639493 - protein, 13 aa, Staphylococcus aureus
KNNLEELANRNPA

SEQ ID NO: 1639494 - protein, 12 aa, Staphylococcus aureus
KNNNNKPTRRGQ

SEQ ID NO: 1639495 - protein, 11 aa, Staphylococcus aureus
KNNPDEATNIN

SEQ ID NO: 1639496 - protein, 18 aa, Staphylococcus aureus
KNNPQKTNPFLKLNESKK

SEQ ID NO: 1639497 - protein, 8 aa, Staphylococcus aureus
KNNPYKIT

SEQ ID NO: 1639498 - protein, 16 aa, Staphylococcus aureus
KNNQGHIDNGELHKAN

SEQ ID NO: 1639499 - protein, 5 aa, Staphylococcus aureus
KNNQP

SEQ ID NO: 1639500 - protein, 11 aa, Staphylococcus aureus
KNNSERKPKGL

SEQ ID NO: 1639501 - protein, 10 aa, Staphylococcus aureus
KNNSQLEKQL

SEQ ID NO: 1639502 - protein, 6 aa, Staphylococcus aureus
KNNTDI

SEQ ID NO: 1639503 - protein, 7 aa, Staphylococcus aureus
KNNVITD

SEQ ID NO: 1639504 - protein, 15 aa, Staphylococcus aureus
KNNVPYKKEDGNYTV

SEQ ID NO: 1639505 - protein, 15 aa, Staphylococcus aureus
KNNVPYKKETGNYTV

SEQ ID NO: 1639506 - protein, 12 aa, Staphylococcus aureus
KNPNKITVDVLF

SEQ ID NO: 1639507 - protein, 7 aa, Staphylococcus aureus
KNPSLVT

SEQ ID NO: 1639508 - protein, 18 aa, Staphylococcus aureus
KNPTLSQAIQGNTYDNPI

SEQ ID NO: 1639509 - protein, 6 aa, Staphylococcus aureus
KNQEGD

SEQ ID NO: 1639510 - protein, 8 aa, Staphylococcus aureus
KNQHRDGV

SEQ ID NO: 1639511 - protein, 14 aa, Staphylococcus aureus
KNQNISYKDLEDKV

SEQ ID NO: 1639512 - protein, 12 aa, Staphylococcus aureus
KNQSPTLGSFST

SEQ ID NO: 1639513 - protein, 6 aa, Staphylococcus aureus
KNQSVA

SEQ ID NO: 1639514 - protein, 25 aa, Staphylococcus aureus
KNQSVAEAIRTASDSIQKVGEEFNQ

SEQ ID NO: 1639515 - protein, 5 aa, Staphylococcus aureus
KNQSY

SEQ ID NO: 1639516 - protein, 11 aa, Staphylococcus aureus
KNRKIENNDIT

SEQ ID NO: 1639517 - protein, 11 aa, Staphylococcus aureus
KNRKVENNDIT

SEQ ID NO: 1639518 - protein, 6 aa, Staphylococcus aureus
KNRQGK

SEQ ID NO: 1639519 - protein, 14 aa, Staphylococcus aureus
KNRRSLQIYGFSPC

SEQ ID NO: 1639520 - protein, 11 aa, Staphylococcus aureus
KNSKKISRSLS

SEQ ID NO: 1639521 - protein, 8 aa, Staphylococcus aureus
KNSKVAPT

SEQ ID NO: 1639522 - protein, 31 aa, Staphylococcus aureus
KNSLNDKDTTLGSQNFADADPEKKNAYNEAI

SEQ ID NO: 1639523 - protein, 6 aa, Staphylococcus aureus
KNTDSQ

SEQ ID NO: 1639524 - protein, 4 aa, Staphylococcus aureus
KNTG

SEQ ID NO: 1639525 - protein, 9 aa, Staphylococcus aureus
KNTGDRPIQ

SEQ ID NO: 1639526 - protein, 8 aa, Staphylococcus aureus
KNTKGINK

SEQ ID NO: 1639527 - protein, 7 aa, Staphylococcus aureus
KNTLKNK

SEQ ID NO: 1639528 - protein, 16 aa, Staphylococcus aureus
KNTSTSNESGVRFELT

SEQ ID NO: 1639529 - protein, 7 aa, Staphylococcus aureus
KNTTKGH

SEQ ID NO: 1639530 - protein, 7 aa, Staphylococcus aureus
KNTTSDD

SEQ ID NO: 1639531 - protein, 12 aa, Staphylococcus aureus
KNTTSYQKTCIQ

SEQ ID NO: 1639532 - protein, 5 aa, Staphylococcus aureus
KNVDS

SEQ ID NO: 1639533 - protein, 7 aa, Staphylococcus aureus
KNVDTLP

SEQ ID NO: 1639534 - protein, 4 aa, Staphylococcus aureus
KNVE

SEQ ID NO: 1639535 - protein, 9 aa, Staphylococcus aureus
KNVKGGTNV

SEQ ID NO: 1639536 - protein, 10 aa, Staphylococcus aureus
KNVPFTAPAE

SEQ ID NO: 1639537 - protein, 11 aa, Staphylococcus aureus
KNVSKKDYKAI

SEQ ID NO: 1639538 - protein, 6 aa, Staphylococcus aureus
KNYFTE

SEQ ID NO: 1639539 - protein, 19 aa, Staphylococcus aureus
KNYKDGDISYNPEVPSYSA

SEQ ID NO: 1639540 - protein, 14 aa, Staphylococcus aureus
KNYKDGEVSYNPEV

SEQ ID NO: 1639541 - protein, 16 aa, Staphylococcus aureus
KNYKEGYLTESDGKLC

SEQ ID NO: 1639542 - protein, 9 aa, Staphylococcus aureus
KNYKNGRIT

SEQ ID NO: 1639543 - protein, 7 aa, Staphylococcus aureus
KNYPEYG

SEQ ID NO: 1639544 - protein, 18 aa, Staphylococcus aureus
KNYQDGSITTNENVPRYE

SEQ ID NO: 1639545 - protein, 18 aa, Staphylococcus aureus
KNYQDGSITTNENVPSYE

SEQ ID NO: 1639546 - protein, 14 aa, Staphylococcus aureus
KNYQNGKISSNENV

SEQ ID NO: 1639547 - protein, 16 aa, Staphylococcus aureus
KNYSEEALATKSINGN

SEQ ID NO: 1639548 - protein, 6 aa, Staphylococcus aureus
KNYSSI

SEQ ID NO: 1639549 - protein, 5 aa, Staphylococcus aureus
KPAAL

SEQ ID NO: 1639550 - protein, 18 aa, Staphylococcus aureus
KPAARQSVGVKAEAQNAL

SEQ ID NO: 1639551 - protein, 18 aa, Staphylococcus aureus
KPAARQSVSAKAEAQNAL

SEQ ID NO: 1639552 - protein, 9 aa, Staphylococcus aureus
KPAIKGKDS

SEQ ID NO: 1639553 - protein, 8 aa, Staphylococcus aureus
KPAKKEKN

SEQ ID NO: 1639554 - protein, 12 aa, Staphylococcus aureus
KPASLAQTNQHY

SEQ ID NO: 1639555 - protein, 5 aa, Staphylococcus aureus
KPEHY

SEQ ID NO: 1639556 - protein, 7 aa, Staphylococcus aureus
KPESIDN

SEQ ID NO: 1639557 - protein, 11 aa, Staphylococcus aureus
KPGKENPPKLI

SEQ ID NO: 1639558 - protein, 7 aa, Staphylococcus aureus
KPIEPGK

SEQ ID NO: 1639559 - protein, 11 aa, Staphylococcus aureus
KPIGSKKLGQH

SEQ ID NO: 1639560 - protein, 16 aa, Staphylococcus aureus
KPKDYDIENNKEKILE

SEQ ID NO: 1639561 - protein, 7 aa, Staphylococcus aureus
KPKNQLP

SEQ ID NO: 1639562 - protein, 17 aa, Staphylococcus aureus
KPKTKLKEERLKRGLSA

SEQ ID NO: 1639563 - protein, 10 aa, Staphylococcus aureus
KPKVRRKRAA

SEQ ID NO: 1639564 - protein, 11 aa, Staphylococcus aureus
KPKVRRKRAAL

SEQ ID NO: 1639565 - protein, 4 aa, Staphylococcus aureus
KPKY

SEQ ID NO: 1639566 - protein, 6 aa, Staphylococcus aureus
KPKYEK

SEQ ID NO: 1639567 - protein, 5 aa, Staphylococcus aureus
KPLHN

SEQ ID NO: 1639568 - protein, 7 aa, Staphylococcus aureus
KPLTPKE

SEQ ID NO: 1639569 - protein, 19 aa, Staphylococcus aureus
KPNRRKADIEAKYVGKKNT

SEQ ID NO: 1639570 - protein, 20 aa, Staphylococcus aureus
KPNSKSNKKIMKNYNWEYFK

SEQ ID NO: 1639571 - protein, 13 aa, Staphylococcus aureus
KPNSKSNKKSMKN

SEQ ID NO: 1639572 - protein, 10 aa, Staphylococcus aureus
KPNSKTNKKI

SEQ ID NO: 1639573 - protein, 6 aa, Staphylococcus aureus
KPPIGD

SEQ ID NO: 1639574 - protein, 5 aa, Staphylococcus aureus
KPQFT

SEQ ID NO: 1639575 - protein, 6 aa, Staphylococcus aureus
KPRSAV

SEQ ID NO: 1639576 - protein, 7 aa, Staphylococcus aureus
KPTDTRT

SEQ ID NO: 1639577 - protein, 11 aa, Staphylococcus aureus
KPTNGNEKVNN

SEQ ID NO: 1639578 - protein, 5 aa, Staphylococcus aureus
KPTRV

SEQ ID NO: 1639579 - protein, 8 aa, Staphylococcus aureus
KPTSGTVT

SEQ ID NO: 1639580 - protein, 9 aa, Staphylococcus aureus
KPVAKNDLK

SEQ ID NO: 1639581 - protein, 16 aa, Staphylococcus aureus
KPVDTTGGRGCIYWCS

SEQ ID NO: 1639582 - protein, 4 aa, Staphylococcus aureus
KPVE

SEQ ID NO: 1639583 - protein, 4 aa, Staphylococcus aureus
KPYA

SEQ ID NO: 1639584 - protein, 7 aa, Staphylococcus aureus
KPYGENS

SEQ ID NO: 1639585 - protein, 4 aa, Staphylococcus aureus
KPYP

SEQ ID NO: 1639586 - protein, 10 aa, Staphylococcus aureus
KQAEFKSSKT

SEQ ID NO: 1639587 - protein, 10 aa, Staphylococcus aureus
KQAETYPNAL

SEQ ID NO: 1639588 - protein, 6 aa, Staphylococcus aureus
KQAKYT

SEQ ID NO: 1639589 - protein, 5 aa, Staphylococcus aureus
KQALP

SEQ ID NO: 1639590 - protein, 20 aa, Staphylococcus aureus
KQANTNAEVDQAATVAENNI

SEQ ID NO: 1639591 - protein, 7 aa, Staphylococcus aureus
KQAPRIA

SEQ ID NO: 1639592 - protein, 9 aa, Staphylococcus aureus
KQATAETNS

SEQ ID NO: 1639593 - protein, 7 aa, Staphylococcus aureus
KQCQKYE

SEQ ID NO: 1639594 - protein, 5 aa, Staphylococcus aureus
KQDGT

SEQ ID NO: 1639595 - protein, 52 aa, Staphylococcus aureus
KQDTEAAKNDESKRSKRSKRSLNTQNYKSASQEVTAEQKAEYERKAEERKEK

SEQ ID NO: 1639596 - protein, 6 aa, Staphylococcus aureus
KQEANE

SEQ ID NO: 1639597 - protein, 7 aa, Staphylococcus aureus
KQERPEY

SEQ ID NO: 1639598 - protein, 12 aa, Staphylococcus aureus
KQESNANQCPFH

SEQ ID NO: 1639599 - protein, 8 aa, Staphylococcus aureus
KQETNIEK

SEQ ID NO: 1639600 - protein, 19 aa, Staphylococcus aureus
KQEVSPQTVKITGGEEQLN

SEQ ID NO: 1639601 - protein, 18 aa, Staphylococcus aureus
KQEVSPQTVKVTGGEEQL

SEQ ID NO: 1639602 - protein, 7 aa, Staphylococcus aureus
KQFNPDV

SEQ ID NO: 1639603 - protein, 4 aa, Staphylococcus aureus
KQGE

SEQ ID NO: 1639604 - protein, 6 aa, Staphylococcus aureus
KQGEMK

SEQ ID NO: 1639605 - protein, 8 aa, Staphylococcus aureus
KQGETGRQ

SEQ ID NO: 1639606 - protein, 4 aa, Staphylococcus aureus
KQGR

SEQ ID NO: 1639607 - protein, 5 aa, Staphylococcus aureus
KQGWL

SEQ ID NO: 1639608 - protein, 31 aa, Staphylococcus aureus
KQHANSRITDLENKAQSYSRTFDEQKRYMDE

SEQ ID NO: 1639609 - protein, 14 aa, Staphylococcus aureus
KQHGPNTAQNDVEA

SEQ ID NO: 1639610 - protein, 21 aa, Staphylococcus aureus
KQHQNTESFNHQDNLKSDEKE

SEQ ID NO: 1639611 - protein, 4 aa, Staphylococcus aureus
KQHT

SEQ ID NO: 1639612 - protein, 12 aa, Staphylococcus aureus
KQINSSEYNNKE

SEQ ID NO: 1639613 - protein, 15 aa, Staphylococcus aureus
KQKIENKAVKQKKHP

SEQ ID NO: 1639614 - protein, 13 aa, Staphylococcus aureus
KQKSKKTREKVEK

SEQ ID NO: 1639615 - protein, 18 aa, Staphylococcus aureus
KQKTSEETIPNFEKNEEV

SEQ ID NO: 1639616 - protein, 18 aa, Staphylococcus aureus
KQLEQSEASADEQKSLSD

SEQ ID NO: 1639617 - protein, 4 aa, Staphylococcus aureus
KQLG

SEQ ID NO: 1639618 - protein, 8 aa, Staphylococcus aureus
KQLKDHDG

SEQ ID NO: 1639619 - protein, 17 aa, Staphylococcus aureus
KQLKSKGLVKDGDTITI

SEQ ID NO: 1639620 - protein, 5 aa, Staphylococcus aureus
KQLNK

SEQ ID NO: 1639621 - protein, 5 aa, Staphylococcus aureus
KQMDD

SEQ ID NO: 1639622 - protein, 29 aa, Staphylococcus aureus
KQMQGEEITEEDLQKAQEQAQAIEKDENI

SEQ ID NO: 1639623 - protein, 17 aa, Staphylococcus aureus
KQNAQRPKVRKTTQTGR

SEQ ID NO: 1639624 - protein, 10 aa, Staphylococcus aureus
KQNFNSAKTT

SEQ ID NO: 1639625 - protein, 31 aa, Staphylococcus aureus
KQNIDDSVEQTEESKGHLQDEAIEETSDENV

SEQ ID NO: 1639626 - protein, 6 aa, Staphylococcus aureus
KQNINP

SEQ ID NO: 1639627 - protein, 21 aa, Staphylococcus aureus
KQNKDIDKEMDLSSGRVYKNT

SEQ ID NO: 1639628 - protein, 34 aa, Staphylococcus aureus
KQNPSTYKNKTIKSDGGNSQGGASANHQGLINPD

SEQ ID NO: 1639629 - protein, 13 aa, Staphylococcus aureus
KQNQELDEKQPEL

SEQ ID NO: 1639630 - protein, 8 aa, Staphylococcus aureus
KQNRHNKN

SEQ ID NO: 1639631 - protein, 29 aa, Staphylococcus aureus
KQNRPKSITKYNPTTHNYKTNSDNKPNFD

SEQ ID NO: 1639632 - protein, 8 aa, Staphylococcus aureus
KQNTENIG

SEQ ID NO: 1639633 - protein, 12 aa, Staphylococcus aureus
KQPDLNWDNPEV

SEQ ID NO: 1639634 - protein, 23 aa, Staphylococcus aureus
KQPEGDQRVYRTSTYDLTTDEIS

SEQ ID NO: 1639635 - protein, 8 aa, Staphylococcus aureus
KQPKGKIM

SEQ ID NO: 1639636 - protein, 5 aa, Staphylococcus aureus
KQPKL

SEQ ID NO: 1639637 - protein, 6 aa, Staphylococcus aureus
KQPNHY

SEQ ID NO: 1639638 - protein, 39 aa, Staphylococcus aureus
KQQAQQSRGQSQYPYNKPVKDNPFANANDPIEIDDDDLP

SEQ ID NO: 1639639 - protein, 11 aa, Staphylococcus aureus
KQQIAGAVTNA

SEQ ID NO: 1639640 - protein, 19 aa, Staphylococcus aureus
KQQNYINETQYQQAMSQLN

SEQ ID NO: 1639641 - protein, 6 aa, Staphylococcus aureus
KQQQLD

SEQ ID NO: 1639642 - protein, 10 aa, Staphylococcus aureus
KQQQYDEVSG

SEQ ID NO: 1639643 - protein, 6 aa, Staphylococcus aureus
KQRKHD

SEQ ID NO: 1639644 - protein, 12 aa, Staphylococcus aureus
KQRKQSLLQKIF

SEQ ID NO: 1639645 - protein, 11 aa, Staphylococcus aureus
KQRNTTKKMTK

SEQ ID NO: 1639646 - protein, 10 aa, Staphylococcus aureus
KQTANGKSKE

SEQ ID NO: 1639647 - protein, 4 aa, Staphylococcus aureus
KQTG

SEQ ID NO: 1639648 - protein, 5 aa, Staphylococcus aureus
KQTGV

SEQ ID NO: 1639649 - protein, 11 aa, Staphylococcus aureus
KQTNPTIAPLA

SEQ ID NO: 1639650 - protein, 8 aa, Staphylococcus aureus
KQTPDYKR

SEQ ID NO: 1639651 - protein, 6 aa, Staphylococcus aureus
KQTPLA

SEQ ID NO: 1639652 - protein, 7 aa, Staphylococcus aureus
KQTRLSN

SEQ ID NO: 1639653 - protein, 15 aa, Staphylococcus aureus
KQTRRSVKKMKNKEK

SEQ ID NO: 1639654 - protein, 23 aa, Staphylococcus aureus
KQTVQSKNNLDFGDRFGGGFGFF

SEQ ID NO: 1639655 - protein, 8 aa, Staphylococcus aureus
KQTVVNNA

SEQ ID NO: 1639656 - protein, 14 aa, Staphylococcus aureus
KQVEELQEALESQE

SEQ ID NO: 1639657 - protein, 18 aa, Staphylococcus aureus
KQVEQSEASADEQKSLSD

SEQ ID NO: 1639658 - protein, 15 aa, Staphylococcus aureus
KQVSEKPQVHGKGTN

SEQ ID NO: 1639659 - protein, 6 aa, Staphylococcus aureus
KQWKPS

SEQ ID NO: 1639660 - protein, 7 aa, Staphylococcus aureus
KQWKPSY

SEQ ID NO: 1639661 - protein, 18 aa, Staphylococcus aureus
KQYDQEVKSGAFPSEAYT

SEQ ID NO: 1639662 - protein, 11 aa, Staphylococcus aureus
KQYEVGEQASP

SEQ ID NO: 1639663 - protein, 9 aa, Staphylococcus aureus
KQYKSSDFK

SEQ ID NO: 1639664 - protein, 10 aa, Staphylococcus aureus
KQYKSSGFKL

SEQ ID NO: 1639665 - protein, 7 aa, Staphylococcus aureus
KQYPDFK

SEQ ID NO: 1639666 - protein, 6 aa, Staphylococcus aureus
KQYTYG

SEQ ID NO: 1639667 - protein, 8 aa, Staphylococcus aureus
KRASEELR

SEQ ID NO: 1639668 - protein, 9 aa, Staphylococcus aureus
KRATGKAKK

SEQ ID NO: 1639669 - protein, 18 aa, Staphylococcus aureus
KRDDTMDDIISQGDIVFY

SEQ ID NO: 1639670 - protein, 8 aa, Staphylococcus aureus
KREEWEKD

SEQ ID NO: 1639671 - protein, 27 aa, Staphylococcus aureus
KRENKITLDRSDSGLLPTNDEGTTRST

SEQ ID NO: 1639672 - protein, 8 aa, Staphylococcus aureus
KRESNYQA

SEQ ID NO: 1639673 - protein, 9 aa, Staphylococcus aureus
KRESNYQAD

SEQ ID NO: 1639674 - protein, 11 aa, Staphylococcus aureus
KRESNYQSNAV

SEQ ID NO: 1639675 - protein, 15 aa, Staphylococcus aureus
KRGERGSDRKHIETA

SEQ ID NO: 1639676 - protein, 14 aa, Staphylococcus aureus
KRGGLGKKKNRRTF

SEQ ID NO: 1639677 - protein, 5 aa, Staphylococcus aureus
KRGKY

SEQ ID NO: 1639678 - protein, 8 aa, Staphylococcus aureus
KRHTKEYH

SEQ ID NO: 1639679 - protein, 29 aa, Staphylococcus aureus
KRIHNKRQPQMSKIDKSRQYVRREKTPKW

SEQ ID NO: 1639680 - protein, 8 aa, Staphylococcus aureus
KRKDRKKV

SEQ ID NO: 1639681 - protein, 9 aa, Staphylococcus aureus
KRKDRKYKH

SEQ ID NO: 1639682 - protein, 19 aa, Staphylococcus aureus
KRKERKKQIEQVKQQPKQN

SEQ ID NO: 1639683 - protein, 8 aa, Staphylococcus aureus
KRKHSEQV

SEQ ID NO: 1639684 - protein, 17 aa, Staphylococcus aureus
KRKKNAESKTKVIKSLG

SEQ ID NO: 1639685 - protein, 6 aa, Staphylococcus aureus
KRKKNV

SEQ ID NO: 1639686 - protein, 9 aa, Staphylococcus aureus
KRKNMTQEQ

SEQ ID NO: 1639687 - protein, 9 aa, Staphylococcus aureus
KRKSENEQI

SEQ ID NO: 1639688 - protein, 33 aa, Staphylococcus aureus
KRLAEQKATDAENAENVEKEEAITKATDNTTID

SEQ ID NO: 1639689 - protein, 23 aa, Staphylococcus aureus
KRLSEGKTQAEISQHTNIPTSTL

SEQ ID NO: 1639690 - protein, 4 aa, Staphylococcus aureus
KRLT

SEQ ID NO: 1639691 - protein, 8 aa, Staphylococcus aureus
KRNAEEVG

SEQ ID NO: 1639692 - protein, 4 aa, Staphylococcus aureus
KRNG

SEQ ID NO: 1639693 - protein, 25 aa, Staphylococcus aureus
KRNIDKEKKMLEENGDLIESKTSFI

SEQ ID NO: 1639694 - protein, 10 aa, Staphylococcus aureus
KRNKENDDDV

SEQ ID NO: 1639695 - protein, 7 aa, Staphylococcus aureus
KRNKEQA

SEQ ID NO: 1639696 - protein, 5 aa, Staphylococcus aureus
KRNPC

SEQ ID NO: 1639697 - protein, 21 aa, Staphylococcus aureus
KRNQGKLEVKPNVKVTNKEEL

SEQ ID NO: 1639698 - protein, 6 aa, Staphylococcus aureus
KRPLNK

SEQ ID NO: 1639699 - protein, 4 aa, Staphylococcus aureus
KRPS

SEQ ID NO: 1639700 - protein, 40 aa, Staphylococcus aureus
KRQKENAEKERKKKQQEEKEQNELDSQANQYQQLPQQNQY

SEQ ID NO: 1639701 - protein, 13 aa, Staphylococcus aureus
KRQRDIETKTTLN

SEQ ID NO: 1639702 - protein, 9 aa, Staphylococcus aureus
KRQSPNISS

SEQ ID NO: 1639703 - protein, 7 aa, Staphylococcus aureus
KRQSQHS

SEQ ID NO: 1639704 - protein, 13 aa, Staphylococcus aureus
KRRDHLPITSLFN

SEQ ID NO: 1639705 - protein, 9 aa, Staphylococcus aureus
KRRKEKDLT

SEQ ID NO: 1639706 - protein, 10 aa, Staphylococcus aureus
KRSLKTKEEV

SEQ ID NO: 1639707 - protein, 6 aa, Staphylococcus aureus
KRSNKR

SEQ ID NO: 1639708 - protein, 16 aa, Staphylococcus aureus
KRSVSTISREISRNNL

SEQ ID NO: 1639709 - protein, 4 aa, Staphylococcus aureus
KRTD

SEQ ID NO: 1639710 - protein, 5 aa, Staphylococcus aureus
KRTEK

SEQ ID NO: 1639711 - protein, 7 aa, Staphylococcus aureus
KRTERSF

SEQ ID NO: 1639712 - protein, 8 aa, Staphylococcus aureus
KRTIDKEK

SEQ ID NO: 1639713 - protein, 7 aa, Staphylococcus aureus
KRTLENN

SEQ ID NO: 1639714 - protein, 6 aa, Staphylococcus aureus
KRTQEI

SEQ ID NO: 1639715 - protein, 6 aa, Staphylococcus aureus
KRTSGN

SEQ ID NO: 1639716 - protein, 7 aa, Staphylococcus aureus
KRVETQR

SEQ ID NO: 1639717 - protein, 13 aa, Staphylococcus aureus
KRVKQERQQEIED

SEQ ID NO: 1639718 - protein, 15 aa, Staphylococcus aureus
KRVTAQGNTINYLDH

SEQ ID NO: 1639719 - protein, 12 aa, Staphylococcus aureus
KRYDTPTKQAPK

SEQ ID NO: 1639720 - protein, 11 aa, Staphylococcus aureus
KSADKKVLTPA

SEQ ID NO: 1639721 - protein, 10 aa, Staphylococcus aureus
KSAKDVGIEK

SEQ ID NO: 1639722 - protein, 8 aa, Staphylococcus aureus
KSARKKYP

SEQ ID NO: 1639723 - protein, 7 aa, Staphylococcus aureus
KSASEVV

SEQ ID NO: 1639724 - protein, 8 aa, Staphylococcus aureus
KSAVETAE

SEQ ID NO: 1639725 - protein, 6 aa, Staphylococcus aureus
KSAYNN

SEQ ID NO: 1639726 - protein, 5 aa, Staphylococcus aureus
KSDEK

SEQ ID NO: 1639727 - protein, 17 aa, Staphylococcus aureus
KSDERIKNAKENNDSNE

SEQ ID NO: 1639728 - protein, 16 aa, Staphylococcus aureus
KSDGLNDDDNDSSDSI

SEQ ID NO: 1639729 - protein, 7 aa, Staphylococcus aureus
KSDLENY

SEQ ID NO: 1639730 - protein, 5 aa, Staphylococcus aureus
KSDNA

SEQ ID NO: 1639731 - protein, 6 aa, Staphylococcus aureus
KSDNIN

SEQ ID NO: 1639732 - protein, 7 aa, Staphylococcus aureus
KSDRARL

SEQ ID NO: 1639733 - protein, 13 aa, Staphylococcus aureus
KSDSKPFKGVRKE

SEQ ID NO: 1639734 - protein, 6 aa, Staphylococcus aureus
KSDSNW

SEQ ID NO: 1639735 - protein, 5 aa, Staphylococcus aureus
KSDYI

SEQ ID NO: 1639736 - protein, 6 aa, Staphylococcus aureus
KSEELG

SEQ ID NO: 1639737 - protein, 5 aa, Staphylococcus aureus
KSEGV

SEQ ID NO: 1639738 - protein, 20 aa, Staphylococcus aureus
KSEKKVQTEQDKELKKITSK

SEQ ID NO: 1639739 - protein, 7 aa, Staphylococcus aureus
KSENKDY

SEQ ID NO: 1639740 - protein, 6 aa, Staphylococcus aureus
KSENNK

SEQ ID NO: 1639741 - protein, 9 aa, Staphylococcus aureus
KSEPPVEKH

SEQ ID NO: 1639742 - protein, 9 aa, Staphylococcus aureus
KSEQTPSSV

SEQ ID NO: 1639743 - protein, 7 aa, Staphylococcus aureus
KSERGKI

SEQ ID NO: 1639744 - protein, 10 aa, Staphylococcus aureus
KSERKDNRKM

SEQ ID NO: 1639745 - protein, 28 aa, Staphylococcus aureus
KSETAPRSVQSPTQASKKETAKPQPKAV

SEQ ID NO: 1639746 - protein, 6 aa, Staphylococcus aureus
KSFNNK

SEQ ID NO: 1639747 - protein, 47 aa, Staphylococcus aureus; identical to SEQ ID NO: 1561240

SEQ ID NO: 1639748 - protein, 10 aa, Staphylococcus aureus
KSGANNINEN

SEQ ID NO: 1639749 - protein, 7 aa, Staphylococcus aureus
KSGCGKS

SEQ ID NO: 1639750 - protein, 12 aa, Staphylococcus aureus
KSGEPNPKSNQA

SEQ ID NO: 1639751 - protein, 13 aa, Staphylococcus aureus
KSGESYNLPTQKS

SEQ ID NO: 1639752 - protein, 8 aa, Staphylococcus aureus
KSGKTLNI

SEQ ID NO: 1639753 - protein, 6 aa, Staphylococcus aureus
KSGVNT

SEQ ID NO: 1639754 - protein, 5 aa, Staphylococcus aureus
KSHKV

SEQ ID NO: 1639755 - protein, 9 aa, Staphylococcus aureus
KSIDSAEEI

SEQ ID NO: 1639756 - protein, 9 aa, Staphylococcus aureus
KSIEDTRKQ

SEQ ID NO: 1639757 - protein, 14 aa, Staphylococcus aureus
KSIEEDPELPKTEA

SEQ ID NO: 1639758 - protein, 13 aa, Staphylococcus aureus
KSITKGKYTRASE

SEQ ID NO: 1639759 - protein, 6 aa, Staphylococcus aureus
KSKALK

SEQ ID NO: 1639760 - protein, 58 aa, Staphylococcus aureus
KSKDDTSNAEYSKVPDVEGQDKQKAIDNVSAKSLEPVTIGSGTQIKAQSIKAGNKVLP

SEQ ID NO: 1639761 - protein, 8 aa, Staphylococcus aureus
KSKDKAKV

SEQ ID NO: 1639762 - protein, 8 aa, Staphylococcus aureus
KSKDNGKI

SEQ ID NO: 1639763 - protein, 7 aa, Staphylococcus aureus
KSKEGHK

SEQ ID NO: 1639764 - protein, 7 aa, Staphylococcus aureus
KSKEKEY

SEQ ID NO: 1639765 - protein, 5 aa, Staphylococcus aureus
KSKLK

SEQ ID NO: 1639766 - protein, 9 aa, Staphylococcus aureus
KSKSHQTIT

SEQ ID NO: 1639767 - protein, 6 aa, Staphylococcus aureus
KSKTEK

SEQ ID NO: 1639768 - protein, 15 aa, Staphylococcus aureus
KSKYAKNIYLNFKKI

SEQ ID NO: 1639769 - protein, 8 aa, Staphylococcus aureus
KSKYNPNW

SEQ ID NO: 1639770 - protein, 13 aa, Staphylococcus aureus
KSLAKGSATTFDI

SEQ ID NO: 1639771 - protein, 9 aa, Staphylococcus aureus
KSLAPQGQT

SEQ ID NO: 1639772 - protein, 8 aa, Staphylococcus aureus
KSLKSVSR

SEQ ID NO: 1639773 - protein, 9 aa, Staphylococcus aureus
KSLKSWTGD

SEQ ID NO: 1639774 - protein, 6 aa, Staphylococcus aureus
KSLNTL

SEQ ID NO: 1639775 - protein, 6 aa, Staphylococcus aureus
KSLSIT

SEQ ID NO: 1639776 - protein, 10 aa, Staphylococcus aureus
KSLSQTYKQL

SEQ ID NO: 1639777 - protein, 11 aa, Staphylococcus aureus
KSLSSDAELTK

SEQ ID NO: 1639778 - protein, 7 aa, Staphylococcus aureus
KSLSSKG

SEQ ID NO: 1639779 - protein, 12 aa, Staphylococcus aureus
KSLSTSKLEKKL

SEQ ID NO: 1639780 - protein, 5 aa, Staphylococcus aureus
KSNKQ

SEQ ID NO: 1639781 - protein, 6 aa, Staphylococcus aureus
KSNKQL

SEQ ID NO: 1639782 - protein, 6 aa, Staphylococcus aureus
KSNNDY

SEQ ID NO: 1639783 - protein, 10 aa, Staphylococcus aureus
KSNNNSELSK

SEQ ID NO: 1639784 - protein, 12 aa, Staphylococcus aureus
KSNSTHNASDAV

SEQ ID NO: 1639785 - protein, 11 aa, Staphylococcus aureus
KSNTNFAKNEE

SEQ ID NO: 1639786 - protein, 12 aa, Staphylococcus aureus
KSNTNFTKNEEL

SEQ ID NO: 1639787 - protein, 7 aa, Staphylococcus aureus
KSPNPVM

SEQ ID NO: 1639788 - protein, 9 aa, Staphylococcus aureus
KSPSPDEEA

SEQ ID NO: 1639789 - protein, 13 aa, Staphylococcus aureus
KSQIPVGENEQNE

SEQ ID NO: 1639790 - protein, 14 aa, Staphylococcus aureus
KSQIRKMYNQFHPR

SEQ ID NO: 1639791 - protein, 7 aa, Staphylococcus aureus
KSQKKYS

SEQ ID NO: 1639792 - protein, 5 aa, Staphylococcus aureus
KSQVD

SEQ ID NO: 1639793 - protein, 7 aa, Staphylococcus aureus
KSSDPVI

SEQ ID NO: 1639794 - protein, 21 aa, Staphylococcus aureus
KSSDTAEKSKEDSKETQIKKS

SEQ ID NO: 1639795 - protein, 8 aa, Staphylococcus aureus
KSSEGSAI

SEQ ID NO: 1639796 - protein, 6 aa, Staphylococcus aureus
KSSGRL

SEQ ID NO: 1639797 - protein, 14 aa, Staphylococcus aureus
KSSIQKHVKDTNKI

SEQ ID NO: 1639798 - protein, 6 aa, Staphylococcus aureus
KSSLDG

SEQ ID NO: 1639799 - protein, 5 aa, Staphylococcus aureus
KSSLS

SEQ ID NO: 1639800 - protein, 15 aa, Staphylococcus aureus
KSSMTTRALTSGTAI

SEQ ID NO: 1639801 - protein, 12 aa, Staphylococcus aureus
KSSNFSKDKKLD

SEQ ID NO: 1639802 - protein, 9 aa, Staphylococcus aureus
KSSQERKTN

SEQ ID NO: 1639803 - protein, 7 aa, Staphylococcus aureus
KSSRKVN

SEQ ID NO: 1639804 - protein, 7 aa, Staphylococcus aureus
KSSRNDG

SEQ ID NO: 1639805 - protein, 8 aa, Staphylococcus aureus
KSSRTSLT

SEQ ID NO: 1639806 - protein, 8 aa, Staphylococcus aureus
KSSTIYSA

SEQ ID NO: 1639807 - protein, 4 aa, Staphylococcus aureus
KSSY

SEQ ID NO: 1639808 - protein, 8 aa, Staphylococcus aureus
KSTENLQT

SEQ ID NO: 1639809 - protein, 15 aa, Staphylococcus aureus
KSTFQETHDQSSNMI

SEQ ID NO: 1639810 - protein, 14 aa, Staphylococcus aureus
KSTGGGTANSPARL

SEQ ID NO: 1639811 - protein, 11 aa, Staphylococcus aureus
KSTGKDQPIGL

SEQ ID NO: 1639812 - protein, 7 aa, Staphylococcus aureus
KSTINNY

SEQ ID NO: 1639813 - protein, 7 aa, Staphylococcus aureus
KSTIPVA

SEQ ID NO: 1639814 - protein, 7 aa, Staphylococcus aureus
KSTLTQE

SEQ ID NO: 1639815 - protein, 11 aa, Staphylococcus aureus
KSTPENLAEQI

SEQ ID NO: 1639816 - protein, 6 aa, Staphylococcus aureus
KSTTER

SEQ ID NO: 1639817 - protein, 42 aa, Staphylococcus aureus
KSTTNGQQINNKSTTNQQQINTNKNVKNGDNVKNDENEKKKA

SEQ ID NO: 1639818 - protein, 7 aa, Staphylococcus aureus
KSVQNAI

SEQ ID NO: 1639819 - protein, 5 aa, Staphylococcus aureus
KSVSD

SEQ ID NO: 1639820 - protein, 10 aa, Staphylococcus aureus
KSVSKVKQTQ

SEQ ID NO: 1639821 - protein, 7 aa, Staphylococcus aureus
KSVTNTQ

SEQ ID NO: 1639822 - protein, 5 aa, Staphylococcus aureus
KSYDV

SEQ ID NO: 1639823 - protein, 6 aa, Staphylococcus aureus
KSYRRR

SEQ ID NO: 1639824 - protein, 12 aa, Staphylococcus aureus
KSYSPGSSKYKK

SEQ ID NO: 1639825 - protein, 7 aa, Staphylococcus aureus
KSYTSEL

SEQ ID NO: 1639826 - protein, 5 aa, Staphylococcus aureus
KSYYS

SEQ ID NO: 1639827 - protein, 10 aa, Staphylococcus aureus
KTAENTQSIN

SEQ ID NO: 1639828 - protein, 14 aa, Staphylococcus aureus
KTAHASTPKEGVSA

SEQ ID NO: 1639829 - protein, 14 aa, Staphylococcus aureus
KTAHASTPKESVSA

SEQ ID NO: 1639830 - protein, 5 aa, Staphylococcus aureus
KTCEI

SEQ ID NO: 1639831 - protein, 5 aa, Staphylococcus aureus
KTDDT

SEQ ID NO: 1639832 - protein, 8 aa, Staphylococcus aureus
KTDDVYEA

SEQ ID NO: 1639833 - protein, 8 aa, Staphylococcus aureus
KTDIPENK

SEQ ID NO: 1639834 - protein, 6 aa, Staphylococcus aureus
KTDKTF

SEQ ID NO: 1639835 - protein, 4 aa, Staphylococcus aureus
KTDW

SEQ ID NO: 1639836 - protein, 49 aa, Staphylococcus aureus
KTEDFSHRAETREEVEKKEKEFEEEYKKEQEREKEKEKQKDDDHSSLDE

SEQ ID NO: 1639837 - protein, 5 aa, Staphylococcus aureus
KTEEV

SEQ ID NO: 1639838 - protein, 6 aa, Staphylococcus aureus
KTEIED

SEQ ID NO: 1639839 - protein, 9 aa, Staphylococcus aureus
KTEKQGKDK

SEQ ID NO: 1639840 - protein, 6 aa, Staphylococcus aureus
KTFDTA

SEQ ID NO: 1639841 - protein, 19 aa, Staphylococcus aureus
KTFDTAEELEKIYKATWFG

SEQ ID NO: 1639842 - protein, 7 aa, Staphylococcus aureus
KTFDTAG

SEQ ID NO: 1639843 - protein, 9 aa, Staphylococcus aureus
KTFDTPEEL

SEQ ID NO: 1639844 - protein, 14 aa, Staphylococcus aureus
KTFEHSGHAPHIEE

SEQ ID NO: 1639845 - protein, 5 aa, Staphylococcus aureus
KTFNN

SEQ ID NO: 1639846 - protein, 4 aa, Staphylococcus aureus
KTFQ

SEQ ID NO: 1639847 - protein, 5 aa, Staphylococcus aureus
KTFSN

SEQ ID NO: 1639848 - protein, 15 aa, Staphylococcus aureus
KTGKHFKHNTAKTKD

SEQ ID NO: 1639849 - protein, 16 aa, Staphylococcus aureus
KTGKTLAKYAASTGQH

SEQ ID NO: 1639850 - protein, 18 aa, Staphylococcus aureus
KTGQEAEINAPGPHITST

SEQ ID NO: 1639851 - protein, 17 aa, Staphylococcus aureus
KTGQETEINAPGPHITS

SEQ ID NO: 1639852 - protein, 16 aa, Staphylococcus aureus
KTGRSTQCKCPYRSDL

SEQ ID NO: 1639853 - protein, 17 aa, Staphylococcus aureus
KTGTEHIKDTKYTTAGA

SEQ ID NO: 1639854 - protein, 7 aa, Staphylococcus aureus
KTGYDVN

SEQ ID NO: 1639855 - protein, 12 aa, Staphylococcus aureus
KTGYDVNAKGHL

SEQ ID NO: 1639856 - protein, 18 aa, Staphylococcus aureus
KTHAKSTLSKLKKKGKIA

SEQ ID NO: 1639857 - protein, 10 aa, Staphylococcus aureus
KTHANALANY

SEQ ID NO: 1639858 - protein, 8 aa, Staphylococcus aureus
KTHKEDIY

SEQ ID NO: 1639859 - protein, 15 aa, Staphylococcus aureus
KTHTPLSELPEGSII

SEQ ID NO: 1639860 - protein, 6 aa, Staphylococcus aureus
KTIDGE

SEQ ID NO: 1639861 - protein, 5 aa, Staphylococcus aureus
KTIEQ

SEQ ID NO: 1639862 - protein, 4 aa, Staphylococcus aureus
KTII

SEQ ID NO: 1639863 - protein, 15 aa, Staphylococcus aureus
KTIKEQQTNQLINDF

SEQ ID NO: 1639864 - protein, 14 aa, Staphylococcus aureus
KTILSTNGSGRTNE

SEQ ID NO: 1639865 - protein, 4 aa, Staphylococcus aureus
KTIN

SEQ ID NO: 1639866 - protein, 7 aa, Staphylococcus aureus
KTINGNT

SEQ ID NO: 1639867 - protein, 18 aa, Staphylococcus aureus
KTIRYDRQDIENVIEQMK

SEQ ID NO: 1639868 - protein, 14 aa, Staphylococcus aureus
KTISSISDNQLQTS

SEQ ID NO: 1639869 - protein, 8 aa, Staphylococcus aureus
KTISTEEA

SEQ ID NO: 1639870 - protein, 5 aa, Staphylococcus aureus
KTITN

SEQ ID NO: 1639871 - protein, 13 aa, Staphylococcus aureus
KTITNRKEDGTKK

SEQ ID NO: 1639872 - protein, 11 aa, Staphylococcus aureus
KTKDKSFDEAS

SEQ ID NO: 1639873 - protein, 7 aa, Staphylococcus aureus
KTKDRGQ

SEQ ID NO: 1639874 - protein, 7 aa, Staphylococcus aureus
KTKDSNV

SEQ ID NO: 1639875 - protein, 26 aa, Staphylococcus aureus
KTKFAKLGNSQGKSVIEANNVEDAVD

SEQ ID NO: 1639876 - protein, 6 aa, Staphylococcus aureus
KTKGKV

SEQ ID NO: 1639877 - protein, 9 aa, Staphylococcus aureus
KTKNDDEAI

SEQ ID NO: 1639878 - protein, 9 aa, Staphylococcus aureus
KTKNGERQI

SEQ ID NO: 1639879 - protein, 7 aa, Staphylococcus aureus
KTKSRKQ

SEQ ID NO: 1639880 - protein, 4 aa, Staphylococcus aureus
KTLE

SEQ ID NO: 1639881 - protein, 22 aa, Staphylococcus aureus
KTLETNKKEKPIKSLFKKVFNI

SEQ ID NO: 1639882 - protein, 6 aa, Staphylococcus aureus
KTLGIK

SEQ ID NO: 1639883 - protein, 13 aa, Staphylococcus aureus
KTLNSSKYISEEA

SEQ ID NO: 1639884 - protein, 6 aa, Staphylococcus aureus
KTLPAK

SEQ ID NO: 1639885 - protein, 22 aa, Staphylococcus aureus
KTMDTSNRTIYPRPKTDSSEDI

SEQ ID NO: 1639886 - protein, 8 aa, Staphylococcus aureus
KTNAERQQ

SEQ ID NO: 1639887 - protein, 9 aa, Staphylococcus aureus
KTNAGGTQK

SEQ ID NO: 1639888 - protein, 8 aa, Staphylococcus aureus
KTNDQGKI

SEQ ID NO: 1639889 - protein, 10 aa, Staphylococcus aureus
KTNDQGKIEK

SEQ ID NO: 1639890 - protein, 7 aa, Staphylococcus aureus
KTNEEEF

SEQ ID NO: 1639891 - protein, 6 aa, Staphylococcus aureus
KTNELE

SEQ ID NO: 1639892 - protein, 7 aa, Staphylococcus aureus
KTNNGNV

SEQ ID NO: 1639893 - protein, 9 aa, Staphylococcus aureus
KTNSINEKM

SEQ ID NO: 1639894 - protein, 19 aa, Staphylococcus aureus
KTNSINTMGSRKRRTIYYR

SEQ ID NO: 1639895 - protein, 6 aa, Staphylococcus aureus
KTPITS

SEQ ID NO: 1639896 - protein, 10 aa, Staphylococcus aureus
KTPKISDQNR

SEQ ID NO: 1639897 - protein, 7 aa, Staphylococcus aureus
KTPTEER

SEQ ID NO: 1639898 - protein, 4 aa, Staphylococcus aureus
KTQN

SEQ ID NO: 1639899 - protein, 6 aa, Staphylococcus aureus
KTQSDF

SEQ ID NO: 1639900 - protein, 5 aa, Staphylococcus aureus
KTRKF

SEQ ID NO: 1639901 - protein, 4 aa, Staphylococcus aureus
KTRN

SEQ ID NO: 1639902 - protein, 5 aa, Staphylococcus aureus
KTRRS

SEQ ID NO: 1639903 - protein, 9 aa, Staphylococcus aureus
KTRSYRSAT

SEQ ID NO: 1639904 - protein, 9 aa, Staphylococcus aureus
KTRTQSKKI

SEQ ID NO: 1639905 - protein, 5 aa, Staphylococcus aureus
KTSAL

SEQ ID NO: 1639906 - protein, 9 aa, Staphylococcus aureus
KTSFEEGKT

SEQ ID NO: 1639907 - protein, 7 aa, Staphylococcus aureus
KTSFNNS

SEQ ID NO: 1639908 - protein, 6 aa, Staphylococcus aureus
KTSGFK

SEQ ID NO: 1639909 - protein, 5 aa, Staphylococcus aureus
KTSGH

SEQ ID NO: 1639910 - protein, 20 aa, Staphylococcus aureus
KTSGSGANANKVTINKIMGW

SEQ ID NO: 1639911 - protein, 20 aa, Staphylococcus aureus
KTSGSGANANRVTINKIVGW

SEQ ID NO: 1639912 - protein, 5 aa, Staphylococcus aureus
KTSRF

SEQ ID NO: 1639913 - protein, 7 aa, Staphylococcus aureus
KTSTSWQ

SEQ ID NO: 1639914 - protein, 17 aa, Staphylococcus aureus
KTSVESDSSYKQTDYLS

SEQ ID NO: 1639915 - protein, 5 aa, Staphylococcus aureus
KTTEY

SEQ ID NO: 1639916 - protein, 10 aa, Staphylococcus aureus
KTTNHDHNGI

SEQ ID NO: 1639917 - protein, 8 aa, Staphylococcus aureus
KTTNYCKE

SEQ ID NO: 1639918 - protein, 15 aa, Staphylococcus aureus
KTTPNTGERVERGDS

SEQ ID NO: 1639919 - protein, 19 aa, Staphylococcus aureus
KTTVKDQSTIDERERGYNC

SEQ ID NO: 1639920 - protein, 7 aa, Staphylococcus aureus
KTVNGED

SEQ ID NO: 1639921 - protein, 25 aa, Staphylococcus aureus
KTVQTNGNQTITSTLNEEQTSKELD

SEQ ID NO: 1639922 - protein, 5 aa, Staphylococcus aureus
KTVST

SEQ ID NO: 1639923 - protein, 4 aa, Staphylococcus aureus
KTYE

SEQ ID NO: 1639924 - protein, 5 aa, Staphylococcus aureus
KTYQR

SEQ ID NO: 1639925 - protein, 20 aa, Staphylococcus aureus
KVAEANQAKDQLNTARQGLT

SEQ ID NO: 1639926 - protein, 8 aa, Staphylococcus aureus
KVDEEDKL

SEQ ID NO: 1639927 - protein, 34 aa, Staphylococcus aureus
KVDEHTQKSTKKASATVEQTFTAKQNQPRNNGRF

SEQ ID NO: 1639928 - protein, 34 aa, Staphylococcus aureus
KVDEHTQKSTKKASSTVEQTSTAKQNQPRNNGRF

SEQ ID NO: 1639929 - protein, 12 aa, Staphylococcus aureus
KVDSNSYGNASG

SEQ ID NO: 1639930 - protein, 8 aa, Staphylococcus aureus
KVEASANR

SEQ ID NO: 1639931 - protein, 14 aa, Staphylococcus aureus
KVEDSIGNNESNYE

SEQ ID NO: 1639932 - protein, 11 aa, Staphylococcus aureus
KVEGDLRRETN

SEQ ID NO: 1639933 - protein, 10 aa, Staphylococcus aureus
KVEGSSEIGA

SEQ ID NO: 1639934 - protein, 6 aa, Staphylococcus aureus
KVEGYG

SEQ ID NO: 1639935 - protein, 15 aa, Staphylococcus aureus
KVEKNNAKTKNPRLA

SEQ ID NO: 1639936 - protein, 5 aa, Staphylococcus aureus
KVEVK

SEQ ID NO: 1639937 - protein, 23 aa, Staphylococcus aureus
KVGTFENQKKASVVSDSRTEDHS

SEQ ID NO: 1639938 - protein, 4 aa, Staphylococcus aureus
KVIE

SEQ ID NO: 1639939 - protein, 6 aa, Staphylococcus aureus
KVIQPA

SEQ ID NO: 1639940 - protein, 7 aa, Staphylococcus aureus
KVKEKGF

SEQ ID NO: 1639941 - protein, 6 aa, Staphylococcus aureus
KVKEND

SEQ ID NO: 1639942 - protein, 7 aa, Staphylococcus aureus
KVKENDN

SEQ ID NO: 1639943 - protein, 7 aa, Staphylococcus aureus
KVKKNDD

SEQ ID NO: 1639944 - protein, 13 aa, Staphylococcus aureus
KVKKQDKDKNTTL

SEQ ID NO: 1639945 - protein, 19 aa, Staphylococcus aureus
KVKQYGTPLPVKEAKDDEY

SEQ ID NO: 1639946 - protein, 8 aa, Staphylococcus aureus
KVKSNDQV

SEQ ID NO: 1639947 - protein, 15 aa, Staphylococcus aureus
KVKSSKFENGGEVDT

SEQ ID NO: 1639948 - protein, 9 aa, Staphylococcus aureus
KVKTTTTNY

SEQ ID NO: 1639949 - protein, 7 aa, Staphylococcus aureus
KVNAPSV

SEQ ID NO: 1639950 - protein, 17 aa, Staphylococcus aureus
KVNQPKNEGSSGNYQKL

SEQ ID NO: 1639951 - protein, 6 aa, Staphylococcus aureus
KVNYSE

SEQ ID NO: 1639952 - protein, 12 aa, Staphylococcus aureus
KVQAAQTKINEA

SEQ ID NO: 1639953 - protein, 9 aa, Staphylococcus aureus
KVQNDQYGL

SEQ ID NO: 1639954 - protein, 9 aa, Staphylococcus aureus
KVQPTNNTF

SEQ ID NO: 1639955 - protein, 4 aa, Staphylococcus aureus
KVQS

SEQ ID NO: 1639956 - protein, 16 aa, Staphylococcus aureus
KVRATKAKDDNSANAI

SEQ ID NO: 1639957 - protein, 8 aa, Staphylococcus aureus
KVRIEGSK

SEQ ID NO: 1639958 - protein, 12 aa, Staphylococcus aureus
KVSDRNKADALK

SEQ ID NO: 1639959 - protein, 13 aa, Staphylococcus aureus
KVSDRNKADALKA

SEQ ID NO: 1639960 - protein, 4 aa, Staphylococcus aureus
KVSF

SEQ ID NO: 1639961 - protein, 12 aa, Staphylococcus aureus
KVSGKKTNRSKL

SEQ ID NO: 1639962 - protein, 28 aa, Staphylococcus aureus
KVSGTASSSNAASNSSRPSTNSGGGSYY

SEQ ID NO: 1639963 - protein, 11 aa, Staphylococcus aureus
KVSKKDRKAFA

SEQ ID NO: 1639964 - protein, 13 aa, Staphylococcus aureus
KVSNELKSSNEKI

SEQ ID NO: 1639965 - protein, 12 aa, Staphylococcus aureus
KVSNRNKADALK

SEQ ID NO: 1639966 - protein, 6 aa, Staphylococcus aureus
KVSQIQ

SEQ ID NO: 1639967 - protein, 13 aa, Staphylococcus aureus
KVSQQSLNTEPNE

SEQ ID NO: 1639968 - protein, 10 aa, Staphylococcus aureus
KVSRESLSYS

SEQ ID NO: 1639969 - protein, 6 aa, Staphylococcus aureus
KVSRQT

SEQ ID NO: 1639970 - protein, 16 aa, Staphylococcus aureus
KVSSSSTIISATDPVR

SEQ ID NO: 1639971 - protein, 21 aa, Staphylococcus aureus
KVTGKKKRTTRRFSKKRDAEI

SEQ ID NO: 1639972 - protein, 11 aa, Staphylococcus aureus
KVTKVYGDQDS

SEQ ID NO: 1639973 - protein, 6 aa, Staphylococcus aureus
KVTPAH

SEQ ID NO: 1639974 - protein, 13 aa, Staphylococcus aureus
KVYGNEEQVGTGI

SEQ ID NO: 1639975 - protein, 9 aa, Staphylococcus aureus
KWDNSNLSH

SEQ ID NO: 1639976 - protein, 4 aa, Staphylococcus aureus
KWDT

SEQ ID NO: 1639977 - protein, 12 aa, Staphylococcus aureus
KWTKSKFKQENK

SEQ ID NO: 1639978 - protein, 9 aa, Staphylococcus aureus
KYASSESKY

SEQ ID NO: 1639979 - protein, 7 aa, Staphylococcus aureus
KYDEMGG

SEQ ID NO: 1639980 - protein, 9 aa, Staphylococcus aureus
KYDGIENSD

SEQ ID NO: 1639981 - protein, 9 aa, Staphylococcus aureus
KYDKDGQTH

SEQ ID NO: 1639982 - protein, 6 aa, Staphylococcus aureus
KYDKQT

SEQ ID NO: 1639983 - protein, 17 aa, Staphylococcus aureus
KYDPSGKMKVDNSTLEK

SEQ ID NO: 1639984 - protein, 14 aa, Staphylococcus aureus
KYEEPEYEKAVKKY

SEQ ID NO: 1639985 - protein, 20 aa, Staphylococcus aureus
KYEESNVDRLKSPLAKTEEL

SEQ ID NO: 1639986 - protein, 5 aa, Staphylococcus aureus
KYEGV

SEQ ID NO: 1639987 - protein, 10 aa, Staphylococcus aureus
KYEHAQAIRN

SEQ ID NO: 1639988 - protein, 5 aa, Staphylococcus aureus
KYEHN

SEQ ID NO: 1639989 - protein, 16 aa, Staphylococcus aureus
KYEKELRDNETQKEAF

SEQ ID NO: 1639990 - protein, 5 aa, Staphylococcus aureus
KYEPL

SEQ ID NO: 1639991 - protein, 6 aa, Staphylococcus aureus
KYGDDV

SEQ ID NO: 1639992 - protein, 7 aa, Staphylococcus aureus
KYGGGAG

SEQ ID NO: 1639993 - protein, 6 aa, Staphylococcus aureus
KYGTTY

SEQ ID NO: 1639994 - protein, 5 aa, Staphylococcus aureus
KYGVD

SEQ ID NO: 1639995 - protein, 7 aa, Staphylococcus aureus
KYHKTPA

SEQ ID NO: 1639996 - protein, 7 aa, Staphylococcus aureus
KYKDEEI

SEQ ID NO: 1639997 - protein, 7 aa, Staphylococcus aureus
KYKKTQL

SEQ ID NO: 1639998 - protein, 9 aa, Staphylococcus aureus
KYKKYKPVI

SEQ ID NO: 1639999 - protein, 6 aa, Staphylococcus aureus
KYKNFE

SEQ ID NO: 1640000 - protein, 13 aa, Staphylococcus aureus
KYKRFSNKKGCHS

SEQ ID NO: 1640001 - protein, 6 aa, Staphylococcus aureus
KYLGGH

SEQ ID NO: 1640002 - protein, 9 aa, Staphylococcus aureus
KYNDYKDKW

SEQ ID NO: 1640003 - protein, 6 aa, Staphylococcus aureus
KYNEQG

SEQ ID NO: 1640004 - protein, 8 aa, Staphylococcus aureus
KYNNIDNE

SEQ ID NO: 1640005 - protein, 28 aa, Staphylococcus aureus
KYNSNFEKEDVPNASSQQSESDLSDEEL

SEQ ID NO: 1640006 - protein, 12 aa, Staphylococcus aureus
KYNTGTAQPKLN

SEQ ID NO: 1640007 - protein, 6 aa, Staphylococcus aureus
KYPDES

SEQ ID NO: 1640008 - protein, 4 aa, Staphylococcus aureus
KYPE

SEQ ID NO: 1640009 - protein, 8 aa, Staphylococcus aureus
KYPKIKDK

SEQ ID NO: 1640010 - protein, 6 aa, Staphylococcus aureus
KYPPHK

SEQ ID NO: 1640011 - protein, 6 aa, Staphylococcus aureus
KYQHPA

SEQ ID NO: 1640012 - protein, 8 aa, Staphylococcus aureus
KYSDEDRK

SEQ ID NO: 1640013 - protein, 9 aa, Staphylococcus aureus
KYSKQNNDL

SEQ ID NO: 1640014 - protein, 5 aa, Staphylococcus aureus
KYSQQ

SEQ ID NO: 1640015 - protein, 4 aa, Staphylococcus aureus
KYSV

SEQ ID NO: 1640016 - protein, 11 aa, Staphylococcus aureus
KYTGKTGCLDS

SEQ ID NO: 1640017 - protein, 22 aa, Staphylococcus aureus
KYTNTPDLSDENFSGVQSGESM

SEQ ID NO: 1640018 - protein, 6 aa, Staphylococcus aureus
KYVGQG

SEQ ID NO: 1640019 - protein, 16 aa, Staphylococcus aureus
KYVGQGFQSPAEKDAI

SEQ ID NO: 1640020 - protein, 17 aa, Staphylococcus aureus
LAANERKYREIIKKELA

SEQ ID NO: 1640021 - protein, 17 aa, Staphylococcus aureus
LAASERKYREIIKKELT

SEQ ID NO: 1640022 - protein, 11 aa, Staphylococcus aureus
LADKEASLKEY

SEQ ID NO: 1640023 - protein, 22 aa, Staphylococcus aureus
LADKQSELKRIEDNNSASNENK

SEQ ID NO: 1640024 - protein, 12 aa, Staphylococcus aureus
LADNKSEATNLT

SEQ ID NO: 1640025 - protein, 10 aa, Staphylococcus aureus
LAEDQDESDY

SEQ ID NO: 1640026 - protein, 28 aa, Staphylococcus aureus
LAEGNATVTATSGKKTDTVQVTVQSNLE

SEQ ID NO: 1640027 - protein, 16 aa, Staphylococcus aureus
LAEKHPEIKDYSEEAR

SEQ ID NO: 1640028 - protein, 16 aa, Staphylococcus aureus
LAEKRPEIKDYSEEAR

SEQ ID NO: 1640029 - protein, 9 aa, Staphylococcus aureus
LAENDPERC

SEQ ID NO: 1640030 - protein, 7 aa, Staphylococcus aureus
LAENPEL

SEQ ID NO: 1640031 - protein, 8 aa, Staphylococcus aureus
LAEPGEFT

SEQ ID NO: 1640032 - protein, 5 aa, Staphylococcus aureus
LAESN

SEQ ID NO: 1640033 - protein, 148 aa, Staphylococcus aureus
LAESSNKVENNTATDEKAESKDSKVAGVNTSTDAKTDTKAENAGDGTATKVDKEDQISATEAIEKASVEQPKNDKAAETSNKEATVDAEAQHDAEQQVAEAHAEASKQATSNDSLEAKAENDSTASQSEMSEPKPQEEKKGFFARLFN

SEQ ID NO: 1640034 - protein, 148 aa, Staphylococcus aureus
LAESTNKVEKNAVTEDKADSKDSKVAGVTTSTDAKTDTKAENAGDGTATKVDKEDQISATEAIEKASVEQSKNENAAETSNKEATVDADAQHDAEQQVAEAHAEASKQATSNDSLEAKAENDSTASQSEMSEPKPQEEKKGFFARLFN

SEQ ID NO: 1640035 - protein, 95 aa, Staphylococcus aureus
LAESTNKVESNAVTEDKADSKDSKVAGVNTSTDAKTDTKAENAGDGNATKVDKEDQISATEAIEKASVEQSKNDKAVETSNKEATVDAEAQHDAV

SEQ ID NO: 1640036 - protein, 7 aa, Staphylococcus aureus
LAETPFQ

SEQ ID NO: 1640037 - protein, 6 aa, Staphylococcus aureus
LAGNDY

SEQ ID NO: 1640038 - protein, 6 aa, Staphylococcus aureus
LAGSNS

SEQ ID NO: 1640039 - protein, 7 aa, Staphylococcus aureus
LAGTGKT

SEQ ID NO: 1640040 - protein, 35 aa, Staphylococcus aureus
LAGTTTLDNEEPKSTDVKKSSKTFVGGTKFDDQHA

SEQ ID NO: 1640041 - protein, 6 aa, Staphylococcus aureus
LAKGNT

SEQ ID NO: 1640042 - protein, 8 aa, Staphylococcus aureus
LAKKSENE

SEQ ID NO: 1640043 - protein, 8 aa, Staphylococcus aureus
LAKNGSDI

SEQ ID NO: 1640044 - protein, 11 aa, Staphylococcus aureus
LANDDKTFGEA

SEQ ID NO: 1640045 - protein, 4 aa, Staphylococcus aureus
LANE

SEQ ID NO: 1640046 - protein, 4 aa, Staphylococcus aureus
LANI

SEQ ID NO: 1640047 - protein, 4 aa, Staphylococcus aureus
LANT

SEQ ID NO: 1640048 - protein, 8 aa, Staphylococcus aureus
LANTGTAY

SEQ ID NO: 1640049 - protein, 5 aa, Staphylococcus aureus
LAPET

SEQ ID NO: 1640050 - protein, 27 aa, Staphylococcus aureus
LAPLQAAKTQLQNDIDQPTSTTGMTSA

SEQ ID NO: 1640051 - protein, 27 aa, Staphylococcus aureus
LAPLQTAKTQLQNDIDQPTSTTGMTSA

SEQ ID NO: 1640052 - protein, 6 aa, Staphylococcus aureus
LAPRGT

SEQ ID NO: 1640053 - protein, 7 aa, Staphylococcus aureus
LAPRGTF

SEQ ID NO: 1640054 - protein, 4 aa, Staphylococcus aureus
LAQD

SEQ ID NO: 1640055 - protein, 7 aa, Staphylococcus aureus
LAQDRER

SEQ ID NO: 1640056 - protein, 7 aa, Staphylococcus aureus
LAQRAQE

SEQ ID NO: 1640057 - protein, 11 aa, Staphylococcus aureus
LAQSKTDAARA

SEQ ID NO: 1640058 - protein, 17 aa, Staphylococcus aureus
LARGERTGEEVAKRMER

SEQ ID NO: 1640059 - protein, 9 aa, Staphylococcus aureus
LASEAGVAP

SEQ ID NO: 1640060 - protein, 6 aa, Staphylococcus aureus
LASEGI

SEQ ID NO: 1640061 - protein, 11 aa, Staphylococcus aureus
LASFNPKPVAS

SEQ ID NO: 1640062 - protein, 6 aa, Staphylococcus aureus
LASIDS

SEQ ID NO: 1640063 - protein, 12 aa, Staphylococcus aureus
LASKSETTSHTY

SEQ ID NO: 1640064 - protein, 8 aa, Staphylococcus aureus
LASRMRPK

SEQ ID NO: 1640065 - protein, 10 aa, Staphylococcus aureus
LASVENKRNE

SEQ ID NO: 1640066 - protein, 31 aa, Staphylococcus aureus
LATDETDAIDNVTNATTNADVETAKNNGINT

SEQ ID NO: 1640067 - protein, 10 aa, Staphylococcus aureus
LATEGANATL

SEQ ID NO: 1640068 - protein, 21 aa, Staphylococcus aureus
LATESDKRPAIKQSAEDDFDK

SEQ ID NO: 1640069 - protein, 7 aa, Staphylococcus aureus
LATGSLN

SEQ ID NO: 1640070 - protein, 7 aa, Staphylococcus aureus
LATNKRM

SEQ ID NO: 1640071 - protein, 13 aa, Staphylococcus aureus
LATYTKEDAFNQD

SEQ ID NO: 1640072 - protein, 4 aa, Staphylococcus aureus
LDAG

SEQ ID NO: 1640073 - protein, 7 aa, Staphylococcus aureus
LDDEHRN

SEQ ID NO: 1640074 - protein, 17 aa, Staphylococcus aureus
LDDPQYTTRIQDGKKPI

SEQ ID NO: 1640075 - protein, 9 aa, Staphylococcus aureus
LDDTTFKRA

SEQ ID NO: 1640076 - protein, 11 aa, Staphylococcus aureus
LDEESKQEISP

SEQ ID NO: 1640077 - protein, 10 aa, Staphylococcus aureus
LDEQATAYEH

SEQ ID NO: 1640078 - protein, 5 aa, Staphylococcus aureus
LDEQI

SEQ ID NO: 1640079 - protein, 9 aa, Staphylococcus aureus
LDEYAKSDL

SEQ ID NO: 1640080 - protein, 7 aa, Staphylococcus aureus
LDFSEQT

SEQ ID NO: 1640081 - protein, 8 aa, Staphylococcus aureus
LDGCPTDS

SEQ ID NO: 1640082 - protein, 5 aa, Staphylococcus aureus
LDGGV

SEQ ID NO: 1640083 - protein, 21 aa, Staphylococcus aureus
LDGSTKSFNPVPLNEKNAENY

SEQ ID NO: 1640084 - protein, 4 aa, Staphylococcus aureus
LDID

SEQ ID NO: 1640085 - protein, 15 aa, Staphylococcus aureus
LDKDKDAEVQFQYGL

SEQ ID NO: 1640086 - protein, 11 aa, Staphylococcus aureus
LDKQSKKAYEN

SEQ ID NO: 1640087 - protein, 4 aa, Staphylococcus aureus
LDNA

SEQ ID NO: 1640088 - protein, 11 aa, Staphylococcus aureus
LDNGSIQGINR

SEQ ID NO: 1640089 - protein, 8 aa, Staphylococcus aureus
LDNPQKKD

SEQ ID NO: 1640090 - protein, 7 aa, Staphylococcus aureus
LDNSETV

SEQ ID NO: 1640091 - protein, 8 aa, Staphylococcus aureus
LDPATGHE

SEQ ID NO: 1640092 - protein, 14 aa, Staphylococcus aureus
LDPDKYKNANEEEL

SEQ ID NO: 1640093 - protein, 9 aa, Staphylococcus aureus
LDPEKRFNV

SEQ ID NO: 1640094 - protein, 14 aa, Staphylococcus aureus
LDPEKYKNANEEQL

SEQ ID NO: 1640095 - protein, 7 aa, Staphylococcus aureus
LDPGEQK

SEQ ID NO: 1640096 - protein, 13 aa, Staphylococcus aureus
LDQAKENDKNYPG

SEQ ID NO: 1640097 - protein, 26 aa, Staphylococcus aureus
LDQGRDKAHKASFKTVQKNGKSDGFR

SEQ ID NO: 1640098 - protein, 6 aa, Staphylococcus aureus
LDQSKN

SEQ ID NO: 1640099 - protein, 8 aa, Staphylococcus aureus
LDRKERAH

SEQ ID NO: 1640100 - protein, 5 aa, Staphylococcus aureus
LDSGK

SEQ ID NO: 1640101 - protein, 17 aa, Staphylococcus aureus
LDSKGVPYKKEQGNYTV

SEQ ID NO: 1640102 - protein, 17 aa, Staphylococcus aureus
LDSNGVPYKKEQGNYTV

SEQ ID NO: 1640103 - protein, 7 aa, Staphylococcus aureus
LDSRSFK

SEQ ID NO: 1640104 - protein, 15 aa, Staphylococcus aureus
LDSRSFNSFSKPKWS

SEQ ID NO: 1640105 - protein, 4 aa, Staphylococcus aureus
LDTG

SEQ ID NO: 1640106 - protein, 9 aa, Staphylococcus aureus
LDTHQADDG

SEQ ID NO: 1640107 - protein, 4 aa, Staphylococcus aureus
LEDA

SEQ ID NO: 1640108 - protein, 7 aa, Staphylococcus aureus
LEDDSEG

SEQ ID NO: 1640109 - protein, 4 aa, Staphylococcus aureus
LEDE

SEQ ID NO: 1640110 - protein, 9 aa, Staphylococcus aureus
LEDKEDLIT

SEQ ID NO: 1640111 - protein, 9 aa, Staphylococcus aureus
LEDKNDPIS

SEQ ID NO: 1640112 - protein, 6 aa, Staphylococcus aureus
LEDPDE

SEQ ID NO: 1640113 - protein, 5 aa, Staphylococcus aureus
LEDQG

SEQ ID NO: 1640114 - protein, 8 aa, Staphylococcus aureus
LEDYKEEI

SEQ ID NO: 1640115 - protein, 6 aa, Staphylococcus aureus
LEEERQ

SEQ ID NO: 1640116 - protein, 5 aa, Staphylococcus aureus
LEEGL

SEQ ID NO: 1640117 - protein, 7 aa, Staphylococcus aureus
LEENDKT

SEQ ID NO: 1640118 - protein, 4 aa, Staphylococcus aureus
LEER

SEQ ID NO: 1640119 - protein, 16 aa, Staphylococcus aureus
LEESYNSEKKRIENEL

SEQ ID NO: 1640120 - protein, 5 aa, Staphylococcus aureus
LEEYK

SEQ ID NO: 1640121 - protein, 6 aa, Staphylococcus aureus
LEGRPC

SEQ ID NO: 1640122 - protein, 5 aa, Staphylococcus aureus
LEGTE

SEQ ID NO: 1640123 - protein, 4 aa, Staphylococcus aureus
LEHT

SEQ ID NO: 1640124 - protein, 5 aa, Staphylococcus aureus
LEHTT

SEQ ID NO: 1640125 - protein, 8 aa, Staphylococcus aureus
LEKGMKTF

SEQ ID NO: 1640126 - protein, 6 aa, Staphylococcus aureus
LEKKNV

SEQ ID NO: 1640127 - protein, 4 aa, Staphylococcus aureus
LEKL

SEQ ID NO: 1640128 - protein, 10 aa, Staphylococcus aureus
LEKSSRPSGV

SEQ ID NO: 1640129 - protein, 8 aa, Staphylococcus aureus
LEKTGKQY

SEQ ID NO: 1640130 - protein, 9 aa, Staphylococcus aureus
LEKTTTEFE

SEQ ID NO: 1640131 - protein, 4 aa, Staphylococcus aureus
LEMN

SEQ ID NO: 1640132 - protein, 13 aa, Staphylococcus aureus
LENENDETYENFE

SEQ ID NO: 1640133 - protein, 9 aa, Staphylococcus aureus
LENKNDPIS

SEQ ID NO: 1640134 - protein, 19 aa, Staphylococcus aureus
LENTATNDTGASQTTINDQ

SEQ ID NO: 1640135 - protein, 15 aa, Staphylococcus aureus
LENYKEDEVSYNPEV

SEQ ID NO: 1640136 - protein, 4 aa, Staphylococcus aureus
LEPH

SEQ ID NO: 1640137 - protein, 13 aa, Staphylococcus aureus
LEQAIKDNEALSA

SEQ ID NO: 1640138 - protein, 10 aa, Staphylococcus aureus
LEQKAKRDKI

SEQ ID NO: 1640139 - protein, 18 aa, Staphylococcus aureus
LEQKEKGHSIEEQERKLR

SEQ ID NO: 1640140 - protein, 15 aa, Staphylococcus aureus
LEQNERKRCEKEGIE

SEQ ID NO: 1640141 - protein, 10 aa, Staphylococcus aureus
LEQSKSDNVN

SEQ ID NO: 1640142 - protein, 4 aa, Staphylococcus aureus
LEQT

SEQ ID NO: 1640143 - protein, 5 aa, Staphylococcus aureus
LESIG

SEQ ID NO: 1640144 - protein, 15 aa, Staphylococcus aureus
LESKGYDDAESKYTP

SEQ ID NO: 1640145 - protein, 6 aa, Staphylococcus aureus
LESYGV

SEQ ID NO: 1640146 - protein, 13 aa, Staphylococcus aureus
LETEDGSKINPTL

SEQ ID NO: 1640147 - protein, 11 aa, Staphylococcus aureus
LETETSKSRNW

SEQ ID NO: 1640148 - protein, 6 aa, Staphylococcus aureus
LETGNG

SEQ ID NO: 1640149 - protein, 5 aa, Staphylococcus aureus
LETNE

SEQ ID NO: 1640150 - protein, 32 aa, Staphylococcus aureus; identical to SEQ ID NO: 1565715

SEQ ID NO: 1640151 - protein, 19 aa, Staphylococcus aureus
LETQSEVYKNNADRALKAL

SEQ ID NO: 1640152 - protein, 20 aa, Staphylococcus aureus
LEYRDKDSEEIEATGAGDQG

SEQ ID NO: 1640153 - protein, 15 aa, Staphylococcus aureus
LGAGPQHKSWRKVSL

SEQ ID NO: 1640154 - protein, 15 aa, Staphylococcus aureus
LGAIPTSTLGYEKQT

SEQ ID NO: 1640155 - protein, 16 aa, Staphylococcus aureus
LGDPIPHNHNDSEKNG

SEQ ID NO: 1640156 - protein, 13 aa, Staphylococcus aureus
LGDSQQDIASLGG

SEQ ID NO: 1640157 - protein, 9 aa, Staphylococcus aureus
LGDTAKESF

SEQ ID NO: 1640158 - protein, 8 aa, Staphylococcus aureus
LGEDNNTY

SEQ ID NO: 1640159 - protein, 9 aa, Staphylococcus aureus
LGEEEQQVI

SEQ ID NO: 1640160 - protein, 16 aa, Staphylococcus aureus
LGEGVADDVKEAVQNA

SEQ ID NO: 1640161 - protein, 5 aa, Staphylococcus aureus
LGEMN

SEQ ID NO: 1640162 - protein, 6 aa, Staphylococcus aureus
LGEMNS

SEQ ID NO: 1640163 - protein, 12 aa, Staphylococcus aureus
LGEPLSKMAVIT

SEQ ID NO: 1640164 - protein, 11 aa, Staphylococcus aureus
LGEPPHKGTQK

SEQ ID NO: 1640165 - protein, 11 aa, Staphylococcus aureus
LGESGSGKSTL

SEQ ID NO: 1640166 - protein, 6 aa, Staphylococcus aureus
LGETTV

SEQ ID NO: 1640167 - protein, 5 aa, Staphylococcus aureus
LGGEG

SEQ ID NO: 1640168 - protein, 8 aa, Staphylococcus aureus
LGGEKDAV

SEQ ID NO: 1640169 - protein, 4 aa, Staphylococcus aureus
LGGR

SEQ ID NO: 1640170 - protein, 8 aa, Staphylococcus aureus
LGGRQNQI

SEQ ID NO: 1640171 - protein, 10 aa, Staphylococcus aureus
LGGRQNQTDH

SEQ ID NO: 1640172 - protein, 22 aa, Staphylococcus aureus
LGKEMEQISDQNDQEKNSEEES

SEQ ID NO: 1640173 - protein, 22 aa, Staphylococcus aureus
LGKGMEQISDQNDQEKNSEEDS

SEQ ID NO: 1640174 - protein, 18 aa, Staphylococcus aureus
LGKKSETNRITGISSKPP

SEQ ID NO: 1640175 - protein, 10 aa, Staphylococcus aureus
LGKNKVKAYA

SEQ ID NO: 1640176 - protein, 8 aa, Staphylococcus aureus
LGKPEEVG

SEQ ID NO: 1640177 - protein, 28 aa, Staphylococcus aureus
LGNDEPTTIDAANSKPAKAVKKPLPSKD

SEQ ID NO: 1640178 - protein, 28 aa, Staphylococcus aureus
LGNDESTTIDTVNSKPAKAVKKPLPSKD

SEQ ID NO: 1640179 - protein, 4 aa, Staphylococcus aureus
LGNK

SEQ ID NO: 1640180 - protein, 15 aa, Staphylococcus aureus
LGNKYEGNGNGGDGI

SEQ ID NO: 1640181 - protein, 16 aa, Staphylococcus aureus
LGNNQPNRLYPKKPYD

SEQ ID NO: 1640182 - protein, 10 aa, Staphylococcus aureus
LGNNVKERTA

SEQ ID NO: 1640183 - protein, 14 aa, Staphylococcus aureus
LGNPNADKWNTTTI

SEQ ID NO: 1640184 - protein, 4 aa, Staphylococcus aureus
LGPA

SEQ ID NO: 1640185 - protein, 6 aa, Staphylococcus aureus
LGPTPQ

SEQ ID NO: 1640186 - protein, 7 aa, Staphylococcus aureus
LGPTPQL

SEQ ID NO: 1640187 - protein, 8 aa, Staphylococcus aureus
LGQPIDGQ

SEQ ID NO: 1640188 - protein, 8 aa, Staphylococcus aureus
LGRGGDQV

SEQ ID NO: 1640189 - protein, 12 aa, Staphylococcus aureus
LGRGPNKEKLDS

SEQ ID NO: 1640190 - protein, 9 aa, Staphylococcus aureus
LGRKPTDIE

SEQ ID NO: 1640191 - protein, 4 aa, Staphylococcus aureus
LGRL

SEQ ID NO: 1640192 - protein, 6 aa, Staphylococcus aureus
LGRNGY

SEQ ID NO: 1640193 - protein, 11 aa, Staphylococcus aureus
LGSSNSDSKYE

SEQ ID NO: 1640194 - protein, 14 aa, Staphylococcus aureus
LGVGGITDATIISE

SEQ ID NO: 1640195 - protein, 11 aa, Staphylococcus aureus
LHGTKSSEFKP

SEQ ID NO: 1640196 - protein, 7 aa, Staphylococcus aureus
LHQKQSD

SEQ ID NO: 1640197 - protein, 12 aa, Staphylococcus aureus
LIEKGKKEGSFK

SEQ ID NO: 1640198 - protein, 12 aa, Staphylococcus aureus
LIGQSQTGTGKS

SEQ ID NO: 1640199 - protein, 11 aa, Staphylococcus aureus
LIREGASYHER

SEQ ID NO: 1640200 - protein, 13 aa, Staphylococcus aureus
LIREKTDVRKTDI

SEQ ID NO: 1640201 - protein, 11 aa, Staphylococcus aureus
LISGSSAAYEE

SEQ ID NO: 1640202 - protein, 13 aa, Staphylococcus aureus
LKAGDGGNGITAY

SEQ ID NO: 1640203 - protein, 7 aa, Staphylococcus aureus
LKAKGDY

SEQ ID NO: 1640204 - protein, 28 aa, Staphylococcus aureus
LKAKTTNLAKGGATMATVTDTNNVENSI

SEQ ID NO: 1640205 - protein, 5 aa, Staphylococcus aureus
LKANG

SEQ ID NO: 1640206 - protein, 30 aa, Staphylococcus aureus
LKAQGVSVAPVQKSSKKPARGIQKSKNAFS

SEQ ID NO: 1640207 - protein, 27 aa, Staphylococcus aureus
LKDGDRNNYAQKTVGGEDRLPDDDGGH

SEQ ID NO: 1640208 - protein, 9 aa, Staphylococcus aureus
LKDGTKDRV

SEQ ID NO: 1640209 - protein, 10 aa, Staphylococcus aureus
LKDKLDDSSM

SEQ ID NO: 1640210 - protein, 25 aa, Staphylococcus aureus
LKDSEDKLTSIKRQTESRRGGKGSR

SEQ ID NO: 1640211 - protein, 23 aa, Staphylococcus aureus
LKEGEFSRQNVTNALETVKDGYA

SEQ ID NO: 1640212 - protein, 10 aa, Staphylococcus aureus
LKEIEAESSA

SEQ ID NO: 1640213 - protein, 9 aa, Staphylococcus aureus
LKEKPSLSY

SEQ ID NO: 1640214 - protein, 8 aa, Staphylococcus aureus
LKELESDG

SEQ ID NO: 1640215 - protein, 6 aa, Staphylococcus aureus
LKETYD

SEQ ID NO: 1640216 - protein, 8 aa, Staphylococcus aureus
LKGDKGTQ

SEQ ID NO: 1640217 - protein, 8 aa, Staphylococcus aureus
LKGGDPAI

SEQ ID NO: 1640218 - protein, 11 aa, Staphylococcus aureus
LKGPLHGSANE

SEQ ID NO: 1640219 - protein, 26 aa, Staphylococcus aureus
LKHQVEQAQNVAGVNGVKDKGNTLNT

SEQ ID NO: 1640220 - protein, 10 aa, Staphylococcus aureus
LKHSESERYK

SEQ ID NO: 1640221 - protein, 10 aa, Staphylococcus aureus
LKKDTEPTSA

SEQ ID NO: 1640222 - protein, 6 aa, Staphylococcus aureus
LKKDYG

SEQ ID NO: 1640223 - protein, 10 aa, Staphylococcus aureus
LKKESSKGII

SEQ ID NO: 1640224 - protein, 13 aa, Staphylococcus aureus
LKKLSKAIKSYES

SEQ ID NO: 1640225 - protein, 16 aa, Staphylococcus aureus
LKNAEDVAKLRGKTVE

SEQ ID NO: 1640226 - protein, 32 aa, Staphylococcus aureus
LKNGGESEISGTANLDNLSNTNNSTVSPDSVN

SEQ ID NO: 1640227 - protein, 9 aa, Staphylococcus aureus
LKNKRNSIA

SEQ ID NO: 1640228 - protein, 7 aa, Staphylococcus aureus
LKNRSQN

SEQ ID NO: 1640229 - protein, 4 aa, Staphylococcus aureus
LKPE

SEQ ID NO: 1640230 - protein, 5 aa, Staphylococcus aureus
LKPGY

SEQ ID NO: 1640231 - protein, 7 aa, Staphylococcus aureus
LKPSEAK

SEQ ID NO: 1640232 - protein, 10 aa, Staphylococcus aureus
LKPSTVTGRI

SEQ ID NO: 1640233 - protein, 49 aa, Staphylococcus aureus
LKPVQSKQAASEIKTATQNTPSSSTDSQESNTNAYKTNNMTSNNVENNQ

SEQ ID NO: 1640234 - protein, 35 aa, Staphylococcus aureus
LKPVQSKQAVSESKTASEATPSSSSESQESNTNAY

SEQ ID NO: 1640235 - protein, 45 aa, Staphylococcus aureus
LKPVQSKQAVSESKTASQATPTSSTDSQESNTNAYKTNNMTSNNV

SEQ ID NO: 1640236 - protein, 48 aa, Staphylococcus aureus
LKPVQSKQAVSESKTASQATPTSSTDSQESNTNAYKTNNMTSNNVERN

SEQ ID NO: 1640237 - protein, 49 aa, Staphylococcus aureus
LKPVQSKQSVSESKPESQATPSSGTDSQESNTNAYKTNNMTSNNVENNQ

SEQ ID NO: 1640238 - protein, 24 aa, Staphylococcus aureus
LKQAQQEIENTNQDAAVTDVRNQT

SEQ ID NO: 1640239 - protein, 22 aa, Staphylococcus aureus
LKQEPRANTQAAERILQDLRSQ

SEQ ID NO: 1640240 - protein, 8 aa, Staphylococcus aureus
LKQGEGRV

SEQ ID NO: 1640241 - protein, 16 aa, Staphylococcus aureus
LKQQQNQEKLSYDTKQ

SEQ ID NO: 1640242 - protein, 16 aa, Staphylococcus aureus
LKQQQNQEKPSYDTKQ

SEQ ID NO: 1640243 - protein, 9 aa, Staphylococcus aureus
LKRGPATNP

SEQ ID NO: 1640244 - protein, 5 aa, Staphylococcus aureus
LKRPD

SEQ ID NO: 1640245 - protein, 40 aa, Staphylococcus aureus
LKRTDASQVDGQDDTSEDDDNGSEKADSKSADSESKGGAY

SEQ ID NO: 1640246 - protein, 40 aa, Staphylococcus aureus
LKRTDASQVDGQDDTSEDDDNQSEKADSKSADSESKGGAY

SEQ ID NO: 1640247 - protein, 40 aa, Staphylococcus aureus
LKRTDASQVDGQDDTSEDDENESEKADSKSADSESKGGAY

SEQ ID NO: 1640248 - protein, 40 aa, Staphylococcus aureus
LKRTDTSQVDGQDDTSEDDDNESEKADSKSADSESKGGAY

SEQ ID NO: 1640249 - protein, 25 aa, Staphylococcus aureus
LKSAYENTRPKIDKSVRNDLKETYE

SEQ ID NO: 1640250 - protein, 13 aa, Staphylococcus aureus
LKSDDDGQQSPIL

SEQ ID NO: 1640251 - protein, 11 aa, Staphylococcus aureus
LKSHTTPNNLK

SEQ ID NO: 1640252 - protein, 9 aa, Staphylococcus aureus
LKSKNADEL

SEQ ID NO: 1640253 - protein, 7 aa, Staphylococcus aureus
LKSNPII

SEQ ID NO: 1640254 - protein, 6 aa, Staphylococcus aureus
LKSRGY

SEQ ID NO: 1640255 - protein, 7 aa, Staphylococcus aureus
LKSTYSK

SEQ ID NO: 1640256 - protein, 20 aa, Staphylococcus aureus
LKTDKKTGITDDPNLYSDNP

SEQ ID NO: 1640257 - protein, 8 aa, Staphylococcus aureus
LKTELKND

SEQ ID NO: 1640258 - protein, 11 aa, Staphylococcus aureus
LKTKDGRTFYG

SEQ ID NO: 1640259 - protein, 21 aa, Staphylococcus aureus
LKTNKTNTEGGRLNDEDDLSN

SEQ ID NO: 1640260 - protein, 10 aa, Staphylococcus aureus
LKTYNSAGSD

SEQ ID NO: 1640261 - protein, 26 aa, Staphylococcus aureus
LKVASQHQTKNNPSNKNRYKTKSLST

SEQ ID NO: 1640262 - protein, 14 aa, Staphylococcus aureus
LLSNRKKVQQFTEN

SEQ ID NO: 1640263 - protein, 10 aa, Staphylococcus aureus
LNADNEDIPF

SEQ ID NO: 1640264 - protein, 8 aa, Staphylococcus aureus
LNAPSNIE

SEQ ID NO: 1640265 - protein, 5 aa, Staphylococcus aureus
LNAPT

SEQ ID NO: 1640266 - protein, 17 aa, Staphylococcus aureus
LNASNQQSASDLSDEEL

SEQ ID NO: 1640267 - protein, 23 aa, Staphylococcus aureus
LNATQAVDENNSELNQVGTSTKA

SEQ ID NO: 1640268 - protein, 7 aa, Staphylococcus aureus
LNAYNQK

SEQ ID NO: 1640269 - protein, 16 aa, Staphylococcus aureus
LNAYNQKLQAARQKLT

SEQ ID NO: 1640270 - protein, 50 aa, Staphylococcus aureus; identical to SEQ ID NO: 1568228

SEQ ID NO: 1640271 - protein, 8 aa, Staphylococcus aureus
LNDEKSEQ

SEQ ID NO: 1640272 - protein, 5 aa, Staphylococcus aureus
LNDGQ

SEQ ID NO: 1640273 - protein, 9 aa, Staphylococcus aureus
LNDSDVDSD

SEQ ID NO: 1640274 - protein, 8 aa, Staphylococcus aureus
LNEAQRNG

SEQ ID NO: 1640275 - protein, 10 aa, Staphylococcus aureus
LNEDTRKFKE

SEQ ID NO: 1640276 - protein, 8 aa, Staphylococcus aureus
LNEEQRNG

SEQ ID NO: 1640277 - protein, 9 aa, Staphylococcus aureus
LNENEGQAI

SEQ ID NO: 1640278 - protein, 17 aa, Staphylococcus aureus
LNENEGQAIQTMGQSAS

SEQ ID NO: 1640279 - protein, 43 aa, Staphylococcus aureus
LNEYQNGLEEQKQYTDDQLSDLSNNPEIKASIEQANQEAQEAL

SEQ ID NO: 1640280 - protein, 4 aa, Staphylococcus aureus
LNFG

SEQ ID NO: 1640281 - protein, 21 aa, Staphylococcus aureus
LNGAKKGTGGYKYGAKDIPPD

SEQ ID NO: 1640282 - protein, 13 aa, Staphylococcus aureus
LNGAKKGVGGYKY

SEQ ID NO: 1640283 - protein, 5 aa, Staphylococcus aureus
LNGAV

SEQ ID NO: 1640284 - protein, 9 aa, Staphylococcus aureus
LNGGVSEQT

SEQ ID NO: 1640285 - protein, 5 aa, Staphylococcus aureus
LNKAN

SEQ ID NO: 1640286 - protein, 6 aa, Staphylococcus aureus
LNKANG

SEQ ID NO: 1640287 - protein, 13 aa, Staphylococcus aureus
LNKEQQKKDNITY

SEQ ID NO: 1640288 - protein, 13 aa, Staphylococcus aureus
LNKESKKQEFENS

SEQ ID NO: 1640289 - protein, 8 aa, Staphylococcus aureus
LNKQAPRI

SEQ ID NO: 1640290 - protein, 17 aa, Staphylococcus aureus
LNKQKKNANSQKSIDNI

SEQ ID NO: 1640291 - protein, 17 aa, Staphylococcus aureus
LNKQKKNTNSQKSIDNI

SEQ ID NO: 1640292 - protein, 14 aa, Staphylococcus aureus
LNKSTGPNTAQNAV

SEQ ID NO: 1640293 - protein, 15 aa, Staphylococcus aureus
LNKYREKSKEKKVKI

SEQ ID NO: 1640294 - protein, 11 aa, Staphylococcus aureus
LNLDSNGKEIN

SEQ ID NO: 1640295 - protein, 17 aa, Staphylococcus aureus
LNNAQRQNLQSQINGAH

SEQ ID NO: 1640296 - protein, 17 aa, Staphylococcus aureus
LNNDSKDKFNDIPKEQR

SEQ ID NO: 1640297 - protein, 12 aa, Staphylococcus aureus
LNNEQKIQSNRL

SEQ ID NO: 1640298 - protein, 15 aa, Staphylococcus aureus
LNNQNQQTKHQLKDV

SEQ ID NO: 1640299 - protein, 9 aa, Staphylococcus aureus
LNNSDENVK

SEQ ID NO: 1640300 - protein, 5 aa, Staphylococcus aureus
LNPFS

SEQ ID NO: 1640301 - protein, 14 aa, Staphylococcus aureus
LNPVDTKQRQMEVT

SEQ ID NO: 1640302 - protein, 10 aa, Staphylococcus aureus
LNPYGDGFAS

SEQ ID NO: 1640303 - protein, 51 aa, Staphylococcus aureus; identical to SEQ ID NO: 1568232

SEQ ID NO: 1640304 - protein, 65 aa, Staphylococcus aureus; identical to SEQ ID NO: 1569166

SEQ ID NO: 1640305 - protein, 51 aa, Staphylococcus aureus; identical to SEQ ID NO: 1567575

SEQ ID NO: 1640306 - protein, 65 aa, Staphylococcus aureus
LNQAKNDLNGNNKVAQAKEAAKRALASYSNLNNAQSTAATSQIDNATTVAGVTAAQNTANELNTA

SEQ ID NO: 1640307 - protein, 4 aa, Staphylococcus aureus
LNQE

SEQ ID NO: 1640308 - protein, 4 aa, Staphylococcus aureus
LNQN

SEQ ID NO: 1640309 - protein, 5 aa, Staphylococcus aureus
LNQNN

SEQ ID NO: 1640310 - protein, 18 aa, Staphylococcus aureus
LNRTGTTTGKKPASITAY

SEQ ID NO: 1640311 - protein, 9 aa, Staphylococcus aureus
LNSEDIRAE

SEQ ID NO: 1640312 - protein, 11 aa, Staphylococcus aureus
LNSETEATSAV

SEQ ID NO: 1640313 - protein, 7 aa, Staphylococcus aureus
LNSKQTV

SEQ ID NO: 1640314 - protein, 6 aa, Staphylococcus aureus
LNSNGT

SEQ ID NO: 1640315 - protein, 21 aa, Staphylococcus aureus
LNSNSTSEEHNKRPVEQNPNQ

SEQ ID NO: 1640316 - protein, 11 aa, Staphylococcus aureus
LNSPNIKTKKR

SEQ ID NO: 1640317 - protein, 4 aa, Staphylococcus aureus
LNTA

SEQ ID NO: 1640318 - protein, 6 aa, Staphylococcus aureus
LNTDRI

SEQ ID NO: 1640319 - protein, 8 aa, Staphylococcus aureus
LNTEISTK

SEQ ID NO: 1640320 - protein, 17 aa, Staphylococcus aureus
LNTEQHRQRLAQINDEI

SEQ ID NO: 1640321 - protein, 15 aa, Staphylococcus aureus
LNTPQKAKLKEQVGQ

SEQ ID NO: 1640322 - protein, 35 aa, Staphylococcus aureus
LNTPQKTALKQQVNAAQRVSGVTDLKNSTTSLNNA

SEQ ID NO: 1640323 - protein, 5 aa, Staphylococcus aureus
LNTSD

SEQ ID NO: 1640324 - protein, 5 aa, Staphylococcus aureus
LNTTS

SEQ ID NO: 1640325 - protein, 10 aa, Staphylococcus aureus
LNVQPTNNTF

SEQ ID NO: 1640326 - protein, 11 aa, Staphylococcus aureus
LNYGNKNLGSY

SEQ ID NO: 1640327 - protein, 8 aa, Staphylococcus aureus
LPANNELE

SEQ ID NO: 1640328 - protein, 4 aa, Staphylococcus aureus
LPDD

SEQ ID NO: 1640329 - protein, 5 aa, Staphylococcus aureus
LPEDH

SEQ ID NO: 1640330 - protein, 10 aa, Staphylococcus aureus
LPEEVRQERG

SEQ ID NO: 1640331 - protein, 5 aa, Staphylococcus aureus
LPEKK

SEQ ID NO: 1640332 - protein, 21 aa, Staphylococcus aureus
LPESNNDGELANSKSISASPI

SEQ ID NO: 1640333 - protein, 6 aa, Staphylococcus aureus
LPETQE

SEQ ID NO: 1640334 - protein, 18 aa, Staphylococcus aureus
LPGTSSFSPVGNFGSNSS

SEQ ID NO: 1640335 - protein, 4 aa, Staphylococcus aureus
LPGY

SEQ ID NO: 1640336 - protein, 5 aa, Staphylococcus aureus
LPHKY

SEQ ID NO: 1640337 - protein, 6 aa, Staphylococcus aureus
LPKAAT

SEQ ID NO: 1640338 - protein, 22 aa, Staphylococcus aureus
LPKEEAEKLKEQLEEVGATVEL

SEQ ID NO: 1640339 - protein, 75 aa, Staphylococcus aureus
LPKNDRSQRPARGKTIQAKTRGKSLDKSKSDDKGHKKKGKQRKGKNERKNDKSGNSKHKPFYKDKSVKKKARRKK

SEQ ID NO: 1640340 - protein, 75 aa, Staphylococcus aureus
LPKNDRSQRPARGKTIQAKTRGKSLDKSKSDDKGRKKKSKHRKGKNQRNNDKSGNSKHKPFYKDKSVKKKARRKK

SEQ ID NO: 1640341 - protein, 75 aa, Staphylococcus aureus
LPKNDRSQRPVRGKTIQAKTRGKSLDKSKSDDKGRKKKGKQRKGKNQRNNDKSGNSKHKPFYKDKSVKKKARRKK

SEQ ID NO: 1640342 - protein, 6 aa, Staphylococcus aureus
LPKNGK

SEQ ID NO: 1640343 - protein, 12 aa, Staphylococcus aureus
LPKNKNIQTQQK

SEQ ID NO: 1640344 - protein, 20 aa, Staphylococcus aureus
LPLTKSEFEEQESKKMSTYK

SEQ ID NO: 1640345 - protein, 11 aa, Staphylococcus aureus
LPMSNDKSEGF

SEQ ID NO: 1640346 - protein, 9 aa, Staphylococcus aureus
LPNAPEEKG

SEQ ID NO: 1640347 - protein, 9 aa, Staphylococcus aureus
LPNASEEKG

SEQ ID NO: 1640348 - protein, 11 aa, Staphylococcus aureus
LPNGQGTRNVE

SEQ ID NO: 1640349 - protein, 5 aa, Staphylococcus aureus
LPNIE

SEQ ID NO: 1640350 - protein, 13 aa, Staphylococcus aureus
LPPVEGGDKPLIS

SEQ ID NO: 1640351 - protein, 19 aa, Staphylococcus aureus
LPQNSQLNTNKTKKKNMAN

SEQ ID NO: 1640352 - protein, 6 aa, Staphylococcus aureus
LPRDFP

SEQ ID NO: 1640353 - protein, 6 aa, Staphylococcus aureus
LPSDLG

SEQ ID NO: 1640354 - protein, 8 aa, Staphylococcus aureus
LPSEEIST

SEQ ID NO: 1640355 - protein, 10 aa, Staphylococcus aureus
LPSGQGTRNL

SEQ ID NO: 1640356 - protein, 12 aa, Staphylococcus aureus
LPTKNTNTSGGG

SEQ ID NO: 1640357 - protein, 20 aa, Staphylococcus aureus
LPVPERTKEHTTSNGETKMP

SEQ ID NO: 1640358 - protein, 9 aa, Staphylococcus aureus
LQAARQKLT

SEQ ID NO: 1640359 - protein, 10 aa, Staphylococcus aureus
LQAEKAENDR

SEQ ID NO: 1640360 - protein, 5 aa, Staphylococcus aureus
LQAEV

SEQ ID NO: 1640361 - protein, 7 aa, Staphylococcus aureus
LQATTEG

SEQ ID NO: 1640362 - protein, 7 aa, Staphylococcus aureus
LQDGVTE

SEQ ID NO: 1640363 - protein, 8 aa, Staphylococcus aureus
LQDKRYSN

SEQ ID NO: 1640364 - protein, 11 aa, Staphylococcus aureus
LQDSAEKGEYV

SEQ ID NO: 1640365 - protein, 10 aa, Staphylococcus aureus
LQEAARTRNP

SEQ ID NO: 1640366 - protein, 26 aa, Staphylococcus aureus
LQEKENELNGNERVAEAKTQAKQTID

SEQ ID NO: 1640367 - protein, 7 aa, Staphylococcus aureus
LQGSKAI

SEQ ID NO: 1640368 - protein, 9 aa, Staphylococcus aureus
LQGTENAEH

SEQ ID NO: 1640369 - protein, 6 aa, Staphylococcus aureus
LQHEDG

SEQ ID NO: 1640370 - protein, 9 aa, Staphylococcus aureus
LQKNNETVS

SEQ ID NO: 1640371 - protein, 8 aa, Staphylococcus aureus
LQKSKGKL

SEQ ID NO: 1640372 - protein, 12 aa, Staphylococcus aureus
LQNDEDEHVSQA

SEQ ID NO: 1640373 - protein, 23 aa, Staphylococcus aureus
LQNEEDNEEDEEDKEDENDVLQN

SEQ ID NO: 1640374 - protein, 21 aa, Staphylococcus aureus
LQNEKGEVIGTTETDENGKYR

SEQ ID NO: 1640375 - protein, 6 aa, Staphylococcus aureus
LQNGEK

SEQ ID NO: 1640376 - protein, 51 aa, Staphylococcus aureus; identical to SEQ ID NO: 1565287

SEQ ID NO: 1640377 - protein, 51 aa, Staphylococcus aureus; identical to SEQ ID NO: 1569177

SEQ ID NO: 1640378 - protein, 8 aa, Staphylococcus aureus
LQNNGSYS

SEQ ID NO: 1640379 - protein, 13 aa, Staphylococcus aureus
LQNRGEDIGNEIS

SEQ ID NO: 1640380 - protein, 5 aa, Staphylococcus aureus
LQNSF

SEQ ID NO: 1640381 - protein, 13 aa, Staphylococcus aureus
LQNSNSESSNDTN

SEQ ID NO: 1640382 - protein, 10 aa, Staphylococcus aureus
LQPNERYENL

SEQ ID NO: 1640383 - protein, 10 aa, Staphylococcus aureus
LQPPKTRESQ

SEQ ID NO: 1640384 - protein, 12 aa, Staphylococcus aureus
LQQALKSSTKVE

SEQ ID NO: 1640385 - protein, 6 aa, Staphylococcus aureus
LQQSNA

SEQ ID NO: 1640386 - protein, 26 aa, Staphylococcus aureus
LQQVEQSKQKQYGTTLQNLAKQNRII

SEQ ID NO: 1640387 - protein, 42 aa, Staphylococcus aureus
LQRGHPDAAGSEKNHNGEGHPASRRERQQDVAQRVGRHAGDN

SEQ ID NO: 1640388 - protein, 8 aa, Staphylococcus aureus
LQSGQYNN

SEQ ID NO: 1640389 - protein, 5 aa, Staphylococcus aureus
LQTHR

SEQ ID NO: 1640390 - protein, 8 aa, Staphylococcus aureus
LQTPTSGN

SEQ ID NO: 1640391 - protein, 33 aa, Staphylococcus aureus
LRDAEQKLKNSNQATTAQLKRASDAVQKQSVKH

SEQ ID NO: 1640392 - protein, 33 aa, Staphylococcus aureus
LRDAEQKLKNSNQATTAQLKRASDAVQRQSAKH

SEQ ID NO: 1640393 - protein, 34 aa, Staphylococcus aureus
LRDAERKLKNSNQATTAQLKRASDAVQKQSAKHK

SEQ ID NO: 1640394 - protein, 7 aa, Staphylococcus aureus
LREEGND

SEQ ID NO: 1640395 - protein, 81 aa, Staphylococcus aureus
LREEWDKKQEKIKQQKLEEYKEEQRQKELEEEQQAQEEQQNEEVKESKSKNEEQQEDKKDEQQKINDSKKAFYEKLKQKQA

SEQ ID NO: 1640396 - protein, 6 aa, Staphylococcus aureus
LREPSR

SEQ ID NO: 1640397 - protein, 9 aa, Staphylococcus aureus
LREQQNKEV

SEQ ID NO: 1640398 - protein, 15 aa, Staphylococcus aureus
LRERNKDLEKKASAW

SEQ ID NO: 1640399 - protein, 16 aa, Staphylococcus aureus
LRERNKDLEKKASTWD

SEQ ID NO: 1640400 - protein, 4 aa, Staphylococcus aureus
LRET

SEQ ID NO: 1640401 - protein, 11 aa, Staphylococcus aureus
LRETLQQPTAH

SEQ ID NO: 1640402 - protein, 30 aa, Staphylococcus aureus
LRGERTINDAAKHNSNEKTGASPYEGIRTC

SEQ ID NO: 1640403 - protein, 5 aa, Staphylococcus aureus
LRGQL

SEQ ID NO: 1640404 - protein, 9 aa, Staphylococcus aureus
LRKAKDRSH

SEQ ID NO: 1640405 - protein, 7 aa, Staphylococcus aureus
LRKITKS

SEQ ID NO: 1640406 - protein, 4 aa, Staphylococcus aureus
LRNK

SEQ ID NO: 1640407 - protein, 6 aa, Staphylococcus aureus
LRNPNY

SEQ ID NO: 1640408 - protein, 9 aa, Staphylococcus aureus
LRSETDERQ

SEQ ID NO: 1640409 - protein, 10 aa, Staphylococcus aureus
LRSGKERQEY

SEQ ID NO: 1640410 - protein, 10 aa, Staphylococcus aureus
LRSHTQGRGT

SEQ ID NO: 1640411 - protein, 7 aa, Staphylococcus aureus
LSAAKVS

SEQ ID NO: 1640412 - protein, 6 aa, Staphylococcus aureus
LSADGR

SEQ ID NO: 1640413 - protein, 43 aa, Staphylococcus aureus
LSAQSPAIDKVATEKRISELEHDKRKAVSAEEYKKADDIQNEI

SEQ ID NO: 1640414 - protein, 9 aa, Staphylococcus aureus
LSASKSSIQ

SEQ ID NO: 1640415 - protein, 7 aa, Staphylococcus aureus
LSDAEKA

SEQ ID NO: 1640416 - protein, 4 aa, Staphylococcus aureus
LSDD

SEQ ID NO: 1640417 - protein, 5 aa, Staphylococcus aureus
LSDDA

SEQ ID NO: 1640418 - protein, 16 aa, Staphylococcus aureus
LSDERSGYMTRGHNNS

SEQ ID NO: 1640419 - protein, 4 aa, Staphylococcus aureus
LSDG

SEQ ID NO: 1640420 - protein, 10 aa, Staphylococcus aureus
LSDGRSKGAT

SEQ ID NO: 1640421 - protein, 4 aa, Staphylococcus aureus
LSDK

SEQ ID NO: 1640422 - protein, 13 aa, Staphylococcus aureus
LSEGHTITNVERR

SEQ ID NO: 1640423 - protein, 9 aa, Staphylococcus aureus
LSEKSGELY

SEQ ID NO: 1640424 - protein, 4 aa, Staphylococcus aureus
LSES

SEQ ID NO: 1640425 - protein, 138 aa, Staphylococcus aureus
LSESESLDESESLPESESLAESESLSESESLSESLSESESLSDSESLSDSESLSESESLSESESLSESESLSESESLSESESLSESESLAESESLSESESLSESESLSESESLSESESLSESESLSESESLSESESLS

SEQ ID NO: 1640426 - protein, 4 aa, Staphylococcus aureus
LSET

SEQ ID NO: 1640427 - protein, 5 aa, Staphylococcus aureus
LSEYA

SEQ ID NO: 1640428 - protein, 8 aa, Staphylococcus aureus
LSGEDGGV

SEQ ID NO: 1640429 - protein, 9 aa, Staphylococcus aureus
LSGGEAQRV

SEQ ID NO: 1640430 - protein, 7 aa, Staphylococcus aureus
LSGVSTT

SEQ ID NO: 1640431 - protein, 4 aa, Staphylococcus aureus
LSIE

SEQ ID NO: 1640432 - protein, 25 aa, Staphylococcus aureus
LSITKKDEKGKISHDDSEYKITKEE

SEQ ID NO: 1640433 - protein, 11 aa, Staphylococcus aureus
LSKETTKDNTL

SEQ ID NO: 1640434 - protein, 6 aa, Staphylococcus aureus
LSKGKY

SEQ ID NO: 1640435 - protein, 25 aa, Staphylococcus aureus
LSKGSLAGVDGRLQTRNYENKDGQR

SEQ ID NO: 1640436 - protein, 25 aa, Staphylococcus aureus
LSKGSLAGVDGRLQTRSYDNKDGKR

SEQ ID NO: 1640437 - protein, 8 aa, Staphylococcus aureus
LSKNPSLR

SEQ ID NO: 1640438 - protein, 5 aa, Staphylococcus aureus
LSKNQ

SEQ ID NO: 1640439 - protein, 5 aa, Staphylococcus aureus
LSKQQ

SEQ ID NO: 1640440 - protein, 8 aa, Staphylococcus aureus
LSKRKGYQ

SEQ ID NO: 1640441 - protein, 17 aa, Staphylococcus aureus
LSKYKDGDISYNPEVPS

SEQ ID NO: 1640442 - protein, 31 aa, Staphylococcus aureus
LSKYKDGDISYNPEVPSYSAKYQVTNDDYNV

SEQ ID NO: 1640443 - protein, 9 aa, Staphylococcus aureus
LSNDDYNVQ

SEQ ID NO: 1640444 - protein, 5 aa, Staphylococcus aureus
LSNEE

SEQ ID NO: 1640445 - protein, 13 aa, Staphylococcus aureus
LSNGEVGRIIMKM

SEQ ID NO: 1640446 - protein, 5 aa, Staphylococcus aureus
LSNGG

SEQ ID NO: 1640447 - protein, 10 aa, Staphylococcus aureus
LSNGLAAADA

SEQ ID NO: 1640448 - protein, 7 aa, Staphylococcus aureus
LSNGTYS

SEQ ID NO: 1640449 - protein, 15 aa, Staphylococcus aureus
LSNRGNNNKIYADED

SEQ ID NO: 1640450 - protein, 5 aa, Staphylococcus aureus
LSPAE

SEQ ID NO: 1640451 - protein, 5 aa, Staphylococcus aureus
LSPDD

SEQ ID NO: 1640452 - protein, 9 aa, Staphylococcus aureus
LSPTDFPKG

SEQ ID NO: 1640453 - protein, 17 aa, Staphylococcus aureus
LSPTRRDKLQKMYNKTL

SEQ ID NO: 1640454 - protein, 11 aa, Staphylococcus aureus
LSQPGEESSNV

SEQ ID NO: 1640455 - protein, 6 aa, Staphylococcus aureus
LSQSGL

SEQ ID NO: 1640456 - protein, 6 aa, Staphylococcus aureus
LSQSTK

SEQ ID NO: 1640457 - protein, 9 aa, Staphylococcus aureus
LSRENSNSI

SEQ ID NO: 1640458 - protein, 5 aa, Staphylococcus aureus
LSRKQ

SEQ ID NO: 1640459 - protein, 8 aa, Staphylococcus aureus
LSRKRGEG

SEQ ID NO: 1640460 - protein, 5 aa, Staphylococcus aureus
LSRQD

SEQ ID NO: 1640461 - protein, 11 aa, Staphylococcus aureus
LSSEAKDFNRP

SEQ ID NO: 1640462 - protein, 14 aa, Staphylococcus aureus
LSSESEKGESIKTA

SEQ ID NO: 1640463 - protein, 13 aa, Staphylococcus aureus
LSSFQNQKTESVY

SEQ ID NO: 1640464 - protein, 9 aa, Staphylococcus aureus
LSSGERYDE

SEQ ID NO: 1640465 - protein, 6 aa, Staphylococcus aureus
LSSGGH

SEQ ID NO: 1640466 - protein, 9 aa, Staphylococcus aureus
LSSKDKKHY

SEQ ID NO: 1640467 - protein, 9 aa, Staphylococcus aureus
LSSKENKKY

SEQ ID NO: 1640468 - protein, 6 aa, Staphylococcus aureus
LSSSSM

SEQ ID NO: 1640469 - protein, 7 aa, Staphylococcus aureus
LSTGDDV

SEQ ID NO: 1640470 - protein, 5 aa, Staphylococcus aureus
LSTGH

SEQ ID NO: 1640471 - protein, 5 aa, Staphylococcus aureus
LSTQE

SEQ ID NO: 1640472 - protein, 13 aa, Staphylococcus aureus
LSTSWGKTVLKWT

SEQ ID NO: 1640473 - protein, 15 aa, Staphylococcus aureus
LSTTGGNSGSPVFNE

SEQ ID NO: 1640474 - protein, 10 aa, Staphylococcus aureus
LSVGDKAKGI

SEQ ID NO: 1640475 - protein, 5 aa, Staphylococcus aureus
LSVTH

SEQ ID NO: 1640476 - protein, 14 aa, Staphylococcus aureus
LSVTTTNSAPIPKS

SEQ ID NO: 1640477 - protein, 4 aa, Staphylococcus aureus
LTAA

SEQ ID NO: 1640478 - protein, 10 aa, Staphylococcus aureus
LTAEGEDTYS

SEQ ID NO: 1640479 - protein, 8 aa, Staphylococcus aureus
LTDARASE

SEQ ID NO: 1640480 - protein, 12 aa, Staphylococcus aureus
LTDEEKEKISYT

SEQ ID NO: 1640481 - protein, 40 aa, Staphylococcus aureus
LTDKLKEKQIVKNGDTVTIHSKDKNDPPISAKVGDDYNDH

SEQ ID NO: 1640482 - protein, 6 aa, Staphylococcus aureus
LTDQAG

SEQ ID NO: 1640483 - protein, 6 aa, Staphylococcus aureus
LTDSGG

SEQ ID NO: 1640484 - protein, 10 aa, Staphylococcus aureus
LTDSKGRSVD

SEQ ID NO: 1640485 - protein, 10 aa, Staphylococcus aureus
LTDTGTKSAD

SEQ ID NO: 1640486 - protein, 8 aa, Staphylococcus aureus
LTEEKGLK

SEQ ID NO: 1640487 - protein, 19 aa, Staphylococcus aureus
LTEERSKRLKKTRKALEDY

SEQ ID NO: 1640488 - protein, 13 aa, Staphylococcus aureus
LTEHRDDSTIADG

SEQ ID NO: 1640489 - protein, 13 aa, Staphylococcus aureus
LTEHREDSTIADG

SEQ ID NO: 1640490 - protein, 18 aa, Staphylococcus aureus
LTEKDGKLYGRGTTDMKG

SEQ ID NO: 1640491 - protein, 8 aa, Staphylococcus aureus
LTEPSAQN

SEQ ID NO: 1640492 - protein, 12 aa, Staphylococcus aureus
LTEQKSKSDELY

SEQ ID NO: 1640493 - protein, 6 aa, Staphylococcus aureus
LTESEK

SEQ ID NO: 1640494 - protein, 9 aa, Staphylococcus aureus
LTETQKQQF

SEQ ID NO: 1640495 - protein, 4 aa, Staphylococcus aureus
LTGG

SEQ ID NO: 1640496 - protein, 5 aa, Staphylococcus aureus
LTGGV

SEQ ID NO: 1640497 - protein, 20 aa, Staphylococcus aureus
LTGKDKALPMNTGAEAVETA

SEQ ID NO: 1640498 - protein, 8 aa, Staphylococcus aureus
LTGKPNTH

SEQ ID NO: 1640499 - protein, 10 aa, Staphylococcus aureus
LTGNTGFSTG

SEQ ID NO: 1640500 - protein, 5 aa, Staphylococcus aureus
LTGPK

SEQ ID NO: 1640501 - protein, 15 aa, Staphylococcus aureus
LTGTIEESNDSKPID

SEQ ID NO: 1640502 - protein, 10 aa, Staphylococcus aureus
LTKAAGADFV

SEQ ID NO: 1640503 - protein, 5 aa, Staphylococcus aureus
LTKDE

SEQ ID NO: 1640504 - protein, 15 aa, Staphylococcus aureus
LTKEEIEQAKAQLAQ

SEQ ID NO: 1640505 - protein, 8 aa, Staphylococcus aureus
LTKKKAEH

SEQ ID NO: 1640506 - protein, 9 aa, Staphylococcus aureus
LTKNGRQYE

SEQ ID NO: 1640507 - protein, 16 aa, Staphylococcus aureus
LTKNNKSKLMKASEAT

SEQ ID NO: 1640508 - protein, 5 aa, Staphylococcus aureus
LTKTG

SEQ ID NO: 1640509 - protein, 8 aa, Staphylococcus aureus
LTKTPEEI

SEQ ID NO: 1640510 - protein, 5 aa, Staphylococcus aureus
LTNDE

SEQ ID NO: 1640511 - protein, 8 aa, Staphylococcus aureus
LTNLNQNQ

SEQ ID NO: 1640512 - protein, 20 aa, Staphylococcus aureus
LTNLSTSALQQIRGKDISRS

SEQ ID NO: 1640513 - protein, 37 aa, Staphylococcus aureus
LTNNQKSAISSQIDRAGHVSEVTAAKNAATELNTQMG

SEQ ID NO: 1640514 - protein, 7 aa, Staphylococcus aureus
LTNPEDR

SEQ ID NO: 1640515 - protein, 5 aa, Staphylococcus aureus
LTNPQ

SEQ ID NO: 1640516 - protein, 32 aa, Staphylococcus aureus; identical to SEQ ID NO: 1566649

SEQ ID NO: 1640517 - protein, 5 aa, Staphylococcus aureus
LTPEG

SEQ ID NO: 1640518 - protein, 5 aa, Staphylococcus aureus
LTPET

SEQ ID NO: 1640519 - protein, 7 aa, Staphylococcus aureus
LTPKELQ

SEQ ID NO: 1640520 - protein, 8 aa, Staphylococcus aureus
LTPNGKTA

SEQ ID NO: 1640521 - protein, 8 aa, Staphylococcus aureus
LTPPRQKN

SEQ ID NO: 1640522 - protein, 8 aa, Staphylococcus aureus
LTPPRQNN

SEQ ID NO: 1640523 - protein, 5 aa, Staphylococcus aureus
LTPPT

SEQ ID NO: 1640524 - protein, 14 aa, Staphylococcus aureus
LTPRKPSKSPRSED

SEQ ID NO: 1640525 - protein, 5 aa, Staphylococcus aureus
LTPSA

SEQ ID NO: 1640526 - protein, 20 aa, Staphylococcus aureus
LTPSVKTNDYDFEEDDTNIT

SEQ ID NO: 1640527 - protein, 20 aa, Staphylococcus aureus
LTPSVKTNNYDFEEDDTNIT

SEQ ID NO: 1640528 - protein, 12 aa, Staphylococcus aureus
LTQDMEKTVLLQ

SEQ ID NO: 1640529 - protein, 11 aa, Staphylococcus aureus
LTQDMEKTYDN

SEQ ID NO: 1640530 - protein, 31 aa, Staphylococcus aureus
LTQDQLGEKLNTKKATISNYETGYRTPKQDD

SEQ ID NO: 1640531 - protein, 16 aa, Staphylococcus aureus
LTQPELYNNPQKANEL

SEQ ID NO: 1640532 - protein, 5 aa, Staphylococcus aureus
LTQPM

SEQ ID NO: 1640533 - protein, 6 aa, Staphylococcus aureus
LTQPMQ

SEQ ID NO: 1640534 - protein, 35 aa, Staphylococcus aureus
LTQQGGNHSAEQSAQAFQQAAQRQQGQQGGNGNYL

SEQ ID NO: 1640535 - protein, 35 aa, Staphylococcus aureus
LTQQGSNQSAEQSAQAFQQAAQRQQGQQGGNGNYL

SEQ ID NO: 1640536 - protein, 4 aa, Staphylococcus aureus
LTRA

SEQ ID NO: 1640537 - protein, 9 aa, Staphylococcus aureus
LTSKSERTQ

SEQ ID NO: 1640538 - protein, 13 aa, Staphylococcus aureus
LTSNKKQKKYQPL

SEQ ID NO: 1640539 - protein, 8 aa, Staphylococcus aureus
LTSQTSDL

SEQ ID NO: 1640540 - protein, 15 aa, Staphylococcus aureus
LTSSIRKAAANIGDK

SEQ ID NO: 1640541 - protein, 8 aa, Staphylococcus aureus
LTSSYEPP

SEQ ID NO: 1640542 - protein, 13 aa, Staphylococcus aureus
LTTEIPAGTKSKP

SEQ ID NO: 1640543 - protein, 5 aa, Staphylococcus aureus
LTTGN

SEQ ID NO: 1640544 - protein, 10 aa, Staphylococcus aureus
LTTHDESTRY

SEQ ID NO: 1640545 - protein, 9 aa, Staphylococcus aureus
LTTPDEQEA

SEQ ID NO: 1640546 - protein, 4 aa, Staphylococcus aureus
LTTS

SEQ ID NO: 1640547 - protein, 6 aa, Staphylococcus aureus
LVNSGG

SEQ ID NO: 1640548 - protein, 6 aa, Staphylococcus aureus
LVPKPA

SEQ ID NO: 1640549 - protein, 12 aa, Staphylococcus aureus
LVRQPGDTITRP

SEQ ID NO: 1640550 - protein, 10 aa, Staphylococcus aureus
LYADKNHSHT

SEQ ID NO: 1640551 - protein, 8 aa, Staphylococcus aureus
LYEQGGDI

SEQ ID NO: 1640552 - protein, 6 aa, Staphylococcus aureus
LYGKQS

SEQ ID NO: 1640553 - protein, 16 aa, Staphylococcus aureus
LYGNQSRTTNNRGSVP

SEQ ID NO: 1640554 - protein, 10 aa, Staphylococcus aureus
LYNASSGAIG

SEQ ID NO: 1640555 - protein, 5 aa, Staphylococcus aureus
LYPSS

SEQ ID NO: 1640556 - protein, 10 aa, Staphylococcus aureus
MADTTRDDTA

SEQ ID NO: 1640557 - protein, 8 aa, Staphylococcus aureus
MAEPGEFT

SEQ ID NO: 1640558 - protein, 4 aa, Staphylococcus aureus
MAGS

SEQ ID NO: 1640559 - protein, 10 aa, Staphylococcus aureus
MAGSTTPKLV

SEQ ID NO: 1640560 - protein, 4 aa, Staphylococcus aureus
MAKK

SEQ ID NO: 1640561 - protein, 9 aa, Staphylococcus aureus
MANRTGHTR

SEQ ID NO: 1640562 - protein, 10 aa, Staphylococcus aureus
MATLKSGDEL

SEQ ID NO: 1640563 - protein, 11 aa, Staphylococcus aureus
MATQNKGEALK

SEQ ID NO: 1640564 - protein, 4 aa, Staphylococcus aureus
MDAG

SEQ ID NO: 1640565 - protein, 8 aa, Staphylococcus aureus
MDDESKYG

SEQ ID NO: 1640566 - protein, 10 aa, Staphylococcus aureus
MDEDKGSGKI

SEQ ID NO: 1640567 - protein, 4 aa, Staphylococcus aureus
MDEI

SEQ ID NO: 1640568 - protein, 4 aa, Staphylococcus aureus
MDKA

SEQ ID NO: 1640569 - protein, 7 aa, Staphylococcus aureus
MDKEDKI

SEQ ID NO: 1640570 - protein, 19 aa, Staphylococcus aureus
MDPFNGGEISPGPEVHTDE

SEQ ID NO: 1640571 - protein, 14 aa, Staphylococcus aureus
MDPTATNNKEFTVT

SEQ ID NO: 1640572 - protein, 8 aa, Staphylococcus aureus
MDSKSNIG

SEQ ID NO: 1640573 - protein, 11 aa, Staphylococcus aureus
MDTKRLAQDPA

SEQ ID NO: 1640574 - protein, 20 aa, Staphylococcus aureus
MEDEQNKVKKISDNSSFKAP

SEQ ID NO: 1640575 - protein, 42 aa, Staphylococcus aureus
MEENSDSKNDNKSTTNQQQINTNKNVKNGDNVKNGENEKKKV

SEQ ID NO: 1640576 - protein, 46 aa, Staphylococcus aureus
MEKPEVDSEYATTDNEEHIQEQSNQDKSYFDSESIGNQSGGIRQRE

SEQ ID NO: 1640577 - protein, 5 aa, Staphylococcus aureus
MENPQ

SEQ ID NO: 1640578 - protein, 14 aa, Staphylococcus aureus
MENTKKQAKQIESE

SEQ ID NO: 1640579 - protein, 14 aa, Staphylococcus aureus
MENTKKQAKQIESK

SEQ ID NO: 1640580 - protein, 8 aa, Staphylococcus aureus
MENTPAAR

SEQ ID NO: 1640581 - protein, 8 aa, Staphylococcus aureus
MERGATNK

SEQ ID NO: 1640582 - protein, 7 aa, Staphylococcus aureus
MESNENK

SEQ ID NO: 1640583 - protein, 10 aa, Staphylococcus aureus
MGGSTETSYF

SEQ ID NO: 1640584 - protein, 7 aa, Staphylococcus aureus
MGNTTDQ

SEQ ID NO: 1640585 - protein, 5 aa, Staphylococcus aureus
MGPIQ

SEQ ID NO: 1640586 - protein, 18 aa, Staphylococcus aureus
MGPTRQAMKDAGLTNSDI

SEQ ID NO: 1640587 - protein, 12 aa, Staphylococcus aureus
MGSQTGKDQLDK

SEQ ID NO: 1640588 - protein, 10 aa, Staphylococcus aureus
MGSTHSNSTM

SEQ ID NO: 1640589 - protein, 11 aa, Staphylococcus aureus
MKARRNKVSEE

SEQ ID NO: 1640590 - protein, 8 aa, Staphylococcus aureus
MKDKNGNY

SEQ ID NO: 1640591 - protein, 6 aa, Staphylococcus aureus
MKEGEI

SEQ ID NO: 1640592 - protein, 8 aa, Staphylococcus aureus
MKEKEQIS

SEQ ID NO: 1640593 - protein, 12 aa, Staphylococcus aureus
MKGIKDAPSLDK

SEQ ID NO: 1640594 - protein, 25 aa, Staphylococcus aureus
MKGKRKLNGHSEKEADRLLKDIFLK

SEQ ID NO: 1640595 - protein, 19 aa, Staphylococcus aureus
MKGKRKLNGHSEKRGRQTF

SEQ ID NO: 1640596 - protein, 31 aa, Staphylococcus aureus
MKGTMPRGKTEAEDQQYHKTLQTSSKERAEN

SEQ ID NO: 1640597 - protein, 5 aa, Staphylococcus aureus
MKTNQ

SEQ ID NO: 1640598 - protein, 5 aa, Staphylococcus aureus
MKTRI

SEQ ID NO: 1640599 - protein, 4 aa, Staphylococcus aureus
MNDE

SEQ ID NO: 1640600 - protein, 7 aa, Staphylococcus aureus
MNDQNSI

SEQ ID NO: 1640601 - protein, 9 aa, Staphylococcus aureus
MNDQNSIRT

SEQ ID NO: 1640602 - protein, 7 aa, Staphylococcus aureus
MNDQNSL

SEQ ID NO: 1640603 - protein, 10 aa, Staphylococcus aureus
MNGLDPKAVR

SEQ ID NO: 1640604 - protein, 4 aa, Staphylococcus aureus
MNGN

SEQ ID NO: 1640605 - protein, 6 aa, Staphylococcus aureus
MNKAAQ

SEQ ID NO: 1640606 - protein, 9 aa, Staphylococcus aureus
MNKPNAAKV

SEQ ID NO: 1640607 - protein, 9 aa, Staphylococcus aureus
MNKPNTAQV

SEQ ID NO: 1640608 - protein, 17 aa, Staphylococcus aureus
MNKSRATDKKLKGGEEN

SEQ ID NO: 1640609 - protein, 11 aa, Staphylococcus aureus
MNNDNESTDYL

SEQ ID NO: 1640610 - protein, 23 aa, Staphylococcus aureus
MNPTYDADNRTAKLVANLVHHFF

SEQ ID NO: 1640611 - protein, 23 aa, Staphylococcus aureus
MNPTYDADNRTAKLVANLVHHFL

SEQ ID NO: 1640612 - protein, 9 aa, Staphylococcus aureus
MNYKKTDYP

SEQ ID NO: 1640613 - protein, 8 aa, Staphylococcus aureus
MPDSPISK

SEQ ID NO: 1640614 - protein, 14 aa, Staphylococcus aureus
MPGSHDSGSFTLTD

SEQ ID NO: 1640615 - protein, 18 aa, Staphylococcus aureus
MPKAGDDPSGYSTGEKNG

SEQ ID NO: 1640616 - protein, 8 aa, Staphylococcus aureus
MPNSKLNK

SEQ ID NO: 1640617 - protein, 5 aa, Staphylococcus aureus
MPNSR

SEQ ID NO: 1640618 - protein, 6 aa, Staphylococcus aureus
MPSEDY

SEQ ID NO: 1640619 - protein, 7 aa, Staphylococcus aureus
MPSGTNV

SEQ ID NO: 1640620 - protein, 14 aa, Staphylococcus aureus
MPSKEGKVSASDVE

SEQ ID NO: 1640621 - protein, 4 aa, Staphylococcus aureus
MPSN

SEQ ID NO: 1640622 - protein, 15 aa, Staphylococcus aureus
MPSNSVKGVTGAGDS

SEQ ID NO: 1640623 - protein, 9 aa, Staphylococcus aureus
MQDNSDHNH

SEQ ID NO: 1640624 - protein, 13 aa, Staphylococcus aureus
MQEETLSQSKIGG

SEQ ID NO: 1640625 - protein, 7 aa, Staphylococcus aureus
MQEISSE

SEQ ID NO: 1640626 - protein, 33 aa, Staphylococcus aureus
MQEISSELQQSEQSKLKQYGTTLQNLAKQNRII

SEQ ID NO: 1640627 - protein, 33 aa, Staphylococcus aureus
MQEISSELQQSEQSKQKQYGTKLQNLAKQNRII

SEQ ID NO: 1640628 - protein, 6 aa, Staphylococcus aureus
MQPGQY

SEQ ID NO: 1640629 - protein, 6 aa, Staphylococcus aureus
MQQDLQ

SEQ ID NO: 1640630 - protein, 6 aa, Staphylococcus aureus
MQSSDI

SEQ ID NO: 1640631 - protein, 6 aa, Staphylococcus aureus
MQYSQG

SEQ ID NO: 1640632 - protein, 8 aa, Staphylococcus aureus
MRESAKKY

SEQ ID NO: 1640633 - protein, 6 aa, Staphylococcus aureus
MRHSDR

SEQ ID NO: 1640634 - protein, 15 aa, Staphylococcus aureus
MRHTSKKLATILKGD

SEQ ID NO: 1640635 - protein, 15 aa, Staphylococcus aureus
MRKQRDACKKQRDEL

SEQ ID NO: 1640636 - protein, 12 aa, Staphylococcus aureus
MRKQRDEYKKQR

SEQ ID NO: 1640637 - protein, 14 aa, Staphylococcus aureus
MRKQRDEYKKQRDE

SEQ ID NO: 1640638 - protein, 25 aa, Staphylococcus aureus
MRKQRDEYKKQRDELIGDIAKLRER

SEQ ID NO: 1640639 - protein, 4 aa, Staphylococcus aureus
MRPG

SEQ ID NO: 1640640 - protein, 10 aa, Staphylococcus aureus
MRSKSKVSSY

SEQ ID NO: 1640641 - protein, 10 aa, Staphylococcus aureus
MRSNDNGDDM

SEQ ID NO: 1640642 - protein, 8 aa, Staphylococcus aureus
MRYRSNND

SEQ ID NO: 1640643 - protein, 20 aa, Staphylococcus aureus
MSADEDGDNRDIEEKRDALK

SEQ ID NO: 1640644 - protein, 4 aa, Staphylococcus aureus
MSGE

SEQ ID NO: 1640645 - protein, 15 aa, Staphylococcus aureus
MSKEELEKLEEEQRR

SEQ ID NO: 1640646 - protein, 5 aa, Staphylococcus aureus
MSKRS

SEQ ID NO: 1640647 - protein, 10 aa, Staphylococcus aureus
MSKSAKIARN

SEQ ID NO: 1640648 - protein, 9 aa, Staphylococcus aureus
MSKSEENNL

SEQ ID NO: 1640649 - protein, 6 aa, Staphylococcus aureus
MSKTEI

SEQ ID NO: 1640650 - protein, 6 aa, Staphylococcus aureus
MSMTTT

SEQ ID NO: 1640651 - protein, 14 aa, Staphylococcus aureus
MSNDETLTDDEQMK

SEQ ID NO: 1640652 - protein, 14 aa, Staphylococcus aureus
MSNGEPLTDDEQMK

SEQ ID NO: 1640653 - protein, 9 aa, Staphylococcus aureus
MSPKKGRAL

SEQ ID NO: 1640654 - protein, 4 aa, Staphylococcus aureus
MSQD

SEQ ID NO: 1640655 - protein, 11 aa, Staphylococcus aureus
MSQNRNEKDYN

SEQ ID NO: 1640656 - protein, 11 aa, Staphylococcus aureus
MSQNRNEQDYN

SEQ ID NO: 1640657 - protein, 6 aa, Staphylococcus aureus
MSQSEL

SEQ ID NO: 1640658 - protein, 27 aa, Staphylococcus aureus
MSQSTSGSTSTSTSTSLSDSTSTSLSL

SEQ ID NO: 1640659 - protein, 8 aa, Staphylococcus aureus
MSRGERRI

SEQ ID NO: 1640660 - protein, 13 aa, Staphylococcus aureus
MTATSENKHESLH

SEQ ID NO: 1640661 - protein, 5 aa, Staphylococcus aureus
MTEHT

SEQ ID NO: 1640662 - protein, 19 aa, Staphylococcus aureus
MTKPETTSNELELSANDEL

SEQ ID NO: 1640663 - protein, 13 aa, Staphylococcus aureus
MTSGNKERLLLKL

SEQ ID NO: 1640664 - protein, 8 aa, Staphylococcus aureus
MTTDEKRK

SEQ ID NO: 1640665 - protein, 12 aa, Staphylococcus aureus
MTTTYKDQARPL

SEQ ID NO: 1640666 - protein, 5 aa, Staphylococcus aureus
MVDSK

SEQ ID NO: 1640667 - protein, 13 aa, Staphylococcus aureus
MYEKRRKNIGEKR

SEQ ID NO: 1640668 - protein, 6 aa, Staphylococcus aureus
MYTPSY

SEQ ID NO: 1640669 - protein, 7 aa, Staphylococcus aureus
NAAPNHA

SEQ ID NO: 1640670 - protein, 18 aa, Staphylococcus aureus
NAATNASAPDDILTATVS

SEQ ID NO: 1640671 - protein, 15 aa, Staphylococcus aureus
NADDYDRLINLVHEM

SEQ ID NO: 1640672 - protein, 86 aa, Staphylococcus aureus
NADESKDKDTSKDASKDKSKSTDSDKSKDDQDKATKDESDNDQNNANQANNQAQNNQNQQQANQNQQQQQQRQGGGQRHTVNGQEN

SEQ ID NO: 1640673 - protein, 16 aa, Staphylococcus aureus
NADPDKQNAYKQAVAK

SEQ ID NO: 1640674 - protein, 9 aa, Staphylococcus aureus
NADQVSSLE

SEQ ID NO: 1640675 - protein, 21 aa, Staphylococcus aureus
NADSKVAKHTKANTDLTTEDL

SEQ ID NO: 1640676 - protein, 14 aa, Staphylococcus aureus
NADTIDKSIQDVIK

SEQ ID NO: 1640677 - protein, 9 aa, Staphylococcus aureus
NADTIDNSI

SEQ ID NO: 1640678 - protein, 17 aa, Staphylococcus aureus
NAEEGDEITEYLNEVIH

SEQ ID NO: 1640679 - protein, 6 aa, Staphylococcus aureus
NAEGEI

SEQ ID NO: 1640680 - protein, 24 aa, Staphylococcus aureus
NAEPHKTEEIKATSVNNAEKLATT

SEQ ID NO: 1640681 - protein, 7 aa, Staphylococcus aureus
NAETDEV

SEQ ID NO: 1640682 - protein, 13 aa, Staphylococcus aureus
NAETLNKASRAIN

SEQ ID NO: 1640683 - protein, 14 aa, Staphylococcus aureus
NAFNDPTKETIQKS

SEQ ID NO: 1640684 - protein, 18 aa, Staphylococcus aureus
NAFNGGSKLGLSTRAKRI

SEQ ID NO: 1640685 - protein, 8 aa, Staphylococcus aureus
NAGEGRVL

SEQ ID NO: 1640686 - protein, 7 aa, Staphylococcus aureus
NAGMNPK

SEQ ID NO: 1640687 - protein, 8 aa, Staphylococcus aureus
NAGVPSAA

SEQ ID NO: 1640688 - protein, 4 aa, Staphylococcus aureus
NAIK

SEQ ID NO: 1640689 - protein, 16 aa, Staphylococcus aureus
NAIQTKEATAEAQQTA

SEQ ID NO: 1640690 - protein, 5 aa, Staphylococcus aureus
NAKEQ

SEQ ID NO: 1640691 - protein, 9 aa, Staphylococcus aureus
NAKETEDGQ

SEQ ID NO: 1640692 - protein, 16 aa, Staphylococcus aureus
NAKHTIAGAKQLHGKQ

SEQ ID NO: 1640693 - protein, 7 aa, Staphylococcus aureus
NAKNLNG

SEQ ID NO: 1640694 - protein, 7 aa, Staphylococcus aureus
NAKQAAI

SEQ ID NO: 1640695 - protein, 8 aa, Staphylococcus aureus
NALSDELK

SEQ ID NO: 1640696 - protein, 7 aa, Staphylococcus aureus
NANNHNL

SEQ ID NO: 1640697 - protein, 15 aa, Staphylococcus aureus
NANPDATQEERQAAI

SEQ ID NO: 1640698 - protein, 31 aa, Staphylococcus aureus
NAPKEVKKDKIKSSIEIPAKDLKNQLSDLSK

SEQ ID NO: 1640699 - protein, 7 aa, Staphylococcus aureus
NAQALPN

SEQ ID NO: 1640700 - protein, 10 aa, Staphylococcus aureus
NAQGETDNEV

SEQ ID NO: 1640701 - protein, 9 aa, Staphylococcus aureus
NAQGVTDKE

SEQ ID NO: 1640702 - protein, 18 aa, Staphylococcus aureus
NAQKANLTSQIERGTTVA

SEQ ID NO: 1640703 - protein, 6 aa, Staphylococcus aureus
NAQNTL

SEQ ID NO: 1640704 - protein, 8 aa, Staphylococcus aureus
NAQTNNPT

SEQ ID NO: 1640705 - protein, 8 aa, Staphylococcus aureus
NAQTNSPT

SEQ ID NO: 1640706 - protein, 9 aa, Staphylococcus aureus
NARANDLAQ

SEQ ID NO: 1640707 - protein, 9 aa, Staphylococcus aureus
NARQSPLIG

SEQ ID NO: 1640708 - protein, 10 aa, Staphylococcus aureus
NARSQSEALD

SEQ ID NO: 1640709 - protein, 17 aa, Staphylococcus aureus
NARSQSEALDELDKLGF

SEQ ID NO: 1640710 - protein, 5 aa, Staphylococcus aureus
NASAI

SEQ ID NO: 1640711 - protein, 16 aa, Staphylococcus aureus
NASDNHDANVERIWER

SEQ ID NO: 1640712 - protein, 16 aa, Staphylococcus aureus
NASDNHDVNVERLWER

SEQ ID NO: 1640713 - protein, 7 aa, Staphylococcus aureus
NASKVEA

SEQ ID NO: 1640714 - protein, 46 aa, Staphylococcus aureus
NASNNPEMNPNTINQKASQVNSAKSALNGDEKLAEAKQNAKSDIGH

SEQ ID NO: 1640715 - protein, 16 aa, Staphylococcus aureus
NASNQQSASDLSDEEL

SEQ ID NO: 1640716 - protein, 10 aa, Staphylococcus aureus
NASTKEGYIT

SEQ ID NO: 1640717 - protein, 18 aa, Staphylococcus aureus
NATDELKDISNDLEKNSR

SEQ ID NO: 1640718 - protein, 6 aa, Staphylococcus aureus
NATIEY

SEQ ID NO: 1640719 - protein, 5 aa, Staphylococcus aureus
NATNP

SEQ ID NO: 1640720 - protein, 27 aa, Staphylococcus aureus
NATPDATDDEKNAAINTLNQDRQQAIE

SEQ ID NO: 1640721 - protein, 22 aa, Staphylococcus aureus
NATQAVDENNSELNQGGTSTKA

SEQ ID NO: 1640722 - protein, 8 aa, Staphylococcus aureus
NATQTHLN

SEQ ID NO: 1640723 - protein, 10 aa, Staphylococcus aureus
NATSEQYDKN

SEQ ID NO: 1640724 - protein, 44 aa, Staphylococcus aureus
NATSQPTLDPSAVTQAANQVKTNKTALNGAQNLANKKQETTANI

SEQ ID NO: 1640725 - protein, 30 aa, Staphylococcus aureus
NATSQPTLDPSAVTQAANQVNTNKTALNGV

SEQ ID NO: 1640726 - protein, 16 aa, Staphylococcus aureus
NATTGATREEKQEAIN

SEQ ID NO: 1640727 - protein, 5 aa, Staphylococcus aureus
NCGRK

SEQ ID NO: 1640728 - protein, 13 aa, Staphylococcus aureus
NCNESHSKSRLWR

SEQ ID NO: 1640729 - protein, 5 aa, Staphylococcus aureus
NCSGL

SEQ ID NO: 1640730 - protein, 9 aa, Staphylococcus aureus
NCSKGTRQK

SEQ ID NO: 1640731 - protein, 41 aa, Staphylococcus aureus; identical to SEQ ID NO: 1562359

SEQ ID NO: 1640732 - protein, 10 aa, Staphylococcus aureus
NDADATNSDL

SEQ ID NO: 1640733 - protein, 4 aa, Staphylococcus aureus
NDAE

SEQ ID NO: 1640734 - protein, 6 aa, Staphylococcus aureus
NDAFGD

SEQ ID NO: 1640735 - protein, 18 aa, Staphylococcus aureus
NDAIKKSASEINNGTKIK

SEQ ID NO: 1640736 - protein, 8 aa, Staphylococcus aureus
NDAITDAR

SEQ ID NO: 1640737 - protein, 5 aa, Staphylococcus aureus
NDALK

SEQ ID NO: 1640738 - protein, 12 aa, Staphylococcus aureus
NDAQKQSFESQI

SEQ ID NO: 1640739 - protein, 13 aa, Staphylococcus aureus
NDATLEEQQAAQQ

SEQ ID NO: 1640740 - protein, 20 aa, Staphylococcus aureus
NDCTTKNNNIGETEDVLNRT

SEQ ID NO: 1640741 - protein, 5 aa, Staphylococcus aureus
NDDAL

SEQ ID NO: 1640742 - protein, 6 aa, Staphylococcus aureus
NDDEDK

SEQ ID NO: 1640743 - protein, 9 aa, Staphylococcus aureus
NDDEFKTSS

SEQ ID NO: 1640744 - protein, 8 aa, Staphylococcus aureus
NDDEQNVE

SEQ ID NO: 1640745 - protein, 72 aa, Staphylococcus aureus
NDDHPNNPDNPDNPNNPDNPNNPDNPNNPDNPDNPNNPDNPNNPDNPNNPDQPNNPNNPDNGDNNNSDNPDA

SEQ ID NO: 1640746 - protein, 25 aa, Staphylococcus aureus
NDDIGQTQTSEHSKSLKEIEAESSA

SEQ ID NO: 1640747 - protein, 57 aa, Staphylococcus aureus
NDDQPNNPDNPDNPNNPDNPNNPDNPNNPDEPNNPDNPNNPDNPDNGDNNNSDNPDA

SEQ ID NO: 1640748 - protein, 21 aa, Staphylococcus aureus
NDDSIVPSLKSTSSQNSDGTI

SEQ ID NO: 1640749 - protein, 18 aa, Staphylococcus aureus
NDEDDRQVNMQDVKKVNK

SEQ ID NO: 1640750 - protein, 7 aa, Staphylococcus aureus
NDEDSGF

SEQ ID NO: 1640751 - protein, 4 aa, Staphylococcus aureus
NDEE

SEQ ID NO: 1640752 - protein, 14 aa, Staphylococcus aureus
NDEEIKGDELQEEL

SEQ ID NO: 1640753 - protein, 7 aa, Staphylococcus aureus
NDEEWNN

SEQ ID NO: 1640754 - protein, 6 aa, Staphylococcus aureus
NDEIDQ

SEQ ID NO: 1640755 - protein, 25 aa, Staphylococcus aureus
NDEIEYETTVKGENFKGTEVSRKSV

SEQ ID NO: 1640756 - protein, 8 aa, Staphylococcus aureus
NDELTENL

SEQ ID NO: 1640757 - protein, 4 aa, Staphylococcus aureus
NDEN

SEQ ID NO: 1640758 - protein, 6 aa, Staphylococcus aureus
NDENPH

SEQ ID NO: 1640759 - protein, 7 aa, Staphylococcus aureus
NDEQGRI

SEQ ID NO: 1640760 - protein, 11 aa, Staphylococcus aureus
NDERATPQQVN

SEQ ID NO: 1640761 - protein, 7 aa, Staphylococcus aureus
NDESPTV

SEQ ID NO: 1640762 - protein, 9 aa, Staphylococcus aureus
NDETPGNAI

SEQ ID NO: 1640763 - protein, 5 aa, Staphylococcus aureus
NDEVS

SEQ ID NO: 1640764 - protein, 7 aa, Staphylococcus aureus
NDEVSVS

SEQ ID NO: 1640765 - protein, 4 aa, Staphylococcus aureus
NDFG

SEQ ID NO: 1640766 - protein, 13 aa, Staphylococcus aureus
NDFQCPPKEANFA

SEQ ID NO: 1640767 - protein, 15 aa, Staphylococcus aureus
NDGASQSYVRSKKES

SEQ ID NO: 1640768 - protein, 5 aa, Staphylococcus aureus
NDGHL

SEQ ID NO: 1640769 - protein, 13 aa, Staphylococcus aureus
NDHEDERESRFAN

SEQ ID NO: 1640770 - protein, 14 aa, Staphylococcus aureus
NDIDTHATSNEEDF

SEQ ID NO: 1640771 - protein, 6 aa, Staphylococcus aureus
NDITNQ

SEQ ID NO: 1640772 - protein, 6 aa, Staphylococcus aureus
NDIYGN

SEQ ID NO: 1640773 - protein, 14 aa, Staphylococcus aureus
NDKAAIDNDTTNKI

SEQ ID NO: 1640774 - protein, 14 aa, Staphylococcus aureus
NDKAATDNDTTNKI

SEQ ID NO: 1640775 - protein, 15 aa, Staphylococcus aureus
NDKAKTADGKPLALG

SEQ ID NO: 1640776 - protein, 5 aa, Staphylococcus aureus
NDKDF

SEQ ID NO: 1640777 - protein, 25 aa, Staphylococcus aureus
NDKEFKEGMEQARKEVNYAANTDTV

SEQ ID NO: 1640778 - protein, 24 aa, Staphylococcus aureus
NDKEFKEGMERARKEVNYAADTDA

SEQ ID NO: 1640779 - protein, 9 aa, Staphylococcus aureus
NDKENPIKN

SEQ ID NO: 1640780 - protein, 5 aa, Staphylococcus aureus
NDKGL

SEQ ID NO: 1640781 - protein, 7 aa, Staphylococcus aureus
NDKKEDF

SEQ ID NO: 1640782 - protein, 16 aa, Staphylococcus aureus
NDKKHKADYEKQGNKY

SEQ ID NO: 1640783 - protein, 5 aa, Staphylococcus aureus
NDKND

SEQ ID NO: 1640784 - protein, 11 aa, Staphylococcus aureus
NDKNKSPSLLE

SEQ ID NO: 1640785 - protein, 33 aa, Staphylococcus aureus
NDKNKSTSLLEQNNSYIKSYEQKLKDADTLKSS

SEQ ID NO: 1640786 - protein, 6 aa, Staphylococcus aureus
NDKNNE

SEQ ID NO: 1640787 - protein, 8 aa, Staphylococcus aureus
NDKRSNYV

SEQ ID NO: 1640788 - protein, 9 aa, Staphylococcus aureus
NDKSINDSI

SEQ ID NO: 1640789 - protein, 8 aa, Staphylococcus aureus
NDKVRLGK

SEQ ID NO: 1640790 - protein, 17 aa, Staphylococcus aureus
NDLHPQSKKQVKDTIEK

SEQ ID NO: 1640791 - protein, 14 aa, Staphylococcus aureus
NDLPHEHNNKLFLK

SEQ ID NO: 1640792 - protein, 4 aa, Staphylococcus aureus
NDLS

SEQ ID NO: 1640793 - protein, 11 aa, Staphylococcus aureus
NDLTHSKSNKY

SEQ ID NO: 1640794 - protein, 12 aa, Staphylococcus aureus
NDLTPSDTAQLN

SEQ ID NO: 1640795 - protein, 10 aa, Staphylococcus aureus
NDMNSHKTQK

SEQ ID NO: 1640796 - protein, 11 aa, Staphylococcus aureus
NDMYEKESAKI

SEQ ID NO: 1640797 - protein, 4 aa, Staphylococcus aureus
NDNE

SEQ ID NO: 1640798 - protein, 9 aa, Staphylococcus aureus
NDNEWNNGH

SEQ ID NO: 1640799 - protein, 12 aa, Staphylococcus aureus
NDNIGPYLPPYK

SEQ ID NO: 1640800 - protein, 12 aa, Staphylococcus aureus
NDNIRDNKNLER

SEQ ID NO: 1640801 - protein, 7 aa, Staphylococcus aureus
NDNKRNE

SEQ ID NO: 1640802 - protein, 8 aa, Staphylococcus aureus
NDNKTATV

SEQ ID NO: 1640803 - protein, 7 aa, Staphylococcus aureus
NDNSENE

SEQ ID NO: 1640804 - protein, 8 aa, Staphylococcus aureus
NDNSSNRK

SEQ ID NO: 1640805 - protein, 5 aa, Staphylococcus aureus
NDNTI

SEQ ID NO: 1640806 - protein, 7 aa, Staphylococcus aureus
NDPEYVK

SEQ ID NO: 1640807 - protein, 7 aa, Staphylococcus aureus
NDPWEAY

SEQ ID NO: 1640808 - protein, 12 aa, Staphylococcus aureus
NDQKNKVNNDRV

SEQ ID NO: 1640809 - protein, 14 aa, Staphylococcus aureus
NDQPQTLQSFLQEI

SEQ ID NO: 1640810 - protein, 9 aa, Staphylococcus aureus
NDQPSRTTI

SEQ ID NO: 1640811 - protein, 5 aa, Staphylococcus aureus
NDSES

SEQ ID NO: 1640812 - protein, 8 aa, Staphylococcus aureus
NDSFETKE

SEQ ID NO: 1640813 - protein, 8 aa, Staphylococcus aureus
NDSLLEKN

SEQ ID NO: 1640814 - protein, 5 aa, Staphylococcus aureus
NDSNI

SEQ ID NO: 1640815 - protein, 12 aa, Staphylococcus aureus
NDSTISKNDLTQ

SEQ ID NO: 1640816 - protein, 7 aa, Staphylococcus aureus
NDTAEVA

SEQ ID NO: 1640817 - protein, 11 aa, Staphylococcus aureus
NDTDNLTTSKA

SEQ ID NO: 1640818 - protein, 10 aa, Staphylococcus aureus
NDTENNDMNN

SEQ ID NO: 1640819 - protein, 7 aa, Staphylococcus aureus
NDTLKGK

SEQ ID NO: 1640820 - protein, 18 aa, Staphylococcus aureus
NDTNKGRNYGTKSKFFFW

SEQ ID NO: 1640821 - protein, 8 aa, Staphylococcus aureus
NDVEDKNS

SEQ ID NO: 1640822 - protein, 24 aa, Staphylococcus aureus
NDVSETVNTDNKDTVKQKEAKFEN

SEQ ID NO: 1640823 - protein, 11 aa, Staphylococcus aureus
NDVTTKYHNGQ

SEQ ID NO: 1640824 - protein, 30 aa, Staphylococcus aureus
NDYKDGDISYNPNVPSYSAKYQLNNDDYNV

SEQ ID NO: 1640825 - protein, 14 aa, Staphylococcus aureus
NDYQTQSDNQLANI

SEQ ID NO: 1640826 - protein, 14 aa, Staphylococcus aureus
NDYSEEIKEEVNNQ

SEQ ID NO: 1640827 - protein, 13 aa, Staphylococcus aureus
NDYSEEIKETGID

SEQ ID NO: 1640828 - protein, 12 aa, Staphylococcus aureus
NEASNDTNQAEH

SEQ ID NO: 1640829 - protein, 6 aa, Staphylococcus aureus
NEAYKS

SEQ ID NO: 1640830 - protein, 8 aa, Staphylococcus aureus
NEDKVPYY

SEQ ID NO: 1640831 - protein, 5 aa, Staphylococcus aureus
NEDVP

SEQ ID NO: 1640832 - protein, 5 aa, Staphylococcus aureus
NEDYE

SEQ ID NO: 1640833 - protein, 6 aa, Staphylococcus aureus
NEEEKE

SEQ ID NO: 1640834 - protein, 8 aa, Staphylococcus aureus
NEEIQVND

SEQ ID NO: 1640835 - protein, 8 aa, Staphylococcus aureus
NEEIQVNN

SEQ ID NO: 1640836 - protein, 5 aa, Staphylococcus aureus
NEEIY

SEQ ID NO: 1640837 - protein, 6 aa, Staphylococcus aureus
NEEKIK

SEQ ID NO: 1640838 - protein, 17 aa, Staphylococcus aureus
NEELEDSPEFVNESPYE

SEQ ID NO: 1640839 - protein, 5 aa, Staphylococcus aureus
NEENE

SEQ ID NO: 1640840 - protein, 5 aa, Staphylococcus aureus
NEEQD

SEQ ID NO: 1640841 - protein, 11 aa, Staphylococcus aureus
NEESDDPEDIE

SEQ ID NO: 1640842 - protein, 6 aa, Staphylococcus aureus
NEEVAK

SEQ ID NO: 1640843 - protein, 6 aa, Staphylococcus aureus
NEEVKA

SEQ ID NO: 1640844 - protein, 15 aa, Staphylococcus aureus
NEEYNKLTEDKKEPL

SEQ ID NO: 1640845 - protein, 13 aa, Staphylococcus aureus
NEEYQTKQNADVN

SEQ ID NO: 1640846 - protein, 13 aa, Staphylococcus aureus
NEFPTKHNTKLKS

SEQ ID NO: 1640847 - protein, 4 aa, Staphylococcus aureus
NEFS

SEQ ID NO: 1640848 - protein, 6 aa, Staphylococcus aureus
NEGIRE

SEQ ID NO: 1640849 - protein, 6 aa, Staphylococcus aureus
NEGQIE

SEQ ID NO: 1640850 - protein, 11 aa, Staphylococcus aureus
NEGQIHKHGKR

SEQ ID NO: 1640851 - protein, 10 aa, Staphylococcus aureus
NEGQVNESSM

SEQ ID NO: 1640852 - protein, 7 aa, Staphylococcus aureus
NEHANVE

SEQ ID NO: 1640853 - protein, 9 aa, Staphylococcus aureus
NEHANVEQT

SEQ ID NO: 1640854 - protein, 7 aa, Staphylococcus aureus
NEIDGSL

SEQ ID NO: 1640855 - protein, 7 aa, Staphylococcus aureus
NEIEPNL

SEQ ID NO: 1640856 - protein, 7 aa, Staphylococcus aureus
NEIETSR

SEQ ID NO: 1640857 - protein, 25 aa, Staphylococcus aureus
NEIGEGIHDATDAIKKEAEKDAKIA

SEQ ID NO: 1640858 - protein, 25 aa, Staphylococcus aureus
NEIGESIHDATDAIKKEAEKDAKIA

SEQ ID NO: 1640859 - protein, 7 aa, Staphylococcus aureus
NEIGIST

SEQ ID NO: 1640860 - protein, 8 aa, Staphylococcus aureus
NEINGKSE

SEQ ID NO: 1640861 - protein, 17 aa, Staphylococcus aureus
NEIPKAKIDANKDVDKQ

SEQ ID NO: 1640862 - protein, 21 aa, Staphylococcus aureus
NEIPKAKIDANKDVDKQVQAL

SEQ ID NO: 1640863 - protein, 4 aa, Staphylococcus aureus
NEIS

SEQ ID NO: 1640864 - protein, 32 aa, Staphylococcus aureus
NEITFTKDGKKHTGKYEYNGKKTLKYPKGNRG

SEQ ID NO: 1640865 - protein, 4 aa, Staphylococcus aureus
NEKA

SEQ ID NO: 1640866 - protein, 6 aa, Staphylococcus aureus
NEKGEF

SEQ ID NO: 1640867 - protein, 20 aa, Staphylococcus aureus
NEKGREKTKIYTQHRKYFKK

SEQ ID NO: 1640868 - protein, 14 aa, Staphylococcus aureus
NEKIESKETASYYA

SEQ ID NO: 1640869 - protein, 8 aa, Staphylococcus aureus
NEKKWTDE

SEQ ID NO: 1640870 - protein, 17 aa, Staphylococcus aureus
NEKKYQYTGFTKEAINK

SEQ ID NO: 1640871 - protein, 7 aa, Staphylococcus aureus
NEKSFEP

SEQ ID NO: 1640872 - protein, 6 aa, Staphylococcus aureus
NELEGN

SEQ ID NO: 1640873 - protein, 14 aa, Staphylococcus aureus
NELGADKLSTIEED

SEQ ID NO: 1640874 - protein, 9 aa, Staphylococcus aureus
NELKKQYST

SEQ ID NO: 1640875 - protein, 9 aa, Staphylococcus aureus
NELSPFDEY

SEQ ID NO: 1640876 - protein, 8 aa, Staphylococcus aureus
NEMSDPQI

SEQ ID NO: 1640877 - protein, 10 aa, Staphylococcus aureus
NENALSNQRD

SEQ ID NO: 1640878 - protein, 6 aa, Staphylococcus aureus
NENDDY

SEQ ID NO: 1640879 - protein, 13 aa, Staphylococcus aureus
NENEGQAIQTMDQ

SEQ ID NO: 1640880 - protein, 7 aa, Staphylococcus aureus
NENGKYD

SEQ ID NO: 1640881 - protein, 7 aa, Staphylococcus aureus
NENINTD

SEQ ID NO: 1640882 - protein, 7 aa, Staphylococcus aureus
NENKEDD

SEQ ID NO: 1640883 - protein, 18 aa, Staphylococcus aureus
NENKEDDFTAYASPEHNY

SEQ ID NO: 1640884 - protein, 15 aa, Staphylococcus aureus
NENNQYNNVSYQSSD

SEQ ID NO: 1640885 - protein, 6 aa, Staphylococcus aureus
NENPQN

SEQ ID NO: 1640886 - protein, 8 aa, Staphylococcus aureus
NENQPMQG

SEQ ID NO: 1640887 - protein, 21 aa, Staphylococcus aureus
NENRPANIPALTSDKENNRSM

SEQ ID NO: 1640888 - protein, 7 aa, Staphylococcus aureus
NENTAKV

SEQ ID NO: 1640889 - protein, 12 aa, Staphylococcus aureus
NENTIKADELDD

SEQ ID NO: 1640890 - protein, 8 aa, Staphylococcus aureus
NEPAANGA

SEQ ID NO: 1640891 - protein, 5 aa, Staphylococcus aureus
NEPCV

SEQ ID NO: 1640892 - protein, 8 aa, Staphylococcus aureus
NEPMTAQK

SEQ ID NO: 1640893 - protein, 7 aa, Staphylococcus aureus
NEQETID

SEQ ID NO: 1640894 - protein, 10 aa, Staphylococcus aureus
NEQKTGIKTD

SEQ ID NO: 1640895 - protein, 13 aa, Staphylococcus aureus
NEQKTSIKPDIVG

SEQ ID NO: 1640896 - protein, 14 aa, Staphylococcus aureus
NEQLDEQNKVTSID

SEQ ID NO: 1640897 - protein, 5 aa, Staphylococcus aureus
NEQNS

SEQ ID NO: 1640898 - protein, 7 aa, Staphylococcus aureus
NEQPVAT

SEQ ID NO: 1640899 - protein, 14 aa, Staphylococcus aureus
NEQQAVEKLYDAFN

SEQ ID NO: 1640900 - protein, 8 aa, Staphylococcus aureus
NEQSRQKL

SEQ ID NO: 1640901 - protein, 8 aa, Staphylococcus aureus
NEQTATLD

SEQ ID NO: 1640902 - protein, 11 aa, Staphylococcus aureus
NEQVSKNEQSY

SEQ ID NO: 1640903 - protein, 10 aa, Staphylococcus aureus
NESAANGAGA

SEQ ID NO: 1640904 - protein, 5 aa, Staphylococcus aureus
NESEI

SEQ ID NO: 1640905 - protein, 11 aa, Staphylococcus aureus
NESIDENQAAD

SEQ ID NO: 1640906 - protein, 11 aa, Staphylococcus aureus
NESIDESQAAE

SEQ ID NO: 1640907 - protein, 7 aa, Staphylococcus aureus
NESKGQN

SEQ ID NO: 1640908 - protein, 8 aa, Staphylococcus aureus
NESKKEIK

SEQ ID NO: 1640909 - protein, 5 aa, Staphylococcus aureus
NESRI

SEQ ID NO: 1640910 - protein, 8 aa, Staphylococcus aureus
NESRVLTG

SEQ ID NO: 1640911 - protein, 10 aa, Staphylococcus aureus
NESRVLTGGY

SEQ ID NO: 1640912 - protein, 10 aa, Staphylococcus aureus
NESSTSSHKV

SEQ ID NO: 1640913 - protein, 17 aa, Staphylococcus aureus
NESVDTGEITANTTRTV

SEQ ID NO: 1640914 - protein, 9 aa, Staphylococcus aureus
NESVEGYSN

SEQ ID NO: 1640915 - protein, 12 aa, Staphylococcus aureus
NETAQDVQRERG

SEQ ID NO: 1640916 - protein, 15 aa, Staphylococcus aureus
NETNQYNNVSYQSSD

SEQ ID NO: 1640917 - protein, 14 aa, Staphylococcus aureus
NETQDNIKQPAHYT

SEQ ID NO: 1640918 - protein, 16 aa, Staphylococcus aureus
NETSLGRALKDNDVDR

SEQ ID NO: 1640919 - protein, 6 aa, Staphylococcus aureus
NETVET

SEQ ID NO: 1640920 - protein, 15 aa, Staphylococcus aureus
NETYANSSKAGLKQS

SEQ ID NO: 1640921 - protein, 4 aa, Staphylococcus aureus
NEVE

SEQ ID NO: 1640922 - protein, 23 aa, Staphylococcus aureus
NEVGRKPDLPFGGYKQSGLGREW

SEQ ID NO: 1640923 - protein, 16 aa, Staphylococcus aureus
NEVTQAQNNADALNTA

SEQ ID NO: 1640924 - protein, 4 aa, Staphylococcus aureus
NEYI

SEQ ID NO: 1640925 - protein, 6 aa, Staphylococcus aureus
NEYQGY

SEQ ID NO: 1640926 - protein, 18 aa, Staphylococcus aureus
NFDDKKELAETLSGATHS

SEQ ID NO: 1640927 - protein, 19 aa, Staphylococcus aureus
NFDDKKELAETLSKATRSE

SEQ ID NO: 1640928 - protein, 11 aa, Staphylococcus aureus
NFDDSGAFKKS

SEQ ID NO: 1640929 - protein, 11 aa, Staphylococcus aureus
NFEEGTSVKSL

SEQ ID NO: 1640930 - protein, 12 aa, Staphylococcus aureus
NFESKESKNGHP

SEQ ID NO: 1640931 - protein, 5 aa, Staphylococcus aureus
NFGRA

SEQ ID NO: 1640932 - protein, 5 aa, Staphylococcus aureus
NFGTP

SEQ ID NO: 1640933 - protein, 5 aa, Staphylococcus aureus
NFGVP

SEQ ID NO: 1640934 - protein, 11 aa, Staphylococcus aureus
NFKATQPRNWR

SEQ ID NO: 1640935 - protein, 6 aa, Staphylococcus aureus
NFKKEA

SEQ ID NO: 1640936 - protein, 13 aa, Staphylococcus aureus
NFKPGDKLPNVTQ

SEQ ID NO: 1640937 - protein, 12 aa, Staphylococcus aureus
NFKPGDKLPSVT

SEQ ID NO: 1640938 - protein, 4 aa, Staphylococcus aureus
NFNP

SEQ ID NO: 1640939 - protein, 6 aa, Staphylococcus aureus
NFNPDD

SEQ ID NO: 1640940 - protein, 11 aa, Staphylococcus aureus
NFPADAETVGG

SEQ ID NO: 1640941 - protein, 7 aa, Staphylococcus aureus
NFPTTKE

SEQ ID NO: 1640942 - protein, 9 aa, Staphylococcus aureus
NFSNHNSAD

SEQ ID NO: 1640943 - protein, 13 aa, Staphylococcus aureus
NFTKESKDASMED

SEQ ID NO: 1640944 - protein, 6 aa, Staphylococcus aureus
NFVPTA

SEQ ID NO: 1640945 - protein, 10 aa, Staphylococcus aureus
NFYPQTKSDI

SEQ ID NO: 1640946 - protein, 10 aa, Staphylococcus aureus
NGADSNKETR

SEQ ID NO: 1640947 - protein, 6 aa, Staphylococcus aureus
NGASSV

SEQ ID NO: 1640948 - protein, 28 aa, Staphylococcus aureus
NGDGINEVKDARIDNTGYGHKTLTRSFV

SEQ ID NO: 1640949 - protein, 22 aa, Staphylococcus aureus
NGDGINEVKDARVDNAGYDHKT

SEQ ID NO: 1640950 - protein, 23 aa, Staphylococcus aureus
NGDGINEVTDARVDNTGYGHKTL

SEQ ID NO: 1640951 - protein, 5 aa, Staphylococcus aureus
NGDLV

SEQ ID NO: 1640952 - protein, 10 aa, Staphylococcus aureus
NGDPNNALSE

SEQ ID NO: 1640953 - protein, 7 aa, Staphylococcus aureus
NGDSSFE

SEQ ID NO: 1640954 - protein, 13 aa, Staphylococcus aureus
NGDSVRFSNSEDI

SEQ ID NO: 1640955 - protein, 22 aa, Staphylococcus aureus
NGEDEETSETEPEEMGKTEKQS

SEQ ID NO: 1640956 - protein, 9 aa, Staphylococcus aureus
NGEGIDSGC

SEQ ID NO: 1640957 - protein, 25 aa, Staphylococcus aureus
NGEKVKTLDVTSETNWKYEFKRLTE

SEQ ID NO: 1640958 - protein, 8 aa, Staphylococcus aureus
NGENPALN

SEQ ID NO: 1640959 - protein, 8 aa, Staphylococcus aureus
NGEQESNT

SEQ ID NO: 1640960 - protein, 13 aa, Staphylococcus aureus
NGESATQDTEQHF

SEQ ID NO: 1640961 - protein, 10 aa, Staphylococcus aureus
NGESTTQDIE

SEQ ID NO: 1640962 - protein, 6 aa, Staphylococcus aureus
NGFDDP

SEQ ID NO: 1640963 - protein, 23 aa, Staphylococcus aureus
NGGAPTASNEEVAETPAAPAAVS

SEQ ID NO: 1640964 - protein, 31 aa, Staphylococcus aureus
NGGAPTASNESAASASNEEVAETPAAPAAVS

SEQ ID NO: 1640965 - protein, 39 aa, Staphylococcus aureus; identical to SEQ ID NO: 1571545

SEQ ID NO: 1640966 - protein, 39 aa, Staphylococcus aureus
NGGTTAQSDKQVQTQSTSVDTSSNQSSEDNSENSTIPVN

SEQ ID NO: 1640967 - protein, 7 aa, Staphylococcus aureus
NGHDGYK

SEQ ID NO: 1640968 - protein, 9 aa, Staphylococcus aureus
NGIAGSYAE

SEQ ID NO: 1640969 - protein, 7 aa, Staphylococcus aureus
NGIKQGD

SEQ ID NO: 1640970 - protein, 10 aa, Staphylococcus aureus
NGKDQSSRRD

SEQ ID NO: 1640971 - protein, 7 aa, Staphylococcus aureus
NGKGHSM

SEQ ID NO: 1640972 - protein, 26 aa, Staphylococcus aureus
NGKIDAETFREQTQSLHQQSKPISSI

SEQ ID NO: 1640973 - protein, 7 aa, Staphylococcus aureus
NGKKSFA

SEQ ID NO: 1640974 - protein, 8 aa, Staphylococcus aureus
NGKKVKDV

SEQ ID NO: 1640975 - protein, 6 aa, Staphylococcus aureus
NGKMSR

SEQ ID NO: 1640976 - protein, 18 aa, Staphylococcus aureus
NGKNPKQALDEATNDITQ

SEQ ID NO: 1640977 - protein, 9 aa, Staphylococcus aureus
NGKSKSDIV

SEQ ID NO: 1640978 - protein, 7 aa, Staphylococcus aureus
NGKTRGI

SEQ ID NO: 1640979 - protein, 8 aa, Staphylococcus aureus
NGKTRGIQ

SEQ ID NO: 1640980 - protein, 5 aa, Staphylococcus aureus
NGKYN

SEQ ID NO: 1640981 - protein, 23 aa, Staphylococcus aureus
NGLERKNYNYSNNYSSSYSHEEW

SEQ ID NO: 1640982 - protein, 6 aa, Staphylococcus aureus
NGLKGQ

SEQ ID NO: 1640983 - protein, 8 aa, Staphylococcus aureus
NGLKPRDI

SEQ ID NO: 1640984 - protein, 10 aa, Staphylococcus aureus
NGMDEATLSD

SEQ ID NO: 1640985 - protein, 4 aa, Staphylococcus aureus
NGNA

SEQ ID NO: 1640986 - protein, 8 aa, Staphylococcus aureus
NGNAQHPV

SEQ ID NO: 1640987 - protein, 46 aa, Staphylococcus aureus; identical to SEQ ID NO: 1571552

SEQ ID NO: 1640988 - protein, 10 aa, Staphylococcus aureus
NGNDERLKRQ

SEQ ID NO: 1640989 - protein, 4 aa, Staphylococcus aureus
NGNE

SEQ ID NO: 1640990 - protein, 6 aa, Staphylococcus aureus
NGNGIE

SEQ ID NO: 1640991 - protein, 5 aa, Staphylococcus aureus
NGNID

SEQ ID NO: 1640992 - protein, 9 aa, Staphylococcus aureus
NGNIPTNSG

SEQ ID NO: 1640993 - protein, 6 aa, Staphylococcus aureus
NGNKIL

SEQ ID NO: 1640994 - protein, 9 aa, Staphylococcus aureus
NGNNHYHSG

SEQ ID NO: 1640995 - protein, 5 aa, Staphylococcus aureus
NGNPI

SEQ ID NO: 1640996 - protein, 11 aa, Staphylococcus aureus
NGNPKDLQYEH

SEQ ID NO: 1640997 - protein, 6 aa, Staphylococcus aureus
NGNSME

SEQ ID NO: 1640998 - protein, 8 aa, Staphylococcus aureus
NGNTTRQR

SEQ ID NO: 1640999 - protein, 31 aa, Staphylococcus aureus
NGQPISSGTFTNITSDRTIPTAQEVSQMNAG

SEQ ID NO: 1641000 - protein, 14 aa, Staphylococcus aureus
NGQQAIEKLYDAFN

SEQ ID NO: 1641001 - protein, 10 aa, Staphylococcus aureus
NGQSSSDKQY

SEQ ID NO: 1641002 - protein, 15 aa, Staphylococcus aureus
NGQTTADLGGKLNTT

SEQ ID NO: 1641003 - protein, 7 aa, Staphylococcus aureus
NGQTYTI

SEQ ID NO: 1641004 - protein, 12 aa, Staphylococcus aureus
NGRNAKRNSEYY

SEQ ID NO: 1641005 - protein, 10 aa, Staphylococcus aureus
NGRPGGDEIT

SEQ ID NO: 1641006 - protein, 15 aa, Staphylococcus aureus
NGRSQAAVNKSIQSQ

SEQ ID NO: 1641007 - protein, 7 aa, Staphylococcus aureus
NGRVDSD

SEQ ID NO: 1641008 - protein, 6 aa, Staphylococcus aureus
NGRYSE

SEQ ID NO: 1641009 - protein, 17 aa, Staphylococcus aureus
NGSAPPNQVLGDLWGEI

SEQ ID NO: 1641010 - protein, 6 aa, Staphylococcus aureus
NGSGTF

SEQ ID NO: 1641011 - protein, 11 aa, Staphylococcus aureus
NGSQGEGGKQL

SEQ ID NO: 1641012 - protein, 16 aa, Staphylococcus aureus
NGSRDRTTTSAPALKI

SEQ ID NO: 1641013 - protein, 9 aa, Staphylococcus aureus
NGSSKTPYH

SEQ ID NO: 1641014 - protein, 11 aa, Staphylococcus aureus
NGTDSRDSFPQ

SEQ ID NO: 1641015 - protein, 13 aa, Staphylococcus aureus
NGTMGQRWEDGKK

SEQ ID NO: 1641016 - protein, 6 aa, Staphylococcus aureus
NGTSQN

SEQ ID NO: 1641017 - protein, 7 aa, Staphylococcus aureus
NGVDIGQ

SEQ ID NO: 1641018 - protein, 6 aa, Staphylococcus aureus
NGVGKT

SEQ ID NO: 1641019 - protein, 17 aa, Staphylococcus aureus
NGYKNPIKNSPFDGAPL

SEQ ID NO: 1641020 - protein, 17 aa, Staphylococcus aureus
NGYKNPIKNSPYDGAPL

SEQ ID NO: 1641021 - protein, 5 aa, Staphylococcus aureus
NGYRD

SEQ ID NO: 1641022 - protein, 4 aa, Staphylococcus aureus
NGYT

SEQ ID NO: 1641023 - protein, 17 aa, Staphylococcus aureus
NHADKTAQVNQNSIDAQ

SEQ ID NO: 1641024 - protein, 7 aa, Staphylococcus aureus
NHASPLK

SEQ ID NO: 1641025 - protein, 18 aa, Staphylococcus aureus
NHDLPHKSIDKSNGESYF

SEQ ID NO: 1641026 - protein, 9 aa, Staphylococcus aureus
NHENSYSKN

SEQ ID NO: 1641027 - protein, 10 aa, Staphylococcus aureus
NHESNTTPIT

SEQ ID NO: 1641028 - protein, 13 aa, Staphylococcus aureus
NHFSKKAKNQLSS

SEQ ID NO: 1641029 - protein, 6 aa, Staphylococcus aureus
NHGGRT

SEQ ID NO: 1641030 - protein, 7 aa, Staphylococcus aureus
NHGSNGV

SEQ ID NO: 1641031 - protein, 6 aa, Staphylococcus aureus
NHHPES

SEQ ID NO: 1641032 - protein, 21 aa, Staphylococcus aureus
NHKAQAREKQSAGDNASEDIQ

SEQ ID NO: 1641033 - protein, 21 aa, Staphylococcus aureus
NHKAQSREKQATGDNASEEIQ

SEQ ID NO: 1641034 - protein, 13 aa, Staphylococcus aureus
NHKTYKKQGKVNT

SEQ ID NO: 1641035 - protein, 7 aa, Staphylococcus aureus
NHNKDRR

SEQ ID NO: 1641036 - protein, 8 aa, Staphylococcus aureus
NHNQATEI

SEQ ID NO: 1641037 - protein, 32 aa, Staphylococcus aureus
NHQNSGSFNDADNLTDEEKELRKLRKENQQLK

SEQ ID NO: 1641038 - protein, 6 aa, Staphylococcus aureus
NHQNTI

SEQ ID NO: 1641039 - protein, 9 aa, Staphylococcus aureus
NHQQTEFNN

SEQ ID NO: 1641040 - protein, 10 aa, Staphylococcus aureus
NHRDISKTEM

SEQ ID NO: 1641041 - protein, 7 aa, Staphylococcus aureus
NHREEFS

SEQ ID NO: 1641042 - protein, 10 aa, Staphylococcus aureus
NHSKAKVPIG

SEQ ID NO: 1641043 - protein, 6 aa, Staphylococcus aureus
NHTSEL

SEQ ID NO: 1641044 - protein, 5 aa, Staphylococcus aureus
NHTSN

SEQ ID NO: 1641045 - protein, 12 aa, Staphylococcus aureus
NHVEDEDKLRTQ

SEQ ID NO: 1641046 - protein, 36 aa, Staphylococcus aureus; identical to SEQ ID NO: 1569256

SEQ ID NO: 1641047 - protein, 7 aa, Staphylococcus aureus
NIAPKKA

SEQ ID NO: 1641048 - protein, 5 aa, Staphylococcus aureus
NIAPQ

SEQ ID NO: 1641049 - protein, 16 aa, Staphylococcus aureus
NIAQGTFNATKQVSVG

SEQ ID NO: 1641050 - protein, 7 aa, Staphylococcus aureus
NIDANVP

SEQ ID NO: 1641051 - protein, 5 aa, Staphylococcus aureus
NIDEN

SEQ ID NO: 1641052 - protein, 11 aa, Staphylococcus aureus
NIEDRQKKLES

SEQ ID NO: 1641053 - protein, 26 aa, Staphylococcus aureus
NIEKNSDDLLNKAKDKAKDLNTEENR

SEQ ID NO: 1641054 - protein, 4 aa, Staphylococcus aureus
NIEP

SEQ ID NO: 1641055 - protein, 5 aa, Staphylococcus aureus
NIEYG

SEQ ID NO: 1641056 - protein, 9 aa, Staphylococcus aureus
NIGKAQRVA

SEQ ID NO: 1641057 - protein, 13 aa, Staphylococcus aureus
NIKENGQTPESYT

SEQ ID NO: 1641058 - protein, 13 aa, Staphylococcus aureus
NIKGNSEETSAVS

SEQ ID NO: 1641059 - protein, 11 aa, Staphylococcus aureus
NIKSEDEISEI

SEQ ID NO: 1641060 - protein, 6 aa, Staphylococcus aureus
NILDEQ

SEQ ID NO: 1641061 - protein, 21 aa, Staphylococcus aureus
NINAADTNQEVAQAKDQGTQN

SEQ ID NO: 1641062 - protein, 10 aa, Staphylococcus aureus
NINDYSQEEL

SEQ ID NO: 1641063 - protein, 6 aa, Staphylococcus aureus
NINGEN

SEQ ID NO: 1641064 - protein, 10 aa, Staphylococcus aureus
NINNSNTSLF

SEQ ID NO: 1641065 - protein, 12 aa, Staphylococcus aureus
NINQNDNYSEIY

SEQ ID NO: 1641066 - protein, 6 aa, Staphylococcus aureus
NINSNA

SEQ ID NO: 1641067 - protein, 6 aa, Staphylococcus aureus
NINTAP

SEQ ID NO: 1641068 - protein, 11 aa, Staphylococcus aureus
NINYEDKTLDI

SEQ ID NO: 1641069 - protein, 19 aa, Staphylococcus aureus
NINYKDKPLDIDSAINWIT

SEQ ID NO: 1641070 - protein, 10 aa, Staphylococcus aureus
NIPIKRKSST

SEQ ID NO: 1641071 - protein, 4 aa, Staphylococcus aureus
NIRK

SEQ ID NO: 1641072 - protein, 8 aa, Staphylococcus aureus
NIRRQDER

SEQ ID NO: 1641073 - protein, 6 aa, Staphylococcus aureus
NISDEQ

SEQ ID NO: 1641074 - protein, 8 aa, Staphylococcus aureus
NISDEQEK

SEQ ID NO: 1641075 - protein, 22 aa, Staphylococcus aureus
NISENENKNFADRKKQLSEGFK

SEQ ID NO: 1641076 - protein, 8 aa, Staphylococcus aureus
NISKYTGK

SEQ ID NO: 1641077 - protein, 13 aa, Staphylococcus aureus
NISQSENSYFGDR

SEQ ID NO: 1641078 - protein, 4 aa, Staphylococcus aureus
NITI

SEQ ID NO: 1641079 - protein, 16 aa, Staphylococcus aureus
NITSKGGATQAGLDTL

SEQ ID NO: 1641080 - protein, 10 aa, Staphylococcus aureus
NITSNNVENN

SEQ ID NO: 1641081 - protein, 16 aa, Staphylococcus aureus
NITSSRDIHPIYFMTK

SEQ ID NO: 1641082 - protein, 8 aa, Staphylococcus aureus
NKAGASNI

SEQ ID NO: 1641083 - protein, 8 aa, Staphylococcus aureus
NKAKETKK

SEQ ID NO: 1641084 - protein, 8 aa, Staphylococcus aureus
NKAKNSDI

SEQ ID NO: 1641085 - protein, 4 aa, Staphylococcus aureus
NKAL

SEQ ID NO: 1641086 - protein, 13 aa, Staphylococcus aureus
NKANGNGKNGPII

SEQ ID NO: 1641087 - protein, 20 aa, Staphylococcus aureus
NKAQSYSRTFDEQKRYMDDK

SEQ ID NO: 1641088 - protein, 7 aa, Staphylococcus aureus
NKASEFS

SEQ ID NO: 1641089 - protein, 18 aa, Staphylococcus aureus
NKATSNQAVSQVQTAGNH

SEQ ID NO: 1641090 - protein, 18 aa, Staphylococcus aureus
NKATSNQDVSQVQTAGNH

SEQ ID NO: 1641091 - protein, 16 aa, Staphylococcus aureus
NKDASKDEIKKAYRKL

SEQ ID NO: 1641092 - protein, 12 aa, Staphylococcus aureus
NKDETETYLNLK

SEQ ID NO: 1641093 - protein, 16 aa, Staphylococcus aureus
NKDHGANKDKQAVEQA

SEQ ID NO: 1641094 - protein, 6 aa, Staphylococcus aureus
NKDMEG

SEQ ID NO: 1641095 - protein, 15 aa, Staphylococcus aureus
NKDQIAEYEREQMDK

SEQ ID NO: 1641096 - protein, 9 aa, Staphylococcus aureus
NKDTGKVTV

SEQ ID NO: 1641097 - protein, 8 aa, Staphylococcus aureus
NKDTIDRT

SEQ ID NO: 1641098 - protein, 7 aa, Staphylococcus aureus
NKEESVS

SEQ ID NO: 1641099 - protein, 11 aa, Staphylococcus aureus
NKEFNEDENEY

SEQ ID NO: 1641100 - protein, 12 aa, Staphylococcus aureus
NKEGFAHDGEQI

SEQ ID NO: 1641101 - protein, 4 aa, Staphylococcus aureus
NKEI

SEQ ID NO: 1641102 - protein, 11 aa, Staphylococcus aureus
NKEISEDENEY

SEQ ID NO: 1641103 - protein, 13 aa, Staphylococcus aureus
NKEKKANKFEFSE

SEQ ID NO: 1641104 - protein, 8 aa, Staphylococcus aureus
NKEKSGNI

SEQ ID NO: 1641105 - protein, 4 aa, Staphylococcus aureus
NKEL

SEQ ID NO: 1641106 - protein, 6 aa, Staphylococcus aureus
NKENKY

SEQ ID NO: 1641107 - protein, 12 aa, Staphylococcus aureus
NKESNANQCPFH

SEQ ID NO: 1641108 - protein, 5 aa, Staphylococcus aureus
NKETE

SEQ ID NO: 1641109 - protein, 6 aa, Staphylococcus aureus
NKEVTL

SEQ ID NO: 1641110 - protein, 8 aa, Staphylococcus aureus
NKFGTTSW

SEQ ID NO: 1641111 - protein, 13 aa, Staphylococcus aureus
NKFPDRKNYNVEM

SEQ ID NO: 1641112 - protein, 4 aa, Staphylococcus aureus
NKGK

SEQ ID NO: 1641113 - protein, 5 aa, Staphylococcus aureus
NKGNY

SEQ ID NO: 1641114 - protein, 8 aa, Staphylococcus aureus
NKGNYTRY

SEQ ID NO: 1641115 - protein, 8 aa, Staphylococcus aureus
NKHEGIED

SEQ ID NO: 1641116 - protein, 8 aa, Staphylococcus aureus
NKHEGMED

SEQ ID NO: 1641117 - protein, 12 aa, Staphylococcus aureus
NKIDSADVSQKL

SEQ ID NO: 1641118 - protein, 11 aa, Staphylococcus aureus
NKITSRRDSLN

SEQ ID NO: 1641119 - protein, 11 aa, Staphylococcus aureus
NKKEDQITNYS

SEQ ID NO: 1641120 - protein, 15 aa, Staphylococcus aureus
NKKEITNELIRKSAF

SEQ ID NO: 1641121 - protein, 10 aa, Staphylococcus aureus
NKKENQITNY

SEQ ID NO: 1641122 - protein, 12 aa, Staphylococcus aureus
NKKENQWNDKFT

SEQ ID NO: 1641123 - protein, 9 aa, Staphylococcus aureus
NKKGRKKLT

SEQ ID NO: 1641124 - protein, 15 aa, Staphylococcus aureus
NKKGVKRKEVTTYNG

SEQ ID NO: 1641125 - protein, 6 aa, Staphylococcus aureus
NKKLEE

SEQ ID NO: 1641126 - protein, 7 aa, Staphylococcus aureus
NKKLNDI

SEQ ID NO: 1641127 - protein, 17 aa, Staphylococcus aureus
NKKLSNQDAYKRARPSH

SEQ ID NO: 1641128 - protein, 8 aa, Staphylococcus aureus
NKKQLSSK

SEQ ID NO: 1641129 - protein, 15 aa, Staphylococcus aureus
NKKQRGSIYGPKLLE

SEQ ID NO: 1641130 - protein, 28 aa, Staphylococcus aureus
NKKRKPTSSNIRDLEKSNKQLVTKQQKL

SEQ ID NO: 1641131 - protein, 10 aa, Staphylococcus aureus
NKKTNSKSGK

SEQ ID NO: 1641132 - protein, 12 aa, Staphylococcus aureus
NKLKQKESGENT

SEQ ID NO: 1641133 - protein, 5 aa, Staphylococcus aureus
NKLNE

SEQ ID NO: 1641134 - protein, 6 aa, Staphylococcus aureus
NKLPDI

SEQ ID NO: 1641135 - protein, 9 aa, Staphylococcus aureus
NKLSKSEVL

SEQ ID NO: 1641136 - protein, 10 aa, Staphylococcus aureus
NKMDNKALSL

SEQ ID NO: 1641137 - protein, 8 aa, Staphylococcus aureus
NKNDKDAF

SEQ ID NO: 1641138 - protein, 7 aa, Staphylococcus aureus
NKNEPII

SEQ ID NO: 1641139 - protein, 8 aa, Staphylococcus aureus
NKNFDSNA

SEQ ID NO: 1641140 - protein, 12 aa, Staphylococcus aureus
NKNGNKVRKQER

SEQ ID NO: 1641141 - protein, 17 aa, Staphylococcus aureus
NKNKTLNTVKINEIQFK

SEQ ID NO: 1641142 - protein, 9 aa, Staphylococcus aureus
NKNLQSTKN

SEQ ID NO: 1641143 - protein, 9 aa, Staphylococcus aureus
NKNLRSTKN

SEQ ID NO: 1641144 - protein, 6 aa, Staphylococcus aureus
NKNLTE

SEQ ID NO: 1641145 - protein, 6 aa, Staphylococcus aureus
NKNNTY

SEQ ID NO: 1641146 - protein, 6 aa, Staphylococcus aureus
NKNPID

SEQ ID NO: 1641147 - protein, 6 aa, Staphylococcus aureus
NKNPKY

SEQ ID NO: 1641148 - protein, 16 aa, Staphylococcus aureus
NKNSGSNLDKTAVENA

SEQ ID NO: 1641149 - protein, 10 aa, Staphylococcus aureus
NKNTKQAQKE

SEQ ID NO: 1641150 - protein, 6 aa, Staphylococcus aureus
NKPIQQ

SEQ ID NO: 1641151 - protein, 14 aa, Staphylococcus aureus
NKPTDNNSDISYST

SEQ ID NO: 1641152 - protein, 24 aa, Staphylococcus aureus
NKPTDNNSDISYSTNKNRAREFNG

SEQ ID NO: 1641153 - protein, 6 aa, Staphylococcus aureus
NKPTVA

SEQ ID NO: 1641154 - protein, 7 aa, Staphylococcus aureus
NKQLYPE

SEQ ID NO: 1641155 - protein, 10 aa, Staphylococcus aureus
NKQNFNSAKT

SEQ ID NO: 1641156 - protein, 12 aa, Staphylococcus aureus
NKQNFNSAKTTV

SEQ ID NO: 1641157 - protein, 9 aa, Staphylococcus aureus
NKQNTQYSK

SEQ ID NO: 1641158 - protein, 7 aa, Staphylococcus aureus
NKQPYRT

SEQ ID NO: 1641159 - protein, 9 aa, Staphylococcus aureus
NKQSQELLD

SEQ ID NO: 1641160 - protein, 16 aa, Staphylococcus aureus
NKQTGPNTAKTAVEQA

SEQ ID NO: 1641161 - protein, 16 aa, Staphylococcus aureus
NKQTGQNANQSEVEQA

SEQ ID NO: 1641162 - protein, 4 aa, Staphylococcus aureus
NKQY

SEQ ID NO: 1641163 - protein, 16 aa, Staphylococcus aureus
NKRAEQTQKWQCKYFF

SEQ ID NO: 1641164 - protein, 16 aa, Staphylococcus aureus
NKRNKTGKTPKAPYEV

SEQ ID NO: 1641165 - protein, 8 aa, Staphylococcus aureus
NKRNLNNE

SEQ ID NO: 1641166 - protein, 6 aa, Staphylococcus aureus
NKRTSY

SEQ ID NO: 1641167 - protein, 21 aa, Staphylococcus aureus
NKSDVRKEPITPTLKNNMNDG

SEQ ID NO: 1641168 - protein, 4 aa, Staphylococcus aureus
NKSE

SEQ ID NO: 1641169 - protein, 6 aa, Staphylococcus aureus
NKSGAN

SEQ ID NO: 1641170 - protein, 7 aa, Staphylococcus aureus
NKSITQR

SEQ ID NO: 1641171 - protein, 6 aa, Staphylococcus aureus
NKSKNI

SEQ ID NO: 1641172 - protein, 15 aa, Staphylococcus aureus
NKSKQTATVSADATG

SEQ ID NO: 1641173 - protein, 11 aa, Staphylococcus aureus
NKSLNTKKTYA

SEQ ID NO: 1641174 - protein, 4 aa, Staphylococcus aureus
NKSN

SEQ ID NO: 1641175 - protein, 6 aa, Staphylococcus aureus
NKSNNF

SEQ ID NO: 1641176 - protein, 12 aa, Staphylococcus aureus
NKTDHTQAPVGY

SEQ ID NO: 1641177 - protein, 8 aa, Staphylococcus aureus
NKTDKTYV

SEQ ID NO: 1641178 - protein, 6 aa, Staphylococcus aureus
NKTDNK

SEQ ID NO: 1641179 - protein, 6 aa, Staphylococcus aureus
NKTEAL

SEQ ID NO: 1641180 - protein, 5 aa, Staphylococcus aureus
NKTEF

SEQ ID NO: 1641181 - protein, 11 aa, Staphylococcus aureus
NKTHKNDTVTQ

SEQ ID NO: 1641182 - protein, 8 aa, Staphylococcus aureus
NKTKIEKY

SEQ ID NO: 1641183 - protein, 6 aa, Staphylococcus aureus
NKTKQE

SEQ ID NO: 1641184 - protein, 26 aa, Staphylococcus aureus
NKTLDDKTSYKIDGKGWQKDKSWGGY

SEQ ID NO: 1641185 - protein, 13 aa, Staphylococcus aureus
NKTLGSSEAKPYL

SEQ ID NO: 1641186 - protein, 9 aa, Staphylococcus aureus
NKTNNQRNN

SEQ ID NO: 1641187 - protein, 7 aa, Staphylococcus aureus
NKTNQHG

SEQ ID NO: 1641188 - protein, 7 aa, Staphylococcus aureus
NKTSSMP

SEQ ID NO: 1641189 - protein, 13 aa, Staphylococcus aureus
NKVGEAIKNAKNY

SEQ ID NO: 1641190 - protein, 6 aa, Staphylococcus aureus
NKYHEE

SEQ ID NO: 1641191 - protein, 5 aa, Staphylococcus aureus
NKYIE

SEQ ID NO: 1641192 - protein, 7 aa, Staphylococcus aureus
NKYKKYK

SEQ ID NO: 1641193 - protein, 5 aa, Staphylococcus aureus
NKYRN

SEQ ID NO: 1641194 - protein, 4 aa, Staphylococcus aureus
NKYS

SEQ ID NO: 1641195 - protein, 6 aa, Staphylococcus aureus
NKYSFG

SEQ ID NO: 1641196 - protein, 14 aa, Staphylococcus aureus
NLAANGPKKSITAN

SEQ ID NO: 1641197 - protein, 5 aa, Staphylococcus aureus
NLASE

SEQ ID NO: 1641198 - protein, 8 aa, Staphylococcus aureus
NLDDQFEE

SEQ ID NO: 1641199 - protein, 8 aa, Staphylococcus aureus
NLDGDEAM

SEQ ID NO: 1641200 - protein, 12 aa, Staphylococcus aureus
NLDKTEIKSYFE

SEQ ID NO: 1641201 - protein, 10 aa, Staphylococcus aureus
NLDPATGHET

SEQ ID NO: 1641202 - protein, 8 aa, Staphylococcus aureus
NLEEQQKI

SEQ ID NO: 1641203 - protein, 4 aa, Staphylococcus aureus
NLEF

SEQ ID NO: 1641204 - protein, 16 aa, Staphylococcus aureus
NLGNKYEGHGNGGDGI

SEQ ID NO: 1641205 - protein, 4 aa, Staphylococcus aureus
NLID

SEQ ID NO: 1641206 - protein, 14 aa, Staphylococcus aureus
NLKGAYKSFNKSKE

SEQ ID NO: 1641207 - protein, 31 aa, Staphylococcus aureus
NLKGERTINDAAKHNSKEKTGASPYEGIRTC

SEQ ID NO: 1641208 - protein, 6 aa, Staphylococcus aureus
NLKNEV

SEQ ID NO: 1641209 - protein, 18 aa, Staphylococcus aureus
NLKPEQEEYNELETQNGK

SEQ ID NO: 1641210 - protein, 4 aa, Staphylococcus aureus
NLNI

SEQ ID NO: 1641211 - protein, 6 aa, Staphylococcus aureus
NLNNSS

SEQ ID NO: 1641212 - protein, 16 aa, Staphylococcus aureus
NLNNTQKGAVTGNINQ

SEQ ID NO: 1641213 - protein, 9 aa, Staphylococcus aureus
NLPESEKAI

SEQ ID NO: 1641214 - protein, 8 aa, Staphylococcus aureus
NLPPSRES

SEQ ID NO: 1641215 - protein, 9 aa, Staphylococcus aureus
NLPTDKKGI

SEQ ID NO: 1641216 - protein, 6 aa, Staphylococcus aureus
NLPTPE

SEQ ID NO: 1641217 - protein, 9 aa, Staphylococcus aureus
NLSAPAVRE

SEQ ID NO: 1641218 - protein, 7 aa, Staphylococcus aureus
NLSNDGY

SEQ ID NO: 1641219 - protein, 10 aa, Staphylococcus aureus
NLSNSEKQKH

SEQ ID NO: 1641220 - protein, 10 aa, Staphylococcus aureus
NLSSGKSDSV

SEQ ID NO: 1641221 - protein, 8 aa, Staphylococcus aureus
NLTQEARD

SEQ ID NO: 1641222 - protein, 11 aa, Staphylococcus aureus
NLTTIDKAKAS

SEQ ID NO: 1641223 - protein, 15 aa, Staphylococcus aureus
NLTTPDEVNNKYKLK

SEQ ID NO: 1641224 - protein, 5 aa, Staphylococcus aureus
NLYDT

SEQ ID NO: 1641225 - protein, 8 aa, Staphylococcus aureus
NMGTGGHN

SEQ ID NO: 1641226 - protein, 25 aa, Staphylococcus aureus
NMPENPKSVSEIKKEQSNKEDKKKD

SEQ ID NO: 1641227 - protein, 27 aa, Staphylococcus aureus
NMQNEKLSKQNSKSYTKKKSKLKRYKY

SEQ ID NO: 1641228 - protein, 11 aa, Staphylococcus aureus
NMQTRTKNKIE

SEQ ID NO: 1641229 - protein, 7 aa, Staphylococcus aureus
NMSDTNY

SEQ ID NO: 1641230 - protein, 6 aa, Staphylococcus aureus
NMSEKQ

SEQ ID NO: 1641231 - protein, 8 aa, Staphylococcus aureus
NNADTVTG

SEQ ID NO: 1641232 - protein, 7 aa, Staphylococcus aureus
NNAGTSF

SEQ ID NO: 1641233 - protein, 12 aa, Staphylococcus aureus
NNAKAKTANNTG

SEQ ID NO: 1641234 - protein, 20 aa, Staphylococcus aureus
NNALNQAKQYVDGKFQSTSW

SEQ ID NO: 1641235 - protein, 8 aa, Staphylococcus aureus
NNAPTKED

SEQ ID NO: 1641236 - protein, 7 aa, Staphylococcus aureus
NNAQGDL

SEQ ID NO: 1641237 - protein, 16 aa, Staphylococcus aureus
NNAQGDLGNLSAGNYY

SEQ ID NO: 1641238 - protein, 20 aa, Staphylococcus aureus
NNAQKQDLNTQVTNAPNINT

SEQ ID NO: 1641239 - protein, 34 aa, Staphylococcus aureus
NNAQKQQLQSQITQSSDIATVNGHKQTAESLNTA

SEQ ID NO: 1641240 - protein, 17 aa, Staphylococcus aureus
NNAQQTSATAEVDQAQN

SEQ ID NO: 1641241 - protein, 15 aa, Staphylococcus aureus
NNAQRQNLQSQINGA

SEQ ID NO: 1641242 - protein, 16 aa, Staphylococcus aureus
NNAQRQNLQSQINGAH

SEQ ID NO: 1641243 - protein, 11 aa, Staphylococcus aureus
NNARKSEASNC

SEQ ID NO: 1641244 - protein, 15 aa, Staphylococcus aureus
NNDAKQQIAEQIQAQ

SEQ ID NO: 1641245 - protein, 7 aa, Staphylococcus aureus
NNDKNDV

SEQ ID NO: 1641246 - protein, 10 aa, Staphylococcus aureus
NNDKTSYSHN

SEQ ID NO: 1641247 - protein, 6 aa, Staphylococcus aureus
NNDQQG

SEQ ID NO: 1641248 - protein, 9 aa, Staphylococcus aureus
NNDSYENSH

SEQ ID NO: 1641249 - protein, 5 aa, Staphylococcus aureus
NNEAI

SEQ ID NO: 1641250 - protein, 10 aa, Staphylococcus aureus
NNEATDEEQN

SEQ ID NO: 1641251 - protein, 6 aa, Staphylococcus aureus
NNEDIA

SEQ ID NO: 1641252 - protein, 11 aa, Staphylococcus aureus
NNEDYARYSEK

SEQ ID NO: 1641253 - protein, 6 aa, Staphylococcus aureus
NNEIKA

SEQ ID NO: 1641254 - protein, 7 aa, Staphylococcus aureus
NNEKQQR

SEQ ID NO: 1641255 - protein, 13 aa, Staphylococcus aureus
NNERATPQQVSDA

SEQ ID NO: 1641256 - protein, 6 aa, Staphylococcus aureus
NNERKL

SEQ ID NO: 1641257 - protein, 7 aa, Staphylococcus aureus
NNESIDT

SEQ ID NO: 1641258 - protein, 8 aa, Staphylococcus aureus
NNETGKED

SEQ ID NO: 1641259 - protein, 18 aa, Staphylococcus aureus
NNGNYKHAYGTGHSLGGT

SEQ ID NO: 1641260 - protein, 15 aa, Staphylococcus aureus
NNGQNDGATSSISPY

SEQ ID NO: 1641261 - protein, 22 aa, Staphylococcus aureus
NNGVEGLEDYENEVERIRKRFK

SEQ ID NO: 1641262 - protein, 9 aa, Staphylococcus aureus
NNGVGNEED

SEQ ID NO: 1641263 - protein, 4 aa, Staphylococcus aureus
NNHD

SEQ ID NO: 1641264 - protein, 12 aa, Staphylococcus aureus
NNHQSNTTGADG

SEQ ID NO: 1641265 - protein, 7 aa, Staphylococcus aureus
NNHSINN

SEQ ID NO: 1641266 - protein, 17 aa, Staphylococcus aureus
NNIDDDVDDTLQEKAKE

SEQ ID NO: 1641267 - protein, 6 aa, Staphylococcus aureus
NNIDQE

SEQ ID NO: 1641268 - protein, 6 aa, Staphylococcus aureus
NNIEDD

SEQ ID NO: 1641269 - protein, 4 aa, Staphylococcus aureus
NNIN

SEQ ID NO: 1641270 - protein, 39 aa, Staphylococcus aureus
NNITGNEKAQAEAGGRPNYRTTGYSQANASSDGQTQYTL

SEQ ID NO: 1641271 - protein, 10 aa, Staphylococcus aureus
NNKEDADKVE

SEQ ID NO: 1641272 - protein, 5 aa, Staphylococcus aureus
NNKHY

SEQ ID NO: 1641273 - protein, 8 aa, Staphylococcus aureus
NNKITPND

SEQ ID NO: 1641274 - protein, 17 aa, Staphylococcus aureus
NNKKSNLNKDKTQRITK

SEQ ID NO: 1641275 - protein, 14 aa, Staphylococcus aureus
NNKPNHDDEGSVEL

SEQ ID NO: 1641276 - protein, 12 aa, Staphylococcus aureus
NNKQFDKEIEQN

SEQ ID NO: 1641277 - protein, 8 aa, Staphylococcus aureus
NNKQISQR

SEQ ID NO: 1641278 - protein, 10 aa, Staphylococcus aureus
NNKQKRDPKV

SEQ ID NO: 1641279 - protein, 9 aa, Staphylococcus aureus
NNKVGKNDI

SEQ ID NO: 1641280 - protein, 6 aa, Staphylococcus aureus
NNLNSF

SEQ ID NO: 1641281 - protein, 15 aa, Staphylococcus aureus
NNLNSFAKEKLKKNN

SEQ ID NO: 1641282 - protein, 5 aa, Staphylococcus aureus
NNLPN

SEQ ID NO: 1641283 - protein, 8 aa, Staphylococcus aureus
NNLSKQEK

SEQ ID NO: 1641284 - protein, 11 aa, Staphylococcus aureus
NNMKNKSKALY

SEQ ID NO: 1641285 - protein, 4 aa, Staphylococcus aureus
NNMS

SEQ ID NO: 1641286 - protein, 7 aa, Staphylococcus aureus
NNNANVP

SEQ ID NO: 1641287 - protein, 5 aa, Staphylococcus aureus
NNNDD

SEQ ID NO: 1641288 - protein, 6 aa, Staphylococcus aureus
NNNEAV

SEQ ID NO: 1641289 - protein, 12 aa, Staphylococcus aureus
NNNFKGDSKRLR

SEQ ID NO: 1641290 - protein, 11 aa, Staphylococcus aureus
NNNKTSYSHNK

SEQ ID NO: 1641291 - protein, 4 aa, Staphylococcus aureus
NNNL

SEQ ID NO: 1641292 - protein, 9 aa, Staphylococcus aureus
NNNPVSQSM

SEQ ID NO: 1641293 - protein, 10 aa, Staphylococcus aureus
NNNTKSRGNI

SEQ ID NO: 1641294 - protein, 13 aa, Staphylococcus aureus
NNPEFAKSSKIYK

SEQ ID NO: 1641295 - protein, 11 aa, Staphylococcus aureus
NNPEQRVGDTT

SEQ ID NO: 1641296 - protein, 6 aa, Staphylococcus aureus
NNPFGK

SEQ ID NO: 1641297 - protein, 7 aa, Staphylococcus aureus
NNPNITS

SEQ ID NO: 1641298 - protein, 7 aa, Staphylococcus aureus
NNPPKGI

SEQ ID NO: 1641299 - protein, 5 aa, Staphylococcus aureus
NNPQY

SEQ ID NO: 1641300 - protein, 7 aa, Staphylococcus aureus
NNPSKFE

SEQ ID NO: 1641301 - protein, 15 aa, Staphylococcus aureus
NNPTGRSLTNEQKQN

SEQ ID NO: 1641302 - protein, 11 aa, Staphylococcus aureus
NNQAPKGYIAN

SEQ ID NO: 1641303 - protein, 7 aa, Staphylococcus aureus
NNQASTY

SEQ ID NO: 1641304 - protein, 4 aa, Staphylococcus aureus
NNQR

SEQ ID NO: 1641305 - protein, 7 aa, Staphylococcus aureus
NNQSPKM

SEQ ID NO: 1641306 - protein, 14 aa, Staphylococcus aureus
NNQSQQTKNQLNDV

SEQ ID NO: 1641307 - protein, 6 aa, Staphylococcus aureus
NNQSSD

SEQ ID NO: 1641308 - protein, 7 aa, Staphylococcus aureus
NNRISKT

SEQ ID NO: 1641309 - protein, 5 aa, Staphylococcus aureus
NNRYK

SEQ ID NO: 1641310 - protein, 9 aa, Staphylococcus aureus
NNSDGKDAL

SEQ ID NO: 1641311 - protein, 20 aa, Staphylococcus aureus
NNSDISYSTNRNRAREFNGM

SEQ ID NO: 1641312 - protein, 20 aa, Staphylococcus aureus
NNSDVSYSTNRNRAREFNGM

SEQ ID NO: 1641313 - protein, 5 aa, Staphylococcus aureus
NNSEY

SEQ ID NO: 1641314 - protein, 4 aa, Staphylococcus aureus
NNSI

SEQ ID NO: 1641315 - protein, 9 aa, Staphylococcus aureus
NNSKNKKSI

SEQ ID NO: 1641316 - protein, 7 aa, Staphylococcus aureus
NNSNYEL

SEQ ID NO: 1641317 - protein, 11 aa, Staphylococcus aureus
NNSPTLTEQPT

SEQ ID NO: 1641318 - protein, 14 aa, Staphylococcus aureus
NNSSGLIDKGNQDL

SEQ ID NO: 1641319 - protein, 7 aa, Staphylococcus aureus
NNSSYQK

SEQ ID NO: 1641320 - protein, 10 aa, Staphylococcus aureus
NNSTHNAADA

SEQ ID NO: 1641321 - protein, 8 aa, Staphylococcus aureus
NNSWSTNA

SEQ ID NO: 1641322 - protein, 4 aa, Staphylococcus aureus
NNTD

SEQ ID NO: 1641323 - protein, 15 aa, Staphylococcus aureus
NNTDEQDKLINLIMK

SEQ ID NO: 1641324 - protein, 15 aa, Staphylococcus aureus
NNTDEQDRLINLVMR

SEQ ID NO: 1641325 - protein, 4 aa, Staphylococcus aureus
NNTI

SEQ ID NO: 1641326 - protein, 6 aa, Staphylococcus aureus
NNTNVP

SEQ ID NO: 1641327 - protein, 5 aa, Staphylococcus aureus
NNTTE

SEQ ID NO: 1641328 - protein, 6 aa, Staphylococcus aureus
NNTTIK

SEQ ID NO: 1641329 - protein, 24 aa, Staphylococcus aureus
NNVNNAKHALNGTQNLNNAKQAAI

SEQ ID NO: 1641330 - protein, 24 aa, Staphylococcus aureus
NNVNRTASDVRAAFGKNGGNMGVS

SEQ ID NO: 1641331 - protein, 15 aa, Staphylococcus aureus
NNWDSNARAGTPSKG

SEQ ID NO: 1641332 - protein, 13 aa, Staphylococcus aureus
NPCNNSTPSKGGD

SEQ ID NO: 1641333 - protein, 4 aa, Staphylococcus aureus
NPDA

SEQ ID NO: 1641334 - protein, 12 aa, Staphylococcus aureus
NPDAQTDAMSEE

SEQ ID NO: 1641335 - protein, 11 aa, Staphylococcus aureus
NPDATKEEVIS

SEQ ID NO: 1641336 - protein, 9 aa, Staphylococcus aureus
NPDATQEEV

SEQ ID NO: 1641337 - protein, 14 aa, Staphylococcus aureus
NPDEYADDSEFTRE

SEQ ID NO: 1641338 - protein, 7 aa, Staphylococcus aureus
NPEFPES

SEQ ID NO: 1641339 - protein, 5 aa, Staphylococcus aureus
NPEIE

SEQ ID NO: 1641340 - protein, 10 aa, Staphylococcus aureus
NPEKKDTREI

SEQ ID NO: 1641341 - protein, 5 aa, Staphylococcus aureus
NPEKY

SEQ ID NO: 1641342 - protein, 6 aa, Staphylococcus aureus
NPELNV

SEQ ID NO: 1641343 - protein, 11 aa, Staphylococcus aureus
NPENPAQHQYA

SEQ ID NO: 1641344 - protein, 7 aa, Staphylococcus aureus
NPESPIY

SEQ ID NO: 1641345 - protein, 12 aa, Staphylococcus aureus
NPESTNSVSDIE

SEQ ID NO: 1641346 - protein, 8 aa, Staphylococcus aureus
NPETNEIK

SEQ ID NO: 1641347 - protein, 21 aa, Staphylococcus aureus
NPGKGRPRKPYKEGEENGNLD

SEQ ID NO: 1641348 - protein, 7 aa, Staphylococcus aureus
NPGLATG

SEQ ID NO: 1641349 - protein, 9 aa, Staphylococcus aureus
NPGPTGLEK

SEQ ID NO: 1641350 - protein, 8 aa, Staphylococcus aureus
NPIGRGVS

SEQ ID NO: 1641351 - protein, 19 aa, Staphylococcus aureus
NPILTDKEKQALKDRINQI

SEQ ID NO: 1641352 - protein, 23 aa, Staphylococcus aureus
NPILTDKEKQALKDRINQICNKV

SEQ ID NO: 1641353 - protein, 5 aa, Staphylococcus aureus
NPITT

SEQ ID NO: 1641354 - protein, 25 aa, Staphylococcus aureus
NPIVNSENGSDNNFESGTIERNQNE

SEQ ID NO: 1641355 - protein, 17 aa, Staphylococcus aureus
NPKDLNDYKYDPEKAKK

SEQ ID NO: 1641356 - protein, 30 aa, Staphylococcus aureus
NPKNNANPEPNVAPLANPNVKLSANALFKT

SEQ ID NO: 1641357 - protein, 11 aa, Staphylococcus aureus
NPLAELTNKRR

SEQ ID NO: 1641358 - protein, 6 aa, Staphylococcus aureus
NPLSDL

SEQ ID NO: 1641359 - protein, 9 aa, Staphylococcus aureus
NPNDINNNT

SEQ ID NO: 1641360 - protein, 8 aa, Staphylococcus aureus
NPNDKTIN

SEQ ID NO: 1641361 - protein, 15 aa, Staphylococcus aureus
NPNDTSNGTYHSSQY

SEQ ID NO: 1641362 - protein, 9 aa, Staphylococcus aureus
NPNLTTNQT

SEQ ID NO: 1641363 - protein, 4 aa, Staphylococcus aureus
NPNP

SEQ ID NO: 1641364 - protein, 9 aa, Staphylococcus aureus
NPNSPEGKR

SEQ ID NO: 1641365 - protein, 14 aa, Staphylococcus aureus
NPPYKKIKATANDF

SEQ ID NO: 1641366 - protein, 16 aa, Staphylococcus aureus
NPPYSTGQTNENDNLK

SEQ ID NO: 1641367 - protein, 18 aa, Staphylococcus aureus
NPPYSVGQDSENDNNQNI

SEQ ID NO: 1641368 - protein, 5 aa, Staphylococcus aureus
NPQNV

SEQ ID NO: 1641369 - protein, 8 aa, Staphylococcus aureus
NPRATVNE

SEQ ID NO: 1641370 - protein, 6 aa, Staphylococcus aureus
NPRRMA

SEQ ID NO: 1641371 - protein, 15 aa, Staphylococcus aureus
NPRSGNEKGSVENKV

SEQ ID NO: 1641372 - protein, 4 aa, Staphylococcus aureus
NPSM

SEQ ID NO: 1641373 - protein, 6 aa, Staphylococcus aureus
NPSSKG

SEQ ID NO: 1641374 - protein, 11 aa, Staphylococcus aureus
NPTKLSEATAQ

SEQ ID NO: 1641375 - protein, 9 aa, Staphylococcus aureus
NPTPAIKTY

SEQ ID NO: 1641376 - protein, 6 aa, Staphylococcus aureus
NPTRSG

SEQ ID NO: 1641377 - protein, 12 aa, Staphylococcus aureus
NPYISEDVKRIV

SEQ ID NO: 1641378 - protein, 11 aa, Staphylococcus aureus
NQASPNAKTSI

SEQ ID NO: 1641379 - protein, 19 aa, Staphylococcus aureus
NQASSVGNLSQTMNSNYDA

SEQ ID NO: 1641380 - protein, 18 aa, Staphylococcus aureus
NQATTNADVDNAKGDGLN

SEQ ID NO: 1641381 - protein, 6 aa, Staphylococcus aureus
NQCPTS

SEQ ID NO: 1641382 - protein, 8 aa, Staphylococcus aureus
NQDEAPTV

SEQ ID NO: 1641383 - protein, 6 aa, Staphylococcus aureus
NQDGTV

SEQ ID NO: 1641384 - protein, 16 aa, Staphylococcus aureus
NQDGTVITNDTLKGKK

SEQ ID NO: 1641385 - protein, 9 aa, Staphylococcus aureus
NQDLYENQS

SEQ ID NO: 1641386 - protein, 8 aa, Staphylococcus aureus
NQDNKTLK

SEQ ID NO: 1641387 - protein, 6 aa, Staphylococcus aureus
NQDRTV

SEQ ID NO: 1641388 - protein, 6 aa, Staphylococcus aureus
NQDSLD

SEQ ID NO: 1641389 - protein, 6 aa, Staphylococcus aureus
NQENQN

SEQ ID NO: 1641390 - protein, 7 aa, Staphylococcus aureus
NQESDTS

SEQ ID NO: 1641391 - protein, 26 aa, Staphylococcus aureus
NQEYPKGYGDSSTIPANSDGKNALYA

SEQ ID NO: 1641392 - protein, 6 aa, Staphylococcus aureus
NQFAKG

SEQ ID NO: 1641393 - protein, 7 aa, Staphylococcus aureus
NQGEAAY

SEQ ID NO: 1641394 - protein, 8 aa, Staphylococcus aureus
NQGEASYQ

SEQ ID NO: 1641395 - protein, 8 aa, Staphylococcus aureus
NQGGDETV

SEQ ID NO: 1641396 - protein, 19 aa, Staphylococcus aureus
NQHSNHSNHFSNTHDKESL

SEQ ID NO: 1641397 - protein, 8 aa, Staphylococcus aureus
NQIGNKYG

SEQ ID NO: 1641398 - protein, 4 aa, Staphylococcus aureus
NQKA

SEQ ID NO: 1641399 - protein, 5 aa, Staphylococcus aureus
NQKDD

SEQ ID NO: 1641400 - protein, 6 aa, Staphylococcus aureus
NQKEHS

SEQ ID NO: 1641401 - protein, 8 aa, Staphylococcus aureus
NQKGKSLI

SEQ ID NO: 1641402 - protein, 4 aa, Staphylococcus aureus
NQKK

SEQ ID NO: 1641403 - protein, 18 aa, Staphylococcus aureus
NQKRSNIRKTIQDKVSGI

SEQ ID NO: 1641404 - protein, 21 aa, Staphylococcus aureus
NQKRSNIRKTIQDNVSGIDDK

SEQ ID NO: 1641405 - protein, 6 aa, Staphylococcus aureus
NQLESE

SEQ ID NO: 1641406 - protein, 6 aa, Staphylococcus aureus
NQLGNK

SEQ ID NO: 1641407 - protein, 6 aa, Staphylococcus aureus
NQMPHS

SEQ ID NO: 1641408 - protein, 13 aa, Staphylococcus aureus
NQNCTPSREHPHE

SEQ ID NO: 1641409 - protein, 6 aa, Staphylococcus aureus
NQNDKV

SEQ ID NO: 1641410 - protein, 10 aa, Staphylococcus aureus
NQNELKGERG

SEQ ID NO: 1641411 - protein, 16 aa, Staphylococcus aureus
NQNPLRKEKQDNWKIV

SEQ ID NO: 1641412 - protein, 9 aa, Staphylococcus aureus
NQNQNTAVQ

SEQ ID NO: 1641413 - protein, 5 aa, Staphylococcus aureus
NQNSK

SEQ ID NO: 1641414 - protein, 10 aa, Staphylococcus aureus
NQNSLPPNYD

SEQ ID NO: 1641415 - protein, 10 aa, Staphylococcus aureus
NQNTDNTNEA

SEQ ID NO: 1641416 - protein, 10 aa, Staphylococcus aureus
NQNTGNTTDA

SEQ ID NO: 1641417 - protein, 12 aa, Staphylococcus aureus
NQNTIEEVNQTY

SEQ ID NO: 1641418 - protein, 5 aa, Staphylococcus aureus
NQNYP

SEQ ID NO: 1641419 - protein, 7 aa, Staphylococcus aureus
NQPINDA

SEQ ID NO: 1641420 - protein, 6 aa, Staphylococcus aureus
NQPLSH

SEQ ID NO: 1641421 - protein, 13 aa, Staphylococcus aureus
NQQDDSTREENTS

SEQ ID NO: 1641422 - protein, 4 aa, Staphylococcus aureus
NQQK

SEQ ID NO: 1641423 - protein, 8 aa, Staphylococcus aureus
NQQSEITL

SEQ ID NO: 1641424 - protein, 16 aa, Staphylococcus aureus
NQREDSKEEQIKKSFE

SEQ ID NO: 1641425 - protein, 7 aa, Staphylococcus aureus
NQRNDEY

SEQ ID NO: 1641426 - protein, 4 aa, Staphylococcus aureus
NQRQ

SEQ ID NO: 1641427 - protein, 13 aa, Staphylococcus aureus
NQSAGNNQRDRGT

SEQ ID NO: 1641428 - protein, 7 aa, Staphylococcus aureus
NQSGVSL

SEQ ID NO: 1641429 - protein, 11 aa, Staphylococcus aureus
NQSLNLKDKEQ

SEQ ID NO: 1641430 - protein, 7 aa, Staphylococcus aureus
NQSNRHY

SEQ ID NO: 1641431 - protein, 15 aa, Staphylococcus aureus
NQSNRHYNAYWRGPN

SEQ ID NO: 1641432 - protein, 6 aa, Staphylococcus aureus
NQSNYI

SEQ ID NO: 1641433 - protein, 51 aa, Staphylococcus aureus
NQSSKTQLTQKDEDKSENMPEEKSESETDKDLQSTEEVPANENTENNQHEI

SEQ ID NO: 1641434 - protein, 51 aa, Staphylococcus aureus
NQSSKTQLTQKDENKNEDKPEEKSETATDEDLQSTEEVPANENTENNQHEI

SEQ ID NO: 1641435 - protein, 111 aa, Staphylococcus aureus
NQSSKTQLTQKDENKNEDKPEEKSETATDEDLQSTEEVPANENTENNQHEIDEITTKDQSDDEINTPNVAEDKSQDDLKDDLKEKQQSSNHHQSTQPKTSPSTETNRQQSF

SEQ ID NO: 1641436 - protein, 16 aa, Staphylococcus aureus
NQTNISDKHVNNARKN

SEQ ID NO: 1641437 - protein, 16 aa, Staphylococcus aureus
NQTQTATQIQTATQTR

SEQ ID NO: 1641438 - protein, 12 aa, Staphylococcus aureus
NQTTNPMLNPDD

SEQ ID NO: 1641439 - protein, 5 aa, Staphylococcus aureus
NQVGN

SEQ ID NO: 1641440 - protein, 6 aa, Staphylococcus aureus
NQVGNK

SEQ ID NO: 1641441 - protein, 22 aa, Staphylococcus aureus
NQYKGKNHSKQRHELKNKRGMH

SEQ ID NO: 1641442 - protein, 9 aa, Staphylococcus aureus
NQYSYQADK

SEQ ID NO: 1641443 - protein, 8 aa, Staphylococcus aureus
NQYTGQNV

SEQ ID NO: 1641444 - protein, 7 aa, Staphylococcus aureus
NRALDGD

SEQ ID NO: 1641445 - protein, 12 aa, Staphylococcus aureus
NRALESARNEKV

SEQ ID NO: 1641446 - protein, 6 aa, Staphylococcus aureus
NRATKN

SEQ ID NO: 1641447 - protein, 20 aa, Staphylococcus aureus
NRATTQVNNTKVALDGDENL

SEQ ID NO: 1641448 - protein, 15 aa, Staphylococcus aureus
NRDSELIELHKSERF

SEQ ID NO: 1641449 - protein, 7 aa, Staphylococcus aureus
NREQIEQ

SEQ ID NO: 1641450 - protein, 6 aa, Staphylococcus aureus
NRETII

SEQ ID NO: 1641451 - protein, 5 aa, Staphylococcus aureus
NRFGT

SEQ ID NO: 1641452 - protein, 5 aa, Staphylococcus aureus
NRGEF

SEQ ID NO: 1641453 - protein, 10 aa, Staphylococcus aureus
NRGKFSDDTA

SEQ ID NO: 1641454 - protein, 10 aa, Staphylococcus aureus
NRGKFSDEGA

SEQ ID NO: 1641455 - protein, 17 aa, Staphylococcus aureus
NRGKKGYEVTNGPGKWT

SEQ ID NO: 1641456 - protein, 14 aa, Staphylococcus aureus
NRGKTPDNAPSEKY

SEQ ID NO: 1641457 - protein, 12 aa, Staphylococcus aureus
NRGVERTNKGAV

SEQ ID NO: 1641458 - protein, 15 aa, Staphylococcus aureus
NRIETLKEQNGRKGY

SEQ ID NO: 1641459 - protein, 11 aa, Staphylococcus aureus
NRINDNAIKGD

SEQ ID NO: 1641460 - protein, 6 aa, Staphylococcus aureus
NRITGK

SEQ ID NO: 1641461 - protein, 9 aa, Staphylococcus aureus
NRKAEDKKK

SEQ ID NO: 1641462 - protein, 10 aa, Staphylococcus aureus
NRKDAKGKAV

SEQ ID NO: 1641463 - protein, 5 aa, Staphylococcus aureus
NRKPY

SEQ ID NO: 1641464 - protein, 8 aa, Staphylococcus aureus
NRLAEKHD

SEQ ID NO: 1641465 - protein, 7 aa, Staphylococcus aureus
NRLTDSE

SEQ ID NO: 1641466 - protein, 44 aa, Staphylococcus aureus
NRNAYSIDEASKAIKEAEKARKAIKEAEKARKARKKEVDKQYED

SEQ ID NO: 1641467 - protein, 21 aa, Staphylococcus aureus
NRNESRGAHYKPEFPERNDEE

SEQ ID NO: 1641468 - protein, 21 aa, Staphylococcus aureus
NRNNIAGDGYSSVKNGDTKAI

SEQ ID NO: 1641469 - protein, 6 aa, Staphylococcus aureus
NRNPGH

SEQ ID NO: 1641470 - protein, 23 aa, Staphylococcus aureus
NRNYTKESKERLARTISQTNDNL

SEQ ID NO: 1641471 - protein, 24 aa, Staphylococcus aureus
NRNYTKESKERLARTISQTNDNLN

SEQ ID NO: 1641472 - protein, 6 aa, Staphylococcus aureus
NRPEHH

SEQ ID NO: 1641473 - protein, 14 aa, Staphylococcus aureus
NRPIQDRPNDKTVE

SEQ ID NO: 1641474 - protein, 12 aa, Staphylococcus aureus
NRRDDRTHTGTI

SEQ ID NO: 1641475 - protein, 16 aa, Staphylococcus aureus
NRRSKTMTKHIYFINH

SEQ ID NO: 1641476 - protein, 27 aa, Staphylococcus aureus
NRSINTNNLTGKVNVNSKELKNYSVEK

SEQ ID NO: 1641477 - protein, 5 aa, Staphylococcus aureus
NRSMS

SEQ ID NO: 1641478 - protein, 17 aa, Staphylococcus aureus
NRTGTTTGKKPASITAY

SEQ ID NO: 1641479 - protein, 5 aa, Staphylococcus aureus
NRTGW

SEQ ID NO: 1641480 - protein, 9 aa, Staphylococcus aureus
NRTKDNVKQ

SEQ ID NO: 1641481 - protein, 5 aa, Staphylococcus aureus
NRTSI

SEQ ID NO: 1641482 - protein, 24 aa, Staphylococcus aureus
NRTSRSSKIERPEVRKSNTNDTDF

SEQ ID NO: 1641483 - protein, 6 aa, Staphylococcus aureus
NRYTDE

SEQ ID NO: 1641484 - protein, 5 aa, Staphylococcus aureus
NSAGS

SEQ ID NO: 1641485 - protein, 14 aa, Staphylococcus aureus
NSARPSYSKKDSIE

SEQ ID NO: 1641486 - protein, 22 aa, Staphylococcus aureus
NSARPSYSKKDSIEVGVFIHEK

SEQ ID NO: 1641487 - protein, 10 aa, Staphylococcus aureus
NSARRVENED

SEQ ID NO: 1641488 - protein, 34 aa, Staphylococcus aureus
NSASSSIKSAVETCNNVSKPDKDESTTVSGNNYA

SEQ ID NO: 1641489 - protein, 19 aa, Staphylococcus aureus
NSASWGNGPQTQKLAESQL

SEQ ID NO: 1641490 - protein, 16 aa, Staphylococcus aureus
NSDLKDFNNTEQHNAD

SEQ ID NO: 1641491 - protein, 7 aa, Staphylococcus aureus
NSDNTNV

SEQ ID NO: 1641492 - protein, 10 aa, Staphylococcus aureus
NSDQINEISN

SEQ ID NO: 1641493 - protein, 7 aa, Staphylococcus aureus
NSEDEEI

SEQ ID NO: 1641494 - protein, 50 aa, Staphylococcus aureus
NSEDEEMLEDTATNDTGASQTTIDEQVEAPMSSNDSEEVTSDSTKTDTNV

SEQ ID NO: 1641495 - protein, 48 aa, Staphylococcus aureus
NSEDEEMLENTATNDTGASQTTIDDQVQAPMSSNDSGEVTSDSTKTDI

SEQ ID NO: 1641496 - protein, 24 aa, Staphylococcus aureus
NSEDNKSLPKLESVRSSLANNSDI

SEQ ID NO: 1641497 - protein, 12 aa, Staphylococcus aureus
NSEDNKTLPKLE

SEQ ID NO: 1641498 - protein, 24 aa, Staphylococcus aureus
NSEDNKTLPKLESVRSSLANNSDI

SEQ ID NO: 1641499 - protein, 8 aa, Staphylococcus aureus
NSEGENVN

SEQ ID NO: 1641500 - protein, 4 aa, Staphylococcus aureus
NSEM

SEQ ID NO: 1641501 - protein, 7 aa, Staphylococcus aureus
NSENDED

SEQ ID NO: 1641502 - protein, 5 aa, Staphylococcus aureus
NSENI

SEQ ID NO: 1641503 - protein, 6 aa, Staphylococcus aureus
NSESDT

SEQ ID NO: 1641504 - protein, 10 aa, Staphylococcus aureus
NSETAESKVN

SEQ ID NO: 1641505 - protein, 10 aa, Staphylococcus aureus
NSIKSDLENH

SEQ ID NO: 1641506 - protein, 47 aa, Staphylococcus aureus
NSIQDNTATKNGQNYLDATESNKTNYNNAVDSANGVINATSNPNMDA

SEQ ID NO: 1641507 - protein, 29 aa, Staphylococcus aureus
NSIQDQQQTEAGSKFINEDKPQKDAYQAA

SEQ ID NO: 1641508 - protein, 29 aa, Staphylococcus aureus
NSIQDQQQTESGSKFINEDKPQKDAYQAA

SEQ ID NO: 1641509 - protein, 8 aa, Staphylococcus aureus
NSITGEES

SEQ ID NO: 1641510 - protein, 14 aa, Staphylococcus aureus
NSKDINKIEVTLKQ

SEQ ID NO: 1641511 - protein, 10 aa, Staphylococcus aureus
NSKDSKNNIG

SEQ ID NO: 1641512 - protein, 6 aa, Staphylococcus aureus
NSKEAL

SEQ ID NO: 1641513 - protein, 9 aa, Staphylococcus aureus
NSKETDTVV

SEQ ID NO: 1641514 - protein, 7 aa, Staphylococcus aureus
NSKHFKS

SEQ ID NO: 1641515 - protein, 6 aa, Staphylococcus aureus
NSKKKF

SEQ ID NO: 1641516 - protein, 7 aa, Staphylococcus aureus
NSKTDLK

SEQ ID NO: 1641517 - protein, 8 aa, Staphylococcus aureus
NSKTPITT

SEQ ID NO: 1641518 - protein, 18 aa, Staphylococcus aureus
NSNSNNKLRIPLSSIVSV

SEQ ID NO: 1641519 - protein, 7 aa, Staphylococcus aureus
NSNTNIR

SEQ ID NO: 1641520 - protein, 18 aa, Staphylococcus aureus
NSNVTIDAATSSGSGLDP

SEQ ID NO: 1641521 - protein, 11 aa, Staphylococcus aureus
NSPGYKAFKTP

SEQ ID NO: 1641522 - protein, 4 aa, Staphylococcus aureus
NSPI

SEQ ID NO: 1641523 - protein, 14 aa, Staphylococcus aureus
NSQLDEQNSKGDNV

SEQ ID NO: 1641524 - protein, 22 aa, Staphylococcus aureus
NSQNEAIEQAGKALVDSGAVTD

SEQ ID NO: 1641525 - protein, 8 aa, Staphylococcus aureus
NSQPLNLQ

SEQ ID NO: 1641526 - protein, 9 aa, Staphylococcus aureus
NSQVSEKSS

SEQ ID NO: 1641527 - protein, 9 aa, Staphylococcus aureus
NSREKREAN

SEQ ID NO: 1641528 - protein, 6 aa, Staphylococcus aureus
NSSIAG

SEQ ID NO: 1641529 - protein, 27 aa, Staphylococcus aureus
NSSNDLNQAQKDALKQQVQNATTVAGV

SEQ ID NO: 1641530 - protein, 8 aa, Staphylococcus aureus
NSSPYETG

SEQ ID NO: 1641531 - protein, 5 aa, Staphylococcus aureus
NSSWG

SEQ ID NO: 1641532 - protein, 7 aa, Staphylococcus aureus
NSSYRRM

SEQ ID NO: 1641533 - protein, 13 aa, Staphylococcus aureus
NSTGFDGNKEYAG

SEQ ID NO: 1641534 - protein, 18 aa, Staphylococcus aureus
NSTGGILGPQDSYLLVRG

SEQ ID NO: 1641535 - protein, 14 aa, Staphylococcus aureus
NSTNRTNNSRERNI

SEQ ID NO: 1641536 - protein, 8 aa, Staphylococcus aureus
NSTRTRTA

SEQ ID NO: 1641537 - protein, 11 aa, Staphylococcus aureus
NSVKQTAQELN

SEQ ID NO: 1641538 - protein, 16 aa, Staphylococcus aureus
NSWPDSIDTNCSRGEW

SEQ ID NO: 1641539 - protein, 5 aa, Staphylococcus aureus
NSYDS

SEQ ID NO: 1641540 - protein, 9 aa, Staphylococcus aureus
NSYGPSKDV

SEQ ID NO: 1641541 - protein, 8 aa, Staphylococcus aureus
NTAGSPID

SEQ ID NO: 1641542 - protein, 10 aa, Staphylococcus aureus
NTAKNDIEVE

SEQ ID NO: 1641543 - protein, 6 aa, Staphylococcus aureus
NTAKPF

SEQ ID NO: 1641544 - protein, 8 aa, Staphylococcus aureus
NTARQKGK

SEQ ID NO: 1641545 - protein, 5 aa, Staphylococcus aureus
NTATN

SEQ ID NO: 1641546 - protein, 6 aa, Staphylococcus aureus
NTAVDN

SEQ ID NO: 1641547 - protein, 4 aa, Staphylococcus aureus
NTCE

SEQ ID NO: 1641548 - protein, 15 aa, Staphylococcus aureus
NTDDQHYEQFTLVDL

SEQ ID NO: 1641549 - protein, 9 aa, Staphylococcus aureus
NTDEKHNEW

SEQ ID NO: 1641550 - protein, 14 aa, Staphylococcus aureus
NTDEQERIINMIMK

SEQ ID NO: 1641551 - protein, 5 aa, Staphylococcus aureus
NTDNY

SEQ ID NO: 1641552 - protein, 6 aa, Staphylococcus aureus
NTDPSY

SEQ ID NO: 1641553 - protein, 12 aa, Staphylococcus aureus
NTEDTPDAKISA

SEQ ID NO: 1641554 - protein, 16 aa, Staphylococcus aureus
NTEDTPDSKISAEYIK

SEQ ID NO: 1641555 - protein, 26 aa, Staphylococcus aureus
NTEIEKSNDYDTQEEKLKNLNSNESY

SEQ ID NO: 1641556 - protein, 6 aa, Staphylococcus aureus
NTENFE

SEQ ID NO: 1641557 - protein, 5 aa, Staphylococcus aureus
NTEQY

SEQ ID NO: 1641558 - protein, 6 aa, Staphylococcus aureus
NTEQYG

SEQ ID NO: 1641559 - protein, 11 aa, Staphylococcus aureus
NTESFKTTNSY

SEQ ID NO: 1641560 - protein, 11 aa, Staphylococcus aureus
NTFKEEGLDPW

SEQ ID NO: 1641561 - protein, 15 aa, Staphylococcus aureus
NTGGKELTQEQIEEA

SEQ ID NO: 1641562 - protein, 4 aa, Staphylococcus aureus
NTGI

SEQ ID NO: 1641563 - protein, 9 aa, Staphylococcus aureus
NTGKAPNTI

SEQ ID NO: 1641564 - protein, 14 aa, Staphylococcus aureus
NTGKSPNTIKAYCY

SEQ ID NO: 1641565 - protein, 7 aa, Staphylococcus aureus
NTGTTGT

SEQ ID NO: 1641566 - protein, 14 aa, Staphylococcus aureus
NTHAKHKNASGNNS

SEQ ID NO: 1641567 - protein, 11 aa, Staphylococcus aureus
NTHKRKSDEPF

SEQ ID NO: 1641568 - protein, 39 aa, Staphylococcus aureus; identical to SEQ ID NO: 1568335

SEQ ID NO: 1641569 - protein, 39 aa, Staphylococcus aureus
NTIKPNSAITITPKAGTGHSASSNPSTLTAPATHTVNTT

SEQ ID NO: 1641570 - protein, 39 aa, Staphylococcus aureus; identical to SEQ ID NO: 1565449

SEQ ID NO: 1641571 - protein, 8 aa, Staphylococcus aureus
NTINANKA

SEQ ID NO: 1641572 - protein, 7 aa, Staphylococcus aureus
NTIPNSK

SEQ ID NO: 1641573 - protein, 16 aa, Staphylococcus aureus
NTKEFPNKLYESKDKN

SEQ ID NO: 1641574 - protein, 8 aa, Staphylococcus aureus
NTKETNTI

SEQ ID NO: 1641575 - protein, 12 aa, Staphylococcus aureus
NTKKLSIRDNGI

SEQ ID NO: 1641576 - protein, 6 aa, Staphylococcus aureus
NTKNFE

SEQ ID NO: 1641577 - protein, 9 aa, Staphylococcus aureus
NTKNTTNWH

SEQ ID NO: 1641578 - protein, 11 aa, Staphylococcus aureus
NTKRPNYSKKE

SEQ ID NO: 1641579 - protein, 5 aa, Staphylococcus aureus
NTKSD

SEQ ID NO: 1641580 - protein, 8 aa, Staphylococcus aureus
NTKTTNGY

SEQ ID NO: 1641581 - protein, 16 aa, Staphylococcus aureus
NTMQAATKPGITTKDL

SEQ ID NO: 1641582 - protein, 5 aa, Staphylococcus aureus
NTMQQ

SEQ ID NO: 1641583 - protein, 9 aa, Staphylococcus aureus
NTNASSTSE

SEQ ID NO: 1641584 - protein, 5 aa, Staphylococcus aureus
NTNGQ

SEQ ID NO: 1641585 - protein, 9 aa, Staphylococcus aureus
NTNKEIKVN

SEQ ID NO: 1641586 - protein, 12 aa, Staphylococcus aureus
NTNKTKKKNMAN

SEQ ID NO: 1641587 - protein, 9 aa, Staphylococcus aureus
NTNLSSVEV

SEQ ID NO: 1641588 - protein, 7 aa, Staphylococcus aureus
NTNPHSA

SEQ ID NO: 1641589 - protein, 7 aa, Staphylococcus aureus
NTNPKSW

SEQ ID NO: 1641590 - protein, 5 aa, Staphylococcus aureus
NTNPL

SEQ ID NO: 1641591 - protein, 19 aa, Staphylococcus aureus
NTNRPQDKGTFIVHDREIN

SEQ ID NO: 1641592 - protein, 9 aa, Staphylococcus aureus
NTNSEEGQS

SEQ ID NO: 1641593 - protein, 6 aa, Staphylococcus aureus
NTNTCS

SEQ ID NO: 1641594 - protein, 24 aa, Staphylococcus aureus
NTNVEKDANTDNINSQDTSYTPQV

SEQ ID NO: 1641595 - protein, 13 aa, Staphylococcus aureus
NTPFADTKKHARD

SEQ ID NO: 1641596 - protein, 14 aa, Staphylococcus aureus
NTPFADTKKHAREH

SEQ ID NO: 1641597 - protein, 6 aa, Staphylococcus aureus
NTPFET

SEQ ID NO: 1641598 - protein, 15 aa, Staphylococcus aureus
NTPIDNSVNTPIDAN

SEQ ID NO: 1641599 - protein, 32 aa, Staphylococcus aureus
NTPIDNSVNTPIDANVKENNTSINNTSNNNIN

SEQ ID NO: 1641600 - protein, 5 aa, Staphylococcus aureus
NTPLG

SEQ ID NO: 1641601 - protein, 7 aa, Staphylococcus aureus
NTPNLVS

SEQ ID NO: 1641602 - protein, 8 aa, Staphylococcus aureus
NTPTETDD

SEQ ID NO: 1641603 - protein, 4 aa, Staphylococcus aureus
NTQD

SEQ ID NO: 1641604 - protein, 12 aa, Staphylococcus aureus
NTQTNEDIETQD

SEQ ID NO: 1641605 - protein, 4 aa, Staphylococcus aureus
NTQV

SEQ ID NO: 1641606 - protein, 5 aa, Staphylococcus aureus
NTRPR

SEQ ID NO: 1641607 - protein, 12 aa, Staphylococcus aureus
NTRRKVDAENAK

SEQ ID NO: 1641608 - protein, 6 aa, Staphylococcus aureus
NTRTAK

SEQ ID NO: 1641609 - protein, 7 aa, Staphylococcus aureus
NTRTTTG

SEQ ID NO: 1641610 - protein, 6 aa, Staphylococcus aureus
NTSETI

SEQ ID NO: 1641611 - protein, 27 aa, Staphylococcus aureus
NTSSSGIQTEEKPQIENPSNELPLNPL

SEQ ID NO: 1641612 - protein, 9 aa, Staphylococcus aureus
NTTAVQQDK

SEQ ID NO: 1641613 - protein, 6 aa, Staphylococcus aureus
NTTEFD

SEQ ID NO: 1641614 - protein, 6 aa, Staphylococcus aureus
NTTEIL

SEQ ID NO: 1641615 - protein, 10 aa, Staphylococcus aureus
NTTETKETLN

SEQ ID NO: 1641616 - protein, 17 aa, Staphylococcus aureus
NTTKTRPVEKKATGVMD

SEQ ID NO: 1641617 - protein, 11 aa, Staphylococcus aureus
NTTVEGTELEH

SEQ ID NO: 1641618 - protein, 11 aa, Staphylococcus aureus
NTTYGSGNTAV

SEQ ID NO: 1641619 - protein, 6 aa, Staphylococcus aureus
NTVPKH

SEQ ID NO: 1641620 - protein, 9 aa, Staphylococcus aureus
NTYGPTEAT

SEQ ID NO: 1641621 - protein, 6 aa, Staphylococcus aureus
NTYNDN

SEQ ID NO: 1641622 - protein, 13 aa, Staphylococcus aureus
NTYSKYSKAKLKQ

SEQ ID NO: 1641623 - protein, 7 aa, Staphylococcus aureus
NVDDDSA

SEQ ID NO: 1641624 - protein, 8 aa, Staphylococcus aureus
NVDDDSTL

SEQ ID NO: 1641625 - protein, 10 aa, Staphylococcus aureus
NVDESHLSKG

SEQ ID NO: 1641626 - protein, 20 aa, Staphylococcus aureus
NVDGKVKSVATKHKKSYPQS

SEQ ID NO: 1641627 - protein, 8 aa, Staphylococcus aureus
NVDKDTAR

SEQ ID NO: 1641628 - protein, 6 aa, Staphylococcus aureus
NVDSLP

SEQ ID NO: 1641629 - protein, 6 aa, Staphylococcus aureus
NVEGAQ

SEQ ID NO: 1641630 - protein, 12 aa, Staphylococcus aureus
NVEGSTKIGAKQ

SEQ ID NO: 1641631 - protein, 5 aa, Staphylococcus aureus
NVERR

SEQ ID NO: 1641632 - protein, 7 aa, Staphylococcus aureus
NVETHGI

SEQ ID NO: 1641633 - protein, 5 aa, Staphylococcus aureus
NVEVS

SEQ ID NO: 1641634 - protein, 7 aa, Staphylococcus aureus
NVGPRGI

SEQ ID NO: 1641635 - protein, 4 aa, Staphylococcus aureus
NVGS

SEQ ID NO: 1641636 - protein, 8 aa, Staphylococcus aureus
NVKAGTHI

SEQ ID NO: 1641637 - protein, 6 aa, Staphylococcus aureus
NVKEKA

SEQ ID NO: 1641638 - protein, 12 aa, Staphylococcus aureus
NVKKPFEKDARL

SEQ ID NO: 1641639 - protein, 12 aa, Staphylococcus aureus
NVKQTAQELNNA

SEQ ID NO: 1641640 - protein, 8 aa, Staphylococcus aureus
NVKRDKNK

SEQ ID NO: 1641641 - protein, 12 aa, Staphylococcus aureus
NVKTDRDSSEKI

SEQ ID NO: 1641642 - protein, 19 aa, Staphylococcus aureus
NVKTIDDSRKIREKFNKPK

SEQ ID NO: 1641643 - protein, 20 aa, Staphylococcus aureus
NVKTSAKKPKKYHQCQQVIH

SEQ ID NO: 1641644 - protein, 12 aa, Staphylococcus aureus
NVKTSAKNQKIH

SEQ ID NO: 1641645 - protein, 34 aa, Staphylococcus aureus
NVKTSAKNQKNPPVPASYTPDKNNVPYKKETGYY

SEQ ID NO: 1641646 - protein, 12 aa, Staphylococcus aureus
NVKTTKSDPAKY

SEQ ID NO: 1641647 - protein, 27 aa, Staphylococcus aureus
NVNSTKTALNGDAKLNEAKAAAKQTLG

SEQ ID NO: 1641648 - protein, 18 aa, Staphylococcus aureus
NVNTHGVSTARKVPEIKN

SEQ ID NO: 1641649 - protein, 8 aa, Staphylococcus aureus
NVPTPRTV

SEQ ID NO: 1641650 - protein, 6 aa, Staphylococcus aureus
NVQKKE

SEQ ID NO: 1641651 - protein, 4 aa, Staphylococcus aureus
NVSE

SEQ ID NO: 1641652 - protein, 5 aa, Staphylococcus aureus
NVTDF

SEQ ID NO: 1641653 - protein, 6 aa, Staphylococcus aureus
NVTEES

SEQ ID NO: 1641654 - protein, 15 aa, Staphylococcus aureus
NVTENDNANQSHSVS

SEQ ID NO: 1641655 - protein, 38 aa, Staphylococcus aureus
NVTENDNANQSHSVSLNDTQAVDENNSELNQVDTSTKA

SEQ ID NO: 1641656 - protein, 6 aa, Staphylococcus aureus
NVTETH

SEQ ID NO: 1641657 - protein, 8 aa, Staphylococcus aureus
NVTETHTY

SEQ ID NO: 1641658 - protein, 8 aa, Staphylococcus aureus
NVVGSGDG

SEQ ID NO: 1641659 - protein, 9 aa, Staphylococcus aureus
NVVGSGDGV

SEQ ID NO: 1641660 - protein, 4 aa, Staphylococcus aureus
NVVR

SEQ ID NO: 1641661 - protein, 13 aa, Staphylococcus aureus
NVYHREKDNVAGD

SEQ ID NO: 1641662 - protein, 12 aa, Staphylococcus aureus
NWEEDTPFKDPR

SEQ ID NO: 1641663 - protein, 4 aa, Staphylococcus aureus
NYAI

SEQ ID NO: 1641664 - protein, 21 aa, Staphylococcus aureus
NYAKEGKNLGRPKRNDKNLSD

SEQ ID NO: 1641665 - protein, 6 aa, Staphylococcus aureus
NYDGEN

SEQ ID NO: 1641666 - protein, 9 aa, Staphylococcus aureus
NYDNKPQNL

SEQ ID NO: 1641667 - protein, 10 aa, Staphylococcus aureus
NYDQEDAAVQ

SEQ ID NO: 1641668 - protein, 21 aa, Staphylococcus aureus
NYDQEDAEVQNEMIKGMDTRR

SEQ ID NO: 1641669 - protein, 6 aa, Staphylococcus aureus
NYEADD

SEQ ID NO: 1641670 - protein, 16 aa, Staphylococcus aureus
NYINADDNLKANYDNA

SEQ ID NO: 1641671 - protein, 21 aa, Staphylococcus aureus
NYINADDNLKANYDNAITNAA

SEQ ID NO: 1641672 - protein, 10 aa, Staphylococcus aureus
NYINNEDLSR

SEQ ID NO: 1641673 - protein, 6 aa, Staphylococcus aureus
NYINSS

SEQ ID NO: 1641674 - protein, 4 aa, Staphylococcus aureus
NYIT

SEQ ID NO: 1641675 - protein, 17 aa, Staphylococcus aureus
NYKAKKKELEDLESADQ

SEQ ID NO: 1641676 - protein, 15 aa, Staphylococcus aureus
NYKASDKAKDKLRKN

SEQ ID NO: 1641677 - protein, 18 aa, Staphylococcus aureus
NYKDGDYSYNSEAPTYSA

SEQ ID NO: 1641678 - protein, 39 aa, Staphylococcus aureus
NYKDTHSYKDRLNAQQKVNTLSEGHQKRFNKQIDKVYNG

SEQ ID NO: 1641679 - protein, 10 aa, Staphylococcus aureus
NYKGKKEELA

SEQ ID NO: 1641680 - protein, 16 aa, Staphylococcus aureus
NYKNQTAKINNESNQY

SEQ ID NO: 1641681 - protein, 5 aa, Staphylococcus aureus
NYKRS

SEQ ID NO: 1641682 - protein, 4 aa, Staphylococcus aureus
NYLK

SEQ ID NO: 1641683 - protein, 16 aa, Staphylococcus aureus
NYNEENNTIEISEKDD

SEQ ID NO: 1641684 - protein, 5 aa, Staphylococcus aureus
NYNQM

SEQ ID NO: 1641685 - protein, 12 aa, Staphylococcus aureus
NYPDQSLNYSDD

SEQ ID NO: 1641686 - protein, 14 aa, Staphylococcus aureus
NYPDYDYNQETATD

SEQ ID NO: 1641687 - protein, 11 aa, Staphylococcus aureus
NYPNEVSGGQL

SEQ ID NO: 1641688 - protein, 10 aa, Staphylococcus aureus
NYPRGVSTNG

SEQ ID NO: 1641689 - protein, 11 aa, Staphylococcus aureus
NYPRGVSTNGT

SEQ ID NO: 1641690 - protein, 12 aa, Staphylococcus aureus
NYSDSAKTFDIN

SEQ ID NO: 1641691 - protein, 22 aa, Staphylococcus aureus
NYSEEKDDFYQQGDSEEHSTVA

SEQ ID NO: 1641692 - protein, 11 aa, Staphylococcus aureus
NYSKSEAKKRA

SEQ ID NO: 1641693 - protein, 12 aa, Staphylococcus aureus
NYTNSDDTEKEF

SEQ ID NO: 1641694 - protein, 4 aa, Staphylococcus aureus
NYTQ

SEQ ID NO: 1641695 - protein, 20 aa, Staphylococcus aureus
NYTREGKRLGRPKRDDKNLR

SEQ ID NO: 1641696 - protein, 5 aa, Staphylococcus aureus
PAAQR

SEQ ID NO: 1641697 - protein, 12 aa, Staphylococcus aureus
PADAKPSSVPGE

SEQ ID NO: 1641698 - protein, 8 aa, Staphylococcus aureus
PADSSLAN

SEQ ID NO: 1641699 - protein, 5 aa, Staphylococcus aureus
PAERD

SEQ ID NO: 1641700 - protein, 12 aa, Staphylococcus aureus
PAEVNSTSNSVF

SEQ ID NO: 1641701 - protein, 11 aa, Staphylococcus aureus
PAGDGWDSNPF

SEQ ID NO: 1641702 - protein, 12 aa, Staphylococcus aureus
PAGGVKEQTAGL

SEQ ID NO: 1641703 - protein, 24 aa, Staphylococcus aureus
PAGLTQTGTNTTEDDKDADGGEVD

SEQ ID NO: 1641704 - protein, 20 aa, Staphylococcus aureus
PAHERKSPEKIKEELDKKEG

SEQ ID NO: 1641705 - protein, 10 aa, Staphylococcus aureus
PAHPGTHQYA

SEQ ID NO: 1641706 - protein, 4 aa, Staphylococcus aureus
PAKA

SEQ ID NO: 1641707 - protein, 13 aa, Staphylococcus aureus
PAKAEEKQIFNTF

SEQ ID NO: 1641708 - protein, 6 aa, Staphylococcus aureus
PAKDMT

SEQ ID NO: 1641709 - protein, 10 aa, Staphylococcus aureus
PAKDSDKAIQ

SEQ ID NO: 1641710 - protein, 8 aa, Staphylococcus aureus
PAKEGDDY

SEQ ID NO: 1641711 - protein, 8 aa, Staphylococcus aureus
PAKSELKA

SEQ ID NO: 1641712 - protein, 12 aa, Staphylococcus aureus
PAMSEAPEEAEE

SEQ ID NO: 1641713 - protein, 18 aa, Staphylococcus aureus
PANDVKGNQPLSGELGKG

SEQ ID NO: 1641714 - protein, 20 aa, Staphylococcus aureus
PANQLKSPDEIKEELDKKEG

SEQ ID NO: 1641715 - protein, 8 aa, Staphylococcus aureus
PASPSLRK

SEQ ID NO: 1641716 - protein, 7 aa, Staphylococcus aureus
PASTANL

SEQ ID NO: 1641717 - protein, 6 aa, Staphylococcus aureus
PATGLD

SEQ ID NO: 1641718 - protein, 7 aa, Staphylococcus aureus
PATNTNR

SEQ ID NO: 1641719 - protein, 9 aa, Staphylococcus aureus
PATTNEKEI

SEQ ID NO: 1641720 - protein, 12 aa, Staphylococcus aureus
PAYKDTDVKPAL

SEQ ID NO: 1641721 - protein, 5 aa, Staphylococcus aureus
PCNTK

SEQ ID NO: 1641722 - protein, 7 aa, Staphylococcus aureus
PDAKLDD

SEQ ID NO: 1641723 - protein, 4 aa, Staphylococcus aureus
PDDE

SEQ ID NO: 1641724 - protein, 12 aa, Staphylococcus aureus
PDDETFSSAGTI

SEQ ID NO: 1641725 - protein, 13 aa, Staphylococcus aureus
PDDETLSSAGTLA

SEQ ID NO: 1641726 - protein, 7 aa, Staphylococcus aureus
PDDNNDW

SEQ ID NO: 1641727 - protein, 6 aa, Staphylococcus aureus
PDDTFS

SEQ ID NO: 1641728 - protein, 7 aa, Staphylococcus aureus
PDIRSPI

SEQ ID NO: 1641729 - protein, 12 aa, Staphylococcus aureus
PDKKVKDLTRQQ

SEQ ID NO: 1641730 - protein, 4 aa, Staphylococcus aureus
PDKV

SEQ ID NO: 1641731 - protein, 7 aa, Staphylococcus aureus
PDKYNTT

SEQ ID NO: 1641732 - protein, 8 aa, Staphylococcus aureus
PDLPASKI

SEQ ID NO: 1641733 - protein, 16 aa, Staphylococcus aureus
PDNMSNGQLYKQAGNS

SEQ ID NO: 1641734 - protein, 7 aa, Staphylococcus aureus
PDNPPVN

SEQ ID NO: 1641735 - protein, 4 aa, Staphylococcus aureus
PDPD

SEQ ID NO: 1641736 - protein, 8 aa, Staphylococcus aureus
PDPETNSA

SEQ ID NO: 1641737 - protein, 8 aa, Staphylococcus aureus
PDQNLDTQ

SEQ ID NO: 1641738 - protein, 6 aa, Staphylococcus aureus
PDQVPD

SEQ ID NO: 1641739 - protein, 5 aa, Staphylococcus aureus
PDSEF

SEQ ID NO: 1641740 - protein, 4 aa, Staphylococcus aureus
PDSL

SEQ ID NO: 1641741 - protein, 52 aa, Staphylococcus aureus; identical to SEQ ID NO: 1565739

SEQ ID NO: 1641742 - protein, 7 aa, Staphylococcus aureus
PDSQLNK

SEQ ID NO: 1641743 - protein, 6 aa, Staphylococcus aureus
PDSRSV

SEQ ID NO: 1641744 - protein, 63 aa, Staphylococcus aureus
PEAQEAIKASADNQVESIKDTPHATTDELDEANQQINDTLKQGQQDIDNTTQDAAVNDVRNQT

SEQ ID NO: 1641745 - protein, 6 aa, Staphylococcus aureus
PEDEDM

SEQ ID NO: 1641746 - protein, 13 aa, Staphylococcus aureus
PEDIEKNYRSNRG

SEQ ID NO: 1641747 - protein, 7 aa, Staphylococcus aureus
PEEEGTI

SEQ ID NO: 1641748 - protein, 4 aa, Staphylococcus aureus
PEEN

SEQ ID NO: 1641749 - protein, 16 aa, Staphylococcus aureus
PEEPTEDMDQETKDGW

SEQ ID NO: 1641750 - protein, 12 aa, Staphylococcus aureus
PEGLEGTREVSQ

SEQ ID NO: 1641751 - protein, 6 aa, Staphylococcus aureus
PEGNSI

SEQ ID NO: 1641752 - protein, 23 aa, Staphylococcus aureus
PEGPILNPDTKYDSHGVYSGSAF

SEQ ID NO: 1641753 - protein, 4 aa, Staphylococcus aureus
PEGQ

SEQ ID NO: 1641754 - protein, 18 aa, Staphylococcus aureus
PEHKHKYKDIENGLKGEE

SEQ ID NO: 1641755 - protein, 13 aa, Staphylococcus aureus
PEIGIEPGRSIVG

SEQ ID NO: 1641756 - protein, 8 aa, Staphylococcus aureus
PEIKKSMK

SEQ ID NO: 1641757 - protein, 11 aa, Staphylococcus aureus
PEIKSTDGQVM

SEQ ID NO: 1641758 - protein, 10 aa, Staphylococcus aureus
PEIRSPKEAY

SEQ ID NO: 1641759 - protein, 5 aa, Staphylococcus aureus
PEKLQ

SEQ ID NO: 1641760 - protein, 11 aa, Staphylococcus aureus
PEKSMQIQNDL

SEQ ID NO: 1641761 - protein, 13 aa, Staphylococcus aureus
PELAEDRGIHEGA

SEQ ID NO: 1641762 - protein, 8 aa, Staphylococcus aureus
PELATRSE

SEQ ID NO: 1641763 - protein, 11 aa, Staphylococcus aureus
PELKTGSGIDW

SEQ ID NO: 1641764 - protein, 8 aa, Staphylococcus aureus
PEMSDPSM

SEQ ID NO: 1641765 - protein, 9 aa, Staphylococcus aureus
PENFKGANA

SEQ ID NO: 1641766 - protein, 23 aa, Staphylococcus aureus
PENPKSVSEIKKEQSNKKDKKKD

SEQ ID NO: 1641767 - protein, 7 aa, Staphylococcus aureus
PENTTAL

SEQ ID NO: 1641768 - protein, 6 aa, Staphylococcus aureus
PEQLEE

SEQ ID NO: 1641769 - protein, 6 aa, Staphylococcus aureus
PERNSI

SEQ ID NO: 1641770 - protein, 17 aa, Staphylococcus aureus
PERTKEHITSNGETKMP

SEQ ID NO: 1641771 - protein, 9 aa, Staphylococcus aureus
PERVAQKVT

SEQ ID NO: 1641772 - protein, 4 aa, Staphylococcus aureus
PETD

SEQ ID NO: 1641773 - protein, 39 aa, Staphylococcus aureus
PETKIKPAAREKINQKANELRAQINQDKEATAEERQAAL

SEQ ID NO: 1641774 - protein, 5 aa, Staphylococcus aureus
PETLS

SEQ ID NO: 1641775 - protein, 5 aa, Staphylococcus aureus
PETNS

SEQ ID NO: 1641776 - protein, 6 aa, Staphylococcus aureus
PETQET

SEQ ID NO: 1641777 - protein, 7 aa, Staphylococcus aureus
PETSEYP

SEQ ID NO: 1641778 - protein, 26 aa, Staphylococcus aureus
PETTSISGEKVWDDKDNQDGKRPEKV

SEQ ID NO: 1641779 - protein, 8 aa, Staphylococcus aureus
PEVPSYSA

SEQ ID NO: 1641780 - protein, 15 aa, Staphylococcus aureus
PEYQTTNAPKTATVT

SEQ ID NO: 1641781 - protein, 13 aa, Staphylococcus aureus
PFAPGCPGSPLSP

SEQ ID NO: 1641782 - protein, 7 aa, Staphylococcus aureus
PFDADAV

SEQ ID NO: 1641783 - protein, 4 aa, Staphylococcus aureus
PFES

SEQ ID NO: 1641784 - protein, 9 aa, Staphylococcus aureus
PFGEAYESI

SEQ ID NO: 1641785 - protein, 5 aa, Staphylococcus aureus
PFGGG

SEQ ID NO: 1641786 - protein, 6 aa, Staphylococcus aureus
PFKDNS

SEQ ID NO: 1641787 - protein, 13 aa, Staphylococcus aureus
PFKLKTKKDIEKI

SEQ ID NO: 1641788 - protein, 15 aa, Staphylococcus aureus
PFKTASIEVEKVEVV

SEQ ID NO: 1641789 - protein, 25 aa, Staphylococcus aureus
PFNADGTWGKKTKTRTQYDENGNAI

SEQ ID NO: 1641790 - protein, 4 aa, Staphylococcus aureus
PFPT

SEQ ID NO: 1641791 - protein, 17 aa, Staphylococcus aureus
PGANQTVNTHAGNVTTY

SEQ ID NO: 1641792 - protein, 17 aa, Staphylococcus aureus
PGASITTTSSVQGYHPS

SEQ ID NO: 1641793 - protein, 13 aa, Staphylococcus aureus
PGCAKTGSFNSFC

SEQ ID NO: 1641794 - protein, 9 aa, Staphylococcus aureus
PGDINQKVE

SEQ ID NO: 1641795 - protein, 15 aa, Staphylococcus aureus
PGEPKGIIYETSLII

SEQ ID NO: 1641796 - protein, 7 aa, Staphylococcus aureus
PGFQGTK

SEQ ID NO: 1641797 - protein, 6 aa, Staphylococcus aureus
PGIGKS

SEQ ID NO: 1641798 - protein, 6 aa, Staphylococcus aureus
PGIGSL

SEQ ID NO: 1641799 - protein, 5 aa, Staphylococcus aureus
PGIPY

SEQ ID NO: 1641800 - protein, 27 aa, Staphylococcus aureus
PGIRPKGASQNDQHRITTSEEARQLGS

SEQ ID NO: 1641801 - protein, 4 aa, Staphylococcus aureus
PGKL

SEQ ID NO: 1641802 - protein, 9 aa, Staphylococcus aureus
PGKPFGENG

SEQ ID NO: 1641803 - protein, 15 aa, Staphylococcus aureus
PGMKGAEATVKGAYK

SEQ ID NO: 1641804 - protein, 13 aa, Staphylococcus aureus
PGNPLMAHQIDEY

SEQ ID NO: 1641805 - protein, 6 aa, Staphylococcus aureus
PGQSGF

SEQ ID NO: 1641806 - protein, 7 aa, Staphylococcus aureus
PGQSSFS

SEQ ID NO: 1641807 - protein, 13 aa, Staphylococcus aureus
PGSHDSGSFTLTD

SEQ ID NO: 1641808 - protein, 14 aa, Staphylococcus aureus
PGSNKEGRRYSPFT

SEQ ID NO: 1641809 - protein, 21 aa, Staphylococcus aureus
PGSPPDLLHPPQGDAFARRSQ

SEQ ID NO: 1641810 - protein, 12 aa, Staphylococcus aureus
PGTHGSTFGGNP

SEQ ID NO: 1641811 - protein, 16 aa, Staphylococcus aureus
PGTKTKNSKRDVEVNP

SEQ ID NO: 1641812 - protein, 31 aa, Staphylococcus aureus
PGTTTLNDMPSTNTKNDKSFVGGTKLNNKYA

SEQ ID NO: 1641813 - protein, 5 aa, Staphylococcus aureus
PGTVD

SEQ ID NO: 1641814 - protein, 5 aa, Staphylococcus aureus
PGTVN

SEQ ID NO: 1641815 - protein, 4 aa, Staphylococcus aureus
PGYR

SEQ ID NO: 1641816 - protein, 10 aa, Staphylococcus aureus
PHATSNNEDF

SEQ ID NO: 1641817 - protein, 5 aa, Staphylococcus aureus
PHDYG

SEQ ID NO: 1641818 - protein, 7 aa, Staphylococcus aureus
PHEGDTI

SEQ ID NO: 1641819 - protein, 8 aa, Staphylococcus aureus
PHGDTQLR

SEQ ID NO: 1641820 - protein, 5 aa, Staphylococcus aureus
PHGDY

SEQ ID NO: 1641821 - protein, 10 aa, Staphylococcus aureus
PHGKEPADYT

SEQ ID NO: 1641822 - protein, 4 aa, Staphylococcus aureus
PHSK

SEQ ID NO: 1641823 - protein, 6 aa, Staphylococcus aureus
PHTPTI

SEQ ID NO: 1641824 - protein, 6 aa, Staphylococcus aureus
PHVKEE

SEQ ID NO: 1641825 - protein, 6 aa, Staphylococcus aureus
PIDKNN

SEQ ID NO: 1641826 - protein, 8 aa, Staphylococcus aureus
PIDNKSEF

SEQ ID NO: 1641827 - protein, 11 aa, Staphylococcus aureus
PIEKNLPPKLE

SEQ ID NO: 1641828 - protein, 5 aa, Staphylococcus aureus
PIEQQ

SEQ ID NO: 1641829 - protein, 4 aa, Staphylococcus aureus
PIES

SEQ ID NO: 1641830 - protein, 27 aa, Staphylococcus aureus
PIETLEDEGLKSTLKESKGLGTPATRA

SEQ ID NO: 1641831 - protein, 12 aa, Staphylococcus aureus
PIGTDKTENSIY

SEQ ID NO: 1641832 - protein, 5 aa, Staphylococcus aureus
PIKRR

SEQ ID NO: 1641833 - protein, 6 aa, Staphylococcus aureus
PIPERQ

SEQ ID NO: 1641834 - protein, 8 aa, Staphylococcus aureus
PIPQTKTP

SEQ ID NO: 1641835 - protein, 12 aa, Staphylococcus aureus
PIQASTKKNELQ

SEQ ID NO: 1641836 - protein, 7 aa, Staphylococcus aureus
PISRNES

SEQ ID NO: 1641837 - protein, 14 aa, Staphylococcus aureus
PISTDNASWRGPNI

SEQ ID NO: 1641838 - protein, 21 aa, Staphylococcus aureus
PISTGNGSWRGPNTEKLEPQF

SEQ ID NO: 1641839 - protein, 20 aa, Staphylococcus aureus
PITKSDNPVESYHKIKESWL

SEQ ID NO: 1641840 - protein, 20 aa, Staphylococcus aureus
PITQSANPVESYHKIKESWL

SEQ ID NO: 1641841 - protein, 8 aa, Staphylococcus aureus
PKAHKKSG

SEQ ID NO: 1641842 - protein, 15 aa, Staphylococcus aureus
PKASDDKEVKKCRTS

SEQ ID NO: 1641843 - protein, 7 aa, Staphylococcus aureus
PKDKSLL

SEQ ID NO: 1641844 - protein, 9 aa, Staphylococcus aureus
PKDSNGLKE

SEQ ID NO: 1641845 - protein, 10 aa, Staphylococcus aureus
PKDSYQLSED

SEQ ID NO: 1641846 - protein, 7 aa, Staphylococcus aureus
PKEEALQ

SEQ ID NO: 1641847 - protein, 56 aa, Staphylococcus aureus
PKEEPKSKPVVEPMAPKKQPETKPMTEKPITVPKAEPVEQKHRPSRQDNSDEIRRQ

SEQ ID NO: 1641848 - protein, 10 aa, Staphylococcus aureus
PKEISKNDNR

SEQ ID NO: 1641849 - protein, 12 aa, Staphylococcus aureus
PKEKYSESKSRI

SEQ ID NO: 1641850 - protein, 7 aa, Staphylococcus aureus
PKGAQTK

SEQ ID NO: 1641851 - protein, 6 aa, Staphylococcus aureus
PKGDDY

SEQ ID NO: 1641852 - protein, 9 aa, Staphylococcus aureus
PKGKNMETR

SEQ ID NO: 1641853 - protein, 16 aa, Staphylococcus aureus
PKGNVEEPEHDGSAEW

SEQ ID NO: 1641854 - protein, 12 aa, Staphylococcus aureus
PKGTDFKNISDD

SEQ ID NO: 1641855 - protein, 8 aa, Staphylococcus aureus
PKIPNTVT

SEQ ID NO: 1641856 - protein, 11 aa, Staphylococcus aureus
PKKFDSKAAYE

SEQ ID NO: 1641857 - protein, 27 aa, Staphylococcus aureus
PKKLENGRIPVSKPSEKVESDKQNYDK

SEQ ID NO: 1641858 - protein, 28 aa, Staphylococcus aureus
PKKLENGRIPVSKPSEKVESNKQKYDKY

SEQ ID NO: 1641859 - protein, 6 aa, Staphylococcus aureus
PKKVKI

SEQ ID NO: 1641860 - protein, 4 aa, Staphylococcus aureus
PKKY

SEQ ID NO: 1641861 - protein, 10 aa, Staphylococcus aureus
PKKYDGEVSD

SEQ ID NO: 1641862 - protein, 13 aa, Staphylococcus aureus
PKLTKMGDGLKSI

SEQ ID NO: 1641863 - protein, 15 aa, Staphylococcus aureus
PKNENIQTQQKQILN

SEQ ID NO: 1641864 - protein, 23 aa, Staphylococcus aureus
PKNKYKSDIQSAIDETAKYPVKD

SEQ ID NO: 1641865 - protein, 36 aa, Staphylococcus aureus
PKNNNQQPNNNYQQQGQTQSGNNPFDNNADSIEDLP

SEQ ID NO: 1641866 - protein, 36 aa, Staphylococcus aureus
PKNNNQQQKNNYQQQRQTQTGNNPFDNTEEDFSDLP

SEQ ID NO: 1641867 - protein, 8 aa, Staphylococcus aureus
PKNPDKHL

SEQ ID NO: 1641868 - protein, 8 aa, Staphylococcus aureus
PKNTENNI

SEQ ID NO: 1641869 - protein, 51 aa, Staphylococcus aureus
PKNTNDNQQDLYKQQAQQSHGQSQYPYNKPVKDNPFANANDPIEIDDDDLP

SEQ ID NO: 1641870 - protein, 17 aa, Staphylococcus aureus
PKPKVNSSLIRLNRKKS

SEQ ID NO: 1641871 - protein, 4 aa, Staphylococcus aureus
PKPT

SEQ ID NO: 1641872 - protein, 13 aa, Staphylococcus aureus
PKREETTTYHQQK

SEQ ID NO: 1641873 - protein, 10 aa, Staphylococcus aureus
PKTESSIGKI

SEQ ID NO: 1641874 - protein, 7 aa, Staphylococcus aureus
PKTITNN

SEQ ID NO: 1641875 - protein, 9 aa, Staphylococcus aureus
PKTITVDRG

SEQ ID NO: 1641876 - protein, 6 aa, Staphylococcus aureus
PKVCTP

SEQ ID NO: 1641877 - protein, 11 aa, Staphylococcus aureus
PKYANKSKAKE

SEQ ID NO: 1641878 - protein, 5 aa, Staphylococcus aureus
PKYPD

SEQ ID NO: 1641879 - protein, 7 aa, Staphylococcus aureus
PKYQSLA

SEQ ID NO: 1641880 - protein, 19 aa, Staphylococcus aureus
PKYSRDSEQAAYDKGYKQA

SEQ ID NO: 1641881 - protein, 4 aa, Staphylococcus aureus
PLDP

SEQ ID NO: 1641882 - protein, 8 aa, Staphylococcus aureus
PLGESKPD

SEQ ID NO: 1641883 - protein, 22 aa, Staphylococcus aureus
PLGGASAAEDDFDELDTDDEDF

SEQ ID NO: 1641884 - protein, 8 aa, Staphylococcus aureus
PLKDRDSI

SEQ ID NO: 1641885 - protein, 4 aa, Staphylococcus aureus
PLKQ

SEQ ID NO: 1641886 - protein, 4 aa, Staphylococcus aureus
PLPK

SEQ ID NO: 1641887 - protein, 5 aa, Staphylococcus aureus
PLPNG

SEQ ID NO: 1641888 - protein, 15 aa, Staphylococcus aureus
PLSNNPDAVDGKDPT

SEQ ID NO: 1641889 - protein, 68 aa, Staphylococcus aureus
PLSRKGRNGKPSGSRNRNSKRGNPKFDGKSKRSKGYSNKKKSTKKFDRKEKSSGGSRPMKGRTFADHQ

SEQ ID NO: 1641890 - protein, 13 aa, Staphylococcus aureus
PLTEGTSKKADLN

SEQ ID NO: 1641891 - protein, 5 aa, Staphylococcus aureus
PLTPD

SEQ ID NO: 1641892 - protein, 11 aa, Staphylococcus aureus
PLYNASSGAIG

SEQ ID NO: 1641893 - protein, 16 aa, Staphylococcus aureus
PMAASNTTNTLKDGTK

SEQ ID NO: 1641894 - protein, 4 aa, Staphylococcus aureus
PMEE

SEQ ID NO: 1641895 - protein, 12 aa, Staphylococcus aureus
PMGSPRPRFRKT

SEQ ID NO: 1641896 - protein, 18 aa, Staphylococcus aureus
PMGSPRPRFRKTGRYAQT

SEQ ID NO: 1641897 - protein, 13 aa, Staphylococcus aureus
PMNGNDEAQKQIT

SEQ ID NO: 1641898 - protein, 13 aa, Staphylococcus aureus
PMNGNDEEQKQIT

SEQ ID NO: 1641899 - protein, 13 aa, Staphylococcus aureus
PMNGNNEAQKQIT

SEQ ID NO: 1641900 - protein, 27 aa, Staphylococcus aureus
PMQSTKSDTPQSPTIKQAQTDITPKYE

SEQ ID NO: 1641901 - protein, 14 aa, Staphylococcus aureus
PNATDEEKQAAVNQ

SEQ ID NO: 1641902 - protein, 8 aa, Staphylococcus aureus
PNDFTQGD

SEQ ID NO: 1641903 - protein, 5 aa, Staphylococcus aureus
PNDIS

SEQ ID NO: 1641904 - protein, 14 aa, Staphylococcus aureus
PNDTSNDTYHSSQY

SEQ ID NO: 1641905 - protein, 5 aa, Staphylococcus aureus
PNEDF

SEQ ID NO: 1641906 - protein, 4 aa, Staphylococcus aureus
PNEF

SEQ ID NO: 1641907 - protein, 8 aa, Staphylococcus aureus
PNETTKDE

SEQ ID NO: 1641908 - protein, 7 aa, Staphylococcus aureus
PNGNISV

SEQ ID NO: 1641909 - protein, 5 aa, Staphylococcus aureus
PNGQF

SEQ ID NO: 1641910 - protein, 13 aa, Staphylococcus aureus
PNGTMGQRWEEDK

SEQ ID NO: 1641911 - protein, 8 aa, Staphylococcus aureus
PNGVSNDD

SEQ ID NO: 1641912 - protein, 9 aa, Staphylococcus aureus
PNHKYSTVQ

SEQ ID NO: 1641913 - protein, 13 aa, Staphylococcus aureus
PNIEAGGKSAYNN

SEQ ID NO: 1641914 - protein, 8 aa, Staphylococcus aureus
PNIKTTNG

SEQ ID NO: 1641915 - protein, 13 aa, Staphylococcus aureus
PNIVDGTDKSLED

SEQ ID NO: 1641916 - protein, 4 aa, Staphylococcus aureus
PNKD

SEQ ID NO: 1641917 - protein, 7 aa, Staphylococcus aureus
PNKDLGA

SEQ ID NO: 1641918 - protein, 7 aa, Staphylococcus aureus
PNKENNY

SEQ ID NO: 1641919 - protein, 4 aa, Staphylococcus aureus
PNKH

SEQ ID NO: 1641920 - protein, 10 aa, Staphylococcus aureus
PNLPKSLNES

SEQ ID NO: 1641921 - protein, 12 aa, Staphylococcus aureus
PNLPSGAESYEG

SEQ ID NO: 1641922 - protein, 8 aa, Staphylococcus aureus
PNNETIKY

SEQ ID NO: 1641923 - protein, 11 aa, Staphylococcus aureus
PNNGKTTSVTV

SEQ ID NO: 1641924 - protein, 4 aa, Staphylococcus aureus
PNNL

SEQ ID NO: 1641925 - protein, 26 aa, Staphylococcus aureus
PNNPDNPNNPDNPDNGDNNNSDNPDA

SEQ ID NO: 1641926 - protein, 27 aa, Staphylococcus aureus
PNNQSLSSVTVTGQVTKGNKPGVNNPT

SEQ ID NO: 1641927 - protein, 14 aa, Staphylococcus aureus
PNPLNDSNPSKGGV

SEQ ID NO: 1641928 - protein, 14 aa, Staphylococcus aureus
PNPLQDSNPSKGGV

SEQ ID NO: 1641929 - protein, 5 aa, Staphylococcus aureus
PNPYN

SEQ ID NO: 1641930 - protein, 4 aa, Staphylococcus aureus
PNQF

SEQ ID NO: 1641931 - protein, 7 aa, Staphylococcus aureus
PNQSIDV

SEQ ID NO: 1641932 - protein, 8 aa, Staphylococcus aureus
PNSITGQQ

SEQ ID NO: 1641933 - protein, 7 aa, Staphylococcus aureus
PNSKLNR

SEQ ID NO: 1641934 - protein, 4 aa, Staphylococcus aureus
PNSQ

SEQ ID NO: 1641935 - protein, 12 aa, Staphylococcus aureus
PNVAAKKIKKRS

SEQ ID NO: 1641936 - protein, 12 aa, Staphylococcus aureus
PNVAAKKIKSSC

SEQ ID NO: 1641937 - protein, 7 aa, Staphylococcus aureus
PNVKEKA

SEQ ID NO: 1641938 - protein, 4 aa, Staphylococcus aureus
PNYE

SEQ ID NO: 1641939 - protein, 6 aa, Staphylococcus aureus
PPEEKG

SEQ ID NO: 1641940 - protein, 14 aa, Staphylococcus aureus
PPELGIEPGRSIVG

SEQ ID NO: 1641941 - protein, 12 aa, Staphylococcus aureus
PPFGRKGTITDK

SEQ ID NO: 1641942 - protein, 4 aa, Staphylococcus aureus
PPGA

SEQ ID NO: 1641943 - protein, 4 aa, Staphylococcus aureus
PPGL

SEQ ID NO: 1641944 - protein, 5 aa, Staphylococcus aureus
PPGTI

SEQ ID NO: 1641945 - protein, 4 aa, Staphylococcus aureus
PPHT

SEQ ID NO: 1641946 - protein, 4 aa, Staphylococcus aureus
PPKD

SEQ ID NO: 1641947 - protein, 9 aa, Staphylococcus aureus
PPKEGDDYS

SEQ ID NO: 1641948 - protein, 4 aa, Staphylococcus aureus
PPKI

SEQ ID NO: 1641949 - protein, 9 aa, Staphylococcus aureus
PPLSPTLTS

SEQ ID NO: 1641950 - protein, 12 aa, Staphylococcus aureus
PPNNKNSKSCNL

SEQ ID NO: 1641951 - protein, 15 aa, Staphylococcus aureus
PPPTSKFSTSQHTQM

SEQ ID NO: 1641952 - protein, 4 aa, Staphylococcus aureus
PPQR

SEQ ID NO: 1641953 - protein, 15 aa, Staphylococcus aureus
PPRKRDYTSKSKGGK

SEQ ID NO: 1641954 - protein, 4 aa, Staphylococcus aureus
PPRS

SEQ ID NO: 1641955 - protein, 4 aa, Staphylococcus aureus
PPRY

SEQ ID NO: 1641956 - protein, 18 aa, Staphylococcus aureus
PPSGRTLSGGLDPASLHK

SEQ ID NO: 1641957 - protein, 17 aa, Staphylococcus aureus
PPSQNIHNEDSMYDAST

SEQ ID NO: 1641958 - protein, 13 aa, Staphylococcus aureus
PPTPENTYRGEEK

SEQ ID NO: 1641959 - protein, 8 aa, Staphylococcus aureus
PPVRPSKI

SEQ ID NO: 1641960 - protein, 17 aa, Staphylococcus aureus
PPYDKGEPFYAYYKNFK

SEQ ID NO: 1641961 - protein, 12 aa, Staphylococcus aureus
PQEKSGVIATSA

SEQ ID NO: 1641962 - protein, 14 aa, Staphylococcus aureus
PQEPSANDSENRNA

SEQ ID NO: 1641963 - protein, 7 aa, Staphylococcus aureus
PQEQTAE

SEQ ID NO: 1641964 - protein, 6 aa, Staphylococcus aureus
PQFTTQ

SEQ ID NO: 1641965 - protein, 8 aa, Staphylococcus aureus
PQFTTQRR

SEQ ID NO: 1641966 - protein, 6 aa, Staphylococcus aureus
PQGGYT

SEQ ID NO: 1641967 - protein, 7 aa, Staphylococcus aureus
PQGTITG

SEQ ID NO: 1641968 - protein, 15 aa, Staphylococcus aureus
PQIQKNNEVRVYCLL

SEQ ID NO: 1641969 - protein, 5 aa, Staphylococcus aureus
PQLDS

SEQ ID NO: 1641970 - protein, 362 aa, Staphylococcus aureus
PQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQLKSETNVASNEADKSPSKADTEVSNKPSTSASSEAKEKMTSTNVSQKDDTATADTNDMQTSVGSVANNKAKDMQTNDTQTSVGPVANNKATQNDGANASPATVSNGSHSM

SEQ ID NO: 1641971 - protein, 9 aa, Staphylococcus aureus
PQSENKKSS

SEQ ID NO: 1641972 - protein, 15 aa, Staphylococcus aureus
PQSPVPINDRGDTVP

SEQ ID NO: 1641973 - protein, 15 aa, Staphylococcus aureus
PQVSMTDSGGRVKPL

SEQ ID NO: 1641974 - protein, 21 aa, Staphylococcus aureus
PQVSMTDSGGRVKPLPVQNPA

SEQ ID NO: 1641975 - protein, 12 aa, Staphylococcus aureus
PRDKNAAKQRAL

SEQ ID NO: 1641976 - protein, 24 aa, Staphylococcus aureus
PRDRNGEFKQQTVPAYRRTNDTLE

SEQ ID NO: 1641977 - protein, 10 aa, Staphylococcus aureus
PRDSSPTRLT

SEQ ID NO: 1641978 - protein, 6 aa, Staphylococcus aureus
PRGKAD

SEQ ID NO: 1641979 - protein, 7 aa, Staphylococcus aureus
PRIGTPA

SEQ ID NO: 1641980 - protein, 7 aa, Staphylococcus aureus
PRIPKGR

SEQ ID NO: 1641981 - protein, 20 aa, Staphylococcus aureus
PRNGENLGLPEKNSLSPATE

SEQ ID NO: 1641982 - protein, 8 aa, Staphylococcus aureus
PRTRDGHF

SEQ ID NO: 1641983 - protein, 9 aa, Staphylococcus aureus
PRTRDGHFS

SEQ ID NO: 1641984 - protein, 22 aa, Staphylococcus aureus
PRYKSKKGWYKDKPPKEKGGMP

SEQ ID NO: 1641985 - protein, 24 aa, Staphylococcus aureus
PRYKSKKGWYKDKPPKEKGGMPTE

SEQ ID NO: 1641986 - protein, 17 aa, Staphylococcus aureus
PSDLSQKIGSKKSTITG

SEQ ID NO: 1641987 - protein, 7 aa, Staphylococcus aureus
PSDVYPT

SEQ ID NO: 1641988 - protein, 11 aa, Staphylococcus aureus
PSEKFKRDGDD

SEQ ID NO: 1641989 - protein, 9 aa, Staphylococcus aureus
PSEVSGGEL

SEQ ID NO: 1641990 - protein, 7 aa, Staphylococcus aureus
PSGFTTG

SEQ ID NO: 1641991 - protein, 8 aa, Staphylococcus aureus
PSGYDSEQ

SEQ ID NO: 1641992 - protein, 7 aa, Staphylococcus aureus
PSIKAED

SEQ ID NO: 1641993 - protein, 4 aa, Staphylococcus aureus
PSKE

SEQ ID NO: 1641994 - protein, 8 aa, Staphylococcus aureus
PSKSLADS

SEQ ID NO: 1641995 - protein, 24 aa, Staphylococcus aureus
PSKTNAYNVTTHADGTATYGPRVT

SEQ ID NO: 1641996 - protein, 14 aa, Staphylococcus aureus
PSLEKDGTFTNTER

SEQ ID NO: 1641997 - protein, 7 aa, Staphylococcus aureus
PSLKSIE

SEQ ID NO: 1641998 - protein, 4 aa, Staphylococcus aureus
PSLP

SEQ ID NO: 1641999 - protein, 6 aa, Staphylococcus aureus
PSMKDR

SEQ ID NO: 1642000 - protein, 24 aa, Staphylococcus aureus
PSNGFGGQPVTNSNVRANHSNSTV

SEQ ID NO: 1642001 - protein, 23 aa, Staphylococcus aureus
PSNGYGGQPVTNSNTRANHSNAT

SEQ ID NO: 1642002 - protein, 17 aa, Staphylococcus aureus
PSNKEQQKIGEFFIKLD

SEQ ID NO: 1642003 - protein, 4 aa, Staphylococcus aureus
PSNY

SEQ ID NO: 1642004 - protein, 6 aa, Staphylococcus aureus
PSPKYK

SEQ ID NO: 1642005 - protein, 5 aa, Staphylococcus aureus
PSPQP

SEQ ID NO: 1642006 - protein, 9 aa, Staphylococcus aureus
PSQETAEGK

SEQ ID NO: 1642007 - protein, 4 aa, Staphylococcus aureus
PSQI

SEQ ID NO: 1642008 - protein, 7 aa, Staphylococcus aureus
PSQLSYQ

SEQ ID NO: 1642009 - protein, 8 aa, Staphylococcus aureus
PSSPPHDL

SEQ ID NO: 1642010 - protein, 6 aa, Staphylococcus aureus
PSTTHP

SEQ ID NO: 1642011 - protein, 8 aa, Staphylococcus aureus
PSVSTDEE

SEQ ID NO: 1642012 - protein, 5 aa, Staphylococcus aureus
PSYAP

SEQ ID NO: 1642013 - protein, 6 aa, Staphylococcus aureus
PSYGKF

SEQ ID NO: 1642014 - protein, 45 aa, Staphylococcus aureus
PTAKTTTNQQQMDNKWTTNQQQINTNKNVKNGDNVKNGENEKKKV

SEQ ID NO: 1642015 - protein, 9 aa, Staphylococcus aureus
PTAYNPNAY

SEQ ID NO: 1642016 - protein, 27 aa, Staphylococcus aureus
PTDEDDADAKQKKERYTKPDAKAIGTL

SEQ ID NO: 1642017 - protein, 11 aa, Staphylococcus aureus
PTDVTKKEEVD

SEQ ID NO: 1642018 - protein, 7 aa, Staphylococcus aureus
PTDVTRN

SEQ ID NO: 1642019 - protein, 11 aa, Staphylococcus aureus
PTFNKEGANQI

SEQ ID NO: 1642020 - protein, 17 aa, Staphylococcus aureus
PTGSQMGKKETTKDTAR

SEQ ID NO: 1642021 - protein, 5 aa, Staphylococcus aureus
PTIDE

SEQ ID NO: 1642022 - protein, 5 aa, Staphylococcus aureus
PTIEN

SEQ ID NO: 1642023 - protein, 12 aa, Staphylococcus aureus
PTIGTISTNQRD

SEQ ID NO: 1642024 - protein, 7 aa, Staphylococcus aureus
PTINSDF

SEQ ID NO: 1642025 - protein, 6 aa, Staphylococcus aureus
PTKEPF

SEQ ID NO: 1642026 - protein, 4 aa, Staphylococcus aureus
PTKK

SEQ ID NO: 1642027 - protein, 6 aa, Staphylococcus aureus
PTKKTI

SEQ ID NO: 1642028 - protein, 4 aa, Staphylococcus aureus
PTKN

SEQ ID NO: 1642029 - protein, 21 aa, Staphylococcus aureus
PTKRISKGNSTDNASWRGPNI

SEQ ID NO: 1642030 - protein, 10 aa, Staphylococcus aureus
PTLESNSKSK

SEQ ID NO: 1642031 - protein, 22 aa, Staphylococcus aureus
PTLNAPDISSITGNLSNLGGNI

SEQ ID NO: 1642032 - protein, 24 aa, Staphylococcus aureus
PTLSTGTLAGKGVATDNSGSLTQP

SEQ ID NO: 1642033 - protein, 19 aa, Staphylococcus aureus
PTNANTNAFRPGGAQQLNE

SEQ ID NO: 1642034 - protein, 11 aa, Staphylococcus aureus
PTNDTMRKIPG

SEQ ID NO: 1642035 - protein, 8 aa, Staphylococcus aureus
PTNTASSQ

SEQ ID NO: 1642036 - protein, 11 aa, Staphylococcus aureus
PTPDKAEDNEF

SEQ ID NO: 1642037 - protein, 12 aa, Staphylococcus aureus
PTPDKAEDNEFF

SEQ ID NO: 1642038 - protein, 11 aa, Staphylococcus aureus
PTPRATTPYQQ

SEQ ID NO: 1642039 - protein, 17 aa, Staphylococcus aureus
PTQRISKKEILQAMQVG

SEQ ID NO: 1642040 - protein, 23 aa, Staphylococcus aureus
PTQRISKRNSTGNASWGWAPTQK

SEQ ID NO: 1642041 - protein, 9 aa, Staphylococcus aureus
PTRNEFETD

SEQ ID NO: 1642042 - protein, 5 aa, Staphylococcus aureus
PTSED

SEQ ID NO: 1642043 - protein, 12 aa, Staphylococcus aureus
PTSQEGKWANQK

SEQ ID NO: 1642044 - protein, 5 aa, Staphylococcus aureus
PTSSI

SEQ ID NO: 1642045 - protein, 10 aa, Staphylococcus aureus
PTSSIVGRGL

SEQ ID NO: 1642046 - protein, 13 aa, Staphylococcus aureus
PTTKQVPTEINPK

SEQ ID NO: 1642047 - protein, 6 aa, Staphylococcus aureus
PTTTHK

SEQ ID NO: 1642048 - protein, 9 aa, Staphylococcus aureus
PTVEEKEVS

SEQ ID NO: 1642049 - protein, 6 aa, Staphylococcus aureus
PTVQQN

SEQ ID NO: 1642050 - protein, 7 aa, Staphylococcus aureus
PTVQQNL

SEQ ID NO: 1642051 - protein, 4 aa, Staphylococcus aureus
PVAS

SEQ ID NO: 1642052 - protein, 7 aa, Staphylococcus aureus
PVGDETL

SEQ ID NO: 1642053 - protein, 22 aa, Staphylococcus aureus
PVGKKTKGIQFDAPDSRYVQDQ

SEQ ID NO: 1642054 - protein, 14 aa, Staphylococcus aureus
PVGKPPKKKKVNEY

SEQ ID NO: 1642055 - protein, 4 aa, Staphylococcus aureus
PVIT

SEQ ID NO: 1642056 - protein, 14 aa, Staphylococcus aureus
PVNIKGEKQHLLSG

SEQ ID NO: 1642057 - protein, 19 aa, Staphylococcus aureus
PVPERTKEHTTSNGETKMP

SEQ ID NO: 1642058 - protein, 23 aa, Staphylococcus aureus
PVPERTKEHTTSNGETKTPDEMT

SEQ ID NO: 1642059 - protein, 11 aa, Staphylococcus aureus
PVQAEKGDTDL

SEQ ID NO: 1642060 - protein, 4 aa, Staphylococcus aureus
PVSP

SEQ ID NO: 1642061 - protein, 14 aa, Staphylococcus aureus
PVTQDQITTQTVTQ

SEQ ID NO: 1642062 - protein, 6 aa, Staphylococcus aureus
PYAGSE

SEQ ID NO: 1642063 - protein, 11 aa, Staphylococcus aureus
PYFQRDTNEWS

SEQ ID NO: 1642064 - protein, 6 aa, Staphylococcus aureus
PYGPKQ

SEQ ID NO: 1642065 - protein, 32 aa, Staphylococcus aureus
PYHPDKTTPAPQPVPKPKDDSDDKEKNNKKVP

SEQ ID NO: 1642066 - protein, 27 aa, Staphylococcus aureus
PYHPEKSTPAPKPEDDSDNNEKNNKKV

SEQ ID NO: 1642067 - protein, 5 aa, Staphylococcus aureus
PYLSD

SEQ ID NO: 1642068 - protein, 7 aa, Staphylococcus aureus
PYNSKKI

SEQ ID NO: 1642069 - protein, 4 aa, Staphylococcus aureus
PYNT

SEQ ID NO: 1642070 - protein, 4 aa, Staphylococcus aureus
PYSN

SEQ ID NO: 1642071 - protein, 4 aa, Staphylococcus aureus
PYVD

SEQ ID NO: 1642072 - protein, 33 aa, Staphylococcus aureus
QAAGQGSTSKNALNGNENLEAAKQQATQSLGSL

SEQ ID NO: 1642073 - protein, 31 aa, Staphylococcus aureus
QAATTVNTTKAALHGDAKLQNDKDHAKQTVS

SEQ ID NO: 1642074 - protein, 7 aa, Staphylococcus aureus
QADGRTG

SEQ ID NO: 1642075 - protein, 12 aa, Staphylococcus aureus
QADVPDQPSFKS

SEQ ID NO: 1642076 - protein, 65 aa, Staphylococcus aureus
QAERYVGDSSLNDDSDLTDNSTDASQLHTNGIENETVSNDENKQASIQNEDTNDTHVDESPYNYE

SEQ ID NO: 1642077 - protein, 64 aa, Staphylococcus aureus
QAERYVGDSSLNDDSDLTDNSTEASQLHTNEIENEAVSNDENKQASIQNEDTNDAHVDESPYNY

SEQ ID NO: 1642078 - protein, 64 aa, Staphylococcus aureus
QAERYVGDSSLNDDSDLTDNSTEASQLHTNGIENEAVSNDENKQPSIQNEDTDDTHVDESPYNY

SEQ ID NO: 1642079 - protein, 5 aa, Staphylococcus aureus
QAESL

SEQ ID NO: 1642080 - protein, 7 aa, Staphylococcus aureus
QAESNYK

SEQ ID NO: 1642081 - protein, 11 aa, Staphylococcus aureus
QAFQQQNSRAF

SEQ ID NO: 1642082 - protein, 6 aa, Staphylococcus aureus
QAGSEV

SEQ ID NO: 1642083 - protein, 32 aa, Staphylococcus aureus
QAHEKSMEQSSYHNQKEQRREQRKLERQISEC

SEQ ID NO: 1642084 - protein, 8 aa, Staphylococcus aureus
QAIEDAES

SEQ ID NO: 1642085 - protein, 7 aa, Staphylococcus aureus
QAIESSD

SEQ ID NO: 1642086 - protein, 32 aa, Staphylococcus aureus
QAINDKTQTLADGNYLNADPDKQNAYKQAVAK

SEQ ID NO: 1642087 - protein, 11 aa, Staphylococcus aureus
QAINDKTQTLT

SEQ ID NO: 1642088 - protein, 19 aa, Staphylococcus aureus
QAIRSQKHTKRTPSSNQLK

SEQ ID NO: 1642089 - protein, 4 aa, Staphylococcus aureus
QAKE

SEQ ID NO: 1642090 - protein, 19 aa, Staphylococcus aureus
QALNGDQNLATAKDKANAF

SEQ ID NO: 1642091 - protein, 18 aa, Staphylococcus aureus
QANEGEKMTTLDGTEREL

SEQ ID NO: 1642092 - protein, 6 aa, Staphylococcus aureus
QANGLV

SEQ ID NO: 1642093 - protein, 7 aa, Staphylococcus aureus
QANQKNI

SEQ ID NO: 1642094 - protein, 10 aa, Staphylococcus aureus
QANYPLNEGQ

SEQ ID NO: 1642095 - protein, 15 aa, Staphylococcus aureus
QAPAIEQKYDTMSKD

SEQ ID NO: 1642096 - protein, 9 aa, Staphylococcus aureus
QAQSDTANY

SEQ ID NO: 1642097 - protein, 10 aa, Staphylococcus aureus
QARHAEPMPN

SEQ ID NO: 1642098 - protein, 19 aa, Staphylococcus aureus
QARKKQVSEKPQVHGKGTN

SEQ ID NO: 1642099 - protein, 20 aa, Staphylococcus aureus
QARKKQVSEKPQVHGKGTNI

SEQ ID NO: 1642100 - protein, 5 aa, Staphylococcus aureus
QARLE

SEQ ID NO: 1642101 - protein, 4 aa, Staphylococcus aureus
QASY

SEQ ID NO: 1642102 - protein, 9 aa, Staphylococcus aureus
QATETGDNG

SEQ ID NO: 1642103 - protein, 28 aa, Staphylococcus aureus
QATLASEDYHDATAQRQNDYNQAVTATN

SEQ ID NO: 1642104 - protein, 11 aa, Staphylococcus aureus
QATPPNQCPNC

SEQ ID NO: 1642105 - protein, 8 aa, Staphylococcus aureus
QATPVEPQ

SEQ ID NO: 1642106 - protein, 6 aa, Staphylococcus aureus
QAVPDG

SEQ ID NO: 1642107 - protein, 16 aa, Staphylococcus aureus
QAVTNNDVKRVETNGI

SEQ ID NO: 1642108 - protein, 20 aa, Staphylococcus aureus
QAVTTAKDNLHGDQKLARDQ

SEQ ID NO: 1642109 - protein, 13 aa, Staphylococcus aureus
QAYHSGDTITGST

SEQ ID NO: 1642110 - protein, 16 aa, Staphylococcus aureus
QAYNETHEDQQLSSQF

SEQ ID NO: 1642111 - protein, 21 aa, Staphylococcus aureus
QCEPDPNFSSVQSANPEDHRA

SEQ ID NO: 1642112 - protein, 5 aa, Staphylococcus aureus
QCPMD

SEQ ID NO: 1642113 - protein, 6 aa, Staphylococcus aureus
QCPMRG

SEQ ID NO: 1642114 - protein, 11 aa, Staphylococcus aureus
QCTTANPKEGL

SEQ ID NO: 1642115 - protein, 13 aa, Staphylococcus aureus
QDAGKSIQSYKNQ

SEQ ID NO: 1642116 - protein, 12 aa, Staphylococcus aureus
QDAPLESYSQVA

SEQ ID NO: 1642117 - protein, 6 aa, Staphylococcus aureus
QDCQKE

SEQ ID NO: 1642118 - protein, 7 aa, Staphylococcus aureus
QDCQKEL

SEQ ID NO: 1642119 - protein, 8 aa, Staphylococcus aureus
QDDGYRIG

SEQ ID NO: 1642120 - protein, 5 aa, Staphylococcus aureus
QDDMK

SEQ ID NO: 1642121 - protein, 9 aa, Staphylococcus aureus
QDEQQEKNE

SEQ ID NO: 1642122 - protein, 5 aa, Staphylococcus aureus
QDGEP

SEQ ID NO: 1642123 - protein, 20 aa, Staphylococcus aureus
QDGTATYEHQSEDDIVTSSV

SEQ ID NO: 1642124 - protein, 34 aa, Staphylococcus aureus
QDGTATYVHQSEDDIVTSSVKSNHPVVPSSNQSI

SEQ ID NO: 1642125 - protein, 34 aa, Staphylococcus aureus
QDGTATYVHQSEDDIVTSSVKSTIPVAQKSNQSI

SEQ ID NO: 1642126 - protein, 6 aa, Staphylococcus aureus
QDGTMD

SEQ ID NO: 1642127 - protein, 28 aa, Staphylococcus aureus
QDIEEKEKAKVKDTGEAYQSLNDNEKMV

SEQ ID NO: 1642128 - protein, 10 aa, Staphylococcus aureus
QDLQINAPTK

SEQ ID NO: 1642129 - protein, 60 aa, Staphylococcus aureus
QDNDDYKKQQTEQLSEQQTEQQSEQKKDNRLNRTLNKTKELKNIKNDKNVKNMKKEKKNY

SEQ ID NO: 1642130 - protein, 6 aa, Staphylococcus aureus
QDNDSV

SEQ ID NO: 1642131 - protein, 6 aa, Staphylococcus aureus
QDNENN

SEQ ID NO: 1642132 - protein, 6 aa, Staphylococcus aureus
QDNNEK

SEQ ID NO: 1642133 - protein, 7 aa, Staphylococcus aureus
QDNPDHN

SEQ ID NO: 1642134 - protein, 7 aa, Staphylococcus aureus
QDNSDHN

SEQ ID NO: 1642135 - protein, 8 aa, Staphylococcus aureus
QDPINGVS

SEQ ID NO: 1642136 - protein, 9 aa, Staphylococcus aureus
QDPTGPAAR

SEQ ID NO: 1642137 - protein, 23 aa, Staphylococcus aureus
QDPTTKGIGDSHQALEYEEPRRK

SEQ ID NO: 1642138 - protein, 9 aa, Staphylococcus aureus
QDQSLDGQI

SEQ ID NO: 1642139 - protein, 5 aa, Staphylococcus aureus
QDREE

SEQ ID NO: 1642140 - protein, 13 aa, Staphylococcus aureus
QDRETIEDYTSRT

SEQ ID NO: 1642141 - protein, 4 aa, Staphylococcus aureus
QDRQ

SEQ ID NO: 1642142 - protein, 22 aa, Staphylococcus aureus
QDRQDSNEILKTPDAADITLPG

SEQ ID NO: 1642143 - protein, 7 aa, Staphylococcus aureus
QDRRQFD

SEQ ID NO: 1642144 - protein, 7 aa, Staphylococcus aureus
QDSYSGE

SEQ ID NO: 1642145 - protein, 7 aa, Staphylococcus aureus
QDTKNAL

SEQ ID NO: 1642146 - protein, 6 aa, Staphylococcus aureus
QDVEPD

SEQ ID NO: 1642147 - protein, 15 aa, Staphylococcus aureus
QDVKTHSEEQRVKAK

SEQ ID NO: 1642148 - protein, 8 aa, Staphylococcus aureus
QDVPAGTV

SEQ ID NO: 1642149 - protein, 52 aa, Staphylococcus aureus
QEASYTSDSVNTDQYQKEEKKPEVQPKDISESQQDEKSQQQDDSFNQNDKDI

SEQ ID NO: 1642150 - protein, 7 aa, Staphylococcus aureus
QEDCPSA

SEQ ID NO: 1642151 - protein, 8 aa, Staphylococcus aureus
QEDEYERM

SEQ ID NO: 1642152 - protein, 29 aa, Staphylococcus aureus
QEDGYEKMKQRELAKNKRKREIQKQGTRK

SEQ ID NO: 1642153 - protein, 17 aa, Staphylococcus aureus
QEDGYSNRINHVTHIEV

SEQ ID NO: 1642154 - protein, 7 aa, Staphylococcus aureus
QEDKIDG

SEQ ID NO: 1642155 - protein, 8 aa, Staphylococcus aureus
QEEKQKVI

SEQ ID NO: 1642156 - protein, 9 aa, Staphylococcus aureus
QEENQERKQ

SEQ ID NO: 1642157 - protein, 12 aa, Staphylococcus aureus
QEEVPEGLIPLL

SEQ ID NO: 1642158 - protein, 17 aa, Staphylococcus aureus
QEFEESVEDQSLDDQDQ

SEQ ID NO: 1642159 - protein, 11 aa, Staphylococcus aureus
QEGDDSILQQG

SEQ ID NO: 1642160 - protein, 10 aa, Staphylococcus aureus
QEGEDERTAI

SEQ ID NO: 1642161 - protein, 8 aa, Staphylococcus aureus
QEGRSKQA

SEQ ID NO: 1642162 - protein, 8 aa, Staphylococcus aureus
QEIDDNDY

SEQ ID NO: 1642163 - protein, 23 aa, Staphylococcus aureus
QEITGNEGRTKGSTNYVNADTQV

SEQ ID NO: 1642164 - protein, 9 aa, Staphylococcus aureus
QEKAKNQMK

SEQ ID NO: 1642165 - protein, 25 aa, Staphylococcus aureus
QEKENELNGNERVAEAKTQAKQTID

SEQ ID NO: 1642166 - protein, 8 aa, Staphylococcus aureus
QEKGKLHP

SEQ ID NO: 1642167 - protein, 9 aa, Staphylococcus aureus
QEKKDLTAE

SEQ ID NO: 1642168 - protein, 6 aa, Staphylococcus aureus
QEKKEM

SEQ ID NO: 1642169 - protein, 9 aa, Staphylococcus aureus
QEKNQERKQ

SEQ ID NO: 1642170 - protein, 12 aa, Staphylococcus aureus
QELKNGKIKDDD

SEQ ID NO: 1642171 - protein, 9 aa, Staphylococcus aureus
QELNPETYA

SEQ ID NO: 1642172 - protein, 15 aa, Staphylococcus aureus
QELTTLGRGGSDTTA

SEQ ID NO: 1642173 - protein, 4 aa, Staphylococcus aureus
QELV

SEQ ID NO: 1642174 - protein, 5 aa, Staphylococcus aureus
QEQCP

SEQ ID NO: 1642175 - protein, 10 aa, Staphylococcus aureus
QEQKDGTIEV

SEQ ID NO: 1642176 - protein, 5 aa, Staphylococcus aureus
QEQVI

SEQ ID NO: 1642177 - protein, 16 aa, Staphylococcus aureus
QESIKQTNQQIEESKE

SEQ ID NO: 1642178 - protein, 7 aa, Staphylococcus aureus
QETDNIS

SEQ ID NO: 1642179 - protein, 30 aa, Staphylococcus aureus
QETDSSDTSYSSDTSYSSDTSYSSDTSYSS

SEQ ID NO: 1642180 - protein, 21 aa, Staphylococcus aureus
QETDTSYTSDSSDTSYKSYTS

SEQ ID NO: 1642181 - protein, 27 aa, Staphylococcus aureus
QETDTSYTSDSSDTSYKSYTSYKSYTS

SEQ ID NO: 1642182 - protein, 5 aa, Staphylococcus aureus
QETFG

SEQ ID NO: 1642183 - protein, 6 aa, Staphylococcus aureus
QETHKE

SEQ ID NO: 1642184 - protein, 7 aa, Staphylococcus aureus
QETHKEM

SEQ ID NO: 1642185 - protein, 9 aa, Staphylococcus aureus
QETKKFQSS

SEQ ID NO: 1642186 - protein, 6 aa, Staphylococcus aureus
QETNTN

SEQ ID NO: 1642187 - protein, 13 aa, Staphylococcus aureus
QETSANAIKAEGA

SEQ ID NO: 1642188 - protein, 13 aa, Staphylococcus aureus
QEVAEESKWTRQK

SEQ ID NO: 1642189 - protein, 13 aa, Staphylococcus aureus
QEVAEQSKWTRQK

SEQ ID NO: 1642190 - protein, 17 aa, Staphylococcus aureus
QEVSPQTVKITGGEEQL

SEQ ID NO: 1642191 - protein, 4 aa, Staphylococcus aureus
QEYD

SEQ ID NO: 1642192 - protein, 5 aa, Staphylococcus aureus
QEYGS

SEQ ID NO: 1642193 - protein, 5 aa, Staphylococcus aureus
QFDDT

SEQ ID NO: 1642194 - protein, 14 aa, Staphylococcus aureus
QFDKDGEDKATKEV

SEQ ID NO: 1642195 - protein, 10 aa, Staphylococcus aureus
QFENPANPEV

SEQ ID NO: 1642196 - protein, 12 aa, Staphylococcus aureus
QFSKKAAELQLD

SEQ ID NO: 1642197 - protein, 19 aa, Staphylococcus aureus
QFTQQDDNHSAEQSAQAFQ

SEQ ID NO: 1642198 - protein, 24 aa, Staphylococcus aureus
QFYKGQKQIAGKPMTKDTAEKVEK

SEQ ID NO: 1642199 - protein, 5 aa, Staphylococcus aureus
QGAFA

SEQ ID NO: 1642200 - protein, 13 aa, Staphylococcus aureus
QGAHANYYPGNSP

SEQ ID NO: 1642201 - protein, 15 aa, Staphylococcus aureus
QGAKPGEGGQLPGTK

SEQ ID NO: 1642202 - protein, 5 aa, Staphylococcus aureus
QGARS

SEQ ID NO: 1642203 - protein, 4 aa, Staphylococcus aureus
QGDD

SEQ ID NO: 1642204 - protein, 8 aa, Staphylococcus aureus
QGDDDKHT

SEQ ID NO: 1642205 - protein, 13 aa, Staphylococcus aureus
QGEKIPRKGGQGM

SEQ ID NO: 1642206 - protein, 11 aa, Staphylococcus aureus
QGENGKITNGN

SEQ ID NO: 1642207 - protein, 4 aa, Staphylococcus aureus
QGEQ

SEQ ID NO: 1642208 - protein, 6 aa, Staphylococcus aureus
QGGINA

SEQ ID NO: 1642209 - protein, 20 aa, Staphylococcus aureus
QGGTIETIKPTTISDPVYEE

SEQ ID NO: 1642210 - protein, 24 aa, Staphylococcus aureus
QGHGKSLSRLGGGIGTRGPGETKL

SEQ ID NO: 1642211 - protein, 34 aa, Staphylococcus aureus
QGIANKAQIKVSENYHDADTDKQTAYDNAVTKAE

SEQ ID NO: 1642212 - protein, 14 aa, Staphylococcus aureus
QGIGNTKQPEDVGD

SEQ ID NO: 1642213 - protein, 5 aa, Staphylococcus aureus
QGIIE

SEQ ID NO: 1642214 - protein, 6 aa, Staphylococcus aureus
QGIIEQ

SEQ ID NO: 1642215 - protein, 13 aa, Staphylococcus aureus
QGIPDNAKYEQVK

SEQ ID NO: 1642216 - protein, 24 aa, Staphylococcus aureus
QGITGNEGRTKGSTNYVNADTQVK

SEQ ID NO: 1642217 - protein, 26 aa, Staphylococcus aureus
QGKIDAETFKEQTHSLHQQSKPISSI

SEQ ID NO: 1642218 - protein, 6 aa, Staphylococcus aureus
QGKPIA

SEQ ID NO: 1642219 - protein, 7 aa, Staphylococcus aureus
QGKTAEL

SEQ ID NO: 1642220 - protein, 7 aa, Staphylococcus aureus
QGKTRGM

SEQ ID NO: 1642221 - protein, 6 aa, Staphylococcus aureus
QGLDIP

SEQ ID NO: 1642222 - protein, 4 aa, Staphylococcus aureus
QGLK

SEQ ID NO: 1642223 - protein, 5 aa, Staphylococcus aureus
QGLTQ

SEQ ID NO: 1642224 - protein, 8 aa, Staphylococcus aureus
QGNIPPSA

SEQ ID NO: 1642225 - protein, 10 aa, Staphylococcus aureus
QGNIPPSALD

SEQ ID NO: 1642226 - protein, 6 aa, Staphylococcus aureus
QGNVYT

SEQ ID NO: 1642227 - protein, 15 aa, Staphylococcus aureus
QGQDFPAGNGSSAAD

SEQ ID NO: 1642228 - protein, 8 aa, Staphylococcus aureus
QGQDNQLL

SEQ ID NO: 1642229 - protein, 13 aa, Staphylococcus aureus
QGQETNQGLATSH

SEQ ID NO: 1642230 - protein, 5 aa, Staphylococcus aureus
QGQHD

SEQ ID NO: 1642231 - protein, 22 aa, Staphylococcus aureus
QGQIKTTKKEYQKTNKELSAVD

SEQ ID NO: 1642232 - protein, 6 aa, Staphylococcus aureus
QGQIQG

SEQ ID NO: 1642233 - protein, 15 aa, Staphylococcus aureus
QGQQTEETRNFIQNM

SEQ ID NO: 1642234 - protein, 4 aa, Staphylococcus aureus
QGRF

SEQ ID NO: 1642235 - protein, 6 aa, Staphylococcus aureus
QGSKDI

SEQ ID NO: 1642236 - protein, 6 aa, Staphylococcus aureus
QGSLTK

SEQ ID NO: 1642237 - protein, 24 aa, Staphylococcus aureus
QGSNGPGRVGGAGNPSNPSGYPTS

SEQ ID NO: 1642238 - protein, 22 aa, Staphylococcus aureus
QGTSNEAINPKNPLRSKNIGDD

SEQ ID NO: 1642239 - protein, 14 aa, Staphylococcus aureus
QGVNQTLDQLDALL

SEQ ID NO: 1642240 - protein, 6 aa, Staphylococcus aureus
QGYESC

SEQ ID NO: 1642241 - protein, 5 aa, Staphylococcus aureus
QGYNT

SEQ ID NO: 1642242 - protein, 20 aa, Staphylococcus aureus
QGYVEENNKSFVKNSNNAMS

SEQ ID NO: 1642243 - protein, 5 aa, Staphylococcus aureus
QHAES

SEQ ID NO: 1642244 - protein, 4 aa, Staphylococcus aureus
QHAQ

SEQ ID NO: 1642245 - protein, 7 aa, Staphylococcus aureus
QHGKMNK

SEQ ID NO: 1642246 - protein, 20 aa, Staphylococcus aureus
QHNEKEKFEFTTEGTWQQRQ

SEQ ID NO: 1642247 - protein, 41 aa, Staphylococcus aureus; identical to SEQ ID NO: 1565744

SEQ ID NO: 1642248 - protein, 4 aa, Staphylococcus aureus
QHQK

SEQ ID NO: 1642249 - protein, 10 aa, Staphylococcus aureus
QHRDKNEDVG

SEQ ID NO: 1642250 - protein, 7 aa, Staphylococcus aureus
QHRDPFQ

SEQ ID NO: 1642251 - protein, 12 aa, Staphylococcus aureus
QHRSYKNENLKI

SEQ ID NO: 1642252 - protein, 8 aa, Staphylococcus aureus
QHSSQDEV

SEQ ID NO: 1642253 - protein, 7 aa, Staphylococcus aureus
QHTPSGF

SEQ ID NO: 1642254 - protein, 9 aa, Staphylococcus aureus
QIDEEIKNE

SEQ ID NO: 1642255 - protein, 12 aa, Staphylococcus aureus
QIDGKSDTPSMT

SEQ ID NO: 1642256 - protein, 8 aa, Staphylococcus aureus
QIDNGDEH

SEQ ID NO: 1642257 - protein, 17 aa, Staphylococcus aureus
QIDQDRSNAQVDKTATL

SEQ ID NO: 1642258 - protein, 4 aa, Staphylococcus aureus
QIEC

SEQ ID NO: 1642259 - protein, 23 aa, Staphylococcus aureus
QIEQAQNVAGVNGVKDKGNTLNT

SEQ ID NO: 1642260 - protein, 5 aa, Staphylococcus aureus
QIEYE

SEQ ID NO: 1642261 - protein, 14 aa, Staphylococcus aureus
QIGAGSSQAHEQEK

SEQ ID NO: 1642262 - protein, 16 aa, Staphylococcus aureus
QIGGEQELKRRAGTEN

SEQ ID NO: 1642263 - protein, 12 aa, Staphylococcus aureus
QIGGITRNEDIY

SEQ ID NO: 1642264 - protein, 13 aa, Staphylococcus aureus
QIKDEEKGREKIR

SEQ ID NO: 1642265 - protein, 7 aa, Staphylococcus aureus
QIKSTEF

SEQ ID NO: 1642266 - protein, 9 aa, Staphylococcus aureus
QINKKSGLR

SEQ ID NO: 1642267 - protein, 4 aa, Staphylococcus aureus
QINN

SEQ ID NO: 1642268 - protein, 7 aa, Staphylococcus aureus
QINPSFS

SEQ ID NO: 1642269 - protein, 4 aa, Staphylococcus aureus
QINY

SEQ ID NO: 1642270 - protein, 10 aa, Staphylococcus aureus
QIPKNYTATQ

SEQ ID NO: 1642271 - protein, 25 aa, Staphylococcus aureus
QIQQTSTEKIETEKTSYLINYMNAV

SEQ ID NO: 1642272 - protein, 25 aa, Staphylococcus aureus
QIQQTSTVKIETEKTSYLINYMNAV

SEQ ID NO: 1642273 - protein, 14 aa, Staphylococcus aureus
QIRKQTRKKRTEIK

SEQ ID NO: 1642274 - protein, 14 aa, Staphylococcus aureus
QISTGNASWRGPNI

SEQ ID NO: 1642275 - protein, 10 aa, Staphylococcus aureus
QKAARSYAEK

SEQ ID NO: 1642276 - protein, 6 aa, Staphylococcus aureus
QKAPIF

SEQ ID NO: 1642277 - protein, 9 aa, Staphylococcus aureus
QKAVQGRGK

SEQ ID NO: 1642278 - protein, 15 aa, Staphylococcus aureus
QKCQKDTSRNVETTR

SEQ ID NO: 1642279 - protein, 36 aa, Staphylococcus aureus
QKDAEKKVAPKVEAPQIQSPQIEKPKAESPKVEVPQ

SEQ ID NO: 1642280 - protein, 46 aa, Staphylococcus aureus
QKDAEKKVAPKVEAPQIQSPQIEKPKVESPKVEVPQIQSPKVEVPQ

SEQ ID NO: 1642281 - protein, 7 aa, Staphylococcus aureus
QKDNQIS

SEQ ID NO: 1642282 - protein, 5 aa, Staphylococcus aureus
QKDPV

SEQ ID NO: 1642283 - protein, 9 aa, Staphylococcus aureus
QKDSRNVEE

SEQ ID NO: 1642284 - protein, 9 aa, Staphylococcus aureus
QKEAAKLAQ

SEQ ID NO: 1642285 - protein, 7 aa, Staphylococcus aureus
QKELAAE

SEQ ID NO: 1642286 - protein, 13 aa, Staphylococcus aureus
QKEQSRNQKKLSS

SEQ ID NO: 1642287 - protein, 6 aa, Staphylococcus aureus
QKERNT

SEQ ID NO: 1642288 - protein, 6 aa, Staphylococcus aureus
QKESPE

SEQ ID NO: 1642289 - protein, 6 aa, Staphylococcus aureus
QKETKI

SEQ ID NO: 1642290 - protein, 14 aa, Staphylococcus aureus
QKEVEKTRKEFTER

SEQ ID NO: 1642291 - protein, 19 aa, Staphylococcus aureus
QKFATEQEDNKGRKQTISG

SEQ ID NO: 1642292 - protein, 12 aa, Staphylococcus aureus
QKFKKREYKRAA

SEQ ID NO: 1642293 - protein, 12 aa, Staphylococcus aureus
QKFNKDNPKKIY

SEQ ID NO: 1642294 - protein, 12 aa, Staphylococcus aureus
QKGKGAGRTAQH

SEQ ID NO: 1642295 - protein, 11 aa, Staphylococcus aureus
QKGTSIDENVS

SEQ ID NO: 1642296 - protein, 20 aa, Staphylococcus aureus
QKGVSITDGAYPEKEEQGTL

SEQ ID NO: 1642297 - protein, 10 aa, Staphylococcus aureus
QKHSNTDSKY

SEQ ID NO: 1642298 - protein, 10 aa, Staphylococcus aureus
QKIKAGHESL

SEQ ID NO: 1642299 - protein, 30 aa, Staphylococcus aureus
QKIKGKNPTWRDSKTKWTISKNKGQPHGGS

SEQ ID NO: 1642300 - protein, 41 aa, Staphylococcus aureus
QKIKNNDFTRKNLTTEGNKTRWSKAKCNNSSKYKGVSWDKK

SEQ ID NO: 1642301 - protein, 12 aa, Staphylococcus aureus
QKKEKVKYKVKF

SEQ ID NO: 1642302 - protein, 13 aa, Staphylococcus aureus
QKKSISMGRSCFS

SEQ ID NO: 1642303 - protein, 6 aa, Staphylococcus aureus
QKKTVQ

SEQ ID NO: 1642304 - protein, 5 aa, Staphylococcus aureus
QKLQY

SEQ ID NO: 1642305 - protein, 17 aa, Staphylococcus aureus
QKLSGEEIAEQTGVSRS

SEQ ID NO: 1642306 - protein, 14 aa, Staphylococcus aureus
QKMETLPENFLPPF

SEQ ID NO: 1642307 - protein, 8 aa, Staphylococcus aureus
QKPKHPQI

SEQ ID NO: 1642308 - protein, 7 aa, Staphylococcus aureus
QKPSGVV

SEQ ID NO: 1642309 - protein, 8 aa, Staphylococcus aureus
QKPSQKKI

SEQ ID NO: 1642310 - protein, 9 aa, Staphylococcus aureus
QKQLREKEA

SEQ ID NO: 1642311 - protein, 4 aa, Staphylococcus aureus
QKQM

SEQ ID NO: 1642312 - protein, 9 aa, Staphylococcus aureus
QKQSNLSDL

SEQ ID NO: 1642313 - protein, 6 aa, Staphylococcus aureus
QKRKGI

SEQ ID NO: 1642314 - protein, 8 aa, Staphylococcus aureus
QKRNGYFE

SEQ ID NO: 1642315 - protein, 12 aa, Staphylococcus aureus
QKRRKVKRELYD

SEQ ID NO: 1642316 - protein, 13 aa, Staphylococcus aureus
QKRVTAQGNAINY

SEQ ID NO: 1642317 - protein, 11 aa, Staphylococcus aureus
QKSENNLTERQ

SEQ ID NO: 1642318 - protein, 8 aa, Staphylococcus aureus
QKSQEDTY

SEQ ID NO: 1642319 - protein, 6 aa, Staphylococcus aureus
QKSTIE

SEQ ID NO: 1642320 - protein, 10 aa, Staphylococcus aureus
QKTDKLSKEK

SEQ ID NO: 1642321 - protein, 24 aa, Staphylococcus aureus
QKTDTSYTSDSSDTSYKSYKSYTS

SEQ ID NO: 1642322 - protein, 13 aa, Staphylococcus aureus
QKTIENILNEIIY

SEQ ID NO: 1642323 - protein, 9 aa, Staphylococcus aureus
QKTPPELSE

SEQ ID NO: 1642324 - protein, 11 aa, Staphylococcus aureus
QKTYSNIEKGI

SEQ ID NO: 1642325 - protein, 4 aa, Staphylococcus aureus
QKVA

SEQ ID NO: 1642326 - protein, 30 aa, Staphylococcus aureus
QKVKGKNPTWRDSKTKWTISKNKGQPHGGS

SEQ ID NO: 1642327 - protein, 8 aa, Staphylococcus aureus
QKVSPNKI

SEQ ID NO: 1642328 - protein, 12 aa, Staphylococcus aureus
QKVTGVPVYVGG

SEQ ID NO: 1642329 - protein, 5 aa, Staphylococcus aureus
QLAQD

SEQ ID NO: 1642330 - protein, 10 aa, Staphylococcus aureus
QLDRSTERGM

SEQ ID NO: 1642331 - protein, 7 aa, Staphylococcus aureus
QLEEEKK

SEQ ID NO: 1642332 - protein, 15 aa, Staphylococcus aureus
QLETNSGGPGKPRNI

SEQ ID NO: 1642333 - protein, 12 aa, Staphylococcus aureus
QLGAKKDKYPID

SEQ ID NO: 1642334 - protein, 5 aa, Staphylococcus aureus
QLGET

SEQ ID NO: 1642335 - protein, 16 aa, Staphylococcus aureus
QLKEQKKKQEEQLSNK

SEQ ID NO: 1642336 - protein, 8 aa, Staphylococcus aureus
QLKESGKA

SEQ ID NO: 1642337 - protein, 4 aa, Staphylococcus aureus
QLKN

SEQ ID NO: 1642338 - protein, 19 aa, Staphylococcus aureus
QLKNEKALKEGSKLAGEGT

SEQ ID NO: 1642339 - protein, 11 aa, Staphylococcus aureus
QLKNEKALKEV

SEQ ID NO: 1642340 - protein, 10 aa, Staphylococcus aureus
QLKNSDYNVE

SEQ ID NO: 1642341 - protein, 29 aa, Staphylococcus aureus
QLKQRDEENAQLQSQMKQAQRSEEIARKQ

SEQ ID NO: 1642342 - protein, 4 aa, Staphylococcus aureus
QLNP

SEQ ID NO: 1642343 - protein, 7 aa, Staphylococcus aureus
QLNPNDT

SEQ ID NO: 1642344 - protein, 6 aa, Staphylococcus aureus
QLNTDD

SEQ ID NO: 1642345 - protein, 9 aa, Staphylococcus aureus
QLPSNEEIG

SEQ ID NO: 1642346 - protein, 22 aa, Staphylococcus aureus
QLQRKDFKETKKFKNKVKKPIV

SEQ ID NO: 1642347 - protein, 5 aa, Staphylococcus aureus
QLTEG

SEQ ID NO: 1642348 - protein, 9 aa, Staphylococcus aureus
QLTKGYQGK

SEQ ID NO: 1642349 - protein, 8 aa, Staphylococcus aureus
QLTNDDYN

SEQ ID NO: 1642350 - protein, 6 aa, Staphylococcus aureus
QLTTGN

SEQ ID NO: 1642351 - protein, 8 aa, Staphylococcus aureus
QLVEQSER

SEQ ID NO: 1642352 - protein, 11 aa, Staphylococcus aureus
QLVKSDLKDNV

SEQ ID NO: 1642353 - protein, 6 aa, Staphylococcus aureus
QMEQNK

SEQ ID NO: 1642354 - protein, 6 aa, Staphylococcus aureus
QMETGE

SEQ ID NO: 1642355 - protein, 12 aa, Staphylococcus aureus
QMGAKKDSYPID

SEQ ID NO: 1642356 - protein, 4 aa, Staphylococcus aureus
QMPP

SEQ ID NO: 1642357 - protein, 6 aa, Staphylococcus aureus
QMQDGD

SEQ ID NO: 1642358 - protein, 8 aa, Staphylococcus aureus
QMRNDGIT

SEQ ID NO: 1642359 - protein, 16 aa, Staphylococcus aureus
QMSRSQKGLAGAGEWE

SEQ ID NO: 1642360 - protein, 4 aa, Staphylococcus aureus
QMTT

SEQ ID NO: 1642361 - protein, 24 aa, Staphylococcus aureus
QNAQSKANTAESNAKLYTDDKFNK

SEQ ID NO: 1642362 - protein, 5 aa, Staphylococcus aureus
QNCTV

SEQ ID NO: 1642363 - protein, 13 aa, Staphylococcus aureus
QNDELTDEEKQAA

SEQ ID NO: 1642364 - protein, 10 aa, Staphylococcus aureus
QNDGVNDGDA

SEQ ID NO: 1642365 - protein, 5 aa, Staphylococcus aureus
QNDKV

SEQ ID NO: 1642366 - protein, 14 aa, Staphylococcus aureus
QNDLQKSLPQIPNL

SEQ ID NO: 1642367 - protein, 7 aa, Staphylococcus aureus
QNDYTDH

SEQ ID NO: 1642368 - protein, 39 aa, Staphylococcus aureus
QNEDTANENRPRINQPDVATNQAVQTSKPMIRKGPNIKL

SEQ ID NO: 1642369 - protein, 4 aa, Staphylococcus aureus
QNFE

SEQ ID NO: 1642370 - protein, 16 aa, Staphylococcus aureus
QNGDYQPTAKAVDGYI

SEQ ID NO: 1642371 - protein, 35 aa, Staphylococcus aureus
QNGINDEAATKAAQKYTDADRDKQTAYNDAVTAAK

SEQ ID NO: 1642372 - protein, 13 aa, Staphylococcus aureus
QNGINDQNTVKQQ

SEQ ID NO: 1642373 - protein, 25 aa, Staphylococcus aureus
QNGINNESQVKSSEKYRDADTNKQQ

SEQ ID NO: 1642374 - protein, 29 aa, Staphylococcus aureus
QNGKQTVYSSDQASDRTLGDFKDKSDKTI

SEQ ID NO: 1642375 - protein, 7 aa, Staphylococcus aureus
QNGSDNV

SEQ ID NO: 1642376 - protein, 17 aa, Staphylococcus aureus
QNGTLDDKNGWRVVVPK

SEQ ID NO: 1642377 - protein, 6 aa, Staphylococcus aureus
QNHADM

SEQ ID NO: 1642378 - protein, 11 aa, Staphylococcus aureus
QNHDDEAVRNA

SEQ ID NO: 1642379 - protein, 35 aa, Staphylococcus aureus
QNIADNATTKQNQNYTDSSPNKKDAYNNAVTTAQG

SEQ ID NO: 1642380 - protein, 10 aa, Staphylococcus aureus
QNINPDNNSF

SEQ ID NO: 1642381 - protein, 6 aa, Staphylococcus aureus
QNIVDD

SEQ ID NO: 1642382 - protein, 4 aa, Staphylococcus aureus
QNKG

SEQ ID NO: 1642383 - protein, 9 aa, Staphylococcus aureus
QNKLKSDEK

SEQ ID NO: 1642384 - protein, 19 aa, Staphylococcus aureus
QNLNGEQRLQEAKDKAIQN

SEQ ID NO: 1642385 - protein, 8 aa, Staphylococcus aureus
QNLPLSDS

SEQ ID NO: 1642386 - protein, 11 aa, Staphylococcus aureus
QNLSEIAAEQV

SEQ ID NO: 1642387 - protein, 4 aa, Staphylococcus aureus
QNMI

SEQ ID NO: 1642388 - protein, 13 aa, Staphylococcus aureus
QNMNAEDPSQKEL

SEQ ID NO: 1642389 - protein, 7 aa, Staphylococcus aureus
QNNDQQG

SEQ ID NO: 1642390 - protein, 15 aa, Staphylococcus aureus
QNNGQPVIKDNDGDI

SEQ ID NO: 1642391 - protein, 15 aa, Staphylococcus aureus
QNNGQPVIKDSDGDI

SEQ ID NO: 1642392 - protein, 7 aa, Staphylococcus aureus
QNNNQQG

SEQ ID NO: 1642393 - protein, 7 aa, Staphylococcus aureus
QNNSISE

SEQ ID NO: 1642394 - protein, 183 aa, Staphylococcus aureus
QNQLTSKIDSNSESLKAIQTSQEAIQEAQASQAKALAESTNKVEKNAVTEDKADSKDSKVAGVNTSTDAKTDTKAENAGDGTATNVDKEDQISATEAIEKASVEQSKNDNAAETSNKEATVDAEAQHDAEQQVAEAHAEASKQATSNDSLEAKAENDSTASQSEMSEPKPQEEKKGFFARLFN

SEQ ID NO: 1642395 - protein, 134 aa, Staphylococcus aureus
QNQLTTKIDSNSESLKAIQTSQEAIQEAQASQAKALAESTNKVENNAVTEDKADSKDSKVAGVYTSTDAKTDTKTENAGDGTATKVDKEDQISATEAIEKASVEQSKNDKAAETSNKEATVDAEAQHDAEQQVA

SEQ ID NO: 1642396 - protein, 11 aa, Staphylococcus aureus
QNQNKNSKKAD

SEQ ID NO: 1642397 - protein, 7 aa, Staphylococcus aureus
QNRDRVD

SEQ ID NO: 1642398 - protein, 5 aa, Staphylococcus aureus
QNRKG

SEQ ID NO: 1642399 - protein, 6 aa, Staphylococcus aureus
QNRKGK

SEQ ID NO: 1642400 - protein, 19 aa, Staphylococcus aureus
QNSGNSTKVSAPGNSNEDF

SEQ ID NO: 1642401 - protein, 4 aa, Staphylococcus aureus
QNSQ

SEQ ID NO: 1642402 - protein, 8 aa, Staphylococcus aureus
QNTIETEE

SEQ ID NO: 1642403 - protein, 7 aa, Staphylococcus aureus
QNTKELK

SEQ ID NO: 1642404 - protein, 9 aa, Staphylococcus aureus
QNTPENREA

SEQ ID NO: 1642405 - protein, 12 aa, Staphylococcus aureus
QNTYEPGSTFKS

SEQ ID NO: 1642406 - protein, 29 aa, Staphylococcus aureus
QNVSSAKNALNGDQNVTNAKNAAKNALNN

SEQ ID NO: 1642407 - protein, 26 aa, Staphylococcus aureus
QNVSSAKNALNGDQNVTNAKNTAKHA

SEQ ID NO: 1642408 - protein, 12 aa, Staphylococcus aureus
QNYHDTPSKDNF

SEQ ID NO: 1642409 - protein, 12 aa, Staphylococcus aureus
QPAKVDEDDEDG

SEQ ID NO: 1642410 - protein, 21 aa, Staphylococcus aureus
QPAQPFERGVSNEKFKAQGGT

SEQ ID NO: 1642411 - protein, 6 aa, Staphylococcus aureus
QPDKKV

SEQ ID NO: 1642412 - protein, 20 aa, Staphylococcus aureus
QPEVTKDKTMHVGERKGGPY

SEQ ID NO: 1642413 - protein, 6 aa, Staphylococcus aureus
QPFTAE

SEQ ID NO: 1642414 - protein, 8 aa, Staphylococcus aureus
QPGTIGTT

SEQ ID NO: 1642415 - protein, 13 aa, Staphylococcus aureus
QPKEFKESELREE

SEQ ID NO: 1642416 - protein, 13 aa, Staphylococcus aureus
QPKKAKREETSVN

SEQ ID NO: 1642417 - protein, 9 aa, Staphylococcus aureus
QPKKTYTKE

SEQ ID NO: 1642418 - protein, 8 aa, Staphylococcus aureus
QPKYSKAC

SEQ ID NO: 1642419 - protein, 5 aa, Staphylococcus aureus
QPLAE

SEQ ID NO: 1642420 - protein, 12 aa, Staphylococcus aureus
QPLITSKNNLYT

SEQ ID NO: 1642421 - protein, 7 aa, Staphylococcus aureus
QPNTKSN

SEQ ID NO: 1642422 - protein, 9 aa, Staphylococcus aureus
QPPAEKDAI

SEQ ID NO: 1642423 - protein, 14 aa, Staphylococcus aureus
QPQHERTQNFLARV

SEQ ID NO: 1642424 - protein, 6 aa, Staphylococcus aureus
QPQNIS

SEQ ID NO: 1642425 - protein, 8 aa, Staphylococcus aureus
QPRNVTKK

SEQ ID NO: 1642426 - protein, 10 aa, Staphylococcus aureus
QPSHDSPANK

SEQ ID NO: 1642427 - protein, 5 aa, Staphylococcus aureus
QPSVK

SEQ ID NO: 1642428 - protein, 8 aa, Staphylococcus aureus
QPTEQRLT

SEQ ID NO: 1642429 - protein, 4 aa, Staphylococcus aureus
QPYA

SEQ ID NO: 1642430 - protein, 12 aa, Staphylococcus aureus
QQDDPSKALGTA

SEQ ID NO: 1642431 - protein, 4 aa, Staphylococcus aureus
QQEK

SEQ ID NO: 1642432 - protein, 20 aa, Staphylococcus aureus
QQERPESIPALTSEKNHNQT

SEQ ID NO: 1642433 - protein, 11 aa, Staphylococcus aureus
QQGFGRTGKWS

SEQ ID NO: 1642434 - protein, 5 aa, Staphylococcus aureus
QQGLP

SEQ ID NO: 1642435 - protein, 13 aa, Staphylococcus aureus
QQGRKESVGNAKM

SEQ ID NO: 1642436 - protein, 9 aa, Staphylococcus aureus
QQHQAISDE

SEQ ID NO: 1642437 - protein, 5 aa, Staphylococcus aureus
QQISH

SEQ ID NO: 1642438 - protein, 33 aa, Staphylococcus aureus
QQKLDDTKTKTHDISQFEPKNAFQSMAKRMFLD

SEQ ID NO: 1642439 - protein, 6 aa, Staphylococcus aureus
QQKRDD

SEQ ID NO: 1642440 - protein, 4 aa, Staphylococcus aureus
QQLG

SEQ ID NO: 1642441 - protein, 45 aa, Staphylococcus aureus
QQLTAELSGVEEALKESPNSKKNKTKRTQLEQQLNSNKRKIDNTI

SEQ ID NO: 1642442 - protein, 10 aa, Staphylococcus aureus
QQNAKLTQQL

SEQ ID NO: 1642443 - protein, 4 aa, Staphylococcus aureus
QQNL

SEQ ID NO: 1642444 - protein, 11 aa, Staphylococcus aureus
QQQAQQSTNQM

SEQ ID NO: 1642445 - protein, 4 aa, Staphylococcus aureus
QQQF

SEQ ID NO: 1642446 - protein, 9 aa, Staphylococcus aureus
QQQHPDDEV

SEQ ID NO: 1642447 - protein, 4 aa, Staphylococcus aureus
QQQQ

SEQ ID NO: 1642448 - protein, 5 aa, Staphylococcus aureus
QQQQL

SEQ ID NO: 1642449 - protein, 13 aa, Staphylococcus aureus
QQRKKNRIIIESS

SEQ ID NO: 1642450 - protein, 6 aa, Staphylococcus aureus
QQRTLD

SEQ ID NO: 1642451 - protein, 5 aa, Staphylococcus aureus
QQRYQ

SEQ ID NO: 1642452 - protein, 8 aa, Staphylococcus aureus
QQSAYESS

SEQ ID NO: 1642453 - protein, 9 aa, Staphylococcus aureus
QQSFTSSQI

SEQ ID NO: 1642454 - protein, 6 aa, Staphylococcus aureus
QQSTMP

SEQ ID NO: 1642455 - protein, 21 aa, Staphylococcus aureus
QQSTTVAEAQGNDQKANNVDA

SEQ ID NO: 1642456 - protein, 5 aa, Staphylococcus aureus
QQSVQ

SEQ ID NO: 1642457 - protein, 9 aa, Staphylococcus aureus
QQTAKAEHN

SEQ ID NO: 1642458 - protein, 21 aa, Staphylococcus aureus
QQTAKAEHNVKQVQNTNISPY

SEQ ID NO: 1642459 - protein, 8 aa, Staphylococcus aureus
QQVDQSKV

SEQ ID NO: 1642460 - protein, 12 aa, Staphylococcus aureus
QQVFEEENNQYD

SEQ ID NO: 1642461 - protein, 6 aa, Staphylococcus aureus
QRDNHA

SEQ ID NO: 1642462 - protein, 10 aa, Staphylococcus aureus
QRDTLNKRKT

SEQ ID NO: 1642463 - protein, 8 aa, Staphylococcus aureus
QRENEQFK

SEQ ID NO: 1642464 - protein, 5 aa, Staphylococcus aureus
QRFKT

SEQ ID NO: 1642465 - protein, 8 aa, Staphylococcus aureus
QRGDRGEF

SEQ ID NO: 1642466 - protein, 35 aa, Staphylococcus aureus; identical to SEQ ID NO: 1569385

SEQ ID NO: 1642467 - protein, 14 aa, Staphylococcus aureus
QRGKHYGATWQDKE

SEQ ID NO: 1642468 - protein, 4 aa, Staphylococcus aureus
QRGL

SEQ ID NO: 1642469 - protein, 8 aa, Staphylococcus aureus
QRGSHDEL

SEQ ID NO: 1642470 - protein, 7 aa, Staphylococcus aureus
QRGVNQS

SEQ ID NO: 1642471 - protein, 17 aa, Staphylococcus aureus
QRHKDEVRKAKSKKDDV

SEQ ID NO: 1642472 - protein, 17 aa, Staphylococcus aureus
QRHKDEVRKVKSKKDAV

SEQ ID NO: 1642473 - protein, 6 aa, Staphylococcus aureus
QRIKAG

SEQ ID NO: 1642474 - protein, 7 aa, Staphylococcus aureus
QRKYPHQ

SEQ ID NO: 1642475 - protein, 17 aa, Staphylococcus aureus
QRLEDRPQIVVANKMDL

SEQ ID NO: 1642476 - protein, 14 aa, Staphylococcus aureus
QRLKELGDKVTNPV

SEQ ID NO: 1642477 - protein, 14 aa, Staphylococcus aureus
QRLKGLGDKVTNPV

SEQ ID NO: 1642478 - protein, 11 aa, Staphylococcus aureus
QRLSQSPKKMA

SEQ ID NO: 1642479 - protein, 5 aa, Staphylococcus aureus
QRLSR

SEQ ID NO: 1642480 - protein, 7 aa, Staphylococcus aureus
QRPDADV

SEQ ID NO: 1642481 - protein, 5 aa, Staphylococcus aureus
QRQEA

SEQ ID NO: 1642482 - protein, 17 aa, Staphylococcus aureus
QRSSTLKANSKAASIDA

SEQ ID NO: 1642483 - protein, 13 aa, Staphylococcus aureus
QRTDLRKAKETLE

SEQ ID NO: 1642484 - protein, 23 aa, Staphylococcus aureus
QRTKEKEAQGSKPQKSSARKNTR

SEQ ID NO: 1642485 - protein, 18 aa, Staphylococcus aureus
QRTNKKQKIHTFNVIYGR

SEQ ID NO: 1642486 - protein, 9 aa, Staphylococcus aureus
QRVKEAAKL

SEQ ID NO: 1642487 - protein, 11 aa, Staphylococcus aureus
QRVKKQASSIH

SEQ ID NO: 1642488 - protein, 8 aa, Staphylococcus aureus
QRYRNKGI

SEQ ID NO: 1642489 - protein, 27 aa, Staphylococcus aureus
QSAEKIVETAKRSGADVSGPIPLPTEN

SEQ ID NO: 1642490 - protein, 5 aa, Staphylococcus aureus
QSASL

SEQ ID NO: 1642491 - protein, 14 aa, Staphylococcus aureus
QSDNGKNYCNFINL

SEQ ID NO: 1642492 - protein, 10 aa, Staphylococcus aureus
QSEGNTGTTW

SEQ ID NO: 1642493 - protein, 5 aa, Staphylococcus aureus
QSEKL

SEQ ID NO: 1642494 - protein, 27 aa, Staphylococcus aureus
QSEPINAPLTPAIDGVEEEKLVKNCKF

SEQ ID NO: 1642495 - protein, 56 aa, Staphylococcus aureus
QSEQGRNQHQNDIKPTSKQHQSNINPTSKQHQTNTNNNDNKDNNEKNVNNEKKKAA

SEQ ID NO: 1642496 - protein, 10 aa, Staphylococcus aureus
QSFGTEGNRN

SEQ ID NO: 1642497 - protein, 8 aa, Staphylococcus aureus
QSFNDLPN

SEQ ID NO: 1642498 - protein, 11 aa, Staphylococcus aureus
QSGIEQRDGFE

SEQ ID NO: 1642499 - protein, 31 aa, Staphylococcus aureus; identical to SEQ ID NO: 1568402

SEQ ID NO: 1642500 - protein, 17 aa, Staphylococcus aureus
QSGPSLSNNYTNPPLTN

SEQ ID NO: 1642501 - protein, 13 aa, Staphylococcus aureus
QSGTTYPTVKPEE

SEQ ID NO: 1642502 - protein, 13 aa, Staphylococcus aureus
QSHHKTPNDTNSH

SEQ ID NO: 1642503 - protein, 9 aa, Staphylococcus aureus
QSHSQEPFH

SEQ ID NO: 1642504 - protein, 10 aa, Staphylococcus aureus
QSHSQEPLHN

SEQ ID NO: 1642505 - protein, 34 aa, Staphylococcus aureus
QSIADKDATRASSAYVNAEPNKKQAYDEAVRNAE

SEQ ID NO: 1642506 - protein, 34 aa, Staphylococcus aureus; identical to SEQ ID NO: 1567207

SEQ ID NO: 1642507 - protein, 4 aa, Staphylococcus aureus
QSIN

SEQ ID NO: 1642508 - protein, 13 aa, Staphylococcus aureus
QSKFNNRKFENYA

SEQ ID NO: 1642509 - protein, 26 aa, Staphylococcus aureus
QSKLSERTGFSQNTISNHENGNRNIG

SEQ ID NO: 1642510 - protein, 10 aa, Staphylococcus aureus
QSKPTPANDD

SEQ ID NO: 1642511 - protein, 9 aa, Staphylococcus aureus
QSLEEKENQ

SEQ ID NO: 1642512 - protein, 4 aa, Staphylococcus aureus
QSLS

SEQ ID NO: 1642513 - protein, 4 aa, Staphylococcus aureus
QSLT

SEQ ID NO: 1642514 - protein, 4 aa, Staphylococcus aureus
QSNI

SEQ ID NO: 1642515 - protein, 4 aa, Staphylococcus aureus
QSNV

SEQ ID NO: 1642516 - protein, 13 aa, Staphylococcus aureus
QSQISEEQATSTT

SEQ ID NO: 1642517 - protein, 15 aa, Staphylococcus aureus
QSRMISKNPDQPIDY

SEQ ID NO: 1642518 - protein, 6 aa, Staphylococcus aureus
QSRQKL

SEQ ID NO: 1642519 - protein, 8 aa, Staphylococcus aureus
QSSLPNEK

SEQ ID NO: 1642520 - protein, 8 aa, Staphylococcus aureus
QSSYKDNK

SEQ ID NO: 1642521 - protein, 6 aa, Staphylococcus aureus
QSTITW

SEQ ID NO: 1642522 - protein, 5 aa, Staphylococcus aureus
QSTND

SEQ ID NO: 1642523 - protein, 5 aa, Staphylococcus aureus
QSVNE

SEQ ID NO: 1642524 - protein, 11 aa, Staphylococcus aureus
QSVQTNGQALN

SEQ ID NO: 1642525 - protein, 8 aa, Staphylococcus aureus
QSVTANTE

SEQ ID NO: 1642526 - protein, 15 aa, Staphylococcus aureus
QSVTSTENALNGDAN

SEQ ID NO: 1642527 - protein, 9 aa, Staphylococcus aureus
QTANPTMSV

SEQ ID NO: 1642528 - protein, 8 aa, Staphylococcus aureus
QTAPLGKR

SEQ ID NO: 1642529 - protein, 5 aa, Staphylococcus aureus
QTATR

SEQ ID NO: 1642530 - protein, 17 aa, Staphylococcus aureus
QTEAINGYTKEIKKLLE

SEQ ID NO: 1642531 - protein, 13 aa, Staphylococcus aureus
QTEEQVDKNIEGI

SEQ ID NO: 1642532 - protein, 7 aa, Staphylococcus aureus
QTETVEE

SEQ ID NO: 1642533 - protein, 5 aa, Staphylococcus aureus
QTEYD

SEQ ID NO: 1642534 - protein, 24 aa, Staphylococcus aureus
QTFDSNDDTTVQNYENKASDDYYD

SEQ ID NO: 1642535 - protein, 24 aa, Staphylococcus aureus
QTFDSNEDASVQNYENKASDDYYD

SEQ ID NO: 1642536 - protein, 9 aa, Staphylococcus aureus
QTGKTEHDP

SEQ ID NO: 1642537 - protein, 4 aa, Staphylococcus aureus
QTGM

SEQ ID NO: 1642538 - protein, 18 aa, Staphylococcus aureus
QTIDKLQSGQISIEEPGL

SEQ ID NO: 1642539 - protein, 6 aa, Staphylococcus aureus
QTISQN

SEQ ID NO: 1642540 - protein, 6 aa, Staphylococcus aureus
QTKEEV

SEQ ID NO: 1642541 - protein, 8 aa, Staphylococcus aureus
QTKPIEPQ

SEQ ID NO: 1642542 - protein, 5 aa, Staphylococcus aureus
QTLAD

SEQ ID NO: 1642543 - protein, 9 aa, Staphylococcus aureus
QTLADENGL

SEQ ID NO: 1642544 - protein, 18 aa, Staphylococcus aureus
QTLNNEGKTVEIIDDIDS

SEQ ID NO: 1642545 - protein, 6 aa, Staphylococcus aureus
QTMGTS

SEQ ID NO: 1642546 - protein, 18 aa, Staphylococcus aureus
QTNLGSSDLGISGVNSGV

SEQ ID NO: 1642547 - protein, 29 aa, Staphylococcus aureus
QTNLGSSDLGISGVNSGVASKNINFSSPS

SEQ ID NO: 1642548 - protein, 20 aa, Staphylococcus aureus
QTPGSEITDTRGGSHNAPTR

SEQ ID NO: 1642549 - protein, 10 aa, Staphylococcus aureus
QTPLKDRDHS

SEQ ID NO: 1642550 - protein, 26 aa, Staphylococcus aureus
QTPMSQQSNPFANANGPIEISDDDLP

SEQ ID NO: 1642551 - protein, 7 aa, Staphylococcus aureus
QTQPKNW

SEQ ID NO: 1642552 - protein, 6 aa, Staphylococcus aureus
QTQTAI

SEQ ID NO: 1642553 - protein, 17 aa, Staphylococcus aureus
QTQTVTQTQTATQTQIA

SEQ ID NO: 1642554 - protein, 7 aa, Staphylococcus aureus
QTRPPRL

SEQ ID NO: 1642555 - protein, 9 aa, Staphylococcus aureus
QTRPPRTLN

SEQ ID NO: 1642556 - protein, 6 aa, Staphylococcus aureus
QTSDNN

SEQ ID NO: 1642557 - protein, 7 aa, Staphylococcus aureus
QTSENEV

SEQ ID NO: 1642558 - protein, 11 aa, Staphylococcus aureus
QTSHQKTNKLR

SEQ ID NO: 1642559 - protein, 7 aa, Staphylococcus aureus
QTSTDND

SEQ ID NO: 1642560 - protein, 6 aa, Staphylococcus aureus
QTSTSQ

SEQ ID NO: 1642561 - protein, 4 aa, Staphylococcus aureus
QTSY

SEQ ID NO: 1642562 - protein, 22 aa, Staphylococcus aureus
QTSYTTTVGGTLASGTQASGYA

SEQ ID NO: 1642563 - protein, 4 aa, Staphylococcus aureus
QTVQ

SEQ ID NO: 1642564 - protein, 12 aa, Staphylococcus aureus
QTVQSNANTLDQ

SEQ ID NO: 1642565 - protein, 11 aa, Staphylococcus aureus
QTVQTNGQALN

SEQ ID NO: 1642566 - protein, 13 aa, Staphylococcus aureus
QTVRTKEDLTEYN

SEQ ID NO: 1642567 - protein, 4 aa, Staphylococcus aureus
QTVT

SEQ ID NO: 1642568 - protein, 7 aa, Staphylococcus aureus
QTVTQTQ

SEQ ID NO: 1642569 - protein, 12 aa, Staphylococcus aureus
QTVTQTQTATQT

SEQ ID NO: 1642570 - protein, 12 aa, Staphylococcus aureus
QTVTQTQTVTQT

SEQ ID NO: 1642571 - protein, 4 aa, Staphylococcus aureus
QTWT

SEQ ID NO: 1642572 - protein, 27 aa, Staphylococcus aureus
QVANAKGALNGNHNLEQAKSNANTTIN

SEQ ID NO: 1642573 - protein, 4 aa, Staphylococcus aureus
QVAR

SEQ ID NO: 1642574 - protein, 11 aa, Staphylococcus aureus
QVDDNASKDGV

SEQ ID NO: 1642575 - protein, 20 aa, Staphylococcus aureus
QVDRNDHDNRIEHENEQTNH

SEQ ID NO: 1642576 - protein, 11 aa, Staphylococcus aureus
QVDRNNNDNHL

SEQ ID NO: 1642577 - protein, 9 aa, Staphylococcus aureus
QVEKNLPGV

SEQ ID NO: 1642578 - protein, 6 aa, Staphylococcus aureus
QVETAV

SEQ ID NO: 1642579 - protein, 26 aa, Staphylococcus aureus
QVGGGAPTQRISKRNSTNNASWGWMT

SEQ ID NO: 1642580 - protein, 7 aa, Staphylococcus aureus
QVGYNED

SEQ ID NO: 1642581 - protein, 10 aa, Staphylococcus aureus
QVNEAREKAL

SEQ ID NO: 1642582 - protein, 10 aa, Staphylococcus aureus
QVNKYKDNKG

SEQ ID NO: 1642583 - protein, 12 aa, Staphylococcus aureus
QVNSAKTNLDGT

SEQ ID NO: 1642584 - protein, 20 aa, Staphylococcus aureus
QVPEGAPFGGYKKIRYRSRN

SEQ ID NO: 1642585 - protein, 16 aa, Staphylococcus aureus
QVSQGKIKTSKYVKKE

SEQ ID NO: 1642586 - protein, 24 aa, Staphylococcus aureus
QVSTTQQLSDDEVTVSDVTSQRQS

SEQ ID NO: 1642587 - protein, 22 aa, Staphylococcus aureus
QVTNQGLASSHDLNYKEILNVI

SEQ ID NO: 1642588 - protein, 19 aa, Staphylococcus aureus
QVTRTQKQVKCKPSENQLK

SEQ ID NO: 1642589 - protein, 9 aa, Staphylococcus aureus
QWAAPNEHK

SEQ ID NO: 1642590 - protein, 6 aa, Staphylococcus aureus
QYEGQG

SEQ ID NO: 1642591 - protein, 4 aa, Staphylococcus aureus
QYEN

SEQ ID NO: 1642592 - protein, 6 aa, Staphylococcus aureus
QYGENS

SEQ ID NO: 1642593 - protein, 16 aa, Staphylococcus aureus
QYGTPLPLKEAKDDEY

SEQ ID NO: 1642594 - protein, 17 aa, Staphylococcus aureus
QYIDSRSADGLRKSLND

SEQ ID NO: 1642595 - protein, 6 aa, Staphylococcus aureus
QYKNSK

SEQ ID NO: 1642596 - protein, 9 aa, Staphylococcus aureus
QYKSAPSLP

SEQ ID NO: 1642597 - protein, 10 aa, Staphylococcus aureus
QYNANERNQI

SEQ ID NO: 1642598 - protein, 5 aa, Staphylococcus aureus
QYQAG

SEQ ID NO: 1642599 - protein, 6 aa, Staphylococcus aureus
QYQGNK

SEQ ID NO: 1642600 - protein, 11 aa, Staphylococcus aureus
QYQLTNDDYNV

SEQ ID NO: 1642601 - protein, 21 aa, Staphylococcus aureus
QYSEREQSLRRYDSRSFEAQG

SEQ ID NO: 1642602 - protein, 5 aa, Staphylococcus aureus
QYSKG

SEQ ID NO: 1642603 - protein, 5 aa, Staphylococcus aureus
QYTQE

SEQ ID NO: 1642604 - protein, 9 aa, Staphylococcus aureus
QYVQSSGDF

SEQ ID NO: 1642605 - protein, 35 aa, Staphylococcus aureus
QYVQSSGDFNSIQPSIKADDIKQIGTISVKKGAPQ

SEQ ID NO: 1642606 - protein, 11 aa, Staphylococcus aureus
QYVRKNPGEVC

SEQ ID NO: 1642607 - protein, 8 aa, Staphylococcus aureus
RAANYRSV

SEQ ID NO: 1642608 - protein, 9 aa, Staphylococcus aureus
RAARNDRGE

SEQ ID NO: 1642609 - protein, 4 aa, Staphylococcus aureus
RADA

SEQ ID NO: 1642610 - protein, 4 aa, Staphylococcus aureus
RAEA

SEQ ID NO: 1642611 - protein, 12 aa, Staphylococcus aureus
RAEDVEKAEDKQ

SEQ ID NO: 1642612 - protein, 12 aa, Staphylococcus aureus
RAEGVEKAEDKQ

SEQ ID NO: 1642613 - protein, 15 aa, Staphylococcus aureus
RAESPNTNDNSVTIN

SEQ ID NO: 1642614 - protein, 20 aa, Staphylococcus aureus
RAEYEEERKRRLRPWLYDGT

SEQ ID NO: 1642615 - protein, 12 aa, Staphylococcus aureus
RAGDYAYATGGK

SEQ ID NO: 1642616 - protein, 12 aa, Staphylococcus aureus
RAGGKRKDTALN

SEQ ID NO: 1642617 - protein, 4 aa, Staphylococcus aureus
RAKE

SEQ ID NO: 1642618 - protein, 6 aa, Staphylococcus aureus
RAKEEF

SEQ ID NO: 1642619 - protein, 12 aa, Staphylococcus aureus
RAKEKGKSTGLV

SEQ ID NO: 1642620 - protein, 13 aa, Staphylococcus aureus
RAKEKGKSTGLVS

SEQ ID NO: 1642621 - protein, 19 aa, Staphylococcus aureus
RAKQNQWQRQVETNERVKN

SEQ ID NO: 1642622 - protein, 7 aa, Staphylococcus aureus
RAKYGYD

SEQ ID NO: 1642623 - protein, 6 aa, Staphylococcus aureus
RALPDR

SEQ ID NO: 1642624 - protein, 16 aa, Staphylococcus aureus
RANAKRGYTNYNNPVH

SEQ ID NO: 1642625 - protein, 9 aa, Staphylococcus aureus
RANEDESRW

SEQ ID NO: 1642626 - protein, 18 aa, Staphylococcus aureus
RANGLSGNNIRNGQQIVI

SEQ ID NO: 1642627 - protein, 16 aa, Staphylococcus aureus
RAPDSVGMASDASRVF

SEQ ID NO: 1642628 - protein, 11 aa, Staphylococcus aureus
RAPKVIPPETV

SEQ ID NO: 1642629 - protein, 16 aa, Staphylococcus aureus
RAQKEKYDNLYKILQR

SEQ ID NO: 1642630 - protein, 13 aa, Staphylococcus aureus
RAQSNARKLANKC

SEQ ID NO: 1642631 - protein, 4 aa, Staphylococcus aureus
RAQT

SEQ ID NO: 1642632 - protein, 4 aa, Staphylococcus aureus
RARE

SEQ ID NO: 1642633 - protein, 6 aa, Staphylococcus aureus
RARESG

SEQ ID NO: 1642634 - protein, 13 aa, Staphylococcus aureus
RARINNKRTLGKS

SEQ ID NO: 1642635 - protein, 9 aa, Staphylococcus aureus
RASKQPLTA

SEQ ID NO: 1642636 - protein, 15 aa, Staphylococcus aureus
RATQKRTQNQGLKAM

SEQ ID NO: 1642637 - protein, 12 aa, Staphylococcus aureus
RATQQRTQNQGL

SEQ ID NO: 1642638 - protein, 43 aa, Staphylococcus aureus
RAVTPQNHVTHGPKDSMVRSEGKHSISSHEMKSSKYVESPNYT

SEQ ID NO: 1642639 - protein, 44 aa, Staphylococcus aureus
RAVTPQNHVTHGPKDSMVRSEGKHSVSSHEINSSKYVESPNYTK

SEQ ID NO: 1642640 - protein, 4 aa, Staphylococcus aureus
RAYS

SEQ ID NO: 1642641 - protein, 4 aa, Staphylococcus aureus
RCGS

SEQ ID NO: 1642642 - protein, 11 aa, Staphylococcus aureus
RCKTKKEISEG

SEQ ID NO: 1642643 - protein, 19 aa, Staphylococcus aureus
RDANAKEGNEYIKKDKEDL

SEQ ID NO: 1642644 - protein, 10 aa, Staphylococcus aureus
RDDEEIREGS

SEQ ID NO: 1642645 - protein, 6 aa, Staphylococcus aureus
RDEDFE

SEQ ID NO: 1642646 - protein, 5 aa, Staphylococcus aureus
RDGGK

SEQ ID NO: 1642647 - protein, 9 aa, Staphylococcus aureus
RDGLTDEQI

SEQ ID NO: 1642648 - protein, 12 aa, Staphylococcus aureus
RDGQVTAEAQGI

SEQ ID NO: 1642649 - protein, 14 aa, Staphylococcus aureus
RDGQVTAEAQGIAT

SEQ ID NO: 1642650 - protein, 13 aa, Staphylococcus aureus
RDGRARVNVGARS

SEQ ID NO: 1642651 - protein, 10 aa, Staphylococcus aureus
RDGSSTTLEA

SEQ ID NO: 1642652 - protein, 6 aa, Staphylococcus aureus
RDGVSE

SEQ ID NO: 1642653 - protein, 8 aa, Staphylococcus aureus
RDITNDDF

SEQ ID NO: 1642654 - protein, 18 aa, Staphylococcus aureus
RDITNDDFRNQVKSSIQK

SEQ ID NO: 1642655 - protein, 10 aa, Staphylococcus aureus
RDITSKKNEL

SEQ ID NO: 1642656 - protein, 5 aa, Staphylococcus aureus
RDKEI

SEQ ID NO: 1642657 - protein, 10 aa, Staphylococcus aureus
RDKNSQNVEN

SEQ ID NO: 1642658 - protein, 13 aa, Staphylococcus aureus
RDKSPVVRRTAGD

SEQ ID NO: 1642659 - protein, 8 aa, Staphylococcus aureus
RDKTGEPM

SEQ ID NO: 1642660 - protein, 5 aa, Staphylococcus aureus
RDKYE

SEQ ID NO: 1642661 - protein, 5 aa, Staphylococcus aureus
RDLTE

SEQ ID NO: 1642662 - protein, 6 aa, Staphylococcus aureus
RDLTEL

SEQ ID NO: 1642663 - protein, 22 aa, Staphylococcus aureus
RDMRQADKKYNKSSEKRGKLDV

SEQ ID NO: 1642664 - protein, 21 aa, Staphylococcus aureus
RDMRQAGKKYNKSSEKRGKLD

SEQ ID NO: 1642665 - protein, 24 aa, Staphylococcus aureus
RDMRQAGKKYNKSSEKRGKLDVGS

SEQ ID NO: 1642666 - protein, 21 aa, Staphylococcus aureus
RDMRQAGKKYNKSSENRGKLD

SEQ ID NO: 1642667 - protein, 22 aa, Staphylococcus aureus
RDMRQAGKKYNRSSEKRGKLDV

SEQ ID NO: 1642668 - protein, 15 aa, Staphylococcus aureus
RDNANDLARSLNEAG

SEQ ID NO: 1642669 - protein, 15 aa, Staphylococcus aureus
RDNANDLASSLNEAG

SEQ ID NO: 1642670 - protein, 11 aa, Staphylococcus aureus
RDNDGHGTMER

SEQ ID NO: 1642671 - protein, 7 aa, Staphylococcus aureus
RDNPDLS

SEQ ID NO: 1642672 - protein, 7 aa, Staphylococcus aureus
RDNPELS

SEQ ID NO: 1642673 - protein, 7 aa, Staphylococcus aureus
RDNSVET

SEQ ID NO: 1642674 - protein, 24 aa, Staphylococcus aureus
RDPRMKERKKPGLKGARRSPQFSK

SEQ ID NO: 1642675 - protein, 4 aa, Staphylococcus aureus
RDQP

SEQ ID NO: 1642676 - protein, 18 aa, Staphylococcus aureus
RDQRDQRKLTISIKKNAY

SEQ ID NO: 1642677 - protein, 10 aa, Staphylococcus aureus
RDRLSPSEVT

SEQ ID NO: 1642678 - protein, 32 aa, Staphylococcus aureus
RDSIANEATIKAGQNYTDASPNNRNEYDSAVT

SEQ ID NO: 1642679 - protein, 32 aa, Staphylococcus aureus; identical to SEQ ID NO: 1565950

SEQ ID NO: 1642680 - protein, 32 aa, Staphylococcus aureus
RDSIANEATIKAGQNYTDASQNKQTDYNNAVT

SEQ ID NO: 1642681 - protein, 83 aa, Staphylococcus aureus; identical to SEQ ID NO: 1567215

SEQ ID NO: 1642682 - protein, 6 aa, Staphylococcus aureus
RDSQKG

SEQ ID NO: 1642683 - protein, 7 aa, Staphylococcus aureus
RDSYLPP

SEQ ID NO: 1642684 - protein, 6 aa, Staphylococcus aureus
RDTESG

SEQ ID NO: 1642685 - protein, 4 aa, Staphylococcus aureus
RDTF

SEQ ID NO: 1642686 - protein, 22 aa, Staphylococcus aureus
RDVNDRKGHGTMVSGQTSANGR

SEQ ID NO: 1642687 - protein, 4 aa, Staphylococcus aureus
RDYD

SEQ ID NO: 1642688 - protein, 34 aa, Staphylococcus aureus
REAGTVKGKKTGKFGDQVTGNESLNQRGVGYFLY

SEQ ID NO: 1642689 - protein, 8 aa, Staphylococcus aureus
REANNEME

SEQ ID NO: 1642690 - protein, 4 aa, Staphylococcus aureus
REDG

SEQ ID NO: 1642691 - protein, 6 aa, Staphylococcus aureus
REDNFK

SEQ ID NO: 1642692 - protein, 7 aa, Staphylococcus aureus
REDNYEQ

SEQ ID NO: 1642693 - protein, 5 aa, Staphylococcus aureus
REEET

SEQ ID NO: 1642694 - protein, 5 aa, Staphylococcus aureus
REEFK

SEQ ID NO: 1642695 - protein, 8 aa, Staphylococcus aureus
REERVNPA

SEQ ID NO: 1642696 - protein, 6 aa, Staphylococcus aureus
REETYD

SEQ ID NO: 1642697 - protein, 16 aa, Staphylococcus aureus
REFSKAETQRMQFIYD

SEQ ID NO: 1642698 - protein, 10 aa, Staphylococcus aureus
REGDDEQTAI

SEQ ID NO: 1642699 - protein, 10 aa, Staphylococcus aureus
REGDDERTAF

SEQ ID NO: 1642700 - protein, 9 aa, Staphylococcus aureus
REGLPAKQD

SEQ ID NO: 1642701 - protein, 6 aa, Staphylococcus aureus
REGNKI

SEQ ID NO: 1642702 - protein, 18 aa, Staphylococcus aureus
REHGATTYDFGGTDNDPD

SEQ ID NO: 1642703 - protein, 23 aa, Staphylococcus aureus
REHGATTYDFGGTDNDPDKDSEH

SEQ ID NO: 1642704 - protein, 24 aa, Staphylococcus aureus
REHGATTYDFGGTDNDPDKDSEHY

SEQ ID NO: 1642705 - protein, 18 aa, Staphylococcus aureus
REIGTPISTGNASWGGAP

SEQ ID NO: 1642706 - protein, 23 aa, Staphylococcus aureus
REIGTPISTGNASWGGAPTKKLT

SEQ ID NO: 1642707 - protein, 10 aa, Staphylococcus aureus
REKDAKDRLN

SEQ ID NO: 1642708 - protein, 8 aa, Staphylococcus aureus
REKIETKI

SEQ ID NO: 1642709 - protein, 8 aa, Staphylococcus aureus
REKKSNLN

SEQ ID NO: 1642710 - protein, 4 aa, Staphylococcus aureus
REKL

SEQ ID NO: 1642711 - protein, 11 aa, Staphylococcus aureus
REKNPTVEPGD

SEQ ID NO: 1642712 - protein, 9 aa, Staphylococcus aureus
REKRKARKA

SEQ ID NO: 1642713 - protein, 19 aa, Staphylococcus aureus
RELAKNKRKREIQKQGTRK

SEQ ID NO: 1642714 - protein, 17 aa, Staphylococcus aureus
RELERERKKEAELRKKK

SEQ ID NO: 1642715 - protein, 7 aa, Staphylococcus aureus
RELSRDG

SEQ ID NO: 1642716 - protein, 5 aa, Staphylococcus aureus
RENDI

SEQ ID NO: 1642717 - protein, 8 aa, Staphylococcus aureus
RENKNYEN

SEQ ID NO: 1642718 - protein, 17 aa, Staphylococcus aureus
REQNRLRKQKQRENNRK

SEQ ID NO: 1642719 - protein, 21 aa, Staphylococcus aureus
REQTEAELRERRSELQRQETR

SEQ ID NO: 1642720 - protein, 4 aa, Staphylococcus aureus
REQV

SEQ ID NO: 1642721 - protein, 7 aa, Staphylococcus aureus
RERMGSI

SEQ ID NO: 1642722 - protein, 7 aa, Staphylococcus aureus
RERNKEL

SEQ ID NO: 1642723 - protein, 14 aa, Staphylococcus aureus
RERNKELEKKANAW

SEQ ID NO: 1642724 - protein, 14 aa, Staphylococcus aureus
RERNKELEKKASAW

SEQ ID NO: 1642725 - protein, 21 aa, Staphylococcus aureus
RESKEREIARQRRKEAELRRK

SEQ ID NO: 1642726 - protein, 13 aa, Staphylococcus aureus
RESSMKPSNSEKM

SEQ ID NO: 1642727 - protein, 14 aa, Staphylococcus aureus
RESSMKPSNSEKMS

SEQ ID NO: 1642728 - protein, 8 aa, Staphylococcus aureus
RETELKED

SEQ ID NO: 1642729 - protein, 9 aa, Staphylococcus aureus
RETENLNDG

SEQ ID NO: 1642730 - protein, 6 aa, Staphylococcus aureus
RETGEM

SEQ ID NO: 1642731 - protein, 5 aa, Staphylococcus aureus
RETIR

SEQ ID NO: 1642732 - protein, 5 aa, Staphylococcus aureus
REVER

SEQ ID NO: 1642733 - protein, 4 aa, Staphylococcus aureus
REVG

SEQ ID NO: 1642734 - protein, 16 aa, Staphylococcus aureus
REYQGNGEVKDVPASM

SEQ ID NO: 1642735 - protein, 5 aa, Staphylococcus aureus
RFDDV

SEQ ID NO: 1642736 - protein, 6 aa, Staphylococcus aureus
RFSATT

SEQ ID NO: 1642737 - protein, 4 aa, Staphylococcus aureus
RGAA

SEQ ID NO: 1642738 - protein, 5 aa, Staphylococcus aureus
RGADN

SEQ ID NO: 1642739 - protein, 4 aa, Staphylococcus aureus
RGAL

SEQ ID NO: 1642740 - protein, 10 aa, Staphylococcus aureus
RGASGYAPEH

SEQ ID NO: 1642741 - protein, 11 aa, Staphylococcus aureus
RGASGYAPEHT

SEQ ID NO: 1642742 - protein, 6 aa, Staphylococcus aureus
RGASNK

SEQ ID NO: 1642743 - protein, 14 aa, Staphylococcus aureus
RGATSYHPKMMLKI

SEQ ID NO: 1642744 - protein, 20 aa, Staphylococcus aureus
RGDNVQDAQRDAYEKVSQIQ

SEQ ID NO: 1642745 - protein, 15 aa, Staphylococcus aureus
RGDTINKDGKIDYTN

SEQ ID NO: 1642746 - protein, 12 aa, Staphylococcus aureus
RGEYKENPQNGK

SEQ ID NO: 1642747 - protein, 10 aa, Staphylococcus aureus
RGFLPGNGAI

SEQ ID NO: 1642748 - protein, 7 aa, Staphylococcus aureus
RGGKQQI

SEQ ID NO: 1642749 - protein, 13 aa, Staphylococcus aureus
RGGYYTEGPAANF

SEQ ID NO: 1642750 - protein, 12 aa, Staphylococcus aureus
RGHGRSGGKRTF

SEQ ID NO: 1642751 - protein, 22 aa, Staphylococcus aureus
RGIDHSEVKSTRVRKSVGTEHT

SEQ ID NO: 1642752 - protein, 34 aa, Staphylococcus aureus; identical to SEQ ID NO: 1566264

SEQ ID NO: 1642753 - protein, 6 aa, Staphylococcus aureus
RGINIE

SEQ ID NO: 1642754 - protein, 7 aa, Staphylococcus aureus
RGKFPSN

SEQ ID NO: 1642755 - protein, 5 aa, Staphylococcus aureus
RGKIV

SEQ ID NO: 1642756 - protein, 10 aa, Staphylococcus aureus
RGLAKESTEI

SEQ ID NO: 1642757 - protein, 4 aa, Staphylococcus aureus
RGLQ

SEQ ID NO: 1642758 - protein, 11 aa, Staphylococcus aureus
RGLRKSANKEY

SEQ ID NO: 1642759 - protein, 13 aa, Staphylococcus aureus
RGLTDATKATIEK

SEQ ID NO: 1642760 - protein, 12 aa, Staphylococcus aureus
RGNHNLGGEQSG

SEQ ID NO: 1642761 - protein, 26 aa, Staphylococcus aureus
RGPNKEADEKSACNNVQVGDGPQHRE

SEQ ID NO: 1642762 - protein, 19 aa, Staphylococcus aureus
RGPNKEADEKSAYNNVQVG

SEQ ID NO: 1642763 - protein, 26 aa, Staphylococcus aureus
RGPNKEADEKSAYNNVQVGDGSQQRE

SEQ ID NO: 1642764 - protein, 13 aa, Staphylococcus aureus
RGPNKEADEKVSL

SEQ ID NO: 1642765 - protein, 15 aa, Staphylococcus aureus
RGPNTEADGKSAYNN

SEQ ID NO: 1642766 - protein, 7 aa, Staphylococcus aureus
RGQNNQW

SEQ ID NO: 1642767 - protein, 19 aa, Staphylococcus aureus
RGRQTTKRSVKDNSGKKQS

SEQ ID NO: 1642768 - protein, 22 aa, Staphylococcus aureus
RGSGGGSMPSGLTTVPNPMVTY

SEQ ID NO: 1642769 - protein, 9 aa, Staphylococcus aureus
RGSGTRVYQ

SEQ ID NO: 1642770 - protein, 7 aa, Staphylococcus aureus
RGSKEQE

SEQ ID NO: 1642771 - protein, 10 aa, Staphylococcus aureus
RGTEPEEIGD

SEQ ID NO: 1642772 - protein, 10 aa, Staphylococcus aureus
RGVAKPEKCG

SEQ ID NO: 1642773 - protein, 9 aa, Staphylococcus aureus
RGVARAKKC

SEQ ID NO: 1642774 - protein, 7 aa, Staphylococcus aureus
RGVTPRN

SEQ ID NO: 1642775 - protein, 5 aa, Staphylococcus aureus
RHEFR

SEQ ID NO: 1642776 - protein, 4 aa, Staphylococcus aureus
RHGL

SEQ ID NO: 1642777 - protein, 18 aa, Staphylococcus aureus
RHIDSPSEVVKEGDEVEA

SEQ ID NO: 1642778 - protein, 6 aa, Staphylococcus aureus
RHKDND

SEQ ID NO: 1642779 - protein, 5 aa, Staphylococcus aureus
RHPNE

SEQ ID NO: 1642780 - protein, 5 aa, Staphylococcus aureus
RHRED

SEQ ID NO: 1642781 - protein, 4 aa, Staphylococcus aureus
RHYG

SEQ ID NO: 1642782 - protein, 11 aa, Staphylococcus aureus
RIAKEEQEKRD

SEQ ID NO: 1642783 - protein, 8 aa, Staphylococcus aureus
RIAKNDKV

SEQ ID NO: 1642784 - protein, 4 aa, Staphylococcus aureus
RIEK

SEQ ID NO: 1642785 - protein, 21 aa, Staphylococcus aureus
RIGAEGMTSEAVDGRSNSYEL

SEQ ID NO: 1642786 - protein, 12 aa, Staphylococcus aureus
RIGIPNKGDWTH

SEQ ID NO: 1642787 - protein, 10 aa, Staphylococcus aureus
RIGPKSKGMP

SEQ ID NO: 1642788 - protein, 19 aa, Staphylococcus aureus
RIGTTKRVEVSQGNVQTKK

SEQ ID NO: 1642789 - protein, 6 aa, Staphylococcus aureus
RIGYGG

SEQ ID NO: 1642790 - protein, 16 aa, Staphylococcus aureus
RINASKLSKETGISRT

SEQ ID NO: 1642791 - protein, 7 aa, Staphylococcus aureus
RINGSTQ

SEQ ID NO: 1642792 - protein, 4 aa, Staphylococcus aureus
RINN

SEQ ID NO: 1642793 - protein, 8 aa, Staphylococcus aureus
RISKGENI

SEQ ID NO: 1642794 - protein, 4 aa, Staphylococcus aureus
RISR

SEQ ID NO: 1642795 - protein, 13 aa, Staphylococcus aureus
RITKEDNKGTISH

SEQ ID NO: 1642796 - protein, 16 aa, Staphylococcus aureus
RKAAQSLELDERPLED

SEQ ID NO: 1642797 - protein, 104 aa, Staphylococcus aureus; identical to SEQ ID NO: 1564690

SEQ ID NO: 1642798 - protein, 107 aa, Staphylococcus aureus; identical to SEQ ID NO: 1566467

SEQ ID NO: 1642799 - protein, 10 aa, Staphylococcus aureus
RKAKGARSNI

SEQ ID NO: 1642800 - protein, 15 aa, Staphylococcus aureus
RKASGKKLAQESPVN

SEQ ID NO: 1642801 - protein, 9 aa, Staphylococcus aureus
RKASKQQTN

SEQ ID NO: 1642802 - protein, 8 aa, Staphylococcus aureus
RKDGNHKK

SEQ ID NO: 1642803 - protein, 6 aa, Staphylococcus aureus
RKDKQT

SEQ ID NO: 1642804 - protein, 16 aa, Staphylococcus aureus
RKDMPTKNQTEIEKGQ

SEQ ID NO: 1642805 - protein, 11 aa, Staphylococcus aureus
RKDSKSKEEVE

SEQ ID NO: 1642806 - protein, 10 aa, Staphylococcus aureus
RKDTDKNKLG

SEQ ID NO: 1642807 - protein, 37 aa, Staphylococcus aureus
RKEDIDKKQQAPASTPTSQQAPAKEEKKYNQYPTKPV

SEQ ID NO: 1642808 - protein, 8 aa, Staphylococcus aureus
RKEEYMSD

SEQ ID NO: 1642809 - protein, 8 aa, Staphylococcus aureus
RKEIGKPV

SEQ ID NO: 1642810 - protein, 10 aa, Staphylococcus aureus
RKEKEKSDVL

SEQ ID NO: 1642811 - protein, 17 aa, Staphylococcus aureus
RKEKSEVHKQKKRFDDF

SEQ ID NO: 1642812 - protein, 21 aa, Staphylococcus aureus
RKFNKNPKSVSEIKKEQNTSN

SEQ ID NO: 1642813 - protein, 18 aa, Staphylococcus aureus
RKGFPFEPKEIDNEAEIQ

SEQ ID NO: 1642814 - protein, 10 aa, Staphylococcus aureus
RKGKSISPKT

SEQ ID NO: 1642815 - protein, 7 aa, Staphylococcus aureus
RKGNKIV

SEQ ID NO: 1642816 - protein, 15 aa, Staphylococcus aureus
RKGTLDGQGKAFAEA

SEQ ID NO: 1642817 - protein, 8 aa, Staphylococcus aureus
RKGTNLTY

SEQ ID NO: 1642818 - protein, 17 aa, Staphylococcus aureus
RKGVPNIKPSVKGANTI

SEQ ID NO: 1642819 - protein, 9 aa, Staphylococcus aureus
RKGYNMDDD

SEQ ID NO: 1642820 - protein, 7 aa, Staphylococcus aureus
RKHNEHT

SEQ ID NO: 1642821 - protein, 9 aa, Staphylococcus aureus
RKKDKKISF

SEQ ID NO: 1642822 - protein, 4 aa, Staphylococcus aureus
RKKE

SEQ ID NO: 1642823 - protein, 8 aa, Staphylococcus aureus
RKKESNLP

SEQ ID NO: 1642824 - protein, 13 aa, Staphylococcus aureus
RKKGQGSKKYTGF

SEQ ID NO: 1642825 - protein, 17 aa, Staphylococcus aureus
RKKPGLKGARRSPQFSK

SEQ ID NO: 1642826 - protein, 10 aa, Staphylococcus aureus
RKKSNTNPYQ

SEQ ID NO: 1642827 - protein, 8 aa, Staphylococcus aureus
RKKTGAGM

SEQ ID NO: 1642828 - protein, 9 aa, Staphylococcus aureus
RKLSGNKRF

SEQ ID NO: 1642829 - protein, 6 aa, Staphylococcus aureus
RKMTNT

SEQ ID NO: 1642830 - protein, 6 aa, Staphylococcus aureus
RKNDSV

SEQ ID NO: 1642831 - protein, 9 aa, Staphylococcus aureus
RKNRRDGIE

SEQ ID NO: 1642832 - protein, 6 aa, Staphylococcus aureus
RKPDHS

SEQ ID NO: 1642833 - protein, 9 aa, Staphylococcus aureus
RKPDTPSMP

SEQ ID NO: 1642834 - protein, 7 aa, Staphylococcus aureus
RKPIKEN

SEQ ID NO: 1642835 - protein, 15 aa, Staphylococcus aureus
RKPKYYENIKLMEEG

SEQ ID NO: 1642836 - protein, 9 aa, Staphylococcus aureus
RKPSAREYD

SEQ ID NO: 1642837 - protein, 14 aa, Staphylococcus aureus
RKQARKKELKDETV

SEQ ID NO: 1642838 - protein, 7 aa, Staphylococcus aureus
RKRDNKA

SEQ ID NO: 1642839 - protein, 12 aa, Staphylococcus aureus
RKRKVASFTKIC

SEQ ID NO: 1642840 - protein, 8 aa, Staphylococcus aureus
RKSENKDY

SEQ ID NO: 1642841 - protein, 10 aa, Staphylococcus aureus
RKSGRKTLTM

SEQ ID NO: 1642842 - protein, 8 aa, Staphylococcus aureus
RKSKNDKS

SEQ ID NO: 1642843 - protein, 7 aa, Staphylococcus aureus
RKSYTAK

SEQ ID NO: 1642844 - protein, 5 aa, Staphylococcus aureus
RKVER

SEQ ID NO: 1642845 - protein, 4 aa, Staphylococcus aureus
RLAD

SEQ ID NO: 1642846 - protein, 9 aa, Staphylococcus aureus
RLAEENKNE

SEQ ID NO: 1642847 - protein, 8 aa, Staphylococcus aureus
RLDEETAE

SEQ ID NO: 1642848 - protein, 5 aa, Staphylococcus aureus
RLEED

SEQ ID NO: 1642849 - protein, 12 aa, Staphylococcus aureus
RLEKRKQQERVV

SEQ ID NO: 1642850 - protein, 5 aa, Staphylococcus aureus
RLEPI

SEQ ID NO: 1642851 - protein, 8 aa, Staphylococcus aureus
RLGEPETE

SEQ ID NO: 1642852 - protein, 7 aa, Staphylococcus aureus
RLGHGDI

SEQ ID NO: 1642853 - protein, 8 aa, Staphylococcus aureus
RLGHGDIK

SEQ ID NO: 1642854 - protein, 7 aa, Staphylococcus aureus
RLGRTTK

SEQ ID NO: 1642855 - protein, 8 aa, Staphylococcus aureus
RLKQQKKL

SEQ ID NO: 1642856 - protein, 4 aa, Staphylococcus aureus
RLKS

SEQ ID NO: 1642857 - protein, 22 aa, Staphylococcus aureus
RLNEGKDIRFSSERDEYKPQNN

SEQ ID NO: 1642858 - protein, 5 aa, Staphylococcus aureus
RLNTY

SEQ ID NO: 1642859 - protein, 35 aa, Staphylococcus aureus
RLQEEYNKRLKEELSRRMKQKEKEKQEAVDEAKRL

SEQ ID NO: 1642860 - protein, 6 aa, Staphylococcus aureus
RLSKGL

SEQ ID NO: 1642861 - protein, 10 aa, Staphylococcus aureus
RLSNKAANVL

SEQ ID NO: 1642862 - protein, 10 aa, Staphylococcus aureus
RLTDSGTVVS

SEQ ID NO: 1642863 - protein, 7 aa, Staphylococcus aureus
RLTEDGL

SEQ ID NO: 1642864 - protein, 7 aa, Staphylococcus aureus
RLYGKQS

SEQ ID NO: 1642865 - protein, 9 aa, Staphylococcus aureus
RLYGKQSEI

SEQ ID NO: 1642866 - protein, 8 aa, Staphylococcus aureus
RMKKRARK

SEQ ID NO: 1642867 - protein, 7 aa, Staphylococcus aureus
RMNNDNQ

SEQ ID NO: 1642868 - protein, 4 aa, Staphylococcus aureus
RMSD

SEQ ID NO: 1642869 - protein, 25 aa, Staphylococcus aureus
RNAKKKGRLSIGGGGATSGSGATYA

SEQ ID NO: 1642870 - protein, 14 aa, Staphylococcus aureus
RNALQAEDKGIDKL

SEQ ID NO: 1642871 - protein, 10 aa, Staphylococcus aureus
RNDNDELEMP

SEQ ID NO: 1642872 - protein, 9 aa, Staphylococcus aureus
RNDQPDLEN

SEQ ID NO: 1642873 - protein, 6 aa, Staphylococcus aureus
RNDRYS

SEQ ID NO: 1642874 - protein, 6 aa, Staphylococcus aureus
RNDSMD

SEQ ID NO: 1642875 - protein, 28 aa, Staphylococcus aureus
RNDTEEEEEREEEKEEEYKNKEEEREAV

SEQ ID NO: 1642876 - protein, 24 aa, Staphylococcus aureus
RNDTEEEEEREEEYKNKEEEREAV

SEQ ID NO: 1642877 - protein, 26 aa, Staphylococcus aureus
RNDTEEEREEEKEEEYKNKEEEREAV

SEQ ID NO: 1642878 - protein, 10 aa, Staphylococcus aureus
RNEDSDDTVT

SEQ ID NO: 1642879 - protein, 11 aa, Staphylococcus aureus
RNEEADDSVTI

SEQ ID NO: 1642880 - protein, 4 aa, Staphylococcus aureus
RNEI

SEQ ID NO: 1642881 - protein, 25 aa, Staphylococcus aureus
RNESIDSNDSASVTVTPQLQATSEG

SEQ ID NO: 1642882 - protein, 6 aa, Staphylococcus aureus
RNGENG

SEQ ID NO: 1642883 - protein, 5 aa, Staphylococcus aureus
RNGYK

SEQ ID NO: 1642884 - protein, 6 aa, Staphylococcus aureus
RNHTSR

SEQ ID NO: 1642885 - protein, 9 aa, Staphylococcus aureus
RNINNQQYR

SEQ ID NO: 1642886 - protein, 13 aa, Staphylococcus aureus
RNKINKSSNDEYI

SEQ ID NO: 1642887 - protein, 8 aa, Staphylococcus aureus
RNKKKPAI

SEQ ID NO: 1642888 - protein, 23 aa, Staphylococcus aureus
RNLGNPPFTTRESLPSIRERELE

SEQ ID NO: 1642889 - protein, 8 aa, Staphylococcus aureus
RNNHDKSI

SEQ ID NO: 1642890 - protein, 4 aa, Staphylococcus aureus
RNNN

SEQ ID NO: 1642891 - protein, 9 aa, Staphylococcus aureus
RNPNSTTNA

SEQ ID NO: 1642892 - protein, 5 aa, Staphylococcus aureus
RNPQM

SEQ ID NO: 1642893 - protein, 10 aa, Staphylococcus aureus
RNQAGRNAFT

SEQ ID NO: 1642894 - protein, 6 aa, Staphylococcus aureus
RNQERE

SEQ ID NO: 1642895 - protein, 4 aa, Staphylococcus aureus
RNRF

SEQ ID NO: 1642896 - protein, 14 aa, Staphylococcus aureus
RNTNLQKDDYVDTT

SEQ ID NO: 1642897 - protein, 6 aa, Staphylococcus aureus
RNTNSV

SEQ ID NO: 1642898 - protein, 8 aa, Staphylococcus aureus
RNTRSAKG

SEQ ID NO: 1642899 - protein, 4 aa, Staphylococcus aureus
RNTS

SEQ ID NO: 1642900 - protein, 7 aa, Staphylococcus aureus
RNTSIQT

SEQ ID NO: 1642901 - protein, 4 aa, Staphylococcus aureus
RNTV

SEQ ID NO: 1642902 - protein, 7 aa, Staphylococcus aureus
RNVTDEA

SEQ ID NO: 1642903 - protein, 24 aa, Staphylococcus aureus
RNYIKESKERLARTISQTNDNLDM

SEQ ID NO: 1642904 - protein, 5 aa, Staphylococcus aureus
RPALF

SEQ ID NO: 1642905 - protein, 7 aa, Staphylococcus aureus
RPDNTTK

SEQ ID NO: 1642906 - protein, 15 aa, Staphylococcus aureus
RPDSGAKRATEAENV

SEQ ID NO: 1642907 - protein, 15 aa, Staphylococcus aureus
RPGMTGAEADAISRN

SEQ ID NO: 1642908 - protein, 14 aa, Staphylococcus aureus
RPGMTGAEADTISR

SEQ ID NO: 1642909 - protein, 13 aa, Staphylococcus aureus
RPHGTTKEPPIEK

SEQ ID NO: 1642910 - protein, 14 aa, Staphylococcus aureus
RPKASDKGPKINWP

SEQ ID NO: 1642911 - protein, 5 aa, Staphylococcus aureus
RPKKL

SEQ ID NO: 1642912 - protein, 14 aa, Staphylococcus aureus
RPKKNTNELYLSEK

SEQ ID NO: 1642913 - protein, 15 aa, Staphylococcus aureus
RPKKTTRIGKTYYKT

SEQ ID NO: 1642914 - protein, 5 aa, Staphylococcus aureus
RPLDE

SEQ ID NO: 1642915 - protein, 13 aa, Staphylococcus aureus
RPLTTARGDKKSY

SEQ ID NO: 1642916 - protein, 5 aa, Staphylococcus aureus
RPNGQ

SEQ ID NO: 1642917 - protein, 5 aa, Staphylococcus aureus
RPNRE

SEQ ID NO: 1642918 - protein, 9 aa, Staphylococcus aureus
RPPLSNNDN

SEQ ID NO: 1642919 - protein, 38 aa, Staphylococcus aureus
RPPYSKDISKPSSTDTSSASKANDSTITGEAKKPQFKE

SEQ ID NO: 1642920 - protein, 13 aa, Staphylococcus aureus
RPQSVTSRIQPGS

SEQ ID NO: 1642921 - protein, 11 aa, Staphylococcus aureus
RPRDHNENGAY

SEQ ID NO: 1642922 - protein, 13 aa, Staphylococcus aureus
RPSEEVLRSLFEE

SEQ ID NO: 1642923 - protein, 8 aa, Staphylococcus aureus
RPSNAGKL

SEQ ID NO: 1642924 - protein, 7 aa, Staphylococcus aureus
RPTDLSH

SEQ ID NO: 1642925 - protein, 9 aa, Staphylococcus aureus
RPTSSGFEL

SEQ ID NO: 1642926 - protein, 5 aa, Staphylococcus aureus
RPYRG

SEQ ID NO: 1642927 - protein, 11 aa, Staphylococcus aureus
RQAKQKQNDQL

SEQ ID NO: 1642928 - protein, 9 aa, Staphylococcus aureus
RQARKNADL

SEQ ID NO: 1642929 - protein, 14 aa, Staphylococcus aureus
RQDARYGGKGGARC

SEQ ID NO: 1642930 - protein, 14 aa, Staphylococcus aureus
RQDKEPLKPNPELS

SEQ ID NO: 1642931 - protein, 8 aa, Staphylococcus aureus
RQDQIEQE

SEQ ID NO: 1642932 - protein, 8 aa, Staphylococcus aureus
RQGLNKPN

SEQ ID NO: 1642933 - protein, 8 aa, Staphylococcus aureus
RQGQRIKA

SEQ ID NO: 1642934 - protein, 13 aa, Staphylococcus aureus
RQGTSGKVNGRPM

SEQ ID NO: 1642935 - protein, 6 aa, Staphylococcus aureus
RQKATG

SEQ ID NO: 1642936 - protein, 7 aa, Staphylococcus aureus
RQKNENI

SEQ ID NO: 1642937 - protein, 8 aa, Staphylococcus aureus
RQKQRNIA

SEQ ID NO: 1642938 - protein, 13 aa, Staphylococcus aureus
RQKQRNTAIENSK

SEQ ID NO: 1642939 - protein, 9 aa, Staphylococcus aureus
RQKSKNESV

SEQ ID NO: 1642940 - protein, 7 aa, Staphylococcus aureus
RQNGHEA

SEQ ID NO: 1642941 - protein, 5 aa, Staphylococcus aureus
RQPAF

SEQ ID NO: 1642942 - protein, 6 aa, Staphylococcus aureus
RQPALT

SEQ ID NO: 1642943 - protein, 4 aa, Staphylococcus aureus
RQRD

SEQ ID NO: 1642944 - protein, 16 aa, Staphylococcus aureus
RQRDGLAPIPGGNGSI

SEQ ID NO: 1642945 - protein, 4 aa, Staphylococcus aureus
RQRN

SEQ ID NO: 1642946 - protein, 12 aa, Staphylococcus aureus
RQSKIKKSDSIA

SEQ ID NO: 1642947 - protein, 14 aa, Staphylococcus aureus
RQSLSKANAKQHGI

SEQ ID NO: 1642948 - protein, 10 aa, Staphylococcus aureus
RQSNETITDL

SEQ ID NO: 1642949 - protein, 9 aa, Staphylococcus aureus
RQSSAYAGQ

SEQ ID NO: 1642950 - protein, 11 aa, Staphylococcus aureus
RQSSNIEDIDP

SEQ ID NO: 1642951 - protein, 15 aa, Staphylococcus aureus
RQTIPELPDERKAKY

SEQ ID NO: 1642952 - protein, 9 aa, Staphylococcus aureus
RQYESKEKG

SEQ ID NO: 1642953 - protein, 13 aa, Staphylococcus aureus
RQYNYKDELQDNL

SEQ ID NO: 1642954 - protein, 14 aa, Staphylococcus aureus
RRDKEEDEKNKEKK

SEQ ID NO: 1642955 - protein, 9 aa, Staphylococcus aureus
RRDTGGGAV

SEQ ID NO: 1642956 - protein, 6 aa, Staphylococcus aureus
RRGESF

SEQ ID NO: 1642957 - protein, 14 aa, Staphylococcus aureus
RRINDYSDKADHRA

SEQ ID NO: 1642958 - protein, 4 aa, Staphylococcus aureus
RRIQ

SEQ ID NO: 1642959 - protein, 22 aa, Staphylococcus aureus
RRKDKEEDVETTTSIESKDEDV

SEQ ID NO: 1642960 - protein, 15 aa, Staphylococcus aureus
RRKDLDKAKLNEDTL

SEQ ID NO: 1642961 - protein, 4 aa, Staphylococcus aureus
RRKH

SEQ ID NO: 1642962 - protein, 8 aa, Staphylococcus aureus
RRKVKREW

SEQ ID NO: 1642963 - protein, 7 aa, Staphylococcus aureus
RRNDRNQ

SEQ ID NO: 1642964 - protein, 7 aa, Staphylococcus aureus
RRPTPTR

SEQ ID NO: 1642965 - protein, 6 aa, Staphylococcus aureus
RRQPSP

SEQ ID NO: 1642966 - protein, 25 aa, Staphylococcus aureus
RRQSYGSTGQSSIKQQLDVAKQLLS

SEQ ID NO: 1642967 - protein, 13 aa, Staphylococcus aureus
RRQSYGSTGQSSV

SEQ ID NO: 1642968 - protein, 7 aa, Staphylococcus aureus
RRRDNKS

SEQ ID NO: 1642969 - protein, 4 aa, Staphylococcus aureus
RRSA

SEQ ID NO: 1642970 - protein, 4 aa, Staphylococcus aureus
RRTI

SEQ ID NO: 1642971 - protein, 5 aa, Staphylococcus aureus
RRVDE

SEQ ID NO: 1642972 - protein, 8 aa, Staphylococcus aureus
RSEQAPKK

SEQ ID NO: 1642973 - protein, 14 aa, Staphylococcus aureus
RSFARQTVKNDKHI

SEQ ID NO: 1642974 - protein, 14 aa, Staphylococcus aureus
RSFEKVKGQTPNEK

SEQ ID NO: 1642975 - protein, 9 aa, Staphylococcus aureus
RSFKENGDW

SEQ ID NO: 1642976 - protein, 5 aa, Staphylococcus aureus
RSGEL

SEQ ID NO: 1642977 - protein, 4 aa, Staphylococcus aureus
RSGK

SEQ ID NO: 1642978 - protein, 12 aa, Staphylococcus aureus
RSGQPGINSEEY

SEQ ID NO: 1642979 - protein, 6 aa, Staphylococcus aureus
RSHPYN

SEQ ID NO: 1642980 - protein, 6 aa, Staphylococcus aureus
RSIDDE

SEQ ID NO: 1642981 - protein, 9 aa, Staphylococcus aureus
RSKKENEYV

SEQ ID NO: 1642982 - protein, 10 aa, Staphylococcus aureus
RSKVSQNILS

SEQ ID NO: 1642983 - protein, 5 aa, Staphylococcus aureus
RSLGS

SEQ ID NO: 1642984 - protein, 6 aa, Staphylococcus aureus
RSLKEY

SEQ ID NO: 1642985 - protein, 12 aa, Staphylococcus aureus
RSLSTKGCPYDN

SEQ ID NO: 1642986 - protein, 11 aa, Staphylococcus aureus
RSMQEGQEAKY

SEQ ID NO: 1642987 - protein, 6 aa, Staphylococcus aureus
RSNAEN

SEQ ID NO: 1642988 - protein, 7 aa, Staphylococcus aureus
RSNDDNE

SEQ ID NO: 1642989 - protein, 7 aa, Staphylococcus aureus
RSNDSNE

SEQ ID NO: 1642990 - protein, 8 aa, Staphylococcus aureus
RSNNGETE

SEQ ID NO: 1642991 - protein, 10 aa, Staphylococcus aureus
RSNNGETETV

SEQ ID NO: 1642992 - protein, 29 aa, Staphylococcus aureus
RSNPLNKSFEKPGASENLKSTLSEKAKKK

SEQ ID NO: 1642993 - protein, 14 aa, Staphylococcus aureus
RSNRKSLPFTENDE

SEQ ID NO: 1642994 - protein, 8 aa, Staphylococcus aureus
RSNVGKST

SEQ ID NO: 1642995 - protein, 16 aa, Staphylococcus aureus
RSQKQTKQTPSDNQLK

SEQ ID NO: 1642996 - protein, 6 aa, Staphylococcus aureus
RSRDSL

SEQ ID NO: 1642997 - protein, 12 aa, Staphylococcus aureus
RSRHNDAEADFN

SEQ ID NO: 1642998 - protein, 10 aa, Staphylococcus aureus
RSSSTEETNA

SEQ ID NO: 1642999 - protein, 5 aa, Staphylococcus aureus
RSTAL

SEQ ID NO: 1643000 - protein, 6 aa, Staphylococcus aureus
RSTDER

SEQ ID NO: 1643001 - protein, 16 aa, Staphylococcus aureus
RSVSTISREISRNNLN

SEQ ID NO: 1643002 - protein, 23 aa, Staphylococcus aureus
RSVSTISREISRNNLNQSYQAET

SEQ ID NO: 1643003 - protein, 13 aa, Staphylococcus aureus
RSVTDKDPHFKGT

SEQ ID NO: 1643004 - protein, 10 aa, Staphylococcus aureus
RSYTSDSDFD

SEQ ID NO: 1643005 - protein, 10 aa, Staphylococcus aureus
RTANQKNLDE

SEQ ID NO: 1643006 - protein, 10 aa, Staphylococcus aureus
RTASDNIQKV

SEQ ID NO: 1643007 - protein, 9 aa, Staphylococcus aureus
RTDEETEMG

SEQ ID NO: 1643008 - protein, 5 aa, Staphylococcus aureus
RTDPK

SEQ ID NO: 1643009 - protein, 10 aa, Staphylococcus aureus
RTDSGGGLTN

SEQ ID NO: 1643010 - protein, 10 aa, Staphylococcus aureus
RTEGEQLDDE

SEQ ID NO: 1643011 - protein, 7 aa, Staphylococcus aureus
RTGENDS

SEQ ID NO: 1643012 - protein, 4 aa, Staphylococcus aureus
RTGI

SEQ ID NO: 1643013 - protein, 8 aa, Staphylococcus aureus
RTGSRTFD

SEQ ID NO: 1643014 - protein, 9 aa, Staphylococcus aureus
RTHLTKQRI

SEQ ID NO: 1643015 - protein, 7 aa, Staphylococcus aureus
RTHNTED

SEQ ID NO: 1643016 - protein, 13 aa, Staphylococcus aureus
RTIAKGGGEKKRV

SEQ ID NO: 1643017 - protein, 11 aa, Staphylococcus aureus
RTIESDNNGKD

SEQ ID NO: 1643018 - protein, 7 aa, Staphylococcus aureus
RTINSPT

SEQ ID NO: 1643019 - protein, 4 aa, Staphylococcus aureus
RTIQ

SEQ ID NO: 1643020 - protein, 6 aa, Staphylococcus aureus
RTKGEI

SEQ ID NO: 1643021 - protein, 4 aa, Staphylococcus aureus
RTKN

SEQ ID NO: 1643022 - protein, 6 aa, Staphylococcus aureus
RTLRDQ

SEQ ID NO: 1643023 - protein, 8 aa, Staphylococcus aureus
RTMPGKTD

SEQ ID NO: 1643024 - protein, 6 aa, Staphylococcus aureus
RTNAEN

SEQ ID NO: 1643025 - protein, 4 aa, Staphylococcus aureus
RTPL

SEQ ID NO: 1643026 - protein, 6 aa, Staphylococcus aureus
RTPMGG

SEQ ID NO: 1643027 - protein, 8 aa, Staphylococcus aureus
RTPTDSGL

SEQ ID NO: 1643028 - protein, 7 aa, Staphylococcus aureus
RTSNSYR

SEQ ID NO: 1643029 - protein, 21 aa, Staphylococcus aureus
RTSVERENNNFSQHVNETKDH

SEQ ID NO: 1643030 - protein, 8 aa, Staphylococcus aureus
RTTKERHK

SEQ ID NO: 1643031 - protein, 28 aa, Staphylococcus aureus
RTTNGLESAKERGRYGGRPQLSEDKRKY

SEQ ID NO: 1643032 - protein, 5 aa, Staphylococcus aureus
RTTSW

SEQ ID NO: 1643033 - protein, 4 aa, Staphylococcus aureus
RTTV

SEQ ID NO: 1643034 - protein, 10 aa, Staphylococcus aureus
RTYKTKSKHK

SEQ ID NO: 1643035 - protein, 10 aa, Staphylococcus aureus
RVDKGDHKLE

SEQ ID NO: 1643036 - protein, 4 aa, Staphylococcus aureus
RVEE

SEQ ID NO: 1643037 - protein, 9 aa, Staphylococcus aureus
RVGAQAAKQ

SEQ ID NO: 1643038 - protein, 9 aa, Staphylococcus aureus
RVGKTESIV

SEQ ID NO: 1643039 - protein, 8 aa, Staphylococcus aureus
RVIGKEND

SEQ ID NO: 1643040 - protein, 6 aa, Staphylococcus aureus
RVNGDF

SEQ ID NO: 1643041 - protein, 13 aa, Staphylococcus aureus
RVNNAKDALNGDA

SEQ ID NO: 1643042 - protein, 13 aa, Staphylococcus aureus
RVNPNGNTIEAND

SEQ ID NO: 1643043 - protein, 6 aa, Staphylococcus aureus
RVNQEE

SEQ ID NO: 1643044 - protein, 4 aa, Staphylococcus aureus
RVSD

SEQ ID NO: 1643045 - protein, 17 aa, Staphylococcus aureus
RVSTKDQNLGSVVKLEK

SEQ ID NO: 1643046 - protein, 7 aa, Staphylococcus aureus
RVTNQEE

SEQ ID NO: 1643047 - protein, 31 aa, Staphylococcus aureus
RVYRPTDENDEYAGVYGDNGDENVNKKGGKR

SEQ ID NO: 1643048 - protein, 5 aa, Staphylococcus aureus
RWNSS

SEQ ID NO: 1643049 - protein, 16 aa, Staphylococcus aureus
RYAASSRKDPNITKKD

SEQ ID NO: 1643050 - protein, 13 aa, Staphylococcus aureus
RYDGENKSDEANI

SEQ ID NO: 1643051 - protein, 9 aa, Staphylococcus aureus
RYDGGNQLD

SEQ ID NO: 1643052 - protein, 15 aa, Staphylococcus aureus
RYDRQDIENVIEQMK

SEQ ID NO: 1643053 - protein, 6 aa, Staphylococcus aureus
RYDVEN

SEQ ID NO: 1643054 - protein, 12 aa, Staphylococcus aureus
RYEDNDKPVIES

SEQ ID NO: 1643055 - protein, 12 aa, Staphylococcus aureus
RYEDNEKPIIES

SEQ ID NO: 1643056 - protein, 10 aa, Staphylococcus aureus
RYEEDESNYE

SEQ ID NO: 1643057 - protein, 13 aa, Staphylococcus aureus
RYEIREPGSYARV

SEQ ID NO: 1643058 - protein, 6 aa, Staphylococcus aureus
RYGPNA

SEQ ID NO: 1643059 - protein, 7 aa, Staphylococcus aureus
RYGPNAN

SEQ ID NO: 1643060 - protein, 8 aa, Staphylococcus aureus
RYHSSNMA

SEQ ID NO: 1643061 - protein, 6 aa, Staphylococcus aureus
RYKTDA

SEQ ID NO: 1643062 - protein, 4 aa, Staphylococcus aureus
RYNG

SEQ ID NO: 1643063 - protein, 5 aa, Staphylococcus aureus
RYNNG

SEQ ID NO: 1643064 - protein, 9 aa, Staphylococcus aureus
RYNQNSGVR

SEQ ID NO: 1643065 - protein, 7 aa, Staphylococcus aureus
RYPSRNR

SEQ ID NO: 1643066 - protein, 22 aa, Staphylococcus aureus
RYQSGSTQSRDTINKRGNKKAR

SEQ ID NO: 1643067 - protein, 5 aa, Staphylococcus aureus
RYSDE

SEQ ID NO: 1643068 - protein, 4 aa, Staphylococcus aureus
RYSS

SEQ ID NO: 1643069 - protein, 4 aa, Staphylococcus aureus
RYTN

SEQ ID NO: 1643070 - protein, 15 aa, Staphylococcus aureus
RYTNRKGERQVEDKN

SEQ ID NO: 1643071 - protein, 12 aa, Staphylococcus aureus
RYYPDKAELKQT

SEQ ID NO: 1643072 - protein, 6 aa, Staphylococcus aureus
SAAGAS

SEQ ID NO: 1643073 - protein, 6 aa, Staphylococcus aureus
SAAMTE

SEQ ID NO: 1643074 - protein, 5 aa, Staphylococcus aureus
SAAPG

SEQ ID NO: 1643075 - protein, 19 aa, Staphylococcus aureus
SACNGNDTEGLLKEIEDVY

SEQ ID NO: 1643076 - protein, 7 aa, Staphylococcus aureus
SADEYRK

SEQ ID NO: 1643077 - protein, 8 aa, Staphylococcus aureus
SADNASWR

SEQ ID NO: 1643078 - protein, 10 aa, Staphylococcus aureus
SADNDKDGYR

SEQ ID NO: 1643079 - protein, 11 aa, Staphylococcus aureus
SADQELREQLP

SEQ ID NO: 1643080 - protein, 11 aa, Staphylococcus aureus
SADSAEQKSIA

SEQ ID NO: 1643081 - protein, 23 aa, Staphylococcus aureus
SADSYKNQNIDLEPTKKEGWKAR

SEQ ID NO: 1643082 - protein, 9 aa, Staphylococcus aureus
SADVDTTSK

SEQ ID NO: 1643083 - protein, 7 aa, Staphylococcus aureus
SAERLSL

SEQ ID NO: 1643084 - protein, 10 aa, Staphylococcus aureus
SAFKEEDLEP

SEQ ID NO: 1643085 - protein, 8 aa, Staphylococcus aureus
SAGDSKMN

SEQ ID NO: 1643086 - protein, 4 aa, Staphylococcus aureus
SAGI

SEQ ID NO: 1643087 - protein, 9 aa, Staphylococcus aureus
SAGSGKSNS

SEQ ID NO: 1643088 - protein, 15 aa, Staphylococcus aureus
SAHHSSKGKGGGNYD

SEQ ID NO: 1643089 - protein, 8 aa, Staphylococcus aureus
SAKEQKKI

SEQ ID NO: 1643090 - protein, 7 aa, Staphylococcus aureus
SAKNNIG

SEQ ID NO: 1643091 - protein, 9 aa, Staphylococcus aureus
SALTTRQAE

SEQ ID NO: 1643092 - protein, 11 aa, Staphylococcus aureus
SAMPRTTNGNI

SEQ ID NO: 1643093 - protein, 21 aa, Staphylococcus aureus
SANANSCTGQQGLDDAQQTQT

SEQ ID NO: 1643094 - protein, 14 aa, Staphylococcus aureus
SANEGIGPSGVHED

SEQ ID NO: 1643095 - protein, 8 aa, Staphylococcus aureus
SANHQKTI

SEQ ID NO: 1643096 - protein, 7 aa, Staphylococcus aureus
SANPTGD

SEQ ID NO: 1643097 - protein, 8 aa, Staphylococcus aureus
SANRQYTL

SEQ ID NO: 1643098 - protein, 7 aa, Staphylococcus aureus
SANTLTK

SEQ ID NO: 1643099 - protein, 6 aa, Staphylococcus aureus
SAPDQR

SEQ ID NO: 1643100 - protein, 17 aa, Staphylococcus aureus
SAPQSESYATRVDSTKG

SEQ ID NO: 1643101 - protein, 22 aa, Staphylococcus aureus
SAPSKKPTTPTTYTETTTQVPM

SEQ ID NO: 1643102 - protein, 22 aa, Staphylococcus aureus
SAPTKKPTTPTTYTETTTQVPM

SEQ ID NO: 1643103 - protein, 8 aa, Staphylococcus aureus
SARRKGIA

SEQ ID NO: 1643104 - protein, 14 aa, Staphylococcus aureus
SARRQPEEKRQDIR

SEQ ID NO: 1643105 - protein, 11 aa, Staphylococcus aureus
SASLKTSDTAD

SEQ ID NO: 1643106 - protein, 9 aa, Staphylococcus aureus
SASQQASGG

SEQ ID NO: 1643107 - protein, 7 aa, Staphylococcus aureus
SASSISG

SEQ ID NO: 1643108 - protein, 19 aa, Staphylococcus aureus
SASYRSDEALYSERTDEKI

SEQ ID NO: 1643109 - protein, 14 aa, Staphylococcus aureus
SATEEPDKLKKIII

SEQ ID NO: 1643110 - protein, 16 aa, Staphylococcus aureus
SATEGMKARRNKVSEE

SEQ ID NO: 1643111 - protein, 7 aa, Staphylococcus aureus
SATGYYP

SEQ ID NO: 1643112 - protein, 7 aa, Staphylococcus aureus
SATRFDS

SEQ ID NO: 1643113 - protein, 5 aa, Staphylococcus aureus
SAVPN

SEQ ID NO: 1643114 - protein, 8 aa, Staphylococcus aureus
SAYKSAKG

SEQ ID NO: 1643115 - protein, 21 aa, Staphylococcus aureus
SCERKGIPFEPKEIDNEAEIQ

SEQ ID NO: 1643116 - protein, 8 aa, Staphylococcus aureus
SCSTNNKI

SEQ ID NO: 1643117 - protein, 7 aa, Staphylococcus aureus
SDAMDSD

SEQ ID NO: 1643118 - protein, 141 aa, Staphylococcus aureus
SDAPLTSELNTQSETVGNQNSTTIDASTSTADSTSVTKNSSSVQTSNSDAVSSEKSENVTSTTNSTSNQQEKLTSTSESTSSKNTTSSSDTKSVASTSSTEQPINTSTNQSTASNNTSQSTTPSSANLNKTSTTSTSTAPV

SEQ ID NO: 1643119 - protein, 15 aa, Staphylococcus aureus
SDATGSDSGSKGLSD

SEQ ID NO: 1643120 - protein, 6 aa, Staphylococcus aureus
SDDEQH

SEQ ID NO: 1643121 - protein, 9 aa, Staphylococcus aureus
SDDHHTTVR

SEQ ID NO: 1643122 - protein, 9 aa, Staphylococcus aureus
SDDKNISEN

SEQ ID NO: 1643123 - protein, 5 aa, Staphylococcus aureus
SDDTL

SEQ ID NO: 1643124 - protein, 8 aa, Staphylococcus aureus
SDEAKSKG

SEQ ID NO: 1643125 - protein, 20 aa, Staphylococcus aureus
SDEAKSKGITCASAGNHAQG

SEQ ID NO: 1643126 - protein, 5 aa, Staphylococcus aureus
SDEFT

SEQ ID NO: 1643127 - protein, 8 aa, Staphylococcus aureus
SDEGLKKE

SEQ ID NO: 1643128 - protein, 4 aa, Staphylococcus aureus
SDEH

SEQ ID NO: 1643129 - protein, 8 aa, Staphylococcus aureus
SDEKEDIE

SEQ ID NO: 1643130 - protein, 17 aa, Staphylococcus aureus
SDEKEDIENCVSSLDQI

SEQ ID NO: 1643131 - protein, 5 aa, Staphylococcus aureus
SDELT

SEQ ID NO: 1643132 - protein, 4 aa, Staphylococcus aureus
SDEP

SEQ ID NO: 1643133 - protein, 4 aa, Staphylococcus aureus
SDES

SEQ ID NO: 1643134 - protein, 5 aa, Staphylococcus aureus
SDESL

SEQ ID NO: 1643135 - protein, 14 aa, Staphylococcus aureus
SDETSNVPSVESHQ

SEQ ID NO: 1643136 - protein, 10 aa, Staphylococcus aureus
SDFQTQPETA

SEQ ID NO: 1643137 - protein, 15 aa, Staphylococcus aureus
SDGDFIKSSSSALGN

SEQ ID NO: 1643138 - protein, 7 aa, Staphylococcus aureus
SDGINTT

SEQ ID NO: 1643139 - protein, 12 aa, Staphylococcus aureus
SDGKPSGKNAEL

SEQ ID NO: 1643140 - protein, 7 aa, Staphylococcus aureus
SDGTQEL

SEQ ID NO: 1643141 - protein, 5 aa, Staphylococcus aureus
SDIGR

SEQ ID NO: 1643142 - protein, 4 aa, Staphylococcus aureus
SDIK

SEQ ID NO: 1643143 - protein, 7 aa, Staphylococcus aureus
SDIKGKT

SEQ ID NO: 1643144 - protein, 7 aa, Staphylococcus aureus
SDINPNI

SEQ ID NO: 1643145 - protein, 5 aa, Staphylococcus aureus
SDKAK

SEQ ID NO: 1643146 - protein, 15 aa, Staphylococcus aureus
SDKQMNEQRDMTNKS

SEQ ID NO: 1643147 - protein, 9 aa, Staphylococcus aureus
SDKRDRKKR

SEQ ID NO: 1643148 - protein, 5 aa, Staphylococcus aureus
SDKSI

SEQ ID NO: 1643149 - protein, 12 aa, Staphylococcus aureus
SDKSNVTPQDVR

SEQ ID NO: 1643150 - protein, 12 aa, Staphylococcus aureus
SDKSTKIYRTPN

SEQ ID NO: 1643151 - protein, 5 aa, Staphylococcus aureus
SDKYD

SEQ ID NO: 1643152 - protein, 23 aa, Staphylococcus aureus
SDLNQTQKNALTQQVNNAQNVQA

SEQ ID NO: 1643153 - protein, 7 aa, Staphylococcus aureus
SDLPEDV

SEQ ID NO: 1643154 - protein, 10 aa, Staphylococcus aureus
SDLSTEEERL

SEQ ID NO: 1643155 - protein, 8 aa, Staphylococcus aureus
SDLTKSLA

SEQ ID NO: 1643156 - protein, 7 aa, Staphylococcus aureus
SDLTNQA

SEQ ID NO: 1643157 - protein, 13 aa, Staphylococcus aureus
SDMNMKGATPFKS

SEQ ID NO: 1643158 - protein, 5 aa, Staphylococcus aureus
SDMSE

SEQ ID NO: 1643159 - protein, 17 aa, Staphylococcus aureus
SDNETQTFNLSNELGVV

SEQ ID NO: 1643160 - protein, 4 aa, Staphylococcus aureus
SDNI

SEQ ID NO: 1643161 - protein, 13 aa, Staphylococcus aureus
SDNIQKVGEAFDQ

SEQ ID NO: 1643162 - protein, 7 aa, Staphylococcus aureus
SDNNKKV

SEQ ID NO: 1643163 - protein, 8 aa, Staphylococcus aureus
SDNNNGNL

SEQ ID NO: 1643164 - protein, 7 aa, Staphylococcus aureus
SDQQSKK

SEQ ID NO: 1643165 - protein, 7 aa, Staphylococcus aureus
SDRLNNK

SEQ ID NO: 1643166 - protein, 21 aa, Staphylococcus aureus
SDSASYAQDFKSEENAKKIAE

SEQ ID NO: 1643167 - protein, 15 aa, Staphylococcus aureus
SDSIDEAKSVSSKYL

SEQ ID NO: 1643168 - protein, 20 aa, Staphylococcus aureus
SDSNSDDKKKSDSKTDKDKS

SEQ ID NO: 1643169 - protein, 12 aa, Staphylococcus aureus
SDSVYQKDSPIL

SEQ ID NO: 1643170 - protein, 4 aa, Staphylococcus aureus
SDTS

SEQ ID NO: 1643171 - protein, 8 aa, Staphylococcus aureus
SDTWNDSK

SEQ ID NO: 1643172 - protein, 4 aa, Staphylococcus aureus
SDVD

SEQ ID NO: 1643173 - protein, 4 aa, Staphylococcus aureus
SDVE

SEQ ID NO: 1643174 - protein, 34 aa, Staphylococcus aureus
SDVNNALSNVTNKEHALNGEAKLNAAKQEANTAL

SEQ ID NO: 1643175 - protein, 14 aa, Staphylococcus aureus
SDYFSRETDDLKAD

SEQ ID NO: 1643176 - protein, 21 aa, Staphylococcus aureus
SDYKKPEEKTSDTERKLNSKE

SEQ ID NO: 1643177 - protein, 5 aa, Staphylococcus aureus
SEADE

SEQ ID NO: 1643178 - protein, 25 aa, Staphylococcus aureus
SEAEMGSPIRGGRPSTHAVKADDGY

SEQ ID NO: 1643179 - protein, 6 aa, Staphylococcus aureus
SEAIDT

SEQ ID NO: 1643180 - protein, 4 aa, Staphylococcus aureus
SEAL

SEQ ID NO: 1643181 - protein, 11 aa, Staphylococcus aureus
SEASIGKDTMT

SEQ ID NO: 1643182 - protein, 12 aa, Staphylococcus aureus
SEATGAGKSTIA

SEQ ID NO: 1643183 - protein, 14 aa, Staphylococcus aureus
SEDEREERHPQNER

SEQ ID NO: 1643184 - protein, 9 aa, Staphylococcus aureus
SEDITGNES

SEQ ID NO: 1643185 - protein, 6 aa, Staphylococcus aureus
SEDPTL

SEQ ID NO: 1643186 - protein, 5 aa, Staphylococcus aureus
SEEKI

SEQ ID NO: 1643187 - protein, 8 aa, Staphylococcus aureus
SEELGPKG

SEQ ID NO: 1643188 - protein, 10 aa, Staphylococcus aureus
SEENSEDSQA

SEQ ID NO: 1643189 - protein, 11 aa, Staphylococcus aureus
SEENTEADNTD

SEQ ID NO: 1643190 - protein, 4 aa, Staphylococcus aureus
SEFN

SEQ ID NO: 1643191 - protein, 4 aa, Staphylococcus aureus
SEFS

SEQ ID NO: 1643192 - protein, 4 aa, Staphylococcus aureus
SEFY

SEQ ID NO: 1643193 - protein, 13 aa, Staphylococcus aureus
SEGEKFNNNETLR

SEQ ID NO: 1643194 - protein, 11 aa, Staphylococcus aureus
SEGIKNNRKND

SEQ ID NO: 1643195 - protein, 5 aa, Staphylococcus aureus
SEGKQ

SEQ ID NO: 1643196 - protein, 10 aa, Staphylococcus aureus
SEGKQYNADG

SEQ ID NO: 1643197 - protein, 4 aa, Staphylococcus aureus
SEGV

SEQ ID NO: 1643198 - protein, 15 aa, Staphylococcus aureus
SEHTMEIAGKLIGHD

SEQ ID NO: 1643199 - protein, 7 aa, Staphylococcus aureus
SEHTTES

SEQ ID NO: 1643200 - protein, 26 aa, Staphylococcus aureus
SEIAPRSVQSPTQAPKKETAIPQPKA

SEQ ID NO: 1643201 - protein, 27 aa, Staphylococcus aureus
SEIAPRSVQSPTQAPKKETAKPQPKAV

SEQ ID NO: 1643202 - protein, 5 aa, Staphylococcus aureus
SEISG

SEQ ID NO: 1643203 - protein, 5 aa, Staphylococcus aureus
SEKAM

SEQ ID NO: 1643204 - protein, 10 aa, Staphylococcus aureus
SEKENASNKL

SEQ ID NO: 1643205 - protein, 12 aa, Staphylococcus aureus
SEKPDEFVPLRH

SEQ ID NO: 1643206 - protein, 4 aa, Staphylococcus aureus
SEKR

SEQ ID NO: 1643207 - protein, 7 aa, Staphylococcus aureus
SEKTSEL

SEQ ID NO: 1643208 - protein, 9 aa, Staphylococcus aureus
SEKTVHDDA

SEQ ID NO: 1643209 - protein, 10 aa, Staphylococcus aureus
SELKSKVSQT

SEQ ID NO: 1643210 - protein, 14 aa, Staphylococcus aureus
SELNKCKTHNKEKS

SEQ ID NO: 1643211 - protein, 6 aa, Staphylococcus aureus
SELPAE

SEQ ID NO: 1643212 - protein, 6 aa, Staphylococcus aureus
SELPAQ

SEQ ID NO: 1643213 - protein, 12 aa, Staphylococcus aureus
SELRSGKRKVNN

SEQ ID NO: 1643214 - protein, 10 aa, Staphylococcus aureus
SELSKTDGSI

SEQ ID NO: 1643215 - protein, 6 aa, Staphylococcus aureus
SELSRT

SEQ ID NO: 1643216 - protein, 23 aa, Staphylococcus aureus
SELTQEKSEIEVSRSIEKSNKHL

SEQ ID NO: 1643217 - protein, 11 aa, Staphylococcus aureus
SENDINVNDDG

SEQ ID NO: 1643218 - protein, 19 aa, Staphylococcus aureus
SENNKDEVKKGKELIEATG

SEQ ID NO: 1643219 - protein, 20 aa, Staphylococcus aureus
SENNNKDEVKKGKELIEATG

SEQ ID NO: 1643220 - protein, 20 aa, Staphylococcus aureus
SENNNRDEVKKGKELIEATG

SEQ ID NO: 1643221 - protein, 7 aa, Staphylococcus aureus
SENQTDE

SEQ ID NO: 1643222 - protein, 7 aa, Staphylococcus aureus
SENTIQQ

SEQ ID NO: 1643223 - protein, 8 aa, Staphylococcus aureus
SENTKMQA

SEQ ID NO: 1643224 - protein, 5 aa, Staphylococcus aureus
SENTY

SEQ ID NO: 1643225 - protein, 5 aa, Staphylococcus aureus
SEPDI

SEQ ID NO: 1643226 - protein, 11 aa, Staphylococcus aureus
SEPHDSATTIR

SEQ ID NO: 1643227 - protein, 7 aa, Staphylococcus aureus
SEPLGTH

SEQ ID NO: 1643228 - protein, 18 aa, Staphylococcus aureus
SEPTEGHITYNGKKLDKT

SEQ ID NO: 1643229 - protein, 9 aa, Staphylococcus aureus
SEQKKLSSQ

SEQ ID NO: 1643230 - protein, 9 aa, Staphylococcus aureus
SEQQSYASE

SEQ ID NO: 1643231 - protein, 7 aa, Staphylococcus aureus
SEQRPHD

SEQ ID NO: 1643232 - protein, 7 aa, Staphylococcus aureus
SEREASD

SEQ ID NO: 1643233 - protein, 12 aa, Staphylococcus aureus
SERKAEPRLGES

SEQ ID NO: 1643234 - protein, 13 aa, Staphylococcus aureus
SERRYSAKAWDNR

SEQ ID NO: 1643235 - protein, 29 aa, Staphylococcus aureus
SERTKKGLEAARARGRKGGRPSLPDHKKR

SEQ ID NO: 1643236 - protein, 16 aa, Staphylococcus aureus
SERVFKNGNSKAISLS

SEQ ID NO: 1643237 - protein, 5 aa, Staphylococcus aureus
SERYD

SEQ ID NO: 1643238 - protein, 8 aa, Staphylococcus aureus
SESEDVQK

SEQ ID NO: 1643239 - protein, 52 aa, Staphylococcus aureus
SESESLSESESLSESESLSESESLSESESLSESESLSESESLSESESLSESE

SEQ ID NO: 1643240 - protein, 123 aa, Staphylococcus aureus
SESESLSESESLSESESLSESESLSESESLSESESLSESESLSESESLSESESLSESESLSESDSLSESESLSESESLSESESLSESLSESESLSESESLSESESLSESESLSESESLSDVSS

SEQ ID NO: 1643241 - protein, 69 aa, Staphylococcus aureus
SESESLSESESLSESESLSESESLSESESLSESESLSESESLSESESLSESESLSESESLSESESESLS

SEQ ID NO: 1643242 - protein, 102 aa, Staphylococcus aureus
SESESLSESESLSESESLSESESLSESESLSESESLSESESLSESESLSESESLSESESLSESESESLSESESLSESESLSESESLSESESLSESESLSESE

SEQ ID NO: 1643243 - protein, 104 aa, Staphylococcus aureus
SESESLSESESLSESESLSESESLSESESLSESESLSESESLSESESLSESESLSESESLSESESESLSESESLSESESLSESESLSESESLSESESLSESESL

SEQ ID NO: 1643244 - protein, 68 aa, Staphylococcus aureus
SESESLSESESLSESESLSESESLSESESLSESESLSESESLSESESLSESESLSESESLSESESLSE

SEQ ID NO: 1643245 - protein, 69 aa, Staphylococcus aureus
SESESLSESESLSESESLSESESLSESESLSESESLSESESLSESESLSESESLSESESLSESESLSES

SEQ ID NO: 1643246 - protein, 6 aa, Staphylococcus aureus
SESITN

SEQ ID NO: 1643247 - protein, 4 aa, Staphylococcus aureus
SESL

SEQ ID NO: 1643248 - protein, 15 aa, Staphylococcus aureus
SESMAEDLEKIAEKA

SEQ ID NO: 1643249 - protein, 23 aa, Staphylococcus aureus
SESNTTKTTVTSTSVFPTKEAAQ

SEQ ID NO: 1643250 - protein, 7 aa, Staphylococcus aureus
SESSKGN

SEQ ID NO: 1643251 - protein, 6 aa, Staphylococcus aureus
SESVNW

SEQ ID NO: 1643252 - protein, 6 aa, Staphylococcus aureus
SESYEL

SEQ ID NO: 1643253 - protein, 13 aa, Staphylococcus aureus
SESYNEEAGAHFT

SEQ ID NO: 1643254 - protein, 5 aa, Staphylococcus aureus
SESYP

SEQ ID NO: 1643255 - protein, 9 aa, Staphylococcus aureus
SETMKKSYE

SEQ ID NO: 1643256 - protein, 8 aa, Staphylococcus aureus
SETQGRYA

SEQ ID NO: 1643257 - protein, 8 aa, Staphylococcus aureus
SEVAERPE

SEQ ID NO: 1643258 - protein, 7 aa, Staphylococcus aureus
SEVEKNG

SEQ ID NO: 1643259 - protein, 9 aa, Staphylococcus aureus
SEVETPPTY

SEQ ID NO: 1643260 - protein, 14 aa, Staphylococcus aureus
SEVRKKINKSKFKS

SEQ ID NO: 1643261 - protein, 4 aa, Staphylococcus aureus
SEYA

SEQ ID NO: 1643262 - protein, 5 aa, Staphylococcus aureus
SEYAS

SEQ ID NO: 1643263 - protein, 12 aa, Staphylococcus aureus
SEYDKKSLIESN

SEQ ID NO: 1643264 - protein, 15 aa, Staphylococcus aureus
SEYKMSREEILILLT

SEQ ID NO: 1643265 - protein, 11 aa, Staphylococcus aureus
SEYPRLSDGEI

SEQ ID NO: 1643266 - protein, 7 aa, Staphylococcus aureus
SFADTRQ

SEQ ID NO: 1643267 - protein, 9 aa, Staphylococcus aureus
SFAKDSGKK

SEQ ID NO: 1643268 - protein, 12 aa, Staphylococcus aureus
SFDNNSEYKLRG

SEQ ID NO: 1643269 - protein, 9 aa, Staphylococcus aureus
SFGDNKEIY

SEQ ID NO: 1643270 - protein, 24 aa, Staphylococcus aureus
SFGGKEAKCSTESSGGGSDGKGFD

SEQ ID NO: 1643271 - protein, 9 aa, Staphylococcus aureus
SFGTEGNRN

SEQ ID NO: 1643272 - protein, 5 aa, Staphylococcus aureus
SFHTS

SEQ ID NO: 1643273 - protein, 9 aa, Staphylococcus aureus
SFNDEHTDR

SEQ ID NO: 1643274 - protein, 10 aa, Staphylococcus aureus
SFNKKTKQGV

SEQ ID NO: 1643275 - protein, 4 aa, Staphylococcus aureus
SFRK

SEQ ID NO: 1643276 - protein, 10 aa, Staphylococcus aureus
SFSDGNKRTA

SEQ ID NO: 1643277 - protein, 4 aa, Staphylococcus aureus
SFSE

SEQ ID NO: 1643278 - protein, 7 aa, Staphylococcus aureus
SFSKPEW

SEQ ID NO: 1643279 - protein, 9 aa, Staphylococcus aureus
SFSKTDHDA

SEQ ID NO: 1643280 - protein, 8 aa, Staphylococcus aureus
SFTDEHTD

SEQ ID NO: 1643281 - protein, 4 aa, Staphylococcus aureus
SFTK

SEQ ID NO: 1643282 - protein, 7 aa, Staphylococcus aureus
SFTKEQP

SEQ ID NO: 1643283 - protein, 9 aa, Staphylococcus aureus
SFVPGEKAT

SEQ ID NO: 1643284 - protein, 12 aa, Staphylococcus aureus
SGAEGTRVEDTM

SEQ ID NO: 1643285 - protein, 4 aa, Staphylococcus aureus
SGAG

SEQ ID NO: 1643286 - protein, 7 aa, Staphylococcus aureus
SGAQVND

SEQ ID NO: 1643287 - protein, 11 aa, Staphylococcus aureus
SGASPIVSGEL

SEQ ID NO: 1643288 - protein, 10 aa, Staphylococcus aureus
SGATEDLDNE

SEQ ID NO: 1643289 - protein, 16 aa, Staphylococcus aureus
SGATYDIEGDKLEVED

SEQ ID NO: 1643290 - protein, 9 aa, Staphylococcus aureus
SGDLGTTGS

SEQ ID NO: 1643291 - protein, 25 aa, Staphylococcus aureus
SGEAKADEKVYTNNENGTKSKHEKS

SEQ ID NO: 1643292 - protein, 7 aa, Staphylococcus aureus
SGENVRR

SEQ ID NO: 1643293 - protein, 5 aa, Staphylococcus aureus
SGETV

SEQ ID NO: 1643294 - protein, 4 aa, Staphylococcus aureus
SGFE

SEQ ID NO: 1643295 - protein, 24 aa, Staphylococcus aureus
SGGEIGALTGPSLMPGGQGEAYNK

SEQ ID NO: 1643296 - protein, 11 aa, Staphylococcus aureus
SGGINSPESAL

SEQ ID NO: 1643297 - protein, 8 aa, Staphylococcus aureus
SGGKYTEL

SEQ ID NO: 1643298 - protein, 9 aa, Staphylococcus aureus
SGGYTGADK

SEQ ID NO: 1643299 - protein, 8 aa, Staphylococcus aureus
SGIHDASD

SEQ ID NO: 1643300 - protein, 5 aa, Staphylococcus aureus
SGIIK

SEQ ID NO: 1643301 - protein, 7 aa, Staphylococcus aureus
SGKDRFK

SEQ ID NO: 1643302 - protein, 23 aa, Staphylococcus aureus
SGKGGGRPDMAQGGGTQPENISK

SEQ ID NO: 1643303 - protein, 13 aa, Staphylococcus aureus
SGKLEVSTTPEAS

SEQ ID NO: 1643304 - protein, 13 aa, Staphylococcus aureus
SGKLKVSTTPEAS

SEQ ID NO: 1643305 - protein, 7 aa, Staphylococcus aureus
SGKNGAS

SEQ ID NO: 1643306 - protein, 9 aa, Staphylococcus aureus
SGKSKGKLF

SEQ ID NO: 1643307 - protein, 8 aa, Staphylococcus aureus
SGKTFRNQ

SEQ ID NO: 1643308 - protein, 6 aa, Staphylococcus aureus
SGLASL

SEQ ID NO: 1643309 - protein, 10 aa, Staphylococcus aureus
SGLSGTYNTA

SEQ ID NO: 1643310 - protein, 16 aa, Staphylococcus aureus
SGMKGATANIDNVKKT

SEQ ID NO: 1643311 - protein, 7 aa, Staphylococcus aureus
SGMNKPY

SEQ ID NO: 1643312 - protein, 10 aa, Staphylococcus aureus
SGNPTASSIP

SEQ ID NO: 1643313 - protein, 10 aa, Staphylococcus aureus
SGNRSRKASQ

SEQ ID NO: 1643314 - protein, 9 aa, Staphylococcus aureus
SGNRSTKAC

SEQ ID NO: 1643315 - protein, 5 aa, Staphylococcus aureus
SGPAT

SEQ ID NO: 1643316 - protein, 12 aa, Staphylococcus aureus
SGPIPPNPSELI

SEQ ID NO: 1643317 - protein, 7 aa, Staphylococcus aureus
SGPYDAK

SEQ ID NO: 1643318 - protein, 8 aa, Staphylococcus aureus
SGQKCSAC

SEQ ID NO: 1643319 - protein, 10 aa, Staphylococcus aureus
SGQSVHTPHE

SEQ ID NO: 1643320 - protein, 10 aa, Staphylococcus aureus
SGRPTEGMIP

SEQ ID NO: 1643321 - protein, 7 aa, Staphylococcus aureus
SGRTGDI

SEQ ID NO: 1643322 - protein, 11 aa, Staphylococcus aureus
SGSAQPNISAT

SEQ ID NO: 1643323 - protein, 10 aa, Staphylococcus aureus
SGSNPKYNAN

SEQ ID NO: 1643324 - protein, 7 aa, Staphylococcus aureus
SGSPVFN

SEQ ID NO: 1643325 - protein, 8 aa, Staphylococcus aureus
SGSPVFNE

SEQ ID NO: 1643326 - protein, 6 aa, Staphylococcus aureus
SGSSEI

SEQ ID NO: 1643327 - protein, 16 aa, Staphylococcus aureus
SGSTGNATFVENEKGS

SEQ ID NO: 1643328 - protein, 9 aa, Staphylococcus aureus
SGSTRQPKG

SEQ ID NO: 1643329 - protein, 19 aa, Staphylococcus aureus
SGSVDGEEFEGGQAEGYDL

SEQ ID NO: 1643330 - protein, 16 aa, Staphylococcus aureus
SGTATANYTPAIAESQ

SEQ ID NO: 1643331 - protein, 8 aa, Staphylococcus aureus
SGTGKSIS

SEQ ID NO: 1643332 - protein, 31 aa, Staphylococcus aureus; identical to SEQ ID NO: 1565961

SEQ ID NO: 1643333 - protein, 44 aa, Staphylococcus aureus; identical to SEQ ID NO: 1567231

SEQ ID NO: 1643334 - protein, 9 aa, Staphylococcus aureus
SGTTGVPKG

SEQ ID NO: 1643335 - protein, 19 aa, Staphylococcus aureus
SGVDGAIGSTYNVNGRRAR

SEQ ID NO: 1643336 - protein, 9 aa, Staphylococcus aureus
SGVDTRSIT

SEQ ID NO: 1643337 - protein, 6 aa, Staphylococcus aureus
SGVKRT

SEQ ID NO: 1643338 - protein, 12 aa, Staphylococcus aureus
SGVSPYGSRQAH

SEQ ID NO: 1643339 - protein, 12 aa, Staphylococcus aureus
SGVTDEELKEQF

SEQ ID NO: 1643340 - protein, 15 aa, Staphylococcus aureus
SGYGTSNFASGKDGV

SEQ ID NO: 1643341 - protein, 9 aa, Staphylococcus aureus
SGYKRNYSP

SEQ ID NO: 1643342 - protein, 14 aa, Staphylococcus aureus
SGYSGGHVDNPTYK

SEQ ID NO: 1643343 - protein, 14 aa, Staphylococcus aureus
SGYSGGYVDNPTYE

SEQ ID NO: 1643344 - protein, 36 aa, Staphylococcus aureus
SHEADTDTEDTMDGSYNTGGSVESTMSGTAKMSYGD

SEQ ID NO: 1643345 - protein, 15 aa, Staphylococcus aureus
SHEDEEWKNKITQQE

SEQ ID NO: 1643346 - protein, 13 aa, Staphylococcus aureus
SHETAKEALGDKE

SEQ ID NO: 1643347 - protein, 6 aa, Staphylococcus aureus
SHIKTS

SEQ ID NO: 1643348 - protein, 9 aa, Staphylococcus aureus
SHNPSENVG

SEQ ID NO: 1643349 - protein, 7 aa, Staphylococcus aureus
SHRGQGI

SEQ ID NO: 1643350 - protein, 6 aa, Staphylococcus aureus
SHYDDK

SEQ ID NO: 1643351 - protein, 7 aa, Staphylococcus aureus
SHYDDKD

SEQ ID NO: 1643352 - protein, 9 aa, Staphylococcus aureus
SIAENEGIN

SEQ ID NO: 1643353 - protein, 11 aa, Staphylococcus aureus
SIARSGKGENI

SEQ ID NO: 1643354 - protein, 34 aa, Staphylococcus aureus
SIASKDATKSSEDYQDANADLQTAYNDAVTNAEG

SEQ ID NO: 1643355 - protein, 7 aa, Staphylococcus aureus
SIDNPSS

SEQ ID NO: 1643356 - protein, 9 aa, Staphylococcus aureus
SIDNRKGQE

SEQ ID NO: 1643357 - protein, 6 aa, Staphylococcus aureus
SIDPSI

SEQ ID NO: 1643358 - protein, 5 aa, Staphylococcus aureus
SIDSK

SEQ ID NO: 1643359 - protein, 4 aa, Staphylococcus aureus
SIDT

SEQ ID NO: 1643360 - protein, 11 aa, Staphylococcus aureus
SIEDRKEVKTY

SEQ ID NO: 1643361 - protein, 4 aa, Staphylococcus aureus
SIEH

SEQ ID NO: 1643362 - protein, 15 aa, Staphylococcus aureus
SIEHSDIDDVSSIDT

SEQ ID NO: 1643363 - protein, 5 aa, Staphylococcus aureus
SIENM

SEQ ID NO: 1643364 - protein, 9 aa, Staphylococcus aureus
SIETSPNMK

SEQ ID NO: 1643365 - protein, 5 aa, Staphylococcus aureus
SIIED

SEQ ID NO: 1643366 - protein, 8 aa, Staphylococcus aureus
SIKKGENI

SEQ ID NO: 1643367 - protein, 32 aa, Staphylococcus aureus
SIKNKTAEQMRTTDPKRNATIKREIESSKKQL

SEQ ID NO: 1643368 - protein, 27 aa, Staphylococcus aureus
SINEKDGKVGSVTLTSTKDGSEETHEV

SEQ ID NO: 1643369 - protein, 23 aa, Staphylococcus aureus
SINNAQKAALKSQIEGASTVAGV

SEQ ID NO: 1643370 - protein, 34 aa, Staphylococcus aureus
SINNAQKDALTHSIDGATTVAGVNQESAKATELN

SEQ ID NO: 1643371 - protein, 34 aa, Staphylococcus aureus; identical to SEQ ID NO: 1565762

SEQ ID NO: 1643372 - protein, 21 aa, Staphylococcus aureus
SINNAQKEALKSQIEGATTVA

SEQ ID NO: 1643373 - protein, 22 aa, Staphylococcus aureus
SINNAQKEALKSQIEGATTVAG

SEQ ID NO: 1643374 - protein, 4 aa, Staphylococcus aureus
SINQ

SEQ ID NO: 1643375 - protein, 11 aa, Staphylococcus aureus
SINSNSSTSQS

SEQ ID NO: 1643376 - protein, 18 aa, Staphylococcus aureus
SIPEKNNDQPNMGGIPGM

SEQ ID NO: 1643377 - protein, 6 aa, Staphylococcus aureus
SIPSQV

SEQ ID NO: 1643378 - protein, 31 aa, Staphylococcus aureus; identical to SEQ ID NO: 1568453

SEQ ID NO: 1643379 - protein, 37 aa, Staphylococcus aureus
SIQDNAATKANSKYINEDQPEQQNYDQAVQAANNIIN

SEQ ID NO: 1643380 - protein, 32 aa, Staphylococcus aureus
SIQDNAATKANSKYINEDQSEQQNYDQAVQAA

SEQ ID NO: 1643381 - protein, 32 aa, Staphylococcus aureus; identical to SEQ ID NO: 1565319

SEQ ID NO: 1643382 - protein, 27 aa, Staphylococcus aureus
SIQGEIAKSDPRNNISRKKFHNSIIFN

SEQ ID NO: 1643383 - protein, 27 aa, Staphylococcus aureus
SIQGKIAKSDLRNNISRKKFHNSIIFN

SEQ ID NO: 1643384 - protein, 9 aa, Staphylococcus aureus
SIQQAEDRE

SEQ ID NO: 1643385 - protein, 7 aa, Staphylococcus aureus
SISEKNV

SEQ ID NO: 1643386 - protein, 9 aa, Staphylococcus aureus
SISGGEQQR

SEQ ID NO: 1643387 - protein, 23 aa, Staphylococcus aureus
SISTDDASWGNGPQTQKLAESQL

SEQ ID NO: 1643388 - protein, 16 aa, Staphylococcus aureus
SISTDTSKILKPRKFF

SEQ ID NO: 1643389 - protein, 7 aa, Staphylococcus aureus
SITGEES

SEQ ID NO: 1643390 - protein, 14 aa, Staphylococcus aureus
SITKEDKKGTISHD

SEQ ID NO: 1643391 - protein, 6 aa, Staphylococcus aureus
SITPSK

SEQ ID NO: 1643392 - protein, 6 aa, Staphylococcus aureus
SITSNT

SEQ ID NO: 1643393 - protein, 4 aa, Staphylococcus aureus
SITT

SEQ ID NO: 1643394 - protein, 8 aa, Staphylococcus aureus
SITTTPDA

SEQ ID NO: 1643395 - protein, 6 aa, Staphylococcus aureus
SIVENG

SEQ ID NO: 1643396 - protein, 19 aa, Staphylococcus aureus
SKAASASEAYGTDNAKVYD

SEQ ID NO: 1643397 - protein, 4 aa, Staphylococcus aureus
SKAC

SEQ ID NO: 1643398 - protein, 6 aa, Staphylococcus aureus
SKACGA

SEQ ID NO: 1643399 - protein, 5 aa, Staphylococcus aureus
SKAGF

SEQ ID NO: 1643400 - protein, 8 aa, Staphylococcus aureus
SKAGTVGR

SEQ ID NO: 1643401 - protein, 11 aa, Staphylococcus aureus
SKAKERRWNSG

SEQ ID NO: 1643402 - protein, 15 aa, Staphylococcus aureus
SKANGGNATQSEVEQ

SEQ ID NO: 1643403 - protein, 12 aa, Staphylococcus aureus
SKARSKIDERNT

SEQ ID NO: 1643404 - protein, 17 aa, Staphylococcus aureus
SKATQGNINVDLIVNVV

SEQ ID NO: 1643405 - protein, 14 aa, Staphylococcus aureus
SKCSEEVQDPESLS

SEQ ID NO: 1643406 - protein, 7 aa, Staphylococcus aureus
SKDFEDI

SEQ ID NO: 1643407 - protein, 8 aa, Staphylococcus aureus
SKDKSQEN

SEQ ID NO: 1643408 - protein, 10 aa, Staphylococcus aureus
SKDLYGKEIN

SEQ ID NO: 1643409 - protein, 7 aa, Staphylococcus aureus
SKDNIRG

SEQ ID NO: 1643410 - protein, 11 aa, Staphylococcus aureus
SKDSIQKGDDT

SEQ ID NO: 1643411 - protein, 12 aa, Staphylococcus aureus
SKDSKELESREK

SEQ ID NO: 1643412 - protein, 9 aa, Staphylococcus aureus
SKDSSRENT

SEQ ID NO: 1643413 - protein, 7 aa, Staphylococcus aureus
SKEADIA

SEQ ID NO: 1643414 - protein, 6 aa, Staphylococcus aureus
SKEALT

SEQ ID NO: 1643415 - protein, 8 aa, Staphylococcus aureus
SKEARGRN

SEQ ID NO: 1643416 - protein, 8 aa, Staphylococcus aureus
SKEEATRR

SEQ ID NO: 1643417 - protein, 6 aa, Staphylococcus aureus
SKEELR

SEQ ID NO: 1643418 - protein, 7 aa, Staphylococcus aureus
SKEGRDI

SEQ ID NO: 1643419 - protein, 20 aa, Staphylococcus aureus
SKEHANRYPHEFSGGQRQRI

SEQ ID NO: 1643420 - protein, 9 aa, Staphylococcus aureus
SKEKEDETF

SEQ ID NO: 1643421 - protein, 10 aa, Staphylococcus aureus
SKEKIKSSLF

SEQ ID NO: 1643422 - protein, 16 aa, Staphylococcus aureus
SKEMKEKLASRSLDLD

SEQ ID NO: 1643423 - protein, 4 aa, Staphylococcus aureus
SKEP

SEQ ID NO: 1643424 - protein, 6 aa, Staphylococcus aureus
SKEQFQ

SEQ ID NO: 1643425 - protein, 7 aa, Staphylococcus aureus
SKEQFQE

SEQ ID NO: 1643426 - protein, 12 aa, Staphylococcus aureus
SKESEIKPKKVF

SEQ ID NO: 1643427 - protein, 7 aa, Staphylococcus aureus
SKETDTV

SEQ ID NO: 1643428 - protein, 4 aa, Staphylococcus aureus
SKEV

SEQ ID NO: 1643429 - protein, 13 aa, Staphylococcus aureus
SKFAKGGKYLGKG

SEQ ID NO: 1643430 - protein, 8 aa, Staphylococcus aureus
SKFDGNNY

SEQ ID NO: 1643431 - protein, 12 aa, Staphylococcus aureus
SKFENGGEGDTR

SEQ ID NO: 1643432 - protein, 5 aa, Staphylococcus aureus
SKGAT

SEQ ID NO: 1643433 - protein, 10 aa, Staphylococcus aureus
SKGGKTERGN

SEQ ID NO: 1643434 - protein, 37 aa, Staphylococcus aureus
SKGNGQSATAKSAYNSASKIKDYKENEYKDYSNKQCD

SEQ ID NO: 1643435 - protein, 8 aa, Staphylococcus aureus
SKGPEKVK

SEQ ID NO: 1643436 - protein, 25 aa, Staphylococcus aureus
SKGSLAGVDGRLQTRNYENKEGQRV

SEQ ID NO: 1643437 - protein, 24 aa, Staphylococcus aureus
SKGSLAGVDGRLQTRSYDNKEGRR

SEQ ID NO: 1643438 - protein, 9 aa, Staphylococcus aureus
SKHEDYQAG

SEQ ID NO: 1643439 - protein, 4 aa, Staphylococcus aureus
SKHT

SEQ ID NO: 1643440 - protein, 4 aa, Staphylococcus aureus
SKID

SEQ ID NO: 1643441 - protein, 20 aa, Staphylococcus aureus
SKINDSDPTGTIIISEDDMN

SEQ ID NO: 1643442 - protein, 19 aa, Staphylococcus aureus
SKITDDYGKAIESSEQSID

SEQ ID NO: 1643443 - protein, 7 aa, Staphylococcus aureus
SKKARYN

SEQ ID NO: 1643444 - protein, 7 aa, Staphylococcus aureus
SKKCEEA

SEQ ID NO: 1643445 - protein, 5 aa, Staphylococcus aureus
SKKDF

SEQ ID NO: 1643446 - protein, 17 aa, Staphylococcus aureus
SKKEELEKEINQSKSKY

SEQ ID NO: 1643447 - protein, 17 aa, Staphylococcus aureus
SKKEGEPDKKVFITNTI

SEQ ID NO: 1643448 - protein, 19 aa, Staphylococcus aureus
SKKEGEPDKKVFITNTIPQ

SEQ ID NO: 1643449 - protein, 35 aa, Staphylococcus aureus
SKKENKKDDVSEDDAISPAEEDNSNDKSISDDDLP

SEQ ID NO: 1643450 - protein, 10 aa, Staphylococcus aureus
SKKGQKPQIH

SEQ ID NO: 1643451 - protein, 13 aa, Staphylococcus aureus
SKKKKHKGNGNKH

SEQ ID NO: 1643452 - protein, 5 aa, Staphylococcus aureus
SKKLD

SEQ ID NO: 1643453 - protein, 6 aa, Staphylococcus aureus
SKKRAN

SEQ ID NO: 1643454 - protein, 13 aa, Staphylococcus aureus
SKKREHSAAKDSV

SEQ ID NO: 1643455 - protein, 10 aa, Staphylococcus aureus
SKKSESRLKR

SEQ ID NO: 1643456 - protein, 7 aa, Staphylococcus aureus
SKKSYER

SEQ ID NO: 1643457 - protein, 7 aa, Staphylococcus aureus
SKLGETM

SEQ ID NO: 1643458 - protein, 9 aa, Staphylococcus aureus
SKLNPTPKW

SEQ ID NO: 1643459 - protein, 6 aa, Staphylococcus aureus
SKLSVT

SEQ ID NO: 1643460 - protein, 8 aa, Staphylococcus aureus
SKNAFDNH

SEQ ID NO: 1643461 - protein, 8 aa, Staphylococcus aureus
SKNEPTHI

SEQ ID NO: 1643462 - protein, 6 aa, Staphylococcus aureus
SKNHAS

SEQ ID NO: 1643463 - protein, 9 aa, Staphylococcus aureus
SKNKCDAKE

SEQ ID NO: 1643464 - protein, 8 aa, Staphylococcus aureus
SKNKELDI

SEQ ID NO: 1643465 - protein, 10 aa, Staphylococcus aureus
SKNKNTSSLA

SEQ ID NO: 1643466 - protein, 6 aa, Staphylococcus aureus
SKNNID

SEQ ID NO: 1643467 - protein, 10 aa, Staphylococcus aureus
SKNQPVGRRS

SEQ ID NO: 1643468 - protein, 9 aa, Staphylococcus aureus
SKNRSQTVS

SEQ ID NO: 1643469 - protein, 8 aa, Staphylococcus aureus
SKNSIRAA

SEQ ID NO: 1643470 - protein, 15 aa, Staphylococcus aureus
SKNVARYESINGENL

SEQ ID NO: 1643471 - protein, 7 aa, Staphylococcus aureus
SKNVDPV

SEQ ID NO: 1643472 - protein, 9 aa, Staphylococcus aureus
SKNVQSSRN

SEQ ID NO: 1643473 - protein, 6 aa, Staphylococcus aureus
SKNYTA

SEQ ID NO: 1643474 - protein, 7 aa, Staphylococcus aureus
SKPEIYT

SEQ ID NO: 1643475 - protein, 8 aa, Staphylococcus aureus
SKPRKIRR

SEQ ID NO: 1643476 - protein, 13 aa, Staphylococcus aureus
SKPSLKRVEGNAG

SEQ ID NO: 1643477 - protein, 4 aa, Staphylococcus aureus
SKPT

SEQ ID NO: 1643478 - protein, 24 aa, Staphylococcus aureus
SKPVGKTPQGGGNPDSGVTKEKFD

SEQ ID NO: 1643479 - protein, 23 aa, Staphylococcus aureus
SKPVGNSPQQGDNPTGKPTKEDF

SEQ ID NO: 1643480 - protein, 9 aa, Staphylococcus aureus
SKPYSKANT

SEQ ID NO: 1643481 - protein, 14 aa, Staphylococcus aureus
SKQEVADTKAKALD

SEQ ID NO: 1643482 - protein, 11 aa, Staphylococcus aureus
SKQGKRKANEI

SEQ ID NO: 1643483 - protein, 4 aa, Staphylococcus aureus
SKQH

SEQ ID NO: 1643484 - protein, 7 aa, Staphylococcus aureus
SKQPLTA

SEQ ID NO: 1643485 - protein, 18 aa, Staphylococcus aureus
SKQSGHRVNANNYMGGLT

SEQ ID NO: 1643486 - protein, 5 aa, Staphylococcus aureus
SKQSL

SEQ ID NO: 1643487 - protein, 4 aa, Staphylococcus aureus
SKQY

SEQ ID NO: 1643488 - protein, 8 aa, Staphylococcus aureus
SKQYNTED

SEQ ID NO: 1643489 - protein, 6 aa, Staphylococcus aureus
SKRHQT

SEQ ID NO: 1643490 - protein, 8 aa, Staphylococcus aureus
SKRIKKNS

SEQ ID NO: 1643491 - protein, 33 aa, Staphylococcus aureus
SKRISTDNASWRGPNTEAYEKSAYDNVRVGVGQ

SEQ ID NO: 1643492 - protein, 12 aa, Staphylococcus aureus
SKRKSLPFTEND

SEQ ID NO: 1643493 - protein, 5 aa, Staphylococcus aureus
SKRQA

SEQ ID NO: 1643494 - protein, 8 aa, Staphylococcus aureus
SKRVSENT

SEQ ID NO: 1643495 - protein, 5 aa, Staphylococcus aureus
SKSEL

SEQ ID NO: 1643496 - protein, 19 aa, Staphylococcus aureus
SKSENIEKTVNRFKDFLII

SEQ ID NO: 1643497 - protein, 5 aa, Staphylococcus aureus
SKSGL

SEQ ID NO: 1643498 - protein, 9 aa, Staphylococcus aureus
SKSGQNKHE

SEQ ID NO: 1643499 - protein, 14 aa, Staphylococcus aureus
SKSHDTKPNDTSTH

SEQ ID NO: 1643500 - protein, 7 aa, Staphylococcus aureus
SKSREWE

SEQ ID NO: 1643501 - protein, 6 aa, Staphylococcus aureus
SKSRNL

SEQ ID NO: 1643502 - protein, 7 aa, Staphylococcus aureus
SKSWDGI

SEQ ID NO: 1643503 - protein, 5 aa, Staphylococcus aureus
SKTFD

SEQ ID NO: 1643504 - protein, 8 aa, Staphylococcus aureus
SKTHTDPM

SEQ ID NO: 1643505 - protein, 17 aa, Staphylococcus aureus
SKTHTDPMAKIIRQKLK

SEQ ID NO: 1643506 - protein, 12 aa, Staphylococcus aureus
SKTMEELNTDGY

SEQ ID NO: 1643507 - protein, 6 aa, Staphylococcus aureus
SKVEGI

SEQ ID NO: 1643508 - protein, 26 aa, Staphylococcus aureus
SKVEVTKDNTTVVDGDGDENSIDARV

SEQ ID NO: 1643509 - protein, 10 aa, Staphylococcus aureus
SKVGYSAETV

SEQ ID NO: 1643510 - protein, 7 aa, Staphylococcus aureus
SKVNQDN

SEQ ID NO: 1643511 - protein, 22 aa, Staphylococcus aureus
SKVQNTIKTDIKQEDSNTHVYK

SEQ ID NO: 1643512 - protein, 6 aa, Staphylococcus aureus
SKVSKI

SEQ ID NO: 1643513 - protein, 8 aa, Staphylococcus aureus
SKYEQADI

SEQ ID NO: 1643514 - protein, 5 aa, Staphylococcus aureus
SKYKK

SEQ ID NO: 1643515 - protein, 26 aa, Staphylococcus aureus
SKYNEDSTNYEGKSITNAGGNSLSGA

SEQ ID NO: 1643516 - protein, 7 aa, Staphylococcus aureus
SKYTTES

SEQ ID NO: 1643517 - protein, 17 aa, Staphylococcus aureus
SLAGKTGTINYTSVFKK

SEQ ID NO: 1643518 - protein, 15 aa, Staphylococcus aureus
SLAKTELNKRKSAVM

SEQ ID NO: 1643519 - protein, 7 aa, Staphylococcus aureus
SLDESYR

SEQ ID NO: 1643520 - protein, 4 aa, Staphylococcus aureus
SLDK

SEQ ID NO: 1643521 - protein, 9 aa, Staphylococcus aureus
SLDKEDYVS

SEQ ID NO: 1643522 - protein, 13 aa, Staphylococcus aureus
SLDPDEVKKQKEA

SEQ ID NO: 1643523 - protein, 7 aa, Staphylococcus aureus
SLEESTK

SEQ ID NO: 1643524 - protein, 9 aa, Staphylococcus aureus
SLENETNSI

SEQ ID NO: 1643525 - protein, 4 aa, Staphylococcus aureus
SLFT

SEQ ID NO: 1643526 - protein, 5 aa, Staphylococcus aureus
SLGAD

SEQ ID NO: 1643527 - protein, 6 aa, Staphylococcus aureus
SLGGRD

SEQ ID NO: 1643528 - protein, 8 aa, Staphylococcus aureus
SLINPSKI

SEQ ID NO: 1643529 - protein, 13 aa, Staphylococcus aureus
SLKGPLHGGTNEQ

SEQ ID NO: 1643530 - protein, 7 aa, Staphylococcus aureus
SLKGSAN

SEQ ID NO: 1643531 - protein, 6 aa, Staphylococcus aureus
SLKKYQ

SEQ ID NO: 1643532 - protein, 15 aa, Staphylococcus aureus
SLKNNGNSGASLDTN

SEQ ID NO: 1643533 - protein, 6 aa, Staphylococcus aureus
SLKSIE

SEQ ID NO: 1643534 - protein, 4 aa, Staphylococcus aureus
SLKT

SEQ ID NO: 1643535 - protein, 10 aa, Staphylococcus aureus
SLKTNDMNDG

SEQ ID NO: 1643536 - protein, 10 aa, Staphylococcus aureus
SLKTNDVNDG

SEQ ID NO: 1643537 - protein, 9 aa, Staphylococcus aureus
SLLQGDKQI

SEQ ID NO: 1643538 - protein, 6 aa, Staphylococcus aureus
SLNESG

SEQ ID NO: 1643539 - protein, 4 aa, Staphylococcus aureus
SLNI

SEQ ID NO: 1643540 - protein, 9 aa, Staphylococcus aureus
SLNKDDYID

SEQ ID NO: 1643541 - protein, 4 aa, Staphylococcus aureus
SLNL

SEQ ID NO: 1643542 - protein, 13 aa, Staphylococcus aureus
SLPEDKVNPTSYE

SEQ ID NO: 1643543 - protein, 4 aa, Staphylococcus aureus
SLPI

SEQ ID NO: 1643544 - protein, 11 aa, Staphylococcus aureus
SLPPKEGDDYS

SEQ ID NO: 1643545 - protein, 7 aa, Staphylococcus aureus
SLQEETL

SEQ ID NO: 1643546 - protein, 6 aa, Staphylococcus aureus
SLQPVE

SEQ ID NO: 1643547 - protein, 8 aa, Staphylococcus aureus
SLQSNGSN

SEQ ID NO: 1643548 - protein, 12 aa, Staphylococcus aureus
SLQTSSKDRAEN

SEQ ID NO: 1643549 - protein, 7 aa, Staphylococcus aureus
SLRDPQI

SEQ ID NO: 1643550 - protein, 16 aa, Staphylococcus aureus
SLRHTSKKLSTILKGD

SEQ ID NO: 1643551 - protein, 12 aa, Staphylococcus aureus
SLRYKNAKEDMR

SEQ ID NO: 1643552 - protein, 15 aa, Staphylococcus aureus
SLSAKELKDGFKDVP

SEQ ID NO: 1643553 - protein, 13 aa, Staphylococcus aureus
SLSAKELKGGFKD

SEQ ID NO: 1643554 - protein, 18 aa, Staphylococcus aureus
SLSESESLSESESLSESE

SEQ ID NO: 1643555 - protein, 149 aa, Staphylococcus aureus; identical to SEQ ID NO: 1564702

SEQ ID NO: 1643556 - protein, 17 aa, Staphylococcus aureus
SLSFSKSVERMTKSSGI

SEQ ID NO: 1643557 - protein, 16 aa, Staphylococcus aureus
SLSGLSSEAIKREGKN

SEQ ID NO: 1643558 - protein, 8 aa, Staphylococcus aureus
SLSKDNEV

SEQ ID NO: 1643559 - protein, 17 aa, Staphylococcus aureus
SLSPANLPDNDGNGGGF

SEQ ID NO: 1643560 - protein, 4 aa, Staphylococcus aureus
SLSQ

SEQ ID NO: 1643561 - protein, 9 aa, Staphylococcus aureus
SLSQTYKQL

SEQ ID NO: 1643562 - protein, 6 aa, Staphylococcus aureus
SLSSAQ

SEQ ID NO: 1643563 - protein, 9 aa, Staphylococcus aureus
SLSSDDQII

SEQ ID NO: 1643564 - protein, 11 aa, Staphylococcus aureus
SLSSISKNKDI

SEQ ID NO: 1643565 - protein, 5 aa, Staphylococcus aureus
SLSTS

SEQ ID NO: 1643566 - protein, 5 aa, Staphylococcus aureus
SLSTY

SEQ ID NO: 1643567 - protein, 11 aa, Staphylococcus aureus
SLTKDKELLDS

SEQ ID NO: 1643568 - protein, 29 aa, Staphylococcus aureus
SLTKDKELLDSDKLKDEYELKKRKDEYTD

SEQ ID NO: 1643569 - protein, 8 aa, Staphylococcus aureus
SLTQEQEV

SEQ ID NO: 1643570 - protein, 9 aa, Staphylococcus aureus
SLTQKGKKL

SEQ ID NO: 1643571 - protein, 15 aa, Staphylococcus aureus
SLTTDGQKVNNKDGI

SEQ ID NO: 1643572 - protein, 11 aa, Staphylococcus aureus
SLYADKNHSHT

SEQ ID NO: 1643573 - protein, 13 aa, Staphylococcus aureus
SLYESEKESAIEK

SEQ ID NO: 1643574 - protein, 13 aa, Staphylococcus aureus
SLYESEKQSAIEK

SEQ ID NO: 1643575 - protein, 14 aa, Staphylococcus aureus
SLYGPTVGDSIRLG

SEQ ID NO: 1643576 - protein, 10 aa, Staphylococcus aureus
SMAGRGTDIK

SEQ ID NO: 1643577 - protein, 15 aa, Staphylococcus aureus
SMDKTEKQAGQGYRG

SEQ ID NO: 1643578 - protein, 6 aa, Staphylococcus aureus
SMGSRS

SEQ ID NO: 1643579 - protein, 6 aa, Staphylococcus aureus
SNAFSK

SEQ ID NO: 1643580 - protein, 9 aa, Staphylococcus aureus
SNAKKVNQQ

SEQ ID NO: 1643581 - protein, 15 aa, Staphylococcus aureus
SNATGSDSGSKGLSD

SEQ ID NO: 1643582 - protein, 13 aa, Staphylococcus aureus
SNDETLTDDEQMK

SEQ ID NO: 1643583 - protein, 16 aa, Staphylococcus aureus
SNDKLREELQDKTKYL

SEQ ID NO: 1643584 - protein, 31 aa, Staphylococcus aureus
SNDSNLSSSHDVDENSTKQKHIKNKTTIDHN

SEQ ID NO: 1643585 - protein, 31 aa, Staphylococcus aureus
SNDSNLSSSHDVDESSTKQKQIKNKTTINHN

SEQ ID NO: 1643586 - protein, 8 aa, Staphylococcus aureus
SNDTKKNI

SEQ ID NO: 1643587 - protein, 6 aa, Staphylococcus aureus
SNDTND

SEQ ID NO: 1643588 - protein, 12 aa, Staphylococcus aureus
SNDVIADKDYQP

SEQ ID NO: 1643589 - protein, 9 aa, Staphylococcus aureus
SNEGSQKNL

SEQ ID NO: 1643590 - protein, 8 aa, Staphylococcus aureus
SNEIEKVT

SEQ ID NO: 1643591 - protein, 8 aa, Staphylococcus aureus
SNENFTDK

SEQ ID NO: 1643592 - protein, 7 aa, Staphylococcus aureus
SNERDTH

SEQ ID NO: 1643593 - protein, 4 aa, Staphylococcus aureus
SNFE

SEQ ID NO: 1643594 - protein, 8 aa, Staphylococcus aureus
SNFKGAKW

SEQ ID NO: 1643595 - protein, 6 aa, Staphylococcus aureus
SNFPGK

SEQ ID NO: 1643596 - protein, 8 aa, Staphylococcus aureus
SNFPGKDW

SEQ ID NO: 1643597 - protein, 16 aa, Staphylococcus aureus
SNGKKMSKSKGNVINP

SEQ ID NO: 1643598 - protein, 9 aa, Staphylococcus aureus
SNGLAAADA

SEQ ID NO: 1643599 - protein, 8 aa, Staphylococcus aureus
SNGPGNPE

SEQ ID NO: 1643600 - protein, 11 aa, Staphylococcus aureus
SNGRSNRYNKL

SEQ ID NO: 1643601 - protein, 6 aa, Staphylococcus aureus
SNGRYK

SEQ ID NO: 1643602 - protein, 8 aa, Staphylococcus aureus
SNGRYKPY

SEQ ID NO: 1643603 - protein, 5 aa, Staphylococcus aureus
SNHDE

SEQ ID NO: 1643604 - protein, 4 aa, Staphylococcus aureus
SNHL

SEQ ID NO: 1643605 - protein, 8 aa, Staphylococcus aureus
SNHSTETV

SEQ ID NO: 1643606 - protein, 7 aa, Staphylococcus aureus
SNITGDN

SEQ ID NO: 1643607 - protein, 7 aa, Staphylococcus aureus
SNKAAEK

SEQ ID NO: 1643608 - protein, 16 aa, Staphylococcus aureus
SNKDGKQDSTEKGIKG

SEQ ID NO: 1643609 - protein, 7 aa, Staphylococcus aureus
SNKKIQK

SEQ ID NO: 1643610 - protein, 16 aa, Staphylococcus aureus
SNKKIQKLENQLEKEK

SEQ ID NO: 1643611 - protein, 13 aa, Staphylococcus aureus
SNKKTQKSNYQNS

SEQ ID NO: 1643612 - protein, 6 aa, Staphylococcus aureus
SNKNLD

SEQ ID NO: 1643613 - protein, 20 aa, Staphylococcus aureus
SNKNYTKEENIEKERQEAQL

SEQ ID NO: 1643614 - protein, 17 aa, Staphylococcus aureus
SNKRTDHYGADSLKNSA

SEQ ID NO: 1643615 - protein, 5 aa, Staphylococcus aureus
SNKTV

SEQ ID NO: 1643616 - protein, 13 aa, Staphylococcus aureus
SNKYFKDNQKESM

SEQ ID NO: 1643617 - protein, 7 aa, Staphylococcus aureus
SNLESGN

SEQ ID NO: 1643618 - protein, 9 aa, Staphylococcus aureus
SNLGNKTGY

SEQ ID NO: 1643619 - protein, 12 aa, Staphylococcus aureus
SNLQYKPNQPHG

SEQ ID NO: 1643620 - protein, 51 aa, Staphylococcus aureus
SNMNEIEKQNAEITENVQNEAAESEQNVEEKTIENVNPKKQTEKVSTLSKR

SEQ ID NO: 1643621 - protein, 4 aa, Staphylococcus aureus
SNMS

SEQ ID NO: 1643622 - protein, 27 aa, Staphylococcus aureus
SNNANHRAKDSTPDYHKESFKTSEVPS

SEQ ID NO: 1643623 - protein, 15 aa, Staphylococcus aureus
SNNAQGDGKDKLKEP

SEQ ID NO: 1643624 - protein, 14 aa, Staphylococcus aureus
SNNATLSQADQTTI

SEQ ID NO: 1643625 - protein, 13 aa, Staphylococcus aureus
SNNATVSQADQTA

SEQ ID NO: 1643626 - protein, 6 aa, Staphylococcus aureus
SNNDSE

SEQ ID NO: 1643627 - protein, 7 aa, Staphylococcus aureus
SNNNEDY

SEQ ID NO: 1643628 - protein, 11 aa, Staphylococcus aureus
SNNNWKTNTHL

SEQ ID NO: 1643629 - protein, 8 aa, Staphylococcus aureus
SNNQGAST

SEQ ID NO: 1643630 - protein, 4 aa, Staphylococcus aureus
SNNV

SEQ ID NO: 1643631 - protein, 4 aa, Staphylococcus aureus
SNNY

SEQ ID NO: 1643632 - protein, 4 aa, Staphylococcus aureus
SNQD

SEQ ID NO: 1643633 - protein, 5 aa, Staphylococcus aureus
SNQDK

SEQ ID NO: 1643634 - protein, 12 aa, Staphylococcus aureus
SNQYKNSPSVSL

SEQ ID NO: 1643635 - protein, 13 aa, Staphylococcus aureus
SNQYSASAEYCGK

SEQ ID NO: 1643636 - protein, 5 aa, Staphylococcus aureus
SNRIE

SEQ ID NO: 1643637 - protein, 11 aa, Staphylococcus aureus
SNRKLDKETVR

SEQ ID NO: 1643638 - protein, 16 aa, Staphylococcus aureus
SNRRTDHYGADSLKNR

SEQ ID NO: 1643639 - protein, 10 aa, Staphylococcus aureus
SNRTLESKEV

SEQ ID NO: 1643640 - protein, 9 aa, Staphylococcus aureus
SNRTLKTKE

SEQ ID NO: 1643641 - protein, 10 aa, Staphylococcus aureus
SNSARLKGED

SEQ ID NO: 1643642 - protein, 7 aa, Staphylococcus aureus
SNSEQEA

SEQ ID NO: 1643643 - protein, 16 aa, Staphylococcus aureus
SNSSLRSEDKGDDMST

SEQ ID NO: 1643644 - protein, 6 aa, Staphylococcus aureus
SNSTDF

SEQ ID NO: 1643645 - protein, 15 aa, Staphylococcus aureus
SNTLTNNNRANGNNP

SEQ ID NO: 1643646 - protein, 4 aa, Staphylococcus aureus
SNTN

SEQ ID NO: 1643647 - protein, 6 aa, Staphylococcus aureus
SNTPEY

SEQ ID NO: 1643648 - protein, 5 aa, Staphylococcus aureus
SNTPI

SEQ ID NO: 1643649 - protein, 17 aa, Staphylococcus aureus
SNTRDALSKHAEQSRLH

SEQ ID NO: 1643650 - protein, 8 aa, Staphylococcus aureus
SNVKGDAD

SEQ ID NO: 1643651 - protein, 11 aa, Staphylococcus aureus
SNVNPSLRDAT

SEQ ID NO: 1643652 - protein, 28 aa, Staphylococcus aureus
SNVNPSLRDATVKNYKPQNEKQVHAKQT

SEQ ID NO: 1643653 - protein, 29 aa, Staphylococcus aureus
SNVNPSLRDATVNNYKPQNEKQVKAKQTA

SEQ ID NO: 1643654 - protein, 11 aa, Staphylococcus aureus
SNVNTEKRQQV

SEQ ID NO: 1643655 - protein, 7 aa, Staphylococcus aureus
SNVPSHR

SEQ ID NO: 1643656 - protein, 9 aa, Staphylococcus aureus
SNVPSVESH

SEQ ID NO: 1643657 - protein, 7 aa, Staphylococcus aureus
SNVSEEF

SEQ ID NO: 1643658 - protein, 6 aa, Staphylococcus aureus
SNVSPS

SEQ ID NO: 1643659 - protein, 4 aa, Staphylococcus aureus
SNVV

SEQ ID NO: 1643660 - protein, 31 aa, Staphylococcus aureus
SNWSNEETAYDSDKHDEIRNKIKNELEQLYN

SEQ ID NO: 1643661 - protein, 5 aa, Staphylococcus aureus
SNYHG

SEQ ID NO: 1643662 - protein, 13 aa, Staphylococcus aureus
SNYYRPQNVSRDY

SEQ ID NO: 1643663 - protein, 4 aa, Staphylococcus aureus
SPAF

SEQ ID NO: 1643664 - protein, 19 aa, Staphylococcus aureus
SPANDVKGSQPLSGELGKG

SEQ ID NO: 1643665 - protein, 7 aa, Staphylococcus aureus
SPDETEE

SEQ ID NO: 1643666 - protein, 7 aa, Staphylococcus aureus
SPEAANK

SEQ ID NO: 1643667 - protein, 5 aa, Staphylococcus aureus
SPEQI

SEQ ID NO: 1643668 - protein, 7 aa, Staphylococcus aureus
SPETKTV

SEQ ID NO: 1643669 - protein, 9 aa, Staphylococcus aureus
SPFQMSGGQ

SEQ ID NO: 1643670 - protein, 4 aa, Staphylococcus aureus
SPFT

SEQ ID NO: 1643671 - protein, 9 aa, Staphylococcus aureus
SPGGNGKTT

SEQ ID NO: 1643672 - protein, 6 aa, Staphylococcus aureus
SPGKNQ

SEQ ID NO: 1643673 - protein, 7 aa, Staphylococcus aureus
SPGYGRT

SEQ ID NO: 1643674 - protein, 23 aa, Staphylococcus aureus
SPISMSSEAKAYNISESETNVNE

SEQ ID NO: 1643675 - protein, 13 aa, Staphylococcus aureus
SPKTITVDRGKEF

SEQ ID NO: 1643676 - protein, 8 aa, Staphylococcus aureus
SPLSGDYT

SEQ ID NO: 1643677 - protein, 4 aa, Staphylococcus aureus
SPLT

SEQ ID NO: 1643678 - protein, 4 aa, Staphylococcus aureus
SPMH

SEQ ID NO: 1643679 - protein, 5 aa, Staphylococcus aureus
SPMRD

SEQ ID NO: 1643680 - protein, 9 aa, Staphylococcus aureus
SPNAKNPHK

SEQ ID NO: 1643681 - protein, 6 aa, Staphylococcus aureus
SPNISS

SEQ ID NO: 1643682 - protein, 8 aa, Staphylococcus aureus
SPNPNSTS

SEQ ID NO: 1643683 - protein, 7 aa, Staphylococcus aureus
SPNPTNY

SEQ ID NO: 1643684 - protein, 14 aa, Staphylococcus aureus
SPQVVGKKPHEINN

SEQ ID NO: 1643685 - protein, 17 aa, Staphylococcus aureus
SPRLSLSEKSLKHTPSF

SEQ ID NO: 1643686 - protein, 15 aa, Staphylococcus aureus
SPRQIASQIEKDTGH

SEQ ID NO: 1643687 - protein, 7 aa, Staphylococcus aureus
SPRTEKK

SEQ ID NO: 1643688 - protein, 5 aa, Staphylococcus aureus
SPTKQ

SEQ ID NO: 1643689 - protein, 4 aa, Staphylococcus aureus
SQDF

SEQ ID NO: 1643690 - protein, 16 aa, Staphylococcus aureus
SQDNQSISKKITGYGL

SEQ ID NO: 1643691 - protein, 4 aa, Staphylococcus aureus
SQDT

SEQ ID NO: 1643692 - protein, 11 aa, Staphylococcus aureus
SQEDSIKGHGH

SEQ ID NO: 1643693 - protein, 18 aa, Staphylococcus aureus
SQEINNRESEKGCLWALA

SEQ ID NO: 1643694 - protein, 25 aa, Staphylococcus aureus
SQEITDNEGRTKGSTNYVNADTQVK

SEQ ID NO: 1643695 - protein, 9 aa, Staphylococcus aureus
SQFNPKQCE

SEQ ID NO: 1643696 - protein, 7 aa, Staphylococcus aureus
SQGDKAV

SEQ ID NO: 1643697 - protein, 6 aa, Staphylococcus aureus
SQGDVK

SEQ ID NO: 1643698 - protein, 8 aa, Staphylococcus aureus
SQGGNTQS

SEQ ID NO: 1643699 - protein, 12 aa, Staphylococcus aureus
SQGTQTQENADI

SEQ ID NO: 1643700 - protein, 12 aa, Staphylococcus aureus
SQGTQTQESADV

SEQ ID NO: 1643701 - protein, 7 aa, Staphylococcus aureus
SQIEEKK

SEQ ID NO: 1643702 - protein, 4 aa, Staphylococcus aureus
SQIQ

SEQ ID NO: 1643703 - protein, 27 aa, Staphylococcus aureus
SQIQEKQEELDKLKEKDGGSEDDPQPV

SEQ ID NO: 1643704 - protein, 28 aa, Staphylococcus aureus
SQIQEKQEELDKLKEKDGTSENNPQTVE

SEQ ID NO: 1643705 - protein, 41 aa, Staphylococcus aureus
SQIQEKQEELDKLKEKDRTSENNQQSVEVNEARTYRNQANI

SEQ ID NO: 1643706 - protein, 14 aa, Staphylococcus aureus
SQKANSFNSGFPAS

SEQ ID NO: 1643707 - protein, 14 aa, Staphylococcus aureus
SQKGNTGKGTTASE

SEQ ID NO: 1643708 - protein, 6 aa, Staphylococcus aureus
SQKSLQ

SEQ ID NO: 1643709 - protein, 14 aa, Staphylococcus aureus
SQKSNAFNSGFPAS

SEQ ID NO: 1643710 - protein, 7 aa, Staphylococcus aureus
SQLKSSL

SEQ ID NO: 1643711 - protein, 7 aa, Staphylococcus aureus
SQLTPET

SEQ ID NO: 1643712 - protein, 7 aa, Staphylococcus aureus
SQNDGEL

SEQ ID NO: 1643713 - protein, 6 aa, Staphylococcus aureus
SQNETD

SEQ ID NO: 1643714 - protein, 8 aa, Staphylococcus aureus
SQNGRNYQ

SEQ ID NO: 1643715 - protein, 6 aa, Staphylococcus aureus
SQNNEF

SEQ ID NO: 1643716 - protein, 10 aa, Staphylococcus aureus
SQNYDIAPSE

SEQ ID NO: 1643717 - protein, 13 aa, Staphylococcus aureus
SQPADTEKGRIEQ

SEQ ID NO: 1643718 - protein, 6 aa, Staphylococcus aureus
SQPTLP

SEQ ID NO: 1643719 - protein, 4 aa, Staphylococcus aureus
SQQA

SEQ ID NO: 1643720 - protein, 9 aa, Staphylococcus aureus
SQQEDYESD

SEQ ID NO: 1643721 - protein, 9 aa, Staphylococcus aureus
SQRKDRNGF

SEQ ID NO: 1643722 - protein, 12 aa, Staphylococcus aureus
SQRLIDEQSGEV

SEQ ID NO: 1643723 - protein, 11 aa, Staphylococcus aureus
SQSLENDAMPN

SEQ ID NO: 1643724 - protein, 8 aa, Staphylococcus aureus
SQSTGNVT

SEQ ID NO: 1643725 - protein, 4 aa, Staphylococcus aureus
SQTI

SEQ ID NO: 1643726 - protein, 6 aa, Staphylococcus aureus
SQTSGT

SEQ ID NO: 1643727 - protein, 7 aa, Staphylococcus aureus
SQTTVTE

SEQ ID NO: 1643728 - protein, 7 aa, Staphylococcus aureus
SQVADEA

SEQ ID NO: 1643729 - protein, 6 aa, Staphylococcus aureus
SQVGAG

SEQ ID NO: 1643730 - protein, 15 aa, Staphylococcus aureus
SQVKQKIKAGHESLA

SEQ ID NO: 1643731 - protein, 10 aa, Staphylococcus aureus
SQWTVPNEHK

SEQ ID NO: 1643732 - protein, 6 aa, Staphylococcus aureus
SQYTTT

SEQ ID NO: 1643733 - protein, 12 aa, Staphylococcus aureus
SRALSTNDDIET

SEQ ID NO: 1643734 - protein, 6 aa, Staphylococcus aureus
SRCSKD

SEQ ID NO: 1643735 - protein, 5 aa, Staphylococcus aureus
SRDSL

SEQ ID NO: 1643736 - protein, 8 aa, Staphylococcus aureus
SRDSYLPP

SEQ ID NO: 1643737 - protein, 13 aa, Staphylococcus aureus
SRDTTEKEIEDQL

SEQ ID NO: 1643738 - protein, 8 aa, Staphylococcus aureus
SREGRYAY

SEQ ID NO: 1643739 - protein, 8 aa, Staphylococcus aureus
SRGTGDWN

SEQ ID NO: 1643740 - protein, 13 aa, Staphylococcus aureus
SRIPGKGGDATKF

SEQ ID NO: 1643741 - protein, 13 aa, Staphylococcus aureus
SRIPGKNGDTTKF

SEQ ID NO: 1643742 - protein, 9 aa, Staphylococcus aureus
SRIRNNKEI

SEQ ID NO: 1643743 - protein, 8 aa, Staphylococcus aureus
SRKQSRKE

SEQ ID NO: 1643744 - protein, 12 aa, Staphylococcus aureus
SRKRRQSSKSID

SEQ ID NO: 1643745 - protein, 10 aa, Staphylococcus aureus
SRKVNPKRLQ

SEQ ID NO: 1643746 - protein, 10 aa, Staphylococcus aureus
SRLPSGRPRI

SEQ ID NO: 1643747 - protein, 15 aa, Staphylococcus aureus
SRNRYTKEIVILTNS

SEQ ID NO: 1643748 - protein, 5 aa, Staphylococcus aureus
SRQDN

SEQ ID NO: 1643749 - protein, 11 aa, Staphylococcus aureus
SRQSGGRGQYG

SEQ ID NO: 1643750 - protein, 8 aa, Staphylococcus aureus
SRRNSDVN

SEQ ID NO: 1643751 - protein, 7 aa, Staphylococcus aureus
SRSLKEY

SEQ ID NO: 1643752 - protein, 24 aa, Staphylococcus aureus
SRTNGLKLTPRENGFESHSFERMP

SEQ ID NO: 1643753 - protein, 17 aa, Staphylococcus aureus
SRTSGLKLTPRENGFES

SEQ ID NO: 1643754 - protein, 17 aa, Staphylococcus aureus
SRTSGLKLTPRENSFES

SEQ ID NO: 1643755 - protein, 14 aa, Staphylococcus aureus
SRVEEKSKRFYKKE

SEQ ID NO: 1643756 - protein, 12 aa, Staphylococcus aureus
SRVNNKVDYDQY

SEQ ID NO: 1643757 - protein, 11 aa, Staphylococcus aureus
SRVSGGDVNEA

SEQ ID NO: 1643758 - protein, 12 aa, Staphylococcus aureus
SRYTANNDIDTI

SEQ ID NO: 1643759 - protein, 9 aa, Staphylococcus aureus
SSAGGTEFP

SEQ ID NO: 1643760 - protein, 19 aa, Staphylococcus aureus
SSATRVSGVDTVKQNAQHL

SEQ ID NO: 1643761 - protein, 9 aa, Staphylococcus aureus
SSATSAKIA

SEQ ID NO: 1643762 - protein, 6 aa, Staphylococcus aureus
SSDEFI

SEQ ID NO: 1643763 - protein, 17 aa, Staphylococcus aureus
SSDIDSNDMNDTYDNNI

SEQ ID NO: 1643764 - protein, 14 aa, Staphylococcus aureus
SSDLTEAETQEAHK

SEQ ID NO: 1643765 - protein, 32 aa, Staphylococcus aureus
SSDMTNDSNQQQLETEVRQQSQISEEQATSTT

SEQ ID NO: 1643766 - protein, 4 aa, Staphylococcus aureus
SSDN

SEQ ID NO: 1643767 - protein, 12 aa, Staphylococcus aureus
SSDQRGKTLNDP

SEQ ID NO: 1643768 - protein, 7 aa, Staphylococcus aureus
SSEEAAN

SEQ ID NO: 1643769 - protein, 5 aa, Staphylococcus aureus
SSEID

SEQ ID NO: 1643770 - protein, 13 aa, Staphylococcus aureus
SSELGKDDPFNPA

SEQ ID NO: 1643771 - protein, 11 aa, Staphylococcus aureus
SSENTEEQEKI

SEQ ID NO: 1643772 - protein, 7 aa, Staphylococcus aureus
SSERNTH

SEQ ID NO: 1643773 - protein, 15 aa, Staphylococcus aureus
SSERPTDEERHLNQN

SEQ ID NO: 1643774 - protein, 6 aa, Staphylococcus aureus
SSFDDN

SEQ ID NO: 1643775 - protein, 28 aa, Staphylococcus aureus
SSFENSVTAPAGNQGHGLDKNEFDKKAE

SEQ ID NO: 1643776 - protein, 18 aa, Staphylococcus aureus
SSGEKINEDLRSGTNDHK

SEQ ID NO: 1643777 - protein, 13 aa, Staphylococcus aureus
SSGGSNESNGNTE

SEQ ID NO: 1643778 - protein, 8 aa, Staphylococcus aureus
SSGKGEAV

SEQ ID NO: 1643779 - protein, 16 aa, Staphylococcus aureus
SSGSVIANGQELNKLN

SEQ ID NO: 1643780 - protein, 5 aa, Staphylococcus aureus
SSHAM

SEQ ID NO: 1643781 - protein, 17 aa, Staphylococcus aureus
SSHVTGYDAKGSTTGRD

SEQ ID NO: 1643782 - protein, 5 aa, Staphylococcus aureus
SSIEN

SEQ ID NO: 1643783 - protein, 15 aa, Staphylococcus aureus
SSINTKNDARDNHLK

SEQ ID NO: 1643784 - protein, 22 aa, Staphylococcus aureus
SSITEDTLTEITNTEKTTELSS

SEQ ID NO: 1643785 - protein, 8 aa, Staphylococcus aureus
SSKDKKYY

SEQ ID NO: 1643786 - protein, 12 aa, Staphylococcus aureus
SSKEEAEKAGVE

SEQ ID NO: 1643787 - protein, 9 aa, Staphylococcus aureus
SSKEEAGVE

SEQ ID NO: 1643788 - protein, 10 aa, Staphylococcus aureus
SSKGRVRTHK

SEQ ID NO: 1643789 - protein, 14 aa, Staphylococcus aureus
SSKNDKYVSYKETQ

SEQ ID NO: 1643790 - protein, 14 aa, Staphylococcus aureus
SSKQAPGIITKTKL

SEQ ID NO: 1643791 - protein, 24 aa, Staphylococcus aureus
SSKQAPGIVDQDRNRLTDSGAVVS

SEQ ID NO: 1643792 - protein, 26 aa, Staphylococcus aureus
SSKSHKKFQKELDSKANERGNNNKDD

SEQ ID NO: 1643793 - protein, 25 aa, Staphylococcus aureus
SSKTPGHPEYRHTDGVEVTTGPLGQ

SEQ ID NO: 1643794 - protein, 12 aa, Staphylococcus aureus
SSLNDTTKDESI

SEQ ID NO: 1643795 - protein, 8 aa, Staphylococcus aureus
SSLNNDGH

SEQ ID NO: 1643796 - protein, 6 aa, Staphylococcus aureus
SSLPNN

SEQ ID NO: 1643797 - protein, 10 aa, Staphylococcus aureus
SSLPSGRPRI

SEQ ID NO: 1643798 - protein, 10 aa, Staphylococcus aureus
SSLSTKDAID

SEQ ID NO: 1643799 - protein, 8 aa, Staphylococcus aureus
SSLTDTDQ

SEQ ID NO: 1643800 - protein, 5 aa, Staphylococcus aureus
SSMPI

SEQ ID NO: 1643801 - protein, 10 aa, Staphylococcus aureus
SSNAKDDADM

SEQ ID NO: 1643802 - protein, 5 aa, Staphylococcus aureus
SSNDI

SEQ ID NO: 1643803 - protein, 12 aa, Staphylococcus aureus
SSNFSKDKKLDD

SEQ ID NO: 1643804 - protein, 11 aa, Staphylococcus aureus
SSNKKNNSELD

SEQ ID NO: 1643805 - protein, 5 aa, Staphylococcus aureus
SSPGI

SEQ ID NO: 1643806 - protein, 10 aa, Staphylococcus aureus
SSPPVSGSSD

SEQ ID NO: 1643807 - protein, 14 aa, Staphylococcus aureus
SSPSSAKIAAEQGI

SEQ ID NO: 1643808 - protein, 5 aa, Staphylococcus aureus
SSPTI

SEQ ID NO: 1643809 - protein, 8 aa, Staphylococcus aureus
SSQPITIE

SEQ ID NO: 1643810 - protein, 18 aa, Staphylococcus aureus
SSQPITIEGRTSKQPLTA

SEQ ID NO: 1643811 - protein, 18 aa, Staphylococcus aureus
SSQPITIERRTSKQPLTA

SEQ ID NO: 1643812 - protein, 9 aa, Staphylococcus aureus
SSQSSSQAY

SEQ ID NO: 1643813 - protein, 22 aa, Staphylococcus aureus
SSRGEQTTESVEKEMKKTEKVE

SEQ ID NO: 1643814 - protein, 5 aa, Staphylococcus aureus
SSRID

SEQ ID NO: 1643815 - protein, 26 aa, Staphylococcus aureus
SSSENAKKSKEDSKEDSKEDQIKKSF

SEQ ID NO: 1643816 - protein, 8 aa, Staphylococcus aureus
SSSENSSV

SEQ ID NO: 1643817 - protein, 8 aa, Staphylococcus aureus
SSSGSGSI

SEQ ID NO: 1643818 - protein, 4 aa, Staphylococcus aureus
SSST

SEQ ID NO: 1643819 - protein, 5 aa, Staphylococcus aureus
SSSTY

SEQ ID NO: 1643820 - protein, 4 aa, Staphylococcus aureus
SSSY

SEQ ID NO: 1643821 - protein, 7 aa, Staphylococcus aureus
SSTSAQT

SEQ ID NO: 1643822 - protein, 9 aa, Staphylococcus aureus
SSTTLKDTT

SEQ ID NO: 1643823 - protein, 10 aa, Staphylococcus aureus
SSTTLKDTTG

SEQ ID NO: 1643824 - protein, 8 aa, Staphylococcus aureus
SSVDQLKE

SEQ ID NO: 1643825 - protein, 9 aa, Staphylococcus aureus
SSVEDSDSS

SEQ ID NO: 1643826 - protein, 21 aa, Staphylococcus aureus
SSVEGKLDEKKYNSTYLSTFN

SEQ ID NO: 1643827 - protein, 13 aa, Staphylococcus aureus
SSVEGKLDEKNTI

SEQ ID NO: 1643828 - protein, 6 aa, Staphylococcus aureus
SSVKAQ

SEQ ID NO: 1643829 - protein, 21 aa, Staphylococcus aureus
SSVQIEDAASQSAAYVVMPMR

SEQ ID NO: 1643830 - protein, 14 aa, Staphylococcus aureus
SSYGSTHKADAMNI

SEQ ID NO: 1643831 - protein, 13 aa, Staphylococcus aureus
SSYGSTHKAGAMN

SEQ ID NO: 1643832 - protein, 4 aa, Staphylococcus aureus
SSYI

SEQ ID NO: 1643833 - protein, 7 aa, Staphylococcus aureus
SSYKKPY

SEQ ID NO: 1643834 - protein, 4 aa, Staphylococcus aureus
SSYV

SEQ ID NO: 1643835 - protein, 5 aa, Staphylococcus aureus
STAYE

SEQ ID NO: 1643836 - protein, 5 aa, Staphylococcus aureus
STAYQ

SEQ ID NO: 1643837 - protein, 27 aa, Staphylococcus aureus
STDDDENKKVDIESTENQFESKDKTTK

SEQ ID NO: 1643838 - protein, 18 aa, Staphylococcus aureus
STDNASWGVGPNKEKLDS

SEQ ID NO: 1643839 - protein, 29 aa, Staphylococcus aureus
STDNASWRGPNTEADEKSAYDNVQVGAGQ

SEQ ID NO: 1643840 - protein, 16 aa, Staphylococcus aureus
STDNASWRSPNTEKLD

SEQ ID NO: 1643841 - protein, 13 aa, Staphylococcus aureus
STDPVTVDNNGNV

SEQ ID NO: 1643842 - protein, 6 aa, Staphylococcus aureus
STDRQV

SEQ ID NO: 1643843 - protein, 7 aa, Staphylococcus aureus
STDTEKS

SEQ ID NO: 1643844 - protein, 13 aa, Staphylococcus aureus
STEEVKEENIKKE

SEQ ID NO: 1643845 - protein, 4 aa, Staphylococcus aureus
STEI

SEQ ID NO: 1643846 - protein, 4 aa, Staphylococcus aureus
STEL

SEQ ID NO: 1643847 - protein, 4 aa, Staphylococcus aureus
STFI

SEQ ID NO: 1643848 - protein, 37 aa, Staphylococcus aureus
STFTSNAPNRNYATASANEITSKTVSNVSRTGNNANV

SEQ ID NO: 1643849 - protein, 10 aa, Staphylococcus aureus
STGKSKGIQF

SEQ ID NO: 1643850 - protein, 12 aa, Staphylococcus aureus
STGLKDKNNNEI

SEQ ID NO: 1643851 - protein, 4 aa, Staphylococcus aureus
STGQ

SEQ ID NO: 1643852 - protein, 8 aa, Staphylococcus aureus
STGQPHEH

SEQ ID NO: 1643853 - protein, 17 aa, Staphylococcus aureus
STGRKHTHITKANSNQR

SEQ ID NO: 1643854 - protein, 18 aa, Staphylococcus aureus
STGRKHTHITRAKSNQRY

SEQ ID NO: 1643855 - protein, 18 aa, Staphylococcus aureus
STGRKHTHVTKAKSNQRF

SEQ ID NO: 1643856 - protein, 6 aa, Staphylococcus aureus
STGSLG

SEQ ID NO: 1643857 - protein, 4 aa, Staphylococcus aureus
STGT

SEQ ID NO: 1643858 - protein, 5 aa, Staphylococcus aureus
STGTA

SEQ ID NO: 1643859 - protein, 8 aa, Staphylococcus aureus
STGVSPQF

SEQ ID NO: 1643860 - protein, 11 aa, Staphylococcus aureus
STGVVDEQKGE

SEQ ID NO: 1643861 - protein, 6 aa, Staphylococcus aureus
STHADS

SEQ ID NO: 1643862 - protein, 9 aa, Staphylococcus aureus
STHDSSATI

SEQ ID NO: 1643863 - protein, 6 aa, Staphylococcus aureus
STHSRN

SEQ ID NO: 1643864 - protein, 11 aa, Staphylococcus aureus
STIEKDTAISF

SEQ ID NO: 1643865 - protein, 8 aa, Staphylococcus aureus
STIGKGTT

SEQ ID NO: 1643866 - protein, 6 aa, Staphylococcus aureus
STINEA

SEQ ID NO: 1643867 - protein, 10 aa, Staphylococcus aureus
STINPENTEK

SEQ ID NO: 1643868 - protein, 5 aa, Staphylococcus aureus
STISS

SEQ ID NO: 1643869 - protein, 5 aa, Staphylococcus aureus
STKDA

SEQ ID NO: 1643870 - protein, 12 aa, Staphylococcus aureus
STKEIAKAEKAY

SEQ ID NO: 1643871 - protein, 13 aa, Staphylococcus aureus
STKGYTSKRTNDI

SEQ ID NO: 1643872 - protein, 4 aa, Staphylococcus aureus
STKI

SEQ ID NO: 1643873 - protein, 8 aa, Staphylococcus aureus
STKNPGKI

SEQ ID NO: 1643874 - protein, 14 aa, Staphylococcus aureus
STKVSKKLNEDSSL

SEQ ID NO: 1643875 - protein, 9 aa, Staphylococcus aureus
STKYNPNVV

SEQ ID NO: 1643876 - protein, 12 aa, Staphylococcus aureus
STLINSNKANID

SEQ ID NO: 1643877 - protein, 7 aa, Staphylococcus aureus
STLTSDR

SEQ ID NO: 1643878 - protein, 9 aa, Staphylococcus aureus
STLTTRQAE

SEQ ID NO: 1643879 - protein, 5 aa, Staphylococcus aureus
STMSK

SEQ ID NO: 1643880 - protein, 12 aa, Staphylococcus aureus
STNDVEAKETDA

SEQ ID NO: 1643881 - protein, 10 aa, Staphylococcus aureus
STNEEEATNT

SEQ ID NO: 1643882 - protein, 5 aa, Staphylococcus aureus
STNEG

SEQ ID NO: 1643883 - protein, 10 aa, Staphylococcus aureus
STNEKGKSVV

SEQ ID NO: 1643884 - protein, 17 aa, Staphylococcus aureus
STNGMPKFTDKTGGTNR

SEQ ID NO: 1643885 - protein, 8 aa, Staphylococcus aureus
STNPITYG

SEQ ID NO: 1643886 - protein, 9 aa, Staphylococcus aureus
STNSTQNNI

SEQ ID NO: 1643887 - protein, 16 aa, Staphylococcus aureus
STNTKHTFFNTNVYNI

SEQ ID NO: 1643888 - protein, 29 aa, Staphylococcus aureus
STPAGYTPTTANAGTDDAVDSDGLTTTGV

SEQ ID NO: 1643889 - protein, 10 aa, Staphylococcus aureus
STPENLAEQI

SEQ ID NO: 1643890 - protein, 5 aa, Staphylococcus aureus
STPLS

SEQ ID NO: 1643891 - protein, 5 aa, Staphylococcus aureus
STPLT

SEQ ID NO: 1643892 - protein, 6 aa, Staphylococcus aureus
STPNDK

SEQ ID NO: 1643893 - protein, 4 aa, Staphylococcus aureus
STQF

SEQ ID NO: 1643894 - protein, 13 aa, Staphylococcus aureus
STQIDDGAETNYD

SEQ ID NO: 1643895 - protein, 10 aa, Staphylococcus aureus
STQSQGDVRS

SEQ ID NO: 1643896 - protein, 11 aa, Staphylococcus aureus
STQSQGDVRSA

SEQ ID NO: 1643897 - protein, 8 aa, Staphylococcus aureus
STRDDNSS

SEQ ID NO: 1643898 - protein, 7 aa, Staphylococcus aureus
STRNIKG

SEQ ID NO: 1643899 - protein, 4 aa, Staphylococcus aureus
STRR

SEQ ID NO: 1643900 - protein, 201 aa, Staphylococcus aureus
STSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLS

SEQ ID NO: 1643901 - protein, 80 aa, Staphylococcus aureus
STSASTSKSTSVSLSDSVSASKSLSTSESNSVSSSTSTSLVNSQSVSSSMSGSVSKSTSLSDSISNSSSTRKIRKSINKH

SEQ ID NO: 1643902 - protein, 13 aa, Staphylococcus aureus
STSAYNGDDTEGL

SEQ ID NO: 1643903 - protein, 15 aa, Staphylococcus aureus
STSHIRTNQQSQITL

SEQ ID NO: 1643904 - protein, 6 aa, Staphylococcus aureus
STSKTK

SEQ ID NO: 1643905 - protein, 5 aa, Staphylococcus aureus
STSND

SEQ ID NO: 1643906 - protein, 14 aa, Staphylococcus aureus
STSPGINEEANQLE

SEQ ID NO: 1643907 - protein, 6 aa, Staphylococcus aureus
STSTMD

SEQ ID NO: 1643908 - protein, 14 aa, Staphylococcus aureus
STTEQFQSHGLTKN

SEQ ID NO: 1643909 - protein, 22 aa, Staphylococcus aureus
STTGLNDPDADPSVRLSPYTRQ

SEQ ID NO: 1643910 - protein, 14 aa, Staphylococcus aureus
STTGQNALSQARNF

SEQ ID NO: 1643911 - protein, 6 aa, Staphylococcus aureus
STTTSL

SEQ ID NO: 1643912 - protein, 6 aa, Staphylococcus aureus
STVETQ

SEQ ID NO: 1643913 - protein, 8 aa, Staphylococcus aureus
STVGKGTT

SEQ ID NO: 1643914 - protein, 19 aa, Staphylococcus aureus
STVHGGGQEYGVRSGTVNL

SEQ ID NO: 1643915 - protein, 6 aa, Staphylococcus aureus
SVAEND

SEQ ID NO: 1643916 - protein, 7 aa, Staphylococcus aureus
SVEADTE

SEQ ID NO: 1643917 - protein, 9 aa, Staphylococcus aureus
SVEDRYKAR

SEQ ID NO: 1643918 - protein, 7 aa, Staphylococcus aureus
SVEGQGT

SEQ ID NO: 1643919 - protein, 6 aa, Staphylococcus aureus
SVENAQ

SEQ ID NO: 1643920 - protein, 21 aa, Staphylococcus aureus
SVESNKLDDDSSENGKTPEYS

SEQ ID NO: 1643921 - protein, 20 aa, Staphylococcus aureus
SVESNKLDDDSSETGKMPEY

SEQ ID NO: 1643922 - protein, 22 aa, Staphylococcus aureus
SVESNKLDDDSSETGKTPEYSL

SEQ ID NO: 1643923 - protein, 21 aa, Staphylococcus aureus
SVESNKLDDDTSETGKTPEYS

SEQ ID NO: 1643924 - protein, 7 aa, Staphylococcus aureus
SVFEPDE

SEQ ID NO: 1643925 - protein, 16 aa, Staphylococcus aureus
SVGGITKANRKKVDYK

SEQ ID NO: 1643926 - protein, 17 aa, Staphylococcus aureus
SVGGITKTNSKKVDHKA

SEQ ID NO: 1643927 - protein, 15 aa, Staphylococcus aureus
SVGNLSQSMNSNYDA

SEQ ID NO: 1643928 - protein, 14 aa, Staphylococcus aureus
SVGPKLGNKTKNIQ

SEQ ID NO: 1643929 - protein, 8 aa, Staphylococcus aureus
SVITDKEG

SEQ ID NO: 1643930 - protein, 13 aa, Staphylococcus aureus
SVKDTEIKNGKEV

SEQ ID NO: 1643931 - protein, 7 aa, Staphylococcus aureus
SVKERQE

SEQ ID NO: 1643932 - protein, 5 aa, Staphylococcus aureus
SVKKY

SEQ ID NO: 1643933 - protein, 4 aa, Staphylococcus aureus
SVNI

SEQ ID NO: 1643934 - protein, 8 aa, Staphylococcus aureus
SVNPGGSM

SEQ ID NO: 1643935 - protein, 8 aa, Staphylococcus aureus
SVNQDNTS

SEQ ID NO: 1643936 - protein, 15 aa, Staphylococcus aureus
SVNQQGNDIGQKYRT

SEQ ID NO: 1643937 - protein, 15 aa, Staphylococcus aureus
SVNRQGNDIGEKYRT

SEQ ID NO: 1643938 - protein, 5 aa, Staphylococcus aureus
SVPTR

SEQ ID NO: 1643939 - protein, 8 aa, Staphylococcus aureus
SVRAREKA

SEQ ID NO: 1643940 - protein, 4 aa, Staphylococcus aureus
SVRI

SEQ ID NO: 1643941 - protein, 13 aa, Staphylococcus aureus
SVRPDMDKDFQEK

SEQ ID NO: 1643942 - protein, 17 aa, Staphylococcus aureus
SVRSGDEPLEDRTTNNT

SEQ ID NO: 1643943 - protein, 5 aa, Staphylococcus aureus
SVSDL

SEQ ID NO: 1643944 - protein, 9 aa, Staphylococcus aureus
SVSGQSGLK

SEQ ID NO: 1643945 - protein, 35 aa, Staphylococcus aureus
SVSPSEIGEDGRLENKTNKITMSGGNWEKIKKEIK

SEQ ID NO: 1643946 - protein, 12 aa, Staphylococcus aureus
SVTKQDPDIPAD

SEQ ID NO: 1643947 - protein, 8 aa, Staphylococcus aureus
SVTNSDTP

SEQ ID NO: 1643948 - protein, 15 aa, Staphylococcus aureus
SVTNSKKHCISRYFI

SEQ ID NO: 1643949 - protein, 7 aa, Staphylococcus aureus
SVTPELA

SEQ ID NO: 1643950 - protein, 4 aa, Staphylococcus aureus
SWGE

SEQ ID NO: 1643951 - protein, 11 aa, Staphylococcus aureus
SWKTDQADAHK

SEQ ID NO: 1643952 - protein, 5 aa, Staphylococcus aureus
SWPEV

SEQ ID NO: 1643953 - protein, 4 aa, Staphylococcus aureus
SWQG

SEQ ID NO: 1643954 - protein, 12 aa, Staphylococcus aureus
SWWGPNKEKLDS

SEQ ID NO: 1643955 - protein, 7 aa, Staphylococcus aureus
SYDPTYG

SEQ ID NO: 1643956 - protein, 6 aa, Staphylococcus aureus
SYEDGD

SEQ ID NO: 1643957 - protein, 11 aa, Staphylococcus aureus
SYGKRTERHPR

SEQ ID NO: 1643958 - protein, 6 aa, Staphylococcus aureus
SYGPKQ

SEQ ID NO: 1643959 - protein, 17 aa, Staphylococcus aureus
SYGPSQGKTFECKGGRK

SEQ ID NO: 1643960 - protein, 20 aa, Staphylococcus aureus
SYGQLSKSKEYEVTKSESLN

SEQ ID NO: 1643961 - protein, 8 aa, Staphylococcus aureus
SYKQDKVE

SEQ ID NO: 1643962 - protein, 6 aa, Staphylococcus aureus
SYKTNN

SEQ ID NO: 1643963 - protein, 14 aa, Staphylococcus aureus
SYNDDKNRNLNGAA

SEQ ID NO: 1643964 - protein, 10 aa, Staphylococcus aureus
SYNGGEINQT

SEQ ID NO: 1643965 - protein, 35 aa, Staphylococcus aureus
SYNPFVTKTSESLIADDESSGYNNTREKDEDYFKK

SEQ ID NO: 1643966 - protein, 13 aa, Staphylococcus aureus
SYNPNAPNYSAEY

SEQ ID NO: 1643967 - protein, 24 aa, Staphylococcus aureus
SYNPNAPNYSAEYKINDDDNNIKQ

SEQ ID NO: 1643968 - protein, 10 aa, Staphylococcus aureus
SYQQYSKDHP

SEQ ID NO: 1643969 - protein, 9 aa, Staphylococcus aureus
SYQSTAMTE

SEQ ID NO: 1643970 - protein, 14 aa, Staphylococcus aureus
SYSDLNSKKYAEKY

SEQ ID NO: 1643971 - protein, 6 aa, Staphylococcus aureus
SYTDEL

SEQ ID NO: 1643972 - protein, 29 aa, Staphylococcus aureus
SYTNNASFPAYHRPTSPDYTVGTESLTQQ

SEQ ID NO: 1643973 - protein, 13 aa, Staphylococcus aureus
TAAKNKATSLNTA

SEQ ID NO: 1643974 - protein, 6 aa, Staphylococcus aureus
TAANDT

SEQ ID NO: 1643975 - protein, 14 aa, Staphylococcus aureus
TADLEKTRLYLRSS

SEQ ID NO: 1643976 - protein, 8 aa, Staphylococcus aureus
TADQSDAY

SEQ ID NO: 1643977 - protein, 12 aa, Staphylococcus aureus
TAEKPGDITKDN

SEQ ID NO: 1643978 - protein, 18 aa, Staphylococcus aureus
TAERATVKAELKDKYGIT

SEQ ID NO: 1643979 - protein, 6 aa, Staphylococcus aureus
TAESWD

SEQ ID NO: 1643980 - protein, 11 aa, Staphylococcus aureus
TAGDNKLGGDD

SEQ ID NO: 1643981 - protein, 17 aa, Staphylococcus aureus
TAGGGGKGIRVARDEKE

SEQ ID NO: 1643982 - protein, 9 aa, Staphylococcus aureus
TAGLTGTVV

SEQ ID NO: 1643983 - protein, 4 aa, Staphylococcus aureus
TAGM

SEQ ID NO: 1643984 - protein, 8 aa, Staphylococcus aureus
TAGSPIDL

SEQ ID NO: 1643985 - protein, 6 aa, Staphylococcus aureus
TAHYGN

SEQ ID NO: 1643986 - protein, 7 aa, Staphylococcus aureus
TAIENNN

SEQ ID NO: 1643987 - protein, 43 aa, Staphylococcus aureus; identical to SEQ ID NO: 1572447

SEQ ID NO: 1643988 - protein, 17 aa, Staphylococcus aureus
TAIPQPKVDSPSSVPGE

SEQ ID NO: 1643989 - protein, 6 aa, Staphylococcus aureus
TAITRN

SEQ ID NO: 1643990 - protein, 6 aa, Staphylococcus aureus
TAKNDE

SEQ ID NO: 1643991 - protein, 6 aa, Staphylococcus aureus
TAKQSN

SEQ ID NO: 1643992 - protein, 13 aa, Staphylococcus aureus
TALITDDEDRLNK

SEQ ID NO: 1643993 - protein, 13 aa, Staphylococcus aureus
TALNNSSNRGVYE

SEQ ID NO: 1643994 - protein, 8 aa, Staphylococcus aureus
TANGVGST

SEQ ID NO: 1643995 - protein, 11 aa, Staphylococcus aureus
TANNPEQEEAE

SEQ ID NO: 1643996 - protein, 17 aa, Staphylococcus aureus
TANVTSNLKDGSSTEIE

SEQ ID NO: 1643997 - protein, 10 aa, Staphylococcus aureus
TAPIKEQATD

SEQ ID NO: 1643998 - protein, 8 aa, Staphylococcus aureus
TAPPSGVY

SEQ ID NO: 1643999 - protein, 6 aa, Staphylococcus aureus
TAQEID

SEQ ID NO: 1644000 - protein, 5 aa, Staphylococcus aureus
TAQEL

SEQ ID NO: 1644001 - protein, 18 aa, Staphylococcus aureus
TAQKTHLTNQINSGTTVA

SEQ ID NO: 1644002 - protein, 19 aa, Staphylococcus aureus
TAQKTNLTNQINSGTTVAG

SEQ ID NO: 1644003 - protein, 7 aa, Staphylococcus aureus
TAQNEQD

SEQ ID NO: 1644004 - protein, 34 aa, Staphylococcus aureus; identical to SEQ ID NO: 1568494

SEQ ID NO: 1644005 - protein, 15 aa, Staphylococcus aureus
TARMPERNHKTDAGY

SEQ ID NO: 1644006 - protein, 9 aa, Staphylococcus aureus
TASAKGLDT

SEQ ID NO: 1644007 - protein, 11 aa, Staphylococcus aureus
TASHPRSRNDS

SEQ ID NO: 1644008 - protein, 7 aa, Staphylococcus aureus
TASNTNY

SEQ ID NO: 1644009 - protein, 5 aa, Staphylococcus aureus
TASPI

SEQ ID NO: 1644010 - protein, 7 aa, Staphylococcus aureus
TASQTSM

SEQ ID NO: 1644011 - protein, 22 aa, Staphylococcus aureus
TASRQGKKVGKRIKRTGRSENN

SEQ ID NO: 1644012 - protein, 5 aa, Staphylococcus aureus
TASSE

SEQ ID NO: 1644013 - protein, 5 aa, Staphylococcus aureus
TASSI

SEQ ID NO: 1644014 - protein, 6 aa, Staphylococcus aureus
TASSTG

SEQ ID NO: 1644015 - protein, 23 aa, Staphylococcus aureus
TATGDGSIAAQSAAEYIEHLKDQ

SEQ ID NO: 1644016 - protein, 12 aa, Staphylococcus aureus
TATMKGTDSDAY

SEQ ID NO: 1644017 - protein, 7 aa, Staphylococcus aureus
TATPKEY

SEQ ID NO: 1644018 - protein, 7 aa, Staphylococcus aureus
TATQTQI

SEQ ID NO: 1644019 - protein, 8 aa, Staphylococcus aureus
TATQTQTV

SEQ ID NO: 1644020 - protein, 7 aa, Staphylococcus aureus
TATRNTA

SEQ ID NO: 1644021 - protein, 16 aa, Staphylococcus aureus
TATSVDEAIANEKAGI

SEQ ID NO: 1644022 - protein, 16 aa, Staphylococcus aureus
TATSVDEAIENEKAGM

SEQ ID NO: 1644023 - protein, 20 aa, Staphylococcus aureus
TATSVDEAITNEKAGMDAIV

SEQ ID NO: 1644024 - protein, 9 aa, Staphylococcus aureus
TAVATRGVS

SEQ ID NO: 1644025 - protein, 14 aa, Staphylococcus aureus
TAVKEGKAQGLEIG

SEQ ID NO: 1644026 - protein, 14 aa, Staphylococcus aureus
TAVTKVKSKTDPAV

SEQ ID NO: 1644027 - protein, 8 aa, Staphylococcus aureus
TAYISPNK

SEQ ID NO: 1644028 - protein, 10 aa, Staphylococcus aureus
TAYKDQARPL

SEQ ID NO: 1644029 - protein, 9 aa, Staphylococcus aureus
TAYKNSSDL

SEQ ID NO: 1644030 - protein, 8 aa, Staphylococcus aureus
TAYNPNAY

SEQ ID NO: 1644031 - protein, 4 aa, Staphylococcus aureus
TDAA

SEQ ID NO: 1644032 - protein, 15 aa, Staphylococcus aureus
TDADKAKKDAYTNAV

SEQ ID NO: 1644033 - protein, 5 aa, Staphylococcus aureus
TDANF

SEQ ID NO: 1644034 - protein, 8 aa, Staphylococcus aureus
TDAQHGHG

SEQ ID NO: 1644035 - protein, 9 aa, Staphylococcus aureus
TDDEDYKAF

SEQ ID NO: 1644036 - protein, 5 aa, Staphylococcus aureus
TDDMK

SEQ ID NO: 1644037 - protein, 18 aa, Staphylococcus aureus
TDDNDGRPIDNKKKYPVK

SEQ ID NO: 1644038 - protein, 28 aa, Staphylococcus aureus
TDDPALADQIKEEKKDETYFDRSIRILF

SEQ ID NO: 1644039 - protein, 9 aa, Staphylococcus aureus
TDDSHEKID

SEQ ID NO: 1644040 - protein, 10 aa, Staphylococcus aureus
TDDSKVRRNS

SEQ ID NO: 1644041 - protein, 9 aa, Staphylococcus aureus
TDDSTGALA

SEQ ID NO: 1644042 - protein, 17 aa, Staphylococcus aureus
TDDTKRFTDFPTEHKGV

SEQ ID NO: 1644043 - protein, 5 aa, Staphylococcus aureus
TDFSD

SEQ ID NO: 1644044 - protein, 7 aa, Staphylococcus aureus
TDGGWPQ

SEQ ID NO: 1644045 - protein, 5 aa, Staphylococcus aureus
TDGKQ

SEQ ID NO: 1644046 - protein, 12 aa, Staphylococcus aureus
TDGKTDKNRTKF

SEQ ID NO: 1644047 - protein, 7 aa, Staphylococcus aureus
TDGNNDQ

SEQ ID NO: 1644048 - protein, 14 aa, Staphylococcus aureus
TDGVQQPGSGWEKV

SEQ ID NO: 1644049 - protein, 12 aa, Staphylococcus aureus
TDHGKDYTSEHM

SEQ ID NO: 1644050 - protein, 6 aa, Staphylococcus aureus
TDHPNA

SEQ ID NO: 1644051 - protein, 10 aa, Staphylococcus aureus
TDIEKTDESI

SEQ ID NO: 1644052 - protein, 11 aa, Staphylococcus aureus
TDIELGDRGEI

SEQ ID NO: 1644053 - protein, 7 aa, Staphylococcus aureus
TDIKEKQ

SEQ ID NO: 1644054 - protein, 19 aa, Staphylococcus aureus
TDINQTNISDKHVNNARKN

SEQ ID NO: 1644055 - protein, 11 aa, Staphylococcus aureus
TDITNKQISTH

SEQ ID NO: 1644056 - protein, 14 aa, Staphylococcus aureus
TDKAIQRTDEPDKV

SEQ ID NO: 1644057 - protein, 6 aa, Staphylococcus aureus
TDKDYE

SEQ ID NO: 1644058 - protein, 6 aa, Staphylococcus aureus
TDKGKD

SEQ ID NO: 1644059 - protein, 14 aa, Staphylococcus aureus
TDKGLSMNKAENHA

SEQ ID NO: 1644060 - protein, 6 aa, Staphylococcus aureus
TDKHPN

SEQ ID NO: 1644061 - protein, 9 aa, Staphylococcus aureus
TDKKIRPKA

SEQ ID NO: 1644062 - protein, 7 aa, Staphylococcus aureus
TDKNGTF

SEQ ID NO: 1644063 - protein, 8 aa, Staphylococcus aureus
TDKPIKDI

SEQ ID NO: 1644064 - protein, 13 aa, Staphylococcus aureus
TDKQFDWKDIIYF

SEQ ID NO: 1644065 - protein, 9 aa, Staphylococcus aureus
TDKRERKKR

SEQ ID NO: 1644066 - protein, 8 aa, Staphylococcus aureus
TDKRETEI

SEQ ID NO: 1644067 - protein, 17 aa, Staphylococcus aureus
TDLNNSKVTHSKEKITE

SEQ ID NO: 1644068 - protein, 30 aa, Staphylococcus aureus
TDLNRERTLEGLNEAKARGRKGGRPGVTKD

SEQ ID NO: 1644069 - protein, 6 aa, Staphylococcus aureus
TDLTPR

SEQ ID NO: 1644070 - protein, 5 aa, Staphylococcus aureus
TDLTQ

SEQ ID NO: 1644071 - protein, 11 aa, Staphylococcus aureus
TDNASWRGPNI

SEQ ID NO: 1644072 - protein, 10 aa, Staphylococcus aureus
TDNERNIQEI

SEQ ID NO: 1644073 - protein, 5 aa, Staphylococcus aureus
TDNKI

SEQ ID NO: 1644074 - protein, 5 aa, Staphylococcus aureus
TDNTN

SEQ ID NO: 1644075 - protein, 9 aa, Staphylococcus aureus
TDPDADRLG

SEQ ID NO: 1644076 - protein, 7 aa, Staphylococcus aureus
TDPHDSD

SEQ ID NO: 1644077 - protein, 37 aa, Staphylococcus aureus
TDPITGKQKRTTRRGFKTEREAKIAEAKLQTEVSQNG

SEQ ID NO: 1644078 - protein, 38 aa, Staphylococcus aureus
TDPITGKQKRTTRRGFKTEREAKIAEAKLQTEVSQNGF

SEQ ID NO: 1644079 - protein, 13 aa, Staphylococcus aureus
TDPKEATAESREA

SEQ ID NO: 1644080 - protein, 13 aa, Staphylococcus aureus
TDPSGEVYEKTAN

SEQ ID NO: 1644081 - protein, 8 aa, Staphylococcus aureus
TDQSMPRE

SEQ ID NO: 1644082 - protein, 12 aa, Staphylococcus aureus
TDQYQSSTRFKR

SEQ ID NO: 1644083 - protein, 9 aa, Staphylococcus aureus
TDRIPAGKR

SEQ ID NO: 1644084 - protein, 5 aa, Staphylococcus aureus
TDSDG

SEQ ID NO: 1644085 - protein, 15 aa, Staphylococcus aureus
TDSEDHSENSAGSLP

SEQ ID NO: 1644086 - protein, 6 aa, Staphylococcus aureus
TDSESL

SEQ ID NO: 1644087 - protein, 15 aa, Staphylococcus aureus
TDSGEHSDDSLGSLP

SEQ ID NO: 1644088 - protein, 5 aa, Staphylococcus aureus
TDSGG

SEQ ID NO: 1644089 - protein, 7 aa, Staphylococcus aureus
TDSHDSD

SEQ ID NO: 1644090 - protein, 21 aa, Staphylococcus aureus
TDSYGVATTYTSSSAADNAAK

SEQ ID NO: 1644091 - protein, 21 aa, Staphylococcus aureus
TDSYGVATTYTSSSTADNAAK

SEQ ID NO: 1644092 - protein, 13 aa, Staphylococcus aureus
TDTSKILKPRKFF

SEQ ID NO: 1644093 - protein, 13 aa, Staphylococcus aureus
TDTSSLEHAPKKQ

SEQ ID NO: 1644094 - protein, 8 aa, Staphylococcus aureus
TDVNDDEE

SEQ ID NO: 1644095 - protein, 7 aa, Staphylococcus aureus
TDVSAGL

SEQ ID NO: 1644096 - protein, 5 aa, Staphylococcus aureus
TDWEN

SEQ ID NO: 1644097 - protein, 6 aa, Staphylococcus aureus
TDYATP

SEQ ID NO: 1644098 - protein, 4 aa, Staphylococcus aureus
TDYN

SEQ ID NO: 1644099 - protein, 15 aa, Staphylococcus aureus
TDYPAKINSNDIDNP

SEQ ID NO: 1644100 - protein, 8 aa, Staphylococcus aureus
TEAEQAGY

SEQ ID NO: 1644101 - protein, 9 aa, Staphylococcus aureus
TEAGRTDNV

SEQ ID NO: 1644102 - protein, 8 aa, Staphylococcus aureus
TEAKTGQA

SEQ ID NO: 1644103 - protein, 6 aa, Staphylococcus aureus
TEAMKQ

SEQ ID NO: 1644104 - protein, 4 aa, Staphylococcus aureus
TEAP

SEQ ID NO: 1644105 - protein, 7 aa, Staphylococcus aureus
TEARQHG

SEQ ID NO: 1644106 - protein, 12 aa, Staphylococcus aureus
TEDETGNHSTRE

SEQ ID NO: 1644107 - protein, 4 aa, Staphylococcus aureus
TEDS

SEQ ID NO: 1644108 - protein, 11 aa, Staphylococcus aureus
TEEEKDKRAKE

SEQ ID NO: 1644109 - protein, 10 aa, Staphylococcus aureus
TEEEVSSSKG

SEQ ID NO: 1644110 - protein, 4 aa, Staphylococcus aureus
TEEL

SEQ ID NO: 1644111 - protein, 13 aa, Staphylococcus aureus
TEGAGALPTAAIL

SEQ ID NO: 1644112 - protein, 4 aa, Staphylococcus aureus
TEGL

SEQ ID NO: 1644113 - protein, 7 aa, Staphylococcus aureus
TEINGPH

SEQ ID NO: 1644114 - protein, 6 aa, Staphylococcus aureus
TEINGS

SEQ ID NO: 1644115 - protein, 17 aa, Staphylococcus aureus
TEIRGTTLASKESKFKS

SEQ ID NO: 1644116 - protein, 5 aa, Staphylococcus aureus
TEITE

SEQ ID NO: 1644117 - protein, 6 aa, Staphylococcus aureus
TEKFNG

SEQ ID NO: 1644118 - protein, 10 aa, Staphylococcus aureus
TEKQGTPEQM

SEQ ID NO: 1644119 - protein, 17 aa, Staphylococcus aureus
TEKQRDQVADKFAKYIN

SEQ ID NO: 1644120 - protein, 32 aa, Staphylococcus aureus
TEKRKTENRKTISENQNKEVVKTKKGNSKIGI

SEQ ID NO: 1644121 - protein, 5 aa, Staphylococcus aureus
TEKST

SEQ ID NO: 1644122 - protein, 8 aa, Staphylococcus aureus
TEKVQAAR

SEQ ID NO: 1644123 - protein, 6 aa, Staphylococcus aureus
TELDGE

SEQ ID NO: 1644124 - protein, 5 aa, Staphylococcus aureus
TELNA

SEQ ID NO: 1644125 - protein, 20 aa, Staphylococcus aureus
TELPYGESIGTSLELEENKK

SEQ ID NO: 1644126 - protein, 26 aa, Staphylococcus aureus
TELSGNEIARKTGVSRSTVYRIKRDF

SEQ ID NO: 1644127 - protein, 14 aa, Staphylococcus aureus
TEMQSTEGYSIDGQ

SEQ ID NO: 1644128 - protein, 10 aa, Staphylococcus aureus
TENDPTIREQ

SEQ ID NO: 1644129 - protein, 7 aa, Staphylococcus aureus
TENEDTL

SEQ ID NO: 1644130 - protein, 19 aa, Staphylococcus aureus
TENRNKGKLKITGGGNNYT

SEQ ID NO: 1644131 - protein, 13 aa, Staphylococcus aureus
TENVSTTSNPDQQ

SEQ ID NO: 1644132 - protein, 7 aa, Staphylococcus aureus
TEPSSDE

SEQ ID NO: 1644133 - protein, 5 aa, Staphylococcus aureus
TEQEY

SEQ ID NO: 1644134 - protein, 18 aa, Staphylococcus aureus
TEQGKAIKSPLAEISVKV

SEQ ID NO: 1644135 - protein, 5 aa, Staphylococcus aureus
TEQSK

SEQ ID NO: 1644136 - protein, 11 aa, Staphylococcus aureus
TEQTKQEIKNV

SEQ ID NO: 1644137 - protein, 12 aa, Staphylococcus aureus
TEQTKQEIKNVK

SEQ ID NO: 1644138 - protein, 9 aa, Staphylococcus aureus
TESATSSNE

SEQ ID NO: 1644139 - protein, 7 aa, Staphylococcus aureus
TESEDMQ

SEQ ID NO: 1644140 - protein, 8 aa, Staphylococcus aureus
TESEEMQQ

SEQ ID NO: 1644141 - protein, 7 aa, Staphylococcus aureus
TESEEMR

SEQ ID NO: 1644142 - protein, 6 aa, Staphylococcus aureus
TESGTF

SEQ ID NO: 1644143 - protein, 15 aa, Staphylococcus aureus
TESQVNNIDKTVDNE

SEQ ID NO: 1644144 - protein, 41 aa, Staphylococcus aureus
TESTVEETNIKQNIDDSVDQAEESKGHLQDEAIEETSDENV

SEQ ID NO: 1644145 - protein, 7 aa, Staphylococcus aureus
TESTVEV

SEQ ID NO: 1644146 - protein, 8 aa, Staphylococcus aureus
TETRTMKA

SEQ ID NO: 1644147 - protein, 7 aa, Staphylococcus aureus
TETSSIS

SEQ ID NO: 1644148 - protein, 6 aa, Staphylococcus aureus
TEVANN

SEQ ID NO: 1644149 - protein, 7 aa, Staphylococcus aureus
TEVASNN

SEQ ID NO: 1644150 - protein, 4 aa, Staphylococcus aureus
TEVS

SEQ ID NO: 1644151 - protein, 7 aa, Staphylococcus aureus
TEYKDGK

SEQ ID NO: 1644152 - protein, 9 aa, Staphylococcus aureus
TEYNGQSIQ

SEQ ID NO: 1644153 - protein, 6 aa, Staphylococcus aureus
TEYQGE

SEQ ID NO: 1644154 - protein, 7 aa, Staphylococcus aureus
TFADSRQ

SEQ ID NO: 1644155 - protein, 8 aa, Staphylococcus aureus
TFDEPPEH

SEQ ID NO: 1644156 - protein, 11 aa, Staphylococcus aureus
TFKGSGDGPTI

SEQ ID NO: 1644157 - protein, 10 aa, Staphylococcus aureus
TFKKEGLEPW

SEQ ID NO: 1644158 - protein, 9 aa, Staphylococcus aureus
TFKQSKNKT

SEQ ID NO: 1644159 - protein, 12 aa, Staphylococcus aureus
TFPNGKSVDERI

SEQ ID NO: 1644160 - protein, 5 aa, Staphylococcus aureus
TFPTT

SEQ ID NO: 1644161 - protein, 5 aa, Staphylococcus aureus
TFQPE

SEQ ID NO: 1644162 - protein, 8 aa, Staphylococcus aureus
TFSRKNDR

SEQ ID NO: 1644163 - protein, 7 aa, Staphylococcus aureus
TFTAKTS

SEQ ID NO: 1644164 - protein, 4 aa, Staphylococcus aureus
TFTP

SEQ ID NO: 1644165 - protein, 8 aa, Staphylococcus aureus
TGADANDG

SEQ ID NO: 1644166 - protein, 4 aa, Staphylococcus aureus
TGAF

SEQ ID NO: 1644167 - protein, 7 aa, Staphylococcus aureus
TGAKPAG

SEQ ID NO: 1644168 - protein, 16 aa, Staphylococcus aureus
TGASTGKSYIHKEEKD

SEQ ID NO: 1644169 - protein, 8 aa, Staphylococcus aureus
TGDEGSHC

SEQ ID NO: 1644170 - protein, 10 aa, Staphylococcus aureus
TGDKQEVKRK

SEQ ID NO: 1644171 - protein, 11 aa, Staphylococcus aureus
TGDLKGSSVGY

SEQ ID NO: 1644172 - protein, 10 aa, Staphylococcus aureus
TGDPRVGYKD

SEQ ID NO: 1644173 - protein, 11 aa, Staphylococcus aureus
TGDPRVGYKDI

SEQ ID NO: 1644174 - protein, 7 aa, Staphylococcus aureus
TGDVTDT

SEQ ID NO: 1644175 - protein, 14 aa, Staphylococcus aureus
TGDVTDTDLIMKKE

SEQ ID NO: 1644176 - protein, 6 aa, Staphylococcus aureus
TGDYSA

SEQ ID NO: 1644177 - protein, 11 aa, Staphylococcus aureus
TGEAYQSLNDH

SEQ ID NO: 1644178 - protein, 6 aa, Staphylococcus aureus
TGEESH

SEQ ID NO: 1644179 - protein, 5 aa, Staphylococcus aureus
TGEHI

SEQ ID NO: 1644180 - protein, 5 aa, Staphylococcus aureus
TGELE

SEQ ID NO: 1644181 - protein, 13 aa, Staphylococcus aureus
TGEYIAPSTSTFQ

SEQ ID NO: 1644182 - protein, 5 aa, Staphylococcus aureus
TGEYQ

SEQ ID NO: 1644183 - protein, 12 aa, Staphylococcus aureus
TGGCPHTTIRED

SEQ ID NO: 1644184 - protein, 5 aa, Staphylococcus aureus
TGGES

SEQ ID NO: 1644185 - protein, 8 aa, Staphylococcus aureus
TGGKKMTN

SEQ ID NO: 1644186 - protein, 9 aa, Staphylococcus aureus
TGGLTTSPV

SEQ ID NO: 1644187 - protein, 13 aa, Staphylococcus aureus
TGGRVKPLPMRPD

SEQ ID NO: 1644188 - protein, 8 aa, Staphylococcus aureus
TGGTGIAK

SEQ ID NO: 1644189 - protein, 6 aa, Staphylococcus aureus
TGIGDD

SEQ ID NO: 1644190 - protein, 10 aa, Staphylococcus aureus
TGIGTRNNKI

SEQ ID NO: 1644191 - protein, 23 aa, Staphylococcus aureus
TGISPINSIRSTKSVIDDLMQDF

SEQ ID NO: 1644192 - protein, 4 aa, Staphylococcus aureus
TGKE

SEQ ID NO: 1644193 - protein, 21 aa, Staphylococcus aureus
TGKLGESLQDKEETQFTVPSE

SEQ ID NO: 1644194 - protein, 16 aa, Staphylococcus aureus
TGKMRAEYAGKTWETS

SEQ ID NO: 1644195 - protein, 12 aa, Staphylococcus aureus
TGKSSTSEDTNE

SEQ ID NO: 1644196 - protein, 22 aa, Staphylococcus aureus
TGKSTKMLTETKQKMKADPLGD

SEQ ID NO: 1644197 - protein, 9 aa, Staphylococcus aureus
TGLEEDDPV

SEQ ID NO: 1644198 - protein, 17 aa, Staphylococcus aureus
TGLENPNSPTQLLAWFK

SEQ ID NO: 1644199 - protein, 6 aa, Staphylococcus aureus
TGLGGG

SEQ ID NO: 1644200 - protein, 8 aa, Staphylococcus aureus
TGLQKTMQ

SEQ ID NO: 1644201 - protein, 4 aa, Staphylococcus aureus
TGLS

SEQ ID NO: 1644202 - protein, 17 aa, Staphylococcus aureus
TGLSNPMKSFNDLEKVE

SEQ ID NO: 1644203 - protein, 9 aa, Staphylococcus aureus
TGNHNNDSS

SEQ ID NO: 1644204 - protein, 5 aa, Staphylococcus aureus
TGNIN

SEQ ID NO: 1644205 - protein, 11 aa, Staphylococcus aureus
TGNLKGSSVGY

SEQ ID NO: 1644206 - protein, 5 aa, Staphylococcus aureus
TGNSK

SEQ ID NO: 1644207 - protein, 16 aa, Staphylococcus aureus
TGPNPHYNSNTSKGGD

SEQ ID NO: 1644208 - protein, 14 aa, Staphylococcus aureus
TGQAIGRPKTGTYT

SEQ ID NO: 1644209 - protein, 6 aa, Staphylococcus aureus
TGQNEI

SEQ ID NO: 1644210 - protein, 8 aa, Staphylococcus aureus
TGQQYGRK

SEQ ID NO: 1644211 - protein, 11 aa, Staphylococcus aureus
TGRKLSKEERI

SEQ ID NO: 1644212 - protein, 4 aa, Staphylococcus aureus
TGRM

SEQ ID NO: 1644213 - protein, 8 aa, Staphylococcus aureus
TGRRDENV

SEQ ID NO: 1644214 - protein, 7 aa, Staphylococcus aureus
TGSDGVQ

SEQ ID NO: 1644215 - protein, 7 aa, Staphylococcus aureus
TGSEELE

SEQ ID NO: 1644216 - protein, 18 aa, Staphylococcus aureus
TGSEVSKQYGEAGLPENT

SEQ ID NO: 1644217 - protein, 10 aa, Staphylococcus aureus
TGSGPTGSKI

SEQ ID NO: 1644218 - protein, 6 aa, Staphylococcus aureus
TGTDTF

SEQ ID NO: 1644219 - protein, 4 aa, Staphylococcus aureus
TGTE

SEQ ID NO: 1644220 - protein, 8 aa, Staphylococcus aureus
TGTGIAPE

SEQ ID NO: 1644221 - protein, 7 aa, Staphylococcus aureus
TGTGISK

SEQ ID NO: 1644222 - protein, 7 aa, Staphylococcus aureus
TGTGQAE

SEQ ID NO: 1644223 - protein, 5 aa, Staphylococcus aureus
TGTGT

SEQ ID NO: 1644224 - protein, 4 aa, Staphylococcus aureus
TGTL

SEQ ID NO: 1644225 - protein, 11 aa, Staphylococcus aureus
TGTLKSPTDMN

SEQ ID NO: 1644226 - protein, 8 aa, Staphylococcus aureus
TGTPDGVH

SEQ ID NO: 1644227 - protein, 26 aa, Staphylococcus aureus
TGTPPRVNSKTIDYSKTEIQPGDDVD

SEQ ID NO: 1644228 - protein, 27 aa, Staphylococcus aureus
TGTPPRVNSKTIDYSKTEIQPGDDVGR

SEQ ID NO: 1644229 - protein, 9 aa, Staphylococcus aureus
TGTQSKLSG

SEQ ID NO: 1644230 - protein, 5 aa, Staphylococcus aureus
TGTSL

SEQ ID NO: 1644231 - protein, 10 aa, Staphylococcus aureus
TGTSSPNSLQ

SEQ ID NO: 1644232 - protein, 5 aa, Staphylococcus aureus
TGVKS

SEQ ID NO: 1644233 - protein, 4 aa, Staphylococcus aureus
TGVL

SEQ ID NO: 1644234 - protein, 10 aa, Staphylococcus aureus
TGYSSNDASL

SEQ ID NO: 1644235 - protein, 7 aa, Staphylococcus aureus
THGKKHT

SEQ ID NO: 1644236 - protein, 6 aa, Staphylococcus aureus
THGSGF

SEQ ID NO: 1644237 - protein, 4 aa, Staphylococcus aureus
THNP

SEQ ID NO: 1644238 - protein, 11 aa, Staphylococcus aureus
THSGERIQENQ

SEQ ID NO: 1644239 - protein, 9 aa, Staphylococcus aureus
THSSGTGYG

SEQ ID NO: 1644240 - protein, 6 aa, Staphylococcus aureus
THTEYS

SEQ ID NO: 1644241 - protein, 7 aa, Staphylococcus aureus
THTEYSK

SEQ ID NO: 1644242 - protein, 9 aa, Staphylococcus aureus
THTKEENQF

SEQ ID NO: 1644243 - protein, 23 aa, Staphylococcus aureus
THTQSEDSRCGAGHDRKIRAEQM

SEQ ID NO: 1644244 - protein, 5 aa, Staphylococcus aureus
THTST

SEQ ID NO: 1644245 - protein, 18 aa, Staphylococcus aureus
THTVSAHRKATKGSQLSI

SEQ ID NO: 1644246 - protein, 11 aa, Staphylococcus aureus
THYGEHQGKPF

SEQ ID NO: 1644247 - protein, 15 aa, Staphylococcus aureus
TIDKNNYKNRPDLTQ

SEQ ID NO: 1644248 - protein, 4 aa, Staphylococcus aureus
TIDN

SEQ ID NO: 1644249 - protein, 14 aa, Staphylococcus aureus
TIDRTSDGKGRIAD

SEQ ID NO: 1644250 - protein, 15 aa, Staphylococcus aureus
TIDRTSDGKGRISDY

SEQ ID NO: 1644251 - protein, 22 aa, Staphylococcus aureus
TIDSKPKDEVNEFYAKTKILEM

SEQ ID NO: 1644252 - protein, 19 aa, Staphylococcus aureus
TIDTQSDQKSTTTPSTEKQ

SEQ ID NO: 1644253 - protein, 4 aa, Staphylococcus aureus
TIEE

SEQ ID NO: 1644254 - protein, 10 aa, Staphylococcus aureus
TIEKQTKQVQ

SEQ ID NO: 1644255 - protein, 9 aa, Staphylococcus aureus
TIENNGYEA

SEQ ID NO: 1644256 - protein, 6 aa, Staphylococcus aureus
TIEPNT

SEQ ID NO: 1644257 - protein, 5 aa, Staphylococcus aureus
TIKEQ

SEQ ID NO: 1644258 - protein, 13 aa, Staphylococcus aureus
TIKEVQKETGIKG

SEQ ID NO: 1644259 - protein, 11 aa, Staphylococcus aureus
TIKQTAPKLEG

SEQ ID NO: 1644260 - protein, 6 aa, Staphylococcus aureus
TINGKE

SEQ ID NO: 1644261 - protein, 22 aa, Staphylococcus aureus
TINKDDQEVKTELKNKFDSEDE

SEQ ID NO: 1644262 - protein, 10 aa, Staphylococcus aureus
TIPAQREEEK

SEQ ID NO: 1644263 - protein, 5 aa, Staphylococcus aureus
TIPAV

SEQ ID NO: 1644264 - protein, 19 aa, Staphylococcus aureus
TIQPDDNNDWINQRDEKYQ

SEQ ID NO: 1644265 - protein, 13 aa, Staphylococcus aureus
TIRRKDTDKNKLG

SEQ ID NO: 1644266 - protein, 8 aa, Staphylococcus aureus
TISENSRQ

SEQ ID NO: 1644267 - protein, 18 aa, Staphylococcus aureus
TISGRKLNSLTSEMPKVR

SEQ ID NO: 1644268 - protein, 16 aa, Staphylococcus aureus
TISMSQDQSNKVVTND

SEQ ID NO: 1644269 - protein, 42 aa, Staphylococcus aureus
TISTGNASWGVGPNTENFEKRNSTGNAGWGVGPNTEKLEHQF

SEQ ID NO: 1644270 - protein, 7 aa, Staphylococcus aureus
TISYNQK

SEQ ID NO: 1644271 - protein, 11 aa, Staphylococcus aureus
TKADKGTRKIE

SEQ ID NO: 1644272 - protein, 7 aa, Staphylococcus aureus
TKAKAED

SEQ ID NO: 1644273 - protein, 6 aa, Staphylococcus aureus
TKANHG

SEQ ID NO: 1644274 - protein, 7 aa, Staphylococcus aureus
TKAQDII

SEQ ID NO: 1644275 - protein, 15 aa, Staphylococcus aureus
TKASGQNVDKAAVEQ

SEQ ID NO: 1644276 - protein, 17 aa, Staphylococcus aureus
TKDEDEGKPHDNEKRYP

SEQ ID NO: 1644277 - protein, 7 aa, Staphylococcus aureus
TKDEGDI

SEQ ID NO: 1644278 - protein, 8 aa, Staphylococcus aureus
TKDEQIKQ

SEQ ID NO: 1644279 - protein, 13 aa, Staphylococcus aureus
TKDFPSNNSGVDV

SEQ ID NO: 1644280 - protein, 7 aa, Staphylococcus aureus
TKDKGFL

SEQ ID NO: 1644281 - protein, 18 aa, Staphylococcus aureus
TKDKKGYTHDKDKKYPVK

SEQ ID NO: 1644282 - protein, 18 aa, Staphylococcus aureus
TKDKKGYVHDKDKKYPVK

SEQ ID NO: 1644283 - protein, 8 aa, Staphylococcus aureus
TKDNEQYQ

SEQ ID NO: 1644284 - protein, 19 aa, Staphylococcus aureus
TKDNPQNNTDWSNKKYDDY

SEQ ID NO: 1644285 - protein, 6 aa, Staphylococcus aureus
TKDNTK

SEQ ID NO: 1644286 - protein, 12 aa, Staphylococcus aureus
TKDNYTKDNTID

SEQ ID NO: 1644287 - protein, 6 aa, Staphylococcus aureus
TKDRGQ

SEQ ID NO: 1644288 - protein, 9 aa, Staphylococcus aureus
TKDYNDDNQ

SEQ ID NO: 1644289 - protein, 28 aa, Staphylococcus aureus
TKDYTGQEIAEKTNVSRDTVYRILREFK

SEQ ID NO: 1644290 - protein, 12 aa, Staphylococcus aureus
TKEEAAQHFKDQ

SEQ ID NO: 1644291 - protein, 18 aa, Staphylococcus aureus
TKEEAAQHFKDQDAATNL

SEQ ID NO: 1644292 - protein, 9 aa, Staphylococcus aureus
TKEEAQDAT

SEQ ID NO: 1644293 - protein, 13 aa, Staphylococcus aureus
TKEEARNASEKWN

SEQ ID NO: 1644294 - protein, 4 aa, Staphylococcus aureus
TKEG

SEQ ID NO: 1644295 - protein, 15 aa, Staphylococcus aureus
TKELNKAYKKKDYKY

SEQ ID NO: 1644296 - protein, 59 aa, Staphylococcus aureus
TKELPNSQFQNNEFGSSRTVNLSGQELPNSQSNDTELNNTNYIENEDNDTYDMNDIISN

SEQ ID NO: 1644297 - protein, 6 aa, Staphylococcus aureus
TKENLS

SEQ ID NO: 1644298 - protein, 13 aa, Staphylococcus aureus
TKEPKNDKSEERL

SEQ ID NO: 1644299 - protein, 7 aa, Staphylococcus aureus
TKETHHN

SEQ ID NO: 1644300 - protein, 13 aa, Staphylococcus aureus
TKFADGAKAKDRI

SEQ ID NO: 1644301 - protein, 8 aa, Staphylococcus aureus
TKFPNTPQ

SEQ ID NO: 1644302 - protein, 17 aa, Staphylococcus aureus
TKGESADSLGLDGTEEI

SEQ ID NO: 1644303 - protein, 7 aa, Staphylococcus aureus
TKGKYKD

SEQ ID NO: 1644304 - protein, 21 aa, Staphylococcus aureus
TKGQAGTNSITRPSFRVPNDD

SEQ ID NO: 1644305 - protein, 14 aa, Staphylococcus aureus
TKGQGGTNSITRPS

SEQ ID NO: 1644306 - protein, 14 aa, Staphylococcus aureus
TKHNKSSGTYTKKG

SEQ ID NO: 1644307 - protein, 8 aa, Staphylococcus aureus
TKHPNTVN

SEQ ID NO: 1644308 - protein, 11 aa, Staphylococcus aureus
TKIESANENDV

SEQ ID NO: 1644309 - protein, 9 aa, Staphylococcus aureus
TKIKKGLEN

SEQ ID NO: 1644310 - protein, 6 aa, Staphylococcus aureus
TKINDD

SEQ ID NO: 1644311 - protein, 14 aa, Staphylococcus aureus
TKIRRKDTDKNKLG

SEQ ID NO: 1644312 - protein, 8 aa, Staphylococcus aureus
TKKDEVTV

SEQ ID NO: 1644313 - protein, 9 aa, Staphylococcus aureus
TKKDEVTVV

SEQ ID NO: 1644314 - protein, 17 aa, Staphylococcus aureus
TKKDGKYYVKNMTNSIG

SEQ ID NO: 1644315 - protein, 9 aa, Staphylococcus aureus
TKKDNQGMI

SEQ ID NO: 1644316 - protein, 15 aa, Staphylococcus aureus
TKKEKTTHNKESVKN

SEQ ID NO: 1644317 - protein, 36 aa, Staphylococcus aureus
TKKERTTQNKENKKSEITYENTEKNRYNNSDGFETL

SEQ ID NO: 1644318 - protein, 9 aa, Staphylococcus aureus
TKKGEEILK

SEQ ID NO: 1644319 - protein, 7 aa, Staphylococcus aureus
TKKNSGS

SEQ ID NO: 1644320 - protein, 16 aa, Staphylococcus aureus
TKKQVEDKKKDKANYQ

SEQ ID NO: 1644321 - protein, 9 aa, Staphylococcus aureus
TKKTRRTRT

SEQ ID NO: 1644322 - protein, 8 aa, Staphylococcus aureus
TKKWSNTI

SEQ ID NO: 1644323 - protein, 8 aa, Staphylococcus aureus
TKLATTGG

SEQ ID NO: 1644324 - protein, 29 aa, Staphylococcus aureus
TKLEHNNKALRDTAKKNLDDSKENEVKGA

SEQ ID NO: 1644325 - protein, 4 aa, Staphylococcus aureus
TKLG

SEQ ID NO: 1644326 - protein, 11 aa, Staphylococcus aureus
TKNEETRNSLN

SEQ ID NO: 1644327 - protein, 8 aa, Staphylococcus aureus
TKNGGKYT

SEQ ID NO: 1644328 - protein, 14 aa, Staphylococcus aureus
TKNGGKYTFELHKK

SEQ ID NO: 1644329 - protein, 4 aa, Staphylococcus aureus
TKNI

SEQ ID NO: 1644330 - protein, 6 aa, Staphylococcus aureus
TKPEQI

SEQ ID NO: 1644331 - protein, 13 aa, Staphylococcus aureus
TKPKDGKDSDKRR

SEQ ID NO: 1644332 - protein, 6 aa, Staphylococcus aureus
TKPSLE

SEQ ID NO: 1644333 - protein, 8 aa, Staphylococcus aureus
TKQADGSY

SEQ ID NO: 1644334 - protein, 7 aa, Staphylococcus aureus
TKQYEEK

SEQ ID NO: 1644335 - protein, 12 aa, Staphylococcus aureus
TKQYEEKHITEP

SEQ ID NO: 1644336 - protein, 7 aa, Staphylococcus aureus
TKQYGSQ

SEQ ID NO: 1644337 - protein, 37 aa, Staphylococcus aureus
TKRISKRNSTDNASWRGPNIEAGGKSAYNNVQVGGAP

SEQ ID NO: 1644338 - protein, 38 aa, Staphylococcus aureus
TKRISKRNSTGNASWGVGPNTEAYDKSAYDNVQVGVVQ

SEQ ID NO: 1644339 - protein, 5 aa, Staphylococcus aureus
TKRYP

SEQ ID NO: 1644340 - protein, 5 aa, Staphylococcus aureus
TKSGI

SEQ ID NO: 1644341 - protein, 8 aa, Staphylococcus aureus
TKSITESK

SEQ ID NO: 1644342 - protein, 7 aa, Staphylococcus aureus
TKSLKGL

SEQ ID NO: 1644343 - protein, 10 aa, Staphylococcus aureus
TKSSRTSLTI

SEQ ID NO: 1644344 - protein, 8 aa, Staphylococcus aureus
TKSVRHQL

SEQ ID NO: 1644345 - protein, 8 aa, Staphylococcus aureus
TKSVTENK

SEQ ID NO: 1644346 - protein, 28 aa, Staphylococcus aureus
TKTSESLIADDESSGYNDTREKDEDYFK

SEQ ID NO: 1644347 - protein, 29 aa, Staphylococcus aureus
TKTSESLIADDESSGYNNTREKDEDYFKK

SEQ ID NO: 1644348 - protein, 29 aa, Staphylococcus aureus
TKTSESLITDDESSGYNNTREKDEDYFKK

SEQ ID NO: 1644349 - protein, 14 aa, Staphylococcus aureus
TKTTPKGNIEKNVT

SEQ ID NO: 1644350 - protein, 16 aa, Staphylococcus aureus
TKYKGGDISYNPEAPI

SEQ ID NO: 1644351 - protein, 4 aa, Staphylococcus aureus
TKYT

SEQ ID NO: 1644352 - protein, 10 aa, Staphylococcus aureus
TLADPENGLN

SEQ ID NO: 1644353 - protein, 10 aa, Staphylococcus aureus
TLADSENGLN

SEQ ID NO: 1644354 - protein, 7 aa, Staphylococcus aureus
TLAQKAN

SEQ ID NO: 1644355 - protein, 8 aa, Staphylococcus aureus
TLDETDDF

SEQ ID NO: 1644356 - protein, 4 aa, Staphylococcus aureus
TLDI

SEQ ID NO: 1644357 - protein, 21 aa, Staphylococcus aureus
TLDNNAINQAATTVNTTKAAL

SEQ ID NO: 1644358 - protein, 11 aa, Staphylococcus aureus
TLDTTQDERDV

SEQ ID NO: 1644359 - protein, 10 aa, Staphylococcus aureus
TLDTTQDERN

SEQ ID NO: 1644360 - protein, 5 aa, Staphylococcus aureus
TLEDD

SEQ ID NO: 1644361 - protein, 9 aa, Staphylococcus aureus
TLGEESEND

SEQ ID NO: 1644362 - protein, 5 aa, Staphylococcus aureus
TLGIK

SEQ ID NO: 1644363 - protein, 8 aa, Staphylococcus aureus
TLKNERSL

SEQ ID NO: 1644364 - protein, 12 aa, Staphylococcus aureus
TLKQKPNTSQLG

SEQ ID NO: 1644365 - protein, 7 aa, Staphylococcus aureus
TLMDGDT

SEQ ID NO: 1644366 - protein, 11 aa, Staphylococcus aureus
TLNNQKSNLSI

SEQ ID NO: 1644367 - protein, 4 aa, Staphylococcus aureus
TLPE

SEQ ID NO: 1644368 - protein, 12 aa, Staphylococcus aureus
TLPERARNLTDD

SEQ ID NO: 1644369 - protein, 14 aa, Staphylococcus aureus
TLPKPQGEKSSKVE

SEQ ID NO: 1644370 - protein, 12 aa, Staphylococcus aureus
TLQNEMSEIYGD

SEQ ID NO: 1644371 - protein, 12 aa, Staphylococcus aureus
TLQTSSKERAEN

SEQ ID NO: 1644372 - protein, 9 aa, Staphylococcus aureus
TLSDLTKQA

SEQ ID NO: 1644373 - protein, 14 aa, Staphylococcus aureus
TLSDNNKYDNDKNI

SEQ ID NO: 1644374 - protein, 9 aa, Staphylococcus aureus
TLSESYDGV

SEQ ID NO: 1644375 - protein, 8 aa, Staphylococcus aureus
TLSNGTTN

SEQ ID NO: 1644376 - protein, 5 aa, Staphylococcus aureus
TLSPV

SEQ ID NO: 1644377 - protein, 6 aa, Staphylococcus aureus
TLSPYD

SEQ ID NO: 1644378 - protein, 4 aa, Staphylococcus aureus
TLTR

SEQ ID NO: 1644379 - protein, 6 aa, Staphylococcus aureus
TLTTNQ

SEQ ID NO: 1644380 - protein, 11 aa, Staphylococcus aureus
TLVEPEPDVLN

SEQ ID NO: 1644381 - protein, 6 aa, Staphylococcus aureus
TLYEKN

SEQ ID NO: 1644382 - protein, 18 aa, Staphylococcus aureus
TMDDAVSDVSSLDEDGAI

SEQ ID NO: 1644383 - protein, 11 aa, Staphylococcus aureus
TMDDSTKTRYK

SEQ ID NO: 1644384 - protein, 11 aa, Staphylococcus aureus
TMDKSTKAKYK

SEQ ID NO: 1644385 - protein, 18 aa, Staphylococcus aureus
TMGQSPKSVNYTDNSNDT

SEQ ID NO: 1644386 - protein, 12 aa, Staphylococcus aureus
TMIRGGDPENMA

SEQ ID NO: 1644387 - protein, 13 aa, Staphylococcus aureus
TMITTKKTKNGTT

SEQ ID NO: 1644388 - protein, 14 aa, Staphylococcus aureus
TMKQQSLAAQKQAI

SEQ ID NO: 1644389 - protein, 7 aa, Staphylococcus aureus
TMNPETR

SEQ ID NO: 1644390 - protein, 4 aa, Staphylococcus aureus
TMPN

SEQ ID NO: 1644391 - protein, 13 aa, Staphylococcus aureus
TMTQSTDKIDKAL

SEQ ID NO: 1644392 - protein, 5 aa, Staphylococcus aureus
TNAEQ

SEQ ID NO: 1644393 - protein, 8 aa, Staphylococcus aureus
TNAGAGSF

SEQ ID NO: 1644394 - protein, 6 aa, Staphylococcus aureus
TNANIN

SEQ ID NO: 1644395 - protein, 4 aa, Staphylococcus aureus
TNAP

SEQ ID NO: 1644396 - protein, 32 aa, Staphylococcus aureus
TNAYNVTTNQDGTVSYGARPTQNKPSETNAYN

SEQ ID NO: 1644397 - protein, 32 aa, Staphylococcus aureus
TNDKVDTKRLPNPSPIQQSNKVYSEPSNEIEQ

SEQ ID NO: 1644398 - protein, 27 aa, Staphylococcus aureus
TNEAMNKADELTQERLGKHTQGLNIPG

SEQ ID NO: 1644399 - protein, 4 aa, Staphylococcus aureus
TNED

SEQ ID NO: 1644400 - protein, 9 aa, Staphylococcus aureus
TNEDLKSVA

SEQ ID NO: 1644401 - protein, 5 aa, Staphylococcus aureus
TNEGK

SEQ ID NO: 1644402 - protein, 7 aa, Staphylococcus aureus
TNENYTG

SEQ ID NO: 1644403 - protein, 13 aa, Staphylococcus aureus
TNEYNNKKNNSSF

SEQ ID NO: 1644404 - protein, 6 aa, Staphylococcus aureus
TNFGDG

SEQ ID NO: 1644405 - protein, 20 aa, Staphylococcus aureus
TNFGNKSNQERRELYNELLM

SEQ ID NO: 1644406 - protein, 31 aa, Staphylococcus aureus
TNFKKEALAKRYSGNGDKQDKIDSDETEKDL

SEQ ID NO: 1644407 - protein, 5 aa, Staphylococcus aureus
TNGDI

SEQ ID NO: 1644408 - protein, 6 aa, Staphylococcus aureus
TNIDDN

SEQ ID NO: 1644409 - protein, 20 aa, Staphylococcus aureus
TNITNDRTNQQVNDSTNQAL

SEQ ID NO: 1644410 - protein, 9 aa, Staphylococcus aureus
TNKDEVEEL

SEQ ID NO: 1644411 - protein, 15 aa, Staphylococcus aureus
TNKETDGYKGSTTFT

SEQ ID NO: 1644412 - protein, 5 aa, Staphylococcus aureus
TNKNM

SEQ ID NO: 1644413 - protein, 9 aa, Staphylococcus aureus
TNKRDRKKR

SEQ ID NO: 1644414 - protein, 35 aa, Staphylococcus aureus
TNKSADKAEVNQTNDDNQQRVNATPSARRYARENG

SEQ ID NO: 1644415 - protein, 5 aa, Staphylococcus aureus
TNKSE

SEQ ID NO: 1644416 - protein, 19 aa, Staphylococcus aureus
TNKSRSKWDNISSTAWSNA

SEQ ID NO: 1644417 - protein, 7 aa, Staphylococcus aureus
TNKTGHV

SEQ ID NO: 1644418 - protein, 28 aa, Staphylococcus aureus
TNLGSSDLGISGVNSGVASKNINFSNPS

SEQ ID NO: 1644419 - protein, 21 aa, Staphylococcus aureus
TNLGSSELGISGVNSGVASKN

SEQ ID NO: 1644420 - protein, 30 aa, Staphylococcus aureus
TNLGSSELGISGVNSGVASKNINFSNPSGT

SEQ ID NO: 1644421 - protein, 9 aa, Staphylococcus aureus
TNNDSINGV

SEQ ID NO: 1644422 - protein, 6 aa, Staphylococcus aureus
TNNGMQ

SEQ ID NO: 1644423 - protein, 11 aa, Staphylococcus aureus
TNNKLRDLGTK

SEQ ID NO: 1644424 - protein, 5 aa, Staphylococcus aureus
TNNNE

SEQ ID NO: 1644425 - protein, 33 aa, Staphylococcus aureus; identical to SEQ ID NO: 1566291

SEQ ID NO: 1644426 - protein, 36 aa, Staphylococcus aureus; identical to SEQ ID NO: 1568524

SEQ ID NO: 1644427 - protein, 19 aa, Staphylococcus aureus
TNNTPYSISKNSGVPRQTV

SEQ ID NO: 1644428 - protein, 7 aa, Staphylococcus aureus
TNNVDNC

SEQ ID NO: 1644429 - protein, 9 aa, Staphylococcus aureus
TNPETAEYK

SEQ ID NO: 1644430 - protein, 7 aa, Staphylococcus aureus
TNPQTNE

SEQ ID NO: 1644431 - protein, 5 aa, Staphylococcus aureus
TNQSL

SEQ ID NO: 1644432 - protein, 17 aa, Staphylococcus aureus
TNQTTNGGSEADQIPSG

SEQ ID NO: 1644433 - protein, 4 aa, Staphylococcus aureus
TNRS

SEQ ID NO: 1644434 - protein, 5 aa, Staphylococcus aureus
TNSKD

SEQ ID NO: 1644435 - protein, 5 aa, Staphylococcus aureus
TNTER

SEQ ID NO: 1644436 - protein, 4 aa, Staphylococcus aureus
TNTI

SEQ ID NO: 1644437 - protein, 10 aa, Staphylococcus aureus
TNTITANDNF

SEQ ID NO: 1644438 - protein, 10 aa, Staphylococcus aureus
TNTITTNDNF

SEQ ID NO: 1644439 - protein, 12 aa, Staphylococcus aureus
TNTNLNNELTNN

SEQ ID NO: 1644440 - protein, 8 aa, Staphylococcus aureus
TNTQSEEH

SEQ ID NO: 1644441 - protein, 8 aa, Staphylococcus aureus
TNTSGIPI

SEQ ID NO: 1644442 - protein, 6 aa, Staphylococcus aureus
TNVAPY

SEQ ID NO: 1644443 - protein, 13 aa, Staphylococcus aureus
TNVHNDASETIKD

SEQ ID NO: 1644444 - protein, 10 aa, Staphylococcus aureus
TNVPKKVSLN

SEQ ID NO: 1644445 - protein, 7 aa, Staphylococcus aureus
TNVSGSF

SEQ ID NO: 1644446 - protein, 9 aa, Staphylococcus aureus
TNVVGSGKG

SEQ ID NO: 1644447 - protein, 9 aa, Staphylococcus aureus
TNYKPSPDG

SEQ ID NO: 1644448 - protein, 5 aa, Staphylococcus aureus
TNYSI

SEQ ID NO: 1644449 - protein, 18 aa, Staphylococcus aureus
TPAQKTNLTNQINSGTTV

SEQ ID NO: 1644450 - protein, 17 aa, Staphylococcus aureus
TPDAAKTINSKLNTVAK

SEQ ID NO: 1644451 - protein, 5 aa, Staphylococcus aureus
TPEGT

SEQ ID NO: 1644452 - protein, 11 aa, Staphylococcus aureus
TPENTYRGEEK

SEQ ID NO: 1644453 - protein, 13 aa, Staphylococcus aureus
TPEQFDESKKYPA

SEQ ID NO: 1644454 - protein, 5 aa, Staphylococcus aureus
TPESI

SEQ ID NO: 1644455 - protein, 4 aa, Staphylococcus aureus
TPET

SEQ ID NO: 1644456 - protein, 7 aa, Staphylococcus aureus
TPEYGIQ

SEQ ID NO: 1644457 - protein, 6 aa, Staphylococcus aureus
TPFTNN

SEQ ID NO: 1644458 - protein, 13 aa, Staphylococcus aureus
TPGDTIVTSEATF

SEQ ID NO: 1644459 - protein, 23 aa, Staphylococcus aureus
TPGSEAMKGAIKKAKELKEEHGY

SEQ ID NO: 1644460 - protein, 4 aa, Staphylococcus aureus
TPHG

SEQ ID NO: 1644461 - protein, 5 aa, Staphylococcus aureus
TPIKT

SEQ ID NO: 1644462 - protein, 5 aa, Staphylococcus aureus
TPINR

SEQ ID NO: 1644463 - protein, 8 aa, Staphylococcus aureus
TPISNTTI

SEQ ID NO: 1644464 - protein, 15 aa, Staphylococcus aureus
TPISTDNASWRGPNI

SEQ ID NO: 1644465 - protein, 30 aa, Staphylococcus aureus
TPKPLAGLNGESHDFTTTHQSPTTSNHTHN

SEQ ID NO: 1644466 - protein, 30 aa, Staphylococcus aureus
TPKPLARLNGESHDFTTTHQSPTTSNHTHN

SEQ ID NO: 1644467 - protein, 11 aa, Staphylococcus aureus
TPKTESSIGKI

SEQ ID NO: 1644468 - protein, 6 aa, Staphylococcus aureus
TPLADG

SEQ ID NO: 1644469 - protein, 9 aa, Staphylococcus aureus
TPLAESSIG

SEQ ID NO: 1644470 - protein, 8 aa, Staphylococcus aureus
TPLDQKTM

SEQ ID NO: 1644471 - protein, 6 aa, Staphylococcus aureus
TPLYNQ

SEQ ID NO: 1644472 - protein, 14 aa, Staphylococcus aureus
TPNDEYPHHGGSHA

SEQ ID NO: 1644473 - protein, 7 aa, Staphylococcus aureus
TPNEYRN

SEQ ID NO: 1644474 - protein, 8 aa, Staphylococcus aureus
TPNHTKEQ

SEQ ID NO: 1644475 - protein, 15 aa, Staphylococcus aureus
TPNKVFDREQLLKEV

SEQ ID NO: 1644476 - protein, 18 aa, Staphylococcus aureus
TPNMKDDNFSGTTSGEAM

SEQ ID NO: 1644477 - protein, 8 aa, Staphylococcus aureus
TPNNPSGH

SEQ ID NO: 1644478 - protein, 10 aa, Staphylococcus aureus
TPNSDTAKYS

SEQ ID NO: 1644479 - protein, 4 aa, Staphylococcus aureus
TPNW

SEQ ID NO: 1644480 - protein, 8 aa, Staphylococcus aureus
TPPEPSEV

SEQ ID NO: 1644481 - protein, 10 aa, Staphylococcus aureus
TPPQPNGISQ

SEQ ID NO: 1644482 - protein, 8 aa, Staphylococcus aureus
TPQKQDDR

SEQ ID NO: 1644483 - protein, 6 aa, Staphylococcus aureus
TPQMSD

SEQ ID NO: 1644484 - protein, 9 aa, Staphylococcus aureus
TPRAQHERS

SEQ ID NO: 1644485 - protein, 5 aa, Staphylococcus aureus
TPRET

SEQ ID NO: 1644486 - protein, 12 aa, Staphylococcus aureus
TPRMEGANEEIR

SEQ ID NO: 1644487 - protein, 5 aa, Staphylococcus aureus
TPSDS

SEQ ID NO: 1644488 - protein, 19 aa, Staphylococcus aureus
TPSLKTNDYDFEEDDTNIT

SEQ ID NO: 1644489 - protein, 5 aa, Staphylococcus aureus
TPSNA

SEQ ID NO: 1644490 - protein, 9 aa, Staphylococcus aureus
TPSNSKRVY

SEQ ID NO: 1644491 - protein, 4 aa, Staphylococcus aureus
TPSY

SEQ ID NO: 1644492 - protein, 4 aa, Staphylococcus aureus
TPTL

SEQ ID NO: 1644493 - protein, 4 aa, Staphylococcus aureus
TPTS

SEQ ID NO: 1644494 - protein, 4 aa, Staphylococcus aureus
TPVE

SEQ ID NO: 1644495 - protein, 7 aa, Staphylococcus aureus
TQAQTAH

SEQ ID NO: 1644496 - protein, 21 aa, Staphylococcus aureus
TQAVDENNSELNQVGKSTKAQ

SEQ ID NO: 1644497 - protein, 15 aa, Staphylococcus aureus
TQCEEGNEILYERFI

SEQ ID NO: 1644498 - protein, 25 aa, Staphylococcus aureus
TQDAKNNVIPVSNGDHYRWYSSIYG

SEQ ID NO: 1644499 - protein, 5 aa, Staphylococcus aureus
TQDEG

SEQ ID NO: 1644500 - protein, 14 aa, Staphylococcus aureus
TQEELAKRTDLSKG

SEQ ID NO: 1644501 - protein, 10 aa, Staphylococcus aureus
TQERYPKKSA

SEQ ID NO: 1644502 - protein, 7 aa, Staphylococcus aureus
TQGERTS

SEQ ID NO: 1644503 - protein, 16 aa, Staphylococcus aureus
TQGSGETVSDEQHSDD

SEQ ID NO: 1644504 - protein, 16 aa, Staphylococcus aureus
TQGSGETVSDEQRSDD

SEQ ID NO: 1644505 - protein, 4 aa, Staphylococcus aureus
TQGY

SEQ ID NO: 1644506 - protein, 4 aa, Staphylococcus aureus
TQHD

SEQ ID NO: 1644507 - protein, 6 aa, Staphylococcus aureus
TQIATR

SEQ ID NO: 1644508 - protein, 6 aa, Staphylococcus aureus
TQIEKG

SEQ ID NO: 1644509 - protein, 17 aa, Staphylococcus aureus
TQINDKSKKNNFSTKPN

SEQ ID NO: 1644510 - protein, 11 aa, Staphylococcus aureus
TQIQTATQTQI

SEQ ID NO: 1644511 - protein, 11 aa, Staphylococcus aureus
TQKEGAGNEIQ

SEQ ID NO: 1644512 - protein, 12 aa, Staphylococcus aureus
TQKFSKGSVSIE

SEQ ID NO: 1644513 - protein, 8 aa, Staphylococcus aureus
TQKLTKSQ

SEQ ID NO: 1644514 - protein, 26 aa, Staphylococcus aureus
TQNEEQLDNSDEQSQRNEKTFSQEEV

SEQ ID NO: 1644515 - protein, 5 aa, Staphylococcus aureus
TQNGN

SEQ ID NO: 1644516 - protein, 8 aa, Staphylococcus aureus
TQNKPNDI

SEQ ID NO: 1644517 - protein, 11 aa, Staphylococcus aureus
TQNLTNENYNI

SEQ ID NO: 1644518 - protein, 5 aa, Staphylococcus aureus
TQNQK

SEQ ID NO: 1644519 - protein, 4 aa, Staphylococcus aureus
TQPD

SEQ ID NO: 1644520 - protein, 6 aa, Staphylococcus aureus
TQQEVA

SEQ ID NO: 1644521 - protein, 5 aa, Staphylococcus aureus
TQQNQ

SEQ ID NO: 1644522 - protein, 19 aa, Staphylococcus aureus
TQRISKRNSTGKASWGGTT

SEQ ID NO: 1644523 - protein, 7 aa, Staphylococcus aureus
TQRQGVN

SEQ ID NO: 1644524 - protein, 16 aa, Staphylococcus aureus
TQSAVKAGYSANSAHV

SEQ ID NO: 1644525 - protein, 4 aa, Staphylococcus aureus
TQSK

SEQ ID NO: 1644526 - protein, 5 aa, Staphylococcus aureus
TQSLS

SEQ ID NO: 1644527 - protein, 10 aa, Staphylococcus aureus
TQSQGDVRSA

SEQ ID NO: 1644528 - protein, 17 aa, Staphylococcus aureus
TQSSREKLAEKFQNHIN

SEQ ID NO: 1644529 - protein, 8 aa, Staphylococcus aureus
TQSTDNVT

SEQ ID NO: 1644530 - protein, 5 aa, Staphylococcus aureus
TQSTF

SEQ ID NO: 1644531 - protein, 7 aa, Staphylococcus aureus
TQTATQI

SEQ ID NO: 1644532 - protein, 8 aa, Staphylococcus aureus
TQTATQTQ

SEQ ID NO: 1644533 - protein, 22 aa, Staphylococcus aureus
TQTATQTQTATQTQTATQTQTV

SEQ ID NO: 1644534 - protein, 7 aa, Staphylococcus aureus
TQTEEQV

SEQ ID NO: 1644535 - protein, 10 aa, Staphylococcus aureus
TQTQTVTQTQ

SEQ ID NO: 1644536 - protein, 36 aa, Staphylococcus aureus
TQTVNQTQTATQIQKATQTQKATQIQKATQTQTAIQ

SEQ ID NO: 1644537 - protein, 6 aa, Staphylococcus aureus
TQTVSQ

SEQ ID NO: 1644538 - protein, 13 aa, Staphylococcus aureus
TQTVTQTQTATQT

SEQ ID NO: 1644539 - protein, 6 aa, Staphylococcus aureus
TQTVTR

SEQ ID NO: 1644540 - protein, 5 aa, Staphylococcus aureus
TQTWS

SEQ ID NO: 1644541 - protein, 51 aa, Staphylococcus aureus
TQVTSTKNALDGTHNLTQAKQTATNAIDGAANLNKAQKDALKAQVTSAQRV

SEQ ID NO: 1644542 - protein, 12 aa, Staphylococcus aureus
TRADKGTRKIEP

SEQ ID NO: 1644543 - protein, 10 aa, Staphylococcus aureus
TRAKNDEKYI

SEQ ID NO: 1644544 - protein, 7 aa, Staphylococcus aureus
TRALTTK

SEQ ID NO: 1644545 - protein, 13 aa, Staphylococcus aureus
TRDPRMKERKKTR

SEQ ID NO: 1644546 - protein, 19 aa, Staphylococcus aureus
TREDKLSNTYKKVEETQPE

SEQ ID NO: 1644547 - protein, 4 aa, Staphylococcus aureus
TREG

SEQ ID NO: 1644548 - protein, 7 aa, Staphylococcus aureus
TRGNITG

SEQ ID NO: 1644549 - protein, 8 aa, Staphylococcus aureus
TRHDAGTI

SEQ ID NO: 1644550 - protein, 16 aa, Staphylococcus aureus
TRIKDKKERYEAQATR

SEQ ID NO: 1644551 - protein, 4 aa, Staphylococcus aureus
TRIN

SEQ ID NO: 1644552 - protein, 108 aa, Staphylococcus aureus
TRKADEKTTNNTAVDKKSGKQSKKTTPSNKRNASKASTNKTSGQKKQHNKKSSQGAKKQSSSSKLTQKNNQTSNKNSKTTNAKSSNASKTPNAKVEKANSKIEKRTFN

SEQ ID NO: 1644553 - protein, 108 aa, Staphylococcus aureus; identical to SEQ ID NO: 1572583

SEQ ID NO: 1644554 - protein, 8 aa, Staphylococcus aureus
TRKDGNKH

SEQ ID NO: 1644555 - protein, 5 aa, Staphylococcus aureus
TRKPY

SEQ ID NO: 1644556 - protein, 8 aa, Staphylococcus aureus
TRKQISEL

SEQ ID NO: 1644557 - protein, 5 aa, Staphylococcus aureus
TRLGH

SEQ ID NO: 1644558 - protein, 12 aa, Staphylococcus aureus
TRLNDHNKAEHS

SEQ ID NO: 1644559 - protein, 19 aa, Staphylococcus aureus
TRLNQNKQQITHEENRRNQ

SEQ ID NO: 1644560 - protein, 6 aa, Staphylococcus aureus
TRMEEE

SEQ ID NO: 1644561 - protein, 14 aa, Staphylococcus aureus
TRMGPAGLAESHPH

SEQ ID NO: 1644562 - protein, 8 aa, Staphylococcus aureus
TRNKNNCK

SEQ ID NO: 1644563 - protein, 5 aa, Staphylococcus aureus
TRNTK

SEQ ID NO: 1644564 - protein, 6 aa, Staphylococcus aureus
TRPNPM

SEQ ID NO: 1644565 - protein, 6 aa, Staphylococcus aureus
TRPSEI

SEQ ID NO: 1644566 - protein, 8 aa, Staphylococcus aureus
TRQSGDTF

SEQ ID NO: 1644567 - protein, 10 aa, Staphylococcus aureus
TRRNNTSPWV

SEQ ID NO: 1644568 - protein, 5 aa, Staphylococcus aureus
TRRQH

SEQ ID NO: 1644569 - protein, 5 aa, Staphylococcus aureus
TRSEY

SEQ ID NO: 1644570 - protein, 5 aa, Staphylococcus aureus
TRTIN

SEQ ID NO: 1644571 - protein, 4 aa, Staphylococcus aureus
TRTK

SEQ ID NO: 1644572 - protein, 9 aa, Staphylococcus aureus
TRTLTTKYD

SEQ ID NO: 1644573 - protein, 18 aa, Staphylococcus aureus
TRYNQKTFGDIDDTIDRN

SEQ ID NO: 1644574 - protein, 14 aa, Staphylococcus aureus
TRYQSLNTAKNTLK

SEQ ID NO: 1644575 - protein, 5 aa, Staphylococcus aureus
TSADV

SEQ ID NO: 1644576 - protein, 14 aa, Staphylococcus aureus
TSAEKKLGKPVGSD

SEQ ID NO: 1644577 - protein, 7 aa, Staphylococcus aureus
TSALDPE

SEQ ID NO: 1644578 - protein, 20 aa, Staphylococcus aureus
TSAVKYTENYKPMAKSSTMR

SEQ ID NO: 1644579 - protein, 9 aa, Staphylococcus aureus
TSAVNKGYT

SEQ ID NO: 1644580 - protein, 8 aa, Staphylococcus aureus
TSDIGKDI

SEQ ID NO: 1644581 - protein, 5 aa, Staphylococcus aureus
TSDKI

SEQ ID NO: 1644582 - protein, 7 aa, Staphylococcus aureus
TSDKPRF

SEQ ID NO: 1644583 - protein, 14 aa, Staphylococcus aureus
TSDMDVDDDPREDL

SEQ ID NO: 1644584 - protein, 8 aa, Staphylococcus aureus
TSEAFKED

SEQ ID NO: 1644585 - protein, 5 aa, Staphylococcus aureus
TSEEI

SEQ ID NO: 1644586 - protein, 6 aa, Staphylococcus aureus
TSEGNL

SEQ ID NO: 1644587 - protein, 24 aa, Staphylococcus aureus
TSEGVITDKEARKRNVGGEIIAYV

SEQ ID NO: 1644588 - protein, 4 aa, Staphylococcus aureus
TSEI

SEQ ID NO: 1644589 - protein, 5 aa, Staphylococcus aureus
TSEIP

SEQ ID NO: 1644590 - protein, 6 aa, Staphylococcus aureus
TSELGE

SEQ ID NO: 1644591 - protein, 22 aa, Staphylococcus aureus
TSENNIPKITGKVGDNYQDNKG

SEQ ID NO: 1644592 - protein, 9 aa, Staphylococcus aureus
TSEQTPSSI

SEQ ID NO: 1644593 - protein, 13 aa, Staphylococcus aureus
TSESIRRNSEKEI

SEQ ID NO: 1644594 - protein, 6 aa, Staphylococcus aureus
TSGHWD

SEQ ID NO: 1644595 - protein, 8 aa, Staphylococcus aureus
TSGSKLTT

SEQ ID NO: 1644596 - protein, 8 aa, Staphylococcus aureus
TSKDTKFS

SEQ ID NO: 1644597 - protein, 16 aa, Staphylococcus aureus
TSKDTKFSLKLQENII

SEQ ID NO: 1644598 - protein, 29 aa, Staphylococcus aureus
TSKEAINPNNPLKSSGFGDDWLQNAKLMN

SEQ ID NO: 1644599 - protein, 14 aa, Staphylococcus aureus
TSKEIKQTKEGLKT

SEQ ID NO: 1644600 - protein, 7 aa, Staphylococcus aureus
TSKFSDD

SEQ ID NO: 1644601 - protein, 10 aa, Staphylococcus aureus
TSKITGEEEI

SEQ ID NO: 1644602 - protein, 4 aa, Staphylococcus aureus
TSLD

SEQ ID NO: 1644603 - protein, 9 aa, Staphylococcus aureus
TSLDCKEKK

SEQ ID NO: 1644604 - protein, 4 aa, Staphylococcus aureus
TSLE

SEQ ID NO: 1644605 - protein, 16 aa, Staphylococcus aureus
TSLEDIEKAETKYDHA

SEQ ID NO: 1644606 - protein, 16 aa, Staphylococcus aureus
TSLEGIKRDTKRWKDE

SEQ ID NO: 1644607 - protein, 21 aa, Staphylococcus aureus
TSLEGIKRDTKRWKDEVEPIV

SEQ ID NO: 1644608 - protein, 13 aa, Staphylococcus aureus
TSLITDDEDRLNK

SEQ ID NO: 1644609 - protein, 6 aa, Staphylococcus aureus
TSLYNQ

SEQ ID NO: 1644610 - protein, 34 aa, Staphylococcus aureus; identical to SEQ ID NO: 1569598

SEQ ID NO: 1644611 - protein, 8 aa, Staphylococcus aureus
TSNEYQTV

SEQ ID NO: 1644612 - protein, 5 aa, Staphylococcus aureus
TSNRQ

SEQ ID NO: 1644613 - protein, 6 aa, Staphylococcus aureus
TSNSYR

SEQ ID NO: 1644614 - protein, 9 aa, Staphylococcus aureus
TSPEDPRPI

SEQ ID NO: 1644615 - protein, 6 aa, Staphylococcus aureus
TSPQYE

SEQ ID NO: 1644616 - protein, 8 aa, Staphylococcus aureus
TSQIRVGS

SEQ ID NO: 1644617 - protein, 14 aa, Staphylococcus aureus
TSRSKKIGGERAKY

SEQ ID NO: 1644618 - protein, 16 aa, Staphylococcus aureus
TSRTISANQAGSYNFI

SEQ ID NO: 1644619 - protein, 5 aa, Staphylococcus aureus
TSSIS

SEQ ID NO: 1644620 - protein, 7 aa, Staphylococcus aureus
TSSTHYR

SEQ ID NO: 1644621 - protein, 7 aa, Staphylococcus aureus
TSSVKSE

SEQ ID NO: 1644622 - protein, 4 aa, Staphylococcus aureus
TSSY

SEQ ID NO: 1644623 - protein, 9 aa, Staphylococcus aureus
TSSYKKPYL

SEQ ID NO: 1644624 - protein, 7 aa, Staphylococcus aureus
TSTDDKN

SEQ ID NO: 1644625 - protein, 13 aa, Staphylococcus aureus
TSTGFAGGGATAE

SEQ ID NO: 1644626 - protein, 6 aa, Staphylococcus aureus
TSTKLK

SEQ ID NO: 1644627 - protein, 8 aa, Staphylococcus aureus
TSTKNLSD

SEQ ID NO: 1644628 - protein, 15 aa, Staphylococcus aureus
TSTNDQRVPSSKGVI

SEQ ID NO: 1644629 - protein, 15 aa, Staphylococcus aureus
TSTNTGGVMQVPENL

SEQ ID NO: 1644630 - protein, 10 aa, Staphylococcus aureus
TSVKGRMKQK

SEQ ID NO: 1644631 - protein, 14 aa, Staphylococcus aureus
TSVNSDSSYNQNNY

SEQ ID NO: 1644632 - protein, 6 aa, Staphylococcus aureus
TSYQDG

SEQ ID NO: 1644633 - protein, 5 aa, Staphylococcus aureus
TSYTF

SEQ ID NO: 1644634 - protein, 11 aa, Staphylococcus aureus
TSYYSAPSDLS

SEQ ID NO: 1644635 - protein, 4 aa, Staphylococcus aureus
TTAD

SEQ ID NO: 1644636 - protein, 4 aa, Staphylococcus aureus
TTAG

SEQ ID NO: 1644637 - protein, 4 aa, Staphylococcus aureus
TTAK

SEQ ID NO: 1644638 - protein, 10 aa, Staphylococcus aureus
TTAKDTDAST

SEQ ID NO: 1644639 - protein, 12 aa, Staphylococcus aureus
TTASELGGKAEF

SEQ ID NO: 1644640 - protein, 5 aa, Staphylococcus aureus
TTAYQ

SEQ ID NO: 1644641 - protein, 8 aa, Staphylococcus aureus
TTDEWNQN

SEQ ID NO: 1644642 - protein, 8 aa, Staphylococcus aureus
TTDLASDD

SEQ ID NO: 1644643 - protein, 17 aa, Staphylococcus aureus
TTDLKKNRLSISVLKYK

SEQ ID NO: 1644644 - protein, 12 aa, Staphylococcus aureus
TTDLKKTDYRYQ

SEQ ID NO: 1644645 - protein, 9 aa, Staphylococcus aureus
TTDPVSTKQ

SEQ ID NO: 1644646 - protein, 8 aa, Staphylococcus aureus
TTEDEDVE

SEQ ID NO: 1644647 - protein, 13 aa, Staphylococcus aureus
TTEFDNKSPSDAI

SEQ ID NO: 1644648 - protein, 5 aa, Staphylococcus aureus
TTEKE

SEQ ID NO: 1644649 - protein, 15 aa, Staphylococcus aureus
TTEYEKQEQEVPGLQ

SEQ ID NO: 1644650 - protein, 12 aa, Staphylococcus aureus
TTGGSLSSSQQQ

SEQ ID NO: 1644651 - protein, 13 aa, Staphylococcus aureus
TTGIGTGAGIATS

SEQ ID NO: 1644652 - protein, 10 aa, Staphylococcus aureus
TTGRQQMTET

SEQ ID NO: 1644653 - protein, 16 aa, Staphylococcus aureus
TTGSAQNNTDWGNKEY

SEQ ID NO: 1644654 - protein, 5 aa, Staphylococcus aureus
TTIEN

SEQ ID NO: 1644655 - protein, 24 aa, Staphylococcus aureus
TTIQRKDKRKLEKISTYSCRKRIE

SEQ ID NO: 1644656 - protein, 14 aa, Staphylococcus aureus
TTIRRKDTDKNKLG

SEQ ID NO: 1644657 - protein, 6 aa, Staphylococcus aureus
TTKEIS

SEQ ID NO: 1644658 - protein, 9 aa, Staphylococcus aureus
TTKKGDYGE

SEQ ID NO: 1644659 - protein, 10 aa, Staphylococcus aureus
TTKNGQGATN

SEQ ID NO: 1644660 - protein, 15 aa, Staphylococcus aureus
TTKQQSLAAQKQTIK

SEQ ID NO: 1644661 - protein, 12 aa, Staphylococcus aureus
TTKQQSLPAQKQ

SEQ ID NO: 1644662 - protein, 8 aa, Staphylococcus aureus
TTKQQSLV

SEQ ID NO: 1644663 - protein, 13 aa, Staphylococcus aureus
TTLPTDGGKPMKP

SEQ ID NO: 1644664 - protein, 35 aa, Staphylococcus aureus
TTMNNRQNINPQEATFTEESQNINQQQKECQPTEV

SEQ ID NO: 1644665 - protein, 25 aa, Staphylococcus aureus
TTMNQAKDALNGDEKLAQAKQEALA

SEQ ID NO: 1644666 - protein, 14 aa, Staphylococcus aureus
TTNAQDIKNILKEH

SEQ ID NO: 1644667 - protein, 15 aa, Staphylococcus aureus
TTNETESRNYPLGKA

SEQ ID NO: 1644668 - protein, 12 aa, Staphylococcus aureus
TTPAGMAENNES

SEQ ID NO: 1644669 - protein, 6 aa, Staphylococcus aureus
TTPFKE

SEQ ID NO: 1644670 - protein, 16 aa, Staphylococcus aureus
TTPNQDNPLTEDKTPI

SEQ ID NO: 1644671 - protein, 5 aa, Staphylococcus aureus
TTPYD

SEQ ID NO: 1644672 - protein, 107 aa, Staphylococcus aureus
TTQAANTRQERTPKLEKAPNTNEEKTSASKIEKISQPKQEEQKSLNISATPAPKQEQSQTTTESTTPKTKVTTPPSTNTPQPMQSTKSDTPQSPTIKQAQTDMTPKY

SEQ ID NO: 1644673 - protein, 45 aa, Staphylococcus aureus
TTQAANTRQERTPKLEKAPNTNEEKTSASKIEKISQPKQEEQKTL

SEQ ID NO: 1644674 - protein, 5 aa, Staphylococcus aureus
TTQGY

SEQ ID NO: 1644675 - protein, 14 aa, Staphylococcus aureus
TTRETQIKNDHEEF

SEQ ID NO: 1644676 - protein, 4 aa, Staphylococcus aureus
TTRI

SEQ ID NO: 1644677 - protein, 13 aa, Staphylococcus aureus
TTSEGIQSESVIS

SEQ ID NO: 1644678 - protein, 10 aa, Staphylococcus aureus
TTSEGIRSES

SEQ ID NO: 1644679 - protein, 10 aa, Staphylococcus aureus
TTSNISARTM

SEQ ID NO: 1644680 - protein, 9 aa, Staphylococcus aureus
TTSPGSTQK

SEQ ID NO: 1644681 - protein, 12 aa, Staphylococcus aureus
TTSSVQGYNPSP

SEQ ID NO: 1644682 - protein, 4 aa, Staphylococcus aureus
TTTD

SEQ ID NO: 1644683 - protein, 14 aa, Staphylococcus aureus
TTTEFDNKSPSDAI

SEQ ID NO: 1644684 - protein, 13 aa, Staphylococcus aureus
TTTGKTSKGFKGL

SEQ ID NO: 1644685 - protein, 9 aa, Staphylococcus aureus
TTTNPSKII

SEQ ID NO: 1644686 - protein, 12 aa, Staphylococcus aureus
TTVTQKGNQNVE

SEQ ID NO: 1644687 - protein, 17 aa, Staphylococcus aureus
TTVTSTSVFPTKEAAQQ

SEQ ID NO: 1644688 - protein, 21 aa, Staphylococcus aureus
TTVVKGASSLSPLKAERVEGT

SEQ ID NO: 1644689 - protein, 21 aa, Staphylococcus aureus
TTVVKGASSLSPLKEERVEGT

SEQ ID NO: 1644690 - protein, 4 aa, Staphylococcus aureus
TTYN

SEQ ID NO: 1644691 - protein, 21 aa, Staphylococcus aureus
TTYTTTVGGTLANGTQASGYA

SEQ ID NO: 1644692 - protein, 10 aa, Staphylococcus aureus
TVDESHLSKG

SEQ ID NO: 1644693 - protein, 15 aa, Staphylococcus aureus
TVDKIKSNGDNAKAY

SEQ ID NO: 1644694 - protein, 16 aa, Staphylococcus aureus
TVDKNGEEEKQSTFKT

SEQ ID NO: 1644695 - protein, 30 aa, Staphylococcus aureus
TVDKNGKLTLSDGKTSKVMPTNAKDKKGND

SEQ ID NO: 1644696 - protein, 13 aa, Staphylococcus aureus
TVEEREKGQQVGS

SEQ ID NO: 1644697 - protein, 6 aa, Staphylococcus aureus
TVEGEK

SEQ ID NO: 1644698 - protein, 13 aa, Staphylococcus aureus
TVETEAQASTESE

SEQ ID NO: 1644699 - protein, 13 aa, Staphylococcus aureus
TVETEAQESTESE

SEQ ID NO: 1644700 - protein, 13 aa, Staphylococcus aureus
TVETEGQESTESE

SEQ ID NO: 1644701 - protein, 9 aa, Staphylococcus aureus
TVGTGVGPT

SEQ ID NO: 1644702 - protein, 8 aa, Staphylococcus aureus
TVHKEGTA

SEQ ID NO: 1644703 - protein, 9 aa, Staphylococcus aureus
TVKEEEAVS

SEQ ID NO: 1644704 - protein, 7 aa, Staphylococcus aureus
TVKESPF

SEQ ID NO: 1644705 - protein, 11 aa, Staphylococcus aureus
TVKKEQRKKEL

SEQ ID NO: 1644706 - protein, 28 aa, Staphylococcus aureus
TVKSTKGALDGQQNLQRAKTEATNAITH

SEQ ID NO: 1644707 - protein, 6 aa, Staphylococcus aureus
TVNDYG

SEQ ID NO: 1644708 - protein, 6 aa, Staphylococcus aureus
TVNPNS

SEQ ID NO: 1644709 - protein, 33 aa, Staphylococcus aureus
TVPNTSQITGTVDNNHQHVSATAPNVTSATTKT

SEQ ID NO: 1644710 - protein, 33 aa, Staphylococcus aureus; identical to SEQ ID NO: 1569608

SEQ ID NO: 1644711 - protein, 5 aa, Staphylococcus aureus
TVQPN

SEQ ID NO: 1644712 - protein, 5 aa, Staphylococcus aureus
TVQYS

SEQ ID NO: 1644713 - protein, 6 aa, Staphylococcus aureus
TVSNET

SEQ ID NO: 1644714 - protein, 25 aa, Staphylococcus aureus
TVSVTRNKNNVRSQKDAQLELNRII

SEQ ID NO: 1644715 - protein, 38 aa, Staphylococcus aureus
TVTNNRENIHPQEATFTGESQNINHQQKKSQPTEKEIN

SEQ ID NO: 1644716 - protein, 7 aa, Staphylococcus aureus
TVTQTQT

SEQ ID NO: 1644717 - protein, 9 aa, Staphylococcus aureus
TVTRGDNNQ

SEQ ID NO: 1644718 - protein, 11 aa, Staphylococcus aureus
TVTSDNKHKSL

SEQ ID NO: 1644719 - protein, 4 aa, Staphylococcus aureus
TWPG

SEQ ID NO: 1644720 - protein, 8 aa, Staphylococcus aureus
TYADQQSN

SEQ ID NO: 1644721 - protein, 6 aa, Staphylococcus aureus
TYAGGL

SEQ ID NO: 1644722 - protein, 6 aa, Staphylococcus aureus
TYDDSR

SEQ ID NO: 1644723 - protein, 5 aa, Staphylococcus aureus
TYDEV

SEQ ID NO: 1644724 - protein, 5 aa, Staphylococcus aureus
TYDGS

SEQ ID NO: 1644725 - protein, 17 aa, Staphylococcus aureus
TYEASGGSDDTREGTVM

SEQ ID NO: 1644726 - protein, 5 aa, Staphylococcus aureus
TYEAT

SEQ ID NO: 1644727 - protein, 5 aa, Staphylococcus aureus
TYELP

SEQ ID NO: 1644728 - protein, 8 aa, Staphylococcus aureus
TYGPNKDV

SEQ ID NO: 1644729 - protein, 9 aa, Staphylococcus aureus
TYGQEPQPF

SEQ ID NO: 1644730 - protein, 21 aa, Staphylococcus aureus
TYHSVKANTNAYYRYDRDSIT

SEQ ID NO: 1644731 - protein, 7 aa, Staphylococcus aureus
TYKKASK

SEQ ID NO: 1644732 - protein, 8 aa, Staphylococcus aureus
TYKKASKD

SEQ ID NO: 1644733 - protein, 9 aa, Staphylococcus aureus
TYNDGVPDY

SEQ ID NO: 1644734 - protein, 13 aa, Staphylococcus aureus
TYNPKTSKKENAL

SEQ ID NO: 1644735 - protein, 13 aa, Staphylococcus aureus
TYNPKTSKKENTF

SEQ ID NO: 1644736 - protein, 15 aa, Staphylococcus aureus
TYPRTDSRYITEDEK

SEQ ID NO: 1644737 - protein, 10 aa, Staphylococcus aureus
TYSDNTANNK

SEQ ID NO: 1644738 - protein, 4 aa, Staphylococcus aureus
TYTD

SEQ ID NO: 1644739 - protein, 6 aa, Staphylococcus aureus
TYTNEA

SEQ ID NO: 1644740 - protein, 10 aa, Staphylococcus aureus
TYTTQDEHGQ

SEQ ID NO: 1644741 - protein, 11 aa, Staphylococcus aureus
TYTTQDEHGRA

SEQ ID NO: 1644742 - protein, 18 aa, Staphylococcus aureus
TYYPSKLNKDQIKEEMLA

SEQ ID NO: 1644743 - protein, 11 aa, Staphylococcus aureus
VAAPQQGTNVN

SEQ ID NO: 1644744 - protein, 5 aa, Staphylococcus aureus
VADAY

SEQ ID NO: 1644745 - protein, 6 aa, Staphylococcus aureus
VADELD

SEQ ID NO: 1644746 - protein, 25 aa, Staphylococcus aureus
VADGGNSEGGAGAKYHGAKHQNENI

SEQ ID NO: 1644747 - protein, 33 aa, Staphylococcus aureus; identical to SEQ ID NO: 1566733

SEQ ID NO: 1644748 - protein, 34 aa, Staphylococcus aureus; identical to SEQ ID NO: 1566511

SEQ ID NO: 1644749 - protein, 33 aa, Staphylococcus aureus; identical to SEQ ID NO: 1567782

SEQ ID NO: 1644750 - protein, 31 aa, Staphylococcus aureus
VADNQATLASEDYHDATAQRQNDYNQALTAT

SEQ ID NO: 1644751 - protein, 11 aa, Staphylococcus aureus
VADSGDFDGPV

SEQ ID NO: 1644752 - protein, 28 aa, Staphylococcus aureus
VAEGTSVITATSTDGSDKSGQITVTVTN

SEQ ID NO: 1644753 - protein, 7 aa, Staphylococcus aureus
VAEKRNA

SEQ ID NO: 1644754 - protein, 15 aa, Staphylococcus aureus
VAGERGAADAERDIR

SEQ ID NO: 1644755 - protein, 7 aa, Staphylococcus aureus
VAGSDNS

SEQ ID NO: 1644756 - protein, 8 aa, Staphylococcus aureus
VAGTPAKV

SEQ ID NO: 1644757 - protein, 18 aa, Staphylococcus aureus
VAKGNKADVDKAVEAADN

SEQ ID NO: 1644758 - protein, 8 aa, Staphylococcus aureus
VAKNGKVC

SEQ ID NO: 1644759 - protein, 12 aa, Staphylococcus aureus
VAKRSQIPVIIV

SEQ ID NO: 1644760 - protein, 20 aa, Staphylococcus aureus
VALDGDENLAAAKQQANNRL

SEQ ID NO: 1644761 - protein, 5 aa, Staphylococcus aureus
VANDR

SEQ ID NO: 1644762 - protein, 15 aa, Staphylococcus aureus
VANKDKGYYILRSIK

SEQ ID NO: 1644763 - protein, 7 aa, Staphylococcus aureus
VANPDVR

SEQ ID NO: 1644764 - protein, 22 aa, Staphylococcus aureus
VAPNTEAVGKSAYNNVQVGGAP

SEQ ID NO: 1644765 - protein, 5 aa, Staphylococcus aureus
VAPRS

SEQ ID NO: 1644766 - protein, 7 aa, Staphylococcus aureus
VAQDNDA

SEQ ID NO: 1644767 - protein, 40 aa, Staphylococcus aureus; identical to SEQ ID NO: 1566734

SEQ ID NO: 1644768 - protein, 34 aa, Staphylococcus aureus
VAQQQQQAQGANAGQNNDSTVEDAEFKEVKDDDK

SEQ ID NO: 1644769 - protein, 7 aa, Staphylococcus aureus
VASEDTL

SEQ ID NO: 1644770 - protein, 10 aa, Staphylococcus aureus
VASPYTPTPS

SEQ ID NO: 1644771 - protein, 18 aa, Staphylococcus aureus
VATQGSGETISDEQRSDD

SEQ ID NO: 1644772 - protein, 9 aa, Staphylococcus aureus
VATSNDKQG

SEQ ID NO: 1644773 - protein, 7 aa, Staphylococcus aureus
VATSNNK

SEQ ID NO: 1644774 - protein, 5 aa, Staphylococcus aureus
VATTK

SEQ ID NO: 1644775 - protein, 9 aa, Staphylococcus aureus
VDAKTPNAK

SEQ ID NO: 1644776 - protein, 26 aa, Staphylococcus aureus
VDAPKTQEHAVTESQVNNIDKTVDNE

SEQ ID NO: 1644777 - protein, 46 aa, Staphylococcus aureus
VDASKQATSNDSLEAKAENDSTASQSEMSEPKPQEEKKGFFARLFN

SEQ ID NO: 1644778 - protein, 16 aa, Staphylococcus aureus
VDDDGNSVPANTKGNI

SEQ ID NO: 1644779 - protein, 17 aa, Staphylococcus aureus
VDDEKDALAERLDDNPY

SEQ ID NO: 1644780 - protein, 19 aa, Staphylococcus aureus
VDDEKDALAKRLDDNPGEL

SEQ ID NO: 1644781 - protein, 10 aa, Staphylococcus aureus
VDDTEKLSAE

SEQ ID NO: 1644782 - protein, 33 aa, Staphylococcus aureus
VDEHTQKSTKKASSTVEQTSTCKQNQPRNNGRF

SEQ ID NO: 1644783 - protein, 6 aa, Staphylococcus aureus
VDEKTT

SEQ ID NO: 1644784 - protein, 6 aa, Staphylococcus aureus
VDEPSV

SEQ ID NO: 1644785 - protein, 18 aa, Staphylococcus aureus
VDETKQLSATTEPSGQKV

SEQ ID NO: 1644786 - protein, 11 aa, Staphylococcus aureus
VDGKGAMPTTI

SEQ ID NO: 1644787 - protein, 16 aa, Staphylococcus aureus
VDGPTGTFINGDGEMP

SEQ ID NO: 1644788 - protein, 12 aa, Staphylococcus aureus
VDHQTLNQNHPQ

SEQ ID NO: 1644789 - protein, 19 aa, Staphylococcus aureus
VDKEKDTLAKRLDDNPDEL

SEQ ID NO: 1644790 - protein, 8 aa, Staphylococcus aureus
VDKEKEAL

SEQ ID NO: 1644791 - protein, 8 aa, Staphylococcus aureus
VDKEKESL

SEQ ID NO: 1644792 - protein, 19 aa, Staphylococcus aureus
VDKEKETLAKRLDNNPDEL

SEQ ID NO: 1644793 - protein, 9 aa, Staphylococcus aureus
VDKEKIDKE

SEQ ID NO: 1644794 - protein, 16 aa, Staphylococcus aureus
VDKKAMESLSEETKKD

SEQ ID NO: 1644795 - protein, 6 aa, Staphylococcus aureus
VDKNRE

SEQ ID NO: 1644796 - protein, 16 aa, Staphylococcus aureus
VDKSSYAKTQDITTIS

SEQ ID NO: 1644797 - protein, 10 aa, Staphylococcus aureus
VDLPEGLARE

SEQ ID NO: 1644798 - protein, 11 aa, Staphylococcus aureus
VDLPEGLASEG

SEQ ID NO: 1644799 - protein, 7 aa, Staphylococcus aureus
VDNAEGK

SEQ ID NO: 1644800 - protein, 10 aa, Staphylococcus aureus
VDNAKQQVKR

SEQ ID NO: 1644801 - protein, 11 aa, Staphylococcus aureus
VDNNFSPDDSK

SEQ ID NO: 1644802 - protein, 6 aa, Staphylococcus aureus
VDNNPS

SEQ ID NO: 1644803 - protein, 9 aa, Staphylococcus aureus
VDNPEEKIE

SEQ ID NO: 1644804 - protein, 9 aa, Staphylococcus aureus
VDQGSGDKI

SEQ ID NO: 1644805 - protein, 4 aa, Staphylococcus aureus
VDQT

SEQ ID NO: 1644806 - protein, 13 aa, Staphylococcus aureus
VDRENSGPSTLKR

SEQ ID NO: 1644807 - protein, 6 aa, Staphylococcus aureus
VDSDST

SEQ ID NO: 1644808 - protein, 22 aa, Staphylococcus aureus
VDSEAGHVGGYTESSEESNPID

SEQ ID NO: 1644809 - protein, 13 aa, Staphylococcus aureus
VDSPKKLRDYQEE

SEQ ID NO: 1644810 - protein, 8 aa, Staphylococcus aureus
VDSQIKDK

SEQ ID NO: 1644811 - protein, 16 aa, Staphylococcus aureus
VDTAQKYKLNDRDKEV

SEQ ID NO: 1644812 - protein, 4 aa, Staphylococcus aureus
VDTD

SEQ ID NO: 1644813 - protein, 13 aa, Staphylococcus aureus
VDTEYDGQDGLDK

SEQ ID NO: 1644814 - protein, 9 aa, Staphylococcus aureus
VDTTDKTGT

SEQ ID NO: 1644815 - protein, 7 aa, Staphylococcus aureus
VDTTTNQ

SEQ ID NO: 1644816 - protein, 8 aa, Staphylococcus aureus
VDVGNGEN

SEQ ID NO: 1644817 - protein, 5 aa, Staphylococcus aureus
VDYNM

SEQ ID NO: 1644818 - protein, 24 aa, Staphylococcus aureus
VEAPISSNDSEEVTSDSIKTDTNV

SEQ ID NO: 1644819 - protein, 7 aa, Staphylococcus aureus
VEATEEE

SEQ ID NO: 1644820 - protein, 6 aa, Staphylococcus aureus
VEDETV

SEQ ID NO: 1644821 - protein, 6 aa, Staphylococcus aureus
VEEELS

SEQ ID NO: 1644822 - protein, 10 aa, Staphylococcus aureus
VEEEYDSSTL

SEQ ID NO: 1644823 - protein, 15 aa, Staphylococcus aureus
VEEIKAGKVEYRAEK

SEQ ID NO: 1644824 - protein, 6 aa, Staphylococcus aureus
VEENDL

SEQ ID NO: 1644825 - protein, 18 aa, Staphylococcus aureus
VEGAEGHAEGTIETEEDS

SEQ ID NO: 1644826 - protein, 5 aa, Staphylococcus aureus
VEGGD

SEQ ID NO: 1644827 - protein, 6 aa, Staphylococcus aureus
VEGQGT

SEQ ID NO: 1644828 - protein, 26 aa, Staphylococcus aureus
VEIKDSNGNLIRDNNGNPKTERKPVI

SEQ ID NO: 1644829 - protein, 17 aa, Staphylococcus aureus
VEISTETNIAQPKFKYG

SEQ ID NO: 1644830 - protein, 20 aa, Staphylococcus aureus
VEKFNENGIDYSNINSDNFK

SEQ ID NO: 1644831 - protein, 4 aa, Staphylococcus aureus
VEKI

SEQ ID NO: 1644832 - protein, 7 aa, Staphylococcus aureus
VEKINDN

SEQ ID NO: 1644833 - protein, 4 aa, Staphylococcus aureus
VEKP

SEQ ID NO: 1644834 - protein, 10 aa, Staphylococcus aureus
VEKRKDSQVA

SEQ ID NO: 1644835 - protein, 25 aa, Staphylococcus aureus
VEKTLNKNKYDSVDEAVKAGLQLVV

SEQ ID NO: 1644836 - protein, 14 aa, Staphylococcus aureus
VENANNNKISNREL

SEQ ID NO: 1644837 - protein, 14 aa, Staphylococcus aureus
VENDKVKKKFDRAK

SEQ ID NO: 1644838 - protein, 6 aa, Staphylococcus aureus
VENDNA

SEQ ID NO: 1644839 - protein, 6 aa, Staphylococcus aureus
VENGED

SEQ ID NO: 1644840 - protein, 10 aa, Staphylococcus aureus
VENGETYPHH

SEQ ID NO: 1644841 - protein, 10 aa, Staphylococcus aureus
VEPESVENQI

SEQ ID NO: 1644842 - protein, 13 aa, Staphylococcus aureus
VEPLKEEEAIAKE

SEQ ID NO: 1644843 - protein, 9 aa, Staphylococcus aureus
VEPSREPVI

SEQ ID NO: 1644844 - protein, 22 aa, Staphylococcus aureus
VEPTVHGGGQEYGVRSGTVNLP

SEQ ID NO: 1644845 - protein, 10 aa, Staphylococcus aureus
VEQEREDKKQ

SEQ ID NO: 1644846 - protein, 22 aa, Staphylococcus aureus
VEQNDNKFTVTASKKLDKTTIK

SEQ ID NO: 1644847 - protein, 8 aa, Staphylococcus aureus
VEQQINGA

SEQ ID NO: 1644848 - protein, 16 aa, Staphylococcus aureus
VEQRQKIKKSISKCDG

SEQ ID NO: 1644849 - protein, 13 aa, Staphylococcus aureus
VERKAKSPLLFGS

SEQ ID NO: 1644850 - protein, 6 aa, Staphylococcus aureus
VERNSI

SEQ ID NO: 1644851 - protein, 15 aa, Staphylococcus aureus
VERPGARLSTTDDGE

SEQ ID NO: 1644852 - protein, 6 aa, Staphylococcus aureus
VESDSD

SEQ ID NO: 1644853 - protein, 11 aa, Staphylococcus aureus
VESIENKYSDL

SEQ ID NO: 1644854 - protein, 11 aa, Staphylococcus aureus
VETEPGPNAGL

SEQ ID NO: 1644855 - protein, 20 aa, Staphylococcus aureus
VETIGDNKTSQDLKTAINDQ

SEQ ID NO: 1644856 - protein, 12 aa, Staphylococcus aureus
VETKVGKGYMAH

SEQ ID NO: 1644857 - protein, 5 aa, Staphylococcus aureus
VETPS

SEQ ID NO: 1644858 - protein, 15 aa, Staphylococcus aureus
VETTELSSDDHHTTV

SEQ ID NO: 1644859 - protein, 15 aa, Staphylococcus aureus
VEVPDNKKLSIEQRK

SEQ ID NO: 1644860 - protein, 6 aa, Staphylococcus aureus
VEYSNE

SEQ ID NO: 1644861 - protein, 13 aa, Staphylococcus aureus
VFGGGKGANQAIA

SEQ ID NO: 1644862 - protein, 12 aa, Staphylococcus aureus
VGAGTKRGLPKA

SEQ ID NO: 1644863 - protein, 4 aa, Staphylococcus aureus
VGAT

SEQ ID NO: 1644864 - protein, 9 aa, Staphylococcus aureus
VGDDVTKNE

SEQ ID NO: 1644865 - protein, 5 aa, Staphylococcus aureus
VGDKD

SEQ ID NO: 1644866 - protein, 9 aa, Staphylococcus aureus
VGDPQDEAI

SEQ ID NO: 1644867 - protein, 9 aa, Staphylococcus aureus
VGEDIPSDY

SEQ ID NO: 1644868 - protein, 9 aa, Staphylococcus aureus
VGEGPQHRE

SEQ ID NO: 1644869 - protein, 9 aa, Staphylococcus aureus
VGETVKAKQ

SEQ ID NO: 1644870 - protein, 51 aa, Staphylococcus aureus
VGGAPTERNRITNSNKQCKLAGPQHREIGSPISTDNASWGRTSIKKYFFFR

SEQ ID NO: 1644871 - protein, 9 aa, Staphylococcus aureus
VGGAPTKRN

SEQ ID NO: 1644872 - protein, 10 aa, Staphylococcus aureus
VGGAPTQRIS

SEQ ID NO: 1644873 - protein, 24 aa, Staphylococcus aureus
VGGAPTQRISKRNSTNNASWGWMT

SEQ ID NO: 1644874 - protein, 10 aa, Staphylococcus aureus
VGGAPTQRNW

SEQ ID NO: 1644875 - protein, 51 aa, Staphylococcus aureus
VGGATTERNRITNSNKQCKLAGPQHREIGSPISTDNASWGRTSIKKYFFFR

SEQ ID NO: 1644876 - protein, 17 aa, Staphylococcus aureus
VGGITKSNSKKVDHKAG

SEQ ID NO: 1644877 - protein, 17 aa, Staphylococcus aureus
VGGITKTNSKKVDHKAE

SEQ ID NO: 1644878 - protein, 14 aa, Staphylococcus aureus
VGGITKTNSKKVNH

SEQ ID NO: 1644879 - protein, 10 aa, Staphylococcus aureus
VGGKGAMPTT

SEQ ID NO: 1644880 - protein, 13 aa, Staphylococcus aureus
VGGRKGHVYTDDQ

SEQ ID NO: 1644881 - protein, 4 aa, Staphylococcus aureus
VGHE

SEQ ID NO: 1644882 - protein, 13 aa, Staphylococcus aureus
VGHWEKDDTNLSN

SEQ ID NO: 1644883 - protein, 4 aa, Staphylococcus aureus
VGIT

SEQ ID NO: 1644884 - protein, 9 aa, Staphylococcus aureus
VGKEGADKR

SEQ ID NO: 1644885 - protein, 9 aa, Staphylococcus aureus
VGKGKNEEI

SEQ ID NO: 1644886 - protein, 4 aa, Staphylococcus aureus
VGKP

SEQ ID NO: 1644887 - protein, 10 aa, Staphylococcus aureus
VGKSDTPSMP

SEQ ID NO: 1644888 - protein, 8 aa, Staphylococcus aureus
VGLEKDND

SEQ ID NO: 1644889 - protein, 15 aa, Staphylococcus aureus
VGNFNENHGREKVQS

SEQ ID NO: 1644890 - protein, 9 aa, Staphylococcus aureus
VGNGTNERD

SEQ ID NO: 1644891 - protein, 14 aa, Staphylococcus aureus
VGNPREDGTQVGPM

SEQ ID NO: 1644892 - protein, 10 aa, Staphylococcus aureus
VGNTKIKDAK

SEQ ID NO: 1644893 - protein, 6 aa, Staphylococcus aureus
VGPKHR

SEQ ID NO: 1644894 - protein, 17 aa, Staphylococcus aureus
VGPNTEAGEKSAYKNVQ

SEQ ID NO: 1644895 - protein, 41 aa, Staphylococcus aureus
VGPNTEAGEKSAYKNVQVGGATTERNRITNSNKQCKLAGAP

SEQ ID NO: 1644896 - protein, 68 aa, Staphylococcus aureus
VGPNTEAGEKSAYKNVQVGGATTERNRITNSNKQCKLAGPQHREIGSPISTDNASWGRTSIKKYFFFR

SEQ ID NO: 1644897 - protein, 7 aa, Staphylococcus aureus
VGPNTEN

SEQ ID NO: 1644898 - protein, 7 aa, Staphylococcus aureus
VGPQGSK

SEQ ID NO: 1644899 - protein, 24 aa, Staphylococcus aureus
VGPQQREIGSPIPTDNASWRGPNI

SEQ ID NO: 1644900 - protein, 11 aa, Staphylococcus aureus
VGPSGAGKSTL

SEQ ID NO: 1644901 - protein, 29 aa, Staphylococcus aureus
VGPSPDKENDLVNDNAETNQPKPKEFEPT

SEQ ID NO: 1644902 - protein, 6 aa, Staphylococcus aureus
VGPYTQ

SEQ ID NO: 1644903 - protein, 8 aa, Staphylococcus aureus
VGQDKSVD

SEQ ID NO: 1644904 - protein, 4 aa, Staphylococcus aureus
VGQR

SEQ ID NO: 1644905 - protein, 20 aa, Staphylococcus aureus
VGQSQISRSIGGGSKPTITS

SEQ ID NO: 1644906 - protein, 16 aa, Staphylococcus aureus
VGSDQVRAYKPNPEGI

SEQ ID NO: 1644907 - protein, 9 aa, Staphylococcus aureus
VGSGMNRNK

SEQ ID NO: 1644908 - protein, 5 aa, Staphylococcus aureus
VGSRS

SEQ ID NO: 1644909 - protein, 8 aa, Staphylococcus aureus
VGSSPESF

SEQ ID NO: 1644910 - protein, 9 aa, Staphylococcus aureus
VGSSPESFV

SEQ ID NO: 1644911 - protein, 12 aa, Staphylococcus aureus
VGSTDQKSNLSE

SEQ ID NO: 1644912 - protein, 7 aa, Staphylococcus aureus
VGTAGGG

SEQ ID NO: 1644913 - protein, 7 aa, Staphylococcus aureus
VGTNGEV

SEQ ID NO: 1644914 - protein, 24 aa, Staphylococcus aureus
VGTPEGVRELENAGADATKVGIGP

SEQ ID NO: 1644915 - protein, 19 aa, Staphylococcus aureus
VGVSSEEIKEAIESSFKNT

SEQ ID NO: 1644916 - protein, 7 aa, Staphylococcus aureus
VGYQPTL

SEQ ID NO: 1644917 - protein, 8 aa, Staphylococcus aureus
VGYQPTLA

SEQ ID NO: 1644918 - protein, 5 aa, Staphylococcus aureus
VGYYP

SEQ ID NO: 1644919 - protein, 6 aa, Staphylococcus aureus
VHQVGN

SEQ ID NO: 1644920 - protein, 4 aa, Staphylococcus aureus
VHSK

SEQ ID NO: 1644921 - protein, 23 aa, Staphylococcus aureus
VHVETKDIDGNTSFENEQTSNLT

SEQ ID NO: 1644922 - protein, 11 aa, Staphylococcus aureus
VINTENNSVPY

SEQ ID NO: 1644923 - protein, 12 aa, Staphylococcus aureus
VIQPGTKGTTVG

SEQ ID NO: 1644924 - protein, 8 aa, Staphylococcus aureus
VKAEAGEF

SEQ ID NO: 1644925 - protein, 8 aa, Staphylococcus aureus
VKDDEVNT

SEQ ID NO: 1644926 - protein, 8 aa, Staphylococcus aureus
VKDEETAV

SEQ ID NO: 1644927 - protein, 25 aa, Staphylococcus aureus
VKDGNLINTSDEDKTTDEEEKAHSI

SEQ ID NO: 1644928 - protein, 6 aa, Staphylococcus aureus
VKDKTQ

SEQ ID NO: 1644929 - protein, 8 aa, Staphylococcus aureus
VKDQETTL

SEQ ID NO: 1644930 - protein, 15 aa, Staphylococcus aureus
VKDREYKKEIEEKNR

SEQ ID NO: 1644931 - protein, 7 aa, Staphylococcus aureus
VKDTNKI

SEQ ID NO: 1644932 - protein, 21 aa, Staphylococcus aureus
VKEAPMPKEETAQLETIEEVK

SEQ ID NO: 1644933 - protein, 27 aa, Staphylococcus aureus
VKEDAEDETNEDEQSTVSEDGTEQQHE

SEQ ID NO: 1644934 - protein, 8 aa, Staphylococcus aureus
VKEPKKKL

SEQ ID NO: 1644935 - protein, 6 aa, Staphylococcus aureus
VKGEQQ

SEQ ID NO: 1644936 - protein, 16 aa, Staphylococcus aureus
VKGNNVREGYSTNSRI

SEQ ID NO: 1644937 - protein, 30 aa, Staphylococcus aureus
VKGNSTTNWQKSKLTDDCGKAIESSEQSID

SEQ ID NO: 1644938 - protein, 9 aa, Staphylococcus aureus
VKGNSTVNW

SEQ ID NO: 1644939 - protein, 30 aa, Staphylococcus aureus
VKGNTTTNWQKSKITDDYGKAIESSEQSID

SEQ ID NO: 1644940 - protein, 11 aa, Staphylococcus aureus
VKGPKGELSRT

SEQ ID NO: 1644941 - protein, 8 aa, Staphylococcus aureus
VKGSTETE

SEQ ID NO: 1644942 - protein, 22 aa, Staphylococcus aureus
VKGYQDENNKALKSVRKQTRNR

SEQ ID NO: 1644943 - protein, 21 aa, Staphylococcus aureus
VKGYQDENNKSLKSVRKQTRH

SEQ ID NO: 1644944 - protein, 20 aa, Staphylococcus aureus
VKGYQDENNKSLKSVRKTNE

SEQ ID NO: 1644945 - protein, 12 aa, Staphylococcus aureus
VKINEQRANYTR

SEQ ID NO: 1644946 - protein, 8 aa, Staphylococcus aureus
VKKGDKVN

SEQ ID NO: 1644947 - protein, 7 aa, Staphylococcus aureus
VKKSNDS

SEQ ID NO: 1644948 - protein, 6 aa, Staphylococcus aureus
VKKSRA

SEQ ID NO: 1644949 - protein, 17 aa, Staphylococcus aureus
VKLPDELQGDGIAQLPN

SEQ ID NO: 1644950 - protein, 8 aa, Staphylococcus aureus
VKMEEGSL

SEQ ID NO: 1644951 - protein, 8 aa, Staphylococcus aureus
VKNGKSGI

SEQ ID NO: 1644952 - protein, 6 aa, Staphylococcus aureus
VKNKTQ

SEQ ID NO: 1644953 - protein, 11 aa, Staphylococcus aureus
VKNPNKEGHGE

SEQ ID NO: 1644954 - protein, 5 aa, Staphylococcus aureus
VKNTR

SEQ ID NO: 1644955 - protein, 14 aa, Staphylococcus aureus
VKNYKPQNEKQVQA

SEQ ID NO: 1644956 - protein, 20 aa, Staphylococcus aureus
VKPAARQSVGVKAEAQNTLI

SEQ ID NO: 1644957 - protein, 23 aa, Staphylococcus aureus
VKPDPPRIDGNSVTYKAGLTNQQ

SEQ ID NO: 1644958 - protein, 12 aa, Staphylococcus aureus
VKPDPPRIEANS

SEQ ID NO: 1644959 - protein, 5 aa, Staphylococcus aureus
VKPDT

SEQ ID NO: 1644960 - protein, 12 aa, Staphylococcus aureus
VKPGKENPSKLI

SEQ ID NO: 1644961 - protein, 7 aa, Staphylococcus aureus
VKPNELK

SEQ ID NO: 1644962 - protein, 7 aa, Staphylococcus aureus
VKPNGLA

SEQ ID NO: 1644963 - protein, 4 aa, Staphylococcus aureus
VKPV

SEQ ID NO: 1644964 - protein, 12 aa, Staphylococcus aureus
VKPVNNSWSTNA

SEQ ID NO: 1644965 - protein, 10 aa, Staphylococcus aureus
VKQTATSLDQ

SEQ ID NO: 1644966 - protein, 17 aa, Staphylococcus aureus
VKQTPNATDEEKQAAVN

SEQ ID NO: 1644967 - protein, 18 aa, Staphylococcus aureus
VKQTPNATDEEKQAAVNQ

SEQ ID NO: 1644968 - protein, 8 aa, Staphylococcus aureus
VKRPSTAK

SEQ ID NO: 1644969 - protein, 4 aa, Staphylococcus aureus
VKRT

SEQ ID NO: 1644970 - protein, 8 aa, Staphylococcus aureus
VKSGKTLN

SEQ ID NO: 1644971 - protein, 25 aa, Staphylococcus aureus
VKSLENEKKRLKDEINTLYNKIYED

SEQ ID NO: 1644972 - protein, 24 aa, Staphylococcus aureus
VKSPATSSSTAKSSEVNPKPQSDE

SEQ ID NO: 1644973 - protein, 6 aa, Staphylococcus aureus
VKSPTV

SEQ ID NO: 1644974 - protein, 8 aa, Staphylococcus aureus
VKSSNPNL

SEQ ID NO: 1644975 - protein, 8 aa, Staphylococcus aureus
VKSSQNAV

SEQ ID NO: 1644976 - protein, 17 aa, Staphylococcus aureus
VKTAKDIEACQKQTQQL

SEQ ID NO: 1644977 - protein, 21 aa, Staphylococcus aureus
VKTDKKSGIVDNPNKFSTDPQ

SEQ ID NO: 1644978 - protein, 10 aa, Staphylococcus aureus
VKTDRDTSEK

SEQ ID NO: 1644979 - protein, 4 aa, Staphylococcus aureus
VKTE

SEQ ID NO: 1644980 - protein, 7 aa, Staphylococcus aureus
VKTPSNK

SEQ ID NO: 1644981 - protein, 18 aa, Staphylococcus aureus
VKTPVKNEKNPPVPAGYT

SEQ ID NO: 1644982 - protein, 16 aa, Staphylococcus aureus
VKVNGTTVTELGTKVK

SEQ ID NO: 1644983 - protein, 14 aa, Staphylococcus aureus
VKYGSKEEQQAENH

SEQ ID NO: 1644984 - protein, 8 aa, Staphylococcus aureus
VLEKPSNN

SEQ ID NO: 1644985 - protein, 9 aa, Staphylococcus aureus
VLESNRGIT

SEQ ID NO: 1644986 - protein, 6 aa, Staphylococcus aureus
VLESTN

SEQ ID NO: 1644987 - protein, 8 aa, Staphylococcus aureus
VLKDNEHS

SEQ ID NO: 1644988 - protein, 9 aa, Staphylococcus aureus
VLKSERGIS

SEQ ID NO: 1644989 - protein, 5 aa, Staphylococcus aureus
VLTKG

SEQ ID NO: 1644990 - protein, 24 aa, Staphylococcus aureus
VNAQNNASNTSDNNQQSNDSETTK

SEQ ID NO: 1644991 - protein, 36 aa, Staphylococcus aureus
VNARQSPLTGGDSFNHTAKNKTQNLAEIAKQKRIIK

SEQ ID NO: 1644992 - protein, 10 aa, Staphylococcus aureus
VNCPSLPANV

SEQ ID NO: 1644993 - protein, 7 aa, Staphylococcus aureus
VNDDQLD

SEQ ID NO: 1644994 - protein, 4 aa, Staphylococcus aureus
VNDQ

SEQ ID NO: 1644995 - protein, 4 aa, Staphylococcus aureus
VNEE

SEQ ID NO: 1644996 - protein, 9 aa, Staphylococcus aureus
VNEENIKEA

SEQ ID NO: 1644997 - protein, 7 aa, Staphylococcus aureus
VNENNYN

SEQ ID NO: 1644998 - protein, 15 aa, Staphylococcus aureus
VNENTPKLTLNEGNT

SEQ ID NO: 1644999 - protein, 7 aa, Staphylococcus aureus
VNEPEDV

SEQ ID NO: 1645000 - protein, 12 aa, Staphylococcus aureus
VNEQDELKNQSR

SEQ ID NO: 1645001 - protein, 12 aa, Staphylococcus aureus
VNEYHQSSYVKV

SEQ ID NO: 1645002 - protein, 10 aa, Staphylococcus aureus
VNIKGEKTSP

SEQ ID NO: 1645003 - protein, 14 aa, Staphylococcus aureus
VNKKEIEQKVNEAA

SEQ ID NO: 1645004 - protein, 8 aa, Staphylococcus aureus
VNKNSTTM

SEQ ID NO: 1645005 - protein, 9 aa, Staphylococcus aureus
VNKQKHEKN

SEQ ID NO: 1645006 - protein, 16 aa, Staphylococcus aureus
VNKSEHDFDRRPNDEA

SEQ ID NO: 1645007 - protein, 9 aa, Staphylococcus aureus
VNKSGQLIN

SEQ ID NO: 1645008 - protein, 7 aa, Staphylococcus aureus
VNKTSSM

SEQ ID NO: 1645009 - protein, 25 aa, Staphylococcus aureus
VNNAKTALNGDARLNEAKNTAKQQL

SEQ ID NO: 1645010 - protein, 7 aa, Staphylococcus aureus
VNNESTE

SEQ ID NO: 1645011 - protein, 7 aa, Staphylococcus aureus
VNNKTEI

SEQ ID NO: 1645012 - protein, 14 aa, Staphylococcus aureus
VNNNFKGDFQEAEG

SEQ ID NO: 1645013 - protein, 12 aa, Staphylococcus aureus
VNNQDELKKQSR

SEQ ID NO: 1645014 - protein, 8 aa, Staphylococcus aureus
VNNRTGRI

SEQ ID NO: 1645015 - protein, 10 aa, Staphylococcus aureus
VNNTGTFGSV

SEQ ID NO: 1645016 - protein, 6 aa, Staphylococcus aureus
VNPGDE

SEQ ID NO: 1645017 - protein, 4 aa, Staphylococcus aureus
VNPS

SEQ ID NO: 1645018 - protein, 8 aa, Staphylococcus aureus
VNPTSTGL

SEQ ID NO: 1645019 - protein, 7 aa, Staphylococcus aureus
VNQDNQV

SEQ ID NO: 1645020 - protein, 7 aa, Staphylococcus aureus
VNQDSQI

SEQ ID NO: 1645021 - protein, 8 aa, Staphylococcus aureus
VNQENKVD

SEQ ID NO: 1645022 - protein, 34 aa, Staphylococcus aureus; identical to SEQ ID NO: 1567286

SEQ ID NO: 1645023 - protein, 34 aa, Staphylococcus aureus; identical to SEQ ID NO: 1567793

SEQ ID NO: 1645024 - protein, 7 aa, Staphylococcus aureus
VNQKALE

SEQ ID NO: 1645025 - protein, 7 aa, Staphylococcus aureus
VNQTAKN

SEQ ID NO: 1645026 - protein, 8 aa, Staphylococcus aureus
VNQTSNNY

SEQ ID NO: 1645027 - protein, 19 aa, Staphylococcus aureus
VNRATSAVTSNKNALNGYE

SEQ ID NO: 1645028 - protein, 10 aa, Staphylococcus aureus
VNRPGEETGV

SEQ ID NO: 1645029 - protein, 7 aa, Staphylococcus aureus
VNSDEDV

SEQ ID NO: 1645030 - protein, 10 aa, Staphylococcus aureus
VNSLEKEKKM

SEQ ID NO: 1645031 - protein, 11 aa, Staphylococcus aureus
VNSLGDDVKER

SEQ ID NO: 1645032 - protein, 21 aa, Staphylococcus aureus
VNSLGDDVKERIKSAAAIQGS

SEQ ID NO: 1645033 - protein, 5 aa, Staphylococcus aureus
VNSNK

SEQ ID NO: 1645034 - protein, 19 aa, Staphylococcus aureus
VNSQVGKGSTFKVILKDYK

SEQ ID NO: 1645035 - protein, 12 aa, Staphylococcus aureus
VNTAKNALNGDA

SEQ ID NO: 1645036 - protein, 20 aa, Staphylococcus aureus
VNVKQKGSLADDKELSSIDL

SEQ ID NO: 1645037 - protein, 10 aa, Staphylococcus aureus
VNYNSSNSPI

SEQ ID NO: 1645038 - protein, 4 aa, Staphylococcus aureus
VPAD

SEQ ID NO: 1645039 - protein, 4 aa, Staphylococcus aureus
VPDD

SEQ ID NO: 1645040 - protein, 16 aa, Staphylococcus aureus
VPDKNATSEDSEDSEE

SEQ ID NO: 1645041 - protein, 7 aa, Staphylococcus aureus
VPEADTH

SEQ ID NO: 1645042 - protein, 11 aa, Staphylococcus aureus
VPELDKNKNHT

SEQ ID NO: 1645043 - protein, 4 aa, Staphylococcus aureus
VPES

SEQ ID NO: 1645044 - protein, 4 aa, Staphylococcus aureus
VPEV

SEQ ID NO: 1645045 - protein, 7 aa, Staphylococcus aureus
VPGEKAT

SEQ ID NO: 1645046 - protein, 4 aa, Staphylococcus aureus
VPKD

SEQ ID NO: 1645047 - protein, 11 aa, Staphylococcus aureus
VPKEASSNETF

SEQ ID NO: 1645048 - protein, 12 aa, Staphylococcus aureus
VPKKKSYDIEDN

SEQ ID NO: 1645049 - protein, 10 aa, Staphylococcus aureus
VPKNSGKWER

SEQ ID NO: 1645050 - protein, 8 aa, Staphylococcus aureus
VPLEDAEV

SEQ ID NO: 1645051 - protein, 12 aa, Staphylococcus aureus
VPPANFNDRVDA

SEQ ID NO: 1645052 - protein, 8 aa, Staphylococcus aureus
VPQKPPYL

SEQ ID NO: 1645053 - protein, 5 aa, Staphylococcus aureus
VPQRN

SEQ ID NO: 1645054 - protein, 9 aa, Staphylococcus aureus
VPSNHKNLA

SEQ ID NO: 1645055 - protein, 6 aa, Staphylococcus aureus
VPSPEL

SEQ ID NO: 1645056 - protein, 10 aa, Staphylococcus aureus
VPSPVKRPQD

SEQ ID NO: 1645057 - protein, 12 aa, Staphylococcus aureus
VPTDVTKKEQVD

SEQ ID NO: 1645058 - protein, 13 aa, Staphylococcus aureus
VPTSYKSKEIRPF

SEQ ID NO: 1645059 - protein, 4 aa, Staphylococcus aureus
VPTT

SEQ ID NO: 1645060 - protein, 12 aa, Staphylococcus aureus
VPYKKEQGNYTV

SEQ ID NO: 1645061 - protein, 11 aa, Staphylococcus aureus
VPYKKETGNYT

SEQ ID NO: 1645062 - protein, 12 aa, Staphylococcus aureus
VPYKKETGNYTV

SEQ ID NO: 1645063 - protein, 7 aa, Staphylococcus aureus
VQAGDSL

SEQ ID NO: 1645064 - protein, 8 aa, Staphylococcus aureus
VQAQTKQV

SEQ ID NO: 1645065 - protein, 28 aa, Staphylococcus aureus
VQASTTKKSDAKAEIAQKASERKTAIEA

SEQ ID NO: 1645066 - protein, 12 aa, Staphylococcus aureus
VQDKSDKKRAVN

SEQ ID NO: 1645067 - protein, 5 aa, Staphylococcus aureus
VQEDQ

SEQ ID NO: 1645068 - protein, 6 aa, Staphylococcus aureus
VQEESN

SEQ ID NO: 1645069 - protein, 6 aa, Staphylococcus aureus
VQGGQF

SEQ ID NO: 1645070 - protein, 9 aa, Staphylococcus aureus
VQKNNEKIS

SEQ ID NO: 1645071 - protein, 25 aa, Staphylococcus aureus
VQNAQTKANMAESNAKLYADDKFNK

SEQ ID NO: 1645072 - protein, 12 aa, Staphylococcus aureus
VQPAKPTVTETA

SEQ ID NO: 1645073 - protein, 15 aa, Staphylococcus aureus
VQPAKPTVTETAAGA

SEQ ID NO: 1645074 - protein, 11 aa, Staphylococcus aureus
VQPARGPKKDM

SEQ ID NO: 1645075 - protein, 4 aa, Staphylococcus aureus
VQPN

SEQ ID NO: 1645076 - protein, 31 aa, Staphylococcus aureus
VQQAIKASAENQVESIKDTPHATVDELDEAN

SEQ ID NO: 1645077 - protein, 5 aa, Staphylococcus aureus
VQQNL

SEQ ID NO: 1645078 - protein, 19 aa, Staphylococcus aureus
VQQRLSKGSLAKAQQYTKT

SEQ ID NO: 1645079 - protein, 27 aa, Staphylococcus aureus
VQRAKNELNGNQNVTNAKTTAKNALNN

SEQ ID NO: 1645080 - protein, 25 aa, Staphylococcus aureus
VQSAQSKANMAESNAKLYADDKFNK

SEQ ID NO: 1645081 - protein, 10 aa, Staphylococcus aureus
VQSNANTLDQ

SEQ ID NO: 1645082 - protein, 20 aa, Staphylococcus aureus
VQSRKKQVSQKPQVHGKGTN

SEQ ID NO: 1645083 - protein, 8 aa, Staphylococcus aureus
VQTFENER

SEQ ID NO: 1645084 - protein, 4 aa, Staphylococcus aureus
VQTG

SEQ ID NO: 1645085 - protein, 9 aa, Staphylococcus aureus
VQTTASGGK

SEQ ID NO: 1645086 - protein, 19 aa, Staphylococcus aureus
VQTVNNEGKTVEIMDGIDS

SEQ ID NO: 1645087 - protein, 28 aa, Staphylococcus aureus
VQVTQDQQVRQHRSVTQQAQVNPIRRQH

SEQ ID NO: 1645088 - protein, 11 aa, Staphylococcus aureus
VRAAQTKIDQA

SEQ ID NO: 1645089 - protein, 5 aa, Staphylococcus aureus
VRDKY

SEQ ID NO: 1645090 - protein, 13 aa, Staphylococcus aureus
VRGQYGKGYIDGK

SEQ ID NO: 1645091 - protein, 6 aa, Staphylococcus aureus
VRHSAT

SEQ ID NO: 1645092 - protein, 11 aa, Staphylococcus aureus
VRIPENSDDRL

SEQ ID NO: 1645093 - protein, 10 aa, Staphylococcus aureus
VRSASNEEAR

SEQ ID NO: 1645094 - protein, 11 aa, Staphylococcus aureus
VRSSLANNSDI

SEQ ID NO: 1645095 - protein, 14 aa, Staphylococcus aureus
VRTTSDKKKSRKFQ

SEQ ID NO: 1645096 - protein, 16 aa, Staphylococcus aureus
VSAGSTFSEISKKQME

SEQ ID NO: 1645097 - protein, 10 aa, Staphylococcus aureus
VSDEAPGNAI

SEQ ID NO: 1645098 - protein, 7 aa, Staphylococcus aureus
VSDESQL

SEQ ID NO: 1645099 - protein, 22 aa, Staphylococcus aureus
VSDLTTAKKIKTENLANKMGDF

SEQ ID NO: 1645100 - protein, 7 aa, Staphylococcus aureus
VSEAGGL

SEQ ID NO: 1645101 - protein, 6 aa, Staphylococcus aureus
VSEGRG

SEQ ID NO: 1645102 - protein, 4 aa, Staphylococcus aureus
VSEK

SEQ ID NO: 1645103 - protein, 5 aa, Staphylococcus aureus
VSEPF

SEQ ID NO: 1645104 - protein, 6 aa, Staphylococcus aureus
VSEQQM

SEQ ID NO: 1645105 - protein, 5 aa, Staphylococcus aureus
VSEYE

SEQ ID NO: 1645106 - protein, 12 aa, Staphylococcus aureus
VSGESDDTLGYK

SEQ ID NO: 1645107 - protein, 13 aa, Staphylococcus aureus
VSGGATGAAASCF

SEQ ID NO: 1645108 - protein, 12 aa, Staphylococcus aureus
VSGGGSGHEPAH

SEQ ID NO: 1645109 - protein, 7 aa, Staphylococcus aureus
VSGPLGT

SEQ ID NO: 1645110 - protein, 28 aa, Staphylococcus aureus
VSIDENKQASIQNEDTNDAHVDESPYNY

SEQ ID NO: 1645111 - protein, 13 aa, Staphylococcus aureus
VSKAENPYDQKLL

SEQ ID NO: 1645112 - protein, 7 aa, Staphylococcus aureus
VSKGYYV

SEQ ID NO: 1645113 - protein, 8 aa, Staphylococcus aureus
VSKLDKKI

SEQ ID NO: 1645114 - protein, 8 aa, Staphylococcus aureus
VSKQPLTA

SEQ ID NO: 1645115 - protein, 12 aa, Staphylococcus aureus
VSKRDNRMKEDE

SEQ ID NO: 1645116 - protein, 27 aa, Staphylococcus aureus
VSNEEVAAEQNIDLDEKEKSEETEATE

SEQ ID NO: 1645117 - protein, 7 aa, Staphylococcus aureus
VSNENKV

SEQ ID NO: 1645118 - protein, 11 aa, Staphylococcus aureus
VSNGHTTSSSH

SEQ ID NO: 1645119 - protein, 7 aa, Staphylococcus aureus
VSNSGEY

SEQ ID NO: 1645120 - protein, 13 aa, Staphylococcus aureus
VSPKDSKGNIDNE

SEQ ID NO: 1645121 - protein, 13 aa, Staphylococcus aureus
VSPKDSKGNVDNE

SEQ ID NO: 1645122 - protein, 13 aa, Staphylococcus aureus
VSPSTPLRYIDHA

SEQ ID NO: 1645123 - protein, 6 aa, Staphylococcus aureus
VSPYPG

SEQ ID NO: 1645124 - protein, 6 aa, Staphylococcus aureus
VSQEQE

SEQ ID NO: 1645125 - protein, 4 aa, Staphylococcus aureus
VSQG

SEQ ID NO: 1645126 - protein, 8 aa, Staphylococcus aureus
VSQTQTAI

SEQ ID NO: 1645127 - protein, 7 aa, Staphylococcus aureus
VSRARKQ

SEQ ID NO: 1645128 - protein, 6 aa, Staphylococcus aureus
VSRQGN

SEQ ID NO: 1645129 - protein, 8 aa, Staphylococcus aureus
VSSTSGNL

SEQ ID NO: 1645130 - protein, 7 aa, Staphylococcus aureus
VSSTTGN

SEQ ID NO: 1645131 - protein, 8 aa, Staphylococcus aureus
VSTGNRNQ

SEQ ID NO: 1645132 - protein, 12 aa, Staphylococcus aureus
VSTNGASPKLTK

SEQ ID NO: 1645133 - protein, 23 aa, Staphylococcus aureus
VSVGNRAKSVIKQATAKKQAVIK

SEQ ID NO: 1645134 - protein, 14 aa, Staphylococcus aureus
VSVQYDDSKVAVSQ

SEQ ID NO: 1645135 - protein, 19 aa, Staphylococcus aureus
VTAANAAKSALDQARNGLT

SEQ ID NO: 1645136 - protein, 19 aa, Staphylococcus aureus
VTAANATKTALDQARNGLT

SEQ ID NO: 1645137 - protein, 6 aa, Staphylococcus aureus
VTDEDS

SEQ ID NO: 1645138 - protein, 15 aa, Staphylococcus aureus
VTEGQTYASVSSSGL

SEQ ID NO: 1645139 - protein, 11 aa, Staphylococcus aureus
VTENDKLTDAG

SEQ ID NO: 1645140 - protein, 5 aa, Staphylococcus aureus
VTEQA

SEQ ID NO: 1645141 - protein, 16 aa, Staphylococcus aureus
VTEQEEYKNKQEEIED

SEQ ID NO: 1645142 - protein, 8 aa, Staphylococcus aureus
VTEQETNI

SEQ ID NO: 1645143 - protein, 14 aa, Staphylococcus aureus
VTEVESQNSKGVKW

SEQ ID NO: 1645144 - protein, 5 aa, Staphylococcus aureus
VTFST

SEQ ID NO: 1645145 - protein, 13 aa, Staphylococcus aureus
VTGRMDGMNESGL

SEQ ID NO: 1645146 - protein, 10 aa, Staphylococcus aureus
VTGYPGDKPV

SEQ ID NO: 1645147 - protein, 11 aa, Staphylococcus aureus
VTHKTKDKYIR

SEQ ID NO: 1645148 - protein, 11 aa, Staphylococcus aureus
VTKAPNGQNLH

SEQ ID NO: 1645149 - protein, 5 aa, Staphylococcus aureus
VTKDN

SEQ ID NO: 1645150 - protein, 7 aa, Staphylococcus aureus
VTKEDLP

SEQ ID NO: 1645151 - protein, 6 aa, Staphylococcus aureus
VTKESI

SEQ ID NO: 1645152 - protein, 20 aa, Staphylococcus aureus
VTKIYGDQDSVSFAPGEKAT

SEQ ID NO: 1645153 - protein, 5 aa, Staphylococcus aureus
VTKNN

SEQ ID NO: 1645154 - protein, 4 aa, Staphylococcus aureus
VTLG

SEQ ID NO: 1645155 - protein, 8 aa, Staphylococcus aureus
VTNSEGTG

SEQ ID NO: 1645156 - protein, 8 aa, Staphylococcus aureus
VTNSNTKY

SEQ ID NO: 1645157 - protein, 6 aa, Staphylococcus aureus
VTQAEQ

SEQ ID NO: 1645158 - protein, 16 aa, Staphylococcus aureus
VTQGKIKTSKYVKKEC

SEQ ID NO: 1645159 - protein, 7 aa, Staphylococcus aureus
VTQTQTA

SEQ ID NO: 1645160 - protein, 16 aa, Staphylococcus aureus
VTRNESVDSNDSASVH

SEQ ID NO: 1645161 - protein, 11 aa, Staphylococcus aureus
VTSASAAVASM

SEQ ID NO: 1645162 - protein, 17 aa, Staphylococcus aureus
VTSDRKATKKKTDSDDL

SEQ ID NO: 1645163 - protein, 46 aa, Staphylococcus aureus
VTSRDSHATEEDKELDKELDKELERDKEKDIDKNLSANNSATDVTH

SEQ ID NO: 1645164 - protein, 47 aa, Staphylococcus aureus
VTSRDSHATEEDKELDKELDKELERDKEKDIDKNLSSINSATDVTHE

SEQ ID NO: 1645165 - protein, 42 aa, Staphylococcus aureus
VTSRDSHATEEDKELDKELERDKEKDIDKNLSSINSATDVTH

SEQ ID NO: 1645166 - protein, 43 aa, Staphylococcus aureus
VTSRDSHATEEDKELDKELERDKEKDIDKNLSSINSATDVTHE

SEQ ID NO: 1645167 - protein, 17 aa, Staphylococcus aureus
VTSRTISANQAGSYNFI

SEQ ID NO: 1645168 - protein, 5 aa, Staphylococcus aureus
VTSTT

SEQ ID NO: 1645169 - protein, 27 aa, Staphylococcus aureus
VTTHANGQVSYGARPTQNKPSETNAYN

SEQ ID NO: 1645170 - protein, 43 aa, Staphylococcus aureus
VTTHANGQVSYGARPTQNKPSKTNAYNVTTHADGTATYGPRVT

SEQ ID NO: 1645171 - protein, 97 aa, Staphylococcus aureus
VTTHANGQVSYGARPTQNKPSKTNAYNVTTHGNGQVSYGARPTQNKPSKTNAYNVTTHANGQVSYGARPTYKKPSKTNAYNVTTHADGTATYGPRVT

SEQ ID NO: 1645172 - protein, 27 aa, Staphylococcus aureus
VTTHANGQVSYGARPTYKKPSETNAYN

SEQ ID NO: 1645173 - protein, 10 aa, Staphylococcus aureus
VTTKKEAVIK

SEQ ID NO: 1645174 - protein, 15 aa, Staphylococcus aureus
VTTPNQDNPLTEGKT

SEQ ID NO: 1645175 - protein, 13 aa, Staphylococcus aureus
VTVKETGKAVEVT

SEQ ID NO: 1645176 - protein, 19 aa, Staphylococcus aureus
VTVNDGKDLSQDAHAKDLE

SEQ ID NO: 1645177 - protein, 12 aa, Staphylococcus aureus
VTVNKNNGSYNQ

SEQ ID NO: 1645178 - protein, 11 aa, Staphylococcus aureus
VTYKAGLTNQE

SEQ ID NO: 1645179 - protein, 10 aa, Staphylococcus aureus
VTYKTTAQNV

SEQ ID NO: 1645180 - protein, 11 aa, Staphylococcus aureus
VVDTDGNGGGI

SEQ ID NO: 1645181 - protein, 12 aa, Staphylococcus aureus
VVEEGVRKGAYT

SEQ ID NO: 1645182 - protein, 12 aa, Staphylococcus aureus
VVGESTTPAIKS

SEQ ID NO: 1645183 - protein, 43 aa, Staphylococcus aureus; identical to SEQ ID NO: 1566135

SEQ ID NO: 1645184 - protein, 11 aa, Staphylococcus aureus
VVPKDSPSNIL

SEQ ID NO: 1645185 - protein, 17 aa, Staphylococcus aureus
VVQPGSSGSPILNSKRE

SEQ ID NO: 1645186 - protein, 11 aa, Staphylococcus aureus
VVSSKSDQLTT

SEQ ID NO: 1645187 - protein, 4 aa, Staphylococcus aureus
VYAT

SEQ ID NO: 1645188 - protein, 16 aa, Staphylococcus aureus
VYEEENDSYDTQEEYK

SEQ ID NO: 1645189 - protein, 8 aa, Staphylococcus aureus
VYKGTGTM

SEQ ID NO: 1645190 - protein, 19 aa, Staphylococcus aureus
VYNTKSSDKETKIEDANGA

SEQ ID NO: 1645191 - protein, 11 aa, Staphylococcus aureus
VYSKDDKGWAK

SEQ ID NO: 1645192 - protein, 20 aa, Staphylococcus aureus
VYSSQKKITEEGLRKSSAKI

SEQ ID NO: 1645193 - protein, 32 aa, Staphylococcus aureus
WDGDDDKLDKTVKEVSNANPNHPVIVDDIPLE

SEQ ID NO: 1645194 - protein, 12 aa, Staphylococcus aureus
WDGDDEELDKAV

SEQ ID NO: 1645195 - protein, 32 aa, Staphylococcus aureus
WDGDDEELDKAVKDVSNNNPNHTVIVDDIPLE

SEQ ID NO: 1645196 - protein, 32 aa, Staphylococcus aureus
WDGDDEELDKTVKEVSNANPSHTVIVDDIPLE

SEQ ID NO: 1645197 - protein, 32 aa, Staphylococcus aureus
WDGDDEEVDKAVRDVSNANPNHTVIVDDIPLE

SEQ ID NO: 1645198 - protein, 12 aa, Staphylococcus aureus
WDGQGYKNQNDS

SEQ ID NO: 1645199 - protein, 9 aa, Staphylococcus aureus
WDGSAKSDI

SEQ ID NO: 1645200 - protein, 7 aa, Staphylococcus aureus
WDSEKQT

SEQ ID NO: 1645201 - protein, 6 aa, Staphylococcus aureus
WEPQKR

SEQ ID NO: 1645202 - protein, 15 aa, Staphylococcus aureus
WETKTQNNKEETIRE

SEQ ID NO: 1645203 - protein, 16 aa, Staphylococcus aureus
WETKTQNNKEETIREL

SEQ ID NO: 1645204 - protein, 9 aa, Staphylococcus aureus
WGPNTENFE

SEQ ID NO: 1645205 - protein, 5 aa, Staphylococcus aureus
WGPTK

SEQ ID NO: 1645206 - protein, 7 aa, Staphylococcus aureus
WGPYDRD

SEQ ID NO: 1645207 - protein, 12 aa, Staphylococcus aureus
WGSEVKDITDGQ

SEQ ID NO: 1645208 - protein, 11 aa, Staphylococcus aureus
WGSEVKGIADG

SEQ ID NO: 1645209 - protein, 12 aa, Staphylococcus aureus
WKAENNYSKQDA

SEQ ID NO: 1645210 - protein, 6 aa, Staphylococcus aureus
WKDTPS

SEQ ID NO: 1645211 - protein, 7 aa, Staphylococcus aureus
WKEQNQR

SEQ ID NO: 1645212 - protein, 9 aa, Staphylococcus aureus
WKGNPKMDE

SEQ ID NO: 1645213 - protein, 12 aa, Staphylococcus aureus
WKSENNYSKQDA

SEQ ID NO: 1645214 - protein, 6 aa, Staphylococcus aureus
WKSNTL

SEQ ID NO: 1645215 - protein, 21 aa, Staphylococcus aureus
WKSQLRRSATTQALKKTTTNA

SEQ ID NO: 1645216 - protein, 17 aa, Staphylococcus aureus
WLTSQGAKVTSSVTKNT

SEQ ID NO: 1645217 - protein, 22 aa, Staphylococcus aureus
WNATKDTRTRDTHRHLDGESVE

SEQ ID NO: 1645218 - protein, 24 aa, Staphylococcus aureus
WNATKDTRTRDTHRHLDGESVEID

SEQ ID NO: 1645219 - protein, 35 aa, Staphylococcus aureus
WNATKDTRTRDTHRHLDGESVEIDQNFKSSGCVGQ

SEQ ID NO: 1645220 - protein, 10 aa, Staphylococcus aureus
WNEDKENEVI

SEQ ID NO: 1645221 - protein, 11 aa, Staphylococcus aureus
WNENKENEVIE

SEQ ID NO: 1645222 - protein, 8 aa, Staphylococcus aureus
WNNDTEYT

SEQ ID NO: 1645223 - protein, 16 aa, Staphylococcus aureus
WNSNARATVDKNEKGI

SEQ ID NO: 1645224 - protein, 21 aa, Staphylococcus aureus
WPQKPSKKRKTKYFGGKVKSG

SEQ ID NO: 1645225 - protein, 27 aa, Staphylococcus aureus
WPTSSREESKTKRLADKQGDPEEKSGI

SEQ ID NO: 1645226 - protein, 12 aa, Staphylococcus aureus
WQEGDDSILQQG

SEQ ID NO: 1645227 - protein, 17 aa, Staphylococcus aureus
WRGPNTEAGEKSAYNSV

SEQ ID NO: 1645228 - protein, 8 aa, Staphylococcus aureus
WSAEDEYA

SEQ ID NO: 1645229 - protein, 21 aa, Staphylococcus aureus
WSDTNDDSVRVNRPRIDTARN

SEQ ID NO: 1645230 - protein, 8 aa, Staphylococcus aureus
WSGSPPYK

SEQ ID NO: 1645231 - protein, 8 aa, Staphylococcus aureus
WSSTQNSI

SEQ ID NO: 1645232 - protein, 7 aa, Staphylococcus aureus
WSTDEEK

SEQ ID NO: 1645233 - protein, 21 aa, Staphylococcus aureus
WSYKGANGKWHTTKGQAPQPF

SEQ ID NO: 1645234 - protein, 13 aa, Staphylococcus aureus
WTPSNDNKAAKEL

SEQ ID NO: 1645235 - protein, 15 aa, Staphylococcus aureus
WTQTTGGALSSSQKQ

SEQ ID NO: 1645236 - protein, 11 aa, Staphylococcus aureus
YAAQAKFAEGS

SEQ ID NO: 1645237 - protein, 14 aa, Staphylococcus aureus
YAARRSNSAGMQVT

SEQ ID NO: 1645238 - protein, 6 aa, Staphylococcus aureus
YADEEE

SEQ ID NO: 1645239 - protein, 9 aa, Staphylococcus aureus
YAESNNSDV

SEQ ID NO: 1645240 - protein, 18 aa, Staphylococcus aureus
YAGEGNIEQRRINGRPTI

SEQ ID NO: 1645241 - protein, 10 aa, Staphylococcus aureus
YAIPSQVTTI

SEQ ID NO: 1645242 - protein, 7 aa, Staphylococcus aureus
YAKEADE

SEQ ID NO: 1645243 - protein, 20 aa, Staphylococcus aureus
YAKQSTENYHKRNRRRKAER

SEQ ID NO: 1645244 - protein, 7 aa, Staphylococcus aureus
YAKSRGS

SEQ ID NO: 1645245 - protein, 10 aa, Staphylococcus aureus
YAKTAQSVNE

SEQ ID NO: 1645246 - protein, 9 aa, Staphylococcus aureus
YANSNDFAN

SEQ ID NO: 1645247 - protein, 20 aa, Staphylococcus aureus
YANTTDTSKFKEVTSNMSGN

SEQ ID NO: 1645248 - protein, 9 aa, Staphylococcus aureus
YAPDQFPTS

SEQ ID NO: 1645249 - protein, 6 aa, Staphylococcus aureus
YAPNYY

SEQ ID NO: 1645250 - protein, 15 aa, Staphylococcus aureus
YAQPGNSGSPVLNSK

SEQ ID NO: 1645251 - protein, 13 aa, Staphylococcus aureus
YARNNETVERPKR

SEQ ID NO: 1645252 - protein, 14 aa, Staphylococcus aureus
YARNNETVERPKRK

SEQ ID NO: 1645253 - protein, 14 aa, Staphylococcus aureus
YASNNITQELNSIN

SEQ ID NO: 1645254 - protein, 10 aa, Staphylococcus aureus
YASVEGDNIQ

SEQ ID NO: 1645255 - protein, 12 aa, Staphylococcus aureus
YATKGSRAKKIP

SEQ ID NO: 1645256 - protein, 4 aa, Staphylococcus aureus
YATQ

SEQ ID NO: 1645257 - protein, 8 aa, Staphylococcus aureus
YDDQELPE

SEQ ID NO: 1645258 - protein, 16 aa, Staphylococcus aureus
YDENGLKTYQPKIDED

SEQ ID NO: 1645259 - protein, 8 aa, Staphylococcus aureus
YDENSNLY

SEQ ID NO: 1645260 - protein, 5 aa, Staphylococcus aureus
YDENY

SEQ ID NO: 1645261 - protein, 7 aa, Staphylococcus aureus
YDGENKF

SEQ ID NO: 1645262 - protein, 11 aa, Staphylococcus aureus
YDGKPYKLGNT

SEQ ID NO: 1645263 - protein, 11 aa, Staphylococcus aureus
YDGNANTPTKL

SEQ ID NO: 1645264 - protein, 4 aa, Staphylococcus aureus
YDIE

SEQ ID NO: 1645265 - protein, 10 aa, Staphylococcus aureus
YDIPTKKAPE

SEQ ID NO: 1645266 - protein, 10 aa, Staphylococcus aureus
YDIPTKQAPK

SEQ ID NO: 1645267 - protein, 9 aa, Staphylococcus aureus
YDIPTNKAP

SEQ ID NO: 1645268 - protein, 10 aa, Staphylococcus aureus
YDIPTSKAPK

SEQ ID NO: 1645269 - protein, 9 aa, Staphylococcus aureus
YDKALDKEK

SEQ ID NO: 1645270 - protein, 29 aa, Staphylococcus aureus
YDKEDKAKELNKDLDNKIASMKDKTKKFN

SEQ ID NO: 1645271 - protein, 19 aa, Staphylococcus aureus
YDKEGYRDDEFKKGDKGTW

SEQ ID NO: 1645272 - protein, 19 aa, Staphylococcus aureus
YDKEGYRDDQFDKKDKGTW

SEQ ID NO: 1645273 - protein, 18 aa, Staphylococcus aureus
YDKEGYRDDQFDKNDKGT

SEQ ID NO: 1645274 - protein, 19 aa, Staphylococcus aureus
YDKEGYRDDQFDKNDKGTW

SEQ ID NO: 1645275 - protein, 16 aa, Staphylococcus aureus
YDKEGYRDGEFEKGDK

SEQ ID NO: 1645276 - protein, 19 aa, Staphylococcus aureus
YDKEGYRDGEFEKGDKGTW

SEQ ID NO: 1645277 - protein, 18 aa, Staphylococcus aureus
YDKEGYRDGEFKKDDKGT

SEQ ID NO: 1645278 - protein, 9 aa, Staphylococcus aureus
YDKGVNESV

SEQ ID NO: 1645279 - protein, 43 aa, Staphylococcus aureus
YDKNNAPNNNHQNQSRTNDNHQHANQRDLNNNQYHSSLSGQYT

SEQ ID NO: 1645280 - protein, 5 aa, Staphylococcus aureus
YDKPT

SEQ ID NO: 1645281 - protein, 14 aa, Staphylococcus aureus
YDKSKLDLNDKESF

SEQ ID NO: 1645282 - protein, 13 aa, Staphylococcus aureus
YDKSKSDLNDKES

SEQ ID NO: 1645283 - protein, 9 aa, Staphylococcus aureus
YDKSSVADI

SEQ ID NO: 1645284 - protein, 11 aa, Staphylococcus aureus
YDLPKRGSNPN

SEQ ID NO: 1645285 - protein, 12 aa, Staphylococcus aureus
YDLTRGRITYRY

SEQ ID NO: 1645286 - protein, 9 aa, Staphylococcus aureus
YDNKKPTGR

SEQ ID NO: 1645287 - protein, 4 aa, Staphylococcus aureus
YDNN

SEQ ID NO: 1645288 - protein, 12 aa, Staphylococcus aureus
YDPSGANDTPDF

SEQ ID NO: 1645289 - protein, 9 aa, Staphylococcus aureus
YDPSITSKA

SEQ ID NO: 1645290 - protein, 8 aa, Staphylococcus aureus
YDQDEANY

SEQ ID NO: 1645291 - protein, 6 aa, Staphylococcus aureus
YDQIST

SEQ ID NO: 1645292 - protein, 9 aa, Staphylococcus aureus
YDRGSRGKD

SEQ ID NO: 1645293 - protein, 14 aa, Staphylococcus aureus
YDSKPYKLGNTKRV

SEQ ID NO: 1645294 - protein, 8 aa, Staphylococcus aureus
YDSRSPQY

SEQ ID NO: 1645295 - protein, 18 aa, Staphylococcus aureus
YDTSNETVMPKDSPPNIL

SEQ ID NO: 1645296 - protein, 18 aa, Staphylococcus aureus
YDTSNETVVPKDSPPNIL

SEQ ID NO: 1645297 - protein, 17 aa, Staphylococcus aureus
YDTSNETVVSKESPSNI

SEQ ID NO: 1645298 - protein, 11 aa, Staphylococcus aureus
YDYHEDKKIDD

SEQ ID NO: 1645299 - protein, 4 aa, Staphylococcus aureus
YEAN

SEQ ID NO: 1645300 - protein, 10 aa, Staphylococcus aureus
YEASNWNKEL

SEQ ID NO: 1645301 - protein, 14 aa, Staphylococcus aureus
YEATSNGSDSVEFT

SEQ ID NO: 1645302 - protein, 17 aa, Staphylococcus aureus
YEDKTLDIDGKVNWITE

SEQ ID NO: 1645303 - protein, 8 aa, Staphylococcus aureus
YEDSTKYG

SEQ ID NO: 1645304 - protein, 8 aa, Staphylococcus aureus
YEEEAQQA

SEQ ID NO: 1645305 - protein, 9 aa, Staphylococcus aureus
YEGEGYGKF

SEQ ID NO: 1645306 - protein, 4 aa, Staphylococcus aureus
YEGK

SEQ ID NO: 1645307 - protein, 9 aa, Staphylococcus aureus
YEGKETTTY

SEQ ID NO: 1645308 - protein, 7 aa, Staphylococcus aureus
YEHANPT

SEQ ID NO: 1645309 - protein, 5 aa, Staphylococcus aureus
YEHTE

SEQ ID NO: 1645310 - protein, 4 aa, Staphylococcus aureus
YEKA

SEQ ID NO: 1645311 - protein, 46 aa, Staphylococcus aureus; identical to SEQ ID NO: 1562626

SEQ ID NO: 1645312 - protein, 9 aa, Staphylococcus aureus
YEKENVPTW

SEQ ID NO: 1645313 - protein, 8 aa, Staphylococcus aureus
YEKETYKK

SEQ ID NO: 1645314 - protein, 10 aa, Staphylococcus aureus
YEKGPEVPRG

SEQ ID NO: 1645315 - protein, 21 aa, Staphylococcus aureus
YEKTPTADLEDDKPQLPDEDA

SEQ ID NO: 1645316 - protein, 11 aa, Staphylococcus aureus
YELTSDDKIDS

SEQ ID NO: 1645317 - protein, 7 aa, Staphylococcus aureus
YENAAEH

SEQ ID NO: 1645318 - protein, 9 aa, Staphylococcus aureus
YEPATNGGV

SEQ ID NO: 1645319 - protein, 6 aa, Staphylococcus aureus
YEPQTI

SEQ ID NO: 1645320 - protein, 37 aa, Staphylococcus aureus
YEQAAQQQQQAQGANAGQNNNSTVEDAEFKEVKDDDK

SEQ ID NO: 1645321 - protein, 8 aa, Staphylococcus aureus
YEQNRENP

SEQ ID NO: 1645322 - protein, 8 aa, Staphylococcus aureus
YERRNRSK

SEQ ID NO: 1645323 - protein, 8 aa, Staphylococcus aureus
YESSVTAG

SEQ ID NO: 1645324 - protein, 4 aa, Staphylococcus aureus
YEYG

SEQ ID NO: 1645325 - protein, 4 aa, Staphylococcus aureus
YGEF

SEQ ID NO: 1645326 - protein, 5 aa, Staphylococcus aureus
YGESD

SEQ ID NO: 1645327 - protein, 5 aa, Staphylococcus aureus
YGGTA

SEQ ID NO: 1645328 - protein, 8 aa, Staphylococcus aureus
YGKAGGEI

SEQ ID NO: 1645329 - protein, 9 aa, Staphylococcus aureus
YGKKPLVEN

SEQ ID NO: 1645330 - protein, 4 aa, Staphylococcus aureus
YGKY

SEQ ID NO: 1645331 - protein, 11 aa, Staphylococcus aureus
YGMSSESIAKQ

SEQ ID NO: 1645332 - protein, 10 aa, Staphylococcus aureus
YGNQKGQQLI

SEQ ID NO: 1645333 - protein, 15 aa, Staphylococcus aureus
YGNQSRTTDNRGGVP

SEQ ID NO: 1645334 - protein, 15 aa, Staphylococcus aureus
YGNQSRTTNNRGSVP

SEQ ID NO: 1645335 - protein, 9 aa, Staphylococcus aureus
YGPPKNRRA

SEQ ID NO: 1645336 - protein, 6 aa, Staphylococcus aureus
YGPSEL

SEQ ID NO: 1645337 - protein, 16 aa, Staphylococcus aureus
YGQKNEQIRRYNRGEV

SEQ ID NO: 1645338 - protein, 10 aa, Staphylococcus aureus
YGRGISKKDM

SEQ ID NO: 1645339 - protein, 5 aa, Staphylococcus aureus
YGRQN

SEQ ID NO: 1645340 - protein, 17 aa, Staphylococcus aureus
YGSDGAQLSTDASELAS

SEQ ID NO: 1645341 - protein, 14 aa, Staphylococcus aureus
YGSGNKATQTVTSG

SEQ ID NO: 1645342 - protein, 9 aa, Staphylococcus aureus
YGSPEHNYQ

SEQ ID NO: 1645343 - protein, 7 aa, Staphylococcus aureus
YGTEIKP

SEQ ID NO: 1645344 - protein, 4 aa, Staphylococcus aureus
YGVS

SEQ ID NO: 1645345 - protein, 5 aa, Staphylococcus aureus
YGVSD

SEQ ID NO: 1645346 - protein, 7 aa, Staphylococcus aureus
YGYPPDL

SEQ ID NO: 1645347 - protein, 6 aa, Staphylococcus aureus
YHANEH

SEQ ID NO: 1645348 - protein, 8 aa, Staphylococcus aureus
YHDGPGGV

SEQ ID NO: 1645349 - protein, 8 aa, Staphylococcus aureus
YHEKAEEI

SEQ ID NO: 1645350 - protein, 7 aa, Staphylococcus aureus
YHGTENT

SEQ ID NO: 1645351 - protein, 25 aa, Staphylococcus aureus
YHNTSKPNAAAKANADPSNVAGGGA

SEQ ID NO: 1645352 - protein, 25 aa, Staphylococcus aureus
YHNTSKPNSAAKANADPSNVAGGGA

SEQ ID NO: 1645353 - protein, 11 aa, Staphylococcus aureus
YHNVPGAEEYT

SEQ ID NO: 1645354 - protein, 14 aa, Staphylococcus aureus
YHPGGNASQPNIHG

SEQ ID NO: 1645355 - protein, 5 aa, Staphylococcus aureus
YHPHG

SEQ ID NO: 1645356 - protein, 13 aa, Staphylococcus aureus
YIEGSEKQDKMLN

SEQ ID NO: 1645357 - protein, 4 aa, Staphylococcus aureus
YINN

SEQ ID NO: 1645358 - protein, 11 aa, Staphylococcus aureus
YINPPNNRYNL

SEQ ID NO: 1645359 - protein, 11 aa, Staphylococcus aureus
YIQHPKKNGYR

SEQ ID NO: 1645360 - protein, 7 aa, Staphylococcus aureus
YKADKGQ

SEQ ID NO: 1645361 - protein, 16 aa, Staphylococcus aureus
YKAKKKELEDLESADQ

SEQ ID NO: 1645362 - protein, 13 aa, Staphylococcus aureus
YKDEISANPKYDK

SEQ ID NO: 1645363 - protein, 4 aa, Staphylococcus aureus
YKDG

SEQ ID NO: 1645364 - protein, 8 aa, Staphylococcus aureus
YKDGKPEV

SEQ ID NO: 1645365 - protein, 16 aa, Staphylococcus aureus
YKDHSQYHTNKPGTYV

SEQ ID NO: 1645366 - protein, 5 aa, Staphylococcus aureus
YKDIK

SEQ ID NO: 1645367 - protein, 23 aa, Staphylococcus aureus
YKDKLQEDKKGYASISKENISKY

SEQ ID NO: 1645368 - protein, 8 aa, Staphylococcus aureus
YKDNEKDF

SEQ ID NO: 1645369 - protein, 11 aa, Staphylococcus aureus
YKDNNGGYESF

SEQ ID NO: 1645370 - protein, 16 aa, Staphylococcus aureus
YKDNPTSQEGKWANQK

SEQ ID NO: 1645371 - protein, 6 aa, Staphylococcus aureus
YKDNYR

SEQ ID NO: 1645372 - protein, 11 aa, Staphylococcus aureus
YKDQQKHYDGH

SEQ ID NO: 1645373 - protein, 6 aa, Staphylococcus aureus
YKEISS

SEQ ID NO: 1645374 - protein, 11 aa, Staphylococcus aureus
YKEKPYEKDYG

SEQ ID NO: 1645375 - protein, 4 aa, Staphylococcus aureus
YKEN

SEQ ID NO: 1645376 - protein, 7 aa, Staphylococcus aureus
YKENEEF

SEQ ID NO: 1645377 - protein, 5 aa, Staphylococcus aureus
YKENG

SEQ ID NO: 1645378 - protein, 15 aa, Staphylococcus aureus
YKEPERTAKAQTGKY

SEQ ID NO: 1645379 - protein, 8 aa, Staphylococcus aureus
YKETRRAH

SEQ ID NO: 1645380 - protein, 10 aa, Staphylococcus aureus
YKEYQATEYR

SEQ ID NO: 1645381 - protein, 7 aa, Staphylococcus aureus
YKEYRAT

SEQ ID NO: 1645382 - protein, 7 aa, Staphylococcus aureus
YKFTGYT

SEQ ID NO: 1645383 - protein, 6 aa, Staphylococcus aureus
YKGAAT

SEQ ID NO: 1645384 - protein, 8 aa, Staphylococcus aureus
YKGTRRAH

SEQ ID NO: 1645385 - protein, 9 aa, Staphylococcus aureus
YKGTTKYGK

SEQ ID NO: 1645386 - protein, 8 aa, Staphylococcus aureus
YKKEDFAE

SEQ ID NO: 1645387 - protein, 7 aa, Staphylococcus aureus
YKKEISI

SEQ ID NO: 1645388 - protein, 8 aa, Staphylococcus aureus
YKKETYKK

SEQ ID NO: 1645389 - protein, 5 aa, Staphylococcus aureus
YKKPN

SEQ ID NO: 1645390 - protein, 9 aa, Staphylococcus aureus
YKKYRKDEN

SEQ ID NO: 1645391 - protein, 11 aa, Staphylococcus aureus
YKNFKTRTFKS

SEQ ID NO: 1645392 - protein, 17 aa, Staphylococcus aureus
YKNNDLSKKIYIKTNKP

SEQ ID NO: 1645393 - protein, 8 aa, Staphylococcus aureus
YKNPSNYG

SEQ ID NO: 1645394 - protein, 9 aa, Staphylococcus aureus
YKNQNTVTF

SEQ ID NO: 1645395 - protein, 12 aa, Staphylococcus aureus
YKPQVQRVPGKW

SEQ ID NO: 1645396 - protein, 9 aa, Staphylococcus aureus
YKPTSGKLI

SEQ ID NO: 1645397 - protein, 9 aa, Staphylococcus aureus
YKQKKKEYY

SEQ ID NO: 1645398 - protein, 12 aa, Staphylococcus aureus
YKQNRSAPPEEL

SEQ ID NO: 1645399 - protein, 10 aa, Staphylococcus aureus
YKQRKSNCGR

SEQ ID NO: 1645400 - protein, 5 aa, Staphylococcus aureus
YKRDG

SEQ ID NO: 1645401 - protein, 6 aa, Staphylococcus aureus
YKRGGT

SEQ ID NO: 1645402 - protein, 14 aa, Staphylococcus aureus
YKRGKSRGKSQRYQ

SEQ ID NO: 1645403 - protein, 13 aa, Staphylococcus aureus
YKRNNSDGNVKKL

SEQ ID NO: 1645404 - protein, 21 aa, Staphylococcus aureus
YKSAKGWPDMANKSRAKWDNI

SEQ ID NO: 1645405 - protein, 8 aa, Staphylococcus aureus
YKSQSFPK

SEQ ID NO: 1645406 - protein, 21 aa, Staphylococcus aureus
YKSTKEGINAIRDKNSDTEIT

SEQ ID NO: 1645407 - protein, 7 aa, Staphylococcus aureus
YKTPKYS

SEQ ID NO: 1645408 - protein, 9 aa, Staphylococcus aureus
YKTTTKDNY

SEQ ID NO: 1645409 - protein, 13 aa, Staphylococcus aureus
YKYEDGEKTDQKL

SEQ ID NO: 1645410 - protein, 10 aa, Staphylococcus aureus
YKYETDYRNI

SEQ ID NO: 1645411 - protein, 11 aa, Staphylococcus aureus
YLANDQSADVS

SEQ ID NO: 1645412 - protein, 12 aa, Staphylococcus aureus
YLKGEKEEYWFL

SEQ ID NO: 1645413 - protein, 8 aa, Staphylococcus aureus
YLNGTDEV

SEQ ID NO: 1645414 - protein, 4 aa, Staphylococcus aureus
YLPK

SEQ ID NO: 1645415 - protein, 8 aa, Staphylococcus aureus
YLPSSTLD

SEQ ID NO: 1645416 - protein, 12 aa, Staphylococcus aureus
YLSKSRDLKDSR

SEQ ID NO: 1645417 - protein, 10 aa, Staphylococcus aureus
YNDGSTEEVQ

SEQ ID NO: 1645418 - protein, 54 aa, Staphylococcus aureus
YNDPSLVKSDTNDAVATNDQSSSDASNQTNTNTSNQNTSTTNNTNDQPQATNNM

SEQ ID NO: 1645419 - protein, 6 aa, Staphylococcus aureus
YNDPTL

SEQ ID NO: 1645420 - protein, 12 aa, Staphylococcus aureus
YNDQSSKKSISD

SEQ ID NO: 1645421 - protein, 10 aa, Staphylococcus aureus
YNDSSTEEVQ

SEQ ID NO: 1645422 - protein, 11 aa, Staphylococcus aureus
YNDTEQPIAPG

SEQ ID NO: 1645423 - protein, 12 aa, Staphylococcus aureus
YNEEDKMPQRKD

SEQ ID NO: 1645424 - protein, 4 aa, Staphylococcus aureus
YNEG

SEQ ID NO: 1645425 - protein, 20 aa, Staphylococcus aureus
YNEKKKKFEKIGKTRKKLET

SEQ ID NO: 1645426 - protein, 4 aa, Staphylococcus aureus
YNEQ

SEQ ID NO: 1645427 - protein, 7 aa, Staphylococcus aureus
YNFEEKE

SEQ ID NO: 1645428 - protein, 7 aa, Staphylococcus aureus
YNFNGKK

SEQ ID NO: 1645429 - protein, 7 aa, Staphylococcus aureus
YNFPKKP

SEQ ID NO: 1645430 - protein, 29 aa, Staphylococcus aureus
YNGESEITHNATGDKGGSKYQLKGVGQRE

SEQ ID NO: 1645431 - protein, 9 aa, Staphylococcus aureus
YNGNSQRPT

SEQ ID NO: 1645432 - protein, 19 aa, Staphylococcus aureus
YNHSEEHKEKSRKLDEKSK

SEQ ID NO: 1645433 - protein, 13 aa, Staphylococcus aureus
YNHYSKELKLKVV

SEQ ID NO: 1645434 - protein, 13 aa, Staphylococcus aureus
YNIPKNASTKVEL

SEQ ID NO: 1645435 - protein, 13 aa, Staphylococcus aureus
YNIPSNASTKVEL

SEQ ID NO: 1645436 - protein, 10 aa, Staphylococcus aureus
YNIPTEKAPK

SEQ ID NO: 1645437 - protein, 17 aa, Staphylococcus aureus
YNKETGKITKNESEVNL

SEQ ID NO: 1645438 - protein, 9 aa, Staphylococcus aureus
YNKETGNSI

SEQ ID NO: 1645439 - protein, 5 aa, Staphylococcus aureus
YNKKP

SEQ ID NO: 1645440 - protein, 15 aa, Staphylococcus aureus
YNKNKNIKNSIIRIL

SEQ ID NO: 1645441 - protein, 8 aa, Staphylococcus aureus
YNKPRKHH

SEQ ID NO: 1645442 - protein, 15 aa, Staphylococcus aureus
YNNEEQTKADTELNT

SEQ ID NO: 1645443 - protein, 27 aa, Staphylococcus aureus
YNNNFEKEDDSNTPSQQNASDLSDEEL

SEQ ID NO: 1645444 - protein, 4 aa, Staphylococcus aureus
YNNQ

SEQ ID NO: 1645445 - protein, 10 aa, Staphylococcus aureus
YNNSNKKELI

SEQ ID NO: 1645446 - protein, 7 aa, Staphylococcus aureus
YNPDAEA

SEQ ID NO: 1645447 - protein, 7 aa, Staphylococcus aureus
YNPKPTW

SEQ ID NO: 1645448 - protein, 5 aa, Staphylococcus aureus
YNQSK

SEQ ID NO: 1645449 - protein, 6 aa, Staphylococcus aureus
YNQTSS

SEQ ID NO: 1645450 - protein, 10 aa, Staphylococcus aureus
YNSQQNGQVT

SEQ ID NO: 1645451 - protein, 16 aa, Staphylococcus aureus
YNSRMTSFGTTKDYQD

SEQ ID NO: 1645452 - protein, 10 aa, Staphylococcus aureus
YNTNPKNYKH

SEQ ID NO: 1645453 - protein, 8 aa, Staphylococcus aureus
YPAETEAD

SEQ ID NO: 1645454 - protein, 13 aa, Staphylococcus aureus
YPDNSSTDNGKID

SEQ ID NO: 1645455 - protein, 9 aa, Staphylococcus aureus
YPEAIDEKQ

SEQ ID NO: 1645456 - protein, 5 aa, Staphylococcus aureus
YPEFG

SEQ ID NO: 1645457 - protein, 5 aa, Staphylococcus aureus
YPENE

SEQ ID NO: 1645458 - protein, 11 aa, Staphylococcus aureus
YPEQALNYSDD

SEQ ID NO: 1645459 - protein, 13 aa, Staphylococcus aureus
YPFDPSNPEDVRA

SEQ ID NO: 1645460 - protein, 6 aa, Staphylococcus aureus
YPKEKN

SEQ ID NO: 1645461 - protein, 7 aa, Staphylococcus aureus
YPKEKNL

SEQ ID NO: 1645462 - protein, 10 aa, Staphylococcus aureus
YPKKQEQQKI

SEQ ID NO: 1645463 - protein, 8 aa, Staphylococcus aureus
YPKVPKAL

SEQ ID NO: 1645464 - protein, 4 aa, Staphylococcus aureus
YPNE

SEQ ID NO: 1645465 - protein, 9 aa, Staphylococcus aureus
YPNEQEQKK

SEQ ID NO: 1645466 - protein, 14 aa, Staphylococcus aureus
YPNNPTGYTPTHKE

SEQ ID NO: 1645467 - protein, 8 aa, Staphylococcus aureus
YPNPTDTR

SEQ ID NO: 1645468 - protein, 7 aa, Staphylococcus aureus
YPNPYKN

SEQ ID NO: 1645469 - protein, 8 aa, Staphylococcus aureus
YPPKANEE

SEQ ID NO: 1645470 - protein, 13 aa, Staphylococcus aureus
YPPQTLTEDELTT

SEQ ID NO: 1645471 - protein, 14 aa, Staphylococcus aureus
YPRKGYNPTDERVK

SEQ ID NO: 1645472 - protein, 7 aa, Staphylococcus aureus
YPRKKQS

SEQ ID NO: 1645473 - protein, 9 aa, Staphylococcus aureus
YPTGTIHSR

SEQ ID NO: 1645474 - protein, 11 aa, Staphylococcus aureus
YPTLNSSEIKK

SEQ ID NO: 1645475 - protein, 6 aa, Staphylococcus aureus
YPTLSR

SEQ ID NO: 1645476 - protein, 7 aa, Staphylococcus aureus
YPTPSYK

SEQ ID NO: 1645477 - protein, 9 aa, Staphylococcus aureus
YQAPQPQKV

SEQ ID NO: 1645478 - protein, 13 aa, Staphylococcus aureus
YQATDADEKKLKA

SEQ ID NO: 1645479 - protein, 4 aa, Staphylococcus aureus
YQDN

SEQ ID NO: 1645480 - protein, 5 aa, Staphylococcus aureus
YQDNE

SEQ ID NO: 1645481 - protein, 5 aa, Staphylococcus aureus
YQGFG

SEQ ID NO: 1645482 - protein, 7 aa, Staphylococcus aureus
YQGHGYG

SEQ ID NO: 1645483 - protein, 6 aa, Staphylococcus aureus
YQGNKP

SEQ ID NO: 1645484 - protein, 14 aa, Staphylococcus aureus
YQGNSELTLSGEFG

SEQ ID NO: 1645485 - protein, 4 aa, Staphylococcus aureus
YQGQ

SEQ ID NO: 1645486 - protein, 12 aa, Staphylococcus aureus
YQLPAPKFEAGD

SEQ ID NO: 1645487 - protein, 13 aa, Staphylococcus aureus
YQLPQSKIQTRSI

SEQ ID NO: 1645488 - protein, 6 aa, Staphylococcus aureus
YQNDDA

SEQ ID NO: 1645489 - protein, 24 aa, Staphylococcus aureus
YQNKDKKQLTKGQQALSKLNLNAK

SEQ ID NO: 1645490 - protein, 10 aa, Staphylococcus aureus
YQNPGGSLKD

SEQ ID NO: 1645491 - protein, 5 aa, Staphylococcus aureus
YQPDR

SEQ ID NO: 1645492 - protein, 4 aa, Staphylococcus aureus
YQPK

SEQ ID NO: 1645493 - protein, 19 aa, Staphylococcus aureus
YQQENAKKVIAESNQTTEL

SEQ ID NO: 1645494 - protein, 9 aa, Staphylococcus aureus
YQQGTPYEH

SEQ ID NO: 1645495 - protein, 21 aa, Staphylococcus aureus
YQSATKSDLKFSSTKHLSNKN

SEQ ID NO: 1645496 - protein, 5 aa, Staphylococcus aureus
YQSDD

SEQ ID NO: 1645497 - protein, 21 aa, Staphylococcus aureus
YQSGSTQSRDAINKRGNKKAR

SEQ ID NO: 1645498 - protein, 7 aa, Staphylococcus aureus
YQSQKDI

SEQ ID NO: 1645499 - protein, 14 aa, Staphylococcus aureus
YQTEQDMYAKFEGS

SEQ ID NO: 1645500 - protein, 6 aa, Staphylococcus aureus
YQTGFD

SEQ ID NO: 1645501 - protein, 7 aa, Staphylococcus aureus
YQTGHPH

SEQ ID NO: 1645502 - protein, 11 aa, Staphylococcus aureus
YRADKETQYAQ

SEQ ID NO: 1645503 - protein, 7 aa, Staphylococcus aureus
YRKPSDF

SEQ ID NO: 1645504 - protein, 13 aa, Staphylococcus aureus
YRLPKSDISTQSV

SEQ ID NO: 1645505 - protein, 7 aa, Staphylococcus aureus
YRNSTDE

SEQ ID NO: 1645506 - protein, 9 aa, Staphylococcus aureus
YRNTGESQY

SEQ ID NO: 1645507 - protein, 11 aa, Staphylococcus aureus
YRPTDENDAYA

SEQ ID NO: 1645508 - protein, 6 aa, Staphylococcus aureus
YRQKDT

SEQ ID NO: 1645509 - protein, 13 aa, Staphylococcus aureus
YRRPSTGAYPLRG

SEQ ID NO: 1645510 - protein, 5 aa, Staphylococcus aureus
YRTGE

SEQ ID NO: 1645511 - protein, 12 aa, Staphylococcus aureus
YRVGTSSRVANP

SEQ ID NO: 1645512 - protein, 13 aa, Staphylococcus aureus
YRVGTSSTAANPV

SEQ ID NO: 1645513 - protein, 6 aa, Staphylococcus aureus
YSAAPG

SEQ ID NO: 1645514 - protein, 10 aa, Staphylococcus aureus
YSAGKNKDAH

SEQ ID NO: 1645515 - protein, 9 aa, Staphylococcus aureus
YSANQVKRQ

SEQ ID NO: 1645516 - protein, 4 aa, Staphylococcus aureus
YSDI

SEQ ID NO: 1645517 - protein, 10 aa, Staphylococcus aureus
YSDSAKTFEI

SEQ ID NO: 1645518 - protein, 9 aa, Staphylococcus aureus
YSENQVKRQ

SEQ ID NO: 1645519 - protein, 5 aa, Staphylococcus aureus
YSENY

SEQ ID NO: 1645520 - protein, 9 aa, Staphylococcus aureus
YSEPYDSKI

SEQ ID NO: 1645521 - protein, 8 aa, Staphylococcus aureus
YSERGEKL

SEQ ID NO: 1645522 - protein, 7 aa, Staphylococcus aureus
YSETQFE

SEQ ID NO: 1645523 - protein, 10 aa, Staphylococcus aureus
YSGKSKGKFF

SEQ ID NO: 1645524 - protein, 10 aa, Staphylococcus aureus
YSGNKKAVDD

SEQ ID NO: 1645525 - protein, 7 aa, Staphylococcus aureus
YSKLNKK

SEQ ID NO: 1645526 - protein, 7 aa, Staphylococcus aureus
YSKRELA

SEQ ID NO: 1645527 - protein, 6 aa, Staphylococcus aureus
YSKSEL

SEQ ID NO: 1645528 - protein, 5 aa, Staphylococcus aureus
YSMTK

SEQ ID NO: 1645529 - protein, 6 aa, Staphylococcus aureus
YSNESL

SEQ ID NO: 1645530 - protein, 5 aa, Staphylococcus aureus
YSNFN

SEQ ID NO: 1645531 - protein, 6 aa, Staphylococcus aureus
YSNFNN

SEQ ID NO: 1645532 - protein, 9 aa, Staphylococcus aureus
YSNSTQTFD

SEQ ID NO: 1645533 - protein, 5 aa, Staphylococcus aureus
YSNYQ

SEQ ID NO: 1645534 - protein, 7 aa, Staphylococcus aureus
YSPEKQL

SEQ ID NO: 1645535 - protein, 8 aa, Staphylococcus aureus
YSQDHLKE

SEQ ID NO: 1645536 - protein, 5 aa, Staphylococcus aureus
YSQIG

SEQ ID NO: 1645537 - protein, 15 aa, Staphylococcus aureus
YSQPAQDTGNVTNEI

SEQ ID NO: 1645538 - protein, 20 aa, Staphylococcus aureus
YSSEKAAHSMENGYSSAATV

SEQ ID NO: 1645539 - protein, 7 aa, Staphylococcus aureus
YSSGFGD

SEQ ID NO: 1645540 - protein, 9 aa, Staphylococcus aureus
YSSSKSDDM

SEQ ID NO: 1645541 - protein, 11 aa, Staphylococcus aureus
YSSTGKNGGYM

SEQ ID NO: 1645542 - protein, 16 aa, Staphylococcus aureus
YSTDLESDNDPEKWSV

SEQ ID NO: 1645543 - protein, 13 aa, Staphylococcus aureus
YSTENQNIHNCCK

SEQ ID NO: 1645544 - protein, 10 aa, Staphylococcus aureus
YSTKENEYGK

SEQ ID NO: 1645545 - protein, 6 aa, Staphylococcus aureus
YSTRLD

SEQ ID NO: 1645546 - protein, 6 aa, Staphylococcus aureus
YSYSNK

SEQ ID NO: 1645547 - protein, 13 aa, Staphylococcus aureus
YTENTPKSYDSTK

SEQ ID NO: 1645548 - protein, 7 aa, Staphylococcus aureus
YTESLGS

SEQ ID NO: 1645549 - protein, 12 aa, Staphylococcus aureus
YTEVAKESGLEV

SEQ ID NO: 1645550 - protein, 10 aa, Staphylococcus aureus
YTGNSQRPTE

SEQ ID NO: 1645551 - protein, 4 aa, Staphylococcus aureus
YTIS

SEQ ID NO: 1645552 - protein, 4 aa, Staphylococcus aureus
YTKE

SEQ ID NO: 1645553 - protein, 5 aa, Staphylococcus aureus
YTKYA

SEQ ID NO: 1645554 - protein, 5 aa, Staphylococcus aureus
YTLEG

SEQ ID NO: 1645555 - protein, 8 aa, Staphylococcus aureus
YTNVSGSF

SEQ ID NO: 1645556 - protein, 4 aa, Staphylococcus aureus
YTPE

SEQ ID NO: 1645557 - protein, 5 aa, Staphylococcus aureus
YTPIS

SEQ ID NO: 1645558 - protein, 7 aa, Staphylococcus aureus
YTPKPAW

SEQ ID NO: 1645559 - protein, 5 aa, Staphylococcus aureus
YTPNE

SEQ ID NO: 1645560 - protein, 12 aa, Staphylococcus aureus
YTPRMEGANEEI

SEQ ID NO: 1645561 - protein, 14 aa, Staphylococcus aureus
YTREINTIKYYNLL

SEQ ID NO: 1645562 - protein, 14 aa, Staphylococcus aureus
YTREINTMKYYSLL

SEQ ID NO: 1645563 - protein, 10 aa, Staphylococcus aureus
YTRPSFSENK

SEQ ID NO: 1645564 - protein, 12 aa, Staphylococcus aureus
YTRSITNGRLEP

SEQ ID NO: 1645565 - protein, 6 aa, Staphylococcus aureus
YTSRNG

SEQ ID NO: 1645566 - protein, 12 aa, Staphylococcus aureus
YTTNKKAFSSEF

SEQ ID NO: 1645567 - protein, 10 aa, Staphylococcus aureus
YTTPVPKSGE

SEQ ID NO: 1645568 - protein, 4 aa, Staphylococcus aureus
YTTQ

SEQ ID NO: 1645569 - protein, 9 aa, Staphylococcus aureus
YTTRRNPKV

SEQ ID NO: 1645570 - protein, 8 aa, Staphylococcus aureus
YTYGGDNR

SEQ ID NO: 1645571 - protein, 5 aa, Staphylococcus aureus
YVEAV

SEQ ID NO: 1645572 - protein, 6 aa, Staphylococcus aureus
YVEQEN

SEQ ID NO: 1645573 - protein, 28 aa, Staphylococcus aureus
YVGEDTASSKVHEQHTTNVKVRDIGDDK

SEQ ID NO: 1645574 - protein, 101 aa, Staphylococcus aureus; identical to SEQ ID NO: 1563176

SEQ ID NO: 1645575 - protein, 8 aa, Staphylococcus aureus
YVRPSESY

SEQ ID NO: 1645576 - protein, 8 aa, Staphylococcus aureus
YWDSEARG

SEQ ID NO: 1645577 - protein, 9 aa, Staphylococcus aureus
YYDSNASNL

SEQ ID NO: 1645578 - protein, 117 aa, Staphylococcus aureus
YYEEETSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSVLRQRFRF

SEQ ID NO: 1645579 - protein, 7 aa, Staphylococcus aureus
YYKNNDR

SEQ ID NO: 1645580 - protein, 5 aa, Staphylococcus aureus
YYNDG

SEQ ID NO: 1645581 - protein, 13 aa, Staphylococcus aureus
YYNRDEDDGITGK

SEQ ID NO: 1645582 - protein, 5 aa, Staphylococcus aureus
YYRGD

SEQ ID NO: 1645583 - protein, 10 aa, Staphylococcus aureus
YYSSKTLKES

SEQ ID NO: 1645584 - protein, 5 aa, Staphylococcus aureus
YYSSN

SEQ ID NO: 1645585 - protein, 21 aa, Staphylococcus aureus
VEVNTRLVLEKGLTLIGSSRS

SEQ ID NO: 1645586 - protein, 26 aa, Staphylococcus aureus
EYAVFKKPMIFYAFDLEDYITTRDFY

SEQ ID NO: 1645587 - protein, 18 aa, Staphylococcus aureus
PYSAKWTADSKFENDERF

SEQ ID NO: 1645588 - protein, 17 aa, Staphylococcus aureus
TADSKFENDERFSGYGK

SEQ ID NO: 1645589 - protein, 19 aa, Staphylococcus aureus
VWHAVGAFKTVGFSRTGKK

SEQ ID NO: 1645590 - protein, 21 aa, Staphylococcus aureus
PKSKADFAFIQHMVHYLDDEG

SEQ ID NO: 1645591 - protein, 18 aa, Staphylococcus aureus
KLAPKSKADFAFIQHMVH

SEQ ID NO: 1645592 - protein, 28 aa, Staphylococcus aureus
ANIFYGTSIPTCILVFKKCRQQDDNVLF

SEQ ID NO: 1645593 - protein, 19 aa, Staphylococcus aureus
FKNNWKVLLMDTSKTIFSK

SEQ ID NO: 1645594 - protein, 20 aa, Staphylococcus aureus
TIFSKYRWNKSFKAYKRSSD

SEQ ID NO: 1645595 - protein, 25 aa, Staphylococcus aureus
KDLRLCNWPKFINRLNSVSKKSVSK

SEQ ID NO: 1645596 - protein, 23 aa, Staphylococcus aureus
SVKNVTGSMSFIFIDNDTHDVID

SEQ ID NO: 1645597 - protein, 20 aa, Staphylococcus aureus
QRFKCLECNGTFTAKTSIVD

SEQ ID NO: 1645598 - protein, 26 aa, Staphylococcus aureus
YDPTCGSGSLLLRVGKETQVYRYFGQ

SEQ ID NO: 1645599 - protein, 30 aa, Staphylococcus aureus
MDASEFRNYILGLIFYRFLSEKAEQEYADA

SEQ ID NO: 1645600 - protein, 24 aa, Staphylococcus aureus
NFKARIMMIFSLYKGEKKKTTKPN

SEQ ID NO: 1645601 - protein, 18 aa, Staphylococcus aureus
IGALKDGRFDDVQQDIEA

SEQ ID NO: 1645602 - protein, 19 aa, Staphylococcus aureus
FPNAAIIFDRFHIVQHLNR

SEQ ID NO: 1645603 - protein, 22 aa, Staphylococcus aureus
DLKAELIDQVGYFIEPQDLFSA

SEQ ID NO: 1645604 - protein, 22 aa, Staphylococcus aureus
ADEIDMVINIGALKDGRFDDVQ

SEQ ID NO: 1645605 - protein, 23 aa, Staphylococcus aureus
LGDAYEFLIGRFAATAGKKAGEF

SEQ ID NO: 1645606 - protein, 19 aa, Staphylococcus aureus
AKELDEMGADYIAVHTGYD

SEQ ID NO: 1645607 - protein, 21 aa, Staphylococcus aureus
SVATFTLAVNRTFTNAQGERE

SEQ ID NO: 1645608 - protein, 17 aa, Staphylococcus aureus
AGAKKRAPYIFRKLNIE

SEQ ID NO: 1645609 - protein, 25 aa, Staphylococcus aureus
AQTPYPIMINKWYIPQEISELTLTR

SEQ ID NO: 1645610 - protein, 24 aa, Staphylococcus aureus
ASHRLKQPLAHRIPGIELMDECLK

SEQ ID NO: 1645611 - protein, 19 aa, Staphylococcus aureus
CFTFIPLNVIDTFKVNTQN

SEQ ID NO: 1645612 - protein, 29 aa, Staphylococcus aureus
DIIKRHRLLELFLIEILKYNWEEVHQEAE

SEQ ID NO: 1645613 - protein, 26 aa, Staphylococcus aureus
DSLLNFPETCPHGGVIPRNNEYKEKY

SEQ ID NO: 1645614 - protein, 26 aa, Staphylococcus aureus
DVIVFKYAGAYGWSISHHDFLSHPHP

SEQ ID NO: 1645615 - protein, 21 aa, Staphylococcus aureus
EGKDFKGIYPSSANYTTDLHS

SEQ ID NO: 1645616 - protein, 18 aa, Staphylococcus aureus
FASLKDRPFHPLAKEKRG

SEQ ID NO: 1645617 - protein, 22 aa, Staphylococcus aureus
FSEACARFVDRWQQQRPEINFI

SEQ ID NO: 1645618 - protein, 23 aa, Staphylococcus aureus
GAADLSQSLGIPWQTRDDQVTSH

SEQ ID NO: 1645619 - protein, 23 aa, Staphylococcus aureus
GIENIEFKMLCMGFKRKEIKAMT

SEQ ID NO: 1645620 - protein, 22 aa, Staphylococcus aureus
GNLGIALAMIAKIKGLKLTCVV

SEQ ID NO: 1645621 - protein, 28 aa, Staphylococcus aureus
HLAKKGFKDLTIIGCGLIGDKQLQSMLE

SEQ ID NO: 1645622 - protein, 18 aa, Staphylococcus aureus
IADRIIAMPSHIGGEHAI

SEQ ID NO: 1645623 - protein, 18 aa, Staphylococcus aureus
ILSGCYKEIGWFRRPNKS

SEQ ID NO: 1645624 - protein, 25 aa, Staphylococcus aureus
IPQKAHIDLDFPISVEQVILSGCYK

SEQ ID NO: 1645625 - protein, 22 aa, Staphylococcus aureus
KERMKDALIPKHKNKTFFALDD

SEQ ID NO: 1645626 - protein, 18 aa, Staphylococcus aureus
LDGLNYLAGKTIDEVNTK

SEQ ID NO: 1645627 - protein, 19 aa, Staphylococcus aureus
LNIYLKLPIHVKITNFIRT

SEQ ID NO: 1645628 - protein, 26 aa, Staphylococcus aureus
MLCMGFKRKEIKAMTPKIIEFSELGE

SEQ ID NO: 1645629 - protein, 25 aa, Staphylococcus aureus
NYEPSMQYFNEWWKQLFGESEGKDF

SEQ ID NO: 1645630 - protein, 20 aa, Staphylococcus aureus
PVRGEIIGIMGPNGAGKSSL

SEQ ID NO: 1645631 - protein, 24 aa, Staphylococcus aureus
PYIEYDWLQKGAFISNISIMDVHK

SEQ ID NO: 1645632 - protein, 22 aa, Staphylococcus aureus
QGLSIDDYVLFPVHPWQYQHIL

SEQ ID NO: 1645633 - protein, 21 aa, Staphylococcus aureus
RQFCTKIAWIEGGKLKDYGEL

SEQ ID NO: 1645634 - protein, 18 aa, Staphylococcus aureus
SELVRGRGGPRCMSQPLF

SEQ ID NO: 1645635 - protein, 18 aa, Staphylococcus aureus
SLISSMRTAAVSVIAAKH

SEQ ID NO: 1645636 - protein, 22 aa, Staphylococcus aureus
TEGKTPILLFDVWEHAYYLKYQ

SEQ ID NO: 1645637 - protein, 23 aa, Staphylococcus aureus
YAPECHTSFQLHYLAVHQDVLLT

SEQ ID NO: 1645638 - protein, 23 aa, Staphylococcus aureus
YSSGMRAKLGFSINITVNPDILV

SEQ ID NO: 1645639 - protein, 22 aa, Staphylococcus aureus
AAEVAKSHGAYVVAITNFEGSK

SEQ ID NO: 1645640 - protein, 25 aa, Staphylococcus aureus
ADGYARLNGLAALVTTFGVGELSAV

SEQ ID NO: 1645641 - protein, 20 aa, Staphylococcus aureus
ADLDVLKSRIAKRNRSFEHQ

SEQ ID NO: 1645642 - protein, 25 aa, Staphylococcus aureus
ADLLLWFLRPEMKSLNHIENEFNKL

SEQ ID NO: 1645643 - protein, 23 aa, Staphylococcus aureus
AEEEAKAWIDAVVNDTEPVVKPE

SEQ ID NO: 1645644 - protein, 24 aa, Staphylococcus aureus
AEERLNGTVLWLGESDELYHPQQS

SEQ ID NO: 1645645 - protein, 19 aa, Staphylococcus aureus
AFYLTRPAIDVIIPGAKRA

SEQ ID NO: 1645646 - protein, 24 aa, Staphylococcus aureus
AGDTFIGAFVSRLNKSQDNLADAI

SEQ ID NO: 1645647 - protein, 21 aa, Staphylococcus aureus
AGKDLKIIANYGAGFNNIDIE

SEQ ID NO: 1645648 - protein, 28 aa, Staphylococcus aureus
AGLKDPKRPIGSFIFLGPTGVGKTELAR

SEQ ID NO: 1645649 - protein, 26 aa, Staphylococcus aureus
AGNIGYKIAQRLGGYDAVGPVLQGLN

SEQ ID NO: 1645650 - protein, 18 aa, Staphylococcus aureus
AGVDKIFGVPGDFNLAFL

SEQ ID NO: 1645651 - protein, 24 aa, Staphylococcus aureus
AIAHANCMVMLPGGSRGFKAGHTV

SEQ ID NO: 1645652 - protein, 24 aa, Staphylococcus aureus
AIVLSSIPFNANWLNQQYAEIIQA

SEQ ID NO: 1645653 - protein, 19 aa, Staphylococcus aureus
AKATIFIKDMNDFQKINEV

SEQ ID NO: 1645654 - protein, 18 aa, Staphylococcus aureus
AKTYEEWFKQFSSKKAQF

SEQ ID NO: 1645655 - protein, 22 aa, Staphylococcus aureus
AKWLRDVRDVDIFPNKALIESA

SEQ ID NO: 1645656 - protein, 21 aa, Staphylococcus aureus
ALAFDGEIRAYAALTTETVQE

SEQ ID NO: 1645657 - protein, 24 aa, Staphylococcus aureus
APAKAYNPLFIYGGVGLGKTHLMH

SEQ ID NO: 1645658 - protein, 19 aa, Staphylococcus aureus
APLRVKVRLIIKETGEVKE

SEQ ID NO: 1645659 - protein, 22 aa, Staphylococcus aureus
AQIANRLRFFFPDVQVRGYYPS

SEQ ID NO: 1645660 - protein, 20 aa, Staphylococcus aureus
ARIKRYEWFDEMMNVLEADV

SEQ ID NO: 1645661 - protein, 19 aa, Staphylococcus aureus
ASINPRFKVIDVIKRPLII

SEQ ID NO: 1645662 - protein, 27 aa, Staphylococcus aureus
AYETFLKNEIARWIKIQEDIGLDVLVH

SEQ ID NO: 1645663 - protein, 18 aa, Staphylococcus aureus
CFELLSMVTYADKLKSLI

SEQ ID NO: 1645664 - protein, 18 aa, Staphylococcus aureus
CREVRKKYEMPIIMLTAK

SEQ ID NO: 1645665 - protein, 19 aa, Staphylococcus aureus
CTYCGVGCSFEVWTKDREI

SEQ ID NO: 1645666 - protein, 17 aa, Staphylococcus aureus
DADKGWHDLKIVPYGPI

SEQ ID NO: 1645667 - protein, 19 aa, Staphylococcus aureus
DAILRQVIREEGLEREIWQ

SEQ ID NO: 1645668 - protein, 25 aa, Staphylococcus aureus
DAVRPFLTHRIIKENIQAALEYGAV

SEQ ID NO: 1645669 - protein, 17 aa, Staphylococcus aureus
DCLLSKYYELFNISAKT

SEQ ID NO: 1645670 - protein, 29 aa, Staphylococcus aureus
DDNYKWLQILPEKKRYSITVMFDNKGNPL

SEQ ID NO: 1645671 - protein, 27 aa, Staphylococcus aureus
DDPTLRLKRDLIREFIDNVVPSLNKDD

SEQ ID NO: 1645672 - protein, 26 aa, Staphylococcus aureus
DEAGLFLWETLRNNFYYSAINVPKAT

SEQ ID NO: 1645673 - protein, 18 aa, Staphylococcus aureus
DEVRKLGIELGIPEHLVW

SEQ ID NO: 1645674 - protein, 20 aa, Staphylococcus aureus
DHDACIPGLTNMASTMKQHG

SEQ ID NO: 1645675 - protein, 21 aa, Staphylococcus aureus
DHFIMKLRIVKFARTPDYNEL

SEQ ID NO: 1645676 - protein, 23 aa, Staphylococcus aureus
DIPFAARHFHYFASVIETEEGTV

SEQ ID NO: 1645677 - protein, 17 aa, Staphylococcus aureus
DLAEFNTHFDNWFSETS

SEQ ID NO: 1645678 - protein, 25 aa, Staphylococcus aureus
DLAVSRTSFNWGVHVPSNPKHVVYV

SEQ ID NO: 1645679 - protein, 31 aa, Staphylococcus aureus
DLLFACFKTGAVFLPLNWRLNPKEIAAIVED

SEQ ID NO: 1645680 - protein, 20 aa, Staphylococcus aureus
DQLTCIFVDHGLLRKGEGDM

SEQ ID NO: 1645681 - protein, 19 aa, Staphylococcus aureus
DRFLPDKAIDLIDEASSKV

SEQ ID NO: 1645682 - protein, 18 aa, Staphylococcus aureus
DRPFHPLAKEKRGLREAD

SEQ ID NO: 1645683 - protein, 20 aa, Staphylococcus aureus
DRRNLLLIGDGSLQLTVQAI

SEQ ID NO: 1645684 - protein, 22 aa, Staphylococcus aureus
DSFVGCNVNLVAPVTIGDDVLV

SEQ ID NO: 1645685 - protein, 19 aa, Staphylococcus aureus
DVSHMLLPLIQTFHLQNDT

SEQ ID NO: 1645686 - protein, 24 aa, Staphylococcus aureus
DWGKRRLAYEINDFKDGFYNIVRV

SEQ ID NO: 1645687 - protein, 24 aa, Staphylococcus aureus
DYPLSREKLSPVLALVKAQSTKQA

SEQ ID NO: 1645688 - protein, 20 aa, Staphylococcus aureus
EAARRIGEGAAMLRTKGEPG

SEQ ID NO: 1645689 - protein, 22 aa, Staphylococcus aureus
EADFINCVVFRRQADNVNNYLS

SEQ ID NO: 1645690 - protein, 21 aa, Staphylococcus aureus
EADSHVAIAGRLMTKRGKGKA

SEQ ID NO: 1645691 - protein, 23 aa, Staphylococcus aureus
EDFTGNLSLEFVDYRLGEPKYDL

SEQ ID NO: 1645692 - protein, 23 aa, Staphylococcus aureus
EDHGAEAVCHFCGNKYKYTEEEL

SEQ ID NO: 1645693 - protein, 20 aa, Staphylococcus aureus
EEACKVIGITDLRKMGLRDK

SEQ ID NO: 1645694 - protein, 27 aa, Staphylococcus aureus
EEYPQLTIRVSGYAVNFIKLTREQQLD

SEQ ID NO: 1645695 - protein, 24 aa, Staphylococcus aureus
EGIEGRTAYKGALQDTIYQLMGGV

SEQ ID NO: 1645696 - protein, 21 aa, Staphylococcus aureus
EHSYCPGKFDLSIDGKKFAGI

SEQ ID NO: 1645697 - protein, 21 aa, Staphylococcus aureus
EIYDQMMWIGFKPFKITNIKQ

SEQ ID NO: 1645698 - protein, 25 aa, Staphylococcus aureus
EKDTEYRALMNLELDMLYQMIDLIN

SEQ ID NO: 1645699 - protein, 24 aa, Staphylococcus aureus
EKFRGIRSNIMFSKANGEVKRLLV

SEQ ID NO: 1645700 - protein, 19 aa, Staphylococcus aureus
ELLQFFKKTYKTHFNMDGG

SEQ ID NO: 1645701 - protein, 23 aa, Staphylococcus aureus
EMARIAKVYAELGVKKIRITGGE

SEQ ID NO: 1645702 - protein, 20 aa, Staphylococcus aureus
ENERSYDVFQYLKHEMNYSE

SEQ ID NO: 1645703 - protein, 27 aa, Staphylococcus aureus
ENIPGELIMKILAFDGNLEKIDKASKI

SEQ ID NO: 1645704 - protein, 24 aa, Staphylococcus aureus
EQIKIATKGSHEFDENQEVHQNNQ

SEQ ID NO: 1645705 - protein, 24 aa, Staphylococcus aureus
EQLEEIEGLILPGGESTTLRRLMN

SEQ ID NO: 1645706 - protein, 20 aa, Staphylococcus aureus
ERGLHHLVWEIVDNSIDEAL

SEQ ID NO: 1645707 - protein, 25 aa, Staphylococcus aureus
ERLNLGRRLGFELSTAKESRIERGY

SEQ ID NO: 1645708 - protein, 19 aa, Staphylococcus aureus
ESVFARFISSIKEERVNAS

SEQ ID NO: 1645709 - protein, 24 aa, Staphylococcus aureus
ETLKRYLLEETFELFEAIDNEDDW

SEQ ID NO: 1645710 - protein, 25 aa, Staphylococcus aureus
ETVRKALDLLALDGMIQKIHGKGSL

SEQ ID NO: 1645711 - protein, 19 aa, Staphylococcus aureus
ETYESFKLFESTYFDHQIL

SEQ ID NO: 1645712 - protein, 23 aa, Staphylococcus aureus
EVESMMFYTCILDMIKYEESSEM

SEQ ID NO: 1645713 - protein, 24 aa, Staphylococcus aureus
EVTEFPFSELVSFKEMQEEMGVAY

SEQ ID NO: 1645714 - protein, 24 aa, Staphylococcus aureus
EWEMIKRLSTPFMNLDHVQQFENA

SEQ ID NO: 1645715 - protein, 27 aa, Staphylococcus aureus
FAEECAKAESVVICWAMGITQQDIGSD

SEQ ID NO: 1645716 - protein, 25 aa, Staphylococcus aureus
FDASVEVAFRLGIDTRKNDQQIRGA

SEQ ID NO: 1645717 - protein, 20 aa, Staphylococcus aureus
FDKMKHKVIFDTKNVVKSSF

SEQ ID NO: 1645718 - protein, 18 aa, Staphylococcus aureus
FFEMYSWAQIGIHEKPIA

SEQ ID NO: 1645719 - protein, 22 aa, Staphylococcus aureus
FFSNYRPQFYFRTTDVTGVVHL

SEQ ID NO: 1645720 - protein, 17 aa, Staphylococcus aureus
FGVPGDFNLAFLDDIIS

SEQ ID NO: 1645721 - protein, 19 aa, Staphylococcus aureus
FHALLDVFGKHYFRDKDIK

SEQ ID NO: 1645722 - protein, 23 aa, Staphylococcus aureus
FINRDLFKYIPFDGSIITISELQ

SEQ ID NO: 1645723 - protein, 24 aa, Staphylococcus aureus
FKEDGRFIPTIAFYSPNALGAITK

SEQ ID NO: 1645724 - protein, 19 aa, Staphylococcus aureus
FKMMQNFLKPNDVIIADQG

SEQ ID NO: 1645725 - protein, 20 aa, Staphylococcus aureus
FKQYGINIINGYGLTEAPLV

SEQ ID NO: 1645726 - protein, 22 aa, Staphylococcus aureus
FKYPEIEPSCMASLETLLNKTI

SEQ ID NO: 1645727 - protein, 18 aa, Staphylococcus aureus
FNDFEMHFYRYVFPYYDT

SEQ ID NO: 1645728 - protein, 17 aa, Staphylococcus aureus
FRKQIALAKRLKLPIII

SEQ ID NO: 1645729 - protein, 23 aa, Staphylococcus aureus
FSDTEIFKLLSLLQDDIDHMKVS

SEQ ID NO: 1645730 - protein, 25 aa, Staphylococcus aureus
FTENASWPLAMPVFKMDYAHQEYEA

SEQ ID NO: 1645731 - protein, 19 aa, Staphylococcus aureus
FYYPFTFEEIRDYYFDIIE

SEQ ID NO: 1645732 - protein, 20 aa, Staphylococcus aureus
GAIIPELFAYEAGQSAVGDL

SEQ ID NO: 1645733 - protein, 18 aa, Staphylococcus aureus
GASHQYKLLIILSPSGAY

SEQ ID NO: 1645734 - protein, 19 aa, Staphylococcus aureus
GDNIGALLRGVAREDVQRG

SEQ ID NO: 1645735 - protein, 24 aa, Staphylococcus aureus
GDVDDIRESPAFDIYELLNQEPDI

SEQ ID NO: 1645736 - protein, 23 aa, Staphylococcus aureus
GDYRRVALYGVDFLMEEKMHDFN

SEQ ID NO: 1645737 - protein, 23 aa, Staphylococcus aureus
GEAFKYQYMHLINEIYIEDELVT

SEQ ID NO: 1645738 - protein, 20 aa, Staphylococcus aureus
GEGYPIVLIHTVLDNYSVFN

SEQ ID NO: 1645739 - protein, 23 aa, Staphylococcus aureus
GEIAANWEGQAFSRFEEQFQQLS

SEQ ID NO: 1645740 - protein, 25 aa, Staphylococcus aureus
GELDRYPLAKFKRSNSGTCYNQRPI

SEQ ID NO: 1645741 - protein, 17 aa, Staphylococcus aureus
GEVNGTISIGCSSLIGQ

SEQ ID NO: 1645742 - protein, 23 aa, Staphylococcus aureus
GEYYLPDVLSLILNDGGIVEVYR

SEQ ID NO: 1645743 - protein, 21 aa, Staphylococcus aureus
GFIDPKYRALAPLCDTKESLI

SEQ ID NO: 1645744 - protein, 24 aa, Staphylococcus aureus
GFNKSEAYILLFSKLFRNQEKTMK

SEQ ID NO: 1645745 - protein, 22 aa, Staphylococcus aureus
GFQELKIAISRYLPEDIATNPH

SEQ ID NO: 1645746 - protein, 21 aa, Staphylococcus aureus
GGQAKWFLQDVEVLINGVRET

SEQ ID NO: 1645747 - protein, 20 aa, Staphylococcus aureus
GHDIQNWFMNAHIYLELADD

SEQ ID NO: 1645748 - protein, 21 aa, Staphylococcus aureus
GHGPFSHSFEKIFNTDHEAYT

SEQ ID NO: 1645749 - protein, 23 aa, Staphylococcus aureus
GHPIGASGARVLVTLLHQLNDEV

SEQ ID NO: 1645750 - protein, 25 aa, Staphylococcus aureus
GIGVEEVRALNEFAINGLYPDLTIY

SEQ ID NO: 1645751 - protein, 27 aa, Staphylococcus aureus
GKEINPKFKIGTMISHVPIYPYSCHPK

SEQ ID NO: 1645752 - protein, 25 aa, Staphylococcus aureus
GKNPFPKEWRMHAFFMDALPILNEP

SEQ ID NO: 1645753 - protein, 25 aa, Staphylococcus aureus
GKVKMYVCGPTVYNYIHIGNARPAI

SEQ ID NO: 1645754 - protein, 26 aa, Staphylococcus aureus
GLGEIGSAVARRARAFDMDVLYTGPN

SEQ ID NO: 1645755 - protein, 32 aa, Staphylococcus aureus
GLMTLKLAQHYPLKRIAVMSAPKEKSDDGLIE

SEQ ID NO: 1645756 - protein, 20 aa, Staphylococcus aureus
GMRFYGYHGALSAENEIGQI

SEQ ID NO: 1645757 - protein, 23 aa, Staphylococcus aureus
GNIIAEVFNRFSITDTSMMLDRM

SEQ ID NO: 1645758 - protein, 19 aa, Staphylococcus aureus
GNPGLSLYCSTKFAVRGLT

SEQ ID NO: 1645759 - protein, 17 aa, Staphylococcus aureus
GPTKDWECSCGKYKRVR

SEQ ID NO: 1645760 - protein, 25 aa, Staphylococcus aureus
GTDQFKRIRIGVGRPTNGMTVPDYV

SEQ ID NO: 1645761 - protein, 22 aa, Staphylococcus aureus
GTEIGIRLKQPIDLQYGDILYA

SEQ ID NO: 1645762 - protein, 24 aa, Staphylococcus aureus
GTRQDLREAFEFAAENKVTPKVQL

SEQ ID NO: 1645763 - protein, 19 aa, Staphylococcus aureus
GVEYKVYKNTMVRRAAEKA

SEQ ID NO: 1645764 - protein, 21 aa, Staphylococcus aureus
GVHKWKTLGIAYELEDVEAPD

SEQ ID NO: 1645765 - protein, 20 aa, Staphylococcus aureus
GWHDLKIVPYGPIEISPAAQ

SEQ ID NO: 1645766 - protein, 18 aa, Staphylococcus aureus
HAPKEIFEQLNINNPQFM

SEQ ID NO: 1645767 - protein, 24 aa, Staphylococcus aureus
HDHKPSDVDLCFLTSTATDLYDNI

SEQ ID NO: 1645768 - protein, 17 aa, Staphylococcus aureus
HGARKGLADTALKTADS

SEQ ID NO: 1645769 - protein, 17 aa, Staphylococcus aureus
HIGEVNGTISIGCSSLI

SEQ ID NO: 1645770 - protein, 26 aa, Staphylococcus aureus
HKLTKEELKEIVTMMVNKLTNRLSEQ

SEQ ID NO: 1645771 - protein, 22 aa, Staphylococcus aureus
HKNLAYRAAQLFIEQYQLKQGV

SEQ ID NO: 1645772 - protein, 26 aa, Staphylococcus aureus
HLEQSRLTQYIGHLNVVLFAPEDLNI

SEQ ID NO: 1645773 - protein, 19 aa, Staphylococcus aureus
HNYYPRPDTGLSVDLVNKK

SEQ ID NO: 1645774 - protein, 18 aa, Staphylococcus aureus
HSDYICFYPMNKRRNETY

SEQ ID NO: 1645775 - protein, 18 aa, Staphylococcus aureus
HVLVKFEEEIHCEIVNKD

SEQ ID NO: 1645776 - protein, 17 aa, Staphylococcus aureus
IAFADSRIRKETIAAED

SEQ ID NO: 1645777 - protein, 24 aa, Staphylococcus aureus
IAIQRLNENFSFDIPINEIDKWRH

SEQ ID NO: 1645778 - protein, 21 aa, Staphylococcus aureus
IDGEFQFDAAIVPGVAEKKAP

SEQ ID NO: 1645779 - protein, 18 aa, Staphylococcus aureus
IDPRRRGETLSIQDFAKL

SEQ ID NO: 1645780 - protein, 26 aa, Staphylococcus aureus
IEGPDFPTAGLILGKSGIRRAYETGR

SEQ ID NO: 1645781 - protein, 19 aa, Staphylococcus aureus
IEIAPGLDLHKDILNQMAF

SEQ ID NO: 1645782 - protein, 18 aa, Staphylococcus aureus
IERRMIKRVIMSILTASS

SEQ ID NO: 1645783 - protein, 24 aa, Staphylococcus aureus
IFDEKRLSKSPAFFDKQKLAWVNN

SEQ ID NO: 1645784 - protein, 21 aa, Staphylococcus aureus
IGADCYLEPSLSASVKIINRF

SEQ ID NO: 1645785 - protein, 17 aa, Staphylococcus aureus
IGKRLFIDHGMGVVIGE

SEQ ID NO: 1645786 - protein, 23 aa, Staphylococcus aureus
IGNARPAINYDVVRRYFEYQGYN

SEQ ID NO: 1645787 - protein, 18 aa, Staphylococcus aureus
IHALIKYYETFKRLNKKL

SEQ ID NO: 1645788 - protein, 18 aa, Staphylococcus aureus
IIGWHPVDAIDFTEEHLE

SEQ ID NO: 1645789 - protein, 17 aa, Staphylococcus aureus
IKAIIVCTQGTSVSQMM

SEQ ID NO: 1645790 - protein, 22 aa, Staphylococcus aureus
IKSEDDSAVAIRSLILHKDEPM

SEQ ID NO: 1645791 - protein, 18 aa, Staphylococcus aureus
ILGATGLSNPMKSFNDLE

SEQ ID NO: 1645792 - protein, 17 aa, Staphylococcus aureus
ILVRRLVEENGVEHEGE

SEQ ID NO: 1645793 - protein, 18 aa, Staphylococcus aureus
IMDEVGVDAARYFLTMRS

SEQ ID NO: 1645794 - protein, 17 aa, Staphylococcus aureus
INDSRYLLIEFPSNEVP

SEQ ID NO: 1645795 - protein, 17 aa, Staphylococcus aureus
INEKWPGTITSIVHRIG

SEQ ID NO: 1645796 - protein, 22 aa, Staphylococcus aureus
IPPEIRPMVQLDGGRFATSDLN

SEQ ID NO: 1645797 - protein, 18 aa, Staphylococcus aureus
IPVSAGLAGGSADAAATL

SEQ ID NO: 1645798 - protein, 24 aa, Staphylococcus aureus
IQKMKEPPAIIFATAHDQYAVQAF

SEQ ID NO: 1645799 - protein, 24 aa, Staphylococcus aureus
IREGLKQIIPWGDYHFNTIYTAKD

SEQ ID NO: 1645800 - protein, 18 aa, Staphylococcus aureus
IRTEAMLFAASRREHLVL

SEQ ID NO: 1645801 - protein, 24 aa, Staphylococcus aureus
ISTMIRQHIKPVLFVINNDGYTVE

SEQ ID NO: 1645802 - protein, 18 aa, Staphylococcus aureus
IVEELKMADFDRAAKVSG

SEQ ID NO: 1645803 - protein, 18 aa, Staphylococcus aureus
IVPIWKKEIWEDGSKWQG

SEQ ID NO: 1645804 - protein, 25 aa, Staphylococcus aureus
IYDAPNCIFVAQFIGSPAMNMLNAT

SEQ ID NO: 1645805 - protein, 20 aa, Staphylococcus aureus
IYSYELIHTFGCKKLIRVGS

SEQ ID NO: 1645806 - protein, 18 aa, Staphylococcus aureus
KAGTVGRIAKFISKSKDT

SEQ ID NO: 1645807 - protein, 18 aa, Staphylococcus aureus
KATTLFGSGWTWLVVNDG

SEQ ID NO: 1645808 - protein, 20 aa, Staphylococcus aureus
KAVNLLEHLAERIANRINSQ

SEQ ID NO: 1645809 - protein, 23 aa, Staphylococcus aureus
KDARRRREILSRKLRIGHSNGKQ

SEQ ID NO: 1645810 - protein, 21 aa, Staphylococcus aureus
KDEHGRLLVAAAIGISKDTDI

SEQ ID NO: 1645811 - protein, 21 aa, Staphylococcus aureus
KDSEIDKVLGLELGADDYVTK

SEQ ID NO: 1645812 - protein, 21 aa, Staphylococcus aureus
KDSRIPMDQKFIFNPYETKSI

SEQ ID NO: 1645813 - protein, 20 aa, Staphylococcus aureus
KFDQMMDWLAGVYINSLNVI

SEQ ID NO: 1645814 - protein, 20 aa, Staphylococcus aureus
KFKISDERIEVIQGGSDRND

SEQ ID NO: 1645815 - protein, 18 aa, Staphylococcus aureus
KGKVLARHIVPYPPGIPI

SEQ ID NO: 1645816 - protein, 24 aa, Staphylococcus aureus
KHESSDEFVMFILRANQDGITLVE

SEQ ID NO: 1645817 - protein, 24 aa, Staphylococcus aureus
KKENRPMFCKMFKTMTKLRKDMNY

SEQ ID NO: 1645818 - protein, 19 aa, Staphylococcus aureus
KKQASFYVACELYKEMAFN

SEQ ID NO: 1645819 - protein, 18 aa, Staphylococcus aureus
KKTIKRSGILKETYPSVF

SEQ ID NO: 1645820 - protein, 31 aa, Staphylococcus aureus
KKWGTPREFSFEPKAHWDIVEELKMADFDRA

SEQ ID NO: 1645821 - protein, 19 aa, Staphylococcus aureus
KKYKVLHEVAGKPMVEHVL

SEQ ID NO: 1645822 - protein, 25 aa, Staphylococcus aureus
KLMDLTEAFAPFVVLAGHASHSHNN

SEQ ID NO: 1645823 - protein, 20 aa, Staphylococcus aureus
KLQSLTIAAVNGFFEDIIHT

SEQ ID NO: 1645824 - protein, 21 aa, Staphylococcus aureus
KNTMVRRAAEKAGIEGLDEFL

SEQ ID NO: 1645825 - protein, 20 aa, Staphylococcus aureus
KPDVMIYLECNYDEVIDRII

SEQ ID NO: 1645826 - protein, 19 aa, Staphylococcus aureus
KPFMMPVEDVFSITGRGTV

SEQ ID NO: 1645827 - protein, 22 aa, Staphylococcus aureus
KPGTDLAWLSAVTKYIIDHDLH

SEQ ID NO: 1645828 - protein, 18 aa, Staphylococcus aureus
KQQHGFIDTVGFDLYSQM

SEQ ID NO: 1645829 - protein, 29 aa, Staphylococcus aureus
KSIAYPRQIAMYLSRELTDFSLPKIGEEF

SEQ ID NO: 1645830 - protein, 24 aa, Staphylococcus aureus
KSRPMDRLLCGDVGYGKTEVAVRA

SEQ ID NO: 1645831 - protein, 23 aa, Staphylococcus aureus
KSYEWFLREGLIEMFRDISPIED

SEQ ID NO: 1645832 - protein, 18 aa, Staphylococcus aureus
KTAGIGIVVEKSFQNGHQ

SEQ ID NO: 1645833 - protein, 20 aa, Staphylococcus aureus
KTLPTTFEFTDIAGIVKGAS

SEQ ID NO: 1645834 - protein, 23 aa, Staphylococcus aureus
KVQRIGIRMADLLEKETFERLLK

SEQ ID NO: 1645835 - protein, 25 aa, Staphylococcus aureus
KVRRKPYSVILFDEIEKAHPDVFNI

SEQ ID NO: 1645836 - protein, 18 aa, Staphylococcus aureus
KVVKRLSKEMSIGVITND

SEQ ID NO: 1645837 - protein, 20 aa, Staphylococcus aureus
KYSPFPEELNRVMVSNIAEL

SEQ ID NO: 1645838 - protein, 36 aa, Staphylococcus aureus
KYTAPNFFLLERIRKAFPDKLILSGFDEMLVQATIS

SEQ ID NO: 1645839 - protein, 17 aa, Staphylococcus aureus
LAPLSHLALALIGEGKV

SEQ ID NO: 1645840 - protein, 17 aa, Staphylococcus aureus
LASELGTAMKGLDINQL

SEQ ID NO: 1645841 - protein, 19 aa, Staphylococcus aureus
LDKLYGFCIQRHITVRDKV

SEQ ID NO: 1645842 - protein, 18 aa, Staphylococcus aureus
LDSEAEIAYIKESMQPPA

SEQ ID NO: 1645843 - protein, 17 aa, Staphylococcus aureus
LEEPPDNTIAILLSTKP

SEQ ID NO: 1645844 - protein, 21 aa, Staphylococcus aureus
LEGALTRLLAYSQLLGKPITT

SEQ ID NO: 1645845 - protein, 22 aa, Staphylococcus aureus
LEREIWQYFTVLPNIQSVGVMG

SEQ ID NO: 1645846 - protein, 18 aa, Staphylococcus aureus
LESAWTRLHIVDAVKEAT

SEQ ID NO: 1645847 - protein, 26 aa, Staphylococcus aureus
LEVACNMCTTSIYLAHTYGCHIQGVD

SEQ ID NO: 1645848 - protein, 17 aa, Staphylococcus aureus
LEYYFDINIKNITQKGN

SEQ ID NO: 1645849 - protein, 19 aa, Staphylococcus aureus
LFNAMVMTPYFPKPDVMIY

SEQ ID NO: 1645850 - protein, 23 aa, Staphylococcus aureus
LGERFKYHRHFFVPDNVGHDGFL

SEQ ID NO: 1645851 - protein, 28 aa, Staphylococcus aureus
LGHYGYNVSSEWMIPKIMEVMNRAPEIM

SEQ ID NO: 1645852 - protein, 19 aa, Staphylococcus aureus
LGIPLTIITESVFARFISS

SEQ ID NO: 1645853 - protein, 22 aa, Staphylococcus aureus
LGQAGVNIMGFCKEFNARTQDQ

SEQ ID NO: 1645854 - protein, 17 aa, Staphylococcus aureus
LHLGMAAKNLGIHVASP

SEQ ID NO: 1645855 - protein, 19 aa, Staphylococcus aureus
LIRSHACGLGEPFSKEVAL

SEQ ID NO: 1645856 - protein, 25 aa, Staphylococcus aureus
LKPALARGELQCIGATTLDEYRKNI

SEQ ID NO: 1645857 - protein, 17 aa, Staphylococcus aureus
LLRGVAREDVQRGQVLA

SEQ ID NO: 1645858 - protein, 19 aa, Staphylococcus aureus
LNGSILPGITRKSIIELAK

SEQ ID NO: 1645859 - protein, 24 aa, Staphylococcus aureus
LNIAKAVRTGRIWINTYNQVPEGA

SEQ ID NO: 1645860 - protein, 24 aa, Staphylococcus aureus
LNIMKSKCLIILTTHHLDEVEALA

SEQ ID NO: 1645861 - protein, 21 aa, Staphylococcus aureus
LNKVGKLIASIYMEEKLDAVV

SEQ ID NO: 1645862 - protein, 24 aa, Staphylococcus aureus
LPEIVEIAEEFGLLTYVDDAHGSG

SEQ ID NO: 1645863 - protein, 27 aa, Staphylococcus aureus
LPKEMALELFKPFVMKELVQREIATNI

SEQ ID NO: 1645864 - protein, 24 aa, Staphylococcus aureus
LPLPKKVFAHGWILMKDGKMSKSK

SEQ ID NO: 1645865 - protein, 18 aa, Staphylococcus aureus
LPLTVLLRALGFSSDQEI

SEQ ID NO: 1645866 - protein, 25 aa, Staphylococcus aureus
LQKDFGLRMKACRVLVNTPSAVGGI

SEQ ID NO: 1645867 - protein, 24 aa, Staphylococcus aureus
LQNFKFNELMVAIQSPFLLDEEDD

SEQ ID NO: 1645868 - protein, 18 aa, Staphylococcus aureus
LRIADFLIPTYSYVSVIE

SEQ ID NO: 1645869 - protein, 24 aa, Staphylococcus aureus
LRRLNYPVLCANIYENDSTLTDNG

SEQ ID NO: 1645870 - protein, 18 aa, Staphylococcus aureus
LRSKCRRLKQEHGLDMIV

SEQ ID NO: 1645871 - protein, 28 aa, Staphylococcus aureus
LSHALDVADEFDVQIALHADTLNEAGFM

SEQ ID NO: 1645872 - protein, 17 aa, Staphylococcus aureus
LTIDREFDRTSDLPVGF

SEQ ID NO: 1645873 - protein, 19 aa, Staphylococcus aureus
LTIITESVFARFISSIKEE

SEQ ID NO: 1645874 - protein, 22 aa, Staphylococcus aureus
LTKDPKYLIGRIIARPYVGEPG

SEQ ID NO: 1645875 - protein, 19 aa, Staphylococcus aureus
LTSLCIGGGQAIAAVVSKY

SEQ ID NO: 1645876 - protein, 26 aa, Staphylococcus aureus
LVMSKLRPLLHYARAKDIDNYRTVEE

SEQ ID NO: 1645877 - protein, 17 aa, Staphylococcus aureus
LYCSTKFAVRGLTQVAA

SEQ ID NO: 1645878 - protein, 19 aa, Staphylococcus aureus
LYKSPRTTYLQTWHGTPLK

SEQ ID NO: 1645879 - protein, 19 aa, Staphylococcus aureus
LYPELPHSDYICFYPMNKR

SEQ ID NO: 1645880 - protein, 26 aa, Staphylococcus aureus
MAALHFDVPCLFAKKAKPSTLTDGYY

SEQ ID NO: 1645881 - protein, 20 aa, Staphylococcus aureus
MAKEIVRFHSIIWPILLMAL

SEQ ID NO: 1645882 - protein, 22 aa, Staphylococcus aureus
MASRGSVIPLFIDKIKAGEPLT

SEQ ID NO: 1645883 - protein, 19 aa, Staphylococcus aureus
MATGLPVIASHVGGISELV

SEQ ID NO: 1645884 - protein, 18 aa, Staphylococcus aureus
MEHYSHYGSAYFIHEDVN

SEQ ID NO: 1645885 - protein, 27 aa, Staphylococcus aureus
MESLQFSVALSTVWKFISRTNKYIDET

SEQ ID NO: 1645886 - protein, 18 aa, Staphylococcus aureus
MFGTCAGLIVLAQDIVGE

SEQ ID NO: 1645887 - protein, 38 aa, Staphylococcus aureus
MGHIELAAPVSHIWYFKGIPSRMGLLLDMSPRALEEVI

SEQ ID NO: 1645888 - protein, 17 aa, Staphylococcus aureus
MGKGAGTVKHFGLQDKI

SEQ ID NO: 1645889 - protein, 25 aa, Staphylococcus aureus
MKQVAINFAKLILCQTDSQCETKVS

SEQ ID NO: 1645890 - protein, 23 aa, Staphylococcus aureus
MPGESGLIALDWHNGNRSVLSDS

SEQ ID NO: 1645891 - protein, 21 aa, Staphylococcus aureus
MRQRVMIAMALILKPQILIAD

SEQ ID NO: 1645892 - protein, 24 aa, Staphylococcus aureus
MSLGRTSTFLDIYAERDLKAGVIT

SEQ ID NO: 1645893 - protein, 17 aa, Staphylococcus aureus
MTATAMMGAMLKGDQKL

SEQ ID NO: 1645894 - protein, 25 aa, Staphylococcus aureus
NAGAIGLKVHEDWGATPSALSHALD

SEQ ID NO: 1645895 - protein, 20 aa, Staphylococcus aureus
NAITKAGALAANYPFATIDP

SEQ ID NO: 1645896 - protein, 24 aa, Staphylococcus aureus
NAKMIRRHPHIFGDANAETIDDLK

SEQ ID NO: 1645897 - protein, 28 aa, Staphylococcus aureus
NEREPSVLPARFPNLLANGASGIAVGMA

SEQ ID NO: 1645898 - protein, 19 aa, Staphylococcus aureus
NFIMSRYQMYWQIYFHPVS

SEQ ID NO: 1645899 - protein, 17 aa, Staphylococcus aureus
NGMICASEQVVVIDKEI

SEQ ID NO: 1645900 - protein, 18 aa, Staphylococcus aureus
NIEYKQAYFKGMFNETCP

SEQ ID NO: 1645901 - protein, 20 aa, Staphylococcus aureus
NIGQVLELHLGMAAKNLGIH

SEQ ID NO: 1645902 - protein, 24 aa, Staphylococcus aureus
NIRYAAVLLRPFLTHAPKEIFEQL

SEQ ID NO: 1645903 - protein, 26 aa, Staphylococcus aureus
NLTVLWSVRLPDNFKTYCAKMSIKTS

SEQ ID NO: 1645904 - protein, 24 aa, Staphylococcus aureus
NNNRFKGIIGLVTMKKVRDPLEVT

SEQ ID NO: 1645905 - protein, 19 aa, Staphylococcus aureus
NNTQIFKVPAQIYFEENAI

SEQ ID NO: 1645906 - protein, 20 aa, Staphylococcus aureus
NQFRIGLSRMERVVRERMSI

SEQ ID NO: 1645907 - protein, 19 aa, Staphylococcus aureus
NRIYGGYSLLLDVNYEAMD

SEQ ID NO: 1645908 - protein, 28 aa, Staphylococcus aureus
NTGIGLAFVCAAKGYKAVFTMPETMSQE

SEQ ID NO: 1645909 - protein, 25 aa, Staphylococcus aureus
NVEMTVELIAPIAIEDGTRFSIREG

SEQ ID NO: 1645910 - protein, 22 aa, Staphylococcus aureus
NVKETLEALLINQYDIIFLDVN

SEQ ID NO: 1645911 - protein, 19 aa, Staphylococcus aureus
PAEYRVCSTNEGLLNIKRT

SEQ ID NO: 1645912 - protein, 32 aa, Staphylococcus aureus
PDSEVKCITPADIIASMSYFFNLLSGIGYTDD

SEQ ID NO: 1645913 - protein, 19 aa, Staphylococcus aureus
PDYETRMAILQKKIEEEKL

SEQ ID NO: 1645914 - protein, 25 aa, Staphylococcus aureus
PEDPRFTDRFELFIVGREHANAFTE

SEQ ID NO: 1645915 - protein, 23 aa, Staphylococcus aureus
PEERLFRKYAHIIRNWDPEKQDK

SEQ ID NO: 1645916 - protein, 17 aa, Staphylococcus aureus
PELPNTIEVLGKEKVLN

SEQ ID NO: 1645917 - protein, 21 aa, Staphylococcus aureus
PERVLPGKILEELVHNNRIIG

SEQ ID NO: 1645918 - protein, 19 aa, Staphylococcus aureus
PETKLTIDREFDRTSDLPV

SEQ ID NO: 1645919 - protein, 20 aa, Staphylococcus aureus
PFVCGCRNLGEAARRIGEGA

SEQ ID NO: 1645920 - protein, 17 aa, Staphylococcus aureus
PKKTLPTTFEFTDIAGI

SEQ ID NO: 1645921 - protein, 33 aa, Staphylococcus aureus
PKQIMIYEAFGWEPPRFGHMSLIVNEERKKLSK

SEQ ID NO: 1645922 - protein, 21 aa, Staphylococcus aureus
PKSQYSGVISKMFDSFEHNKP

SEQ ID NO: 1645923 - protein, 26 aa, Staphylococcus aureus
PLVKDGRLEGLITIKDIEKVIEFPNA

SEQ ID NO: 1645924 - protein, 27 aa, Staphylococcus aureus
PNPLLPEEVRFILKQMGLKEKTIDVEL

SEQ ID NO: 1645925 - protein, 17 aa, Staphylococcus aureus
PPIRAGKETVHRIFEQA

SEQ ID NO: 1645926 - protein, 19 aa, Staphylococcus aureus
PRGLFKVVINNENNMILGA

SEQ ID NO: 1645927 - protein, 21 aa, Staphylococcus aureus
PSEEDLSWGRKLIALYQKEMS

SEQ ID NO: 1645928 - protein, 18 aa, Staphylococcus aureus
PSGCGKSTTLRMVAGLES

SEQ ID NO: 1645929 - protein, 20 aa, Staphylococcus aureus
PSGIFYKDKLAVIGNGVVVD

SEQ ID NO: 1645930 - protein, 21 aa, Staphylococcus aureus
PSLIISFYPGYAVHPDHEATA

SEQ ID NO: 1645931 - protein, 18 aa, Staphylococcus aureus
PSVPESFRVLMKELQSLG

SEQ ID NO: 1645932 - protein, 17 aa, Staphylococcus aureus
PSWMILDVLPIIPPEIR

SEQ ID NO: 1645933 - protein, 19 aa, Staphylococcus aureus
PVEMLLPLHHLMEAGFDVD

SEQ ID NO: 1645934 - protein, 19 aa, Staphylococcus aureus
PYVGKLTFFRVYSGTMTSG

SEQ ID NO: 1645935 - protein, 18 aa, Staphylococcus aureus
QAIHLGGKEGLSIARQLG

SEQ ID NO: 1645936 - protein, 27 aa, Staphylococcus aureus
QAIKEFTELGSGFKIAMRDLNIRGAGN

SEQ ID NO: 1645937 - protein, 22 aa, Staphylococcus aureus
QALLDAIMAWCLNNQIHRIEAN

SEQ ID NO: 1645938 - protein, 24 aa, Staphylococcus aureus
QAMRRRKVPGWGVFTNKALQGGGS

SEQ ID NO: 1645939 - protein, 25 aa, Staphylococcus aureus
QDVKIAIELHAGFLVHTPYTMLKLR

SEQ ID NO: 1645940 - protein, 26 aa, Staphylococcus aureus
QEDLKGSWSVVCFYPADFSFVCPTEL

SEQ ID NO: 1645941 - protein, 30 aa, Staphylococcus aureus
QEVLLPESFYRGAHQHIFRAMMHLNEDNKE

SEQ ID NO: 1645942 - protein, 25 aa, Staphylococcus aureus
QFGGQRFGEMEVWALEAYGAAYTLQ

SEQ ID NO: 1645943 - protein, 18 aa, Staphylococcus aureus
QFLADKFANMRCYTEKVY

SEQ ID NO: 1645944 - protein, 26 aa, Staphylococcus aureus
QFTGVDFPKLFKAFKDMGMTYNIVNI

SEQ ID NO: 1645945 - protein, 18 aa, Staphylococcus aureus
QIHGASFQVFNYVKQQLE

SEQ ID NO: 1645946 - protein, 28 aa, Staphylococcus aureus
QLARHAKRVLAFEIDQRLIPVLNDTLSP

SEQ ID NO: 1645947 - protein, 26 aa, Staphylococcus aureus
QLEDRLRSRFEWGLIVDITPPDYETR

SEQ ID NO: 1645948 - protein, 18 aa, Staphylococcus aureus
QLMMQKIHLHKSLHDNED

SEQ ID NO: 1645949 - protein, 22 aa, Staphylococcus aureus
QPALELFKSADFQIEGVLKDKL

SEQ ID NO: 1645950 - protein, 23 aa, Staphylococcus aureus
QQYAEIIQAILFDVVGYEVKPHF

SEQ ID NO: 1645951 - protein, 20 aa, Staphylococcus aureus
QRFDCVPSQLNYVIKTRFTN

SEQ ID NO: 1645952 - protein, 21 aa, Staphylococcus aureus
RAAKVSGARFVYLTNEGAQLE

SEQ ID NO: 1645953 - protein, 23 aa, Staphylococcus aureus
RDETSLRTGVRVVIDVRKDANAS

SEQ ID NO: 1645954 - protein, 23 aa, Staphylococcus aureus
RDSRTQAILPLRGKILNVEKARL

SEQ ID NO: 1645955 - protein, 19 aa, Staphylococcus aureus
RELTYCSVCGHITENDPCY

SEQ ID NO: 1645956 - protein, 20 aa, Staphylococcus aureus
RGVVKRSALSNFSRINRNGK

SEQ ID NO: 1645957 - protein, 23 aa, Staphylococcus aureus
RISEVLELPNLIEIQTKSYEWFL

SEQ ID NO: 1645958 - protein, 18 aa, Staphylococcus aureus
RLLHLPKKIADMVKDGRL

SEQ ID NO: 1645959 - protein, 26 aa, Staphylococcus aureus
RLSKSRPYIANMLRLLHLPKKIADMV

SEQ ID NO: 1645960 - protein, 18 aa, Staphylococcus aureus
RLTKPLVRKNGEFHEVEW

SEQ ID NO: 1645961 - protein, 17 aa, Staphylococcus aureus
RMFEYGGGFVQDRSIYE

SEQ ID NO: 1645962 - protein, 20 aa, Staphylococcus aureus
RMKGMIRGSDAFIFESNHDV

SEQ ID NO: 1645963 - protein, 26 aa, Staphylococcus aureus
RPAENFKEAVQWLYLAYLAAIKEQNG

SEQ ID NO: 1645964 - protein, 17 aa, Staphylococcus aureus
RPDEKRVTERAYENPRF

SEQ ID NO: 1645965 - protein, 20 aa, Staphylococcus aureus
RSCLNDCYDKVSSIYDHLVK

SEQ ID NO: 1645966 - protein, 30 aa, Staphylococcus aureus
RTTGFDGWAPLFFRGREVSGKTIGIIGLGE

SEQ ID NO: 1645967 - protein, 18 aa, Staphylococcus aureus
RVTERAYENPRFVEDLIR

SEQ ID NO: 1645968 - protein, 20 aa, Staphylococcus aureus
RWYAVHTYSGYENKVKKNLE

SEQ ID NO: 1645969 - protein, 23 aa, Staphylococcus aureus
SAKTGEGGKLFGSVSTKQIAEAL

SEQ ID NO: 1645970 - protein, 25 aa, Staphylococcus aureus
SDLIKRIDTHLSIDFMDVSSYHGGT

SEQ ID NO: 1645971 - protein, 25 aa, Staphylococcus aureus
SDMKQPVWIRHVLVPGYSDDKDDLI

SEQ ID NO: 1645972 - protein, 22 aa, Staphylococcus aureus
SFKEMQEEMGVAYLTEVVVNEV

SEQ ID NO: 1645973 - protein, 23 aa, Staphylococcus aureus
SFNRLKYSLKPVVTAVQGRALGG

SEQ ID NO: 1645974 - protein, 21 aa, Staphylococcus aureus
SGACGRLMCCLKYENDYYEEV

SEQ ID NO: 1645975 - protein, 24 aa, Staphylococcus aureus
SGILKETYPSVFIVELDQDKHNFE

SEQ ID NO: 1645976 - protein, 26 aa, Staphylococcus aureus
SIEPGKLADIVLWDPIFFGVKPELVV

SEQ ID NO: 1645977 - protein, 17 aa, Staphylococcus aureus
SIIKMLGTDQFKRIRIG

SEQ ID NO: 1645978 - protein, 17 aa, Staphylococcus aureus
SKIGTDIPFCIYNKTAL

SEQ ID NO: 1645979 - protein, 20 aa, Staphylococcus aureus
SNLKALGFVPKYTVETGLKD

SEQ ID NO: 1645980 - protein, 25 aa, Staphylococcus aureus
SNQLLPGVITKIGLNTAVDPRYGGG

SEQ ID NO: 1645981 - protein, 24 aa, Staphylococcus aureus
SQFDNLKWLGLDWDESVDKDNGYG

SEQ ID NO: 1645982 - protein, 21 aa, Staphylococcus aureus
SRFGHSLGVYEIVRRLIDESF

SEQ ID NO: 1645983 - protein, 22 aa, Staphylococcus aureus
SRNVGVPALVVFLNKVDMVDDE

SEQ ID NO: 1645984 - protein, 21 aa, Staphylococcus aureus
STPMFHVLGFNDTVLPVLMSG

SEQ ID NO: 1645985 - protein, 24 aa, Staphylococcus aureus
STTLRRLMNLYGFKEALQNSTLPM

SEQ ID NO: 1645986 - protein, 19 aa, Staphylococcus aureus
SVLIELGLIVGKDARRRRE

SEQ ID NO: 1645987 - protein, 23 aa, Staphylococcus aureus
TEFYYRMIRMGLKGNVTTDSHLM

SEQ ID NO: 1645988 - protein, 21 aa, Staphylococcus aureus
TESKMAIAMARQGGLGVIHKN

SEQ ID NO: 1645989 - protein, 25 aa, Staphylococcus aureus
TETVWRQATTYGVPRIVFVNKMDKL

SEQ ID NO: 1645990 - protein, 17 aa, Staphylococcus aureus
TEYCGVCHTDLHVKNAD

SEQ ID NO: 1645991 - protein, 24 aa, Staphylococcus aureus
TFGCKKLIRVGSCGAMQENIDLYD

SEQ ID NO: 1645992 - protein, 22 aa, Staphylococcus aureus
TGRETLCRSVKNAGYTVDGAMA

SEQ ID NO: 1645993 - protein, 29 aa, Staphylococcus aureus
TLYMRIAIELHLKRLIVGGLEKVYEIGRV

SEQ ID NO: 1645994 - protein, 21 aa, Staphylococcus aureus
TNGHAILLLHSFTGTNRDVKH

SEQ ID NO: 1645995 - protein, 23 aa, Staphylococcus aureus
TNVTVICAGAKSILDLPKTMEYL

SEQ ID NO: 1645996 - protein, 25 aa, Staphylococcus aureus
TPHFKLMFEEGYRALLPNPLGQTVE

SEQ ID NO: 1645997 - protein, 19 aa, Staphylococcus aureus
TQIATLFLIDIVSYHLLEN

SEQ ID NO: 1645998 - protein, 18 aa, Staphylococcus aureus
TQLAGMRGLMAAPSGKII

SEQ ID NO: 1645999 - protein, 23 aa, Staphylococcus aureus
TRAIKRLEVVESFRNSGNKPSWM

SEQ ID NO: 1646000 - protein, 25 aa, Staphylococcus aureus
TRPEAIKMAPLVKEIDHNGNFEANI

SEQ ID NO: 1646001 - protein, 25 aa, Staphylococcus aureus
TTASERWMRMGILGVEMESAALYMN

SEQ ID NO: 1646002 - protein, 27 aa, Staphylococcus aureus
TTMPIKLNHIIKFSCKPVQQFYGQYDI

SEQ ID NO: 1646003 - protein, 19 aa, Staphylococcus aureus
TTPYDLKVANAIIQGDIAD

SEQ ID NO: 1646004 - protein, 22 aa, Staphylococcus aureus
TVKKTFPGYVLVELIMTDESWY

SEQ ID NO: 1646005 - protein, 18 aa, Staphylococcus aureus
TVRIYKPWLTAHQLSLPK

SEQ ID NO: 1646006 - protein, 18 aa, Staphylococcus aureus
TVVEKGIMAARARVAAKK

SEQ ID NO: 1646007 - protein, 23 aa, Staphylococcus aureus
VAKIPYDCCKDGISNTFSIVPKS

SEQ ID NO: 1646008 - protein, 23 aa, Staphylococcus aureus
VAPARAMGMVSVWYKQEDAEIEP

SEQ ID NO: 1646009 - protein, 23 aa, Staphylococcus aureus
VDDIAVDLVERFMTKLRSHKTYR

SEQ ID NO: 1646010 - protein, 17 aa, Staphylococcus aureus
VEDVFSITGRGTVATGR

SEQ ID NO: 1646011 - protein, 23 aa, Staphylococcus aureus
VEKLSRLRPAFKKDGTVTAGNAS

SEQ ID NO: 1646012 - protein, 17 aa, Staphylococcus aureus
VGEVITRTWQVAHRMKE

SEQ ID NO: 1646013 - protein, 23 aa, Staphylococcus aureus
VHECREAGYPCYFTMDAGPNVKI

SEQ ID NO: 1646014 - protein, 19 aa, Staphylococcus aureus
VIDLLASFEHKPVYLHVET

SEQ ID NO: 1646015 - protein, 24 aa, Staphylococcus aureus
VIGPGNRFPHAASLAVAEAPAKAY

SEQ ID NO: 1646016 - protein, 20 aa, Staphylococcus aureus
VINGEKKWIGGAHVSDVIPV

SEQ ID NO: 1646017 - protein, 18 aa, Staphylococcus aureus
VITPELNGSILPGITRKS

SEQ ID NO: 1646018 - protein, 18 aa, Staphylococcus aureus
VIVCDEAVSALDVSIQKD

SEQ ID NO: 1646019 - protein, 23 aa, Staphylococcus aureus
VKADIGIKNGYIFAIGNAGNPDI

SEQ ID NO: 1646020 - protein, 17 aa, Staphylococcus aureus
VLSFKLATSSVRDETQI

SEQ ID NO: 1646021 - protein, 24 aa, Staphylococcus aureus
VQKRKIHVGDKMCGRHGNKGVISK

SEQ ID NO: 1646022 - protein, 18 aa, Staphylococcus aureus
VRKNGEFHEVEWDEALNV

SEQ ID NO: 1646023 - protein, 21 aa, Staphylococcus aureus
VRMPHDRAWDFIYNNGVSVAY

SEQ ID NO: 1646024 - protein, 18 aa, Staphylococcus aureus
VRQLQFFINERIIPIIPQ

SEQ ID NO: 1646025 - protein, 17 aa, Staphylococcus aureus
VSRLIKRRTLAKEVSDQ

SEQ ID NO: 1646026 - protein, 27 aa, Staphylococcus aureus
VVGLKEVSEGFIWYNELPLSLFKDDEL

SEQ ID NO: 1646027 - protein, 17 aa, Staphylococcus aureus
VVTDHGTEIGIRLKQPI

SEQ ID NO: 1646028 - protein, 17 aa, Staphylococcus aureus
WLAGVYINSLNVIHYMH

SEQ ID NO: 1646029 - protein, 19 aa, Staphylococcus aureus
WLDSLKFLVKCIEESMRIS

SEQ ID NO: 1646030 - protein, 18 aa, Staphylococcus aureus
WRQPFPGPGLGIRVLGEI

SEQ ID NO: 1646031 - protein, 22 aa, Staphylococcus aureus
WVTESIGGVGIDGRPLVTKNSF

SEQ ID NO: 1646032 - protein, 19 aa, Staphylococcus aureus
YAHARICSILKQAKEQGIE

SEQ ID NO: 1646033 - protein, 25 aa, Staphylococcus aureus
YATWKFSGLPKERVIGSGTILDSAR

SEQ ID NO: 1646034 - protein, 17 aa, Staphylococcus aureus
YDMKELAAILSEASGTE

SEQ ID NO: 1646035 - protein, 28 aa, Staphylococcus aureus
YEDISKWSFQTEMFFLCNRYKQFQDVTQ

SEQ ID NO: 1646036 - protein, 18 aa, Staphylococcus aureus
YGARPLIRAIQKTIEDNL

SEQ ID NO: 1646037 - protein, 21 aa, Staphylococcus aureus
YIKRLPVSTYRAQNRGGRGVQ

SEQ ID NO: 1646038 - protein, 26 aa, Staphylococcus aureus
YILFTQGCLLRCLYCHNPDTWKISEP

SEQ ID NO: 1646039 - protein, 18 aa, Staphylococcus aureus
YKHPKLGQSTGFDYTRTK

SEQ ID NO: 1646040 - protein, 18 aa, Staphylococcus aureus
YKHYEIADKVGFSEYKMF

SEQ ID NO: 1646041 - protein, 26 aa, Staphylococcus aureus
YKRVRYKGMVCDRCGVEVTKSKVRRE

SEQ ID NO: 1646042 - protein, 25 aa, Staphylococcus aureus
YKVNFPVTLGHEFSGEIVEVGADVK

SEQ ID NO: 1646043 - protein, 19 aa, Staphylococcus aureus
YLVTWNIPEGITMDQYLAR

SEQ ID NO: 1646044 - protein, 23 aa, Staphylococcus aureus
YTYFLPDIAYHFDKVKRGNDILI

SEQ ID NO: 1646045 - protein, 19 aa, Staphylococcus aureus
YVQTGRAFFKLKVQGKGGH

SEQ ID NO: 1646046 - protein, 23 aa, Staphylococcus aureus
YVTEFPLTIMVNGEEFATVICSP

SEQ ID NO: 1646047 - protein, 19 aa, Staphylococcus aureus
YYNVRIEDFSAKKRTKSIA

SEQ ID NO: 1646048 - protein, 19 aa, Staphylococcus aureus
AAEKAGIEGLDEFLTGPTA

SEQ ID NO: 1646049 - protein, 28 aa, Staphylococcus aureus
AASRLQLPVNIVGVLACAENMINEASMK

SEQ ID NO: 1646050 - protein, 21 aa, Staphylococcus aureus
ADILRANGFKVFGPNKQAAQI

SEQ ID NO: 1646051 - protein, 17 aa, Staphylococcus aureus
ADLGVKYVVIGHSERRE

SEQ ID NO: 1646052 - protein, 21 aa, Staphylococcus aureus
ADLTIGLVLAVARRIVEGDQL

SEQ ID NO: 1646053 - protein, 19 aa, Staphylococcus aureus
AEAAHIIPIVRVTAVIDRD

SEQ ID NO: 1646054 - protein, 25 aa, Staphylococcus aureus
AEEAGKPEAWGWEQFTSQIALGRVS

SEQ ID NO: 1646055 - protein, 19 aa, Staphylococcus aureus
AEIQIRTLAMNFWATIEHT

SEQ ID NO: 1646056 - protein, 24 aa, Staphylococcus aureus
AENYLKSSYFRSSGHDGFMQDFVL

SEQ ID NO: 1646057 - protein, 17 aa, Staphylococcus aureus
AGAYGGEVKDCIDYALC

SEQ ID NO: 1646058 - protein, 19 aa, Staphylococcus aureus
AGIKFPDDNLLGIDYVIPD

SEQ ID NO: 1646059 - protein, 17 aa, Staphylococcus aureus
AGINHWFNSDTIYRSIL

SEQ ID NO: 1646060 - protein, 20 aa, Staphylococcus aureus
AGLDTSRKAILTAVNIMHEK

SEQ ID NO: 1646061 - protein, 19 aa, Staphylococcus aureus
AGNMLKPMLARGELHCIGA

SEQ ID NO: 1646062 - protein, 26 aa, Staphylococcus aureus
AGRARRGELVSCFLLEVDDSLNSINF

SEQ ID NO: 1646063 - protein, 25 aa, Staphylococcus aureus
AHAIFKHGMTPIICVGETDEERESG

SEQ ID NO: 1646064 - protein, 18 aa, Staphylococcus aureus
AIANLKDAITIIGGGDSA

SEQ ID NO: 1646065 - protein, 18 aa, Staphylococcus aureus
AIGRELLLDYQFVEKIKD

SEQ ID NO: 1646066 - protein, 28 aa, Staphylococcus aureus
AKAGIDVFRIFDSLNWVDQMKVANEAVQ

SEQ ID NO: 1646067 - protein, 19 aa, Staphylococcus aureus
AKDRAHILEGLRIALDHID

SEQ ID NO: 1646068 - protein, 27 aa, Staphylococcus aureus
AKVGGRLPGGIKIKRAKLRGERSEGMI

SEQ ID NO: 1646069 - protein, 20 aa, Staphylococcus aureus
ALEKEDYILPGYRDVPQIIW

SEQ ID NO: 1646070 - protein, 32 aa, Staphylococcus aureus
ALEKEHPEGIYLSGALLMFAGSKSYYLYGASS

SEQ ID NO: 1646071 - protein, 19 aa, Staphylococcus aureus
ANLKTVMIERGIPGGQMAN

SEQ ID NO: 1646072 - protein, 18 aa, Staphylococcus aureus
ANSCMKNDGAVLLLIMEK

SEQ ID NO: 1646073 - protein, 19 aa, Staphylococcus aureus
APFANYWMHNGFINIDNEK

SEQ ID NO: 1646074 - protein, 17 aa, Staphylococcus aureus
APTNIIPGLDFSPDKML

SEQ ID NO: 1646075 - protein, 20 aa, Staphylococcus aureus
AQARGANIYAEIVGYGTTGD

SEQ ID NO: 1646076 - protein, 26 aa, Staphylococcus aureus
AQELREILASLGLKRVEDLVGRTDLL

SEQ ID NO: 1646077 - protein, 25 aa, Staphylococcus aureus
AQNDFLFDRVKVVVATNAFGMGIDK

SEQ ID NO: 1646078 - protein, 21 aa, Staphylococcus aureus
ARKQVLVDHGFRLPSALDNRP

SEQ ID NO: 1646079 - protein, 25 aa, Staphylococcus aureus
ASYRLSEVKLGIDLNYIELQNFKFN

SEQ ID NO: 1646080 - protein, 18 aa, Staphylococcus aureus
ATGIRIGFLLGPQYLIDK

SEQ ID NO: 1646081 - protein, 18 aa, Staphylococcus aureus
ATGMSRPFLNQVENNGIA

SEQ ID NO: 1646082 - protein, 17 aa, Staphylococcus aureus
AVLSFGMIQAGTTDSVI

SEQ ID NO: 1646083 - protein, 27 aa, Staphylococcus aureus
AVSAKRLKIPVFHMEAGNRCFDQNVPE

SEQ ID NO: 1646084 - protein, 32 aa, Staphylococcus aureus
AVVAWNFPMLLAAWKIAPAIAAGNTIVIQPSS

SEQ ID NO: 1646085 - protein, 21 aa, Staphylococcus aureus
AVYELGQSVGIEMNLKSQGVS

SEQ ID NO: 1646086 - protein, 18 aa, Staphylococcus aureus
AYLTMLFGGSLRRQDENF

SEQ ID NO: 1646087 - protein, 18 aa, Staphylococcus aureus
AYVKLWKHHGAYKEAEKL

SEQ ID NO: 1646088 - protein, 18 aa, Staphylococcus aureus
CNHYDIPTPLKSYHEHNK

SEQ ID NO: 1646089 - protein, 20 aa, Staphylococcus aureus
CPAPCESACVMKINRESIAI

SEQ ID NO: 1646090 - protein, 19 aa, Staphylococcus aureus
CQHVYFKPIDKEKFINRLV

SEQ ID NO: 1646091 - protein, 17 aa, Staphylococcus aureus
CTSCRKAKAWLQEHDIP

SEQ ID NO: 1646092 - protein, 18 aa, Staphylococcus aureus
DAHVRYTTIQNWANNVYN

SEQ ID NO: 1646093 - protein, 18 aa, Staphylococcus aureus
DALPGLGHACGHNIIGTA

SEQ ID NO: 1646094 - protein, 20 aa, Staphylococcus aureus
DASFSYRLVGACGLDSMRVA

SEQ ID NO: 1646095 - protein, 24 aa, Staphylococcus aureus
DAVNFRADLGIKMEALNGQKLKHV

SEQ ID NO: 1646096 - protein, 21 aa, Staphylococcus aureus
DDIDLAVGIVLNKKIGDKVEE

SEQ ID NO: 1646097 - protein, 19 aa, Staphylococcus aureus
DDIVLFKPLSIDDMSMIVD

SEQ ID NO: 1646098 - protein, 17 aa, Staphylococcus aureus
DDNLLGIDYVIPDYTYL

SEQ ID NO: 1646099 - protein, 24 aa, Staphylococcus aureus
DDVEYKEHIGVVFDDLRVPNKLTI

SEQ ID NO: 1646100 - protein, 18 aa, Staphylococcus aureus
DDYRVCLDHMKPDKPFIK

SEQ ID NO: 1646101 - protein, 19 aa, Staphylococcus aureus
DEIICVFDAYDQSGVEREY

SEQ ID NO: 1646102 - protein, 28 aa, Staphylococcus aureus
DEVKDMYRRVNFLFGDIVKVTPSSKVVG

SEQ ID NO: 1646103 - protein, 25 aa, Staphylococcus aureus
DEYDEGYILNWLVSKSNEYDMEPLI

SEQ ID NO: 1646104 - protein, 18 aa, Staphylococcus aureus
DGLKGTSIHLDFPSVGAT

SEQ ID NO: 1646105 - protein, 29 aa, Staphylococcus aureus
DGRFLNVGENLWGLRDWYSVDDIEEKIAP

SEQ ID NO: 1646106 - protein, 21 aa, Staphylococcus aureus
DIAEVIAGWTGIPLTKINETE

SEQ ID NO: 1646107 - protein, 17 aa, Staphylococcus aureus
DIIEDVNKIYGLDHKQV

SEQ ID NO: 1646108 - protein, 26 aa, Staphylococcus aureus
DIIELLKQLQLDFGITYLFITHDMGV

SEQ ID NO: 1646109 - protein, 24 aa, Staphylococcus aureus
DIQLRLKGYPAIVFQHEIDHLNGV

SEQ ID NO: 1646110 - protein, 24 aa, Staphylococcus aureus
DISRPGLEMAGYFSHYASDRIQLL

SEQ ID NO: 1646111 - protein, 19 aa, Staphylococcus aureus
DKETLRYGENPQQSAYFVR

SEQ ID NO: 1646112 - protein, 21 aa, Staphylococcus aureus
DKIRIKEFVQDVAKYDEVYGL

SEQ ID NO: 1646113 - protein, 27 aa, Staphylococcus aureus
DKNTSRIYAKFGKEIYVAAKSGEPNPE

SEQ ID NO: 1646114 - protein, 34 aa, Staphylococcus aureus
DKTIDQICHCLKRSETIFIYGFGASFVVATDLYQ

SEQ ID NO: 1646115 - protein, 19 aa, Staphylococcus aureus
DLETFFAYFQTLAVSVNLY

SEQ ID NO: 1646116 - protein, 24 aa, Staphylococcus aureus
DLNITIPVAIHLDHGSSFEKCKEA

SEQ ID NO: 1646117 - protein, 22 aa, Staphylococcus aureus
DLSLNVRRIFFSTYDRSCLNDC

SEQ ID NO: 1646118 - protein, 23 aa, Staphylococcus aureus
DLVGLDIAVSVIKGMQQVPEETP

SEQ ID NO: 1646119 - protein, 20 aa, Staphylococcus aureus
DMVDRILFNNSLKYYMNEHP

SEQ ID NO: 1646120 - protein, 17 aa, Staphylococcus aureus
DPLKLLIKYEGFTGHDI

SEQ ID NO: 1646121 - protein, 22 aa, Staphylococcus aureus
DQLPTRGAIIYAISPKPKDAPG

SEQ ID NO: 1646122 - protein, 18 aa, Staphylococcus aureus
DRKARSREPITAKLVANL

SEQ ID NO: 1646123 - protein, 24 aa, Staphylococcus aureus
DSGERVWVKFHFRTQQGIENLTDE

SEQ ID NO: 1646124 - protein, 22 aa, Staphylococcus aureus
DSHYRLYGIFLLDQLNGKEIVM

SEQ ID NO: 1646125 - protein, 24 aa, Staphylococcus aureus
DSYIPYPVEVEVGGATVFVMPVDA

SEQ ID NO: 1646126 - protein, 24 aa, Staphylococcus aureus
DTKVFRGKRPFTFTNLKTDEGLDE

SEQ ID NO: 1646127 - protein, 20 aa, Staphylococcus aureus
DTRAVFKIGGIGLAFKKGKF

SEQ ID NO: 1646128 - protein, 24 aa, Staphylococcus aureus
DYIGMPAVCFTEPELATVGYSEAQ

SEQ ID NO: 1646129 - protein, 18 aa, Staphylococcus aureus
DYTLVSLLTKGGEEASLS

SEQ ID NO: 1646130 - protein, 19 aa, Staphylococcus aureus
EAKEWMLKALEPMGEEYLN

SEQ ID NO: 1646131 - protein, 17 aa, Staphylococcus aureus
EAQRVALARALSTKPDL

SEQ ID NO: 1646132 - protein, 23 aa, Staphylococcus aureus
EATRILTERGILLVPDVLASAGG

SEQ ID NO: 1646133 - protein, 17 aa, Staphylococcus aureus
EDSLKRIDINPLGAAAL

SEQ ID NO: 1646134 - protein, 18 aa, Staphylococcus aureus
EDVAEGIAQIQVMYDPGL

SEQ ID NO: 1646135 - protein, 18 aa, Staphylococcus aureus
EDYIHTFGGTVITVSHDR

SEQ ID NO: 1646136 - protein, 25 aa, Staphylococcus aureus
EEIAKRYGLRSGVGLAAPQINISKR

SEQ ID NO: 1646137 - protein, 20 aa, Staphylococcus aureus
EEIEDLFLGLGYEIVNGYEV

SEQ ID NO: 1646138 - protein, 19 aa, Staphylococcus aureus
EEKETLIAMREFLVNSQDE

SEQ ID NO: 1646139 - protein, 22 aa, Staphylococcus aureus
EELFKKYFASVVPAADNKFAAL

SEQ ID NO: 1646140 - protein, 18 aa, Staphylococcus aureus
EELPNIWEDLGMRSASAY

SEQ ID NO: 1646141 - protein, 18 aa, Staphylococcus aureus
EEPHLKYKSDKIVANYHK

SEQ ID NO: 1646142 - protein, 25 aa, Staphylococcus aureus
EEVENFPGFEMITGPDLSTKMFEHA

SEQ ID NO: 1646143 - protein, 25 aa, Staphylococcus aureus
EFACGIPGSIGGAVYMNAGAYGGEV

SEQ ID NO: 1646144 - protein, 22 aa, Staphylococcus aureus
EFGHSAHSYFSRKFQPSNSSDY

SEQ ID NO: 1646145 - protein, 18 aa, Staphylococcus aureus
EFSKRLKDEGVYVKSIVF

SEQ ID NO: 1646146 - protein, 24 aa, Staphylococcus aureus
EGDEAKEYWLCWVTTERNEQGPYY

SEQ ID NO: 1646147 - protein, 24 aa, Staphylococcus aureus
EGFELPDMGLVVITERELFKSKQK

SEQ ID NO: 1646148 - protein, 25 aa, Staphylococcus aureus
EGTMPQTRFVLKKALEQNLKPVVVV

SEQ ID NO: 1646149 - protein, 19 aa, Staphylococcus aureus
EIADKVGFSEYKMFSYHFK

SEQ ID NO: 1646150 - protein, 21 aa, Staphylococcus aureus
EIEGRTAIIIDDIIDTAGTIT

SEQ ID NO: 1646151 - protein, 25 aa, Staphylococcus aureus
EIGKQTEMFARFSTVAGERGAADAE

SEQ ID NO: 1646152 - protein, 20 aa, Staphylococcus aureus
EIISRLTFLNNVGLEYLTLN

SEQ ID NO: 1646153 - protein, 18 aa, Staphylococcus aureus
EILNRMDDIVLFKPLSID

SEQ ID NO: 1646154 - protein, 32 aa, Staphylococcus aureus
EKDQERFFGLHFFNPPRIMKLVELIPTSHTKE

SEQ ID NO: 1646155 - protein, 20 aa, Staphylococcus aureus
EKEKFEFTTEGTWQQRQSNF

SEQ ID NO: 1646156 - protein, 22 aa, Staphylococcus aureus
EKGVHRLVRISPFDSSGRRHTS

SEQ ID NO: 1646157 - protein, 19 aa, Staphylococcus aureus
ELIDDLSLEYNRARQAEIT

SEQ ID NO: 1646158 - protein, 24 aa, Staphylococcus aureus
ELNGLKIPHTYALQNSNDYLEIME

SEQ ID NO: 1646159 - protein, 17 aa, Staphylococcus aureus
ELPELVKQRMKPMPNNY

SEQ ID NO: 1646160 - protein, 21 aa, Staphylococcus aureus
ELRAQRILQDRAFKNDKIDFI

SEQ ID NO: 1646161 - protein, 17 aa, Staphylococcus aureus
EMKCFKYTNDLGTEIEE

SEQ ID NO: 1646162 - protein, 24 aa, Staphylococcus aureus
ENKGKIALFAGIDKCRFKRQVVPG

SEQ ID NO: 1646163 - protein, 18 aa, Staphylococcus aureus
ENNNKWLGHYGYNVSSEW

SEQ ID NO: 1646164 - protein, 21 aa, Staphylococcus aureus
ENRFMHVAEFKRMNANINVEG

SEQ ID NO: 1646165 - protein, 21 aa, Staphylococcus aureus
ENVKFADNWLAPNPGSDAAIA

SEQ ID NO: 1646166 - protein, 22 aa, Staphylococcus aureus
EPEGIAAKVLESFNITEDKVIE

SEQ ID NO: 1646167 - protein, 23 aa, Staphylococcus aureus
EQPDLLSMMSFDGKLFSAKFAEL

SEQ ID NO: 1646168 - protein, 23 aa, Staphylococcus aureus
ERHKGSMPHELYLRLKKHIKNGR

SEQ ID NO: 1646169 - protein, 23 aa, Staphylococcus aureus
ESFEGVKRGRIVTKQDLTINGYD

SEQ ID NO: 1646170 - protein, 25 aa, Staphylococcus aureus
ESFLDYAMSVIVARALPDVRDGLKP

SEQ ID NO: 1646171 - protein, 24 aa, Staphylococcus aureus
ESGDAPLLVKYLWDNLTDAPHGIV

SEQ ID NO: 1646172 - protein, 24 aa, Staphylococcus aureus
ESKRPSVQIGDPFVGKKLMEATLE

SEQ ID NO: 1646173 - protein, 32 aa, Staphylococcus aureus
ESLKIGDRVSIAWMFESCGRCEYCTTGRETLC

SEQ ID NO: 1646174 - protein, 20 aa, Staphylococcus aureus
ETPSNPLLRVTDIKKSAEIA

SEQ ID NO: 1646175 - protein, 25 aa, Staphylococcus aureus
EVDERAKAGLFLAMQYPSEITGVTN

SEQ ID NO: 1646176 - protein, 35 aa, Staphylococcus aureus
EVDVSCFKCKGKGCNVCKHTGWIEILGAGMVHPNV

SEQ ID NO: 1646177 - protein, 24 aa, Staphylococcus aureus
EVIERLRPFLLRDGGDCSLIDVED

SEQ ID NO: 1646178 - protein, 33 aa, Staphylococcus aureus
EVRPERRTTLGLRWLVNYARLRGEKTMEDRLAN

SEQ ID NO: 1646179 - protein, 23 aa, Staphylococcus aureus
EVSSHGLVLGRLRGVEFDVAIFS

SEQ ID NO: 1646180 - protein, 27 aa, Staphylococcus aureus
EYGIPHGRANAILLPHIIRYNAKDPQK

SEQ ID NO: 1646181 - protein, 25 aa, Staphylococcus aureus
FAAGDARRGQSLVVWAIKEGRGVAK

SEQ ID NO: 1646182 - protein, 18 aa, Staphylococcus aureus
FDDLRVPNKLTIKDIDKV

SEQ ID NO: 1646183 - protein, 17 aa, Staphylococcus aureus
FEDELNHWAESNATELL

SEQ ID NO: 1646184 - protein, 17 aa, Staphylococcus aureus
FEIGNVFFANGEGELPD

SEQ ID NO: 1646185 - protein, 18 aa, Staphylococcus aureus
FELTELNAQKGLYINGPA

SEQ ID NO: 1646186 - protein, 24 aa, Staphylococcus aureus
FFELACAMSGYQLGVNPFNQPGVE

SEQ ID NO: 1646187 - protein, 27 aa, Staphylococcus aureus
FFFEEGKRAVLLLHGFTGNSSDVRQLG

SEQ ID NO: 1646188 - protein, 22 aa, Staphylococcus aureus
FGACPTCDGLGQKLTVDVDLVV

SEQ ID NO: 1646189 - protein, 25 aa, Staphylococcus aureus
FGVLKRPQIFYAYDLDKYGDELRGF

SEQ ID NO: 1646190 - protein, 26 aa, Staphylococcus aureus
FKEEKRCPSCHMTLKDIAHVGKFGCA

SEQ ID NO: 1646191 - protein, 20 aa, Staphylococcus aureus
FKKAEHDLLTMIKHGVLAVE

SEQ ID NO: 1646192 - protein, 17 aa, Staphylococcus aureus
FKQSRLDRTLPKLDNLF

SEQ ID NO: 1646193 - protein, 22 aa, Staphylococcus aureus
FKVSPTHFVKSWLLDARAPKVE

SEQ ID NO: 1646194 - protein, 25 aa, Staphylococcus aureus
FNCPEFTSLCPITGQPDFATIYISY

SEQ ID NO: 1646195 - protein, 23 aa, Staphylococcus aureus
FNDYPVEVARLLDIVEIKVHALH

SEQ ID NO: 1646196 - protein, 18 aa, Staphylococcus aureus
FNEIIIATPAQWISHTQD

SEQ ID NO: 1646197 - protein, 17 aa, Staphylococcus aureus
FPKQEEWIMTHENQFES

SEQ ID NO: 1646198 - protein, 25 aa, Staphylococcus aureus
FQFADAAYILLDFHVSIFDDSQIDI

SEQ ID NO: 1646199 - protein, 19 aa, Staphylococcus aureus
FQFDETFMMYLPRLCEHCL

SEQ ID NO: 1646200 - protein, 29 aa, Staphylococcus aureus
FSESHACPICGFSIGELEPRMFSFNSPFG

SEQ ID NO: 1646201 - protein, 22 aa, Staphylococcus aureus
FSETSREGFLLAQDISSYSLTI

SEQ ID NO: 1646202 - protein, 19 aa, Staphylococcus aureus
FVDDDVLCIEYSYYHKEIV

SEQ ID NO: 1646203 - protein, 21 aa, Staphylococcus aureus
FVRYHGRNHYGWTKKDMSDQE

SEQ ID NO: 1646204 - protein, 20 aa, Staphylococcus aureus
FYDMSVGICHNGNLINAKSL

SEQ ID NO: 1646205 - protein, 32 aa, Staphylococcus aureus
FYQRVPILGVCLGFQCIVSYFGGNIIHGYHPV

SEQ ID NO: 1646206 - protein, 24 aa, Staphylococcus aureus
GAHTVVWNGPMGVFEFSNFAQGTI

SEQ ID NO: 1646207 - protein, 26 aa, Staphylococcus aureus
GAKGKRFALPNAEVMIHQPLGGAQGQ

SEQ ID NO: 1646208 - protein, 21 aa, Staphylococcus aureus
GAKLRKGLNALQTFLYSSEFN

SEQ ID NO: 1646209 - protein, 21 aa, Staphylococcus aureus
GAKNIRFMCLIAAPEGVEKMH

SEQ ID NO: 1646210 - protein, 19 aa, Staphylococcus aureus
GARPLKRFVQRQIETPLAR

SEQ ID NO: 1646211 - protein, 17 aa, Staphylococcus aureus
GATIGIIGGGQLGKMMA

SEQ ID NO: 1646212 - protein, 26 aa, Staphylococcus aureus
GCLTHCGICSAGLYALVNGDIVEGDS

SEQ ID NO: 1646213 - protein, 28 aa, Staphylococcus aureus
GDEAAIFAGDLMRMYSKYAESQGFKTEI

SEQ ID NO: 1646214 - protein, 24 aa, Staphylococcus aureus
GDFALKLSLNRDVKGIVTMCAPMG

SEQ ID NO: 1646215 - protein, 22 aa, Staphylococcus aureus
GDGCGECPACHLRQRGLNQYLE

SEQ ID NO: 1646216 - protein, 20 aa, Staphylococcus aureus
GDGNLGYITAILLRKLYPES

SEQ ID NO: 1646217 - protein, 25 aa, Staphylococcus aureus
GDMTYGLADMEVFDYITPEFLIKRS

SEQ ID NO: 1646218 - protein, 18 aa, Staphylococcus aureus
GDRYLRTIMTFLGVPSYE

SEQ ID NO: 1646219 - protein, 19 aa, Staphylococcus aureus
GDTELPVWSHANIAGQPLK

SEQ ID NO: 1646220 - protein, 21 aa, Staphylococcus aureus
GDTFLMCTIISFKTFEIKETV

SEQ ID NO: 1646221 - protein, 19 aa, Staphylococcus aureus
GDYPKWTMYIQVMTEEQAK

SEQ ID NO: 1646222 - protein, 22 aa, Staphylococcus aureus
GEKQRVAIMRAFMNNPKIILAD

SEQ ID NO: 1646223 - protein, 19 aa, Staphylococcus aureus
GEPFEPMPKLMAVSEQVTK

SEQ ID NO: 1646224 - protein, 22 aa, Staphylococcus aureus
GEQKRLYLLRLLVHQPNVLLLD

SEQ ID NO: 1646225 - protein, 31 aa, Staphylococcus aureus
GERAYDIYSRLLKDRIIMLGSQIDDNVANSI

SEQ ID NO: 1646226 - protein, 31 aa, Staphylococcus aureus
GERRCGVGIPGELCTSGFGLAAGYLNQPELT

SEQ ID NO: 1646227 - protein, 25 aa, Staphylococcus aureus
GFGRIGRLAFRRIQEVEGLEVVAVN

SEQ ID NO: 1646228 - protein, 18 aa, Staphylococcus aureus
GFSREDLWTNRKRGEEFF

SEQ ID NO: 1646229 - protein, 27 aa, Staphylococcus aureus
GGNMGVSGSVAYMFDHVATFGIEGKSV

SEQ ID NO: 1646230 - protein, 36 aa, Staphylococcus aureus
GGRGVSYCAVCDGAFFKNKRLFVIGGGDSAVEEGTF

SEQ ID NO: 1646231 - protein, 29 aa, Staphylococcus aureus
GHFQGELHLRFQLAFYLFTNRGVICDPNQ

SEQ ID NO: 1646232 - protein, 24 aa, Staphylococcus aureus
GHSVRFGKPKAFAEVNGETFYSRV

SEQ ID NO: 1646233 - protein, 25 aa, Staphylococcus aureus
GITLREGDEVVGLDVAHANSVDEVL

SEQ ID NO: 1646234 - protein, 20 aa, Staphylococcus aureus
GKFGCANCYATFKDDIIDIV

SEQ ID NO: 1646235 - protein, 25 aa, Staphylococcus aureus
GKINELRIGETLFRGVDTTTNQAIA

SEQ ID NO: 1646236 - protein, 23 aa, Staphylococcus aureus
GKISEGTICYTGDILNPERSNIY

SEQ ID NO: 1646237 - protein, 26 aa, Staphylococcus aureus
GKKIPDEFVVGYGLDYRELYRNLPYI

SEQ ID NO: 1646238 - protein, 22 aa, Staphylococcus aureus
GKPYAGFVYDVMADVLYHAKVG

SEQ ID NO: 1646239 - protein, 23 aa, Staphylococcus aureus
GLGRFGGSIVRELNALDMDVMAI

SEQ ID NO: 1646240 - protein, 24 aa, Staphylococcus aureus
GLLGLECARGLLDQGMEVTVLHLA

SEQ ID NO: 1646241 - protein, 19 aa, Staphylococcus aureus
GLTELALRFNQGINTDGDA

SEQ ID NO: 1646242 - protein, 18 aa, Staphylococcus aureus
GMLMAYEVTRDLELQDVD

SEQ ID NO: 1646243 - protein, 24 aa, Staphylococcus aureus
GMLVKRPLAVMGDKITLGFKEDQY

SEQ ID NO: 1646244 - protein, 19 aa, Staphylococcus aureus
GMVSKRVKDGWELHEAMDA

SEQ ID NO: 1646245 - protein, 18 aa, Staphylococcus aureus
GNGVIPLLLFAKHPRHIE

SEQ ID NO: 1646246 - protein, 19 aa, Staphylococcus aureus
GNNTPVFFFRDPKLFVSLN

SEQ ID NO: 1646247 - protein, 29 aa, Staphylococcus aureus
GPIKSYELAKEFAEEAGFPLMIKATSGGG

SEQ ID NO: 1646248 - protein, 19 aa, Staphylococcus aureus
GPRGPLLMQDIYFLEQMSQ

SEQ ID NO: 1646249 - protein, 18 aa, Staphylococcus aureus
GQVFYLYNKVQSIYEKRE

SEQ ID NO: 1646250 - protein, 20 aa, Staphylococcus aureus
GRDTRGLIRLHQFDKVEMVR

SEQ ID NO: 1646251 - protein, 22 aa, Staphylococcus aureus
GSRLKFQFIDILTAEKNLVKYS

SEQ ID NO: 1646252 - protein, 19 aa, Staphylococcus aureus
GSVTAGFAIYDTIQHIKPD

SEQ ID NO: 1646253 - protein, 27 aa, Staphylococcus aureus
GTIIAYRSSGGFGVRLDAGDGFQGAEI

SEQ ID NO: 1646254 - protein, 26 aa, Staphylococcus aureus
GTIMGVFLRYCLKLDEALKHNIGNCN

SEQ ID NO: 1646255 - protein, 24 aa, Staphylococcus aureus
GTLSKAIGVVGGYVAGTKELIDWL

SEQ ID NO: 1646256 - protein, 30 aa, Staphylococcus aureus
GTVKNFRVTKIFGYFGLKRLEIEEAQAGDL

SEQ ID NO: 1646257 - protein, 39 aa, Staphylococcus aureus
GYQKGRFSFNVKGGRCEACKGDGIIKIEMHFLPDVYVPC

SEQ ID NO: 1646258 - protein, 25 aa, Staphylococcus aureus
HADFGGEVERIMKMVDGVVLVVDAY

SEQ ID NO: 1646259 - protein, 19 aa, Staphylococcus aureus
HGAGCTFAAATTAYLANGK

SEQ ID NO: 1646260 - protein, 28 aa, Staphylococcus aureus
HGPYKGEPKLGFKEMEEIGLSTGLPLVL

SEQ ID NO: 1646261 - protein, 21 aa, Staphylococcus aureus
HIKVRVTGIQPYGAFVETPNH

SEQ ID NO: 1646262 - protein, 21 aa, Staphylococcus aureus
HIPEDAFRLVGSMDDVIAKAK

SEQ ID NO: 1646263 - protein, 17 aa, Staphylococcus aureus
HLEEIIDALTLSEQTDK

SEQ ID NO: 1646264 - protein, 20 aa, Staphylococcus aureus
HLTLSFVEFTILAIITSQNK

SEQ ID NO: 1646265 - protein, 23 aa, Staphylococcus aureus
HPSYKSRLGFTLSDNLKFGPDFV

SEQ ID NO: 1646266 - protein, 21 aa, Staphylococcus aureus
HRYPDIPFYLQVGNPYLSDSV

SEQ ID NO: 1646267 - protein, 28 aa, Staphylococcus aureus
IAELCHKHQKVAIAICATAEKFDLFESQ

SEQ ID NO: 1646268 - protein, 24 aa, Staphylococcus aureus
IAKSIRFGASMVMIGSLFAAHEES

SEQ ID NO: 1646269 - protein, 26 aa, Staphylococcus aureus
IASIVSRVSVPVIIKEVGFGMSKELM

SEQ ID NO: 1646270 - protein, 27 aa, Staphylococcus aureus
ICDVLKNARTIFLFGFGASSLTIGDLF

SEQ ID NO: 1646271 - protein, 23 aa, Staphylococcus aureus
ICIGMAASMGSFLLAAGAKGKRF

SEQ ID NO: 1646272 - protein, 18 aa, Staphylococcus aureus
IDALVNYISALGYLSDDE

SEQ ID NO: 1646273 - protein, 17 aa, Staphylococcus aureus
IDFKQSLMGGGFQIDNP

SEQ ID NO: 1646274 - protein, 18 aa, Staphylococcus aureus
IDGTNAFRLFNAEGDGVG

SEQ ID NO: 1646275 - protein, 19 aa, Staphylococcus aureus
IDHLMGVPILAKHFKDDPN

SEQ ID NO: 1646276 - protein, 22 aa, Staphylococcus aureus
IDKLEAIDGFHVEIDEATFVKL

SEQ ID NO: 1646277 - protein, 19 aa, Staphylococcus aureus
IDSGLDIDALKVVSKGINQ

SEQ ID NO: 1646278 - protein, 17 aa, Staphylococcus aureus
IDYAIKHNIPVSINHDS

SEQ ID NO: 1646279 - protein, 17 aa, Staphylococcus aureus
IEARGFSREDLWTNRKR

SEQ ID NO: 1646280 - protein, 20 aa, Staphylococcus aureus
IEGLPPVYMFGGGREMTHPD

SEQ ID NO: 1646281 - protein, 21 aa, Staphylococcus aureus
IELLKPAVMMNLLGKDLDLLE

SEQ ID NO: 1646282 - protein, 22 aa, Staphylococcus aureus
IELPKNKLIVMTGLSGSGKSSL

SEQ ID NO: 1646283 - protein, 17 aa, Staphylococcus aureus
IENCIKYTQPERQELNS

SEQ ID NO: 1646284 - protein, 24 aa, Staphylococcus aureus
IENYYCLVIYDWRVIESETIMSNF

SEQ ID NO: 1646285 - protein, 18 aa, Staphylococcus aureus
IEQACEVFEQKLNAFEKL

SEQ ID NO: 1646286 - protein, 23 aa, Staphylococcus aureus
IETPLARMMIKEGFPEGTTIKVN

SEQ ID NO: 1646287 - protein, 18 aa, Staphylococcus aureus
IEYLKAHITAAIEAVDQD

SEQ ID NO: 1646288 - protein, 18 aa, Staphylococcus aureus
IFRLDPNIRIPKSNIYFH

SEQ ID NO: 1646289 - protein, 21 aa, Staphylococcus aureus
IFRNCKGRIIFATFASNIYRV

SEQ ID NO: 1646290 - protein, 20 aa, Staphylococcus aureus
IFYDIDLCLDFLLDHNFSLT

SEQ ID NO: 1646291 - protein, 22 aa, Staphylococcus aureus
IGEFSLRGGIIDIFPLIGEPIR

SEQ ID NO: 1646292 - protein, 19 aa, Staphylococcus aureus
IGFLAEYDALPGLGHACGH

SEQ ID NO: 1646293 - protein, 17 aa, Staphylococcus aureus
IGGRRNGALISMDQGSA

SEQ ID NO: 1646294 - protein, 19 aa, Staphylococcus aureus
IGSELGTAFANFGSEVTIL

SEQ ID NO: 1646295 - protein, 17 aa, Staphylococcus aureus
IHGEYRMLKAHGETGVE

SEQ ID NO: 1646296 - protein, 27 aa, Staphylococcus aureus
IIATGAGWRKLNIPGEEQLINKGVAFC

SEQ ID NO: 1646297 - protein, 24 aa, Staphylococcus aureus
IIDLDIRAQYGINIIAIKRGKEFI

SEQ ID NO: 1646298 - protein, 28 aa, Staphylococcus aureus
IIEKLDYIKLLGVDYIWLTPVYESPMND

SEQ ID NO: 1646299 - protein, 25 aa, Staphylococcus aureus
IINYEIKTGAPLVYELTDDLEVIDK

SEQ ID NO: 1646300 - protein, 18 aa, Staphylococcus aureus
IIRDLRMGTYDVIVGINL

SEQ ID NO: 1646301 - protein, 18 aa, Staphylococcus aureus
IIRGLRAVSDFEYELRLT

SEQ ID NO: 1646302 - protein, 19 aa, Staphylococcus aureus
IIYNSAAYDLLSIETLSDL

SEQ ID NO: 1646303 - protein, 25 aa, Staphylococcus aureus
IKDPNRPIGSFLFLGPTGVGKTELA

SEQ ID NO: 1646304 - protein, 20 aa, Staphylococcus aureus
IKEIDGVMCEPFERVQCEVP

SEQ ID NO: 1646305 - protein, 26 aa, Staphylococcus aureus
ILDSARFRLLLSEAFDVAPRSVDAQI

SEQ ID NO: 1646306 - protein, 25 aa, Staphylococcus aureus
ILIHTLEKFILINDFEKIIIATPQQ

SEQ ID NO: 1646307 - protein, 25 aa, Staphylococcus aureus
ILNKSEPNDLFFIISLSGETHELLE

SEQ ID NO: 1646308 - protein, 24 aa, Staphylococcus aureus
IMGIANKRSIAFGVAKVLDQLGAK

SEQ ID NO: 1646309 - protein, 17 aa, Staphylococcus aureus
IMQPFKVYPNGFPEELI

SEQ ID NO: 1646310 - protein, 28 aa, Staphylococcus aureus
IPEGLTFDHAFECVGGRGSQSAINQMID

SEQ ID NO: 1646311 - protein, 20 aa, Staphylococcus aureus
IPIGKPILGTHVYIMQGERR

SEQ ID NO: 1646312 - protein, 19 aa, Staphylococcus aureus
IPLGHEFNSLVLAILQVSG

SEQ ID NO: 1646313 - protein, 18 aa, Staphylococcus aureus
IPSKALLHASHRFVEAQH

SEQ ID NO: 1646314 - protein, 20 aa, Staphylococcus aureus
IPSLTLGCGSYGRNSISHNV

SEQ ID NO: 1646315 - protein, 25 aa, Staphylococcus aureus
IPSNKIWLDPGIGFAKTRNEEAEVM

SEQ ID NO: 1646316 - protein, 18 aa, Staphylococcus aureus
IPTKDIQKAIPFGTAKIN

SEQ ID NO: 1646317 - protein, 18 aa, Staphylococcus aureus
IQVMSDFSSRLYGKQSEI

SEQ ID NO: 1646318 - protein, 22 aa, Staphylococcus aureus
IRDFIIIEAYMFRFKKKVKPEV

SEQ ID NO: 1646319 - protein, 21 aa, Staphylococcus aureus
IRFPESTLRPLGRTATGVKGI

SEQ ID NO: 1646320 - protein, 20 aa, Staphylococcus aureus
IRIIPKPVIAMVKGYAVGGG

SEQ ID NO: 1646321 - protein, 17 aa, Staphylococcus aureus
IRISIINGFLGSGKTTL

SEQ ID NO: 1646322 - protein, 23 aa, Staphylococcus aureus
IRQRNLLNLVHAWSTELQLGDNE

SEQ ID NO: 1646323 - protein, 19 aa, Staphylococcus aureus
IRYVDLVIPEKGWGQKEDD

SEQ ID NO: 1646324 - protein, 18 aa, Staphylococcus aureus
ISDRIAVMHFGKIVEIGP

SEQ ID NO: 1646325 - protein, 18 aa, Staphylococcus aureus
ISNPGCFPTATLLALHPL

SEQ ID NO: 1646326 - protein, 20 aa, Staphylococcus aureus
ITGAQAWVGTLLKMKPVLKF

SEQ ID NO: 1646327 - protein, 23 aa, Staphylococcus aureus
ITLDEAFVIHDLRVIEGNSGLFV

SEQ ID NO: 1646328 - protein, 19 aa, Staphylococcus aureus
ITNEIAFVRYHGRNHYGWT

SEQ ID NO: 1646329 - protein, 19 aa, Staphylococcus aureus
IVAAPVLALSLSFDHRQID

SEQ ID NO: 1646330 - protein, 24 aa, Staphylococcus aureus
IVEHKVKHIWNHVDRVILMDYNGN

SEQ ID NO: 1646331 - protein, 22 aa, Staphylococcus aureus
IVESTRGKGHFVIPQTNAQHAS

SEQ ID NO: 1646332 - protein, 19 aa, Staphylococcus aureus
IVLARRRLIKFDKDISIPY

SEQ ID NO: 1646333 - protein, 18 aa, Staphylococcus aureus
KAHVKGVSVLVESKEVKQ

SEQ ID NO: 1646334 - protein, 26 aa, Staphylococcus aureus
KALARELECPVIALSQLSRGVEQRQD

SEQ ID NO: 1646335 - protein, 30 aa, Staphylococcus aureus
KATVDSMLFRGVHYEICCIDNKGYEWVIQT

SEQ ID NO: 1646336 - protein, 26 aa, Staphylococcus aureus
KAVAEMKLAVGLLVDKKLSHMRIHSI

SEQ ID NO: 1646337 - protein, 19 aa, Staphylococcus aureus
KDEIVIIDAGIKFPDDNLL

SEQ ID NO: 1646338 - protein, 30 aa, Staphylococcus aureus
KDGFSLEMWGGATFDVAYNFLKENPWERLE

SEQ ID NO: 1646339 - protein, 20 aa, Staphylococcus aureus
KDGKVKWQLLYIMNQDDDEI

SEQ ID NO: 1646340 - protein, 21 aa, Staphylococcus aureus
KDIQKAIPFGTAKINVNTENQ

SEQ ID NO: 1646341 - protein, 17 aa, Staphylococcus aureus
KDISIPYILKQAYSKEK

SEQ ID NO: 1646342 - protein, 22 aa, Staphylococcus aureus
KEANLKIIYWLQGTGVVSINLQ

SEQ ID NO: 1646343 - protein, 25 aa, Staphylococcus aureus
KEFFPENRVEYFVSYYDYYQPEAYV

SEQ ID NO: 1646344 - protein, 20 aa, Staphylococcus aureus
KEFLNLMMYTMYFKNIIKKH

SEQ ID NO: 1646345 - protein, 21 aa, Staphylococcus aureus
KEILACGLDVLANEPIDHTHP

SEQ ID NO: 1646346 - protein, 23 aa, Staphylococcus aureus
KEISFSVSGNGAYSKLKFENGAH

SEQ ID NO: 1646347 - protein, 23 aa, Staphylococcus aureus
KELFELDCDILVPAAISNQITED

SEQ ID NO: 1646348 - protein, 19 aa, Staphylococcus aureus
KELIRFNADYAKIEGELSY

SEQ ID NO: 1646349 - protein, 19 aa, Staphylococcus aureus
KELIYRSGEEEIIKSVMPS

SEQ ID NO: 1646350 - protein, 20 aa, Staphylococcus aureus
KERYEVYHGVRIQDRALVAA

SEQ ID NO: 1646351 - protein, 24 aa, Staphylococcus aureus
KFDVDRFNADFAYTMDGSQYGELQ

SEQ ID NO: 1646352 - protein, 20 aa, Staphylococcus aureus
KFKLTVLVDMFGRETPVEVE

SEQ ID NO: 1646353 - protein, 23 aa, Staphylococcus aureus
KGDKRRARAAAENIIPNSTGAAK

SEQ ID NO: 1646354 - protein, 23 aa, Staphylococcus aureus
KGERRRLIDSPKVATYDLKPEMS

SEQ ID NO: 1646355 - protein, 17 aa, Staphylococcus aureus
KGLEMMVDFQPDTIIAL

SEQ ID NO: 1646356 - protein, 18 aa, Staphylococcus aureus
KGSGLGLYGMNERAELVS

SEQ ID NO: 1646357 - protein, 19 aa, Staphylococcus aureus
KIDTYRSSGAGGQHVNTTD

SEQ ID NO: 1646358 - protein, 21 aa, Staphylococcus aureus
KIHLWLNKDIEIHDFDADPGW

SEQ ID NO: 1646359 - protein, 17 aa, Staphylococcus aureus
KIIFSRTIEAPIEKVFD

SEQ ID NO: 1646360 - protein, 27 aa, Staphylococcus aureus
KINQELGITILINLHFVDLAKEYGTRI

SEQ ID NO: 1646361 - protein, 22 aa, Staphylococcus aureus
KIPKALALDYVYGYTIINDITD

SEQ ID NO: 1646362 - protein, 18 aa, Staphylococcus aureus
KIQQGWFDFDVVVATPDM

SEQ ID NO: 1646363 - protein, 26 aa, Staphylococcus aureus
KIQTDGRMKALVSITLDEAFVIHDLR

SEQ ID NO: 1646364 - protein, 24 aa, Staphylococcus aureus
KITCVEAAPKMLPMFSEELVNHAV

SEQ ID NO: 1646365 - protein, 23 aa, Staphylococcus aureus
KKNHPKSLFIWRSNLISSSAKGQ

SEQ ID NO: 1646366 - protein, 22 aa, Staphylococcus aureus
KKVPSRYGMSLTRNTSRFYQYW

SEQ ID NO: 1646367 - protein, 18 aa, Staphylococcus aureus
KLDKDVVRRRIKLMEEAG

SEQ ID NO: 1646368 - protein, 17 aa, Staphylococcus aureus
KLHLVPSGIFYKDKLAV

SEQ ID NO: 1646369 - protein, 29 aa, Staphylococcus aureus
KLKMNGREVFKFAVRIMGDASTRVVEKAN

SEQ ID NO: 1646370 - protein, 24 aa, Staphylococcus aureus
KLNIKKLGERVFLDSGTLTPLLKK

SEQ ID NO: 1646371 - protein, 17 aa, Staphylococcus aureus
KLNLSLKDNDYFKNYER

SEQ ID NO: 1646372 - protein, 20 aa, Staphylococcus aureus
KLQAIYRRVYEFTAEEKRTL

SEQ ID NO: 1646373 - protein, 24 aa, Staphylococcus aureus
KLQSHELRTCFALTEPEHGSDVAG

SEQ ID NO: 1646374 - protein, 19 aa, Staphylococcus aureus
KLSHFSFVDDVFFINKIPE

SEQ ID NO: 1646375 - protein, 22 aa, Staphylococcus aureus
KLTFMHAYNCICANVPAQIACI

SEQ ID NO: 1646376 - protein, 23 aa, Staphylococcus aureus
KLWSQDMLEQFAVEINNGALVNR

SEQ ID NO: 1646377 - protein, 19 aa, Staphylococcus aureus
KLYLFSFRNHGDFHEDCMN

SEQ ID NO: 1646378 - protein, 18 aa, Staphylococcus aureus
KMSNLCTEIFQLQETSII

SEQ ID NO: 1646379 - protein, 23 aa, Staphylococcus aureus
KNGDYATNIAMVLTKIAKRNPRE

SEQ ID NO: 1646380 - protein, 24 aa, Staphylococcus aureus
KNNRFKLIILRKGRGLAGTVMKTG

SEQ ID NO: 1646381 - protein, 18 aa, Staphylococcus aureus
KQEHGLDMIVIDYLQLIQ

SEQ ID NO: 1646382 - protein, 24 aa, Staphylococcus aureus
KQFELRKKRILEIRDDINAHFENY

SEQ ID NO: 1646383 - protein, 17 aa, Staphylococcus aureus
KQLRKSGKVPAVVYGYG

SEQ ID NO: 1646384 - protein, 23 aa, Staphylococcus aureus
KQQEDYCIILAYFYEGKPMLSYV

SEQ ID NO: 1646385 - protein, 36 aa, Staphylococcus aureus
KRAPYIFRKLNIEWIYRALIDWKRIGRLKSIPIFMY

SEQ ID NO: 1646386 - protein, 30 aa, Staphylococcus aureus
KRFVEAYRLLAKIILRLKAFDEFEFTIDEI

SEQ ID NO: 1646387 - protein, 23 aa, Staphylococcus aureus
KRGIDEYLIRLSLGVENYEDIER

SEQ ID NO: 1646388 - protein, 20 aa, Staphylococcus aureus
KRLYSDNGVDSFIYNQEDGY

SEQ ID NO: 1646389 - protein, 21 aa, Staphylococcus aureus
KRVFESGITINVFGLDVTHQV

SEQ ID NO: 1646390 - protein, 19 aa, Staphylococcus aureus
KSLETFTMAFAEEATGIPE

SEQ ID NO: 1646391 - protein, 18 aa, Staphylococcus aureus
KSLGNFILVHDIIKEVDP

SEQ ID NO: 1646392 - protein, 25 aa, Staphylococcus aureus
KSLTGGCPMGPYIVTKDELPLPENV

SEQ ID NO: 1646393 - protein, 26 aa, Staphylococcus aureus
KSPVQSIICYLALHRLHKVPMMMEGK

SEQ ID NO: 1646394 - protein, 18 aa, Staphylococcus aureus
KSRHDIHQLLNIMKSKCL

SEQ ID NO: 1646395 - protein, 22 aa, Staphylococcus aureus
KSYKKSARIVGDVMGKYHPHGD

SEQ ID NO: 1646396 - protein, 18 aa, Staphylococcus aureus
KTDEGLDEVIDWIERDTL

SEQ ID NO: 1646397 - protein, 21 aa, Staphylococcus aureus
KTIPVRPGRNVAVIIEVAAMN

SEQ ID NO: 1646398 - protein, 18 aa, Staphylococcus aureus
KTKKCLEATIVHYFEPNE

SEQ ID NO: 1646399 - protein, 18 aa, Staphylococcus aureus
KTNIPFLINVMKNKKFTS

SEQ ID NO: 1646400 - protein, 26 aa, Staphylococcus aureus
KTRMVKEVLEGAGLDQAITYSLVSKE

SEQ ID NO: 1646401 - protein, 17 aa, Staphylococcus aureus
KVKLKGMRKQYEVGEQA

SEQ ID NO: 1646402 - protein, 17 aa, Staphylococcus aureus
KVRMMSFTGSGPTGSKI

SEQ ID NO: 1646403 - protein, 28 aa, Staphylococcus aureus
KVTLGEIVDLLYKFKQSRLDRTLPKLDN

SEQ ID NO: 1646404 - protein, 23 aa, Staphylococcus aureus
KYLPLLHRYTELRKELLGLDDLK

SEQ ID NO: 1646405 - protein, 25 aa, Staphylococcus aureus
KYPDIVEKLALLKGHEINVCTMQDI

SEQ ID NO: 1646406 - protein, 20 aa, Staphylococcus aureus
KYPEYTWDLTTIFKDDEAFE

SEQ ID NO: 1646407 - protein, 19 aa, Staphylococcus aureus
KYPLADFALTPDVAIIDPQ

SEQ ID NO: 1646408 - protein, 18 aa, Staphylococcus aureus
KYSNWLNQLFHGIEYRMQ

SEQ ID NO: 1646409 - protein, 19 aa, Staphylococcus aureus
LAACSGFMYSMITAKQYVQ

SEQ ID NO: 1646410 - protein, 17 aa, Staphylococcus aureus
LAAVIGVVGEVVTTMAI

SEQ ID NO: 1646411 - protein, 17 aa, Staphylococcus aureus
LADKAKSVGADIVLITT

SEQ ID NO: 1646412 - protein, 17 aa, Staphylococcus aureus
LCDDVCILDKGQLVVSG

SEQ ID NO: 1646413 - protein, 24 aa, Staphylococcus aureus
LDLHKDILNQMAFKPIIADHLKLI

SEQ ID NO: 1646414 - protein, 18 aa, Staphylococcus aureus
LEAVRKRPGMYIGSTSER

SEQ ID NO: 1646415 - protein, 20 aa, Staphylococcus aureus
LEEPPAHAIFILATTEPHKI

SEQ ID NO: 1646416 - protein, 25 aa, Staphylococcus aureus
LEMLRRLDHRGGVGADGITGDGAGI

SEQ ID NO: 1646417 - protein, 23 aa, Staphylococcus aureus
LEMRRNIGMIFQHFNLVKRSSVL

SEQ ID NO: 1646418 - protein, 22 aa, Staphylococcus aureus
LERKLTEMGIYPAVDPLASTSR

SEQ ID NO: 1646419 - protein, 23 aa, Staphylococcus aureus
LETYKDDIIFSIGHTVATYEEAV

SEQ ID NO: 1646420 - protein, 17 aa, Staphylococcus aureus
LFEAGGINPDYYFVSEA

SEQ ID NO: 1646421 - protein, 19 aa, Staphylococcus aureus
LFIDHGMGVVIGETCTIGD

SEQ ID NO: 1646422 - protein, 17 aa, Staphylococcus aureus
LGGVCLNVGCIPSKALL

SEQ ID NO: 1646423 - protein, 20 aa, Staphylococcus aureus
LGHACGHNIIGTASVLGAIG

SEQ ID NO: 1646424 - protein, 23 aa, Staphylococcus aureus
LGISSPDIFKLINLDKRYDVHTK

SEQ ID NO: 1646425 - protein, 18 aa, Staphylococcus aureus
LGTAFANFGSEVTILEGA

SEQ ID NO: 1646426 - protein, 18 aa, Staphylococcus aureus
LGTLFRKNIYQMIPQEVT

SEQ ID NO: 1646427 - protein, 26 aa, Staphylococcus aureus
LGYGERAKMGLALNRLVRDGEISAPI

SEQ ID NO: 1646428 - protein, 17 aa, Staphylococcus aureus
LHYTPRAKKVIELSMDE

SEQ ID NO: 1646429 - protein, 24 aa, Staphylococcus aureus
LIKNWPGLHIEPLQAPENMEVLIG

SEQ ID NO: 1646430 - protein, 24 aa, Staphylococcus aureus
LILDELKMTLSHVEADEFSTFASK

SEQ ID NO: 1646431 - protein, 28 aa, Staphylococcus aureus
LINKGVAFCPHCDGPLFENKDVAVIGGG

SEQ ID NO: 1646432 - protein, 17 aa, Staphylococcus aureus
LISHGRAEIVAGRASRT

SEQ ID NO: 1646433 - protein, 20 aa, Staphylococcus aureus
LKATEKMAGQSIIDLDIRAQ

SEQ ID NO: 1646434 - protein, 18 aa, Staphylococcus aureus
LKIFSLKGNEALAQEVAD

SEQ ID NO: 1646435 - protein, 22 aa, Staphylococcus aureus
LKKAKCIIVDLNLGKEALNFLC

SEQ ID NO: 1646436 - protein, 17 aa, Staphylococcus aureus
LKKLFSQVEEEMVETFI

SEQ ID NO: 1646437 - protein, 19 aa, Staphylococcus aureus
LKKRLQEQLFLVVEEGNDI

SEQ ID NO: 1646438 - protein, 26 aa, Staphylococcus aureus
LKLYLKHGHCKVLLGVARGKKKYDKR

SEQ ID NO: 1646439 - protein, 19 aa, Staphylococcus aureus
LKNNPIRTFMCDDCKSRLD

SEQ ID NO: 1646440 - protein, 21 aa, Staphylococcus aureus
LKQLVQCGANIVGLNCHHGPH

SEQ ID NO: 1646441 - protein, 25 aa, Staphylococcus aureus
LKSFHSCGVYGMGVVTSIVAQNTLG

SEQ ID NO: 1646442 - protein, 18 aa, Staphylococcus aureus
LLDDVKFELTELNAQKGL

SEQ ID NO: 1646443 - protein, 20 aa, Staphylococcus aureus
LLKSLGIPYVREDRKVNKAF

SEQ ID NO: 1646444 - protein, 27 aa, Staphylococcus aureus
LLRTFSKAYGLAGLRVGYVVASEHAIE

SEQ ID NO: 1646445 - protein, 17 aa, Staphylococcus aureus
LLSRYARKDDVVVGSVM

SEQ ID NO: 1646446 - protein, 22 aa, Staphylococcus aureus
LMNLKHVVITAVARDDLRDAGS

SEQ ID NO: 1646447 - protein, 18 aa, Staphylococcus aureus
LNIMGINTAEEFSERLNE

SEQ ID NO: 1646448 - protein, 19 aa, Staphylococcus aureus
LNLAYSRLGKQVFELEDLS

SEQ ID NO: 1646449 - protein, 32 aa, Staphylococcus aureus
LNLPEEMNPFLGYRAIRLCLAQQDIFRPQLRA

SEQ ID NO: 1646450 - protein, 18 aa, Staphylococcus aureus
LNRHFSFSRTNGFSLKVK

SEQ ID NO: 1646451 - protein, 23 aa, Staphylococcus aureus
LNSAVWSGGSFIYVPKNIKLDTP

SEQ ID NO: 1646452 - protein, 18 aa, Staphylococcus aureus
LNVGCIPSKALLHASHRF

SEQ ID NO: 1646453 - protein, 32 aa, Staphylococcus aureus
LPKYDGFYWCRKMREVSNVPILFLSSRDNPMD

SEQ ID NO: 1646454 - protein, 17 aa, Staphylococcus aureus
LPMSLIHEGVGEVVFDS

SEQ ID NO: 1646455 - protein, 25 aa, Staphylococcus aureus
LPWKDLNIDVVLECTGFYTDKDKAQ

SEQ ID NO: 1646456 - protein, 18 aa, Staphylococcus aureus
LQAAELKGVEGLSPKTRR

SEQ ID NO: 1646457 - protein, 19 aa, Staphylococcus aureus
LQAVCAVCGSSSSRTQRLI

SEQ ID NO: 1646458 - protein, 27 aa, Staphylococcus aureus
LQDRAFKNDKIDFIWSHTLKSINEKDG

SEQ ID NO: 1646459 - protein, 17 aa, Staphylococcus aureus
LQKEVDFAVKLGLVDRE

SEQ ID NO: 1646460 - protein, 21 aa, Staphylococcus aureus
LQPELFTMVPVNIDIEHQSPL

SEQ ID NO: 1646461 - protein, 25 aa, Staphylococcus aureus
LQPLYKDRIPVVIKNTNRPQDKGTF

SEQ ID NO: 1646462 - protein, 21 aa, Staphylococcus aureus
LRKSGKVPAVVYGYGTKNVSV

SEQ ID NO: 1646463 - protein, 22 aa, Staphylococcus aureus
LRYLTPHGKWNIHSMYQDNKHM

SEQ ID NO: 1646464 - protein, 18 aa, Staphylococcus aureus
LSDYLPLMLQFLQVAEWR

SEQ ID NO: 1646465 - protein, 29 aa, Staphylococcus aureus
LSGRVGYHPTWKMVLGLFPKEDKIKAMDA

SEQ ID NO: 1646466 - protein, 23 aa, Staphylococcus aureus
LSLLDTPTFFFGMRNGETVEIEI

SEQ ID NO: 1646467 - protein, 18 aa, Staphylococcus aureus
LVDEVGMLMAYEVTRDLE

SEQ ID NO: 1646468 - protein, 21 aa, Staphylococcus aureus
LVHITCRDRNLIGLQSHLLGL

SEQ ID NO: 1646469 - protein, 20 aa, Staphylococcus aureus
LVWMGGTFLPKGNVEEPEHD

SEQ ID NO: 1646470 - protein, 19 aa, Staphylococcus aureus
LYDRGPRILRNFPEKLSKY

SEQ ID NO: 1646471 - protein, 26 aa, Staphylococcus aureus
MEIRTIYRMILKLHNIMLNVKLGLNI

SEQ ID NO: 1646472 - protein, 21 aa, Staphylococcus aureus
MGNQCMIMIDYILKHQDTLQI

SEQ ID NO: 1646473 - protein, 20 aa, Staphylococcus aureus
MGRVACRADYVIFTPDNPAN

SEQ ID NO: 1646474 - protein, 18 aa, Staphylococcus aureus
MGTYDVIVGINLLREGID

SEQ ID NO: 1646475 - protein, 23 aa, Staphylococcus aureus
MKAGAPKDIIQWIEVPSIEATKQ

SEQ ID NO: 1646476 - protein, 23 aa, Staphylococcus aureus
MKISASLLSHSDMFIAMSNSGNT

SEQ ID NO: 1646477 - protein, 21 aa, Staphylococcus aureus
MKVTDKRAHFIQELESLAKPI

SEQ ID NO: 1646478 - protein, 25 aa, Staphylococcus aureus
MLVNNSRFGFKMGHQSMVDSMVYDG

SEQ ID NO: 1646479 - protein, 19 aa, Staphylococcus aureus
MPSVRKYAREKGVNIKAVS

SEQ ID NO: 1646480 - protein, 31 aa, Staphylococcus aureus
MSDGLLCGIGMPGELCIAGDSLAIGYINRPE

SEQ ID NO: 1646481 - protein, 23 aa, Staphylococcus aureus
MSMLMTLKGLPLAYNKDMQEDKE

SEQ ID NO: 1646482 - protein, 25 aa, Staphylococcus aureus
MSVELRPASLDDLGLEAAFKSYFKQ

SEQ ID NO: 1646483 - protein, 33 aa, Staphylococcus aureus
MSYTEVYKTLPFDFLSDIVYQWERFAQQFEQLG

SEQ ID NO: 1646484 - protein, 19 aa, Staphylococcus aureus
MTDYCYRNYKNYLKNAIIH

SEQ ID NO: 1646485 - protein, 23 aa, Staphylococcus aureus
MTFPHQMMRVVLIEQVYRAFKIM

SEQ ID NO: 1646486 - protein, 25 aa, Staphylococcus aureus
MTNMFWRQNISQMWVETEFKVSKDI

SEQ ID NO: 1646487 - protein, 19 aa, Staphylococcus aureus
MYNIFNMGIGYTVIVDEKD

SEQ ID NO: 1646488 - protein, 27 aa, Staphylococcus aureus
NATIHRFTRKLGFDGYSDFKSYLKFES

SEQ ID NO: 1646489 - protein, 25 aa, Staphylococcus aureus
NDIFKKRDSMNWNEITQGIEHIPGK

SEQ ID NO: 1646490 - protein, 21 aa, Staphylococcus aureus
NDTKYGLAGYVIGKDKETLHK

SEQ ID NO: 1646491 - protein, 31 aa, Staphylococcus aureus
NDYVGRIGIGRVFRGKMRVGDNVSLIKLDGT

SEQ ID NO: 1646492 - protein, 24 aa, Staphylococcus aureus
NEDEIRRFLPRKVRTFQLQEAQRM

SEQ ID NO: 1646493 - protein, 22 aa, Staphylococcus aureus
NEVMGIPSLLVFKNGDKIAHLH

SEQ ID NO: 1646494 - protein, 19 aa, Staphylococcus aureus
NIEKGEFAVIVGLSGAGKS

SEQ ID NO: 1646495 - protein, 22 aa, Staphylococcus aureus
NIGEPMHQIFKAVRDLADEYKD

SEQ ID NO: 1646496 - protein, 25 aa, Staphylococcus aureus
NKIATCVKGKFSWGHINSDQRLTKP

SEQ ID NO: 1646497 - protein, 25 aa, Staphylococcus aureus
NKPFFIGIMPIASYKNALFLHNEVP

SEQ ID NO: 1646498 - protein, 18 aa, Staphylococcus aureus
NKVESLRASYYMMGAMLG

SEQ ID NO: 1646499 - protein, 17 aa, Staphylococcus aureus
NKVVFIIDECHRSQFGD

SEQ ID NO: 1646500 - protein, 23 aa, Staphylococcus aureus
NMPDSLHAIDWIITNKDETETYL

SEQ ID NO: 1646501 - protein, 19 aa, Staphylococcus aureus
NNFGPFLKEEIDFSKIDNN

SEQ ID NO: 1646502 - protein, 21 aa, Staphylococcus aureus
NNMKDLARMSVGQVLNEHDID

SEQ ID NO: 1646503 - protein, 19 aa, Staphylococcus aureus
NQYQPMGLLLANHVIEQDR

SEQ ID NO: 1646504 - protein, 22 aa, Staphylococcus aureus
NRASMQFECSWSANIKEDKVHV

SEQ ID NO: 1646505 - protein, 18 aa, Staphylococcus aureus
NRISVGVMYMLKLAHMVD

SEQ ID NO: 1646506 - protein, 17 aa, Staphylococcus aureus
NSPGGSVTAGFAIYDTI

SEQ ID NO: 1646507 - protein, 20 aa, Staphylococcus aureus
NVATRAWTFRTVGYGHSPYV

SEQ ID NO: 1646508 - protein, 26 aa, Staphylococcus aureus
NVEFYPVLCGTAFKNKGVQLMLDAVI

SEQ ID NO: 1646509 - protein, 19 aa, Staphylococcus aureus
NVGKSTLFNAITKAGALAA

SEQ ID NO: 1646510 - protein, 20 aa, Staphylococcus aureus
PCGRSLCCSTFLGDFEPVSI

SEQ ID NO: 1646511 - protein, 24 aa, Staphylococcus aureus
PDNTIKAAGGFIIQVMPGAKDETI

SEQ ID NO: 1646512 - protein, 17 aa, Staphylococcus aureus
PEAITFTENASWPLAMP

SEQ ID NO: 1646513 - protein, 21 aa, Staphylococcus aureus
PEEIKRTFDKLGIPEAEQKYL

SEQ ID NO: 1646514 - protein, 24 aa, Staphylococcus aureus
PEKLSKYVAKWFAKNNVTVVPNSN

SEQ ID NO: 1646515 - protein, 21 aa, Staphylococcus aureus
PETNYPIAVMEASLISSMRTA

SEQ ID NO: 1646516 - protein, 21 aa, Staphylococcus aureus
PEVHPGPTLLNVGRIDYAGEF

SEQ ID NO: 1646517 - protein, 25 aa, Staphylococcus aureus
PFEVKELIFRIRAVLRRYNINSNSE

SEQ ID NO: 1646518 - protein, 18 aa, Staphylococcus aureus
PFIDVFLEPTKLYVKPVL

SEQ ID NO: 1646519 - protein, 26 aa, Staphylococcus aureus
PFSKEVALVMMILRLNTLLKGHSGAT

SEQ ID NO: 1646520 - protein, 23 aa, Staphylococcus aureus
PFVKQKLIFLVGMAGERDLTKTP

SEQ ID NO: 1646521 - protein, 22 aa, Staphylococcus aureus
PGDKFCKLDELLENEDKRQAFM

SEQ ID NO: 1646522 - protein, 26 aa, Staphylococcus aureus
PHKFKMGVSGCPRSCVESGVKDFGII

SEQ ID NO: 1646523 - protein, 20 aa, Staphylococcus aureus
PHQHGFKIIYNSAAYDLLSI

SEQ ID NO: 1646524 - protein, 19 aa, Staphylococcus aureus
PIHDACTILYLLQPELFTM

SEQ ID NO: 1646525 - protein, 20 aa, Staphylococcus aureus
PKHHTCLISPVNHDTIRMTI

SEQ ID NO: 1646526 - protein, 25 aa, Staphylococcus aureus
PLNGLKKWLTPVEMWQNHQMTLRVG

SEQ ID NO: 1646527 - protein, 24 aa, Staphylococcus aureus
PLRMLQVRIPVRMDDGTVKTFTGY

SEQ ID NO: 1646528 - protein, 18 aa, Staphylococcus aureus
PLVNRITNEIAFVRYHGR

SEQ ID NO: 1646529 - protein, 24 aa, Staphylococcus aureus
PMRIKEFELLWYLASRENEVISKS

SEQ ID NO: 1646530 - protein, 19 aa, Staphylococcus aureus
PNVEKRPKPDYELASIPTV

SEQ ID NO: 1646531 - protein, 18 aa, Staphylococcus aureus
PPGESGLIATSKIADSFP

SEQ ID NO: 1646532 - protein, 30 aa, Staphylococcus aureus
PPIEACGTWRLVYQRLKALEVLTHEHVHLE

SEQ ID NO: 1646533 - protein, 30 aa, Staphylococcus aureus
PPKLIEHLLEIRGLGIINVMTLFGAGSILT

SEQ ID NO: 1646534 - protein, 25 aa, Staphylococcus aureus
PQKHALFPKYEFFRADTDYADIAKF

SEQ ID NO: 1646535 - protein, 30 aa, Staphylococcus aureus
PRRRAKQKALELVELVGLKGREKAYPSELS

SEQ ID NO: 1646536 - protein, 21 aa, Staphylococcus aureus
PRRVSPFFVPMLIPDMATGQV

SEQ ID NO: 1646537 - protein, 24 aa, Staphylococcus aureus
PRTRIPLSSEILAEFEKIRRGHHK

SEQ ID NO: 1646538 - protein, 24 aa, Staphylococcus aureus
PSLKAFAPVREWAWSREEEIDYAI

SEQ ID NO: 1646539 - protein, 21 aa, Staphylococcus aureus
PTDRTEVYLNDYAKIIMSHNV

SEQ ID NO: 1646540 - protein, 20 aa, Staphylococcus aureus
PTVFELAQAIAKVQEQNYEV

SEQ ID NO: 1646541 - protein, 25 aa, Staphylococcus aureus
PVGNAGNITAYWKGFKEYHEAKGSQ

SEQ ID NO: 1646542 - protein, 19 aa, Staphylococcus aureus
PYDAKGLLISSIRSNDPVV

SEQ ID NO: 1646543 - protein, 29 aa, Staphylococcus aureus
PYFSTPYCIKHFGDLKIAIVGVTADGLME

SEQ ID NO: 1646544 - protein, 18 aa, Staphylococcus aureus
QALLKFEDVRIVRDMRNS

SEQ ID NO: 1646545 - protein, 31 aa, Staphylococcus aureus
QDGRTTADIFGRCLHTYLIRDAIHDGNVLGF

SEQ ID NO: 1646546 - protein, 24 aa, Staphylococcus aureus
QEKMGRPAVEVILTVLHAGGKFGG

SEQ ID NO: 1646547 - protein, 20 aa, Staphylococcus aureus
QELNSVFNFHHLKVDYVDGE

SEQ ID NO: 1646548 - protein, 21 aa, Staphylococcus aureus
QEVPGKLVVVGGGYIGSELGT

SEQ ID NO: 1646549 - protein, 25 aa, Staphylococcus aureus
QGASEISMMFGIHVDDAEKAVLSTY

SEQ ID NO: 1646550 - protein, 27 aa, Staphylococcus aureus
QGFGNAGSFLAKFLYDLGAKIVGISDA

SEQ ID NO: 1646551 - protein, 17 aa, Staphylococcus aureus
QGTICIYVAIGQKDSTV

SEQ ID NO: 1646552 - protein, 18 aa, Staphylococcus aureus
QIKHVYVSDLLRTQQTFE

SEQ ID NO: 1646553 - protein, 18 aa, Staphylococcus aureus
QKVQEFKSSVVNKLTGGV

SEQ ID NO: 1646554 - protein, 26 aa, Staphylococcus aureus
QKYRELQDIIAILGMDELSDEDKQTV

SEQ ID NO: 1646555 - protein, 18 aa, Staphylococcus aureus
QNMFALLGKPGFEDLKKE

SEQ ID NO: 1646556 - protein, 18 aa, Staphylococcus aureus
QRQGGTRKRTMVFEGVVP

SEQ ID NO: 1646557 - protein, 29 aa, Staphylococcus aureus
QRTNYDLEMMREMGFCSGIENYSVHLTLR

SEQ ID NO: 1646558 - protein, 23 aa, Staphylococcus aureus
QSLFKSTGMALMSNVGGASGPLY

SEQ ID NO: 1646559 - protein, 25 aa, Staphylococcus aureus
QSRKRYLECFTEEKMIKEVEDVYNG

SEQ ID NO: 1646560 - protein, 32 aa, Staphylococcus aureus
QTDYLDLFLIHWPCEADGLFLETYKAMEELYE

SEQ ID NO: 1646561 - protein, 24 aa, Staphylococcus aureus
QTEVKIVFMLAMDKVDDQLKLLQQ

SEQ ID NO: 1646562 - protein, 25 aa, Staphylococcus aureus
QTWPFKQILLPLLYQRDSGGGSMPS

SEQ ID NO: 1646563 - protein, 18 aa, Staphylococcus aureus
QVIIKEIDGVMCEPFERV

SEQ ID NO: 1646564 - protein, 25 aa, Staphylococcus aureus
QYTTRLGIRLEKTFEYIDTPHKFKM

SEQ ID NO: 1646565 - protein, 17 aa, Staphylococcus aureus
RAAEAAHIIPIVRVTAV

SEQ ID NO: 1646566 - protein, 19 aa, Staphylococcus aureus
RAKLRGERSEGMICSLQEI

SEQ ID NO: 1646567 - protein, 19 aa, Staphylococcus aureus
RAREAGVDRMFVVGFNKST

SEQ ID NO: 1646568 - protein, 24 aa, Staphylococcus aureus
RAYAPEFEKEIPLQIMMIEKDHVV

SEQ ID NO: 1646569 - protein, 19 aa, Staphylococcus aureus
RDEDSWLASFEVNEMLMLK

SEQ ID NO: 1646570 - protein, 23 aa, Staphylococcus aureus
RDGEISAPIVIGRDHLDAGSVAS

SEQ ID NO: 1646571 - protein, 34 aa, Staphylococcus aureus
RDIDRALVWGFNWKLGPFQLWDAMGYERVKTRME

SEQ ID NO: 1646572 - protein, 20 aa, Staphylococcus aureus
REQPDALLILGDTNSCLAAV

SEQ ID NO: 1646573 - protein, 22 aa, Staphylococcus aureus
RFDKSPYDGFAIRSVDSQGASG

SEQ ID NO: 1646574 - protein, 24 aa, Staphylococcus aureus
RFGDPEAQVLLSRMESDLMQHIID

SEQ ID NO: 1646575 - protein, 17 aa, Staphylococcus aureus
RGFKAGHTVDIILTESD

SEQ ID NO: 1646576 - protein, 22 aa, Staphylococcus aureus
RGTTIRRIVKMLKDSGANKVHV

SEQ ID NO: 1646577 - protein, 25 aa, Staphylococcus aureus
RGVEFKIATPIVACNEKGFVVEVDG

SEQ ID NO: 1646578 - protein, 20 aa, Staphylococcus aureus
RHGTMPLTMFITKKGKQVKV

SEQ ID NO: 1646579 - protein, 24 aa, Staphylococcus aureus
RHHLKCKIFAPYGFSEEKINIMIA

SEQ ID NO: 1646580 - protein, 22 aa, Staphylococcus aureus
RKEFGEEQVHIWRRSYDVKPPA

SEQ ID NO: 1646581 - protein, 17 aa, Staphylococcus aureus
RKKLIYRYVDAQDTRRK

SEQ ID NO: 1646582 - protein, 19 aa, Staphylococcus aureus
RKRTMVFEGVVPNISRRFH

SEQ ID NO: 1646583 - protein, 19 aa, Staphylococcus aureus
RKVVEDYTVLRGCKPYYVE

SEQ ID NO: 1646584 - protein, 24 aa, Staphylococcus aureus
RLEKKIESGMSYFITQPVYSKEKI

SEQ ID NO: 1646585 - protein, 24 aa, Staphylococcus aureus
RLERLRKAIPNVLFQMLLRASNAV

SEQ ID NO: 1646586 - protein, 17 aa, Staphylococcus aureus
RLGHAIVALPGGCAIGS

SEQ ID NO: 1646587 - protein, 17 aa, Staphylococcus aureus
RLHKVPMMMEGKWQSTI

SEQ ID NO: 1646588 - protein, 18 aa, Staphylococcus aureus
RLIRKYLIEKSMDNKEVK

SEQ ID NO: 1646589 - protein, 26 aa, Staphylococcus aureus
RLREEMYDIAGLRMMCQFVEDIDVVV

SEQ ID NO: 1646590 - protein, 21 aa, Staphylococcus aureus
RLVGACGLDSMRVAKGQFGAH

SEQ ID NO: 1646591 - protein, 27 aa, Staphylococcus aureus
RMRKLCRPETPAIIVTRGLQPPEELVE

SEQ ID NO: 1646592 - protein, 19 aa, Staphylococcus aureus
RPAKYIIEHGIKHGLITEN

SEQ ID NO: 1646593 - protein, 18 aa, Staphylococcus aureus
RPATMLVQTASKFDSDIQ

SEQ ID NO: 1646594 - protein, 19 aa, Staphylococcus aureus
RPKPDYELASIPTVSSSKI

SEQ ID NO: 1646595 - protein, 19 aa, Staphylococcus aureus
RPRRVGWFDSVVLRHSRRV

SEQ ID NO: 1646596 - protein, 19 aa, Staphylococcus aureus
RQKLDIPFIYLTAKTQEHD

SEQ ID NO: 1646597 - protein, 19 aa, Staphylococcus aureus
RQLEIFTGTPIMFTAVHNI

SEQ ID NO: 1646598 - protein, 26 aa, Staphylococcus aureus
RQSLYRIVNHWIDFGVDGFRFDVINL

SEQ ID NO: 1646599 - protein, 24 aa, Staphylococcus aureus
RQTKDMYRLLGLAKYEDRFVIPTS

SEQ ID NO: 1646600 - protein, 19 aa, Staphylococcus aureus
RRRLIKFDKDISIPYILKQ

SEQ ID NO: 1646601 - protein, 17 aa, Staphylococcus aureus
RRVAKEEGILAGISSGA

SEQ ID NO: 1646602 - protein, 21 aa, Staphylococcus aureus
RRYPDLTVHRLIRKYLIEKSM

SEQ ID NO: 1646603 - protein, 19 aa, Staphylococcus aureus
RSAAFFAVGLIKGSERPVA

SEQ ID NO: 1646604 - protein, 19 aa, Staphylococcus aureus
RSVRFPGLISHVKEPGGGT

SEQ ID NO: 1646605 - protein, 20 aa, Staphylococcus aureus
RTTGHLMSMLMTLKGLPLAY

SEQ ID NO: 1646606 - protein, 18 aa, Staphylococcus aureus
RTVDLCLDVLALPSGEYE

SEQ ID NO: 1646607 - protein, 22 aa, Staphylococcus aureus
RVTDHRIGLTLQKLGQIMEGHL

SEQ ID NO: 1646608 - protein, 18 aa, Staphylococcus aureus
RYQLPLFIVENGFGAVDE

SEQ ID NO: 1646609 - protein, 19 aa, Staphylococcus aureus
SALIKWFNTNYHYIVPEWD

SEQ ID NO: 1646610 - protein, 25 aa, Staphylococcus aureus
SCGDIAVSVYSGWLAYSTFDHEWVK

SEQ ID NO: 1646611 - protein, 18 aa, Staphylococcus aureus
SDAVGDWAVLNALINTAA

SEQ ID NO: 1646612 - protein, 22 aa, Staphylococcus aureus
SDQEWRDVRYLYDYNEQELIDL

SEQ ID NO: 1646613 - protein, 24 aa, Staphylococcus aureus
SEMAFKIAASLALKEAAKKCDPVI

SEQ ID NO: 1646614 - protein, 31 aa, Staphylococcus aureus
SETGSVVLPGRFFVDIIKKLPGKDVKLSTNE

SEQ ID NO: 1646615 - protein, 22 aa, Staphylococcus aureus
SEWNAKNLFTGWEDVNLSEQGI

SEQ ID NO: 1646616 - protein, 23 aa, Staphylococcus aureus
SGDGGKLKIHYELYQDNEKMGSY

SEQ ID NO: 1646617 - protein, 19 aa, Staphylococcus aureus
SIIQKEHLVVLEAAFTLAP

SEQ ID NO: 1646618 - protein, 25 aa, Staphylococcus aureus
SIKNFKTTMSIVFECHIYTLRQQYA

SEQ ID NO: 1646619 - protein, 25 aa, Staphylococcus aureus
SILTEKRIRLNINLENWNKQKLYDR

SEQ ID NO: 1646620 - protein, 26 aa, Staphylococcus aureus
SKLNHLYPEFHIWDAYSIYQLEESRL

SEQ ID NO: 1646621 - protein, 17 aa, Staphylococcus aureus
SKMTGIKERHWADDDQD

SEQ ID NO: 1646622 - protein, 20 aa, Staphylococcus aureus
SKQLCFLFYVSSKEIIKKYT

SEQ ID NO: 1646623 - protein, 24 aa, Staphylococcus aureus
SNQALRLVLERAKTYSVPNHIIEK

SEQ ID NO: 1646624 - protein, 17 aa, Staphylococcus aureus
SPIRRYPDLTVHRLIRK

SEQ ID NO: 1646625 - protein, 25 aa, Staphylococcus aureus
SPRALEEVIYFASYVVVDPGPTGLE

SEQ ID NO: 1646626 - protein, 24 aa, Staphylococcus aureus
SQLFKFHGEVAMQLFLNDELKLPS

SEQ ID NO: 1646627 - protein, 26 aa, Staphylococcus aureus
SRAPWKIKRPHSVYETALPEFYERAS

SEQ ID NO: 1646628 - protein, 21 aa, Staphylococcus aureus
SRILFGAGLDEVILMISRAVL

SEQ ID NO: 1646629 - protein, 27 aa, Staphylococcus aureus
SRPIEIPNFKFGKRVIDSTGALNLQEV

SEQ ID NO: 1646630 - protein, 22 aa, Staphylococcus aureus
SRPSYISNPWLKPDEHQSNFLT

SEQ ID NO: 1646631 - protein, 19 aa, Staphylococcus aureus
SRTPMQWSDDVNAGFTAGK

SEQ ID NO: 1646632 - protein, 23 aa, Staphylococcus aureus
SSKGLEFPFVIYSGLSKDFNKRD

SEQ ID NO: 1646633 - protein, 24 aa, Staphylococcus aureus
SSQFHLLMGMGFKKYIDTLKIGKS

SEQ ID NO: 1646634 - protein, 22 aa, Staphylococcus aureus
STLAGMAFANAFLGIAHSIAHK

SEQ ID NO: 1646635 - protein, 24 aa, Staphylococcus aureus
SVGDRQLVKVAAWYDNEMSYTAQL

SEQ ID NO: 1646636 - protein, 22 aa, Staphylococcus aureus
SVHPSPLSAYRGFFGSKPYSKA

SEQ ID NO: 1646637 - protein, 18 aa, Staphylococcus aureus
SVSLNFQKVQEFKSSVVN

SEQ ID NO: 1646638 - protein, 17 aa, Staphylococcus aureus
SYHFKKYLQMSPSDYCK

SEQ ID NO: 1646639 - protein, 24 aa, Staphylococcus aureus
SYQGLPSRIAWLGYGERAKMGLAL

SEQ ID NO: 1646640 - protein, 20 aa, Staphylococcus aureus
SYVFHPYSMVKDHRTNEETG

SEQ ID NO: 1646641 - protein, 17 aa, Staphylococcus aureus
TADVFKDGFSLEMWGGA

SEQ ID NO: 1646642 - protein, 22 aa, Staphylococcus aureus
TCIPPLVEKGIHVIDLSGAFRI

SEQ ID NO: 1646643 - protein, 25 aa, Staphylococcus aureus
TDFQARRANIRFKRDKAAKPELAHT

SEQ ID NO: 1646644 - protein, 17 aa, Staphylococcus aureus
TDYADIAKFLGLKGNTT

SEQ ID NO: 1646645 - protein, 25 aa, Staphylococcus aureus
TEADLKADIILTMSYSHKELIEAHF

SEQ ID NO: 1646646 - protein, 17 aa, Staphylococcus aureus
TEFKVSKDIASWKTLSE

SEQ ID NO: 1646647 - protein, 20 aa, Staphylococcus aureus
TEGYEGFYHLMNFEGTVEKA

SEQ ID NO: 1646648 - protein, 21 aa, Staphylococcus aureus
TERILYYTGRIHKIGETHEGA

SEQ ID NO: 1646649 - protein, 24 aa, Staphylococcus aureus
TEVPACNEVQCGWAASHSLEGAKT

SEQ ID NO: 1646650 - protein, 18 aa, Staphylococcus aureus
TFDKLGIPEAEQKYLAGV

SEQ ID NO: 1646651 - protein, 31 aa, Staphylococcus aureus
TFVPARNLLFLSFAGALAYQIGAKHIITGVC

SEQ ID NO: 1646652 - protein, 26 aa, Staphylococcus aureus
TFYPMPFLSPQTMWYYKSAFNTDQMK

SEQ ID NO: 1646653 - protein, 17 aa, Staphylococcus aureus
TGLPEALHQVTILMSDR

SEQ ID NO: 1646654 - protein, 17 aa, Staphylococcus aureus
TGVFGHPVSDRENSMTA

SEQ ID NO: 1646655 - protein, 19 aa, Staphylococcus aureus
TIHPHIKIGSRNLVGHTHR

SEQ ID NO: 1646656 - protein, 25 aa, Staphylococcus aureus
TKAGNSCGKCKPQIAQILQHTLGDD

SEQ ID NO: 1646657 - protein, 17 aa, Staphylococcus aureus
TKHGINFQEVAFKEEKR

SEQ ID NO: 1646658 - protein, 23 aa, Staphylococcus aureus
TKMICAYCNINRSTFYDYYKDKF

SEQ ID NO: 1646659 - protein, 18 aa, Staphylococcus aureus
TKSIAGFDVESFNVSHDA

SEQ ID NO: 1646660 - protein, 26 aa, Staphylococcus aureus
TLPFKKIVSDLCYKQSDLVQHIKVLV

SEQ ID NO: 1646661 - protein, 19 aa, Staphylococcus aureus
TLVDELLKQSGIFRENEHV

SEQ ID NO: 1646662 - protein, 25 aa, Staphylococcus aureus
TNKAEKCTFCFPRIEAGMPTVCSET

SEQ ID NO: 1646663 - protein, 26 aa, Staphylococcus aureus
TNRDLRFIEDFSIKIVDVMTQENLIT

SEQ ID NO: 1646664 - protein, 22 aa, Staphylococcus aureus
TQEAKMIISCIARMKQQESYSV

SEQ ID NO: 1646665 - protein, 24 aa, Staphylococcus aureus
TRELARLYVYAHYKGLKSLYYTRN

SEQ ID NO: 1646666 - protein, 28 aa, Staphylococcus aureus
TRSIALARFPWLSANIEYNVTKEPYFST

SEQ ID NO: 1646667 - protein, 25 aa, Staphylococcus aureus
TSETRPVLTGVNWLIQENELICTAT

SEQ ID NO: 1646668 - protein, 19 aa, Staphylococcus aureus
TSSVIRFSKKITDGGFHDL

SEQ ID NO: 1646669 - protein, 27 aa, Staphylococcus aureus
TTCKKAAKFLDEYGVSYEPIDIVQHTP

SEQ ID NO: 1646670 - protein, 24 aa, Staphylococcus aureus
TTDLRKKAVYSFMAMMEQIHAKSY

SEQ ID NO: 1646671 - protein, 22 aa, Staphylococcus aureus
TTNSAFLIYLFAKDLPNHDELM

SEQ ID NO: 1646672 - protein, 21 aa, Staphylococcus aureus
TTYELLGLSTYFTAGVQEVRA

SEQ ID NO: 1646673 - protein, 18 aa, Staphylococcus aureus
TWQHKVPFGVWWETLQQE

SEQ ID NO: 1646674 - protein, 25 aa, Staphylococcus aureus
VAALKTGFVKVKFHDGTEYIAVSDG

SEQ ID NO: 1646675 - protein, 20 aa, Staphylococcus aureus
VAGTKYRGEFEERLKKVMEE

SEQ ID NO: 1646676 - protein, 23 aa, Staphylococcus aureus
VALKQAEGEFVLFVDSDDYINKE

SEQ ID NO: 1646677 - protein, 21 aa, Staphylococcus aureus
VALQLGDDVVRTIAMDSTDGV

SEQ ID NO: 1646678 - protein, 20 aa, Staphylococcus aureus
VATCKEMLISGVGVTILPEI

SEQ ID NO: 1646679 - protein, 20 aa, Staphylococcus aureus
VDEVEFIKVIREVGRNGVIE

SEQ ID NO: 1646680 - protein, 18 aa, Staphylococcus aureus
VDGACYILALPEIFNSVD

SEQ ID NO: 1646681 - protein, 17 aa, Staphylococcus aureus
VDILFILGGDGTVNELI

SEQ ID NO: 1646682 - protein, 18 aa, Staphylococcus aureus
VEDKGEYKVINFGNKELT

SEQ ID NO: 1646683 - protein, 18 aa, Staphylococcus aureus
VGIKSREIYEAPAAEVIL

SEQ ID NO: 1646684 - protein, 20 aa, Staphylococcus aureus
VHAGGSLATYAFQHMKDPIV

SEQ ID NO: 1646685 - protein, 25 aa, Staphylococcus aureus
VIDALSYYQFFILKFVVGEQRIKDA

SEQ ID NO: 1646686 - protein, 17 aa, Staphylococcus aureus
VIIPKRRSVTLTQTVAK

SEQ ID NO: 1646687 - protein, 26 aa, Staphylococcus aureus
VIMYSPKFKGGHALESDTTFSSIGAT

SEQ ID NO: 1646688 - protein, 17 aa, Staphylococcus aureus
VIPCGALDTLAHEIANR

SEQ ID NO: 1646689 - protein, 24 aa, Staphylococcus aureus
VISKSELLEKVWGYDYYEDANTVN

SEQ ID NO: 1646690 - protein, 18 aa, Staphylococcus aureus
VIVGINLLREGIDIPEVS

SEQ ID NO: 1646691 - protein, 25 aa, Staphylococcus aureus
VKATDLRAAAALILAGLVADGKTSV

SEQ ID NO: 1646692 - protein, 20 aa, Staphylococcus aureus
VKDLNDWGSTIVYSSHRMEH

SEQ ID NO: 1646693 - protein, 19 aa, Staphylococcus aureus
VKEKFGIELNREVRIIGEH

SEQ ID NO: 1646694 - protein, 20 aa, Staphylococcus aureus
VKKSRAVVERIIENEETVYG

SEQ ID NO: 1646695 - protein, 25 aa, Staphylococcus aureus
VKRDFYDVRGFLSCSRILVDKQQTL

SEQ ID NO: 1646696 - protein, 23 aa, Staphylococcus aureus
VLAVESKSGYGLDRENELKQLKV

SEQ ID NO: 1646697 - protein, 18 aa, Staphylococcus aureus
VLGICYGMQLTTKLLGGK

SEQ ID NO: 1646698 - protein, 20 aa, Staphylococcus aureus
VLMSGGTLILQRYFNGEELN

SEQ ID NO: 1646699 - protein, 23 aa, Staphylococcus aureus
VLTESGAFGRALVPSGASTGEHE

SEQ ID NO: 1646700 - protein, 20 aa, Staphylococcus aureus
VNLKSIMGVMSLGVGKDAEI

SEQ ID NO: 1646701 - protein, 23 aa, Staphylococcus aureus
VNMFNNYVSYEFDMPIADDSKET

SEQ ID NO: 1646702 - protein, 18 aa, Staphylococcus aureus
VPAARVGHIGLYRDPETL

SEQ ID NO: 1646703 - protein, 17 aa, Staphylococcus aureus
VPYHSREKLEIMISDYN

SEQ ID NO: 1646704 - protein, 21 aa, Staphylococcus aureus
VRKNPGEVCPAKWEEGAKTLQ

SEQ ID NO: 1646705 - protein, 18 aa, Staphylococcus aureus
VTKIAYAVSEHVKIETGN

SEQ ID NO: 1646706 - protein, 27 aa, Staphylococcus aureus
VTKNIPFRTAHEIVGKIVLECIQQGHY

SEQ ID NO: 1646707 - protein, 19 aa, Staphylococcus aureus
VTMGEEFMFNGKHVLIVYD

SEQ ID NO: 1646708 - protein, 23 aa, Staphylococcus aureus
VVITRPANDPALFESTVKSIKNF

SEQ ID NO: 1646709 - protein, 17 aa, Staphylococcus aureus
VVLRHSRRVSGITDLSI

SEQ ID NO: 1646710 - protein, 24 aa, Staphylococcus aureus
VVTTMAITVAREFKTENIVYIGSS

SEQ ID NO: 1646711 - protein, 17 aa, Staphylococcus aureus
VVVPTKIIAGEFGERTT

SEQ ID NO: 1646712 - protein, 25 aa, Staphylococcus aureus
VYLEHMKLYRSFREEVPEEEYTIDI

SEQ ID NO: 1646713 - protein, 17 aa, Staphylococcus aureus
WALEAYGAAYTLQEILT

SEQ ID NO: 1646714 - protein, 18 aa, Staphylococcus aureus
WANMLFRMYQRYCEKKGF

SEQ ID NO: 1646715 - protein, 22 aa, Staphylococcus aureus
WEREEKAYNAIRNFDAPTYATA

SEQ ID NO: 1646716 - protein, 25 aa, Staphylococcus aureus
WQGPPRLQNGTSWFYFATDQWKYEE

SEQ ID NO: 1646717 - protein, 17 aa, Staphylococcus aureus
WQSWGPYLLSGKDVFNS

SEQ ID NO: 1646718 - protein, 21 aa, Staphylococcus aureus
WSRIPHFYMNYYVYQYATGYS

SEQ ID NO: 1646719 - protein, 26 aa, Staphylococcus aureus
WVVAGRGELHLSILIENMRREGYELQ

SEQ ID NO: 1646720 - protein, 17 aa, Staphylococcus aureus
YDAKHFNPYLALDNQMN

SEQ ID NO: 1646721 - protein, 25 aa, Staphylococcus aureus
YDVQSCKDCFLESMQVQATNFQVFM

SEQ ID NO: 1646722 - protein, 26 aa, Staphylococcus aureus
YDYDYKRLHLFLTLTKEDGTLASTNE

SEQ ID NO: 1646723 - protein, 18 aa, Staphylococcus aureus
YEGGKMVVAEAYRNLIAV

SEQ ID NO: 1646724 - protein, 18 aa, Staphylococcus aureus
YGNKEIAEKLFVSVKTVE

SEQ ID NO: 1646725 - protein, 18 aa, Staphylococcus aureus
YIALEFASMFANLGSKVT

SEQ ID NO: 1646726 - protein, 25 aa, Staphylococcus aureus
YILDCKLPKGIDPYKFHEYLIHLTG

SEQ ID NO: 1646727 - protein, 23 aa, Staphylococcus aureus
YITPDKVHVMYAGKVVKSGGPEL

SEQ ID NO: 1646728 - protein, 19 aa, Staphylococcus aureus
YKKRAMLEGSFVINMTPFF

SEQ ID NO: 1646729 - protein, 22 aa, Staphylococcus aureus
YKLDFPESVVSFFKGEIGQPVN

SEQ ID NO: 1646730 - protein, 20 aa, Staphylococcus aureus
YKQAYFKGMFNETCPSFDDI

SEQ ID NO: 1646731 - protein, 20 aa, Staphylococcus aureus
YLERLRFVDDDVLCIEYSYY

SEQ ID NO: 1646732 - protein, 19 aa, Staphylococcus aureus
YLKQYRASQQLLYPLYKKG

SEQ ID NO: 1646733 - protein, 18 aa, Staphylococcus aureus
YLQENGIESHFIKQLSET

SEQ ID NO: 1646734 - protein, 18 aa, Staphylococcus aureus
YLVQESYDVMALVHECRE

SEQ ID NO: 1646735 - protein, 17 aa, Staphylococcus aureus
YMTPRLQPWDFAGGLVI

SEQ ID NO: 1646736 - protein, 24 aa, Staphylococcus aureus
YNVLAARLGWLPSYPQFNKNSLLF

SEQ ID NO: 1646737 - protein, 18 aa, Staphylococcus aureus
YNYLISVLRLQKWIPELQ

SEQ ID NO: 1646738 - protein, 20 aa, Staphylococcus aureus
YNYVMKWKETEIFFEKLTDL

SEQ ID NO: 1646739 - protein, 17 aa, Staphylococcus aureus
YPNCVLLGEGAKGSTLS

SEQ ID NO: 1646740 - protein, 22 aa, Staphylococcus aureus
YPTLLKRVCEVYKINMDKPFKK

SEQ ID NO: 1646741 - protein, 24 aa, Staphylococcus aureus
YQGKPLVCVGILKGSAMFMSDLIK

SEQ ID NO: 1646742 - protein, 22 aa, Staphylococcus aureus
YQTNELPAFFTRESGVKLTSSV

SEQ ID NO: 1646743 - protein, 18 aa, Staphylococcus aureus
YRELPFVVNQALVDQLPQ

SEQ ID NO: 1646744 - protein, 17 aa, Staphylococcus aureus
YRNVYVVGDCADLPHAP

SEQ ID NO: 1646745 - protein, 18 aa, Staphylococcus aureus
YRQVELFLSKVGDYCENR

SEQ ID NO: 1646746 - protein, 20 aa, Staphylococcus aureus
YYNQIRVFLKSLGLKSEDYR

SEQ ID NO: 1646747 - protein, 19 aa, Staphylococcus aureus
AAEWIKANMTKPVVGFIGG

SEQ ID NO: 1646748 - protein, 26 aa, Staphylococcus aureus
AAGAHGEWTALMIFKAYHENNGEGHR

SEQ ID NO: 1646749 - protein, 18 aa, Staphylococcus aureus
AALDELFDAILTLENREE

SEQ ID NO: 1646750 - protein, 24 aa, Staphylococcus aureus
AANEYKGELIFLHKVKDGAVDDSY

SEQ ID NO: 1646751 - protein, 21 aa, Staphylococcus aureus
ACPTCGSCAGMFTANSMNCLM

SEQ ID NO: 1646752 - protein, 22 aa, Staphylococcus aureus
ADASINWALGLMNEGSQIIDNT

SEQ ID NO: 1646753 - protein, 26 aa, Staphylococcus aureus
ADDYLRRSGLNYTILHPGALTNAAGS

SEQ ID NO: 1646754 - protein, 19 aa, Staphylococcus aureus
ADIGPRIQGTLIKKQVMMR

SEQ ID NO: 1646755 - protein, 26 aa, Staphylococcus aureus
ADNGIKFFGSDGFKLSDEQENEIEAL

SEQ ID NO: 1646756 - protein, 24 aa, Staphylococcus aureus
ADQSVFHIHFHLIPRYENDIDGFG

SEQ ID NO: 1646757 - protein, 29 aa, Staphylococcus aureus
ADSLHIGHLLPFLTLRRFQEHGHRPIVLI

SEQ ID NO: 1646758 - protein, 19 aa, Staphylococcus aureus
AEAHGITLANAHRADEDAA

SEQ ID NO: 1646759 - protein, 20 aa, Staphylococcus aureus
AEDAFYLTMEAFNLAEQYQC

SEQ ID NO: 1646760 - protein, 25 aa, Staphylococcus aureus
AEFKSSKTILDYVWDQYPLMNEKDI

SEQ ID NO: 1646761 - protein, 21 aa, Staphylococcus aureus
AEGIVPKLVWTKRIETGEVVT

SEQ ID NO: 1646762 - protein, 19 aa, Staphylococcus aureus
AEGVASFNQKGHEWALAHF

SEQ ID NO: 1646763 - protein, 25 aa, Staphylococcus aureus
AEKYLQMAHEFCPYSKATQGNINVD

SEQ ID NO: 1646764 - protein, 24 aa, Staphylococcus aureus
AENLGRLGETVAFLSASGQDSEWE

SEQ ID NO: 1646765 - protein, 18 aa, Staphylococcus aureus
AGADMIITYFAKDICRYL

SEQ ID NO: 1646766 - protein, 25 aa, Staphylococcus aureus
AGAGFPSIPLKIMFPQLKVTIVDSL

SEQ ID NO: 1646767 - protein, 25 aa, Staphylococcus aureus
AGIMTKCPKCKKIMYTKELAENLNV

SEQ ID NO: 1646768 - protein, 33 aa, Staphylococcus aureus
AGSNAIYEFLTLRIPMLLVPLGLDQSRGDQIDN

SEQ ID NO: 1646769 - protein, 19 aa, Staphylococcus aureus
AGVHSGDSIAVYPPQTLTE

SEQ ID NO: 1646770 - protein, 26 aa, Staphylococcus aureus
AHAIKRLYGNVKFGVGPVIEGGFYYD

SEQ ID NO: 1646771 - protein, 25 aa, Staphylococcus aureus
AHLAARKGLPYVFAGHFAPQQMKEA

SEQ ID NO: 1646772 - protein, 24 aa, Staphylococcus aureus
AIAGQRSAIMGAYYSEAQHGGQGT

SEQ ID NO: 1646773 - protein, 24 aa, Staphylococcus aureus
AIISYLSSDLFKGVGKKTAQNIVN

SEQ ID NO: 1646774 - protein, 33 aa, Staphylococcus aureus
AISKIAIPRVRFTTSHPWDFTDHMIDVISEGGN

SEQ ID NO: 1646775 - protein, 18 aa, Staphylococcus aureus
AITTDIKKVIAILETLDF

SEQ ID NO: 1646776 - protein, 20 aa, Staphylococcus aureus
AKELVHLSINFKKRTTTYDV

SEQ ID NO: 1646777 - protein, 24 aa, Staphylococcus aureus
AKERTRLRTLFPYINEASENHKKR

SEQ ID NO: 1646778 - protein, 24 aa, Staphylococcus aureus
AKEVAKGYECGITIENYNDLKEGD

SEQ ID NO: 1646779 - protein, 20 aa, Staphylococcus aureus
AKGGIVLAIRNELHIPVKYV

SEQ ID NO: 1646780 - protein, 26 aa, Staphylococcus aureus
AKHTLDYYAGLSFRTLVPKYPAMSPH

SEQ ID NO: 1646781 - protein, 17 aa, Staphylococcus aureus
AKIATYVDYKDTIEEAV

SEQ ID NO: 1646782 - protein, 18 aa, Staphylococcus aureus
AKIKEFKLLSTAGAYWRG

SEQ ID NO: 1646783 - protein, 24 aa, Staphylococcus aureus
AKKADAAPKRFIREFRNVDVDAYE

SEQ ID NO: 1646784 - protein, 21 aa, Staphylococcus aureus
AKKSLAVAVYNHYKRIQQLGP

SEQ ID NO: 1646785 - protein, 21 aa, Staphylococcus aureus
AKLETRNGYNLSAMSFDPEMV

SEQ ID NO: 1646786 - protein, 17 aa, Staphylococcus aureus
AKNLGYEVEERRVSIDE

SEQ ID NO: 1646787 - protein, 18 aa, Staphylococcus aureus
AKNYKYTLMMGRTHGVHA

SEQ ID NO: 1646788 - protein, 24 aa, Staphylococcus aureus
AKQLSEYILAFILDDYKKMKLSYD

SEQ ID NO: 1646789 - protein, 20 aa, Staphylococcus aureus
AKRLVEIGEDVIILMDSITR

SEQ ID NO: 1646790 - protein, 21 aa, Staphylococcus aureus
ALAHAMVRIGNNVGRNTMAII

SEQ ID NO: 1646791 - protein, 21 aa, Staphylococcus aureus
ALAKGRPGFDFIKHLKDEKES

SEQ ID NO: 1646792 - protein, 18 aa, Staphylococcus aureus
ALENAGFNTVVIGDTANS

SEQ ID NO: 1646793 - protein, 23 aa, Staphylococcus aureus
ALKEGKVVLCDRYIDSSLAYQGY

SEQ ID NO: 1646794 - protein, 20 aa, Staphylococcus aureus
ALRKYARVRLSNNIEINAYI

SEQ ID NO: 1646795 - protein, 20 aa, Staphylococcus aureus
ALRRFKRSVSKSGTIQEVRK

SEQ ID NO: 1646796 - protein, 25 aa, Staphylococcus aureus
AMNITQNEIVTWILGYTTSIEDMKQ

SEQ ID NO: 1646797 - protein, 17 aa, Staphylococcus aureus
ANFEKLKRFGLEDKVKA

SEQ ID NO: 1646798 - protein, 28 aa, Staphylococcus aureus
ANIQQAIWYKLLVNLGINSITALGRQTV

SEQ ID NO: 1646799 - protein, 27 aa, Staphylococcus aureus
ANKLRLLKLAPKVLLRLREGKITERHA

SEQ ID NO: 1646800 - protein, 24 aa, Staphylococcus aureus
APEIKVDEALALKWLNDGAKPTDT

SEQ ID NO: 1646801 - protein, 17 aa, Staphylococcus aureus
APVNFGANLGLMLDLYD

SEQ ID NO: 1646802 - protein, 26 aa, Staphylococcus aureus
APYNGLPHLVAPVITDVKAATQSLKW

SEQ ID NO: 1646803 - protein, 17 aa, Staphylococcus aureus
AQCVKQVEVIRARRLLD

SEQ ID NO: 1646804 - protein, 20 aa, Staphylococcus aureus
AQEQTPFIFVDFHAETTSEK

SEQ ID NO: 1646805 - protein, 24 aa, Staphylococcus aureus
AQGIGFKIAERLVEDGFKVAVVDF

SEQ ID NO: 1646806 - protein, 24 aa, Staphylococcus aureus
ARDTLRLEAGLPLHGQDLTESITP

SEQ ID NO: 1646807 - protein, 24 aa, Staphylococcus aureus
ARHHTFFEMLGNFSIGDYFKQEAI

SEQ ID NO: 1646808 - protein, 23 aa, Staphylococcus aureus
ARYTSDGQIEFLGRIDKQVKVNG

SEQ ID NO: 1646809 - protein, 19 aa, Staphylococcus aureus
ASDLRMMISSLKIASDLER

SEQ ID NO: 1646810 - protein, 17 aa, Staphylococcus aureus
ASQQLLYPLYKKGKFLS

SEQ ID NO: 1646811 - protein, 25 aa, Staphylococcus aureus
ASVEIAIKMAYQYWKNIDREKYAKK

SEQ ID NO: 1646812 - protein, 26 aa, Staphylococcus aureus
ASVVGGKAVECYGIVGMASRQQVRDG

SEQ ID NO: 1646813 - protein, 18 aa, Staphylococcus aureus
ATEARIQEELNYFEEIVS

SEQ ID NO: 1646814 - protein, 35 aa, Staphylococcus aureus
ATIEAIDIAMEFRKEFHKDVVIDLVGYRRFGHNEM

SEQ ID NO: 1646815 - protein, 19 aa, Staphylococcus aureus
ATNEAWYYIESSLQLTLPY

SEQ ID NO: 1646816 - protein, 21 aa, Staphylococcus aureus
ATQCLLEKSIAGFKEIEYEVM

SEQ ID NO: 1646817 - protein, 25 aa, Staphylococcus aureus
ATSEHLELFFSYRLEKGQTGRMLAF

SEQ ID NO: 1646818 - protein, 23 aa, Staphylococcus aureus
ATVKEVLPEIAVMHHLIEVDPVL

SEQ ID NO: 1646819 - protein, 26 aa, Staphylococcus aureus
AVEGFRPVMEVQFLGFVFEVFDAIAG

SEQ ID NO: 1646820 - protein, 25 aa, Staphylococcus aureus
AVETALKAARRWAYDVKGIEPNKAE

SEQ ID NO: 1646821 - protein, 18 aa, Staphylococcus aureus
AVEYWKEEGLDRVVLARE

SEQ ID NO: 1646822 - protein, 19 aa, Staphylococcus aureus
AVKLLNHLRHNGIKADKDY

SEQ ID NO: 1646823 - protein, 24 aa, Staphylococcus aureus
AVNRELPYHLAIKNLKQLDENFGV

SEQ ID NO: 1646824 - protein, 25 aa, Staphylococcus aureus
AVSHGLSGLEIDVFDLHSNKSRHIS

SEQ ID NO: 1646825 - protein, 22 aa, Staphylococcus aureus
AVSRLVGAPPGYVGHDDGGQLT

SEQ ID NO: 1646826 - protein, 26 aa, Staphylococcus aureus
AVTSLYRPGPMEEIPTYITRRHDPSK

SEQ ID NO: 1646827 - protein, 17 aa, Staphylococcus aureus
AVVGFEYGYNVENKKSF

SEQ ID NO: 1646828 - protein, 18 aa, Staphylococcus aureus
AWALKDYGFHIIIAGSFS

SEQ ID NO: 1646829 - protein, 27 aa, Staphylococcus aureus
AYADVEFKLYLGLKHISPFIEDAVEQM

SEQ ID NO: 1646830 - protein, 17 aa, Staphylococcus aureus
AYILSRRQLETEKSYSY

SEQ ID NO: 1646831 - protein, 24 aa, Staphylococcus aureus
AYMFRFKKKVKPEVDMTIKEFILL

SEQ ID NO: 1646832 - protein, 17 aa, Staphylococcus aureus
AYYAIKILEDMNVDWKK

SEQ ID NO: 1646833 - protein, 19 aa, Staphylococcus aureus
CCTHPVLSGPAKERIENSA

SEQ ID NO: 1646834 - protein, 20 aa, Staphylococcus aureus
CERLKREIYEETGIYCTVGI

SEQ ID NO: 1646835 - protein, 17 aa, Staphylococcus aureus
CHEMGGIIGADISVRYP

SEQ ID NO: 1646836 - protein, 18 aa, Staphylococcus aureus
CKVIKRKGKVMVICENPK

SEQ ID NO: 1646837 - protein, 17 aa, Staphylococcus aureus
CMEELKMMINIMKPEYF

SEQ ID NO: 1646838 - protein, 31 aa, Staphylococcus aureus
CNNFCTFCIIPWARGLMRSRDPEKVVEQATQ

SEQ ID NO: 1646839 - protein, 24 aa, Staphylococcus aureus
CRRKYLLEFFGEYPPAQDRCCDND

SEQ ID NO: 1646840 - protein, 17 aa, Staphylococcus aureus
CSYAQGFAQMRKASEDN

SEQ ID NO: 1646841 - protein, 21 aa, Staphylococcus aureus
CTGRMRYLGVLLYDADRVHEA

SEQ ID NO: 1646842 - protein, 24 aa, Staphylococcus aureus
CVDNLPPVLLPKFVELMEQGNPSL

SEQ ID NO: 1646843 - protein, 19 aa, Staphylococcus aureus
CVRILRRDADRIGIERNFT

SEQ ID NO: 1646844 - protein, 19 aa, Staphylococcus aureus
DADKMGMVATIDRVGTVRI

SEQ ID NO: 1646845 - protein, 22 aa, Staphylococcus aureus
DADLRILRRLTRDTKERGRSMD

SEQ ID NO: 1646846 - protein, 22 aa, Staphylococcus aureus
DAFAKVRGRLIVSCYASNFIRI

SEQ ID NO: 1646847 - protein, 25 aa, Staphylococcus aureus
DAIAAKAKDGASCVTYIGPNGAGHY

SEQ ID NO: 1646848 - protein, 20 aa, Staphylococcus aureus
DAKMIPKLDFAMSHYHDKIK

SEQ ID NO: 1646849 - protein, 24 aa, Staphylococcus aureus
DANIPIWLDRDCPFNIEGGDELVL

SEQ ID NO: 1646850 - protein, 23 aa, Staphylococcus aureus
DAPYSGLCVESFTGDYPAGLYDY

SEQ ID NO: 1646851 - protein, 20 aa, Staphylococcus aureus
DCYAILGLVHTLWKPMPGRF

SEQ ID NO: 1646852 - protein, 23 aa, Staphylococcus aureus
DDKTPLGELAIWIKEDDSFPKQE

SEQ ID NO: 1646853 - protein, 23 aa, Staphylococcus aureus
DDPAMIGGIGFLNGRAVTVIGQQ

SEQ ID NO: 1646854 - protein, 23 aa, Staphylococcus aureus
DDPMKQKVCDVATMAFENAIAKV

SEQ ID NO: 1646855 - protein, 17 aa, Staphylococcus aureus
DDYFNRRNIRPNVVVET

SEQ ID NO: 1646856 - protein, 23 aa, Staphylococcus aureus
DESFKLGIVLSYLKQYRASQQLL

SEQ ID NO: 1646857 - protein, 23 aa, Staphylococcus aureus
DEVITAFRFHYGAAQDLLGVIPD

SEQ ID NO: 1646858 - protein, 24 aa, Staphylococcus aureus
DEVTLKCHPDVNILIGENAQGKTN

SEQ ID NO: 1646859 - protein, 29 aa, Staphylococcus aureus
DFEKTMARGYRREEVDAFLDDIIADYQKM

SEQ ID NO: 1646860 - protein, 18 aa, Staphylococcus aureus
DFKEEFFEQYGLNVENPK

SEQ ID NO: 1646861 - protein, 21 aa, Staphylococcus aureus
DFKPLCLNSNFVEIEQTDDYV

SEQ ID NO: 1646862 - protein, 26 aa, Staphylococcus aureus
DFVVEGPLWIQVHAFEKGVEVTISKS

SEQ ID NO: 1646863 - protein, 23 aa, Staphylococcus aureus
DGDDIYYKLNVSFPQAALGDEIK

SEQ ID NO: 1646864 - protein, 18 aa, Staphylococcus aureus
DGIDVDRLLVVTFTNLSA

SEQ ID NO: 1646865 - protein, 24 aa, Staphylococcus aureus
DGKTGEMQLHLNVYKQPVCKVCGS

SEQ ID NO: 1646866 - protein, 26 aa, Staphylococcus aureus
DGLKSFKGSIIFTSYDFEFINTIANR

SEQ ID NO: 1646867 - protein, 17 aa, Staphylococcus aureus
DGVVKFERKGRDKKQVS

SEQ ID NO: 1646868 - protein, 17 aa, Staphylococcus aureus
DHYRIGLNKAIQYLSYK

SEQ ID NO: 1646869 - protein, 18 aa, Staphylococcus aureus
DIAELVMELEDEFGTEIP

SEQ ID NO: 1646870 - protein, 20 aa, Staphylococcus aureus
DIDELFDMFIYKNERLKLKM

SEQ ID NO: 1646871 - protein, 24 aa, Staphylococcus aureus
DIDIILRRNVDILQQWIEQKKGPF

SEQ ID NO: 1646872 - protein, 26 aa, Staphylococcus aureus
DIEELLARIRAILRRQPQKDIIDVNG

SEQ ID NO: 1646873 - protein, 17 aa, Staphylococcus aureus
DIHRFHNVFTFETKDIL

SEQ ID NO: 1646874 - protein, 28 aa, Staphylococcus aureus
DILKVEGVKSIFHVMDFISVDKENDANW

SEQ ID NO: 1646875 - protein, 21 aa, Staphylococcus aureus
DIQKGEFVAIMGPSGSGKTTL

SEQ ID NO: 1646876 - protein, 26 aa, Staphylococcus aureus
DKAAARFGSGWAWLVVNNGQLEIVTT

SEQ ID NO: 1646877 - protein, 25 aa, Staphylococcus aureus
DKIIIGGGMAYTFLKAQGKEIGISL

SEQ ID NO: 1646878 - protein, 19 aa, Staphylococcus aureus
DKKDELYVFKGYAGSDKDT

SEQ ID NO: 1646879 - protein, 29 aa, Staphylococcus aureus
DKQICHCFGCKKGGNVFQFTQEIKDISFV

SEQ ID NO: 1646880 - protein, 19 aa, Staphylococcus aureus
DKRRGKLTISKKWDQTTAI

SEQ ID NO: 1646881 - protein, 18 aa, Staphylococcus aureus
DKYGVRWMLHGQDYTAIQ

SEQ ID NO: 1646882 - protein, 24 aa, Staphylococcus aureus
DLPQIKVLMLTSFIEDKEVYRALD

SEQ ID NO: 1646883 - protein, 23 aa, Staphylococcus aureus
DLQLPIGILPGGTFNDFTKTLNI

SEQ ID NO: 1646884 - protein, 27 aa, Staphylococcus aureus
DMYLHPDLDTWVIFPWTAGQGKVARLI

SEQ ID NO: 1646885 - protein, 18 aa, Staphylococcus aureus
DNAWNLYERAGFMHTATK

SEQ ID NO: 1646886 - protein, 17 aa, Staphylococcus aureus
DNSRTPMQWDDTLNGGF

SEQ ID NO: 1646887 - protein, 24 aa, Staphylococcus aureus
DPEYYKWTQWIFIQLYNKGLAYVD

SEQ ID NO: 1646888 - protein, 18 aa, Staphylococcus aureus
DPNGLIFYKGKYYVSHQW

SEQ ID NO: 1646889 - protein, 25 aa, Staphylococcus aureus
DPVLSRVSVHLANFLEIPFDVYPQD

SEQ ID NO: 1646890 - protein, 23 aa, Staphylococcus aureus
DPYRGVISSIRIVDGVVKAGDKI

SEQ ID NO: 1646891 - protein, 24 aa, Staphylococcus aureus
DQARTIRIPVHMVETINKLIRVQR

SEQ ID NO: 1646892 - protein, 22 aa, Staphylococcus aureus
DQLKAMGIQAAFLNSSLTQKEQ

SEQ ID NO: 1646893 - protein, 21 aa, Staphylococcus aureus
DQLYYLMSRGISQREAERLVI

SEQ ID NO: 1646894 - protein, 21 aa, Staphylococcus aureus
DQPRRVSTWGDDDKYWYESAT

SEQ ID NO: 1646895 - protein, 18 aa, Staphylococcus aureus
DQQSYCVLIASPKTETGI

SEQ ID NO: 1646896 - protein, 24 aa, Staphylococcus aureus
DRVKKIKLGNGFDADTEMGPVIST

SEQ ID NO: 1646897 - protein, 21 aa, Staphylococcus aureus
DRVPSIEKVRMVSSGTEATLD

SEQ ID NO: 1646898 - protein, 21 aa, Staphylococcus aureus
DSGFDGYFLIAANPVDILTRF

SEQ ID NO: 1646899 - protein, 19 aa, Staphylococcus aureus
DSQPAFINDILKVEGVKSI

SEQ ID NO: 1646900 - protein, 18 aa, Staphylococcus aureus
DTDIANTVAFLASDKAKY

SEQ ID NO: 1646901 - protein, 23 aa, Staphylococcus aureus
DTKPCSNERVISRDADVMVHEAT

SEQ ID NO: 1646902 - protein, 24 aa, Staphylococcus aureus
DTWFSSALWPFSTLGWPDLESEDF

SEQ ID NO: 1646903 - protein, 21 aa, Staphylococcus aureus
DVKIPVLGFGVFQIPQEQTAE

SEQ ID NO: 1646904 - protein, 23 aa, Staphylococcus aureus
DVSRVARDYALTGLEFACGIPGS

SEQ ID NO: 1646905 - protein, 24 aa, Staphylococcus aureus
DVVKRTCGYLGNPVQRPVIKGRHK

SEQ ID NO: 1646906 - protein, 17 aa, Staphylococcus aureus
DYFEVYKHNELLELTPK

SEQ ID NO: 1646907 - protein, 22 aa, Staphylococcus aureus
DYLTIKPCETFNLEYGTLKENG

SEQ ID NO: 1646908 - protein, 24 aa, Staphylococcus aureus
DYSEYGGSVLLGLEGTVVKAHGSS

SEQ ID NO: 1646909 - protein, 24 aa, Staphylococcus aureus
EAIREAGAIPFEFNTIGVDDGIAM

SEQ ID NO: 1646910 - protein, 25 aa, Staphylococcus aureus
EALELAEQMGIIFIDEIDKVATNNH

SEQ ID NO: 1646911 - protein, 30 aa, Staphylococcus aureus
EALLNFVSRGEIDPVIRFYTWNPATLSIGY

SEQ ID NO: 1646912 - protein, 19 aa, Staphylococcus aureus
EALNFKINALLIKSKSDYI

SEQ ID NO: 1646913 - protein, 30 aa, Staphylococcus aureus
EAMVRMAQDFSYRYPLVDGQGNFGSMDGDG

SEQ ID NO: 1646914 - protein, 17 aa, Staphylococcus aureus
EANTIFLEQNYRSTKTI

SEQ ID NO: 1646915 - protein, 20 aa, Staphylococcus aureus
EAPLKALIFDSEYDPYRGVI

SEQ ID NO: 1646916 - protein, 19 aa, Staphylococcus aureus
EARGFIIGCPVAYSMGIGF

SEQ ID NO: 1646917 - protein, 17 aa, Staphylococcus aureus
EASRRALPQKLTHSEAV

SEQ ID NO: 1646918 - protein, 20 aa, Staphylococcus aureus
EAVKELGDRVNVAVDIEATQ

SEQ ID NO: 1646919 - protein, 24 aa, Staphylococcus aureus
ECSEHRMLVDLGRNDIHRVSKIGT

SEQ ID NO: 1646920 - protein, 20 aa, Staphylococcus aureus
EDARQAMLRGVDQLANAVKV

SEQ ID NO: 1646921 - protein, 24 aa, Staphylococcus aureus
EDDAKKGFLLDGFPRTIEQAEALN

SEQ ID NO: 1646922 - protein, 17 aa, Staphylococcus aureus
EDEIKRDISCNLGSLNI

SEQ ID NO: 1646923 - protein, 17 aa, Staphylococcus aureus
EDGHTFLPIAQSFIEQY

SEQ ID NO: 1646924 - protein, 17 aa, Staphylococcus aureus
EDIDEWIGLLDQLEEKV

SEQ ID NO: 1646925 - protein, 24 aa, Staphylococcus aureus
EDLAKFSGVPVWNGLTDDWHPTQM

SEQ ID NO: 1646926 - protein, 24 aa, Staphylococcus aureus
EDLNSKLYHYWALGHIHERQQLSD

SEQ ID NO: 1646927 - protein, 17 aa, Staphylococcus aureus
EDMKLPKAYILEIASNW

SEQ ID NO: 1646928 - protein, 27 aa, Staphylococcus aureus
EDMNVDWKKRIHMIIGTDEESDWKCTD

SEQ ID NO: 1646929 - protein, 20 aa, Staphylococcus aureus
EDMPYIKAWAEKHHVEVDIT

SEQ ID NO: 1646930 - protein, 24 aa, Staphylococcus aureus
EDYGVYRFKRGFNVQIEELIGDFY

SEQ ID NO: 1646931 - protein, 21 aa, Staphylococcus aureus
EEAKMSGQVILLLDEIHRLDK

SEQ ID NO: 1646932 - protein, 18 aa, Staphylococcus aureus
EEDIELFKDIADKVKQTN

SEQ ID NO: 1646933 - protein, 20 aa, Staphylococcus aureus
EEIQRLNLEYAPCDELSMGM

SEQ ID NO: 1646934 - protein, 22 aa, Staphylococcus aureus
EEIYRIDHYLGKDMVQNIEVLR

SEQ ID NO: 1646935 - protein, 25 aa, Staphylococcus aureus
EEKMKELQDFIARFSANASKSKQAT

SEQ ID NO: 1646936 - protein, 21 aa, Staphylococcus aureus
EELQLRLKLAEVEVPIIVERD

SEQ ID NO: 1646937 - protein, 23 aa, Staphylococcus aureus
EETIGFIIGPRLNAVGRLDDASL

SEQ ID NO: 1646938 - protein, 20 aa, Staphylococcus aureus
EETPFAAVILAEIFDKVGVP

SEQ ID NO: 1646939 - protein, 24 aa, Staphylococcus aureus
EEVLYPAMEDFFLDIIIGKGDEAR

SEQ ID NO: 1646940 - protein, 28 aa, Staphylococcus aureus
EFNIPKSWKLIAQMPFGDIREAAGEKTF

SEQ ID NO: 1646941 - protein, 19 aa, Staphylococcus aureus
EGISEIFKSMGATHIISGG

SEQ ID NO: 1646942 - protein, 24 aa, Staphylococcus aureus
EGKLPREVIRYEYDLEYGTNVLTM

SEQ ID NO: 1646943 - protein, 18 aa, Staphylococcus aureus
EGKNVWFGVREFAMGAAV

SEQ ID NO: 1646944 - protein, 19 aa, Staphylococcus aureus
EGLGGIRIEDDILITENGC

SEQ ID NO: 1646945 - protein, 18 aa, Staphylococcus aureus
EGLISVSHPLAAKIGKDV

SEQ ID NO: 1646946 - protein, 22 aa, Staphylococcus aureus
EGMSCGHCKSAVESALNNIDGV

SEQ ID NO: 1646947 - protein, 20 aa, Staphylococcus aureus
EHMLFIGAGAFHVSKPSDLI

SEQ ID NO: 1646948 - protein, 27 aa, Staphylococcus aureus
EIFPASKEELCIRVEFFGDEIDRIREV

SEQ ID NO: 1646949 - protein, 27 aa, Staphylococcus aureus
EIFYDPKHPYTWGLLSSMPDLSTTNDT

SEQ ID NO: 1646950 - protein, 17 aa, Staphylococcus aureus
EIMGLNIMQPFKVYPNG

SEQ ID NO: 1646951 - protein, 20 aa, Staphylococcus aureus
EINARLIIIDEMSMVDTWLF

SEQ ID NO: 1646952 - protein, 19 aa, Staphylococcus aureus
EIRRYLHQHPELSFHEDET

SEQ ID NO: 1646953 - protein, 27 aa, Staphylococcus aureus
EIVEKSLRGAAIWDELKDRLHTNAYSL

SEQ ID NO: 1646954 - protein, 19 aa, Staphylococcus aureus
EKADFIKRVIKSEEERFHE

SEQ ID NO: 1646955 - protein, 19 aa, Staphylococcus aureus
EKANDLWRNQLGDLLTPPG

SEQ ID NO: 1646956 - protein, 22 aa, Staphylococcus aureus
EKESFGLTLLEAMKTGVVPIGS

SEQ ID NO: 1646957 - protein, 25 aa, Staphylococcus aureus
EKEVTRLANHLGWKGKGTNFDVLPL

SEQ ID NO: 1646958 - protein, 17 aa, Staphylococcus aureus
EKFGVTFPVLAKISVNG

SEQ ID NO: 1646959 - protein, 25 aa, Staphylococcus aureus
EKGYFARPTIFINVDNQMTIAQEEI

SEQ ID NO: 1646960 - protein, 18 aa, Staphylococcus aureus
EKIIWDIGGIAPKPCHEI

SEQ ID NO: 1646961 - protein, 24 aa, Staphylococcus aureus
EKIYKQLLRNGVDFMTMGNHTYGQ

SEQ ID NO: 1646962 - protein, 27 aa, Staphylococcus aureus
ELDLFTCLRPVRWFKGVPSPVKRPQDV

SEQ ID NO: 1646963 - protein, 22 aa, Staphylococcus aureus
ELENHFFGRVGLFRNQVGDELL

SEQ ID NO: 1646964 - protein, 17 aa, Staphylococcus aureus
ELGIDWPSVNANLDAVK

SEQ ID NO: 1646965 - protein, 20 aa, Staphylococcus aureus
ELGYKAAGLDTSRKAILTAV

SEQ ID NO: 1646966 - protein, 22 aa, Staphylococcus aureus
ELNLKGGQKMYFDQKIETYVPA

SEQ ID NO: 1646967 - protein, 23 aa, Staphylococcus aureus
ELPYGAVPIDFAYAIHSEVGNKM

SEQ ID NO: 1646968 - protein, 25 aa, Staphylococcus aureus
ELRELQSRLGITFIFVTHDQEEALA

SEQ ID NO: 1646969 - protein, 24 aa, Staphylococcus aureus
ELTDARASEHFDYVLMSAGGGTSE

SEQ ID NO: 1646970 - protein, 26 aa, Staphylococcus aureus
ELTPELAFKLGRYGGYVLAHNKGEKH

SEQ ID NO: 1646971 - protein, 19 aa, Staphylococcus aureus
EMRELSYAGFSVFHDEALQ

SEQ ID NO: 1646972 - protein, 20 aa, Staphylococcus aureus
EMRLDGPTIVAGFLHDVIED

SEQ ID NO: 1646973 - protein, 18 aa, Staphylococcus aureus
EMYREMAKEGVFLPPSQF

SEQ ID NO: 1646974 - protein, 20 aa, Staphylococcus aureus
ENFGALMITHYQRLLNYITP

SEQ ID NO: 1646975 - protein, 17 aa, Staphylococcus aureus
ENIYPYQIETVAKQFPG

SEQ ID NO: 1646976 - protein, 18 aa, Staphylococcus aureus
ENLKCSFCGKDQDQVKKL

SEQ ID NO: 1646977 - protein, 24 aa, Staphylococcus aureus
ENLVPDYLDGLLFDDIPYLEVAQK

SEQ ID NO: 1646978 - protein, 25 aa, Staphylococcus aureus
ENPELPRPVGNDIVHYSDYFEGAQK

SEQ ID NO: 1646979 - protein, 19 aa, Staphylococcus aureus
EPDFLIVIYHGGLNKISNS

SEQ ID NO: 1646980 - protein, 24 aa, Staphylococcus aureus
EPEILKPRLVPLLRMSNKEFKQTY

SEQ ID NO: 1646981 - protein, 19 aa, Staphylococcus aureus
EPILDIVDYVLVMTVNPGF

SEQ ID NO: 1646982 - protein, 25 aa, Staphylococcus aureus
EPMVLPSRFPNLLVNGSTGISAGYA

SEQ ID NO: 1646983 - protein, 25 aa, Staphylococcus aureus
EQMNEFERMILLRSIDSHWTDHIDT

SEQ ID NO: 1646984 - protein, 17 aa, Staphylococcus aureus
EREAVGIQDLPSTLYTA

SEQ ID NO: 1646985 - protein, 22 aa, Staphylococcus aureus
EREDGSDVFVHFSAIAEDGYKS

SEQ ID NO: 1646986 - protein, 20 aa, Staphylococcus aureus
ERIEREFGIELIATAPSVIY

SEQ ID NO: 1646987 - protein, 18 aa, Staphylococcus aureus
ERNMKLEFERNYERYQFL

SEQ ID NO: 1646988 - protein, 20 aa, Staphylococcus aureus
ERPDILIGVCGCMSQEESVV

SEQ ID NO: 1646989 - protein, 20 aa, Staphylococcus aureus
ESDLKEGCDMMIVKPALSYL

SEQ ID NO: 1646990 - protein, 21 aa, Staphylococcus aureus
ESLFGGAIPNFGQNNEDEEEP

SEQ ID NO: 1646991 - protein, 19 aa, Staphylococcus aureus
ESLTPFKAKVKTGYLARYT

SEQ ID NO: 1646992 - protein, 23 aa, Staphylococcus aureus
ESMEFPEPVIHLSVEPKSKADQD

SEQ ID NO: 1646993 - protein, 21 aa, Staphylococcus aureus
ESNIAALFWQNGHLEPELQDE

SEQ ID NO: 1646994 - protein, 25 aa, Staphylococcus aureus
ESSEIIKKLFLLGIVANINQSLNQE

SEQ ID NO: 1646995 - protein, 23 aa, Staphylococcus aureus
ETFLRGFLGRMLFSGEEVKKKAS

SEQ ID NO: 1646996 - protein, 21 aa, Staphylococcus aureus
ETKGAFPTWLAPKQVQIIPVN

SEQ ID NO: 1646997 - protein, 19 aa, Staphylococcus aureus
ETKRIGITRLHMEEDAGKS

SEQ ID NO: 1646998 - protein, 28 aa, Staphylococcus aureus
ETNTMPQWAGSCWYYLRYIDPKNENMLA

SEQ ID NO: 1646999 - protein, 26 aa, Staphylococcus aureus
ETSGWTNIFIYPGFDFKAIDGQITNF

SEQ ID NO: 1647000 - protein, 31 aa, Staphylococcus aureus
ETTSEKYAMGWHLDGRASAVVGTHTHIQTAD

SEQ ID NO: 1647001 - protein, 25 aa, Staphylococcus aureus
ETYLEVQRIYFLKDFQGGGRGSQLI

SEQ ID NO: 1647002 - protein, 20 aa, Staphylococcus aureus
EVESVICAPAIQLDALTTAV

SEQ ID NO: 1647003 - protein, 18 aa, Staphylococcus aureus
EVILVGGSTRIPAVQEAV

SEQ ID NO: 1647004 - protein, 23 aa, Staphylococcus aureus
EVNILKMQLLIWITETPSGDIQE

SEQ ID NO: 1647005 - protein, 20 aa, Staphylococcus aureus
EVTPSMMVFTNFFRDQMDRF

SEQ ID NO: 1647006 - protein, 26 aa, Staphylococcus aureus
EVYDPRKYLGPAREAIKETVKGKIKE

SEQ ID NO: 1647007 - protein, 27 aa, Staphylococcus aureus
EYSPLRIKYPYIRGKLWDLWTEALEEN

SEQ ID NO: 1647008 - protein, 24 aa, Staphylococcus aureus
FAINQYIKYCRWQNSVLEPTLSAM

SEQ ID NO: 1647009 - protein, 21 aa, Staphylococcus aureus
FAVVGDTLFNNGIGRTDLYKG

SEQ ID NO: 1647010 - protein, 17 aa, Staphylococcus aureus
FDFLKDPVKNGADKFKQ

SEQ ID NO: 1647011 - protein, 18 aa, Staphylococcus aureus
FDGLKALLPAITETFDGI

SEQ ID NO: 1647012 - protein, 18 aa, Staphylococcus aureus
FDLILKFADYGFPRAHAV

SEQ ID NO: 1647013 - protein, 24 aa, Staphylococcus aureus
FDMSFERKFEAFLVPTVIGEIKRY

SEQ ID NO: 1647014 - protein, 17 aa, Staphylococcus aureus
FDVFEMVDGKYEIRESK

SEQ ID NO: 1647015 - protein, 19 aa, Staphylococcus aureus
FDYVFPYMMQFIADLPVVA

SEQ ID NO: 1647016 - protein, 18 aa, Staphylococcus aureus
FEDVRIVRDMRNSVNRLV

SEQ ID NO: 1647017 - protein, 18 aa, Staphylococcus aureus
FEIYEPRFGTIFESKANV

SEQ ID NO: 1647018 - protein, 31 aa, Staphylococcus aureus
FEKVRELFDGMAIPTSEDWKKLQQDVEQYGL

SEQ ID NO: 1647019 - protein, 18 aa, Staphylococcus aureus
FELLDEIEETLNIETYPM

SEQ ID NO: 1647020 - protein, 25 aa, Staphylococcus aureus
FELNKDFNFSAAHHIPCEEAGICQN

SEQ ID NO: 1647021 - protein, 24 aa, Staphylococcus aureus
FEQTEVRLVLSFLRAIDNPLQDIY

SEQ ID NO: 1647022 - protein, 24 aa, Staphylococcus aureus
FEQYKKFILDSGISSTQFVYNNLS

SEQ ID NO: 1647023 - protein, 26 aa, Staphylococcus aureus
FERELGFLALHGFLHLLGYDHMTEAD

SEQ ID NO: 1647024 - protein, 21 aa, Staphylococcus aureus
FESELPFSWVYDENGITETMK

SEQ ID NO: 1647025 - protein, 22 aa, Staphylococcus aureus
FESNRCKIAFLINDLNTTAIQK

SEQ ID NO: 1647026 - protein, 23 aa, Staphylococcus aureus
FGCGSSREHAAWALKDYGFHIII

SEQ ID NO: 1647027 - protein, 18 aa, Staphylococcus aureus
FGGFSGFGGGGFEDIFSS

SEQ ID NO: 1647028 - protein, 27 aa, Staphylococcus aureus
FGHQLRFDLSKGFPLLTTKKVSFKLVA

SEQ ID NO: 1647029 - protein, 17 aa, Staphylococcus aureus
FGPILPILTYQSLDEAI

SEQ ID NO: 1647030 - protein, 18 aa, Staphylococcus aureus
FGVGPVIEGGFYYDFDID

SEQ ID NO: 1647031 - protein, 18 aa, Staphylococcus aureus
FHNVFTFETKDILKDLHA

SEQ ID NO: 1647032 - protein, 21 aa, Staphylococcus aureus
FHPERMASRILGMGDVLSLIE

SEQ ID NO: 1647033 - protein, 25 aa, Staphylococcus aureus
FHSEYWFNVICMFREDGIYYYCNLS

SEQ ID NO: 1647034 - protein, 22 aa, Staphylococcus aureus
FIHQRPKPLSLYLFSEDENATQ

SEQ ID NO: 1647035 - protein, 28 aa, Staphylococcus aureus
FIKSELGSRMRLRIMPELMYEYDQSIEY

SEQ ID NO: 1647036 - protein, 18 aa, Staphylococcus aureus
FIVHRDFAYERGKALVEK

SEQ ID NO: 1647037 - protein, 24 aa, Staphylococcus aureus
FKEEGHKLIGIRGMPRVGKTESIV

SEQ ID NO: 1647038 - protein, 17 aa, Staphylococcus aureus
FKGQKMPGRMGGNTVTV

SEQ ID NO: 1647039 - protein, 26 aa, Staphylococcus aureus
FKHLNRFARVPVCGAISSYNHPEADI

SEQ ID NO: 1647040 - protein, 20 aa, Staphylococcus aureus
FKINALLIKSKSDYISLGLI

SEQ ID NO: 1647041 - protein, 24 aa, Staphylococcus aureus
FKIRVICGKGTYIRTLATDIGVKL

SEQ ID NO: 1647042 - protein, 22 aa, Staphylococcus aureus
FKPKDVIIVEGIFALENKVLRD

SEQ ID NO: 1647043 - protein, 20 aa, Staphylococcus aureus
FKQTYGHLAGAWRGKKPIQR

SEQ ID NO: 1647044 - protein, 17 aa, Staphylococcus aureus
FKQYGLPIITSKVTPEK

SEQ ID NO: 1647045 - protein, 17 aa, Staphylococcus aureus
FKSMGATHIISGGQTMN

SEQ ID NO: 1647046 - protein, 19 aa, Staphylococcus aureus
FKTDNRGLFAYSLESMSQF

SEQ ID NO: 1647047 - protein, 21 aa, Staphylococcus aureus
FLEKIRKALYMSKICSYAQGF

SEQ ID NO: 1647048 - protein, 17 aa, Staphylococcus aureus
FLHEIRVDRIIFGDPAV

SEQ ID NO: 1647049 - protein, 17 aa, Staphylococcus aureus
FMHHYNFPNFSVGETGP

SEQ ID NO: 1647050 - protein, 27 aa, Staphylococcus aureus
FMHRKKPANGFVCYMIGRLILENCRNV

SEQ ID NO: 1647051 - protein, 23 aa, Staphylococcus aureus
FMKMAEAYGVKGFLIDKPEQLEE

SEQ ID NO: 1647052 - protein, 25 aa, Staphylococcus aureus
FMNELKINLLEFRQQMDLLEAIGLL

SEQ ID NO: 1647053 - protein, 19 aa, Staphylococcus aureus
FNAEKGFGFIEREDGSDVF

SEQ ID NO: 1647054 - protein, 17 aa, Staphylococcus aureus
FNDLSLRDIFQQLKVPK

SEQ ID NO: 1647055 - protein, 21 aa, Staphylococcus aureus
FNKYRLEIHSNLPKCLFPLTV

SEQ ID NO: 1647056 - protein, 20 aa, Staphylococcus aureus
FNQPDEWDSPFNIYKPHSGF

SEQ ID NO: 1647057 - protein, 19 aa, Staphylococcus aureus
FPDFEDYILLWKLEVLPKY

SEQ ID NO: 1647058 - protein, 23 aa, Staphylococcus aureus
FPHILRGVNILGIDSVFTAMKLR

SEQ ID NO: 1647059 - protein, 25 aa, Staphylococcus aureus
FPVVNESYKLVGIVTSREMINTKDD

SEQ ID NO: 1647060 - protein, 19 aa, Staphylococcus aureus
FPYMMQFIADLPVVAHNAA

SEQ ID NO: 1647061 - protein, 17 aa, Staphylococcus aureus
FQAILPLRGKVINTEKA

SEQ ID NO: 1647062 - protein, 18 aa, Staphylococcus aureus
FQEHGHRPIVLIGGGTGM

SEQ ID NO: 1647063 - protein, 20 aa, Staphylococcus aureus
FQPLTNCCLIDAKNMLHNGF

SEQ ID NO: 1647064 - protein, 20 aa, Staphylococcus aureus
FRATLFRQTMFAEFEHKIHA

SEQ ID NO: 1647065 - protein, 18 aa, Staphylococcus aureus
FRGGMPSEGGFGVTVATL

SEQ ID NO: 1647066 - protein, 25 aa, Staphylococcus aureus
FRHFAGSYAVQWEMINYALNHGIDR

SEQ ID NO: 1647067 - protein, 26 aa, Staphylococcus aureus
FRQQMDLLEAIGLLKAFVKHDEQETQ

SEQ ID NO: 1647068 - protein, 28 aa, Staphylococcus aureus
FSELFKSELKIAIGPVERGGAGGGIAAV

SEQ ID NO: 1647069 - protein, 17 aa, Staphylococcus aureus
FSPKFLKTGSHMDLIKS

SEQ ID NO: 1647070 - protein, 22 aa, Staphylococcus aureus
FSQHLDIDFIFKARKPMGKAFD

SEQ ID NO: 1647071 - protein, 19 aa, Staphylococcus aureus
FSRTGKKGGPFIDSLNHRS

SEQ ID NO: 1647072 - protein, 25 aa, Staphylococcus aureus
FSSDCFKLSAILSKLRIEYNQYIRI

SEQ ID NO: 1647073 - protein, 17 aa, Staphylococcus aureus
FTARHHTFFEMLGNFSI

SEQ ID NO: 1647074 - protein, 25 aa, Staphylococcus aureus
FTHWEELKSTWKFVDAIQDEWNMVD

SEQ ID NO: 1647075 - protein, 25 aa, Staphylococcus aureus
FTTYWPTNEVMPIFDAAMKYKEDGT

SEQ ID NO: 1647076 - protein, 18 aa, Staphylococcus aureus
FVINSMLVRKDFYSYTRI

SEQ ID NO: 1647077 - protein, 24 aa, Staphylococcus aureus
FYDNEASLGRALKDNGVDREDLFI

SEQ ID NO: 1647078 - protein, 24 aa, Staphylococcus aureus
FYDYPKMVHDFPIYPIRQSHKAIK

SEQ ID NO: 1647079 - protein, 17 aa, Staphylococcus aureus
FYEFYSYLMEPWDGPTM

SEQ ID NO: 1647080 - protein, 25 aa, Staphylococcus aureus
GAAKPRLPFDHVFHHNKYHADKETQ

SEQ ID NO: 1647081 - protein, 21 aa, Staphylococcus aureus
GAEVLKYIDFNAGNIAKQLLN

SEQ ID NO: 1647082 - protein, 21 aa, Staphylococcus aureus
GAKAPRLVTEDMIKQMKNGSV

SEQ ID NO: 1647083 - protein, 24 aa, Staphylococcus aureus
GAMELKDILKYIGPKTLLIVGNRE

SEQ ID NO: 1647084 - protein, 24 aa, Staphylococcus aureus
GAQNKIRVQFRFNEQLKPLTADYL

SEQ ID NO: 1647085 - protein, 23 aa, Staphylococcus aureus
GARCMDCGTPFCQTGQQYGRETI

SEQ ID NO: 1647086 - protein, 24 aa, Staphylococcus aureus
GCDYRCSWCDSAFTWDGSAKGDIK

SEQ ID NO: 1647087 - protein, 18 aa, Staphylococcus aureus
GCGAPLQSEDKNKPGFVP

SEQ ID NO: 1647088 - protein, 19 aa, Staphylococcus aureus
GDILLQVLLHTSIGKKEGY

SEQ ID NO: 1647089 - protein, 17 aa, Staphylococcus aureus
GDLRRETNLNIKRLMEI

SEQ ID NO: 1647090 - protein, 22 aa, Staphylococcus aureus
GDPRANLKRVLKEMEDLGFTDF

SEQ ID NO: 1647091 - protein, 18 aa, Staphylococcus aureus
GDPVLALGGQVKRNDLLR

SEQ ID NO: 1647092 - protein, 19 aa, Staphylococcus aureus
GDSKVGVVIHADHYSNNMM

SEQ ID NO: 1647093 - protein, 26 aa, Staphylococcus aureus
GDTEGRYGTFAKYFTKNDVPTFAICH

SEQ ID NO: 1647094 - protein, 18 aa, Staphylococcus aureus
GDVQGSVEALAASLMKID

SEQ ID NO: 1647095 - protein, 24 aa, Staphylococcus aureus
GEGFHICKGELFGKHRHGEDCLFC

SEQ ID NO: 1647096 - protein, 22 aa, Staphylococcus aureus
GELHVSGIVTFGHLLARAVARD

SEQ ID NO: 1647097 - protein, 26 aa, Staphylococcus aureus
GENERYLEVWNLVFSEFNHNKDHSYT

SEQ ID NO: 1647098 - protein, 26 aa, Staphylococcus aureus
GEQKFGLRLPGEFNRQQMTEAVALAH

SEQ ID NO: 1647099 - protein, 27 aa, Staphylococcus aureus
GFGKEVKRRIFLGTFALSSGYYDAYYK

SEQ ID NO: 1647100 - protein, 25 aa, Staphylococcus aureus
GGKGLLCVYEGFLKALKGEKVEAKV

SEQ ID NO: 1647101 - protein, 20 aa, Staphylococcus aureus
GGLYMEKFIENFRHIEIQIV

SEQ ID NO: 1647102 - protein, 19 aa, Staphylococcus aureus
GGPGTFSPLLLDTLYHLNE

SEQ ID NO: 1647103 - protein, 19 aa, Staphylococcus aureus
GGQGTRLGYKGPKGSFEIE

SEQ ID NO: 1647104 - protein, 22 aa, Staphylococcus aureus
GGSRLKDGILAIDLLRRPEMTY

SEQ ID NO: 1647105 - protein, 24 aa, Staphylococcus aureus
GGYARHGGGCFSGKDPTKVDRSAA

SEQ ID NO: 1647106 - protein, 17 aa, Staphylococcus aureus
GHELFDIMMQNIEEDTC

SEQ ID NO: 1647107 - protein, 25 aa, Staphylococcus aureus
GHKFADCPNFVKGHVPELYVDNNRI

SEQ ID NO: 1647108 - protein, 24 aa, Staphylococcus aureus
GIAIVKLLYAYGVRNMVMCDSRGA

SEQ ID NO: 1647109 - protein, 22 aa, Staphylococcus aureus
GIDSCPMEGFSLDTVTDILANK

SEQ ID NO: 1647110 - protein, 26 aa, Staphylococcus aureus
GIIDKFRLPYLLGKADYIFVDDFHPL

SEQ ID NO: 1647111 - protein, 22 aa, Staphylococcus aureus
GIIDRYFFKSLYYRHNSIMYEF

SEQ ID NO: 1647112 - protein, 25 aa, Staphylococcus aureus
GIYYYCNLSSPFVCDEEALKYIDYD

SEQ ID NO: 1647113 - protein, 22 aa, Staphylococcus aureus
GKALFAASFVTHFSGQTPHIHF

SEQ ID NO: 1647114 - protein, 26 aa, Staphylococcus aureus
GKDAFKLYDTYGFPIELTEEIAVQAG

SEQ ID NO: 1647115 - protein, 20 aa, Staphylococcus aureus
GKEGIAVTFVNPIEMDYIRQ

SEQ ID NO: 1647116 - protein, 23 aa, Staphylococcus aureus
GKGEIKIPRYFFLAETEEFEPGN

SEQ ID NO: 1647117 - protein, 21 aa, Staphylococcus aureus
GKGKAMGFLVGQIMKASKGQA

SEQ ID NO: 1647118 - protein, 23 aa, Staphylococcus aureus
GKGKTKRVEYAWTDEELNKLQKE

SEQ ID NO: 1647119 - protein, 24 aa, Staphylococcus aureus
GKITRNAGVRIIRDGIVQYEGELD

SEQ ID NO: 1647120 - protein, 24 aa, Staphylococcus aureus
GKKFGKSESGAVWLDAEKTSPYEF

SEQ ID NO: 1647121 - protein, 19 aa, Staphylococcus aureus
GKRTSICSVGMVKVIDSQI

SEQ ID NO: 1647122 - protein, 25 aa, Staphylococcus aureus
GKSLSRLGGGIGTRGPGETKLEMDR

SEQ ID NO: 1647123 - protein, 23 aa, Staphylococcus aureus
GKSRAIPIFVFLNDQFEQETVWG

SEQ ID NO: 1647124 - protein, 18 aa, Staphylococcus aureus
GKYFEAWIAKKILIPTPF

SEQ ID NO: 1647125 - protein, 18 aa, Staphylococcus aureus
GLASARRGAKTLMLTINL

SEQ ID NO: 1647126 - protein, 25 aa, Staphylococcus aureus
GLDIVWKFAEKVIFPHVEQNELLGV

SEQ ID NO: 1647127 - protein, 20 aa, Staphylococcus aureus
GLIPEDWGGETIFVPLSALS

SEQ ID NO: 1647128 - protein, 17 aa, Staphylococcus aureus
GLNMAIQLHESGVLQDN

SEQ ID NO: 1647129 - protein, 22 aa, Staphylococcus aureus
GLPKADIVLLGISRTSKTPLSQ

SEQ ID NO: 1647130 - protein, 22 aa, Staphylococcus aureus
GLRPKDQFKVMQHFDLNTNHLE

SEQ ID NO: 1647131 - protein, 18 aa, Staphylococcus aureus
GLVLKGSEEPIRLNPFYI

SEQ ID NO: 1647132 - protein, 17 aa, Staphylococcus aureus
GLYLLKFLASLNLDNNA

SEQ ID NO: 1647133 - protein, 24 aa, Staphylococcus aureus
GMGRIGRMVLRIALQNKNLNVVAI

SEQ ID NO: 1647134 - protein, 17 aa, Staphylococcus aureus
GMIKGTGPRYCPSIEDK

SEQ ID NO: 1647135 - protein, 26 aa, Staphylococcus aureus
GNAIKALCHKLGYSVDQVIAFGDSMN

SEQ ID NO: 1647136 - protein, 28 aa, Staphylococcus aureus
GNALSWSSAGALGFKGSKKSTPFAAQMA

SEQ ID NO: 1647137 - protein, 24 aa, Staphylococcus aureus
GNEVLYRKVLEFYHPEFKKEYVIL

SEQ ID NO: 1647138 - protein, 17 aa, Staphylococcus aureus
GNILKDTLVFDVYQGEH

SEQ ID NO: 1647139 - protein, 25 aa, Staphylococcus aureus
GNLEKLKIAVHYGADAVFLGGQEYG

SEQ ID NO: 1647140 - protein, 23 aa, Staphylococcus aureus
GNQGLEIMPPFYIYNEDGNYSEE

SEQ ID NO: 1647141 - protein, 25 aa, Staphylococcus aureus
GNRLFYLAMAPQFFGVISDYLKSSG

SEQ ID NO: 1647142 - protein, 18 aa, Staphylococcus aureus
GNVNFISRLLEGHYPDTT

SEQ ID NO: 1647143 - protein, 21 aa, Staphylococcus aureus
GNYTLGVKEQLIFPEIDYDKV

SEQ ID NO: 1647144 - protein, 26 aa, Staphylococcus aureus
GPLLHYRMVHELPTFFSSNFDYSELE

SEQ ID NO: 1647145 - protein, 24 aa, Staphylococcus aureus
GPSETGIGFALSIERLLLALEEEG

SEQ ID NO: 1647146 - protein, 22 aa, Staphylococcus aureus
GPSLERPGDLAAILSGLQPGDV

SEQ ID NO: 1647147 - protein, 22 aa, Staphylococcus aureus
GPVRAVLELAGITDILSKSLGS

SEQ ID NO: 1647148 - protein, 21 aa, Staphylococcus aureus
GQVLQCTQIYFVHPINKNNIY

SEQ ID NO: 1647149 - protein, 24 aa, Staphylococcus aureus
GRALGGGCELVLYSPIVVAASETY

SEQ ID NO: 1647150 - protein, 26 aa, Staphylococcus aureus
GRAPIGRPSPMSPWGKPTLGKKTRRG

SEQ ID NO: 1647151 - protein, 20 aa, Staphylococcus aureus
GRASKRLQESTGLEAMTIHR

SEQ ID NO: 1647152 - protein, 26 aa, Staphylococcus aureus
GRDGLKSECILLFSERDINLHEYFIT

SEQ ID NO: 1647153 - protein, 21 aa, Staphylococcus aureus
GRGGRGNSRFATPRNPAPDFS

SEQ ID NO: 1647154 - protein, 30 aa, Staphylococcus aureus
GRGRFNRHWSSSKGQGLWMSVVLRPNVAFS

SEQ ID NO: 1647155 - protein, 21 aa, Staphylococcus aureus
GRLAEEIFDDLAFPKHDDDFN

SEQ ID NO: 1647156 - protein, 17 aa, Staphylococcus aureus
GRMSAQVGAEFLQKLNG

SEQ ID NO: 1647157 - protein, 24 aa, Staphylococcus aureus
GSEEPIRLNPFYINVLLGISETCN

SEQ ID NO: 1647158 - protein, 23 aa, Staphylococcus aureus
GSEFPIVIMPIVKQYFRMLQRPI

SEQ ID NO: 1647159 - protein, 29 aa, Staphylococcus aureus
GSGKSVCINSILMSLLYKNHPEELRLLLI

SEQ ID NO: 1647160 - protein, 18 aa, Staphylococcus aureus
GSHTHEFMALSAIGEDTI

SEQ ID NO: 1647161 - protein, 18 aa, Staphylococcus aureus
GSIEFLEVVGLQGSTYLL

SEQ ID NO: 1647162 - protein, 26 aa, Staphylococcus aureus
GSKERFVPFGAYCRQSIENYLEHFKP

SEQ ID NO: 1647163 - protein, 21 aa, Staphylococcus aureus
GSLKRISFKILQVAKRAQRGI

SEQ ID NO: 1647164 - protein, 24 aa, Staphylococcus aureus
GTEFLMDHRHLWLRSKKQHAVMKI

SEQ ID NO: 1647165 - protein, 17 aa, Staphylococcus aureus
GTKYSESMNATFLDNQG

SEQ ID NO: 1647166 - protein, 23 aa, Staphylococcus aureus
GTRNEVKQLLKKGLVNVNEQVIK

SEQ ID NO: 1647167 - protein, 23 aa, Staphylococcus aureus
GTSDFNPLYAMFDIPYSIMGHVH

SEQ ID NO: 1647168 - protein, 18 aa, Staphylococcus aureus
GTTTGRPRRVGWFDSVVL

SEQ ID NO: 1647169 - protein, 28 aa, Staphylococcus aureus
GTYTMPCARTLVPVKVPLDVTTTEVFDL

SEQ ID NO: 1647170 - protein, 18 aa, Staphylococcus aureus
GVFNCIQKATPQMLRQRS

SEQ ID NO: 1647171 - protein, 21 aa, Staphylococcus aureus
GVGSPDALIECSIRGMDMFDC

SEQ ID NO: 1647172 - protein, 32 aa, Staphylococcus aureus
GVQLVDFWATWCGPCKMIAPVLEELAADYEGK

SEQ ID NO: 1647173 - protein, 20 aa, Staphylococcus aureus
GVVLRWLRDELLASEVETAK

SEQ ID NO: 1647174 - protein, 21 aa, Staphylococcus aureus
GYAIGMGHTIHALRRNMNMTY

SEQ ID NO: 1647175 - protein, 20 aa, Staphylococcus aureus
GYDQLRLKGFYKDSNKKAEM

SEQ ID NO: 1647176 - protein, 19 aa, Staphylococcus aureus
GYVPQCPNCDISLTYHKTT

SEQ ID NO: 1647177 - protein, 25 aa, Staphylococcus aureus
GYYMMKRMNAPFLLIGDPRVEGGSF

SEQ ID NO: 1647178 - protein, 26 aa, Staphylococcus aureus
HASLLPKYRGGAPIHQAIIDGEQETG

SEQ ID NO: 1647179 - protein, 18 aa, Staphylococcus aureus
HDGPQGFGGQGFNGSDFG

SEQ ID NO: 1647180 - protein, 26 aa, Staphylococcus aureus
HDIVCAGASAVLFGSVNAIIGLTSER

SEQ ID NO: 1647181 - protein, 23 aa, Staphylococcus aureus
HEAEWAFNRAVGVAKRNDAKLTI

SEQ ID NO: 1647182 - protein, 21 aa, Staphylococcus aureus
HFAELAVKVADYMSVDTIAFG

SEQ ID NO: 1647183 - protein, 18 aa, Staphylococcus aureus
HFVSPGFVDVHVHLREPG

SEQ ID NO: 1647184 - protein, 23 aa, Staphylococcus aureus
HFYEANAALDFEREMAYGKHLDI

SEQ ID NO: 1647185 - protein, 19 aa, Staphylococcus aureus
HGAGGIVLDVKVFNREEGD

SEQ ID NO: 1647186 - protein, 25 aa, Staphylococcus aureus
HGALGERALKYIIPDTADFPYTIRI

SEQ ID NO: 1647187 - protein, 20 aa, Staphylococcus aureus
HGASLIQIYSSLVIEGPGLT

SEQ ID NO: 1647188 - protein, 23 aa, Staphylococcus aureus
HGGLRYLKQFQIGVVAETGKERA

SEQ ID NO: 1647189 - protein, 22 aa, Staphylococcus aureus
HGVACPGFVPLVEQMRYSDPTI

SEQ ID NO: 1647190 - protein, 18 aa, Staphylococcus aureus
HHMDCYRLEDSDEDLGFD

SEQ ID NO: 1647191 - protein, 23 aa, Staphylococcus aureus
HHTHARVGIALYGSRPYSSLNQH

SEQ ID NO: 1647192 - protein, 17 aa, Staphylococcus aureus
HIICTPEIFAKLLHTIA

SEQ ID NO: 1647193 - protein, 20 aa, Staphylococcus aureus
HKIPPTIISRAQRFDFKAIS

SEQ ID NO: 1647194 - protein, 19 aa, Staphylococcus aureus
HKQDIINNVHLIRANPNLV

SEQ ID NO: 1647195 - protein, 26 aa, Staphylococcus aureus
HKRWSRLDMGQFLLGGSRFVDSQRQE

SEQ ID NO: 1647196 - protein, 25 aa, Staphylococcus aureus
HKTLRGPRGGMILCKEEYKKDIDKT

SEQ ID NO: 1647197 - protein, 36 aa, Staphylococcus aureus
HLEERGYQLSKTEYRGREATDFKEEDIELFKDIADK

SEQ ID NO: 1647198 - protein, 23 aa, Staphylococcus aureus
HLESRFLPGKHCAKFNLQGEIDY

SEQ ID NO: 1647199 - protein, 24 aa, Staphylococcus aureus
HLESYSYHLGMMFQIKDDLLDCYG

SEQ ID NO: 1647200 - protein, 28 aa, Staphylococcus aureus
HLLARAVARDVGRIMGFDEVTLNEISSL

SEQ ID NO: 1647201 - protein, 18 aa, Staphylococcus aureus
HMDMPGLHSLEHLMAENI

SEQ ID NO: 1647202 - protein, 29 aa, Staphylococcus aureus
HMPTHCPSCGHELVRIEGEVALRCINPKC

SEQ ID NO: 1647203 - protein, 17 aa, Staphylococcus aureus
HNNERLSVCFDTCHTHD

SEQ ID NO: 1647204 - protein, 23 aa, Staphylococcus aureus
HPGDMKPPLNVYFSGYRTAEGFE

SEQ ID NO: 1647205 - protein, 24 aa, Staphylococcus aureus
HPVYRKPMKQWVLKITEYADQLLA

SEQ ID NO: 1647206 - protein, 18 aa, Staphylococcus aureus
HQIIPFFSVGDFDSVSKE

SEQ ID NO: 1647207 - protein, 23 aa, Staphylococcus aureus
HRDRIAFMRVVSGAFERGMDVTL

SEQ ID NO: 1647208 - protein, 21 aa, Staphylococcus aureus
HRHERWFSICKKLEGLPRHTS

SEQ ID NO: 1647209 - protein, 23 aa, Staphylococcus aureus
HSLKALGANVMFNSPNAWIDDSL

SEQ ID NO: 1647210 - protein, 24 aa, Staphylococcus aureus
HSNLPKCLFPLTVRTRQSGDTFKL

SEQ ID NO: 1647211 - protein, 17 aa, Staphylococcus aureus
HTNIALIKYWGKKDEAL

SEQ ID NO: 1647212 - protein, 22 aa, Staphylococcus aureus
HYIVRQGLRFLLSTIENIEVLQ

SEQ ID NO: 1647213 - protein, 24 aa, Staphylococcus aureus
IAAELRLGIVNGHIAEGTLLTENQ

SEQ ID NO: 1647214 - protein, 18 aa, Staphylococcus aureus
IAENAGLEGSVIVERLKN

SEQ ID NO: 1647215 - protein, 18 aa, Staphylococcus aureus
IAGERGSGKICLNGAASR

SEQ ID NO: 1647216 - protein, 23 aa, Staphylococcus aureus
IAKRVASELSMIYVDTGAMYRAL

SEQ ID NO: 1647217 - protein, 24 aa, Staphylococcus aureus
IANMNCDLSHEWEVARVEEGLTTA

SEQ ID NO: 1647218 - protein, 25 aa, Staphylococcus aureus
IATNEVNAAMGIICATPTAGSSGTI

SEQ ID NO: 1647219 - protein, 19 aa, Staphylococcus aureus
IATQIAKRYGLTVITTASR

SEQ ID NO: 1647220 - protein, 17 aa, Staphylococcus aureus
IAVKCIFFNQPYLKKKI

SEQ ID NO: 1647221 - protein, 29 aa, Staphylococcus aureus
ICRTKMKAKEILDELGILKDGIFTHEIDH

SEQ ID NO: 1647222 - protein, 20 aa, Staphylococcus aureus
ICTPEIFAKLLHTIATRNID

SEQ ID NO: 1647223 - protein, 17 aa, Staphylococcus aureus
IDACKRASAATINIVVP

SEQ ID NO: 1647224 - protein, 22 aa, Staphylococcus aureus
IDELNIYYSHYVSVLENKPTSR

SEQ ID NO: 1647225 - protein, 18 aa, Staphylococcus aureus
IDHSKFNKVYFARVPLLE

SEQ ID NO: 1647226 - protein, 24 aa, Staphylococcus aureus
IDQSKFPLGQAVYFDTEKDGRMIF

SEQ ID NO: 1647227 - protein, 18 aa, Staphylococcus aureus
IDTGMGLERMASVSQNVR

SEQ ID NO: 1647228 - protein, 21 aa, Staphylococcus aureus
IDYDELIIGLGCEDKYHNVPG

SEQ ID NO: 1647229 - protein, 21 aa, Staphylococcus aureus
IDYVLSWGPLILGHRDPQVIS

SEQ ID NO: 1647230 - protein, 26 aa, Staphylococcus aureus
IEAKELKGAHIFLDMVSVGATINIML

SEQ ID NO: 1647231 - protein, 21 aa, Staphylococcus aureus
IEERLKPILDQGMENGKHIFN

SEQ ID NO: 1647232 - protein, 18 aa, Staphylococcus aureus
IEGFKFNVLHTPGHSPGS

SEQ ID NO: 1647233 - protein, 18 aa, Staphylococcus aureus
IELTEEIAVQAGLKVDMT

SEQ ID NO: 1647234 - protein, 25 aa, Staphylococcus aureus
IENRPMMYIALSYDHRIIDGKEAVG

SEQ ID NO: 1647235 - protein, 24 aa, Staphylococcus aureus
IENYRECFNEEQFIARYSDILDKY

SEQ ID NO: 1647236 - protein, 23 aa, Staphylococcus aureus
IERLRYLVDNDFYFNVFDIYSEA

SEQ ID NO: 1647237 - protein, 24 aa, Staphylococcus aureus
IERYPSRRLKISDGALLDCDGDTN

SEQ ID NO: 1647238 - protein, 17 aa, Staphylococcus aureus
IESFMLIANETVAEHFS

SEQ ID NO: 1647239 - protein, 17 aa, Staphylococcus aureus
IESHITVRFGILDVGRN

SEQ ID NO: 1647240 - protein, 23 aa, Staphylococcus aureus
IEYDAIVPTQLWPTLETKMIKNL

SEQ ID NO: 1647241 - protein, 19 aa, Staphylococcus aureus
IFANGAIQAAERLVNKPNG

SEQ ID NO: 1647242 - protein, 24 aa, Staphylococcus aureus
IFAYKRLKQNQVISNPFVMETMQL

SEQ ID NO: 1647243 - protein, 26 aa, Staphylococcus aureus
IFNGDIGVIVGIFWAKENALNKDVLV

SEQ ID NO: 1647244 - protein, 23 aa, Staphylococcus aureus
IFNHLFKQAITFAKRAHNETDIA

SEQ ID NO: 1647245 - protein, 17 aa, Staphylococcus aureus
IFQGLEFTDRRPFNDVL

SEQ ID NO: 1647246 - protein, 30 aa, Staphylococcus aureus
IFRPQLRALLRASVYGKLNIMFPMVATINE

SEQ ID NO: 1647247 - protein, 20 aa, Staphylococcus aureus
IGAALPKVANAIKRAFNPDG

SEQ ID NO: 1647248 - protein, 19 aa, Staphylococcus aureus
IGAEVMRLGIISTPGVAYL

SEQ ID NO: 1647249 - protein, 22 aa, Staphylococcus aureus
IGGLAMGLAVEGFRPVMEVQFL

SEQ ID NO: 1647250 - protein, 18 aa, Staphylococcus aureus
IGLNKAIQYLSYKKRTEK

SEQ ID NO: 1647251 - protein, 19 aa, Staphylococcus aureus
IGPDIWKAASRVIDAAVEK

SEQ ID NO: 1647252 - protein, 26 aa, Staphylococcus aureus
IGPKGRNVVLDKEFTAPLITNDGVTI

SEQ ID NO: 1647253 - protein, 19 aa, Staphylococcus aureus
IGVKLGFPAHMSKLTRIES

SEQ ID NO: 1647254 - protein, 19 aa, Staphylococcus aureus
IHAVPKLDSKDVSRIGSTF

SEQ ID NO: 1647255 - protein, 17 aa, Staphylococcus aureus
IHRLIGWNQDTKPEDIL

SEQ ID NO: 1647256 - protein, 19 aa, Staphylococcus aureus
IIEIAPLAYMRGRTLEDAF

SEQ ID NO: 1647257 - protein, 24 aa, Staphylococcus aureus
IIGHSMGSVIARLFVETYPQYVDG

SEQ ID NO: 1647258 - protein, 28 aa, Staphylococcus aureus
IKDELKNRFKITIAGGQGHLKGQILRIG

SEQ ID NO: 1647259 - protein, 21 aa, Staphylococcus aureus
IKDVEAAIKMAHNNTIQHLLD

SEQ ID NO: 1647260 - protein, 21 aa, Staphylococcus aureus
IKEALETFGGVKRRFNETTIA

SEQ ID NO: 1647261 - protein, 28 aa, Staphylococcus aureus
IKEDGRLAIELIGGFTYNAIEGEYCQIK

SEQ ID NO: 1647262 - protein, 19 aa, Staphylococcus aureus
IKGVARPALVVTLPTIDGK

SEQ ID NO: 1647263 - protein, 24 aa, Staphylococcus aureus
IKIRYLQCPCKIKYDEERFEAELI

SEQ ID NO: 1647264 - protein, 23 aa, Staphylococcus aureus
IKKADVFISTILIPGAKPPKLVT

SEQ ID NO: 1647265 - protein, 25 aa, Staphylococcus aureus
IKKGFEVLDGTSFNEFVVKFDKPIQ

SEQ ID NO: 1647266 - protein, 18 aa, Staphylococcus aureus
IKNKFQIKEVHVVPGDAD

SEQ ID NO: 1647267 - protein, 21 aa, Staphylococcus aureus
IKNTRFDSDIETVVYRVVQEA

SEQ ID NO: 1647268 - protein, 22 aa, Staphylococcus aureus
IKNVHKPSGAKPGFVTYDNQKT

SEQ ID NO: 1647269 - protein, 25 aa, Staphylococcus aureus
IKQQPSPDCLMLFQHHNLLPWKTIN

SEQ ID NO: 1647270 - protein, 18 aa, Staphylococcus aureus
IKSKDPFEKPSIRFNYLS

SEQ ID NO: 1647271 - protein, 25 aa, Staphylococcus aureus
IKSLKISFNKVFGYFIEITRANLQN

SEQ ID NO: 1647272 - protein, 17 aa, Staphylococcus aureus
IKTHPRIGYQMLQWKEK

SEQ ID NO: 1647273 - protein, 19 aa, Staphylococcus aureus
IKVERRVNEDVAFITDNGN

SEQ ID NO: 1647274 - protein, 20 aa, Staphylococcus aureus
IKVTRLAQGLSVGGDLEYAD

SEQ ID NO: 1647275 - protein, 23 aa, Staphylococcus aureus
ILACEAWSELGHIPKADVQKIRQ

SEQ ID NO: 1647276 - protein, 24 aa, Staphylococcus aureus
ILDHVRKIGSLVMATTHYPELKAY

SEQ ID NO: 1647277 - protein, 23 aa, Staphylococcus aureus
ILDQLPCWLTYTNAETHKVIDDN

SEQ ID NO: 1647278 - protein, 24 aa, Staphylococcus aureus
ILDVMVEPFYEWVVEKDAWYGPEL

SEQ ID NO: 1647279 - protein, 26 aa, Staphylococcus aureus
ILGDFKAPMGCRSFLPSWKDAEGHFE

SEQ ID NO: 1647280 - protein, 19 aa, Staphylococcus aureus
ILKSEGFIKNVEYVEDDKQ

SEQ ID NO: 1647281 - protein, 25 aa, Staphylococcus aureus
ILNFPQRPGALREFVNDVLGPQDDI

SEQ ID NO: 1647282 - protein, 17 aa, Staphylococcus aureus
ILQEYLLYVRYTAILID

SEQ ID NO: 1647283 - protein, 24 aa, Staphylococcus aureus
ILVKDRYDDLVFLFENEFATRWFE

SEQ ID NO: 1647284 - protein, 22 aa, Staphylococcus aureus
INDLKGLLAIESVRDDAKASED

SEQ ID NO: 1647285 - protein, 17 aa, Staphylococcus aureus
INGRPKHIYSIYRKMMK

SEQ ID NO: 1647286 - protein, 25 aa, Staphylococcus aureus
INLSEPKALIGFAGRRVIEQTINEK

SEQ ID NO: 1647287 - protein, 21 aa, Staphylococcus aureus
INPYIKNMMYVLADNRHISLI

SEQ ID NO: 1647288 - protein, 19 aa, Staphylococcus aureus
IPMCGVPYHSADSYIDTLV

SEQ ID NO: 1647289 - protein, 19 aa, Staphylococcus aureus
IPNKGDWTHKSLRYTVKGN

SEQ ID NO: 1647290 - protein, 23 aa, Staphylococcus aureus
IPREKRVVISLTYIYGIGTSTAQ

SEQ ID NO: 1647291 - protein, 23 aa, Staphylococcus aureus
IQMAAQCLIQAIGGEGYVYVKGY

SEQ ID NO: 1647292 - protein, 21 aa, Staphylococcus aureus
IQRIEHMLRNALIIEDTGDNN

SEQ ID NO: 1647293 - protein, 18 aa, Staphylococcus aureus
IQSSILTSIPLWKNQMAI

SEQ ID NO: 1647294 - protein, 25 aa, Staphylococcus aureus
IQTFKRQIKELGFSYDWDREVNTTD

SEQ ID NO: 1647295 - protein, 23 aa, Staphylococcus aureus
IRAPQWRGGGIVFGPTPRSYAYK

SEQ ID NO: 1647296 - protein, 19 aa, Staphylococcus aureus
IRTLKGGFKDGSFEKKLHR

SEQ ID NO: 1647297 - protein, 17 aa, Staphylococcus aureus
IRVNIVYELPLAEVVFD

SEQ ID NO: 1647298 - protein, 17 aa, Staphylococcus aureus
ISELGLAIEAGMNAEDI

SEQ ID NO: 1647299 - protein, 28 aa, Staphylococcus aureus
ISFPGVKGEVLVNAFSKYDIMISTTSAC

SEQ ID NO: 1647300 - protein, 26 aa, Staphylococcus aureus
ISGKELRDTLHFEMLWDTSKIDVIIR

SEQ ID NO: 1647301 - protein, 19 aa, Staphylococcus aureus
ISKKLGLSLNIINKAKTMI

SEQ ID NO: 1647302 - protein, 21 aa, Staphylococcus aureus
ISQKSAMRTAVKNAKTAVSNN

SEQ ID NO: 1647303 - protein, 25 aa, Staphylococcus aureus
ITAHKFGGPKGVGALLVKDHVTLDY

SEQ ID NO: 1647304 - protein, 23 aa, Staphylococcus aureus
ITDKTILVSIMFVNNEVGTVQQI

SEQ ID NO: 1647305 - protein, 20 aa, Staphylococcus aureus
ITFDECDIFFIGGGSDREQA

SEQ ID NO: 1647306 - protein, 25 aa, Staphylococcus aureus
ITKGHEVMEKYGLSNIVVHAPYIIN

SEQ ID NO: 1647307 - protein, 17 aa, Staphylococcus aureus
ITPGNFIFRTREFEQME

SEQ ID NO: 1647308 - protein, 23 aa, Staphylococcus aureus
IVMSSRIRLARNLENHVHPLMYA

SEQ ID NO: 1647309 - protein, 23 aa, Staphylococcus aureus
IVQAIRPTTKMLFIETPSNPLLR

SEQ ID NO: 1647310 - protein, 17 aa, Staphylococcus aureus
IVRHAPCDVLVVRTEEL

SEQ ID NO: 1647311 - protein, 18 aa, Staphylococcus aureus
IVTFGHLLARAVARDVGR

SEQ ID NO: 1647312 - protein, 37 aa, Staphylococcus aureus
IWHGLPLTEAFLFSRGHFKGNQFPEGVNALSPQIIIG

SEQ ID NO: 1647313 - protein, 22 aa, Staphylococcus aureus
IYIDVYCALKHGVNISKTANKI

SEQ ID NO: 1647314 - protein, 21 aa, Staphylococcus aureus
IYLRAYTYIRTMGATGLKEVS

SEQ ID NO: 1647315 - protein, 18 aa, Staphylococcus aureus
IYQSFGLKHLKLVINSVG

SEQ ID NO: 1647316 - protein, 17 aa, Staphylococcus aureus
KAAYRYVNFKGKIPVEL

SEQ ID NO: 1647317 - protein, 17 aa, Staphylococcus aureus
KADNVLQDRLRSLSNVD

SEQ ID NO: 1647318 - protein, 19 aa, Staphylococcus aureus
KAFDGRGNYTLGVKEQLIF

SEQ ID NO: 1647319 - protein, 18 aa, Staphylococcus aureus
KAIDSCWLEQVDYLQQLK

SEQ ID NO: 1647320 - protein, 21 aa, Staphylococcus aureus
KAQLIKSLQYITAQCVKQVEV

SEQ ID NO: 1647321 - protein, 25 aa, Staphylococcus aureus
KAQMAEKDFRVILVGGDCPKIKAKP

SEQ ID NO: 1647322 - protein, 21 aa, Staphylococcus aureus
KARFEAYGWNYLLVKDGNDLE

SEQ ID NO: 1647323 - protein, 18 aa, Staphylococcus aureus
KAYLYSLPYHYYKDYGIR

SEQ ID NO: 1647324 - protein, 24 aa, Staphylococcus aureus
KDFANIFFMMMNFYSIERSMEIAK

SEQ ID NO: 1647325 - protein, 20 aa, Staphylococcus aureus
KDIFGKLSYIGSTVKTLLNP

SEQ ID NO: 1647326 - protein, 22 aa, Staphylococcus aureus
KDKDHFNFFSLFTFSEPIEQVV

SEQ ID NO: 1647327 - protein, 18 aa, Staphylococcus aureus
KDNSEFFEGVNMNLVDWL

SEQ ID NO: 1647328 - protein, 19 aa, Staphylococcus aureus
KDPRVGFITITDVVLTNDL

SEQ ID NO: 1647329 - protein, 21 aa, Staphylococcus aureus
KDTNAIIVYTLIKPEMKQYMS

SEQ ID NO: 1647330 - protein, 21 aa, Staphylococcus aureus
KDYIQPRMTMITPIDKNDDEL

SEQ ID NO: 1647331 - protein, 30 aa, Staphylococcus aureus
KEAVKGSLKRLGIDHIDLYQLHGGTIDDPL

SEQ ID NO: 1647332 - protein, 22 aa, Staphylococcus aureus
KECGLEVGEFVHTFGDAHIYSN

SEQ ID NO: 1647333 - protein, 24 aa, Staphylococcus aureus
KEEALKPFILLVVDRKEEGLKAAN

SEQ ID NO: 1647334 - protein, 26 aa, Staphylococcus aureus
KEEFKRVVNMIIDVYKDFGFEDYSFR

SEQ ID NO: 1647335 - protein, 28 aa, Staphylococcus aureus
KEGGLRCTACFEMRLDIVAKAAVEHGYD

SEQ ID NO: 1647336 - protein, 20 aa, Staphylococcus aureus
KEGKSYPRIISELLEHHEAL

SEQ ID NO: 1647337 - protein, 24 aa, Staphylococcus aureus
KEGRDHFLRISIDKEGGVDLNDCT

SEQ ID NO: 1647338 - protein, 20 aa, Staphylococcus aureus
KEIKSLPGVYQISLNLLESE

SEQ ID NO: 1647339 - protein, 18 aa, Staphylococcus aureus
KEIMKHSPTALRFLKAAM

SEQ ID NO: 1647340 - protein, 24 aa, Staphylococcus aureus
KELEELRLRVATSRPQDNKSFSSN

SEQ ID NO: 1647341 - protein, 18 aa, Staphylococcus aureus
KEPQAIVVAPTRELAQQL

SEQ ID NO: 1647342 - protein, 23 aa, Staphylococcus aureus
KESHQWIGFIGLNYIPETSDYPF

SEQ ID NO: 1647343 - protein, 21 aa, Staphylococcus aureus
KEVADGIVIGSEIVKRFKSNT

SEQ ID NO: 1647344 - protein, 25 aa, Staphylococcus aureus
KEVEKLCKKYDVLLICDEVAVGFGR

SEQ ID NO: 1647345 - protein, 26 aa, Staphylococcus aureus
KFNMIFQFEHLGLWNSGDSHFDVNSY

SEQ ID NO: 1647346 - protein, 34 aa, Staphylococcus aureus
KFRDEKRPRFGLLRGREFIMKDAYSFHADEASLD

SEQ ID NO: 1647347 - protein, 20 aa, Staphylococcus aureus
KFVHRNHRHERWFSICKKLE

SEQ ID NO: 1647348 - protein, 27 aa, Staphylococcus aureus
KFYDRKEIKDLLSYLRIIANSNDDISL

SEQ ID NO: 1647349 - protein, 18 aa, Staphylococcus aureus
KGAVMKLGDNIGRRVSTT

SEQ ID NO: 1647350 - protein, 20 aa, Staphylococcus aureus
KGDMTFKLFPNIAPKTVENF

SEQ ID NO: 1647351 - protein, 20 aa, Staphylococcus aureus
KGILDMKGGLTDTFTNAFSS

SEQ ID NO: 1647352 - protein, 21 aa, Staphylococcus aureus
KGIPAALAMSMIKFGMDSYGH

SEQ ID NO: 1647353 - protein, 19 aa, Staphylococcus aureus
KGLNVTRVLAQVGEPVLAS

SEQ ID NO: 1647354 - protein, 19 aa, Staphylococcus aureus
KGQIAVIGPTAMHYQNVIQ

SEQ ID NO: 1647355 - protein, 19 aa, Staphylococcus aureus
KGTGPRYCPSIEDKFVRFN

SEQ ID NO: 1647356 - protein, 23 aa, Staphylococcus aureus
KHAGGLHKFMNWDGPILTDSGGF

SEQ ID NO: 1647357 - protein, 19 aa, Staphylococcus aureus
KHLIDRGIDGLIIAQYISS

SEQ ID NO: 1647358 - protein, 17 aa, Staphylococcus aureus
KHLRSNNIYPIIVHGGG

SEQ ID NO: 1647359 - protein, 20 aa, Staphylococcus aureus
KIHNSRPLLSMLKRMEMEPI

SEQ ID NO: 1647360 - protein, 20 aa, Staphylococcus aureus
KIIERSCKFYGNTYLGKKAE

SEQ ID NO: 1647361 - protein, 18 aa, Staphylococcus aureus
KILEDMNVDWKKRIHMII

SEQ ID NO: 1647362 - protein, 19 aa, Staphylococcus aureus
KISSNWPDNVSVFSNKVET

SEQ ID NO: 1647363 - protein, 24 aa, Staphylococcus aureus
KITGKRLSGQTVLFLGTGAIATRT

SEQ ID NO: 1647364 - protein, 18 aa, Staphylococcus aureus
KKAFDIAKQILKLDPNNN

SEQ ID NO: 1647365 - protein, 20 aa, Staphylococcus aureus
KKAREIWYLCRQYNAQEALD

SEQ ID NO: 1647366 - protein, 18 aa, Staphylococcus aureus
KKEYPNIEIVAIEPEASP

SEQ ID NO: 1647367 - protein, 23 aa, Staphylococcus aureus
KKGYVRLRIDGEIVDVNDVPTLD

SEQ ID NO: 1647368 - protein, 18 aa, Staphylococcus aureus
KKIKEMNYSKVLVITEDW

SEQ ID NO: 1647369 - protein, 19 aa, Staphylococcus aureus
KKILSRDLIMLDISTTHIL

SEQ ID NO: 1647370 - protein, 26 aa, Staphylococcus aureus
KKLNHLRENIKLFVVIGQLNQLIKGG

SEQ ID NO: 1647371 - protein, 23 aa, Staphylococcus aureus
KKPELRDRLAVRHGRYIEQDAKD

SEQ ID NO: 1647372 - protein, 25 aa, Staphylococcus aureus
KKPILLKRGLSATIEEFVYAAEYIA

SEQ ID NO: 1647373 - protein, 23 aa, Staphylococcus aureus
KKPNWPVTPWPTAYSEIYDYQWN

SEQ ID NO: 1647374 - protein, 18 aa, Staphylococcus aureus
KKQIEAVLTLLEEKNTVP

SEQ ID NO: 1647375 - protein, 20 aa, Staphylococcus aureus
KKQLEMMKVAVKFEDAESFT

SEQ ID NO: 1647376 - protein, 23 aa, Staphylococcus aureus
KKQVIKTWSRRSTIFPNFIGHTF

SEQ ID NO: 1647377 - protein, 18 aa, Staphylococcus aureus
KKRVPRFDIDVNETYQIF

SEQ ID NO: 1647378 - protein, 21 aa, Staphylococcus aureus
KKRYHEFEMEIARLESLTKDK

SEQ ID NO: 1647379 - protein, 19 aa, Staphylococcus aureus
KLANPDKTVVCFVGDGGFQ

SEQ ID NO: 1647380 - protein, 27 aa, Staphylococcus aureus
KLDSKDVSRIGSTFGKTNRVIIDTEDH

SEQ ID NO: 1647381 - protein, 17 aa, Staphylococcus aureus
KLFLKRNSNPFIAALSA

SEQ ID NO: 1647382 - protein, 24 aa, Staphylococcus aureus
KLFPEGPITMTLIREMRLMWKEMM

SEQ ID NO: 1647383 - protein, 19 aa, Staphylococcus aureus
KLLQYRFHDQHPFNQMRLK

SEQ ID NO: 1647384 - protein, 17 aa, Staphylococcus aureus
KLVFSIKKGTNFSPQDP

SEQ ID NO: 1647385 - protein, 24 aa, Staphylococcus aureus
KLVNFKAPKEMIGKLVEVRIDEAK

SEQ ID NO: 1647386 - protein, 23 aa, Staphylococcus aureus
KMAETKKGVVLFHETLKALNIKH

SEQ ID NO: 1647387 - protein, 21 aa, Staphylococcus aureus
KMETLLLCARQFLWSTAKGYQ

SEQ ID NO: 1647388 - protein, 30 aa, Staphylococcus aureus
KMFRERGFEIKPEIAGLMLSAIISDSLLFK

SEQ ID NO: 1647389 - protein, 19 aa, Staphylococcus aureus
KMNHGLRNLISFTGDTLDH

SEQ ID NO: 1647390 - protein, 23 aa, Staphylococcus aureus
KMVAELERPYILVTDKKISSFQD

SEQ ID NO: 1647391 - protein, 17 aa, Staphylococcus aureus
KNDEFDRVLGLELGADD

SEQ ID NO: 1647392 - protein, 19 aa, Staphylococcus aureus
KNGRVGFGTGKAQEVPEAI

SEQ ID NO: 1647393 - protein, 25 aa, Staphylococcus aureus
KNHYPICYNTAYKILTMIQKQFDVN

SEQ ID NO: 1647394 - protein, 18 aa, Staphylococcus aureus
KNKKGVNLPGVRVSLPGI

SEQ ID NO: 1647395 - protein, 29 aa, Staphylococcus aureus
KNKVAPPFRVAEVDIMYGQGISKEGELID

SEQ ID NO: 1647396 - protein, 18 aa, Staphylococcus aureus
KNLPRFIDVLATVLEEME

SEQ ID NO: 1647397 - protein, 20 aa, Staphylococcus aureus
KNNDIEAYFLPQGIIATHYR

SEQ ID NO: 1647398 - protein, 21 aa, Staphylococcus aureus
KNNGVEYVFGIPGAKIDYLFN

SEQ ID NO: 1647399 - protein, 22 aa, Staphylococcus aureus
KPDAKLFILLVGERPEEVTDLE

SEQ ID NO: 1647400 - protein, 20 aa, Staphylococcus aureus
KPFSPREVVARVKAILRRSQ

SEQ ID NO: 1647401 - protein, 20 aa, Staphylococcus aureus
KPMEIKNMFIDIGVSSKEEA

SEQ ID NO: 1647402 - protein, 27 aa, Staphylococcus aureus
KPMLVAADIYRPAAINQLQTVGKQIDI

SEQ ID NO: 1647403 - protein, 21 aa, Staphylococcus aureus
KPMPGRFKDYIAMPKQNLYQS

SEQ ID NO: 1647404 - protein, 20 aa, Staphylococcus aureus
KPVKPEGCHAQLIELPFTAT

SEQ ID NO: 1647405 - protein, 17 aa, Staphylococcus aureus
KPWDIAAQFLFAELLNL

SEQ ID NO: 1647406 - protein, 23 aa, Staphylococcus aureus
KQGHTYLPINVVIDLTVDVLNYQ

SEQ ID NO: 1647407 - protein, 19 aa, Staphylococcus aureus
KQGVLRLFLKYGQNDERVI

SEQ ID NO: 1647408 - protein, 19 aa, Staphylococcus aureus
KQRPYPALEKLRHNKETAL

SEQ ID NO: 1647409 - protein, 20 aa, Staphylococcus aureus
KQRQSILEILAQVEVNIDYP

SEQ ID NO: 1647410 - protein, 23 aa, Staphylococcus aureus
KRAEHKIKCFLQVNVSGEASKHG

SEQ ID NO: 1647411 - protein, 21 aa, Staphylococcus aureus
KRASEGIVEVKERLTGDSEEV

SEQ ID NO: 1647412 - protein, 26 aa, Staphylococcus aureus
KRISKSGFGPFAFDEWRYLPDGSDNP

SEQ ID NO: 1647413 - protein, 23 aa, Staphylococcus aureus
KRLKEVIKSYLLDNKYDVVDVTE

SEQ ID NO: 1647414 - protein, 19 aa, Staphylococcus aureus
KRPGKELENLVPDYLDGLL

SEQ ID NO: 1647415 - protein, 21 aa, Staphylococcus aureus
KRPIAEIQFADFILPATNQII

SEQ ID NO: 1647416 - protein, 23 aa, Staphylococcus aureus
KRSKAVINEAYFRTPSTTDYNGV

SEQ ID NO: 1647417 - protein, 20 aa, Staphylococcus aureus
KRSNSGTCYNQRPIVAVGDV

SEQ ID NO: 1647418 - protein, 21 aa, Staphylococcus aureus
KSEDYRAILVHPWQYDHTIGK

SEQ ID NO: 1647419 - protein, 19 aa, Staphylococcus aureus
KSNDVYVYGQFDLVDAENS

SEQ ID NO: 1647420 - protein, 24 aa, Staphylococcus aureus
KSSTVPRPIGWISTVSKDGKDNLA

SEQ ID NO: 1647421 - protein, 17 aa, Staphylococcus aureus
KTAPRITDFLNEESKAY

SEQ ID NO: 1647422 - protein, 20 aa, Staphylococcus aureus
KTEAEYKVPVTIHDKPVGRI

SEQ ID NO: 1647423 - protein, 22 aa, Staphylococcus aureus
KTGHLHVHLASYLVIDEADLMI

SEQ ID NO: 1647424 - protein, 21 aa, Staphylococcus aureus
KTSRGESVFEPEVLVKMRNRM

SEQ ID NO: 1647425 - protein, 21 aa, Staphylococcus aureus
KTTEGPLLIMAGAGSGKTRVL

SEQ ID NO: 1647426 - protein, 21 aa, Staphylococcus aureus
KVDALSFIVHRDFAYERGKAL

SEQ ID NO: 1647427 - protein, 18 aa, Staphylococcus aureus
KVGNALPLQNIPVGTVVH

SEQ ID NO: 1647428 - protein, 19 aa, Staphylococcus aureus
KVKRYLQGRKTRLVGPNCP

SEQ ID NO: 1647429 - protein, 19 aa, Staphylococcus aureus
KVTQECLNFYELIQSLIKE

SEQ ID NO: 1647430 - protein, 26 aa, Staphylococcus aureus
KVVKGGRRFRFTALVVVGDKNGRVGF

SEQ ID NO: 1647431 - protein, 23 aa, Staphylococcus aureus
KWPTITNNWLYHWAQYIKTIFNK

SEQ ID NO: 1647432 - protein, 18 aa, Staphylococcus aureus
KWVHYGLTSTDVVDTALS

SEQ ID NO: 1647433 - protein, 23 aa, Staphylococcus aureus
KYEIRESKVISGTQFIIELLGVN

SEQ ID NO: 1647434 - protein, 23 aa, Staphylococcus aureus
KYEVMSIPTLIVFKDGQPVDKVV

SEQ ID NO: 1647435 - protein, 18 aa, Staphylococcus aureus
KYGYDYETMAILTAIDEQ

SEQ ID NO: 1647436 - protein, 19 aa, Staphylococcus aureus
KYQGFGYGTKIMMSLPQYV

SEQ ID NO: 1647437 - protein, 26 aa, Staphylococcus aureus
LAAVLACILAGVPIKAIIDSLTTFSG

SEQ ID NO: 1647438 - protein, 17 aa, Staphylococcus aureus
LADGGWPQPIVDAYGEK

SEQ ID NO: 1647439 - protein, 17 aa, Staphylococcus aureus
LAEEISKHLTIPVIGIG

SEQ ID NO: 1647440 - protein, 23 aa, Staphylococcus aureus
LAEQYQCPVIVLSDLQLSLGKQT

SEQ ID NO: 1647441 - protein, 19 aa, Staphylococcus aureus
LAMVMHIYQSFGLKHLKLV

SEQ ID NO: 1647442 - protein, 17 aa, Staphylococcus aureus
LAQNFAACRALVSEGIQ

SEQ ID NO: 1647443 - protein, 17 aa, Staphylococcus aureus
LASEHDIDLSQVVGSGF

SEQ ID NO: 1647444 - protein, 24 aa, Staphylococcus aureus
LDFRDEDIWMLFGTLPVFPCLKDD

SEQ ID NO: 1647445 - protein, 26 aa, Staphylococcus aureus
LDIKRMPFIGLQWIFTRTGAAASNHF

SEQ ID NO: 1647446 - protein, 17 aa, Staphylococcus aureus
LDKDIITPFSIRNDEIN

SEQ ID NO: 1647447 - protein, 18 aa, Staphylococcus aureus
LDKDSVILLEQIRTLDKK

SEQ ID NO: 1647448 - protein, 24 aa, Staphylococcus aureus
LDKKRLKEKLTYLSDDKMKEVDNA

SEQ ID NO: 1647449 - protein, 23 aa, Staphylococcus aureus
LDLSRTKLLVSIRRLIEKERLSK

SEQ ID NO: 1647450 - protein, 19 aa, Staphylococcus aureus
LDVSLELKLLADVGLVGFP

SEQ ID NO: 1647451 - protein, 19 aa, Staphylococcus aureus
LEAMLVVSHLKRFGHHISM

SEQ ID NO: 1647452 - protein, 18 aa, Staphylococcus aureus
LEAVRKRPGMYIGSTDKR

SEQ ID NO: 1647453 - protein, 21 aa, Staphylococcus aureus
LEEELKILLIPKDPNDDKDVI

SEQ ID NO: 1647454 - protein, 20 aa, Staphylococcus aureus
LEGHSVALLAQDYYYKDQKH

SEQ ID NO: 1647455 - protein, 25 aa, Staphylococcus aureus
LEHFKALSVGKWVRAQGRIEEDTFI

SEQ ID NO: 1647456 - protein, 20 aa, Staphylococcus aureus
LEIGSGSFIPGFEEQLEGMK

SEQ ID NO: 1647457 - protein, 23 aa, Staphylococcus aureus
LEPNDPIIHFALAEMLYYDGQYL

SEQ ID NO: 1647458 - protein, 20 aa, Staphylococcus aureus
LEQLLQLDVDLIVTAAFGQL

SEQ ID NO: 1647459 - protein, 32 aa, Staphylococcus aureus
LETTKWLEDYLRYFKGAIVIISHDRYFLDKIV

SEQ ID NO: 1647460 - protein, 23 aa, Staphylococcus aureus
LEVTNLLQLRQKYFISVTTMKDN

SEQ ID NO: 1647461 - protein, 17 aa, Staphylococcus aureus
LEYLASVVHVRDVDGEK

SEQ ID NO: 1647462 - protein, 24 aa, Staphylococcus aureus
LFAYSLESMSQFGMYFTKINLNLH

SEQ ID NO: 1647463 - protein, 17 aa, Staphylococcus aureus
LFKEIFKASTDLQKSEN

SEQ ID NO: 1647464 - protein, 24 aa, Staphylococcus aureus
LFKNKRATISMGYIGLYETATVFY

SEQ ID NO: 1647465 - protein, 18 aa, Staphylococcus aureus
LFNISAKTYEEWFKQFSS

SEQ ID NO: 1647466 - protein, 22 aa, Staphylococcus aureus
LFQKRINLGQSIVMVTHDDEII

SEQ ID NO: 1647467 - protein, 23 aa, Staphylococcus aureus
LGAPLSLSERVHYQMGLNHFVAA

SEQ ID NO: 1647468 - protein, 20 aa, Staphylococcus aureus
LGEEGVLCLLSDSTNSLVPD

SEQ ID NO: 1647469 - protein, 24 aa, Staphylococcus aureus
LGFRGEALASISSVAKVTLKTCTD

SEQ ID NO: 1647470 - protein, 24 aa, Staphylococcus aureus
LGIEKYKPHIAIITNIYSAHLDYH

SEQ ID NO: 1647471 - protein, 19 aa, Staphylococcus aureus
LGKTFQILREQGFNAFYKG

SEQ ID NO: 1647472 - protein, 22 aa, Staphylococcus aureus
LGQRPGAGAVYLNIFHYDVEEF

SEQ ID NO: 1647473 - protein, 18 aa, Staphylococcus aureus
LGYKGPKGSFEIEGVSLF

SEQ ID NO: 1647474 - protein, 23 aa, Staphylococcus aureus
LGYPEALPEMVLLLDDPQKIVRW

SEQ ID NO: 1647475 - protein, 21 aa, Staphylococcus aureus
LHATFMPKPLFGVNGSGMHFN

SEQ ID NO: 1647476 - protein, 26 aa, Staphylococcus aureus
LHDLGFGPKLSMAIYQFYLGDTLTIL

SEQ ID NO: 1647477 - protein, 24 aa, Staphylococcus aureus
LHITDKEFIVFVGPSGCGKSTTLR

SEQ ID NO: 1647478 - protein, 17 aa, Staphylococcus aureus
LICTPKNPLCLFCPVQE

SEQ ID NO: 1647479 - protein, 19 aa, Staphylococcus aureus
LIGGRGRRANLYGLFNKAI

SEQ ID NO: 1647480 - protein, 19 aa, Staphylococcus aureus
LIGRLASELGTAMKGLDIN

SEQ ID NO: 1647481 - protein, 18 aa, Staphylococcus aureus
LIKFCNPSTLNISTDVEI

SEQ ID NO: 1647482 - protein, 17 aa, Staphylococcus aureus
LIYVSTISVGTYFDIDT

SEQ ID NO: 1647483 - protein, 20 aa, Staphylococcus aureus
LKAELVQSFVERRKGKATEE

SEQ ID NO: 1647484 - protein, 21 aa, Staphylococcus aureus
LKAHGETGVECGVEEDNVFIF

SEQ ID NO: 1647485 - protein, 25 aa, Staphylococcus aureus
LKAISPRTTLPILTGIKIDAKEHEV

SEQ ID NO: 1647486 - protein, 24 aa, Staphylococcus aureus
LKDYPEVVKKIAFHEPPINTFLPD

SEQ ID NO: 1647487 - protein, 25 aa, Staphylococcus aureus
LKEAFIRIDHEYLPNIALSNPVFID

SEQ ID NO: 1647488 - protein, 17 aa, Staphylococcus aureus
LKFELFYFDIFTYGTSF

SEQ ID NO: 1647489 - protein, 18 aa, Staphylococcus aureus
LKGKTVLVRADFNVPLKD

SEQ ID NO: 1647490 - protein, 22 aa, Staphylococcus aureus
LKGQILRIGHMGKISPFDILSV

SEQ ID NO: 1647491 - protein, 18 aa, Staphylococcus aureus
LKHLKLVINSVGDMASRK

SEQ ID NO: 1647492 - protein, 18 aa, Staphylococcus aureus
LKKKRERDKTGLALIEGV

SEQ ID NO: 1647493 - protein, 29 aa, Staphylococcus aureus
LKLKSITFTHEFMFARPIHRTPDMIKQHE

SEQ ID NO: 1647494 - protein, 24 aa, Staphylococcus aureus
LKNRARLCLEVMRAVQEVIDKEAP

SEQ ID NO: 1647495 - protein, 21 aa, Staphylococcus aureus
LKNRRATLVNLQRIDKVSAKR

SEQ ID NO: 1647496 - protein, 20 aa, Staphylococcus aureus
LKPMLARGELHCIGATTLNE

SEQ ID NO: 1647497 - protein, 20 aa, Staphylococcus aureus
LKSDVFKAAHKHVRSKNEDE

SEQ ID NO: 1647498 - protein, 21 aa, Staphylococcus aureus
LKSTGRMVGIISHVSELKNRI

SEQ ID NO: 1647499 - protein, 19 aa, Staphylococcus aureus
LKTLIPRQQFEVPVQAAIG

SEQ ID NO: 1647500 - protein, 24 aa, Staphylococcus aureus
LKTLQKFPVLFPVVDKLFTYKNPT

SEQ ID NO: 1647501 - protein, 24 aa, Staphylococcus aureus
LLASKFKNLCVVGDSDQSIYGWRG

SEQ ID NO: 1647502 - protein, 24 aa, Staphylococcus aureus
LLEQRLIDNPGWILSPYPVAIPHL

SEQ ID NO: 1647503 - protein, 17 aa, Staphylococcus aureus
LLIGGEVLNAKWVDLLN

SEQ ID NO: 1647504 - protein, 31 aa, Staphylococcus aureus
LLKEKGTEITSIFYPKMFKAHPELLNMFNQT

SEQ ID NO: 1647505 - protein, 17 aa, Staphylococcus aureus
LLSMLKRMEMEPITPEI

SEQ ID NO: 1647506 - protein, 21 aa, Staphylococcus aureus
LLSPACASWDQYSTFEERGEK

SEQ ID NO: 1647507 - protein, 18 aa, Staphylococcus aureus
LLYATGIRVSELVNIKKQ

SEQ ID NO: 1647508 - protein, 23 aa, Staphylococcus aureus
LNACKRADAILLGAIGGPKWTDP

SEQ ID NO: 1647509 - protein, 25 aa, Staphylococcus aureus
LNDAKACAMITFRLLKNYENLTYVT

SEQ ID NO: 1647510 - protein, 18 aa, Staphylococcus aureus
LNGSFLPLAHERLDDDGQ

SEQ ID NO: 1647511 - protein, 30 aa, Staphylococcus aureus
LNIMFPMVATINEFREAKAILLEEKENLKN

SEQ ID NO: 1647512 - protein, 25 aa, Staphylococcus aureus
LNIPELRKRIKLVAEKNYDQISSIE

SEQ ID NO: 1647513 - protein, 22 aa, Staphylococcus aureus
LNKGEIVGLIGLNGAGKSTTIK

SEQ ID NO: 1647514 - protein, 26 aa, Staphylococcus aureus
LNNLKRKYGKDISELIAYQEKLNNEI

SEQ ID NO: 1647515 - protein, 17 aa, Staphylococcus aureus
LNSSAYYRYLSRRIGAI

SEQ ID NO: 1647516 - protein, 18 aa, Staphylococcus aureus
LPALKAHINDNAFEVKLQ

SEQ ID NO: 1647517 - protein, 26 aa, Staphylococcus aureus
LPDKTCETCGAPLIKEGQDIPFETFL

SEQ ID NO: 1647518 - protein, 20 aa, Staphylococcus aureus
LPFDKGLSRVCTNIRIDDRR

SEQ ID NO: 1647519 - protein, 19 aa, Staphylococcus aureus
LPGRSLELGDYFKEQLKQI

SEQ ID NO: 1647520 - protein, 19 aa, Staphylococcus aureus
LPKRWEDRLNDYTYVPRTK

SEQ ID NO: 1647521 - protein, 17 aa, Staphylococcus aureus
LPLTIVIIGETLDTNHI

SEQ ID NO: 1647522 - protein, 17 aa, Staphylococcus aureus
LPMLFSDILIYCTERNV

SEQ ID NO: 1647523 - protein, 33 aa, Staphylococcus aureus
LPNKEFQLLFMLAARPKQIFTREQIIEKIWGYD

SEQ ID NO: 1647524 - protein, 17 aa, Staphylococcus aureus
LPQNVVFIFQPAEETGG

SEQ ID NO: 1647525 - protein, 18 aa, Staphylococcus aureus
LPSLSGLSKVSAFIHRAD

SEQ ID NO: 1647526 - protein, 24 aa, Staphylococcus aureus
LPSTDFSYPLLMNVDDRGSFTEFI

SEQ ID NO: 1647527 - protein, 19 aa, Staphylococcus aureus
LPTAGGYGVMICYHDADLQ

SEQ ID NO: 1647528 - protein, 20 aa, Staphylococcus aureus
LQGAIKFGIEKSDIVTSVSK

SEQ ID NO: 1647529 - protein, 20 aa, Staphylococcus aureus
LQIPEGVDWDGEVVKVVVGI

SEQ ID NO: 1647530 - protein, 17 aa, Staphylococcus aureus
LQKTVDVYRNYKAKKEE

SEQ ID NO: 1647531 - protein, 17 aa, Staphylococcus aureus
LQYLVAAALEVTDVNIF

SEQ ID NO: 1647532 - protein, 19 aa, Staphylococcus aureus
LREGMPIGAKVTLRGERMY

SEQ ID NO: 1647533 - protein, 19 aa, Staphylococcus aureus
LRQKMGMVFQNFNLFPHKK

SEQ ID NO: 1647534 - protein, 19 aa, Staphylococcus aureus
LRSGEVRMILSTCRATIGQ

SEQ ID NO: 1647535 - protein, 20 aa, Staphylococcus aureus
LRSNNIYPIIVHGGGPFINE

SEQ ID NO: 1647536 - protein, 18 aa, Staphylococcus aureus
LRSSATMRDMVRENHVRK

SEQ ID NO: 1647537 - protein, 26 aa, Staphylococcus aureus
LSEIFANRAFEGFKVEQVKDLFYATF

SEQ ID NO: 1647538 - protein, 19 aa, Staphylococcus aureus
LSEQFPYIRQLLDAYHIKR

SEQ ID NO: 1647539 - protein, 22 aa, Staphylococcus aureus
LSGPKRPQDLIFLSDMKSSFEN

SEQ ID NO: 1647540 - protein, 22 aa, Staphylococcus aureus
LSGRPLFERNLKLIKYAYQQTN

SEQ ID NO: 1647541 - protein, 17 aa, Staphylococcus aureus
LSKDLIDTVHEYFNGLY

SEQ ID NO: 1647542 - protein, 25 aa, Staphylococcus aureus
LSLPQTRLRKLLKRMDFYIKFDDTQ

SEQ ID NO: 1647543 - protein, 26 aa, Staphylococcus aureus
LSPELRNKIQIVTKCGIILPSKQFDF

SEQ ID NO: 1647544 - protein, 19 aa, Staphylococcus aureus
LSSADSFRDLIKVLVELEQ

SEQ ID NO: 1647545 - protein, 21 aa, Staphylococcus aureus
LSVFKNVYCDIGDEQSIEQSL

SEQ ID NO: 1647546 - protein, 17 aa, Staphylococcus aureus
LTAHILMLKVINDMLKY

SEQ ID NO: 1647547 - protein, 20 aa, Staphylococcus aureus
LTEREMEILLLIAKGYSNQE

SEQ ID NO: 1647548 - protein, 18 aa, Staphylococcus aureus
LTGDIFHSQRCDCGAQLE

SEQ ID NO: 1647549 - protein, 23 aa, Staphylococcus aureus
LTGNFLLALGLEHLMAVKDNRVH

SEQ ID NO: 1647550 - protein, 24 aa, Staphylococcus aureus
LTKTEYDLLYLLAENKNHVMQREQ

SEQ ID NO: 1647551 - protein, 20 aa, Staphylococcus aureus
LTVINELAWHNLFAKNMFIR

SEQ ID NO: 1647552 - protein, 26 aa, Staphylococcus aureus
LTVWKSKQAFTDWLKSDVFKAAHKHV

SEQ ID NO: 1647553 - protein, 18 aa, Staphylococcus aureus
LTYQSLDEAIAFIHQRPK

SEQ ID NO: 1647554 - protein, 17 aa, Staphylococcus aureus
LVINSVGDMASRKEYNE

SEQ ID NO: 1647555 - protein, 28 aa, Staphylococcus aureus
LVPGYEAPCYIAWSGKNRSPLIRVPSSR

SEQ ID NO: 1647556 - protein, 18 aa, Staphylococcus aureus
LVSLAVKLVDKAAQSNLI

SEQ ID NO: 1647557 - protein, 27 aa, Staphylococcus aureus
LVVSHLKRFGHHISMQTLYQYKTVRQI

SEQ ID NO: 1647558 - protein, 19 aa, Staphylococcus aureus
LYGKIKHCNEFINHSNDSN

SEQ ID NO: 1647559 - protein, 18 aa, Staphylococcus aureus
LYGTMVFEGSMTLDEMRH

SEQ ID NO: 1647560 - protein, 30 aa, Staphylococcus aureus
LYKNHPEELRLLLIDPKMVELAPYNGLPHL

SEQ ID NO: 1647561 - protein, 18 aa, Staphylococcus aureus
LYYNGPMFRYERKQKGRY

SEQ ID NO: 1647562 - protein, 27 aa, Staphylococcus aureus
MAAYCDKESYEGFANFFIQQAKEERFH

SEQ ID NO: 1647563 - protein, 17 aa, Staphylococcus aureus
MASKFDGIFLVATNPVD

SEQ ID NO: 1647564 - protein, 18 aa, Staphylococcus aureus
MASLKVPVIAIVIGEGGS

SEQ ID NO: 1647565 - protein, 18 aa, Staphylococcus aureus
MAYGHSYYDYILEVYDYV

SEQ ID NO: 1647566 - protein, 19 aa, Staphylococcus aureus
MDEAIKLADKICIMSEGKV

SEQ ID NO: 1647567 - protein, 17 aa, Staphylococcus aureus
MDKEIKFIGGVVNDPHK

SEQ ID NO: 1647568 - protein, 24 aa, Staphylococcus aureus
MDLKIGGIVYPTAPFNGWYMVTEI

SEQ ID NO: 1647569 - protein, 18 aa, Staphylococcus aureus
MDNNIPLTVFSIMEEGNI

SEQ ID NO: 1647570 - protein, 25 aa, Staphylococcus aureus
MDTCIACGACGAAAPDIYDYDDEGI

SEQ ID NO: 1647571 - protein, 19 aa, Staphylococcus aureus
MEHILRSAMDIDQTTKHYI

SEQ ID NO: 1647572 - protein, 24 aa, Staphylococcus aureus
MENNIKIGMELGYIKAPPETFIEP

SEQ ID NO: 1647573 - protein, 23 aa, Staphylococcus aureus
MFDCVLPTRIARNGTCMTSQGRL

SEQ ID NO: 1647574 - protein, 25 aa, Staphylococcus aureus
MGARRLKQWIDRPLISKEQIEARLD

SEQ ID NO: 1647575 - protein, 24 aa, Staphylococcus aureus
MGGHKAGEVASKFVTDELKSRFEA

SEQ ID NO: 1647576 - protein, 26 aa, Staphylococcus aureus
MHSAKGLEFPIVFIMGMEESLFPHIR

SEQ ID NO: 1647577 - protein, 21 aa, Staphylococcus aureus
MICAAMAGIQFFVTGGIGGVH

SEQ ID NO: 1647578 - protein, 19 aa, Staphylococcus aureus
MIMKFDLALQRMLLGEPIQ

SEQ ID NO: 1647579 - protein, 23 aa, Staphylococcus aureus
MIPNYRKHWHVIFELSNDKKLIY

SEQ ID NO: 1647580 - protein, 20 aa, Staphylococcus aureus
MKLEFERNYERYQFLNWATK

SEQ ID NO: 1647581 - protein, 20 aa, Staphylococcus aureus
MKVKSFKVPFKAIGKAVIDS

SEQ ID NO: 1647582 - protein, 23 aa, Staphylococcus aureus
MLAKLKVLYEMFGLEMVDNELSD

SEQ ID NO: 1647583 - protein, 18 aa, Staphylococcus aureus
MLEAIFFGHEEIQRLVDF

SEQ ID NO: 1647584 - protein, 18 aa, Staphylococcus aureus
MLGPTGIGVLFGKRELLQ

SEQ ID NO: 1647585 - protein, 19 aa, Staphylococcus aureus
MLPSTRLGEKQGKKLFVYG

SEQ ID NO: 1647586 - protein, 27 aa, Staphylococcus aureus
MNESRYCPNCGRLLQYDYIHYNQIGHY

SEQ ID NO: 1647587 - protein, 30 aa, Staphylococcus aureus
MRTNVPAIFCSGGPMKAGLSAHGKALTLSS

SEQ ID NO: 1647588 - protein, 18 aa, Staphylococcus aureus
MSASRAYLHPAMKRKNLT

SEQ ID NO: 1647589 - protein, 30 aa, Staphylococcus aureus
MSVVVMLKCMKRFGFTASFNRCAVSGNDTQ

SEQ ID NO: 1647590 - protein, 18 aa, Staphylococcus aureus
MTTFERYFIADKASHKEE

SEQ ID NO: 1647591 - protein, 18 aa, Staphylococcus aureus
MVRIEAGYTQDTMAQTIG

SEQ ID NO: 1647592 - protein, 18 aa, Staphylococcus aureus
MVWYCPPLSPIMSYFEGK

SEQ ID NO: 1647593 - protein, 25 aa, Staphylococcus aureus
MWSVNKWEVLNGIDAELARRNSYQG

SEQ ID NO: 1647594 - protein, 24 aa, Staphylococcus aureus
NAVKFFYKYLKGINVDNIAVIGSK

SEQ ID NO: 1647595 - protein, 25 aa, Staphylococcus aureus
NDAKRKVAIALRNRYRRSLLDEESK

SEQ ID NO: 1647596 - protein, 18 aa, Staphylococcus aureus
NDEYKLELIDAIPEDENV

SEQ ID NO: 1647597 - protein, 28 aa, Staphylococcus aureus
NDFFTLVKWEISGTLNYMKPREFCLVTV

SEQ ID NO: 1647598 - protein, 22 aa, Staphylococcus aureus
NDKNEVVGFFVLHRYYQHEGYD

SEQ ID NO: 1647599 - protein, 24 aa, Staphylococcus aureus
NDTFKILGVGVDFNDEKQPFWTEN

SEQ ID NO: 1647600 - protein, 17 aa, Staphylococcus aureus
NDVRIQKVIDLLRDNAK

SEQ ID NO: 1647601 - protein, 24 aa, Staphylococcus aureus
NDYGMGSSRDWAAKGTNLLGVKTV

SEQ ID NO: 1647602 - protein, 17 aa, Staphylococcus aureus
NEAKLANIHFVDTKINH

SEQ ID NO: 1647603 - protein, 23 aa, Staphylococcus aureus
NEPNKAFLFGINYVIVSDDQDYR

SEQ ID NO: 1647604 - protein, 25 aa, Staphylococcus aureus
NESPMAKALIGKGLDDEVRVPLPNG

SEQ ID NO: 1647605 - protein, 25 aa, Staphylococcus aureus
NETTVCILEAMKLFNEIQAEISGEI

SEQ ID NO: 1647606 - protein, 21 aa, Staphylococcus aureus
NEVIKDFPILDQKVNGKRLAY

SEQ ID NO: 1647607 - protein, 36 aa, Staphylococcus aureus
NEWNLKLGDLAMIWREGCIIRAQFLQKIKDAYDNNP

SEQ ID NO: 1647608 - protein, 26 aa, Staphylococcus aureus
NFETAGPLCYRAEPVGCTATILYKMF

SEQ ID NO: 1647609 - protein, 18 aa, Staphylococcus aureus
NFGCPYFVLRHLSKQEVK

SEQ ID NO: 1647610 - protein, 18 aa, Staphylococcus aureus
NFYLDYGKDILYIEQRDS

SEQ ID NO: 1647611 - protein, 19 aa, Staphylococcus aureus
NGRCNLGVVTLNLPRMALE

SEQ ID NO: 1647612 - protein, 25 aa, Staphylococcus aureus
NGRHELLDSVFLWQSGQKYRIPVHD

SEQ ID NO: 1647613 - protein, 17 aa, Staphylococcus aureus
NGVNWRYIDHSSGLEPM

SEQ ID NO: 1647614 - protein, 18 aa, Staphylococcus aureus
NIEIEAILSAALNESESL

SEQ ID NO: 1647615 - protein, 17 aa, Staphylococcus aureus
NIFTVPVDLIFMNGKEM

SEQ ID NO: 1647616 - protein, 21 aa, Staphylococcus aureus
NIHFVGLAFNFMCFKSDAPSD

SEQ ID NO: 1647617 - protein, 19 aa, Staphylococcus aureus
NIVDIALQQDVDFVIIAGD

SEQ ID NO: 1647618 - protein, 17 aa, Staphylococcus aureus
NIVNCSRINLASKAFPS

SEQ ID NO: 1647619 - protein, 19 aa, Staphylococcus aureus
NKCLSSKAGTGCYVSISED

SEQ ID NO: 1647620 - protein, 25 aa, Staphylococcus aureus
NKGGCPKCRPAINYYLNMVYPHDHE

SEQ ID NO: 1647621 - protein, 22 aa, Staphylococcus aureus
NKIVKFEGCYHGHSDSLLIKAG

SEQ ID NO: 1647622 - protein, 17 aa, Staphylococcus aureus
NKSFVFGPCSVESFEQV

SEQ ID NO: 1647623 - protein, 19 aa, Staphylococcus aureus
NLLNRCFEKLFEKNIGLAI

SEQ ID NO: 1647624 - protein, 24 aa, Staphylococcus aureus
NLNKRMKWYTVIQSIGLVQWYEEQ

SEQ ID NO: 1647625 - protein, 22 aa, Staphylococcus aureus
NLRELGFDIVRFKTGTPPRVNS

SEQ ID NO: 1647626 - protein, 25 aa, Staphylococcus aureus
NLSIRAGSIYGVIGFSGAGKSTLIR

SEQ ID NO: 1647627 - protein, 24 aa, Staphylococcus aureus
NMAPEYGATCGFFPVDDESLKYMK

SEQ ID NO: 1647628 - protein, 21 aa, Staphylococcus aureus
NNEVRIQWRVADIKIPTSEIK

SEQ ID NO: 1647629 - protein, 30 aa, Staphylococcus aureus
NNHDPRLFEGFSMGNPRIQTGNLLVHLKES

SEQ ID NO: 1647630 - protein, 25 aa, Staphylococcus aureus
NNIGAKVFYSALGFDILGFEKNAIK

SEQ ID NO: 1647631 - protein, 17 aa, Staphylococcus aureus
NNKKLRLTKGVHVVIDQ

SEQ ID NO: 1647632 - protein, 22 aa, Staphylococcus aureus
NNLRVFKDIGIVKELTYGDSSS

SEQ ID NO: 1647633 - protein, 25 aa, Staphylococcus aureus
NNPHKGYVGHHLFIKLGNYHQTIFP

SEQ ID NO: 1647634 - protein, 28 aa, Staphylococcus aureus
NNVKPNWCPGCGDFSVQAAIQKAAANIG

SEQ ID NO: 1647635 - protein, 20 aa, Staphylococcus aureus
NPLSMKAGIALLEVLEQDGV

SEQ ID NO: 1647636 - protein, 22 aa, Staphylococcus aureus
NQEAAGFIKHFEQLLEKVEAVA

SEQ ID NO: 1647637 - protein, 30 aa, Staphylococcus aureus
NQFMGPYMMHWFMINYCFDNGYDRYNFYGL

SEQ ID NO: 1647638 - protein, 24 aa, Staphylococcus aureus
NQTSLKLAAAFAAGSPVVLKPSEE

SEQ ID NO: 1647639 - protein, 20 aa, Staphylococcus aureus
NRPGHLFPLVAQDKGVLARN

SEQ ID NO: 1647640 - protein, 19 aa, Staphylococcus aureus
NRQAIAIAGDGAFQMVMQD

SEQ ID NO: 1647641 - protein, 24 aa, Staphylococcus aureus
NRQVRRMFEHFGHQVTKLSRIEYG

SEQ ID NO: 1647642 - protein, 20 aa, Staphylococcus aureus
NRVLKPGGMVVCLETSQPTL

SEQ ID NO: 1647643 - protein, 23 aa, Staphylococcus aureus
NSGAKAYRLGDVSAETQFALDTF

SEQ ID NO: 1647644 - protein, 19 aa, Staphylococcus aureus
NSIGFRGEASLTYKEKLLE

SEQ ID NO: 1647645 - protein, 24 aa, Staphylococcus aureus
NSMAIDRHKHALLIDYLLHNIDLS

SEQ ID NO: 1647646 - protein, 23 aa, Staphylococcus aureus
NSSFRGLYQFIRFIDELIERGKD

SEQ ID NO: 1647647 - protein, 19 aa, Staphylococcus aureus
NTEDIYAGIEFKEGTTEVK

SEQ ID NO: 1647648 - protein, 23 aa, Staphylococcus aureus
NTEIRPFLMKDLFNDKKLRDYYE

SEQ ID NO: 1647649 - protein, 25 aa, Staphylococcus aureus
NTELEVVEGMQFDRGYQSPYMVTDS

SEQ ID NO: 1647650 - protein, 24 aa, Staphylococcus aureus
NVFKNLWLIAWEMTYESQLKQKIK

SEQ ID NO: 1647651 - protein, 23 aa, Staphylococcus aureus
NYWGKRGASRAVLARELNLDEII

SEQ ID NO: 1647652 - protein, 22 aa, Staphylococcus aureus
PADLKAHRMVNVILDKEAAAGL

SEQ ID NO: 1647653 - protein, 18 aa, Staphylococcus aureus
PAITETFDGIILANTTRQ

SEQ ID NO: 1647654 - protein, 32 aa, Staphylococcus aureus
PANEGRGYVLRRLLRRAVRFSQTLGINEPFMY

SEQ ID NO: 1647655 - protein, 20 aa, Staphylococcus aureus
PATEIMRHWPTHPNNPHKGY

SEQ ID NO: 1647656 - protein, 19 aa, Staphylococcus aureus
PCLITIFGATGDLSHRKLF

SEQ ID NO: 1647657 - protein, 24 aa, Staphylococcus aureus
PDADLKVYMIASVEERAERRYKDN

SEQ ID NO: 1647658 - protein, 17 aa, Staphylococcus aureus
PDDYPVQIVTGARSDGA

SEQ ID NO: 1647659 - protein, 24 aa, Staphylococcus aureus
PDFKLKEHRSALRIRVKDNQYEMT

SEQ ID NO: 1647660 - protein, 22 aa, Staphylococcus aureus
PDNFKINPEWLIELDKCANRDT

SEQ ID NO: 1647661 - protein, 21 aa, Staphylococcus aureus
PEILEEAYLSKAMVVEVWSKE

SEQ ID NO: 1647662 - protein, 19 aa, Staphylococcus aureus
PEIQSLIWENSCGSGTASI

SEQ ID NO: 1647663 - protein, 17 aa, Staphylococcus aureus
PETAQGIFVNYKNVQRS

SEQ ID NO: 1647664 - protein, 20 aa, Staphylococcus aureus
PEYFNEGSLLKAMENPQNFI

SEQ ID NO: 1647665 - protein, 21 aa, Staphylococcus aureus
PFAQKRWCASAGLDNVITLSD

SEQ ID NO: 1647666 - protein, 19 aa, Staphylococcus aureus
PFNVPDFLEDLLIDGKIKE

SEQ ID NO: 1647667 - protein, 18 aa, Staphylococcus aureus
PFQARRIAFNINIPKESV

SEQ ID NO: 1647668 - protein, 28 aa, Staphylococcus aureus
PGLANKIALKFAKKIYTTFEETLNYLPK

SEQ ID NO: 1647669 - protein, 22 aa, Staphylococcus aureus
PGREAYPGDVFYLHSRLLERAA

SEQ ID NO: 1647670 - protein, 21 aa, Staphylococcus aureus
PHGGIALGLDRLVMLLTNRTN

SEQ ID NO: 1647671 - protein, 20 aa, Staphylococcus aureus
PHKLRHTFATHLLNQGADLR

SEQ ID NO: 1647672 - protein, 19 aa, Staphylococcus aureus
PIIELAARIYIEILDEVRQ

SEQ ID NO: 1647673 - protein, 19 aa, Staphylococcus aureus
PIPEVIGVRLVNSLPQGAT

SEQ ID NO: 1647674 - protein, 25 aa, Staphylococcus aureus
PITVNRAGSMIGYFLNEGPVTNFEQ

SEQ ID NO: 1647675 - protein, 21 aa, Staphylococcus aureus
PKAMISWETKTPFRELIEQDE

SEQ ID NO: 1647676 - protein, 22 aa, Staphylococcus aureus
PKGDAFARRSQYALDIDFKVEP

SEQ ID NO: 1647677 - protein, 19 aa, Staphylococcus aureus
PKGPTGFMIPTIVQWLKQQ

SEQ ID NO: 1647678 - protein, 25 aa, Staphylococcus aureus
PKGVGIENICPFSRDGQMRVVDNNQ

SEQ ID NO: 1647679 - protein, 19 aa, Staphylococcus aureus
PKLDFAMSHYHDKIKMCTG

SEQ ID NO: 1647680 - protein, 20 aa, Staphylococcus aureus
PKLLIMCGKQDFLYQDNLDF

SEQ ID NO: 1647681 - protein, 24 aa, Staphylococcus aureus
PKVFPELNSLVGHTLMVTDGTSLL

SEQ ID NO: 1647682 - protein, 34 aa, Staphylococcus aureus
PKYNAYMGAYHLQWEMIKFAKAHHIDRYNFYGIT

SEQ ID NO: 1647683 - protein, 17 aa, Staphylococcus aureus
PLFDRSKRHLILTDAGQ

SEQ ID NO: 1647684 - protein, 26 aa, Staphylococcus aureus
PLKYKQKLPCAFCSYQSVCHVDGMID

SEQ ID NO: 1647685 - protein, 21 aa, Staphylococcus aureus
PLSHSLTLYALLFALSSGRTF

SEQ ID NO: 1647686 - protein, 26 aa, Staphylococcus aureus
PNEPIIPFIIGDGIGPDIWKAASRVI

SEQ ID NO: 1647687 - protein, 22 aa, Staphylococcus aureus
PNIDGIEFVEFLISPNKGEPLK

SEQ ID NO: 1647688 - protein, 21 aa, Staphylococcus aureus
PNINESHWFYKPSQEGIYLSI

SEQ ID NO: 1647689 - protein, 19 aa, Staphylococcus aureus
PNLEIKWIRGNIDTRLEKL

SEQ ID NO: 1647690 - protein, 27 aa, Staphylococcus aureus
PQDSYLLVRGIKTLGLRMEQINRSVIE

SEQ ID NO: 1647691 - protein, 37 aa, Staphylococcus aureus
PQFKNKLTFSDEVVEKIAGIAAREVKGILDMKGGLTD

SEQ ID NO: 1647692 - protein, 19 aa, Staphylococcus aureus
PRGTRIFGPVARELREGNF

SEQ ID NO: 1647693 - protein, 20 aa, Staphylococcus aureus
PRTHGSGLFTRGQTQALSVL

SEQ ID NO: 1647694 - protein, 18 aa, Staphylococcus aureus
PSARRYARENGVNLAEVS

SEQ ID NO: 1647695 - protein, 19 aa, Staphylococcus aureus
PSFYFDFNQPISICDVGAG

SEQ ID NO: 1647696 - protein, 18 aa, Staphylococcus aureus
PSLLPKYKGIDAIGQAYH

SEQ ID NO: 1647697 - protein, 18 aa, Staphylococcus aureus
PSNLRKVFYSDTGSASVE

SEQ ID NO: 1647698 - protein, 22 aa, Staphylococcus aureus
PSSRRYPFVKFTPEREIGNDLL

SEQ ID NO: 1647699 - protein, 17 aa, Staphylococcus aureus
PSYQNVISKVFTLPQDF

SEQ ID NO: 1647700 - protein, 22 aa, Staphylococcus aureus
PTKEIRIAGGREVNLRSLQPLA

SEQ ID NO: 1647701 - protein, 21 aa, Staphylococcus aureus
PTRSTFETCFAKLEHGIASFA

SEQ ID NO: 1647702 - protein, 18 aa, Staphylococcus aureus
PTSKDSVILSADYSQIEL

SEQ ID NO: 1647703 - protein, 25 aa, Staphylococcus aureus
PVGPGPRKALDYMYEIAHRDGFTTH

SEQ ID NO: 1647704 - protein, 17 aa, Staphylococcus aureus
PVNNGGVVLRWLRDELL

SEQ ID NO: 1647705 - protein, 18 aa, Staphylococcus aureus
PVVIDFPKDMGVLATNVD

SEQ ID NO: 1647706 - protein, 19 aa, Staphylococcus aureus
PYKGKGIRYQGEYVRRKEG

SEQ ID NO: 1647707 - protein, 17 aa, Staphylococcus aureus
PYLKEAEILCYIDNIDA

SEQ ID NO: 1647708 - protein, 29 aa, Staphylococcus aureus
QAFKFKEQVGYPLIVRPAFTMGGTGGGIC

SEQ ID NO: 1647709 - protein, 25 aa, Staphylococcus aureus
QALMDHKRIFVPKMDYLNHQMTFKE

SEQ ID NO: 1647710 - protein, 18 aa, Staphylococcus aureus
QAWDWKEEYASFIRAQWA

SEQ ID NO: 1647711 - protein, 18 aa, Staphylococcus aureus
QDGLDIFLGIPYAEPPVH

SEQ ID NO: 1647712 - protein, 25 aa, Staphylococcus aureus
QDIFIPKGQSLGAVDGHKVLVQITK

SEQ ID NO: 1647713 - protein, 17 aa, Staphylococcus aureus
QDIIKIIAKEASMDKKI

SEQ ID NO: 1647714 - protein, 26 aa, Staphylococcus aureus
QDLKDRYEFIGGLSPLAGTTDDQADA

SEQ ID NO: 1647715 - protein, 25 aa, Staphylococcus aureus
QEIRKTSNVPIIFISSRIDNMDQIM

SEQ ID NO: 1647716 - protein, 20 aa, Staphylococcus aureus
QESSKMCLFEPRVFSDTQDI

SEQ ID NO: 1647717 - protein, 18 aa, Staphylococcus aureus
QEVPEIYDGTVIVKSVAR

SEQ ID NO: 1647718 - protein, 23 aa, Staphylococcus aureus
QFDQIFDLLAIRVIVNSINDCYA

SEQ ID NO: 1647719 - protein, 18 aa, Staphylococcus aureus
QFNLMFKTFQGVTEDSTN

SEQ ID NO: 1647720 - protein, 17 aa, Staphylococcus aureus
QGHLKGQILRIGHMGKI

SEQ ID NO: 1647721 - protein, 24 aa, Staphylococcus aureus
QGLEIAEAFVRSGAVDIVVVDSVA

SEQ ID NO: 1647722 - protein, 21 aa, Staphylococcus aureus
QGVDFLKNRGYDIEYSQVDVP

SEQ ID NO: 1647723 - protein, 19 aa, Staphylococcus aureus
QGYDVIGIFMKNWDDTDEN

SEQ ID NO: 1647724 - protein, 17 aa, Staphylococcus aureus
QKANISVFPKIENQEGI

SEQ ID NO: 1647725 - protein, 19 aa, Staphylococcus aureus
QKGTGKWTSINALELGIPL

SEQ ID NO: 1647726 - protein, 27 aa, Staphylococcus aureus
QKKLAMVLVQFPPWFDCNAQNIKYILY

SEQ ID NO: 1647727 - protein, 32 aa, Staphylococcus aureus
QKLVGDQAEVIWMSTFHSMCVRILRRDADRIG

SEQ ID NO: 1647728 - protein, 19 aa, Staphylococcus aureus
QKMREERHLLGQMMNQVHQ

SEQ ID NO: 1647729 - protein, 24 aa, Staphylococcus aureus
QKYAKLLQRIHGLDNMRFEDLKIS

SEQ ID NO: 1647730 - protein, 22 aa, Staphylococcus aureus
QKYKDRGFVVLSFPNNNFDNRQ

SEQ ID NO: 1647731 - protein, 18 aa, Staphylococcus aureus
QLAYAIGVAEPVSIAIDT

SEQ ID NO: 1647732 - protein, 19 aa, Staphylococcus aureus
QLDDLFGGRVHTIMSNPLN

SEQ ID NO: 1647733 - protein, 22 aa, Staphylococcus aureus
QLEFPVVYASAVNGTASLDPEK

SEQ ID NO: 1647734 - protein, 22 aa, Staphylococcus aureus
QLEKRLPKLITIADNNCMISNA

SEQ ID NO: 1647735 - protein, 20 aa, Staphylococcus aureus
QLIKGGRISKTKGLIGNLMK

SEQ ID NO: 1647736 - protein, 21 aa, Staphylococcus aureus
QLKSHLVNLCKINNIPYKVDI

SEQ ID NO: 1647737 - protein, 18 aa, Staphylococcus aureus
QLLASMLHKPELLILDEP

SEQ ID NO: 1647738 - protein, 22 aa, Staphylococcus aureus
QLLDEGLEWVLIQGQMGIELWT

SEQ ID NO: 1647739 - protein, 18 aa, Staphylococcus aureus
QLQSGYPYLMFKDNANRV

SEQ ID NO: 1647740 - protein, 24 aa, Staphylococcus aureus
QLSLSRKRGEGIYLVGTESKKREF

SEQ ID NO: 1647741 - protein, 17 aa, Staphylococcus aureus
QLTEAIESGEIFKYFPI

SEQ ID NO: 1647742 - protein, 19 aa, Staphylococcus aureus
QMIKHLDKKAGVVINPGTP

SEQ ID NO: 1647743 - protein, 17 aa, Staphylococcus aureus
QMLSIEYPIIQAGMAGS

SEQ ID NO: 1647744 - protein, 24 aa, Staphylococcus aureus
QNHMLQMVALLAMEAPISLNSEDI

SEQ ID NO: 1647745 - protein, 23 aa, Staphylococcus aureus
QPAAYCGVVGMKPTYGRVSRFGL

SEQ ID NO: 1647746 - protein, 28 aa, Staphylococcus aureus
QPIQSGYLPLEWINKWKHYSSELLPKRW

SEQ ID NO: 1647747 - protein, 30 aa, Staphylococcus aureus
QPKSDRLRQFFDFITNFGIMIKGTGEDIHP

SEQ ID NO: 1647748 - protein, 25 aa, Staphylococcus aureus
QQDIQRLASLNVHAAIIGKAAHQAS

SEQ ID NO: 1647749 - protein, 17 aa, Staphylococcus aureus
QREIYDFIDEAKRLVRP

SEQ ID NO: 1647750 - protein, 19 aa, Staphylococcus aureus
QRIQYQLNHHKIDLITDNG

SEQ ID NO: 1647751 - protein, 24 aa, Staphylococcus aureus
QRLLKGVVKGIGGYGNCIGIPTTA

SEQ ID NO: 1647752 - protein, 31 aa, Staphylococcus aureus
QRVANKLKLGTVWINDFHPYFAQAPWGGYKQ

SEQ ID NO: 1647753 - protein, 24 aa, Staphylococcus aureus
QSEVPAHVQAGWMLTTIASVGELE

SEQ ID NO: 1647754 - protein, 20 aa, Staphylococcus aureus
QSLDEAIAFIHQRPKPLSLY

SEQ ID NO: 1647755 - protein, 23 aa, Staphylococcus aureus
QSLRVANGLQVERLLRQNEEIKA

SEQ ID NO: 1647756 - protein, 24 aa, Staphylococcus aureus
QSNMPSRFLKEIPESLLENHSSGK

SEQ ID NO: 1647757 - protein, 24 aa, Staphylococcus aureus
QTAHFRVYLIGGEMRHITEAFVGE

SEQ ID NO: 1647758 - protein, 20 aa, Staphylococcus aureus
QTKFKMVRIEAGYTQDTMAQ

SEQ ID NO: 1647759 - protein, 24 aa, Staphylococcus aureus
QTYLKEFRKGGISKKTVYTVTPEI

SEQ ID NO: 1647760 - protein, 23 aa, Staphylococcus aureus
QVKKSGYIQYEFVKEDLTDLLAI

SEQ ID NO: 1647761 - protein, 20 aa, Staphylococcus aureus
QVTGKWSWLAPPLSPTLTSN

SEQ ID NO: 1647762 - protein, 19 aa, Staphylococcus aureus
QWAKLGLGLDYSRERFTLD

SEQ ID NO: 1647763 - protein, 18 aa, Staphylococcus aureus
QYEALAYKINEHYVKISL

SEQ ID NO: 1647764 - protein, 20 aa, Staphylococcus aureus
QYIDCISGFSVANQGHCHPT

SEQ ID NO: 1647765 - protein, 19 aa, Staphylococcus aureus
QYSIMISGHMDEVGFMVTK

SEQ ID NO: 1647766 - protein, 36 aa, Staphylococcus aureus
RAELMLRVSAIIRRRKAEIAAIMVYEAGKPWDEAVG

SEQ ID NO: 1647767 - protein, 18 aa, Staphylococcus aureus
RAFNPDGLNIIQNNGEFA

SEQ ID NO: 1647768 - protein, 21 aa, Staphylococcus aureus
RAKLAKARAESHLENDDDNTD

SEQ ID NO: 1647769 - protein, 29 aa, Staphylococcus aureus
RATLKRLPLYYRFVSSLKSKGIDRVNSKA

SEQ ID NO: 1647770 - protein, 20 aa, Staphylococcus aureus
RDDALRIAHEDLYETKSILE

SEQ ID NO: 1647771 - protein, 28 aa, Staphylococcus aureus
RDETDRTGLRIAIELKKDVNSESIKNYL

SEQ ID NO: 1647772 - protein, 19 aa, Staphylococcus aureus
RDLATSLIISERIETTEAR

SEQ ID NO: 1647773 - protein, 25 aa, Staphylococcus aureus
RDMVEANIAKGYKFMVITDHSQSLR

SEQ ID NO: 1647774 - protein, 18 aa, Staphylococcus aureus
RDQYTFPVPMSKIYQFIN

SEQ ID NO: 1647775 - protein, 22 aa, Staphylococcus aureus
RDVSLKVIRALGIEGGCNVQLA

SEQ ID NO: 1647776 - protein, 22 aa, Staphylococcus aureus
RDYDEKLIIPGFFGVSHEGYIV

SEQ ID NO: 1647777 - protein, 22 aa, Staphylococcus aureus
RELEAKTGAGFIVALTGAIMTM

SEQ ID NO: 1647778 - protein, 17 aa, Staphylococcus aureus
REVKGILDMKGGLTDTF

SEQ ID NO: 1647779 - protein, 21 aa, Staphylococcus aureus
RFVKEYTGLPAERVIGSGTVL

SEQ ID NO: 1647780 - protein, 19 aa, Staphylococcus aureus
RGISQREAERLVIHGFLDP

SEQ ID NO: 1647781 - protein, 19 aa, Staphylococcus aureus
RGKQEVRYNRDFQIDEKYR

SEQ ID NO: 1647782 - protein, 23 aa, Staphylococcus aureus
RGQNARLAAKLTGWKIDIKSETD

SEQ ID NO: 1647783 - protein, 17 aa, Staphylococcus aureus
RGVCTRVGTMTPKKPNS

SEQ ID NO: 1647784 - protein, 25 aa, Staphylococcus aureus
RIASPEFMFPSFYGIDVSTTAELIS

SEQ ID NO: 1647785 - protein, 27 aa, Staphylococcus aureus
RIDKVSAKRIIDFLSGTVYAIGGDIQR

SEQ ID NO: 1647786 - protein, 23 aa, Staphylococcus aureus
RIGRLKSIPIFMYKIAKAKRKIK

SEQ ID NO: 1647787 - protein, 19 aa, Staphylococcus aureus
RISKTKGLIGNLMKIKPIG

SEQ ID NO: 1647788 - protein, 19 aa, Staphylococcus aureus
RKALSQADLILFVLNNNEA

SEQ ID NO: 1647789 - protein, 19 aa, Staphylococcus aureus
RKDMDALTEFVNIYGAKGL

SEQ ID NO: 1647790 - protein, 19 aa, Staphylococcus aureus
RKLESAGVIESRSLGMKGT

SEQ ID NO: 1647791 - protein, 17 aa, Staphylococcus aureus
RKREFYEKPSVKRKKKS

SEQ ID NO: 1647792 - protein, 25 aa, Staphylococcus aureus
RKVAKRLDKIVAILLDTKGPEIRTH

SEQ ID NO: 1647793 - protein, 18 aa, Staphylococcus aureus
RLEEAGVDGVHFDVMDGQ

SEQ ID NO: 1647794 - protein, 19 aa, Staphylococcus aureus
RMILEKILPILSDREREII

SEQ ID NO: 1647795 - protein, 23 aa, Staphylococcus aureus
RNLEADMSLAIVIGSEGQGMSRL

SEQ ID NO: 1647796 - protein, 20 aa, Staphylococcus aureus
RPIQVGSHFHFYEANAALDF

SEQ ID NO: 1647797 - protein, 17 aa, Staphylococcus aureus
RPIRPLFPKGYKHDVQI

SEQ ID NO: 1647798 - protein, 21 aa, Staphylococcus aureus
RQCYCGCVFAAMQQGIDFKTV

SEQ ID NO: 1647799 - protein, 25 aa, Staphylococcus aureus
RQFKSLRRFFKIYVRGIRGASELRH

SEQ ID NO: 1647800 - protein, 30 aa, Staphylococcus aureus
RQKLKQPRSSVCFDAPSWYELVVEGRKIAG

SEQ ID NO: 1647801 - protein, 31 aa, Staphylococcus aureus
RQLFILPQGEFKRFLISNSREKQGILRTLFD

SEQ ID NO: 1647802 - protein, 30 aa, Staphylococcus aureus
RQLGKELVDFPALVKEGAFAFTDDGVGVQT

SEQ ID NO: 1647803 - protein, 26 aa, Staphylococcus aureus
RQLLGGTCLHKGCIPTKSLLKSAEVF

SEQ ID NO: 1647804 - protein, 19 aa, Staphylococcus aureus
RRFHELKKYFEYQQIDLSE

SEQ ID NO: 1647805 - protein, 25 aa, Staphylococcus aureus
RRHFLSYKPDYAIMTNIDFDHPDYF

SEQ ID NO: 1647806 - protein, 17 aa, Staphylococcus aureus
RRKLSYIPESPVIYEEL

SEQ ID NO: 1647807 - protein, 23 aa, Staphylococcus aureus
RRTTVENGIPCLTSLDTANALTN

SEQ ID NO: 1647808 - protein, 19 aa, Staphylococcus aureus
RSAGWIAHILEQYKDNRIM

SEQ ID NO: 1647809 - protein, 20 aa, Staphylococcus aureus
RSDAYIGVLIDDLVTKGTNE

SEQ ID NO: 1647810 - protein, 22 aa, Staphylococcus aureus
RSERLGSFLLKALLQLKHPSIK

SEQ ID NO: 1647811 - protein, 18 aa, Staphylococcus aureus
RSIYNLKDSISISDDELE

SEQ ID NO: 1647812 - protein, 23 aa, Staphylococcus aureus
RSMRKKLPFGIGQIGKSFRNEIT

SEQ ID NO: 1647813 - protein, 19 aa, Staphylococcus aureus
RTMLELLYATGMRVSELIH

SEQ ID NO: 1647814 - protein, 17 aa, Staphylococcus aureus
RTPIKKVEVINTDAKKF

SEQ ID NO: 1647815 - protein, 24 aa, Staphylococcus aureus
RTQLILEIFALRARSKEGKLQVEL

SEQ ID NO: 1647816 - protein, 18 aa, Staphylococcus aureus
RTVLHFHPALAPYKAAIL

SEQ ID NO: 1647817 - protein, 25 aa, Staphylococcus aureus
RTYDSLKFAVITPFQGHTEKWNEHN

SEQ ID NO: 1647818 - protein, 19 aa, Staphylococcus aureus
RVHYQMGLNHFVAARDALD

SEQ ID NO: 1647819 - protein, 25 aa, Staphylococcus aureus
RVLPNWTTCISICALFRDSEVLNST

SEQ ID NO: 1647820 - protein, 22 aa, Staphylococcus aureus
RYFLNMLQRIKIHLVAFDEAHC

SEQ ID NO: 1647821 - protein, 18 aa, Staphylococcus aureus
RYPEGFEFEKAMDRFANE

SEQ ID NO: 1647822 - protein, 17 aa, Staphylococcus aureus
SAFDIIGPVMMGPSSSH

SEQ ID NO: 1647823 - protein, 24 aa, Staphylococcus aureus
SALQHAASVAAMFLTTEAVVASIP

SEQ ID NO: 1647824 - protein, 25 aa, Staphylococcus aureus
SAVEREIGYRLKIISGGNSSMLPQL

SEQ ID NO: 1647825 - protein, 22 aa, Staphylococcus aureus
SDDYLLPRKGVYAVSIEIGTEN

SEQ ID NO: 1647826 - protein, 20 aa, Staphylococcus aureus
SDFTDVRFQPGQVLTVVHNN

SEQ ID NO: 1647827 - protein, 29 aa, Staphylococcus aureus
SDGEAFGKFFKLMLNQGINLAPSKFEAWF

SEQ ID NO: 1647828 - protein, 26 aa, Staphylococcus aureus
SEETARQCSIVWGVQPVVKKGRKSTD

SEQ ID NO: 1647829 - protein, 18 aa, Staphylococcus aureus
SEIQEVLEDLGIEEAEFE

SEQ ID NO: 1647830 - protein, 21 aa, Staphylococcus aureus
SEITIGLKDNGTFIYDGDEPL

SEQ ID NO: 1647831 - protein, 22 aa, Staphylococcus aureus
SEITPLTTIRVFELMEEVGFPK

SEQ ID NO: 1647832 - protein, 20 aa, Staphylococcus aureus
SEKDIAVGIHRKRGLLDQLA

SEQ ID NO: 1647833 - protein, 20 aa, Staphylococcus aureus
SERIMIGQIVFDGVDDTEKL

SEQ ID NO: 1647834 - protein, 26 aa, Staphylococcus aureus
SFKFSRLPQDINFFSWLQHVKDSDKT

SEQ ID NO: 1647835 - protein, 23 aa, Staphylococcus aureus
SFVTEGKNEWAFETSDKSFVAQI

SEQ ID NO: 1647836 - protein, 25 aa, Staphylococcus aureus
SFWSHLKPVMMALVLTSMRQRMQQN

SEQ ID NO: 1647837 - protein, 19 aa, Staphylococcus aureus
SFYEGYRLGSDNLTVGEIV

SEQ ID NO: 1647838 - protein, 24 aa, Staphylococcus aureus
SGEQRISNFLIWQVSYSEFIFNQK

SEQ ID NO: 1647839 - protein, 29 aa, Staphylococcus aureus
SGGQRQRVWIAMALAQRTDIIFLDEPTTY

SEQ ID NO: 1647840 - protein, 20 aa, Staphylococcus aureus
SGIDRSELFITTKVWIENVN

SEQ ID NO: 1647841 - protein, 22 aa, Staphylococcus aureus
SGMAKSRRKILEKMERIDKPML

SEQ ID NO: 1647842 - protein, 23 aa, Staphylococcus aureus
SGQKCSACSRAIVHKDVYDEVLE

SEQ ID NO: 1647843 - protein, 21 aa, Staphylococcus aureus
SGSAIQWLRDGLRMINSAPQS

SEQ ID NO: 1647844 - protein, 24 aa, Staphylococcus aureus
SGTVRNVVDFGAFVDIGVKQDGLV

SEQ ID NO: 1647845 - protein, 20 aa, Staphylococcus aureus
SGYPDCRDSFIKSMNVTLSL

SEQ ID NO: 1647846 - protein, 23 aa, Staphylococcus aureus
SHFELGVKTGKWLQQTPLLKNRE

SEQ ID NO: 1647847 - protein, 21 aa, Staphylococcus aureus
SHRKLFPSIFHLYQQDNLDEH

SEQ ID NO: 1647848 - protein, 25 aa, Staphylococcus aureus
SHYHDKIKMCTGKSVNQIPGSGAAG

SEQ ID NO: 1647849 - protein, 22 aa, Staphylococcus aureus
SIDRKLPGLSERERKIISKHTK

SEQ ID NO: 1647850 - protein, 20 aa, Staphylococcus aureus
SIDTSMGFTPLAGVTMGTRS

SEQ ID NO: 1647851 - protein, 24 aa, Staphylococcus aureus
SIFVKSRGQTAILFDEVDSGVSGQ

SEQ ID NO: 1647852 - protein, 24 aa, Staphylococcus aureus
SIGIYSYELYNFFDVDTIIRIGSC

SEQ ID NO: 1647853 - protein, 30 aa, Staphylococcus aureus
SILTSIPLWKNQMAIALTLMRQRNAVAAQR

SEQ ID NO: 1647854 - protein, 17 aa, Staphylococcus aureus
SINDCYAILGLVHTLWK

SEQ ID NO: 1647855 - protein, 19 aa, Staphylococcus aureus
SIRIRPDYFEVYKHNELLE

SEQ ID NO: 1647856 - protein, 20 aa, Staphylococcus aureus
SKAIPRVNLTEVYRQQDGSS

SEQ ID NO: 1647857 - protein, 18 aa, Staphylococcus aureus
SKIVETFALPTLILNIDR

SEQ ID NO: 1647858 - protein, 21 aa, Staphylococcus aureus
SKQPLEYPSCGSVFQRPPGHF

SEQ ID NO: 1647859 - protein, 20 aa, Staphylococcus aureus
SKSHISPKIFEDVQKSAYES

SEQ ID NO: 1647860 - protein, 21 aa, Staphylococcus aureus
SKYMTELPCETCHGKRLSREA

SEQ ID NO: 1647861 - protein, 26 aa, Staphylococcus aureus
SLIDYGCHLLDLSLWLLGKDMVPHEV

SEQ ID NO: 1647862 - protein, 24 aa, Staphylococcus aureus
SLNIPIVLVSRSFNGIVSPTYAYD

SEQ ID NO: 1647863 - protein, 19 aa, Staphylococcus aureus
SLQPLALKAANSIFVGDYL

SEQ ID NO: 1647864 - protein, 17 aa, Staphylococcus aureus
SLQYITAQCVKQVEVIR

SEQ ID NO: 1647865 - protein, 19 aa, Staphylococcus aureus
SLTAVLAVPLWYKNQVYGV

SEQ ID NO: 1647866 - protein, 20 aa, Staphylococcus aureus
SNAFDISKKLGLSLNIINKA

SEQ ID NO: 1647867 - protein, 19 aa, Staphylococcus aureus
SNMPYTMVGGQKFYDRKEI

SEQ ID NO: 1647868 - protein, 18 aa, Staphylococcus aureus
SNMVKQLYSPVQFINSTE

SEQ ID NO: 1647869 - protein, 24 aa, Staphylococcus aureus
SNTLCIRPGVVVTYDRNYVSNDLL

SEQ ID NO: 1647870 - protein, 25 aa, Staphylococcus aureus
SPEDFYEVMRLIAVEILNADLEEAH

SEQ ID NO: 1647871 - protein, 26 aa, Staphylococcus aureus
SPLPLMHLYKMFRPFVNEDIEITNNY

SEQ ID NO: 1647872 - protein, 20 aa, Staphylococcus aureus
SPNDICLIEELAPFFEAGID

SEQ ID NO: 1647873 - protein, 23 aa, Staphylococcus aureus
SPNLKVIANMAVGYDNIDVESAT

SEQ ID NO: 1647874 - protein, 25 aa, Staphylococcus aureus
SPQLFKQLLMISGFDKYYQIVKCFR

SEQ ID NO: 1647875 - protein, 26 aa, Staphylococcus aureus
SPQVRKLKEGFFFAALTPTLRHLGKL

SEQ ID NO: 1647876 - protein, 23 aa, Staphylococcus aureus
SQSLKGALFTSLFLEKMNMNTTP

SEQ ID NO: 1647877 - protein, 20 aa, Staphylococcus aureus
SQTVSNWLKWFDMDIVEEND

SEQ ID NO: 1647878 - protein, 19 aa, Staphylococcus aureus
SRGSLKIKSKDPFEKPSIR

SEQ ID NO: 1647879 - protein, 19 aa, Staphylococcus aureus
SRLEHGISYTEFTYTILQA

SEQ ID NO: 1647880 - protein, 22 aa, Staphylococcus aureus
SRLHNVKGISILKLDQSDVVRH

SEQ ID NO: 1647881 - protein, 19 aa, Staphylococcus aureus
SRPTMSGNFEYIYNEMLRQ

SEQ ID NO: 1647882 - protein, 20 aa, Staphylococcus aureus
SRQAIWKMIKQNGVKANIKK

SEQ ID NO: 1647883 - protein, 24 aa, Staphylococcus aureus
SRSARAYGSAALEIVSVATGNLEA

SEQ ID NO: 1647884 - protein, 19 aa, Staphylococcus aureus
SRTPMQWDDTLNGGFTNGE

SEQ ID NO: 1647885 - protein, 21 aa, Staphylococcus aureus
STEKVESVWNFINKIWNGARF

SEQ ID NO: 1647886 - protein, 18 aa, Staphylococcus aureus
STIFPNFIGHTFAVYDGR

SEQ ID NO: 1647887 - protein, 18 aa, Staphylococcus aureus
STIPLKYSILEELYDLTN

SEQ ID NO: 1647888 - protein, 25 aa, Staphylococcus aureus
STLPYKSEINAIIKQCLSLPQTRLR

SEQ ID NO: 1647889 - protein, 24 aa, Staphylococcus aureus
STVSELLSVFGFKVVDADKAAREA

SEQ ID NO: 1647890 - protein, 20 aa, Staphylococcus aureus
SVIEIIKMLQAHPAVQQVFH

SEQ ID NO: 1647891 - protein, 22 aa, Staphylococcus aureus
SVIKSKHFTISFYLTTHSIPET

SEQ ID NO: 1647892 - protein, 23 aa, Staphylococcus aureus
SVKDRIALAMIEKAEREGKIKPG

SEQ ID NO: 1647893 - protein, 23 aa, Staphylococcus aureus
SYGVKYASSFFGPFRDAADSAPS

SEQ ID NO: 1647894 - protein, 25 aa, Staphylococcus aureus
SYLLLRGLKTLHLRIERAQSNARKL

SEQ ID NO: 1647895 - protein, 26 aa, Staphylococcus aureus
SYLMEPWDGPTMISFCNGDKLGALTD

SEQ ID NO: 1647896 - protein, 19 aa, Staphylococcus aureus
SYSKIAYIMSFLKVHYPNY

SEQ ID NO: 1647897 - protein, 18 aa, Staphylococcus aureus
SYYDYILEVYDYVHQIFP

SEQ ID NO: 1647898 - protein, 19 aa, Staphylococcus aureus
TADVALREQVAFRDDALRI

SEQ ID NO: 1647899 - protein, 20 aa, Staphylococcus aureus
TAREGSIFVASVGYTVDSHK

SEQ ID NO: 1647900 - protein, 25 aa, Staphylococcus aureus
TATPIPRTLAISVFGEMDVSSIKQL

SEQ ID NO: 1647901 - protein, 24 aa, Staphylococcus aureus
TDDARLTIEVMKRAAEKGAEIINY

SEQ ID NO: 1647902 - protein, 23 aa, Staphylococcus aureus
TDFNLGPEPEFFLFKLDEKGEPT

SEQ ID NO: 1647903 - protein, 30 aa, Staphylococcus aureus
TDKRVSPDLFIKRLNFYDYLLLNSDGLTDY

SEQ ID NO: 1647904 - protein, 25 aa, Staphylococcus aureus
TDVKAATQSLKWAVEEMERRYKLFA

SEQ ID NO: 1647905 - protein, 21 aa, Staphylococcus aureus
TEDVYDFWRPTGHKYPLVDGA

SEQ ID NO: 1647906 - protein, 20 aa, Staphylococcus aureus
TEIYDYIRLLYARVGKPYCP

SEQ ID NO: 1647907 - protein, 18 aa, Staphylococcus aureus
TEVNPLPPHYICPNCKTS

SEQ ID NO: 1647908 - protein, 18 aa, Staphylococcus aureus
TFLRGEIILGNMKYSSGP

SEQ ID NO: 1647909 - protein, 24 aa, Staphylococcus aureus
TFNDAWKKMGILGIEMESAGLYLN

SEQ ID NO: 1647910 - protein, 19 aa, Staphylococcus aureus
TGFGTGGWQLAALNICSKA

SEQ ID NO: 1647911 - protein, 21 aa, Staphylococcus aureus
TGRGSIQMRSRAVIEERGGGR

SEQ ID NO: 1647912 - protein, 26 aa, Staphylococcus aureus
THAQMKMFLTRLGFGSKMVVTGDQTQ

SEQ ID NO: 1647913 - protein, 25 aa, Staphylococcus aureus
TIAEYSVSIALQLVRRFPDIERRVQ

SEQ ID NO: 1647914 - protein, 25 aa, Staphylococcus aureus
TIDPIKFNLLFERFLNPERVTMPDI

SEQ ID NO: 1647915 - protein, 17 aa, Staphylococcus aureus
TIKRVMRLIDNIRQYGH

SEQ ID NO: 1647916 - protein, 18 aa, Staphylococcus aureus
TILYKMFRERGFEIKPEI

SEQ ID NO: 1647917 - protein, 25 aa, Staphylococcus aureus
TIRIAPRKVRLVLDLIRGKNAAEAI

SEQ ID NO: 1647918 - protein, 20 aa, Staphylococcus aureus
TITNGGIFGSMMSTPIINGN

SEQ ID NO: 1647919 - protein, 23 aa, Staphylococcus aureus
TITSSKCLVLFTSYKMMHMVQDM

SEQ ID NO: 1647920 - protein, 19 aa, Staphylococcus aureus
TKEDAERAILAARRAFESG

SEQ ID NO: 1647921 - protein, 18 aa, Staphylococcus aureus
TKILKDMYHQGVLTTSKK

SEQ ID NO: 1647922 - protein, 18 aa, Staphylococcus aureus
TKKKAIVIGGGLLGLECA

SEQ ID NO: 1647923 - protein, 17 aa, Staphylococcus aureus
TKLIELWEDQTVVIVEH

SEQ ID NO: 1647924 - protein, 28 aa, Staphylococcus aureus
TKSETFVIISFKHKVILIGGTEYAGEMK

SEQ ID NO: 1647925 - protein, 26 aa, Staphylococcus aureus
TLIEFDRSWEKIGVRFVQSLLETFPV

SEQ ID NO: 1647926 - protein, 24 aa, Staphylococcus aureus
TLQDRRKAFQFAYLSLMQEEKIQA

SEQ ID NO: 1647927 - protein, 25 aa, Staphylococcus aureus
TMAGKGTEIGRSFEELARIIDGVHN

SEQ ID NO: 1647928 - protein, 17 aa, Staphylococcus aureus
TMGKLAMLMLKDLDQAF

SEQ ID NO: 1647929 - protein, 26 aa, Staphylococcus aureus
TMVHLSRFAEEIIFWSTDEAKFITLS

SEQ ID NO: 1647930 - protein, 24 aa, Staphylococcus aureus
TNETETYMPLAIYLSHQLAKRLSD

SEQ ID NO: 1647931 - protein, 25 aa, Staphylococcus aureus
TNLNIKRLMEISSYRGIRHRRGLPV

SEQ ID NO: 1647932 - protein, 18 aa, Staphylococcus aureus
TNVLGLRLVEKSVNQDNP

SEQ ID NO: 1647933 - protein, 22 aa, Staphylococcus aureus
TPDLTCLGKVIGGGLPVGAFGG

SEQ ID NO: 1647934 - protein, 24 aa, Staphylococcus aureus
TPMKCLRIVALFRLINPTKEIRIA

SEQ ID NO: 1647935 - protein, 18 aa, Staphylococcus aureus
TQCDLELYFTSLSRKTIV

SEQ ID NO: 1647936 - protein, 17 aa, Staphylococcus aureus
TQPSHVLDAMFEDEERS

SEQ ID NO: 1647937 - protein, 24 aa, Staphylococcus aureus
TQTLIHLPFDYVFFTGSENVGKIV

SEQ ID NO: 1647938 - protein, 21 aa, Staphylococcus aureus
TRAAYPINHIDNIVVPSKAAH

SEQ ID NO: 1647939 - protein, 20 aa, Staphylococcus aureus
TRASLKIQEGCNNFCTFCII

SEQ ID NO: 1647940 - protein, 25 aa, Staphylococcus aureus
TRFVDGKRSLLFGPFAGFSPKFLKT

SEQ ID NO: 1647941 - protein, 20 aa, Staphylococcus aureus
TRHNIGFEVVDYILEKNNFS

SEQ ID NO: 1647942 - protein, 24 aa, Staphylococcus aureus
TRLLAGLLSGLGIESVLSGDVSIG

SEQ ID NO: 1647943 - protein, 17 aa, Staphylococcus aureus
TSDMDFDGLKALLPAIT

SEQ ID NO: 1647944 - protein, 18 aa, Staphylococcus aureus
TSELKKGRQAYVICPLIE

SEQ ID NO: 1647945 - protein, 19 aa, Staphylococcus aureus
TSFGFKHGIQMDADLVFDV

SEQ ID NO: 1647946 - protein, 21 aa, Staphylococcus aureus
TSSDLILYVSYFNHSFTDNDK

SEQ ID NO: 1647947 - protein, 23 aa, Staphylococcus aureus
TSTERFVRMAFMKANIAQNNDKE

SEQ ID NO: 1647948 - protein, 23 aa, Staphylococcus aureus
TTDKSVEFLLNMDAKSFTMGDYV

SEQ ID NO: 1647949 - protein, 24 aa, Staphylococcus aureus
TTIKEAAMLAGYFSKAGNSGQIPV

SEQ ID NO: 1647950 - protein, 34 aa, Staphylococcus aureus
TTPAMPLDTCGAMSQGMIGYWLETEINRILTEMN

SEQ ID NO: 1647951 - protein, 24 aa, Staphylococcus aureus
TTTECPTCGKFMIKVKTKNGQMLV

SEQ ID NO: 1647952 - protein, 26 aa, Staphylococcus aureus
TVLKRMRRKYTMDRFSERLTKLHKAL

SEQ ID NO: 1647953 - protein, 17 aa, Staphylococcus aureus
TVLRGCKPYYVENGAFS

SEQ ID NO: 1647954 - protein, 25 aa, Staphylococcus aureus
TVYIYRWPNLFGKWCKPNYNSVIAT

SEQ ID NO: 1647955 - protein, 21 aa, Staphylococcus aureus
TWCDLKKAKGKVLARHIVPYP

SEQ ID NO: 1647956 - protein, 19 aa, Staphylococcus aureus
TYQAQRVLTDILPAIDNIE

SEQ ID NO: 1647957 - protein, 25 aa, Staphylococcus aureus
VAQWPMSRLQHWHSLLKARAIENNM

SEQ ID NO: 1647958 - protein, 19 aa, Staphylococcus aureus
VARVKAILRRSQFVKEVEE

SEQ ID NO: 1647959 - protein, 24 aa, Staphylococcus aureus
VCAHKRWLFISSTLIKQTVRSSLI

SEQ ID NO: 1647960 - protein, 25 aa, Staphylococcus aureus
VDAMISRSEFYTAYTPYQPEISQGE

SEQ ID NO: 1647961 - protein, 19 aa, Staphylococcus aureus
VDILTRFVKEYTGLPAERV

SEQ ID NO: 1647962 - protein, 22 aa, Staphylococcus aureus
VDKKLSHMRIHSINIKEFETNC

SEQ ID NO: 1647963 - protein, 18 aa, Staphylococcus aureus
VDLGRRIVNVLAPNEDIT

SEQ ID NO: 1647964 - protein, 24 aa, Staphylococcus aureus
VDPYLRPLYDGLYTVLGREQTERF

SEQ ID NO: 1647965 - protein, 25 aa, Staphylococcus aureus
VDSYRYGLKHMMEFYQLDFHGHHDA

SEQ ID NO: 1647966 - protein, 18 aa, Staphylococcus aureus
VDVEEVWNLIDHKLRTYE

SEQ ID NO: 1647967 - protein, 24 aa, Staphylococcus aureus
VEADRLRFDFSHFGPMTNDEIDQV

SEQ ID NO: 1647968 - protein, 17 aa, Staphylococcus aureus
VEIKSMVDTGVLSDRAV

SEQ ID NO: 1647969 - protein, 20 aa, Staphylococcus aureus
VEIPCVMRNAIGSGNALISA

SEQ ID NO: 1647970 - protein, 19 aa, Staphylococcus aureus
VEKELGQDIPLVINGEKIF

SEQ ID NO: 1647971 - protein, 26 aa, Staphylococcus aureus
VERARRIQFFLSQNFHVAEQFTGQKG

SEQ ID NO: 1647972 - protein, 20 aa, Staphylococcus aureus
VERRKARRIESKQTIEYLAQ

SEQ ID NO: 1647973 - protein, 21 aa, Staphylococcus aureus
VFGIPGAKIDYLFNALIDDGP

SEQ ID NO: 1647974 - protein, 24 aa, Staphylococcus aureus
VFYIPNCDKITPGMILAAMRTNVP

SEQ ID NO: 1647975 - protein, 24 aa, Staphylococcus aureus
VGAGLPLWLPNGATIRREIERYIV

SEQ ID NO: 1647976 - protein, 29 aa, Staphylococcus aureus
VGATTFKESLRWGTEIFHNLKSILSKRGL

SEQ ID NO: 1647977 - protein, 18 aa, Staphylococcus aureus
VGHKKAREIWYLCRQYNA

SEQ ID NO: 1647978 - protein, 19 aa, Staphylococcus aureus
VGILPRTHGSGLFTRGQTQ

SEQ ID NO: 1647979 - protein, 18 aa, Staphylococcus aureus
VGKPYCPNHNIEIESQTV

SEQ ID NO: 1647980 - protein, 19 aa, Staphylococcus aureus
VGLITRANVVDIVYDTIWG

SEQ ID NO: 1647981 - protein, 22 aa, Staphylococcus aureus
VGMGYSLHAGMVVVADGSERAE

SEQ ID NO: 1647982 - protein, 25 aa, Staphylococcus aureus
VGMSEKLDGLELFHPERMASRILGM

SEQ ID NO: 1647983 - protein, 23 aa, Staphylococcus aureus
VGPKGIKAYVEMSMNLSESHLNY

SEQ ID NO: 1647984 - protein, 19 aa, Staphylococcus aureus
VGPNCPGVITADECKIGIM

SEQ ID NO: 1647985 - protein, 26 aa, Staphylococcus aureus
VGQIAKIKGCRVVGIAGGDKKVNYLT

SEQ ID NO: 1647986 - protein, 20 aa, Staphylococcus aureus
VGWHIPNRFTEGYGPNELAF

SEQ ID NO: 1647987 - protein, 20 aa, Staphylococcus aureus
VIDNLRLRYEHVGYHGQPLV

SEQ ID NO: 1647988 - protein, 20 aa, Staphylococcus aureus
VIEFNARFGDPEAQVLLSRM

SEQ ID NO: 1647989 - protein, 26 aa, Staphylococcus aureus
VIEQSKCKRAIILPNNKNILMASEQA

SEQ ID NO: 1647990 - protein, 17 aa, Staphylococcus aureus
VIIIKRNDNVIIVSYEN

SEQ ID NO: 1647991 - protein, 24 aa, Staphylococcus aureus
VILCFDGLDFLRFGRIQRTYESLI

SEQ ID NO: 1647992 - protein, 18 aa, Staphylococcus aureus
VISCPLENGLEIFVGVPS

SEQ ID NO: 1647993 - protein, 19 aa, Staphylococcus aureus
VKEQLIFPEIDYDKVSKVR

SEQ ID NO: 1647994 - protein, 23 aa, Staphylococcus aureus
VKEVDLTLPLVVRLEGTNVELGK

SEQ ID NO: 1647995 - protein, 27 aa, Staphylococcus aureus
VKLLRIEDAHVHWELGVVWKKDKQLSH

SEQ ID NO: 1647996 - protein, 19 aa, Staphylococcus aureus
VKMALWYTEMQRNLQRFKQ

SEQ ID NO: 1647997 - protein, 25 aa, Staphylococcus aureus
VKNILEIGTAIGYSSMQFASISDDI

SEQ ID NO: 1647998 - protein, 21 aa, Staphylococcus aureus
VKPGKGSAFVRSKLRNLRTGA

SEQ ID NO: 1647999 - protein, 19 aa, Staphylococcus aureus
VKVLARGPVSKGLLTSNSV

SEQ ID NO: 1648000 - protein, 21 aa, Staphylococcus aureus
VKYNIIGGFDLGVVSDDFKNH

SEQ ID NO: 1648001 - protein, 20 aa, Staphylococcus aureus
VLAGFAGSVADAFTLFEKFE

SEQ ID NO: 1648002 - protein, 17 aa, Staphylococcus aureus
VLCNLSRRLPRIYHDGD

SEQ ID NO: 1648003 - protein, 19 aa, Staphylococcus aureus
VLYFKARDNHRLSNESNNE

SEQ ID NO: 1648004 - protein, 22 aa, Staphylococcus aureus
VNDIRVGKVLYMTVDEVSDEKV

SEQ ID NO: 1648005 - protein, 19 aa, Staphylococcus aureus
VPAYLPIKNLIALVLDSLD

SEQ ID NO: 1648006 - protein, 18 aa, Staphylococcus aureus
VPVDLIFMNGKEMHRQGR

SEQ ID NO: 1648007 - protein, 26 aa, Staphylococcus aureus
VQNIEVLRFANAMFEPLWNNKYISNI

SEQ ID NO: 1648008 - protein, 25 aa, Staphylococcus aureus
VRDADRLDAIGAIGVARTFQFAGHF

SEQ ID NO: 1648009 - protein, 27 aa, Staphylococcus aureus
VRKHFDLRPAGIIKMLDLKQPIYKQTA

SEQ ID NO: 1648010 - protein, 22 aa, Staphylococcus aureus
VRPGFEGGQLPLFRRLPKRGFT

SEQ ID NO: 1648011 - protein, 18 aa, Staphylococcus aureus
VRSTIIYLPEFIRTLKGG

SEQ ID NO: 1648012 - protein, 22 aa, Staphylococcus aureus
VSALSRPLIAKKLVEIAEKTNS

SEQ ID NO: 1648013 - protein, 24 aa, Staphylococcus aureus
VSAQEKYDLFVLVVTDIINSDSKI

SEQ ID NO: 1648014 - protein, 17 aa, Staphylococcus aureus
VSDGLMVARGDMGVEIP

SEQ ID NO: 1648015 - protein, 26 aa, Staphylococcus aureus
VSDRIGRLFEITGLKDLMHVNEGTEV

SEQ ID NO: 1648016 - protein, 25 aa, Staphylococcus aureus
VSFELRKKHILGIVGESGSGKSITA

SEQ ID NO: 1648017 - protein, 28 aa, Staphylococcus aureus
VSLIRLTLSGVFSRAGATYDDIEDAKIA

SEQ ID NO: 1648018 - protein, 19 aa, Staphylococcus aureus
VSLKHKYNATLILDVSHSF

SEQ ID NO: 1648019 - protein, 21 aa, Staphylococcus aureus
VSVLRAPKTFTREDIIEINCH

SEQ ID NO: 1648020 - protein, 18 aa, Staphylococcus aureus
VTEAIKAQVDKFIHYTPA

SEQ ID NO: 1648021 - protein, 29 aa, Staphylococcus aureus
VTEPEPSFSTCFGAPFFPLHPTVYADLLG

SEQ ID NO: 1648022 - protein, 29 aa, Staphylococcus aureus
VTGYDIIFFWVARMIFQGLEFTDRRPFND

SEQ ID NO: 1648023 - protein, 19 aa, Staphylococcus aureus
VVAAVGLAQNFAACRALVS

SEQ ID NO: 1648024 - protein, 17 aa, Staphylococcus aureus
VVADARSPRDGRIIEQI

SEQ ID NO: 1648025 - protein, 17 aa, Staphylococcus aureus
VVDHPRYGKQLKAETFE

SEQ ID NO: 1648026 - protein, 22 aa, Staphylococcus aureus
VVEKDAWYGPELNHIKYVDDLT

SEQ ID NO: 1648027 - protein, 25 aa, Staphylococcus aureus
VVFPRETMIGSMAYYISHAKNNKNF

SEQ ID NO: 1648028 - protein, 31 aa, Staphylococcus aureus
VVGDSDQSIYGWRGADIQNILSFEKDYPEAN

SEQ ID NO: 1648029 - protein, 27 aa, Staphylococcus aureus
VVNKRAVDWAMRAAMALNMEIATESKF

SEQ ID NO: 1648030 - protein, 25 aa, Staphylococcus aureus
VVVPDYQLSLAIGKRGQNARLAAKL

SEQ ID NO: 1648031 - protein, 24 aa, Staphylococcus aureus
VYRKIRNTLRFMLGNINDFNPDTD

SEQ ID NO: 1648032 - protein, 32 aa, Staphylococcus aureus
WAEPEGMETWDFAHCLPYFKKLEKTYGAAPYD

SEQ ID NO: 1648033 - protein, 32 aa, Staphylococcus aureus
WAVEEMERRYKLFAHYHVRNITAFNKKAPYDE

SEQ ID NO: 1648034 - protein, 23 aa, Staphylococcus aureus
WCGDAMMNLPILKHISEALNLEV

SEQ ID NO: 1648035 - protein, 25 aa, Staphylococcus aureus
WDNKDRPLALCAALLHDLGHGPFSH

SEQ ID NO: 1648036 - protein, 19 aa, Staphylococcus aureus
WDNYPVCMAKTQYSFSDDQ

SEQ ID NO: 1648037 - protein, 18 aa, Staphylococcus aureus
WIKAGLVVANDKVVKSNY

SEQ ID NO: 1648038 - protein, 17 aa, Staphylococcus aureus
WLNCGYNRWNHNEPLVG

SEQ ID NO: 1648039 - protein, 25 aa, Staphylococcus aureus
WNFINKIWNGARFSLMNIGEDFKVE

SEQ ID NO: 1648040 - protein, 20 aa, Staphylococcus aureus
WRPTGHKYPLVDGALSKDAY

SEQ ID NO: 1648041 - protein, 25 aa, Staphylococcus aureus
WTISRQLWWGHQIPAWYHKETGEIY

SEQ ID NO: 1648042 - protein, 27 aa, Staphylococcus aureus
WVEKYSRLRSVYKYEIFNEKGELATTG

SEQ ID NO: 1648043 - protein, 18 aa, Staphylococcus aureus
YAQALGVDIDNLYLSQPD

SEQ ID NO: 1648044 - protein, 17 aa, Staphylococcus aureus
YDMKLSNLYIYKLAVIA

SEQ ID NO: 1648045 - protein, 23 aa, Staphylococcus aureus
YDVLPDRLVTVFAGQDKEATQRA

SEQ ID NO: 1648046 - protein, 17 aa, Staphylococcus aureus
YEAILRMEKRYKGPIAF

SEQ ID NO: 1648047 - protein, 25 aa, Staphylococcus aureus
YELSKCMTCGVCLEVCPNVTENNKF

SEQ ID NO: 1648048 - protein, 17 aa, Staphylococcus aureus
YENVPLWHERDISHSSA

SEQ ID NO: 1648049 - protein, 19 aa, Staphylococcus aureus
YEPLCEVITDKVTAEVPST

SEQ ID NO: 1648050 - protein, 17 aa, Staphylococcus aureus
YESLKVAADICVFTNDN

SEQ ID NO: 1648051 - protein, 18 aa, Staphylococcus aureus
YEYDLEYGTNVLTMHKDA

SEQ ID NO: 1648052 - protein, 20 aa, Staphylococcus aureus
YFDHQILRRLVAFMYETPST

SEQ ID NO: 1648053 - protein, 25 aa, Staphylococcus aureus
YFGGIKLGGGGLIRAYSGAVRDVIY

SEQ ID NO: 1648054 - protein, 23 aa, Staphylococcus aureus
YGCDKFCTYCIVPFTRGKERSRR

SEQ ID NO: 1648055 - protein, 27 aa, Staphylococcus aureus
YGEKGGTPWLDQKHTVFGQIIDGETTL

SEQ ID NO: 1648056 - protein, 18 aa, Staphylococcus aureus
YGTIKFALTQGDKFAKAV

SEQ ID NO: 1648057 - protein, 18 aa, Staphylococcus aureus
YIRHLIKAEETFGIRLTT

SEQ ID NO: 1648058 - protein, 27 aa, Staphylococcus aureus
YIRPVRKRIGMVFQFPESQLFEDTVER

SEQ ID NO: 1648059 - protein, 25 aa, Staphylococcus aureus
YISGLSLLGGEPFCNLDITLNLVKA

SEQ ID NO: 1648060 - protein, 17 aa, Staphylococcus aureus
YISLGLISQILKDDTSN

SEQ ID NO: 1648061 - protein, 17 aa, Staphylococcus aureus
YKDFGFEDYSFRLSYRD

SEQ ID NO: 1648062 - protein, 26 aa, Staphylococcus aureus
YKDSYRKLTCLHVNHGVRSASIEEAR

SEQ ID NO: 1648063 - protein, 19 aa, Staphylococcus aureus
YKEAIEFWGDEIAAVLVEP

SEQ ID NO: 1648064 - protein, 22 aa, Staphylococcus aureus
YKEKLLLSMAYQLLMHNKSQTL

SEQ ID NO: 1648065 - protein, 27 aa, Staphylococcus aureus
YKINEHYVKISLIGSGMRDMSGVASKA

SEQ ID NO: 1648066 - protein, 27 aa, Staphylococcus aureus
YKRYLENQIRAAFGFEGTPIHIIARKR

SEQ ID NO: 1648067 - protein, 18 aa, Staphylococcus aureus
YLHFSPKQFRSLVSKITE

SEQ ID NO: 1648068 - protein, 26 aa, Staphylococcus aureus
YLKSAYLVDLLENFVLERGIYGKRWL

SEQ ID NO: 1648069 - protein, 19 aa, Staphylococcus aureus
YLRSLAHNIDPIFQIGKGG

SEQ ID NO: 1648070 - protein, 19 aa, Staphylococcus aureus
YLSTQWFVRMEDLAKRSLD

SEQ ID NO: 1648071 - protein, 21 aa, Staphylococcus aureus
YMKPREFCLVTVLEGEGQMIV

SEQ ID NO: 1648072 - protein, 18 aa, Staphylococcus aureus
YPLVDGALSKDAYIRSFQ

SEQ ID NO: 1648073 - protein, 28 aa, Staphylococcus aureus
YPWGSVKSISGYPFVWWFATNPEYEGKG

SEQ ID NO: 1648074 - protein, 19 aa, Staphylococcus aureus
YPYKFLKKEFGILGVDMHL

SEQ ID NO: 1648075 - protein, 28 aa, Staphylococcus aureus
YQDVPTKLWPIQPLRDFWGINRRTEAKL

SEQ ID NO: 1648076 - protein, 24 aa, Staphylococcus aureus
YQNKRPDYIGAFWNVVNWEKVDEL

SEQ ID NO: 1648077 - protein, 25 aa, Staphylococcus aureus
YQRSADIFLGVPFNIASYALLTHLI

SEQ ID NO: 1648078 - protein, 19 aa, Staphylococcus aureus
YQTKWTELYDIWFSIYSTP

SEQ ID NO: 1648079 - protein, 19 aa, Staphylococcus aureus
YQYQPRLDYLKAVDKLILD

SEQ ID NO: 1648080 - protein, 18 aa, Staphylococcus aureus
YRNFGMAHPEGYRKALRL

SEQ ID NO: 1648081 - protein, 23 aa, Staphylococcus aureus
YRSEPHERLFALLIKKDGKQVLF

SEQ ID NO: 1648082 - protein, 17 aa, Staphylococcus aureus
YSVNDFTDFNARSQSEA

SEQ ID NO: 1648083 - protein, 22 aa, Staphylococcus aureus
YTDKIIDAFGMRPYIKKKVKKY

SEQ ID NO: 1648084 - protein, 17 aa, Staphylococcus aureus
YTILQAIDFGHLNRELN

SEQ ID NO: 1648085 - protein, 17 aa, Staphylococcus aureus
YTLIKNVHKPSGAKPGF

SEQ ID NO: 1648086 - protein, 26 aa, Staphylococcus aureus
YVFISWTGKMAEAFVLAHELGHAGHF

SEQ ID NO: 1648087 - protein, 18 aa, Staphylococcus aureus
YVHFSRLVQGFWRANEWK

SEQ ID NO: 1648088 - protein, 19 aa, Staphylococcus aureus
YVMLGHLHHPFSIEDDKIK

SEQ ID NO: 1648089 - protein, 18 aa, Staphylococcus aureus
YYIESSLQLTLPYERNDL

SEQ ID NO: 1648090 - protein, 17 aa, Staphylococcus aureus
YYSARVVHDVTIEPSPI

SEQ ID NO: 1648091 - protein, 21 aa, Staphylococcus aureus
AAHGGLHPYGATFFVFSDYLK

SEQ ID NO: 1648092 - protein, 17 aa, Staphylococcus aureus
ACRGWRYCMTGCPYKKV

SEQ ID NO: 1648093 - protein, 19 aa, Staphylococcus aureus
ADGVFIYIGMKPLTAPFKD

SEQ ID NO: 1648094 - protein, 18 aa, Staphylococcus aureus
ADHIVFICGHYEGYDERI

SEQ ID NO: 1648095 - protein, 21 aa, Staphylococcus aureus
ADLMIDLGLIEDVDYIAARLE

SEQ ID NO: 1648096 - protein, 17 aa, Staphylococcus aureus
ADQALLQRLDLMKFQLE

SEQ ID NO: 1648097 - protein, 22 aa, Staphylococcus aureus
ADRILRTSHKFDDKQASMTKVL

SEQ ID NO: 1648098 - protein, 18 aa, Staphylococcus aureus
ADSLKVIARAGVGVDNIN

SEQ ID NO: 1648099 - protein, 19 aa, Staphylococcus aureus
AEGHVPRPPAMVETLTYIK

SEQ ID NO: 1648100 - protein, 23 aa, Staphylococcus aureus
AERIGLLKIDFLGLRNLSIIHQI

SEQ ID NO: 1648101 - protein, 20 aa, Staphylococcus aureus
AGKRKIFGFRGMVNGPIDES

SEQ ID NO: 1648102 - protein, 18 aa, Staphylococcus aureus
AGLFHIAIKLPQISDLAN

SEQ ID NO: 1648103 - protein, 23 aa, Staphylococcus aureus
AGNVLRFQPPLVITYEQLDTALN

SEQ ID NO: 1648104 - protein, 20 aa, Staphylococcus aureus
AGVEAGLASARRGAKTLMLT

SEQ ID NO: 1648105 - protein, 25 aa, Staphylococcus aureus
AGYASCFNGAFDLILKQNKVRDAHP

SEQ ID NO: 1648106 - protein, 17 aa, Staphylococcus aureus
AHASLRQSLLPHLIEAA

SEQ ID NO: 1648107 - protein, 28 aa, Staphylococcus aureus
AILRMEKRYKGPIAFEYTHINNNTERGW

SEQ ID NO: 1648108 - protein, 23 aa, Staphylococcus aureus
AISDGRPKLMGIRQIIDSYLNHQ

SEQ ID NO: 1648109 - protein, 29 aa, Staphylococcus aureus
AIYTARKGLRTGIVADRIGGQVNDTAGIE

SEQ ID NO: 1648110 - protein, 29 aa, Staphylococcus aureus
AKAFVASAIKNGWKMNDFVGPVDHGAYNR

SEQ ID NO: 1648111 - protein, 19 aa, Staphylococcus aureus
AKFKAGLEKSRQNFQEQLN

SEQ ID NO: 1648112 - protein, 23 aa, Staphylococcus aureus
AKFRKESLGFIFQDYSILPTLTV

SEQ ID NO: 1648113 - protein, 23 aa, Staphylococcus aureus
AKGGSGLHLRLEQVPTREPGISP

SEQ ID NO: 1648114 - protein, 18 aa, Staphylococcus aureus
AKIDYLFNALIDDGPELI

SEQ ID NO: 1648115 - protein, 22 aa, Staphylococcus aureus
AKIVEFGGWAMPVQFSSIKEEH

SEQ ID NO: 1648116 - protein, 19 aa, Staphylococcus aureus
AKKIGYPVIIKATAGGGGK

SEQ ID NO: 1648117 - protein, 19 aa, Staphylococcus aureus
AKKPVVLAGAGINQSKSNQ

SEQ ID NO: 1648118 - protein, 22 aa, Staphylococcus aureus
AKMRFECKLSQMILLGDVLDGA

SEQ ID NO: 1648119 - protein, 26 aa, Staphylococcus aureus
AKNYAHRLLMDLGFSRDVMSQSPFQM

SEQ ID NO: 1648120 - protein, 21 aa, Staphylococcus aureus
AKPYRVLRIGSFLLSESGYKI

SEQ ID NO: 1648121 - protein, 24 aa, Staphylococcus aureus
AKSLNTLTIFRVFIIDSQALKRSI

SEQ ID NO: 1648122 - protein, 26 aa, Staphylococcus aureus
AKVKEIKDNPAAYVLLGYNDTTNRSF

SEQ ID NO: 1648123 - protein, 18 aa, Staphylococcus aureus
ALEHKPKLIVAGASAYSR

SEQ ID NO: 1648124 - protein, 26 aa, Staphylococcus aureus
ALFILGETLYNFGLMPQGLEVFRVLY

SEQ ID NO: 1648125 - protein, 20 aa, Staphylococcus aureus
ALTDRNGLRPGRYTITKDNF

SEQ ID NO: 1648126 - protein, 18 aa, Staphylococcus aureus
ANGFISIASEAVKVAPEY

SEQ ID NO: 1648127 - protein, 25 aa, Staphylococcus aureus
AQKARACGIHMLVATQRPSVNVITG

SEQ ID NO: 1648128 - protein, 19 aa, Staphylococcus aureus
AQLDYLLPRLQGHGKSLSR

SEQ ID NO: 1648129 - protein, 18 aa, Staphylococcus aureus
AQLFVVQILFQYLFSQGR

SEQ ID NO: 1648130 - protein, 24 aa, Staphylococcus aureus
AQLVEGLIHFVSRQAMNIDGLGTK

SEQ ID NO: 1648131 - protein, 25 aa, Staphylococcus aureus
AQREFKQYFPQSGWVEHDANEIWTS

SEQ ID NO: 1648132 - protein, 19 aa, Staphylococcus aureus
AREVTRRKSALDVASLPGK

SEQ ID NO: 1648133 - protein, 19 aa, Staphylococcus aureus
ARIDDAIIVGFHYEDVDKR

SEQ ID NO: 1648134 - protein, 19 aa, Staphylococcus aureus
ARPLRRIVEQQVRDKITDY

SEQ ID NO: 1648135 - protein, 17 aa, Staphylococcus aureus
ASIKAGVHLNKLTEERS

SEQ ID NO: 1648136 - protein, 19 aa, Staphylococcus aureus
ATAYIFIKMVQQMKELGVL

SEQ ID NO: 1648137 - protein, 20 aa, Staphylococcus aureus
ATIFLMNAVYEFDLVREHQI

SEQ ID NO: 1648138 - protein, 23 aa, Staphylococcus aureus
ATVKRIEKYGAFVGLFPGKDALL

SEQ ID NO: 1648139 - protein, 26 aa, Staphylococcus aureus
ATVSKGGHLKIRLVANKGRGYALAEQ

SEQ ID NO: 1648140 - protein, 17 aa, Staphylococcus aureus
AVDLKVILEYGESAPKI

SEQ ID NO: 1648141 - protein, 17 aa, Staphylococcus aureus
AVMNMKILINILGAFHQ

SEQ ID NO: 1648142 - protein, 19 aa, Staphylococcus aureus
AYVKQAADWGHPAIAVTDH

SEQ ID NO: 1648143 - protein, 24 aa, Staphylococcus aureus
CAIQKEYYVGFVIDRATDQVTLMA

SEQ ID NO: 1648144 - protein, 29 aa, Staphylococcus aureus
CDKMPDKLCLYYHIGQCLGPCVYDVDLSK

SEQ ID NO: 1648145 - protein, 19 aa, Staphylococcus aureus
CDSLPLVVFTGQVATPGIG

SEQ ID NO: 1648146 - protein, 22 aa, Staphylococcus aureus
CEKNNAVVLFKMHPFVKNRLNI

SEQ ID NO: 1648147 - protein, 19 aa, Staphylococcus aureus
CKDGRKINVINHVDNNAFF

SEQ ID NO: 1648148 - protein, 25 aa, Staphylococcus aureus
CKNELLRYPYIESFEDVDEVIQVAK

SEQ ID NO: 1648149 - protein, 19 aa, Staphylococcus aureus
CKQYQLPLFMDGARLGYGL

SEQ ID NO: 1648150 - protein, 19 aa, Staphylococcus aureus
CNYMIGMAFNQLESFKLAL

SEQ ID NO: 1648151 - protein, 19 aa, Staphylococcus aureus
CQDKVELIKKCEKYTDEVI

SEQ ID NO: 1648152 - protein, 18 aa, Staphylococcus aureus
DAEVLAMVMHIYQSFGLK

SEQ ID NO: 1648153 - protein, 24 aa, Staphylococcus aureus
DDLIKELRRLGANVYVSIENGIKS

SEQ ID NO: 1648154 - protein, 24 aa, Staphylococcus aureus
DDVLKACVDLSIQYIPQRLLPDKA

SEQ ID NO: 1648155 - protein, 22 aa, Staphylococcus aureus
DDYPYGGGQGMVLKPEPVFNAM

SEQ ID NO: 1648156 - protein, 22 aa, Staphylococcus aureus
DEAYPSIKARGGGYQRIAIDTF

SEQ ID NO: 1648157 - protein, 20 aa, Staphylococcus aureus
DEDHYASLIFVLSAIDNHSH

SEQ ID NO: 1648158 - protein, 30 aa, Staphylococcus aureus
DEIQVGLGRTGKWFAMEWEQVVPDIYILGK

SEQ ID NO: 1648159 - protein, 22 aa, Staphylococcus aureus
DEKARHKGVMVVFNDEIHTARN

SEQ ID NO: 1648160 - protein, 19 aa, Staphylococcus aureus
DELSMGMSNDYLIAVEEGA

SEQ ID NO: 1648161 - protein, 20 aa, Staphylococcus aureus
DESRTIKAIEELGTQMGIQT

SEQ ID NO: 1648162 - protein, 24 aa, Staphylococcus aureus
DETAIPLLLGLGLDEFSMSATSIL

SEQ ID NO: 1648163 - protein, 20 aa, Staphylococcus aureus
DETLFKLQRQFAYTKEEIHK

SEQ ID NO: 1648164 - protein, 28 aa, Staphylococcus aureus
DEVYKPYIEGFVKMLAPIAPHIGEELWS

SEQ ID NO: 1648165 - protein, 23 aa, Staphylococcus aureus
DFDDIIQIGITFVRNNQIIDTYH

SEQ ID NO: 1648166 - protein, 21 aa, Staphylococcus aureus
DFLLVKREIFSSGKSLCKINN

SEQ ID NO: 1648167 - protein, 20 aa, Staphylococcus aureus
DGHRVIVAGLDMDFRGEPFE

SEQ ID NO: 1648168 - protein, 19 aa, Staphylococcus aureus
DGNQFVCRFNVAILDNGYY

SEQ ID NO: 1648169 - protein, 21 aa, Staphylococcus aureus
DHAMLKLAYIDLNEYLKTLQL

SEQ ID NO: 1648170 - protein, 23 aa, Staphylococcus aureus
DHIDKKEARRMDRFTQYAIVAAR

SEQ ID NO: 1648171 - protein, 26 aa, Staphylococcus aureus
DHRIIDGKEAVGFLKTIKELIENPED

SEQ ID NO: 1648172 - protein, 17 aa, Staphylococcus aureus
DIELAYEAGLLSRNEEN

SEQ ID NO: 1648173 - protein, 18 aa, Staphylococcus aureus
DIILHLIKTYGVDFGTGY

SEQ ID NO: 1648174 - protein, 24 aa, Staphylococcus aureus
DIKSLDCLIYASGQSLYGVLQDMK

SEQ ID NO: 1648175 - protein, 28 aa, Staphylococcus aureus
DKDSEHYGLWAFKKVWGTYLSEKIGEFD

SEQ ID NO: 1648176 - protein, 23 aa, Staphylococcus aureus
DKINFGDGVARFDLRKEGAKHFH

SEQ ID NO: 1648177 - protein, 17 aa, Staphylococcus aureus
DKIYWERVQLFVEGHSE

SEQ ID NO: 1648178 - protein, 20 aa, Staphylococcus aureus
DKSVKRKYIALVHGNIPHDY

SEQ ID NO: 1648179 - protein, 25 aa, Staphylococcus aureus
DLETSLKINNEWLATVENISFELSK

SEQ ID NO: 1648180 - protein, 21 aa, Staphylococcus aureus
DLPIIPKYMKTVVIGKTSKQF

SEQ ID NO: 1648181 - protein, 24 aa, Staphylococcus aureus
DLRLTDMGYELGMISEERYARFNE

SEQ ID NO: 1648182 - protein, 17 aa, Staphylococcus aureus
DMFKALLHETFKAYGVL

SEQ ID NO: 1648183 - protein, 19 aa, Staphylococcus aureus
DMGYFCVDNLPPVLLPKFV

SEQ ID NO: 1648184 - protein, 23 aa, Staphylococcus aureus
DNEIKRLLVKEGTIEDHGDQLMQ

SEQ ID NO: 1648185 - protein, 23 aa, Staphylococcus aureus
DNILRHPANDFVRDFIGQNRLIQ

SEQ ID NO: 1648186 - protein, 22 aa, Staphylococcus aureus
DQPIEGFFSIAGFKEDAENIDL

SEQ ID NO: 1648187 - protein, 20 aa, Staphylococcus aureus
DQRRIEWKRVLDMNDRALRH

SEQ ID NO: 1648188 - protein, 19 aa, Staphylococcus aureus
DRDDLKDGLFFEPTVITNC

SEQ ID NO: 1648189 - protein, 21 aa, Staphylococcus aureus
DRGEWVISRQRVWGVPLPVFY

SEQ ID NO: 1648190 - protein, 20 aa, Staphylococcus aureus
DRLVKGCTGVKRTTGQHPGG

SEQ ID NO: 1648191 - protein, 22 aa, Staphylococcus aureus
DRSAAYAARYVAKNIVAAGLAD

SEQ ID NO: 1648192 - protein, 18 aa, Staphylococcus aureus
DRVFLCEIFGSIRENTGA

SEQ ID NO: 1648193 - protein, 26 aa, Staphylococcus aureus
DSCGDCTICVDRCPTSALVGNGQLNS

SEQ ID NO: 1648194 - protein, 22 aa, Staphylococcus aureus
DSELLKSHMFYWSDKQNNRINT

SEQ ID NO: 1648195 - protein, 17 aa, Staphylococcus aureus
DSGEYRLLTENDFDKLN

SEQ ID NO: 1648196 - protein, 19 aa, Staphylococcus aureus
DSLGVCIHTSYGAIVYTGE

SEQ ID NO: 1648197 - protein, 17 aa, Staphylococcus aureus
DTIRLSIIGRPNVGKSS

SEQ ID NO: 1648198 - protein, 28 aa, Staphylococcus aureus
DTTYGKLGVKVWIYRGEVLPTKNTSGGG

SEQ ID NO: 1648199 - protein, 17 aa, Staphylococcus aureus
DVPAGIMTKCPKCKKIM

SEQ ID NO: 1648200 - protein, 18 aa, Staphylococcus aureus
DVPQIIWHGLPLTEAFLF

SEQ ID NO: 1648201 - protein, 22 aa, Staphylococcus aureus
DVTPLSLGIEILGGRMNTLIER

SEQ ID NO: 1648202 - protein, 19 aa, Staphylococcus aureus
EAIGVSGLITPWNFPTNQT

SEQ ID NO: 1648203 - protein, 26 aa, Staphylococcus aureus
EAIRPKILLHSCCAPCSTYTLEFLTQ

SEQ ID NO: 1648204 - protein, 23 aa, Staphylococcus aureus
EAIRYLERIGFDAIHKYEQELTI

SEQ ID NO: 1648205 - protein, 24 aa, Staphylococcus aureus
EALLKENVDYLFGYPGGAVLPLYD

SEQ ID NO: 1648206 - protein, 18 aa, Staphylococcus aureus
EALNENYHLLSIRGQVSE

SEQ ID NO: 1648207 - protein, 19 aa, Staphylococcus aureus
EAYMPRRSFLRLNEEKEKN

SEQ ID NO: 1648208 - protein, 27 aa, Staphylococcus aureus
EDGMPGLTICGGYQFLGKKYITPDGTE

SEQ ID NO: 1648209 - protein, 17 aa, Staphylococcus aureus
EDLRLIVSREHRLAKYE

SEQ ID NO: 1648210 - protein, 25 aa, Staphylococcus aureus
EEARLKEFRKLGVEYEMAKLKNDLA

SEQ ID NO: 1648211 - protein, 20 aa, Staphylococcus aureus
EEINEIARRIIVDIRDKQLR

SEQ ID NO: 1648212 - protein, 21 aa, Staphylococcus aureus
EELCIELDPGMAFGTGDHPTT

SEQ ID NO: 1648213 - protein, 17 aa, Staphylococcus aureus
EEYEWLQQSTFNFPGKE

SEQ ID NO: 1648214 - protein, 20 aa, Staphylococcus aureus
EEYTYFFNGVKHILKAKNKE

SEQ ID NO: 1648215 - protein, 21 aa, Staphylococcus aureus
EFLGDAVLELTVSRYLFDKHP

SEQ ID NO: 1648216 - protein, 17 aa, Staphylococcus aureus
EGLPLPDLIIVDGGKGH

SEQ ID NO: 1648217 - protein, 17 aa, Staphylococcus aureus
EHALLFVSKIREILMKE

SEQ ID NO: 1648218 - protein, 21 aa, Staphylococcus aureus
EHDACGIGFYANMDNKRSHDI

SEQ ID NO: 1648219 - protein, 19 aa, Staphylococcus aureus
EHNEVPKINNALVIDVPKE

SEQ ID NO: 1648220 - protein, 23 aa, Staphylococcus aureus
EIAVRIIRACRDLGIQTVAIYSE

SEQ ID NO: 1648221 - protein, 27 aa, Staphylococcus aureus
EIDHFRLGISVSKKLGNAVLRNKIKRA

SEQ ID NO: 1648222 - protein, 20 aa, Staphylococcus aureus
EIISTITVRYPWGSVKSISG

SEQ ID NO: 1648223 - protein, 25 aa, Staphylococcus aureus
EIKQRVTEMLEFVGLSDKKDQFPDE

SEQ ID NO: 1648224 - protein, 28 aa, Staphylococcus aureus
EIKYWAELKDVFELFDVEMPIVMPRLRI

SEQ ID NO: 1648225 - protein, 22 aa, Staphylococcus aureus
EKFSGWLLKEGFEDVAQLHGGI

SEQ ID NO: 1648226 - protein, 18 aa, Staphylococcus aureus
EKHDVPVILFGVGASHLI

SEQ ID NO: 1648227 - protein, 24 aa, Staphylococcus aureus
EKHGIKMIYGMEGMLVDDGVPIAY

SEQ ID NO: 1648228 - protein, 19 aa, Staphylococcus aureus
EKNTVPFIARYRKEQTGGL

SEQ ID NO: 1648229 - protein, 17 aa, Staphylococcus aureus
EKQKLRYLYGMTERQFR

SEQ ID NO: 1648230 - protein, 23 aa, Staphylococcus aureus
EKTLLAKKIEAMVDNKAQYSFLK

SEQ ID NO: 1648231 - protein, 21 aa, Staphylococcus aureus
ELDGATALSIGWHVSVVGQIY

SEQ ID NO: 1648232 - protein, 30 aa, Staphylococcus aureus
ELDLSALVAGAKYRGEFEERLKAVLKEVKE

SEQ ID NO: 1648233 - protein, 24 aa, Staphylococcus aureus
ELGKTECWYILDAAPGAEIIYGVH

SEQ ID NO: 1648234 - protein, 21 aa, Staphylococcus aureus
ELITFKSGERYNMVPDHAEAR

SEQ ID NO: 1648235 - protein, 28 aa, Staphylococcus aureus
ELIYGAKMAWRNSNRCIGRLFWDSLNVI

SEQ ID NO: 1648236 - protein, 21 aa, Staphylococcus aureus
ELLRKSDLVVTIGYDPIEYEA

SEQ ID NO: 1648237 - protein, 19 aa, Staphylococcus aureus
ELMERMVWTRILDQRSISL

SEQ ID NO: 1648238 - protein, 32 aa, Staphylococcus aureus
ELMNRLTGRRICESCGTTYHLVFNPPKVEGIC

SEQ ID NO: 1648239 - protein, 22 aa, Staphylococcus aureus
EMALGRNVVVGFMTWDGYNYED

SEQ ID NO: 1648240 - protein, 18 aa, Staphylococcus aureus
EMFDGVLNHSIMKRAQEN

SEQ ID NO: 1648241 - protein, 23 aa, Staphylococcus aureus
EMGMSGFHEIEFLSNLAQPDIAV

SEQ ID NO: 1648242 - protein, 21 aa, Staphylococcus aureus
EMKSWVPLMIEGRKSDEPIAL

SEQ ID NO: 1648243 - protein, 33 aa, Staphylococcus aureus
ENEWKNYFHPFRASKKFTIVPSWETYAKEADEE

SEQ ID NO: 1648244 - protein, 19 aa, Staphylococcus aureus
ENLNVIACLMEIRRNPVNI

SEQ ID NO: 1648245 - protein, 22 aa, Staphylococcus aureus
ENRLGHMPLLMDFIQQHSIDPS

SEQ ID NO: 1648246 - protein, 24 aa, Staphylococcus aureus
ENVDRIYGTHLWSGYPTGTIHSRA

SEQ ID NO: 1648247 - protein, 28 aa, Staphylococcus aureus
ENVIFIGLLCKHGHWHAVIYDIAQDKTA

SEQ ID NO: 1648248 - protein, 27 aa, Staphylococcus aureus
EPGTIVPLNGLRVMGKFGDSVTTDHIS

SEQ ID NO: 1648249 - protein, 20 aa, Staphylococcus aureus
EPYIRRRAIRHLEKKRVVIF

SEQ ID NO: 1648250 - protein, 20 aa, Staphylococcus aureus
EQLFAAGYASCFNGAFDLIL

SEQ ID NO: 1648251 - protein, 28 aa, Staphylococcus aureus
EQPGIFGSPIKWNFTKFIIDRQGNVVNR

SEQ ID NO: 1648252 - protein, 18 aa, Staphylococcus aureus
ERMFKVENLYDVQNVDVI

SEQ ID NO: 1648253 - protein, 22 aa, Staphylococcus aureus
ESKIQIGEKLTRGLGAGANPEI

SEQ ID NO: 1648254 - protein, 19 aa, Staphylococcus aureus
ESLGARKGEMVDMTTTDNG

SEQ ID NO: 1648255 - protein, 18 aa, Staphylococcus aureus
ESSMKYINEHGGMIIYLP

SEQ ID NO: 1648256 - protein, 18 aa, Staphylococcus aureus
ETAFPLLYTHFVKNGDWT

SEQ ID NO: 1648257 - protein, 25 aa, Staphylococcus aureus
EVLDPSLPIDLIIDYAHTADGMNKL

SEQ ID NO: 1648258 - protein, 20 aa, Staphylococcus aureus
EVLVPLKYLLIGGEVLNAKW

SEQ ID NO: 1648259 - protein, 27 aa, Staphylococcus aureus
EVSDPKELIARHSLKVEAGVIAIQKSI

SEQ ID NO: 1648260 - protein, 17 aa, Staphylococcus aureus
EVYEIFQNTMLKRANED

SEQ ID NO: 1648261 - protein, 30 aa, Staphylococcus aureus
EWMLDFRLKSLKLFYKMPMPQWGGDLSELN

SEQ ID NO: 1648262 - protein, 23 aa, Staphylococcus aureus
EYDEAIVRFFKGDKETLRYGENP

SEQ ID NO: 1648263 - protein, 23 aa, Staphylococcus aureus
EYLRTVTPYEVFSYGIDEEAQFM

SEQ ID NO: 1648264 - protein, 19 aa, Staphylococcus aureus
FAALAFKVMTDPYVGKLTF

SEQ ID NO: 1648265 - protein, 17 aa, Staphylococcus aureus
FDIMLASYIIDPSRTIS

SEQ ID NO: 1648266 - protein, 25 aa, Staphylococcus aureus
FDVDVPRTDWDWMIYPQGLYDQIMR

SEQ ID NO: 1648267 - protein, 20 aa, Staphylococcus aureus
FEDYFLIVSDLIHYAKTNDV

SEQ ID NO: 1648268 - protein, 19 aa, Staphylococcus aureus
FEGTILFVSHDRYFINQLA

SEQ ID NO: 1648269 - protein, 18 aa, Staphylococcus aureus
FEVFDVLQDLGLTKVNGG

SEQ ID NO: 1648270 - protein, 18 aa, Staphylococcus aureus
FFLHHGFTDVEAKNIEGH

SEQ ID NO: 1648271 - protein, 20 aa, Staphylococcus aureus
FFTEVLGMRLVKKTVNQDDI

SEQ ID NO: 1648272 - protein, 33 aa, Staphylococcus aureus
FGFATAPLVVLGCIMMRVCHKDTCPVGVATQNK

SEQ ID NO: 1648273 - protein, 19 aa, Staphylococcus aureus
FGGSIKNQGNRFLNILVVC

SEQ ID NO: 1648274 - protein, 18 aa, Staphylococcus aureus
FHAAALKQVPSCEFFPVE

SEQ ID NO: 1648275 - protein, 24 aa, Staphylococcus aureus
FHSECGWPSFSKALDDDEIIELVD

SEQ ID NO: 1648276 - protein, 20 aa, Staphylococcus aureus
FKASTSFNFDVLSERLQESA

SEQ ID NO: 1648277 - protein, 20 aa, Staphylococcus aureus
FKNQLLFTKHNLRGIEFPGG

SEQ ID NO: 1648278 - protein, 24 aa, Staphylococcus aureus
FLNKTLERKAVWDKWMEQDKNNNS

SEQ ID NO: 1648279 - protein, 18 aa, Staphylococcus aureus
FLQLRDGTGFMQGVVVKS

SEQ ID NO: 1648280 - protein, 23 aa, Staphylococcus aureus
FMGPLDAAIAWSEKGLDGSRRFL

SEQ ID NO: 1648281 - protein, 17 aa, Staphylococcus aureus
FNAEKGFGFIEQENGGD

SEQ ID NO: 1648282 - protein, 31 aa, Staphylococcus aureus
FNKKAPYDERMPKIVIVIDELADLMMMAPQE

SEQ ID NO: 1648283 - protein, 26 aa, Staphylococcus aureus
FNQLESFKLALPYLMTAAELDKDKDA

SEQ ID NO: 1648284 - protein, 21 aa, Staphylococcus aureus
FNYPFQLVFEPLIGAIAAGNT

SEQ ID NO: 1648285 - protein, 20 aa, Staphylococcus aureus
FPEVKYWTTFNEIGPIGDGQ

SEQ ID NO: 1648286 - protein, 18 aa, Staphylococcus aureus
FPPGIKYDFEKVFQSHHN

SEQ ID NO: 1648287 - protein, 23 aa, Staphylococcus aureus
FPYSPRIGTPAARMDDQIDEEIK

SEQ ID NO: 1648288 - protein, 26 aa, Staphylococcus aureus
FQANGIKCVMIAKLPFMNKHNAKYWL

SEQ ID NO: 1648289 - protein, 18 aa, Staphylococcus aureus
FQDLKFNIQQEMTETVIE

SEQ ID NO: 1648290 - protein, 22 aa, Staphylococcus aureus
FRMGSMGSVIGEKICRIIDYCT

SEQ ID NO: 1648291 - protein, 21 aa, Staphylococcus aureus
FRMYQRYCEKKGFKVETVDYL

SEQ ID NO: 1648292 - protein, 23 aa, Staphylococcus aureus
FSRGQGVQVVTVFGGMPIERQIK

SEQ ID NO: 1648293 - protein, 17 aa, Staphylococcus aureus
FSVNQNVHFEVLLVKLA

SEQ ID NO: 1648294 - protein, 17 aa, Staphylococcus aureus
FSYKRYLENQIRAAFGF

SEQ ID NO: 1648295 - protein, 17 aa, Staphylococcus aureus
FTLPMSVFDDLYEEYTE

SEQ ID NO: 1648296 - protein, 19 aa, Staphylococcus aureus
FVCRFNVAILDNGYYLPED

SEQ ID NO: 1648297 - protein, 26 aa, Staphylococcus aureus
FVTESMKIQSPRLMLGFKNKPLQEAP

SEQ ID NO: 1648298 - protein, 23 aa, Staphylococcus aureus
FVYQGAESFKIWTNKDADINSMK

SEQ ID NO: 1648299 - protein, 17 aa, Staphylococcus aureus
GALGDYQLIDGLGPEEE

SEQ ID NO: 1648300 - protein, 25 aa, Staphylococcus aureus
GAPLKRGASTIAMLSKSPILPVAYV

SEQ ID NO: 1648301 - protein, 19 aa, Staphylococcus aureus
GAQLAALFVNAGLKVKLLD

SEQ ID NO: 1648302 - protein, 24 aa, Staphylococcus aureus
GASSFKMKFGHRGANHPVKNLETG

SEQ ID NO: 1648303 - protein, 17 aa, Staphylococcus aureus
GDFRFILEGEKLSDGSG

SEQ ID NO: 1648304 - protein, 18 aa, Staphylococcus aureus
GDIQRVGTDIFLCTPDNV

SEQ ID NO: 1648305 - protein, 17 aa, Staphylococcus aureus
GDLPTIVRRLLVISYED

SEQ ID NO: 1648306 - protein, 24 aa, Staphylococcus aureus
GEIAVRIIRACREYGIETVAVYAK

SEQ ID NO: 1648307 - protein, 17 aa, Staphylococcus aureus
GELLMCDIIDAFINAEY

SEQ ID NO: 1648308 - protein, 21 aa, Staphylococcus aureus
GEMNRRYMGDLVFNHPEKRLE

SEQ ID NO: 1648309 - protein, 18 aa, Staphylococcus aureus
GEPIPVIHWEDGTMTTVP

SEQ ID NO: 1648310 - protein, 22 aa, Staphylococcus aureus
GGKASYPSTVLMTATLAQVAGV

SEQ ID NO: 1648311 - protein, 20 aa, Staphylococcus aureus
GGKLPANFLNLERHIDVFAP

SEQ ID NO: 1648312 - protein, 20 aa, Staphylococcus aureus
GGQFPRDFNIASSDDLLVCA

SEQ ID NO: 1648313 - protein, 18 aa, Staphylococcus aureus
GGVGEIAKNMYIVEVDDE

SEQ ID NO: 1648314 - protein, 18 aa, Staphylococcus aureus
GHDVFLDLKLHDIPNTVG

SEQ ID NO: 1648315 - protein, 17 aa, Staphylococcus aureus
GHQRFMAQLDFGGVPFE

SEQ ID NO: 1648316 - protein, 21 aa, Staphylococcus aureus
GIGCSGRLSGYINSYGVHSIH

SEQ ID NO: 1648317 - protein, 19 aa, Staphylococcus aureus
GIHAFKLGFILNAVNRELP

SEQ ID NO: 1648318 - protein, 18 aa, Staphylococcus aureus
GINDGAAMMLVMSEDKAK

SEQ ID NO: 1648319 - protein, 31 aa, Staphylococcus aureus
GINGEIRPGIVHRIDMDTSGLLMVAKNDIAH

SEQ ID NO: 1648320 - protein, 24 aa, Staphylococcus aureus
GITYPESFKVFGSEQSKVIFCEAD

SEQ ID NO: 1648321 - protein, 20 aa, Staphylococcus aureus
GIYGKRWLDDELFNVEHFSK

SEQ ID NO: 1648322 - protein, 17 aa, Staphylococcus aureus
GKDFIFEATVTVEPEVK

SEQ ID NO: 1648323 - protein, 33 aa, Staphylococcus aureus
GKEGLRLSQFYKELMYTTGCLEIEHGDANEGVL

SEQ ID NO: 1648324 - protein, 19 aa, Staphylococcus aureus
GKSIALAMIKRDEFEMGRE

SEQ ID NO: 1648325 - protein, 17 aa, Staphylococcus aureus
GKSTLLRCMNLLEVPTK

SEQ ID NO: 1648326 - protein, 18 aa, Staphylococcus aureus
GKTPILGLDVWEHAYYLK

SEQ ID NO: 1648327 - protein, 17 aa, Staphylococcus aureus
GKVFNYGQQYGELIKLK

SEQ ID NO: 1648328 - protein, 18 aa, Staphylococcus aureus
GKVFSFGPTFRAEKSKTR

SEQ ID NO: 1648329 - protein, 25 aa, Staphylococcus aureus
GLDIPRVLGDIIICTDVAQEQANNY

SEQ ID NO: 1648330 - protein, 17 aa, Staphylococcus aureus
GLDVKIVLINNGTLGMV

SEQ ID NO: 1648331 - protein, 24 aa, Staphylococcus aureus
GMAHPEGYRKALRLMKQAEKFNRP

SEQ ID NO: 1648332 - protein, 22 aa, Staphylococcus aureus
GMLSLRLNKAYSVAKLLENLDI

SEQ ID NO: 1648333 - protein, 24 aa, Staphylococcus aureus
GMTSFAEACILAFSQTKKNKIVVS

SEQ ID NO: 1648334 - protein, 21 aa, Staphylococcus aureus
GNETRVAWEVALESESTPTSL

SEQ ID NO: 1648335 - protein, 22 aa, Staphylococcus aureus
GNLPDAILCISDEEAIGIMHSA

SEQ ID NO: 1648336 - protein, 25 aa, Staphylococcus aureus
GNSLSFRAFYALPLLSNKAGIHTNA

SEQ ID NO: 1648337 - protein, 17 aa, Staphylococcus aureus
GQLPGTKVYPWIAKTRG

SEQ ID NO: 1648338 - protein, 18 aa, Staphylococcus aureus
GQTIKFKGFMTLYVETKD

SEQ ID NO: 1648339 - protein, 17 aa, Staphylococcus aureus
GRIYLSVDAYGEDIKVN

SEQ ID NO: 1648340 - protein, 20 aa, Staphylococcus aureus
GRPNVGKSTIFNRIVGERVS

SEQ ID NO: 1648341 - protein, 26 aa, Staphylococcus aureus
GSGKSNITDAIKWVLGEQSAKSLRGS

SEQ ID NO: 1648342 - protein, 21 aa, Staphylococcus aureus
GSIRGDLGLTVGRNIIHGSDS

SEQ ID NO: 1648343 - protein, 21 aa, Staphylococcus aureus
GSLLMDCQFCNAIRPGISLYG

SEQ ID NO: 1648344 - protein, 18 aa, Staphylococcus aureus
GSLRCDANISLRPYGQEK

SEQ ID NO: 1648345 - protein, 19 aa, Staphylococcus aureus
GSVGMASDASRVFKGQKMP

SEQ ID NO: 1648346 - protein, 22 aa, Staphylococcus aureus
GTERLVRAAIQYAIDNNRKSVT

SEQ ID NO: 1648347 - protein, 17 aa, Staphylococcus aureus
GTGWLLEIVISNEHYET

SEQ ID NO: 1648348 - protein, 18 aa, Staphylococcus aureus
GVDILICDTAGRLQNKTN

SEQ ID NO: 1648349 - protein, 20 aa, Staphylococcus aureus
GVIGMEFASLMIDLGVDVTV

SEQ ID NO: 1648350 - protein, 17 aa, Staphylococcus aureus
GVLETRPELSFPADMYL

SEQ ID NO: 1648351 - protein, 19 aa, Staphylococcus aureus
GVPIKAPVAGIAMGLVTRE

SEQ ID NO: 1648352 - protein, 26 aa, Staphylococcus aureus
GYGEYFPHRLGHGLGLQEHEYQDVSS

SEQ ID NO: 1648353 - protein, 21 aa, Staphylococcus aureus
GYHLINVNVGRDFNVDEYGDF

SEQ ID NO: 1648354 - protein, 18 aa, Staphylococcus aureus
GYIHKKGHVGVVSRSGTL

SEQ ID NO: 1648355 - protein, 34 aa, Staphylococcus aureus
GYRSLHIVVSIPVFLAERVEVLPVEIQIRTIGMD

SEQ ID NO: 1648356 - protein, 25 aa, Staphylococcus aureus
HAGQVCSAGSRILVQNSIKDKFEQA

SEQ ID NO: 1648357 - protein, 23 aa, Staphylococcus aureus
HANELARAIKYRTRIVTLEGDIV

SEQ ID NO: 1648358 - protein, 28 aa, Staphylococcus aureus
HAQGLGFRGNIFGGYILYNLGYIHSTGR

SEQ ID NO: 1648359 - protein, 18 aa, Staphylococcus aureus
HAVEIIGIDIVREADGLA

SEQ ID NO: 1648360 - protein, 23 aa, Staphylococcus aureus
HDGTKLGFMSFFTKASVAALKKY

SEQ ID NO: 1648361 - protein, 26 aa, Staphylococcus aureus
HEITGRIFISLAVKFSKARLIDNIII

SEQ ID NO: 1648362 - protein, 18 aa, Staphylococcus aureus
HGDIYGGMIPKVLDAKNA

SEQ ID NO: 1648363 - protein, 20 aa, Staphylococcus aureus
HGKYNLKVEPIENGLQVGDH

SEQ ID NO: 1648364 - protein, 25 aa, Staphylococcus aureus
HIEHRRWGAPFPVIEIVKLGINKAR

SEQ ID NO: 1648365 - protein, 17 aa, Staphylococcus aureus
HIFKLDPAKHISDDDLD

SEQ ID NO: 1648366 - protein, 29 aa, Staphylococcus aureus
HIFVAGKGRSGFVANSFAMRLNQLGKQAH

SEQ ID NO: 1648367 - protein, 29 aa, Staphylococcus aureus
HIQVLLLTFFFKYMKPLVQAGRVFIALPP

SEQ ID NO: 1648368 - protein, 25 aa, Staphylococcus aureus
HKILLMVDWKDGREGVLTYDVLDYI

SEQ ID NO: 1648369 - protein, 18 aa, Staphylococcus aureus
HLATLKVIGVGGGGNNAV

SEQ ID NO: 1648370 - protein, 25 aa, Staphylococcus aureus
HLDRKLSERRIFPAIDIGRSSTRKE

SEQ ID NO: 1648371 - protein, 18 aa, Staphylococcus aureus
HLPGLSIMKRMTRIAQTI

SEQ ID NO: 1648372 - protein, 26 aa, Staphylococcus aureus
HQLIIKFSSAWSFLVPEILQIDEDKI

SEQ ID NO: 1648373 - protein, 20 aa, Staphylococcus aureus
HSPGSLTYVFDEFAVVGDTL

SEQ ID NO: 1648374 - protein, 27 aa, Staphylococcus aureus
HVNNIKKFGVEPVVAINAFIHDTDAEV

SEQ ID NO: 1648375 - protein, 19 aa, Staphylococcus aureus
HVVFFTFNQPDEWDSPFNI

SEQ ID NO: 1648376 - protein, 23 aa, Staphylococcus aureus
IAEGDITWRKVIDGFFSSFKQDV

SEQ ID NO: 1648377 - protein, 22 aa, Staphylococcus aureus
IAKQILNEWAEDVAEGIAQIQV

SEQ ID NO: 1648378 - protein, 25 aa, Staphylococcus aureus
IALRTEPKLSLPTARSIIAIAVGYP

SEQ ID NO: 1648379 - protein, 17 aa, Staphylococcus aureus
IAPRFFERCFPKLFKNK

SEQ ID NO: 1648380 - protein, 23 aa, Staphylococcus aureus
IDDKGDIFLAWDAVQGDLPLSVY

SEQ ID NO: 1648381 - protein, 18 aa, Staphylococcus aureus
IDEADLMIDLGLIEDVDY

SEQ ID NO: 1648382 - protein, 17 aa, Staphylococcus aureus
IDIPSDVTVTFDGNHVT

SEQ ID NO: 1648383 - protein, 24 aa, Staphylococcus aureus
IDLTRTWEILGEIIGETASDELID

SEQ ID NO: 1648384 - protein, 26 aa, Staphylococcus aureus
IEGVVVRLANFGAFVEIAPGVQGLVH

SEQ ID NO: 1648385 - protein, 23 aa, Staphylococcus aureus
IEIGPGKVLSGLIKKINRDVKLT

SEQ ID NO: 1648386 - protein, 37 aa, Staphylococcus aureus
IFATAMNRKGYYLYGYRHFSSRIKGGHTNNKIRVSTT

SEQ ID NO: 1648387 - protein, 22 aa, Staphylococcus aureus
IGNYKTNYLIPIALSGDQSQNK

SEQ ID NO: 1648388 - protein, 25 aa, Staphylococcus aureus
IGQLIGMRASSDFVRHGEKKAVIEG

SEQ ID NO: 1648389 - protein, 20 aa, Staphylococcus aureus
IGRDCPKCNQYLVENKKGKT

SEQ ID NO: 1648390 - protein, 20 aa, Staphylococcus aureus
IHTATAMKVFGVEADQVDSL

SEQ ID NO: 1648391 - protein, 23 aa, Staphylococcus aureus
IIEINCHGGILTINRVLELTMTY

SEQ ID NO: 1648392 - protein, 18 aa, Staphylococcus aureus
IIPIYNFVRENEFPTKHN

SEQ ID NO: 1648393 - protein, 18 aa, Staphylococcus aureus
IKAATIIDAEHVKKSDKL

SEQ ID NO: 1648394 - protein, 20 aa, Staphylococcus aureus
IKASLKRLEDEIERYTKLSK

SEQ ID NO: 1648395 - protein, 26 aa, Staphylococcus aureus
IKDSLKRLIVPSIEREIHADLTEKAE

SEQ ID NO: 1648396 - protein, 18 aa, Staphylococcus aureus
IKKVIAILETLDFKVEMI

SEQ ID NO: 1648397 - protein, 21 aa, Staphylococcus aureus
IKNIQIGMAHRGRLNVLTHVL

SEQ ID NO: 1648398 - protein, 25 aa, Staphylococcus aureus
IKQMLIDESMPFIVIGKPTSDIDHQ

SEQ ID NO: 1648399 - protein, 20 aa, Staphylococcus aureus
ILAFSNRVAAIVTTKYGAIN

SEQ ID NO: 1648400 - protein, 26 aa, Staphylococcus aureus
ILRRYCFDKAFIGMNGLDIELGLTTP

SEQ ID NO: 1648401 - protein, 20 aa, Staphylococcus aureus
ILVDMTKLLAPILVHTAEEV

SEQ ID NO: 1648402 - protein, 23 aa, Staphylococcus aureus
INFEHLPKPVVFIDDIHDIEISQ

SEQ ID NO: 1648403 - protein, 23 aa, Staphylococcus aureus
INGGKFNGIIPISQLSTHHIDSP

SEQ ID NO: 1648404 - protein, 21 aa, Staphylococcus aureus
INKGEFLAIVGPNGAGKSTLL

SEQ ID NO: 1648405 - protein, 25 aa, Staphylococcus aureus
INPLDNEGLLAFGSDLQKQMSQFSH

SEQ ID NO: 1648406 - protein, 19 aa, Staphylococcus aureus
INQRWLGGLLTNYKTISKR

SEQ ID NO: 1648407 - protein, 30 aa, Staphylococcus aureus
INTELPVDVTICSGLIKADKYEWLLQKATE

SEQ ID NO: 1648408 - protein, 19 aa, Staphylococcus aureus
INTYDWFKEHLTSVDDIEN

SEQ ID NO: 1648409 - protein, 25 aa, Staphylococcus aureus
INVPEARLLVISPYDKTSVADIEKA

SEQ ID NO: 1648410 - protein, 32 aa, Staphylococcus aureus
INVPGFRKGKVPRPIFEQRFGVEALYQDAIDI

SEQ ID NO: 1648411 - protein, 18 aa, Staphylococcus aureus
IPERRPEDAVTYHMPTHC

SEQ ID NO: 1648412 - protein, 20 aa, Staphylococcus aureus
IPNIGAYVKQAADWGHPAIA

SEQ ID NO: 1648413 - protein, 17 aa, Staphylococcus aureus
IQKEYVMGKAYVLNEDY

SEQ ID NO: 1648414 - protein, 25 aa, Staphylococcus aureus
IQPGDDVGRAFSFETTEYILDQLPC

SEQ ID NO: 1648415 - protein, 18 aa, Staphylococcus aureus
IREKEILEIQDIVPSYRA

SEQ ID NO: 1648416 - protein, 20 aa, Staphylococcus aureus
IREVNYLTGEVLKEREHFAI

SEQ ID NO: 1648417 - protein, 26 aa, Staphylococcus aureus
IRHVQFLIRRLRRKEYIHAQDDFVSM

SEQ ID NO: 1648418 - protein, 18 aa, Staphylococcus aureus
IRKAFKPTSKDSVILSAD

SEQ ID NO: 1648419 - protein, 33 aa, Staphylococcus aureus
IRPEDLQAYGLIPEFIGRVPIVANLETLDVTAL

SEQ ID NO: 1648420 - protein, 23 aa, Staphylococcus aureus
ISEDAKFGKFVVEPLERGYGTTL

SEQ ID NO: 1648421 - protein, 23 aa, Staphylococcus aureus
ISKIPRFPFDKFEKGERELGTQM

SEQ ID NO: 1648422 - protein, 21 aa, Staphylococcus aureus
ISQGYRPGDFESITVTVDADK

SEQ ID NO: 1648423 - protein, 19 aa, Staphylococcus aureus
ITKRLGFENGEVFREPLVE

SEQ ID NO: 1648424 - protein, 26 aa, Staphylococcus aureus
ITPDSIGLILGFLVERFMNNQEELHI

SEQ ID NO: 1648425 - protein, 17 aa, Staphylococcus aureus
ITSLYTFKQPVSPHLAF

SEQ ID NO: 1648426 - protein, 21 aa, Staphylococcus aureus
IVDYCRDRGFFVLTYHDGQII

SEQ ID NO: 1648427 - protein, 26 aa, Staphylococcus aureus
IVKKFPIPHISTGDMFRKAIKEETEL

SEQ ID NO: 1648428 - protein, 23 aa, Staphylococcus aureus
IYDKIKDCIFVAHNVDFDLNFIK

SEQ ID NO: 1648429 - protein, 20 aa, Staphylococcus aureus
IYGAKGLAWVKVVEDGLTGP

SEQ ID NO: 1648430 - protein, 18 aa, Staphylococcus aureus
IYPEKIIWDIGGIAPKPC

SEQ ID NO: 1648431 - protein, 19 aa, Staphylococcus aureus
IYRKMMKQKKQFDQIFDLL

SEQ ID NO: 1648432 - protein, 24 aa, Staphylococcus aureus
KALYRQQMVGFVFQDFNLLPTMTN

SEQ ID NO: 1648433 - protein, 18 aa, Staphylococcus aureus
KAQNYAEVQLRLDNHSKK

SEQ ID NO: 1648434 - protein, 34 aa, Staphylococcus aureus
KAVEKFDFNKGFKFSTYATWWIRQAITRAIADQA

SEQ ID NO: 1648435 - protein, 23 aa, Staphylococcus aureus
KDAEVQFQYGLVLCQLEMFNEAI

SEQ ID NO: 1648436 - protein, 21 aa, Staphylococcus aureus
KDAGKIAGLEVERIINEPTAA

SEQ ID NO: 1648437 - protein, 26 aa, Staphylococcus aureus
KDGVKLLWASCRELFNVIQADEIGAD

SEQ ID NO: 1648438 - protein, 20 aa, Staphylococcus aureus
KDLNDFLGINYYMSDWMRGY

SEQ ID NO: 1648439 - protein, 20 aa, Staphylococcus aureus
KDLREAIQLRLDRQEQVVLF

SEQ ID NO: 1648440 - protein, 24 aa, Staphylococcus aureus
KDNESKLGGFDWFKRKTNKKDTHE

SEQ ID NO: 1648441 - protein, 22 aa, Staphylococcus aureus
KEIKYSVTVDGFLETYSTVEQV

SEQ ID NO: 1648442 - protein, 21 aa, Staphylococcus aureus
KELGKGFTLQRYKGLGEMNPE

SEQ ID NO: 1648443 - protein, 27 aa, Staphylococcus aureus
KEMGLKCLRTSIAWTRIFPNGDEDVPN

SEQ ID NO: 1648444 - protein, 28 aa, Staphylococcus aureus
KEVKESDGRIILFIDEIHMLVGAGKTDG

SEQ ID NO: 1648445 - protein, 23 aa, Staphylococcus aureus
KEYDRLIKFLGGIRDMKSMPQAL

SEQ ID NO: 1648446 - protein, 25 aa, Staphylococcus aureus
KGMGTTCVCALVFEKSVVIANVGDS

SEQ ID NO: 1648447 - protein, 18 aa, Staphylococcus aureus
KGRQAYVICPLIESSEHL

SEQ ID NO: 1648448 - protein, 20 aa, Staphylococcus aureus
KGTMEFADRLYGVTMQESGV

SEQ ID NO: 1648449 - protein, 26 aa, Staphylococcus aureus
KIFELEGDLPLFPGHGPYTTVDDEQL

SEQ ID NO: 1648450 - protein, 23 aa, Staphylococcus aureus
KIHGGARSNSTFQYKEISHKEKH

SEQ ID NO: 1648451 - protein, 22 aa, Staphylococcus aureus
KINGEKRVTCIHSGMDEIEKKH

SEQ ID NO: 1648452 - protein, 23 aa, Staphylococcus aureus
KITERHARAVLSLSDSEQEALIE

SEQ ID NO: 1648453 - protein, 19 aa, Staphylococcus aureus
KIYVRGIRGASELRHQLMN

SEQ ID NO: 1648454 - protein, 17 aa, Staphylococcus aureus
KKDTVLIREIIERDEDI

SEQ ID NO: 1648455 - protein, 24 aa, Staphylococcus aureus
KKLIMSGKVLKVMVSNDIERNHFD

SEQ ID NO: 1648456 - protein, 22 aa, Staphylococcus aureus
KKLQHLSLLSGGERALTAIALL

SEQ ID NO: 1648457 - protein, 18 aa, Staphylococcus aureus
KKPVMLIGVGAKHAKDEL

SEQ ID NO: 1648458 - protein, 25 aa, Staphylococcus aureus
KLKMIGHYIGMSFQIIDDVLDFTST

SEQ ID NO: 1648459 - protein, 22 aa, Staphylococcus aureus
KLKPEHFEDIVAVTSLYRPGPM

SEQ ID NO: 1648460 - protein, 21 aa, Staphylococcus aureus
KLKTKFYPTQYIRFEEATIET

SEQ ID NO: 1648461 - protein, 19 aa, Staphylococcus aureus
KLREDVAIMMSCKKSIKAN

SEQ ID NO: 1648462 - protein, 24 aa, Staphylococcus aureus
KMRRIYRRKLTYILKRLKPYKEQL

SEQ ID NO: 1648463 - protein, 24 aa, Staphylococcus aureus
KNNVKKAWWQKFITQSPFNVGIDA

SEQ ID NO: 1648464 - protein, 25 aa, Staphylococcus aureus
KNVRSNCGLGFKAFWEEETGFHYDL

SEQ ID NO: 1648465 - protein, 19 aa, Staphylococcus aureus
KPDLAIAVDVGIAYDTPGM

SEQ ID NO: 1648466 - protein, 22 aa, Staphylococcus aureus
KPEIRMPKVGGRVMSLQDPTRK

SEQ ID NO: 1648467 - protein, 18 aa, Staphylococcus aureus
KPNHFLVAFDAGKTTFRH

SEQ ID NO: 1648468 - protein, 29 aa, Staphylococcus aureus
KPYLIYMLGFMPGFPYLGGLDEQLHTPRR

SEQ ID NO: 1648469 - protein, 17 aa, Staphylococcus aureus
KQEGIIRAYGISSIRPN

SEQ ID NO: 1648470 - protein, 18 aa, Staphylococcus aureus
KQQWIPVYKSWRLNERHY

SEQ ID NO: 1648471 - protein, 20 aa, Staphylococcus aureus
KQVEVIRARRLLDGQASTTG

SEQ ID NO: 1648472 - protein, 23 aa, Staphylococcus aureus
KRGLKILTEVELSYLISEAPIIA

SEQ ID NO: 1648473 - protein, 19 aa, Staphylococcus aureus
KRRLGEKVIGFSSNEADKY

SEQ ID NO: 1648474 - protein, 26 aa, Staphylococcus aureus
KRVAIEMASPLGWHKYVGTAGKVIAI

SEQ ID NO: 1648475 - protein, 20 aa, Staphylococcus aureus
KSHRVHKGLHMLTFEGINNI

SEQ ID NO: 1648476 - protein, 19 aa, Staphylococcus aureus
KSNFYRDKLGYLFQNYGLI

SEQ ID NO: 1648477 - protein, 21 aa, Staphylococcus aureus
KSVVIAYEPIWAIGTGKSSTS

SEQ ID NO: 1648478 - protein, 24 aa, Staphylococcus aureus
KSYIFKSTRLESGVHLPPYKGKFK

SEQ ID NO: 1648479 - protein, 24 aa, Staphylococcus aureus
KTEFELIRLFGKRGRGLYNKARGI

SEQ ID NO: 1648480 - protein, 19 aa, Staphylococcus aureus
KTFASDWLTSLNMSSENMR

SEQ ID NO: 1648481 - protein, 24 aa, Staphylococcus aureus
KTHDLDAAYQCYIEQLGFQHVSDF

SEQ ID NO: 1648482 - protein, 19 aa, Staphylococcus aureus
KTIEGGVAFATQIVQEKYE

SEQ ID NO: 1648483 - protein, 20 aa, Staphylococcus aureus
KVKVIAWYDNEWGYSNRVVD

SEQ ID NO: 1648484 - protein, 26 aa, Staphylococcus aureus
KVPKLPYTLCYISRGFVVDYSNKEAL

SEQ ID NO: 1648485 - protein, 22 aa, Staphylococcus aureus
KVTALHLPQGFNVRVDSLLYHG

SEQ ID NO: 1648486 - protein, 23 aa, Staphylococcus aureus
KVTYQLLDKLGFGGNDLGSDALK

SEQ ID NO: 1648487 - protein, 25 aa, Staphylococcus aureus
KYGVGRRISLHYTRQMVNQAISGKL

SEQ ID NO: 1648488 - protein, 26 aa, Staphylococcus aureus
KYIKGPDFPTGGIIQGIDGIKKAYES

SEQ ID NO: 1648489 - protein, 25 aa, Staphylococcus aureus
KYLIEGSNFTTGWIFFINSVGEHEL

SEQ ID NO: 1648490 - protein, 17 aa, Staphylococcus aureus
LAIGSAYAFNIQGGTEM

SEQ ID NO: 1648491 - protein, 18 aa, Staphylococcus aureus
LAIVFGRTKRRVDELTSA

SEQ ID NO: 1648492 - protein, 20 aa, Staphylococcus aureus
LDAKSANIQFGFDRNTGNDV

SEQ ID NO: 1648493 - protein, 19 aa, Staphylococcus aureus
LDDLCNAYRGNTVINNTRQ

SEQ ID NO: 1648494 - protein, 17 aa, Staphylococcus aureus
LDGMKFGVAVMDSRFRM

SEQ ID NO: 1648495 - protein, 26 aa, Staphylococcus aureus
LDGSRRFLDRVWRLMVNEDGTLSSKI

SEQ ID NO: 1648496 - protein, 17 aa, Staphylococcus aureus
LDPGMAFGTGDHPTTSM

SEQ ID NO: 1648497 - protein, 21 aa, Staphylococcus aureus
LDRNPYQLIYDIKGIGFNKAD

SEQ ID NO: 1648498 - protein, 21 aa, Staphylococcus aureus
LDTASHFVLIFARKNVTSRSP

SEQ ID NO: 1648499 - protein, 34 aa, Staphylococcus aureus
LDTIFKNAGFEWREPGCSMCLGMNPDQVPEGVHC

SEQ ID NO: 1648500 - protein, 20 aa, Staphylococcus aureus
LDYRELYRNLPYIGTLKPEV

SEQ ID NO: 1648501 - protein, 22 aa, Staphylococcus aureus
LEARTKIQLLAPVIAHRKGSHE

SEQ ID NO: 1648502 - protein, 26 aa, Staphylococcus aureus
LEEVCGACSMVINGRARQSCSAIVDQ

SEQ ID NO: 1648503 - protein, 26 aa, Staphylococcus aureus
LEFYHPEFKKEYVILAEEGAQSDEDD

SEQ ID NO: 1648504 - protein, 18 aa, Staphylococcus aureus
LEGKTKAHHFCINECSIG

SEQ ID NO: 1648505 - protein, 24 aa, Staphylococcus aureus
LEKELKSIIGNGFAVIYLISQRLV

SEQ ID NO: 1648506 - protein, 19 aa, Staphylococcus aureus
LEKLGRYLMDSFVNIDGTD

SEQ ID NO: 1648507 - protein, 18 aa, Staphylococcus aureus
LELAKKVIISHRYESEDR

SEQ ID NO: 1648508 - protein, 17 aa, Staphylococcus aureus
LEMSKAGIINIEQQRNF

SEQ ID NO: 1648509 - protein, 28 aa, Staphylococcus aureus
LERAMSGNGRFGGHFVLGHVDELGTVSK

SEQ ID NO: 1648510 - protein, 17 aa, Staphylococcus aureus
LERAYKVNAKLIGVNNR

SEQ ID NO: 1648511 - protein, 17 aa, Staphylococcus aureus
LESELKEAYDLGIRAIM

SEQ ID NO: 1648512 - protein, 22 aa, Staphylococcus aureus
LETRPELSFPADMYLEGSDQYR

SEQ ID NO: 1648513 - protein, 18 aa, Staphylococcus aureus
LFLDEQFEMGIDIDTLVK

SEQ ID NO: 1648514 - protein, 24 aa, Staphylococcus aureus
LFNEARIAVTLIRGNHYFKASKTM

SEQ ID NO: 1648515 - protein, 20 aa, Staphylococcus aureus
LGEKQGKKLFVYGGAEHPHA

SEQ ID NO: 1648516 - protein, 26 aa, Staphylococcus aureus
LGIELGIPEHLVWRQPFPGPGLGIRV

SEQ ID NO: 1648517 - protein, 24 aa, Staphylococcus aureus
LGSLFEQASQLFLDSVVMGLMTEM

SEQ ID NO: 1648518 - protein, 18 aa, Staphylococcus aureus
LHDFCKYDDLGKMYQIVR

SEQ ID NO: 1648519 - protein, 23 aa, Staphylococcus aureus
LHLRRIKIADLELDSNLDSGEYR

SEQ ID NO: 1648520 - protein, 17 aa, Staphylococcus aureus
LIAKRHPVDVCFVPIGD

SEQ ID NO: 1648521 - protein, 26 aa, Staphylococcus aureus
LIALLRYGGGISYQLLDDHSNYISLY

SEQ ID NO: 1648522 - protein, 17 aa, Staphylococcus aureus
LIDEARTPLIISGEAEK

SEQ ID NO: 1648523 - protein, 26 aa, Staphylococcus aureus
LIKANIPTRIAFMVSSSVDSRTILDS

SEQ ID NO: 1648524 - protein, 19 aa, Staphylococcus aureus
LKAPIRMHRLLQGDVGSGK

SEQ ID NO: 1648525 - protein, 19 aa, Staphylococcus aureus
LKAYSYNREGVMNASVEFD

SEQ ID NO: 1648526 - protein, 17 aa, Staphylococcus aureus
LKEAGIVLTDFQKGNEK

SEQ ID NO: 1648527 - protein, 17 aa, Staphylococcus aureus
LKHKTLPAFSVQYHPEA

SEQ ID NO: 1648528 - protein, 20 aa, Staphylococcus aureus
LKLLKSVHLVKAKRQGQSMI

SEQ ID NO: 1648529 - protein, 24 aa, Staphylococcus aureus
LKNISFKVPQGFVTGFIGRNGAGK

SEQ ID NO: 1648530 - protein, 20 aa, Staphylococcus aureus
LKPHVKEVENAKCISIGVAT

SEQ ID NO: 1648531 - protein, 17 aa, Staphylococcus aureus
LKQTLKTMFIHMKETVH

SEQ ID NO: 1648532 - protein, 23 aa, Staphylococcus aureus
LKTKLWGGQRLSEFGYQLDNDTT

SEQ ID NO: 1648533 - protein, 17 aa, Staphylococcus aureus
LLEAGVHFGHQTRRWNP

SEQ ID NO: 1648534 - protein, 26 aa, Staphylococcus aureus
LMASGLPSYVYTFLGFLPRKEKEKSA

SEQ ID NO: 1648535 - protein, 19 aa, Staphylococcus aureus
LMHDWLKGKIIVDSLGLHS

SEQ ID NO: 1648536 - protein, 25 aa, Staphylococcus aureus
LMIRFGSERLQKMMSRLGLDDSTPI

SEQ ID NO: 1648537 - protein, 17 aa, Staphylococcus aureus
LNDLRSRVKLETDGKLL

SEQ ID NO: 1648538 - protein, 32 aa, Staphylococcus aureus
LNEDYCIPGPFDKRVAPSVARNVAKAAMESGV

SEQ ID NO: 1648539 - protein, 22 aa, Staphylococcus aureus
LNEFDKIIGVDRIKVVHVNDSK

SEQ ID NO: 1648540 - protein, 17 aa, Staphylococcus aureus
LNHFPKPTFEDIPLLDL

SEQ ID NO: 1648541 - protein, 17 aa, Staphylococcus aureus
LNNDIFRSGKFNTNFLE

SEQ ID NO: 1648542 - protein, 18 aa, Staphylococcus aureus
LNQEIIDYIDTLNYIDQY

SEQ ID NO: 1648543 - protein, 19 aa, Staphylococcus aureus
LNVYKQFFGDAVDMTEGAE

SEQ ID NO: 1648544 - protein, 23 aa, Staphylococcus aureus
LPKGRKPIITTWAKHEQYDKVLM

SEQ ID NO: 1648545 - protein, 17 aa, Staphylococcus aureus
LPKKEVVELKKEYDRLI

SEQ ID NO: 1648546 - protein, 18 aa, Staphylococcus aureus
LPLPDLIIVDGGKGHMNG

SEQ ID NO: 1648547 - protein, 19 aa, Staphylococcus aureus
LPRPFFILAPMEDVTDIVF

SEQ ID NO: 1648548 - protein, 25 aa, Staphylococcus aureus
LPTHGFAVRIFAYRTQIIEKILGTI

SEQ ID NO: 1648549 - protein, 17 aa, Staphylococcus aureus
LQDELMIRFGSERLQKM

SEQ ID NO: 1648550 - protein, 19 aa, Staphylococcus aureus
LQDLGLTKVNGGFIVTGGS

SEQ ID NO: 1648551 - protein, 17 aa, Staphylococcus aureus
LQILKLLFQNEDKYVSR

SEQ ID NO: 1648552 - protein, 23 aa, Staphylococcus aureus
LQKCETFYFSVAFITESGLASLK

SEQ ID NO: 1648553 - protein, 18 aa, Staphylococcus aureus
LQRQFAYTKEEIHKYIQE

SEQ ID NO: 1648554 - protein, 23 aa, Staphylococcus aureus
LRKRGIEGLVVIGGDGSYRGAQR

SEQ ID NO: 1648555 - protein, 20 aa, Staphylococcus aureus
LRNGESLFNQGLDLLQEIIW

SEQ ID NO: 1648556 - protein, 19 aa, Staphylococcus aureus
LRVPHGAGGIVLDVKVFNR

SEQ ID NO: 1648557 - protein, 17 aa, Staphylococcus aureus
LRYLYGMTERQFRNTFD

SEQ ID NO: 1648558 - protein, 18 aa, Staphylococcus aureus
LSAVPLDAQLIFVGDEDQ

SEQ ID NO: 1648559 - protein, 30 aa, Staphylococcus aureus
LSEKFGVNGIRISIAWSRIFPNGYGEVNPK

SEQ ID NO: 1648560 - protein, 18 aa, Staphylococcus aureus
LSKEMSIGVITNDIYTKE

SEQ ID NO: 1648561 - protein, 23 aa, Staphylococcus aureus
LSRKDNNYHFLLFNKINDRYMSD

SEQ ID NO: 1648562 - protein, 19 aa, Staphylococcus aureus
LSSVIGCRDDIMVYLMYAG

SEQ ID NO: 1648563 - protein, 24 aa, Staphylococcus aureus
LTDVEPYIGAFIYLYFKNQPRNVT

SEQ ID NO: 1648564 - protein, 18 aa, Staphylococcus aureus
LTPYFTKDFNNISLYFTA

SEQ ID NO: 1648565 - protein, 22 aa, Staphylococcus aureus
LVDERIPEINWVEGVKEALIDL

SEQ ID NO: 1648566 - protein, 23 aa, Staphylococcus aureus
LVMMGVLPLEFKKGESADSLGLD

SEQ ID NO: 1648567 - protein, 19 aa, Staphylococcus aureus
LVQAGRVFIALPPLYKLEK

SEQ ID NO: 1648568 - protein, 20 aa, Staphylococcus aureus
LVRHEFPKLQSIQLEDHKQH

SEQ ID NO: 1648569 - protein, 21 aa, Staphylococcus aureus
LWTGKYSSLFGKRAMTTFERY

SEQ ID NO: 1648570 - protein, 24 aa, Staphylococcus aureus
LYDTCKTLESIGCDLLVIRHPFNN

SEQ ID NO: 1648571 - protein, 23 aa, Staphylococcus aureus
LYLNPRASKFLDDYGTFDHTALV

SEQ ID NO: 1648572 - protein, 26 aa, Staphylococcus aureus
LYYSEIKSVQNLFRIKTHTNKLTEIE

SEQ ID NO: 1648573 - protein, 26 aa, Staphylococcus aureus
MACVSEAIHLLPYNVFFVPARGGLGE

SEQ ID NO: 1648574 - protein, 26 aa, Staphylococcus aureus
MAEPGEFTKRAFLNGRIDLSQAEAVM

SEQ ID NO: 1648575 - protein, 24 aa, Staphylococcus aureus
MAHNVKKGIIAWGDDEHLRKIEAD

SEQ ID NO: 1648576 - protein, 22 aa, Staphylococcus aureus
MAPFSIELCGGIHVRNTSEIGL

SEQ ID NO: 1648577 - protein, 18 aa, Staphylococcus aureus
MAQLAMRAIIGEKLTDMG

SEQ ID NO: 1648578 - protein, 20 aa, Staphylococcus aureus
MASDASRVFKGQKMPGRMGG

SEQ ID NO: 1648579 - protein, 18 aa, Staphylococcus aureus
MEHIERAGVHSGDSIAVY

SEQ ID NO: 1648580 - protein, 19 aa, Staphylococcus aureus
MISSLKIASDLERIGDNAS

SEQ ID NO: 1648581 - protein, 19 aa, Staphylococcus aureus
MKEACYAATPAIQLAKDYL

SEQ ID NO: 1648582 - protein, 22 aa, Staphylococcus aureus
MKEEPIKLLALITSNYRLFYQC

SEQ ID NO: 1648583 - protein, 25 aa, Staphylococcus aureus
MKLFSEPRFNVDVLKVEVPVNMKYV

SEQ ID NO: 1648584 - protein, 19 aa, Staphylococcus aureus
MKPEYFIPVQGEFKMQIAH

SEQ ID NO: 1648585 - protein, 25 aa, Staphylococcus aureus
MLCGCQGVNGGGWAHYVGQEKCRPI

SEQ ID NO: 1648586 - protein, 19 aa, Staphylococcus aureus
MPGLPKKPAALNMDVTDDG

SEQ ID NO: 1648587 - protein, 20 aa, Staphylococcus aureus
MPHRIFDFYNAFIGTSDFNP

SEQ ID NO: 1648588 - protein, 18 aa, Staphylococcus aureus
MQDSFYITDEILLRTHTS

SEQ ID NO: 1648589 - protein, 17 aa, Staphylococcus aureus
MQKGGVIMDVVNAEQAR

SEQ ID NO: 1648590 - protein, 17 aa, Staphylococcus aureus
MSTKNGRKVLARRRRKG

SEQ ID NO: 1648591 - protein, 19 aa, Staphylococcus aureus
MTVIEGNLFLKGKKPIVER

SEQ ID NO: 1648592 - protein, 17 aa, Staphylococcus aureus
NDPRGLFKVVINNENNM

SEQ ID NO: 1648593 - protein, 18 aa, Staphylococcus aureus
NEENFSYYDRFRNRIMFP

SEQ ID NO: 1648594 - protein, 17 aa, Staphylococcus aureus
NELKRPPVSNIDTLVIV

SEQ ID NO: 1648595 - protein, 39 aa, Staphylococcus aureus
NEVPDWYLDSCLKIKYMFPKAHAAAYVLMAVRIAYFKVH

SEQ ID NO: 1648596 - protein, 28 aa, Staphylococcus aureus
NFTFDERLRIALQLEKWGVDVIEAGFPA

SEQ ID NO: 1648597 - protein, 25 aa, Staphylococcus aureus
NFYYPKLTFRSSILELIKENKVTAK

SEQ ID NO: 1648598 - protein, 19 aa, Staphylococcus aureus
NGFAVIYLISQRLVKKSLD

SEQ ID NO: 1648599 - protein, 24 aa, Staphylococcus aureus
NGGPAGDLYVVFRVKPSETFKRDG

SEQ ID NO: 1648600 - protein, 19 aa, Staphylococcus aureus
NGSLIKAFRNCGFDIDKII

SEQ ID NO: 1648601 - protein, 23 aa, Staphylococcus aureus
NGYEKRYGLFYVDFETQERYPKK

SEQ ID NO: 1648602 - protein, 26 aa, Staphylococcus aureus
NHLSQFKAGVSVKVFIGGTDIEKDRQ

SEQ ID NO: 1648603 - protein, 18 aa, Staphylococcus aureus
NIAQFRYDHYLQLFNEIS

SEQ ID NO: 1648604 - protein, 21 aa, Staphylococcus aureus
NIVLVPKLLKWTKEEKDKRAK

SEQ ID NO: 1648605 - protein, 25 aa, Staphylococcus aureus
NIYFSQEGYSIWFEEFERDQLQRRY

SEQ ID NO: 1648606 - protein, 17 aa, Staphylococcus aureus
NKEFSRVKNGLEPTEVA

SEQ ID NO: 1648607 - protein, 22 aa, Staphylococcus aureus
NKEGYNLTFFAFFVKAVADALK

SEQ ID NO: 1648608 - protein, 21 aa, Staphylococcus aureus
NKERFNLFLDEQFEMGIDIDT

SEQ ID NO: 1648609 - protein, 20 aa, Staphylococcus aureus
NKHFRSYFCGQLDVPLTDTG

SEQ ID NO: 1648610 - protein, 29 aa, Staphylococcus aureus
NLEKHNALAFAHGFNIHFGVIQPPADVDV

SEQ ID NO: 1648611 - protein, 22 aa, Staphylococcus aureus
NLEYAPCDELSMGMSNDYLIAV

SEQ ID NO: 1648612 - protein, 23 aa, Staphylococcus aureus
NNEGLSSLLLNWSTYQDSIISTE

SEQ ID NO: 1648613 - protein, 33 aa, Staphylococcus aureus
NPEVRDAVFEMMNWWFDKGIDGFRVDAITHIKK

SEQ ID NO: 1648614 - protein, 24 aa, Staphylococcus aureus
NQLMYRSGDIVRLLPDGNIDYLYR

SEQ ID NO: 1648615 - protein, 23 aa, Staphylococcus aureus
NRTLRAEIFLKQQFERLQNEQIF

SEQ ID NO: 1648616 - protein, 20 aa, Staphylococcus aureus
NSLENLLFGLGIRHLGVKAS

SEQ ID NO: 1648617 - protein, 22 aa, Staphylococcus aureus
NTGHAYLAYAGKFAGKATVLDA

SEQ ID NO: 1648618 - protein, 20 aa, Staphylococcus aureus
NTGTPWLGPDVQDLTRDLYE

SEQ ID NO: 1648619 - protein, 17 aa, Staphylococcus aureus
NTIKPDLAIAVDVGIAY

SEQ ID NO: 1648620 - protein, 21 aa, Staphylococcus aureus
NTSRFYQYWLDHIDEDLAEAK

SEQ ID NO: 1648621 - protein, 17 aa, Staphylococcus aureus
NVINFKNTIIICTSNAG

SEQ ID NO: 1648622 - protein, 22 aa, Staphylococcus aureus
NYHLKNKFGQKIFKVALDGGFD

SEQ ID NO: 1648623 - protein, 20 aa, Staphylococcus aureus
PAFACSSPELLMMHTLAQTN

SEQ ID NO: 1648624 - protein, 17 aa, Staphylococcus aureus
PAKRIKVGNKLNFGNGK

SEQ ID NO: 1648625 - protein, 21 aa, Staphylococcus aureus
PAQGLFAKFGFHKVGEQLMEY

SEQ ID NO: 1648626 - protein, 20 aa, Staphylococcus aureus
PCNTKGLAISGGDVGGSKNF

SEQ ID NO: 1648627 - protein, 18 aa, Staphylococcus aureus
PDIVLLDLVMPGMNGIEI

SEQ ID NO: 1648628 - protein, 21 aa, Staphylococcus aureus
PEDHFVVIVSGAFGNRFKQIA

SEQ ID NO: 1648629 - protein, 17 aa, Staphylococcus aureus
PEGAAALLWKDSNLAKI

SEQ ID NO: 1648630 - protein, 17 aa, Staphylococcus aureus
PEKEFEYGRLLVGQHKR

SEQ ID NO: 1648631 - protein, 20 aa, Staphylococcus aureus
PEKRFNVSEEVYEIFQNTML

SEQ ID NO: 1648632 - protein, 17 aa, Staphylococcus aureus
PELIKQPAAAVLVNDDE

SEQ ID NO: 1648633 - protein, 22 aa, Staphylococcus aureus
PEQMVISTMMLRSMQQAHYDDV

SEQ ID NO: 1648634 - protein, 17 aa, Staphylococcus aureus
PGNRPLKSLSHMLKGKQ

SEQ ID NO: 1648635 - protein, 23 aa, Staphylococcus aureus
PHCGFGLGLERTVAWISGVEHVR

SEQ ID NO: 1648636 - protein, 18 aa, Staphylococcus aureus
PKCNQYLVENKKGKTTQV

SEQ ID NO: 1648637 - protein, 25 aa, Staphylococcus aureus
PKIKEMVPSFGYRLTDHEDLYHKIN

SEQ ID NO: 1648638 - protein, 20 aa, Staphylococcus aureus
PKMVELAPYNGLPHLVAPVI

SEQ ID NO: 1648639 - protein, 20 aa, Staphylococcus aureus
PKPTFEDIPLLDLALSDEKV

SEQ ID NO: 1648640 - protein, 18 aa, Staphylococcus aureus
PKVAHYLPKDYVYAPIQT

SEQ ID NO: 1648641 - protein, 19 aa, Staphylococcus aureus
PLLYTHFVKNGDWTLQQLV

SEQ ID NO: 1648642 - protein, 28 aa, Staphylococcus aureus
PLNVPRLVSHATKLLWLGIPDDAIIGAL

SEQ ID NO: 1648643 - protein, 24 aa, Staphylococcus aureus
PLRDRFGVHLRLEYYNESDLKEII

SEQ ID NO: 1648644 - protein, 36 aa, Staphylococcus aureus
PMIDTIKSLMAFLKQRHIPMAIATSSVKAEIMPTFK

SEQ ID NO: 1648645 - protein, 21 aa, Staphylococcus aureus
PNKDGKFPVVMSADTYGKDNK

SEQ ID NO: 1648646 - protein, 22 aa, Staphylococcus aureus
PPGKRMGHAGAIISGGKGTAEE

SEQ ID NO: 1648647 - protein, 24 aa, Staphylococcus aureus
PPKDRRAGVITFNLQDVHPHDVAT

SEQ ID NO: 1648648 - protein, 18 aa, Staphylococcus aureus
PQIEVTFDIDKNGIVNVT

SEQ ID NO: 1648649 - protein, 23 aa, Staphylococcus aureus
PRFFNQVTVPAFWEIKGNNNSAT

SEQ ID NO: 1648650 - protein, 25 aa, Staphylococcus aureus
PRNNGRFSPVVFKLASEHDIDLSQV

SEQ ID NO: 1648651 - protein, 19 aa, Staphylococcus aureus
PRRNQALVYYREVVKHHQL

SEQ ID NO: 1648652 - protein, 18 aa, Staphylococcus aureus
PSISEVLMELGLKAESRA

SEQ ID NO: 1648653 - protein, 35 aa, Staphylococcus aureus
PSKLKSIVGPFAYYIKGFEMLPQMKAVDLRIEYDG

SEQ ID NO: 1648654 - protein, 25 aa, Staphylococcus aureus
PTDEQWEAMLLGWKVVPSVKSNAII

SEQ ID NO: 1648655 - protein, 18 aa, Staphylococcus aureus
PTLNLAMEEYVLKNLPAE

SEQ ID NO: 1648656 - protein, 23 aa, Staphylococcus aureus
PTSVKALLKEAGYNDNIDEETIG

SEQ ID NO: 1648657 - protein, 18 aa, Staphylococcus aureus
PVLASGFIGGELGQFIAK

SEQ ID NO: 1648658 - protein, 30 aa, Staphylococcus aureus
PYKIAEHFRMMAALYPNRIDLGIGNNPGTT

SEQ ID NO: 1648659 - protein, 19 aa, Staphylococcus aureus
QAEAIVMLQLYRLTNTDIV

SEQ ID NO: 1648660 - protein, 19 aa, Staphylococcus aureus
QALIDRKVISIAYETVQLP

SEQ ID NO: 1648661 - protein, 18 aa, Staphylococcus aureus
QDALPNFELMRLDQMDQQ

SEQ ID NO: 1648662 - protein, 18 aa, Staphylococcus aureus
QDHLCEYEKIMSNNEKEA

SEQ ID NO: 1648663 - protein, 21 aa, Staphylococcus aureus
QDMYRRYKIGPKETLNTLQSL

SEQ ID NO: 1648664 - protein, 19 aa, Staphylococcus aureus
QEPPYTRLIDSARRQPEQT

SEQ ID NO: 1648665 - protein, 34 aa, Staphylococcus aureus
QEQVVLFLNRRGYASFMLCRDCGYVPQCPNCDIS

SEQ ID NO: 1648666 - protein, 19 aa, Staphylococcus aureus
QETGITIMYMVKKLDAGNI

SEQ ID NO: 1648667 - protein, 25 aa, Staphylococcus aureus
QEVKVHGDKALKMYNLTFDHTKTDH

SEQ ID NO: 1648668 - protein, 31 aa, Staphylococcus aureus
QGAGVIKYIRRMDMSNLHPKMETARIQVMSD

SEQ ID NO: 1648669 - protein, 26 aa, Staphylococcus aureus
QGDKGDSRFYLSLQDELMIRFGSERL

SEQ ID NO: 1648670 - protein, 29 aa, Staphylococcus aureus
QGKSLADFASLCFHVPFTKMGKKALESII

SEQ ID NO: 1648671 - protein, 18 aa, Staphylococcus aureus
QIIPHRQPFLLIDKVVEY

SEQ ID NO: 1648672 - protein, 19 aa, Staphylococcus aureus
QKMMSRLGLDDSTPIESKM

SEQ ID NO: 1648673 - protein, 18 aa, Staphylococcus aureus
QLDLTVFFDGNRSVSRDI

SEQ ID NO: 1648674 - protein, 19 aa, Staphylococcus aureus
QLKDHFTVVAVDRRDYGES

SEQ ID NO: 1648675 - protein, 23 aa, Staphylococcus aureus
QLMMLEPKFAILDEIDSGLDIDA

SEQ ID NO: 1648676 - protein, 24 aa, Staphylococcus aureus
QMKQADRLGAKFTIVIGDQELENN

SEQ ID NO: 1648677 - protein, 32 aa, Staphylococcus aureus
QMMLYELRNLFPEIIFLDAISLRTFENYTLDY

SEQ ID NO: 1648678 - protein, 25 aa, Staphylococcus aureus
QMYALYFKFVMPIFGKLFAKSKEEY

SEQ ID NO: 1648679 - protein, 19 aa, Staphylococcus aureus
QNVSLDWECFIISKSEMLL

SEQ ID NO: 1648680 - protein, 19 aa, Staphylococcus aureus
QQHHARLIYVSTISVGTYF

SEQ ID NO: 1648681 - protein, 23 aa, Staphylococcus aureus
QQKAQNLFARWRQLQNSNSESSN

SEQ ID NO: 1648682 - protein, 25 aa, Staphylococcus aureus
QRISIEVSDDAKAWLGQEAYEPQYG

SEQ ID NO: 1648683 - protein, 17 aa, Staphylococcus aureus
QTQVYGALGVIWRENIY

SEQ ID NO: 1648684 - protein, 23 aa, Staphylococcus aureus
QTRRWNPKMKKYIFTERNGIYII

SEQ ID NO: 1648685 - protein, 28 aa, Staphylococcus aureus
QYFKVERLKGIFAWGFRFNSDEPEEGLP

SEQ ID NO: 1648686 - protein, 24 aa, Staphylococcus aureus
QYRLYKLIWERFVASQMAPAILDT

SEQ ID NO: 1648687 - protein, 19 aa, Staphylococcus aureus
QYTMTLTFEEAVFGTTKEI

SEQ ID NO: 1648688 - protein, 20 aa, Staphylococcus aureus
RAKEGITDGLVRISVGIEDT

SEQ ID NO: 1648689 - protein, 24 aa, Staphylococcus aureus
RALFKQLAYVEGFEKYLHKNFVGA

SEQ ID NO: 1648690 - protein, 28 aa, Staphylococcus aureus
RAMKLIDEYDFLYGIIGWHPVDAIDFTE

SEQ ID NO: 1648691 - protein, 24 aa, Staphylococcus aureus
RCELIEARCQCLSEVELDNLNQLL

SEQ ID NO: 1648692 - protein, 23 aa, Staphylococcus aureus
RDELKAHSWGAAKQLDTASHFVL

SEQ ID NO: 1648693 - protein, 19 aa, Staphylococcus aureus
RDISCNLGSLNIVNVMESG

SEQ ID NO: 1648694 - protein, 25 aa, Staphylococcus aureus
RDLQAGETIGLFSYGSGSVGEFYSA

SEQ ID NO: 1648695 - protein, 19 aa, Staphylococcus aureus
RDNPKLKGKPVIVGGKASS

SEQ ID NO: 1648696 - protein, 21 aa, Staphylococcus aureus
REKKLGLDDMVNGSFTITNGG

SEQ ID NO: 1648697 - protein, 24 aa, Staphylococcus aureus
RELVLRINNLLTRMKKYHHQPVEQ

SEQ ID NO: 1648698 - protein, 24 aa, Staphylococcus aureus
REMVKSMKKGSVLIDIAIDQGGTI

SEQ ID NO: 1648699 - protein, 18 aa, Staphylococcus aureus
RFNINVGIVGDSKIALHQ

SEQ ID NO: 1648700 - protein, 21 aa, Staphylococcus aureus
RFSIEGVDALVPMLQRTITIA

SEQ ID NO: 1648701 - protein, 25 aa, Staphylococcus aureus
RGDTFFPPYTFEDWEVASSVEGKLD

SEQ ID NO: 1648702 - protein, 26 aa, Staphylococcus aureus
RGVSPYKFLLSHGFVMDGEGKKMSKS

SEQ ID NO: 1648703 - protein, 17 aa, Staphylococcus aureus
RHIEVINKMNVPIVIVG

SEQ ID NO: 1648704 - protein, 19 aa, Staphylococcus aureus
RHPVDVCFVPIGDNFTMGI

SEQ ID NO: 1648705 - protein, 20 aa, Staphylococcus aureus
RIDVGLPREVLVPWEDLPKV

SEQ ID NO: 1648706 - protein, 19 aa, Staphylococcus aureus
RIGDAGGKLHTGRSRNDQV

SEQ ID NO: 1648707 - protein, 18 aa, Staphylococcus aureus
RKVSGGLSSVAVRMPSHS

SEQ ID NO: 1648708 - protein, 18 aa, Staphylococcus aureus
RKYIALVHGNIPHDYGTI

SEQ ID NO: 1648709 - protein, 37 aa, Staphylococcus aureus
RLAEANLRLVVSIAKRYVGRGMLFLDLIQEGNMGLIK

SEQ ID NO: 1648710 - protein, 19 aa, Staphylococcus aureus
RLEDEIERYTKLSKEGKES

SEQ ID NO: 1648711 - protein, 32 aa, Staphylococcus aureus
RLGLPEARIPLSQAVIELCLSPKSNSAMSAID

SEQ ID NO: 1648712 - protein, 25 aa, Staphylococcus aureus
RLKDIADLFLDSGLGKEAYSIISQG

SEQ ID NO: 1648713 - protein, 19 aa, Staphylococcus aureus
RLMKASNIVNCSRINLASK

SEQ ID NO: 1648714 - protein, 18 aa, Staphylococcus aureus
RLNVILMVGVNGVGKTTT

SEQ ID NO: 1648715 - protein, 20 aa, Staphylococcus aureus
RLVEMVRPQLSSVIQPLYDI

SEQ ID NO: 1648716 - protein, 21 aa, Staphylococcus aureus
RMHAKGSGAFGTFTVTKDITK

SEQ ID NO: 1648717 - protein, 27 aa, Staphylococcus aureus
RNHWYQWLEHNLTLEGYDVTLFNFESP

SEQ ID NO: 1648718 - protein, 20 aa, Staphylococcus aureus
RPDLAILTMSGFLEARPRVG

SEQ ID NO: 1648719 - protein, 19 aa, Staphylococcus aureus
RPDLPASKIAQYIRKDILE

SEQ ID NO: 1648720 - protein, 17 aa, Staphylococcus aureus
RPERLMASINKFIKDDA

SEQ ID NO: 1648721 - protein, 20 aa, Staphylococcus aureus
RPFSFEGRKRQTQAAAGVEA

SEQ ID NO: 1648722 - protein, 22 aa, Staphylococcus aureus
RPKHIYSIYRKMMKQKKQFDQI

SEQ ID NO: 1648723 - protein, 25 aa, Staphylococcus aureus
RQQLQAFPMCVEFRHQSWFSDAFKE

SEQ ID NO: 1648724 - protein, 27 aa, Staphylococcus aureus
RRKVKRELYDGRGFLSCSRILGEGQRI

SEQ ID NO: 1648725 - protein, 17 aa, Staphylococcus aureus
RRLLDGQASTTGYFDNI

SEQ ID NO: 1648726 - protein, 24 aa, Staphylococcus aureus
RRQAKAVNFGIVYGISDYGLSQSL

SEQ ID NO: 1648727 - protein, 19 aa, Staphylococcus aureus
RSLLDEYREGLLVGTACDE

SEQ ID NO: 1648728 - protein, 19 aa, Staphylococcus aureus
RSRWKGIRPTVRGSVMNPN

SEQ ID NO: 1648729 - protein, 27 aa, Staphylococcus aureus
RTDHIRHLLEFKACTPIDIDQVEPVSD

SEQ ID NO: 1648730 - protein, 23 aa, Staphylococcus aureus
RTPRGRKATPLAYEHFAKSNEER

SEQ ID NO: 1648731 - protein, 17 aa, Staphylococcus aureus
RTTRWAKRCLDAHQRPE

SEQ ID NO: 1648732 - protein, 17 aa, Staphylococcus aureus
RVEFHLHTAMSQMDGIP

SEQ ID NO: 1648733 - protein, 25 aa, Staphylococcus aureus
RVHHPNEILECILIEAPDLKNAASD

SEQ ID NO: 1648734 - protein, 17 aa, Staphylococcus aureus
RVILMCPQGEPFSHQKA

SEQ ID NO: 1648735 - protein, 17 aa, Staphylococcus aureus
RVLELTMTYGARMAEPG

SEQ ID NO: 1648736 - protein, 24 aa, Staphylococcus aureus
RVNELYQLCDIYLDINEGNEILNA

SEQ ID NO: 1648737 - protein, 27 aa, Staphylococcus aureus
RVQDAYTLRCIPQIHGASFQVFNYVKQ

SEQ ID NO: 1648738 - protein, 17 aa, Staphylococcus aureus
SAGSLLMDCQFCNAIRP

SEQ ID NO: 1648739 - protein, 22 aa, Staphylococcus aureus
SAIKHFFEKLLKLESLMHTDTA

SEQ ID NO: 1648740 - protein, 31 aa, Staphylococcus aureus
SAKAWDNRYGCVLAIEILELLKDIELDVDLY

SEQ ID NO: 1648741 - protein, 19 aa, Staphylococcus aureus
SANEIGLDLNYSVEELIEL

SEQ ID NO: 1648742 - protein, 28 aa, Staphylococcus aureus
SDDYRYFPEPDIVPLYIDDAWKERVRQT

SEQ ID NO: 1648743 - protein, 18 aa, Staphylococcus aureus
SDFGLAFDGDGDRIIAVD

SEQ ID NO: 1648744 - protein, 24 aa, Staphylococcus aureus
SEDKRYLFEAVYGAGIIRMYELNT

SEQ ID NO: 1648745 - protein, 25 aa, Staphylococcus aureus
SEEMAELYNFLGLTVGLNLNSKTTE

SEQ ID NO: 1648746 - protein, 25 aa, Staphylococcus aureus
SEKDGRQAIQFLKERNLGRATFLPL

SEQ ID NO: 1648747 - protein, 19 aa, Staphylococcus aureus
SGAEHRKAQNYAEVQLRLD

SEQ ID NO: 1648748 - protein, 17 aa, Staphylococcus aureus
SGLPDFLVANLVEDYRM

SEQ ID NO: 1648749 - protein, 18 aa, Staphylococcus aureus
SHFHRAPGSVGMASDASR

SEQ ID NO: 1648750 - protein, 18 aa, Staphylococcus aureus
SIAKEANGFISIASEAVK

SEQ ID NO: 1648751 - protein, 17 aa, Staphylococcus aureus
SIASGVDIKEVFLKLPI

SEQ ID NO: 1648752 - protein, 24 aa, Staphylococcus aureus
SITRKIRQHGVLKAGFTDRKEDID

SEQ ID NO: 1648753 - protein, 19 aa, Staphylococcus aureus
SIVRFSRKMTHQGFQELKI

SEQ ID NO: 1648754 - protein, 25 aa, Staphylococcus aureus
SKGIYKFKYAILEAVRKVFDYKSIY

SEQ ID NO: 1648755 - protein, 19 aa, Staphylococcus aureus
SKLKLTPIVKKILESKSII

SEQ ID NO: 1648756 - protein, 17 aa, Staphylococcus aureus
SKNGIKFAQTVYDLNRK

SEQ ID NO: 1648757 - protein, 28 aa, Staphylococcus aureus
SKRIADVGCGYGPIGLMIAKVSPHHSIT

SEQ ID NO: 1648758 - protein, 19 aa, Staphylococcus aureus
SLFPCGSITGAPKLNTMKY

SEQ ID NO: 1648759 - protein, 18 aa, Staphylococcus aureus
SLGALRVKLAKELGLIDE

SEQ ID NO: 1648760 - protein, 18 aa, Staphylococcus aureus
SLGGRDAVVLGMSNGIPN

SEQ ID NO: 1648761 - protein, 17 aa, Staphylococcus aureus
SLIEMIDYFKALFPNGG

SEQ ID NO: 1648762 - protein, 17 aa, Staphylococcus aureus
SLIKYNFVTNNDKSINS

SEQ ID NO: 1648763 - protein, 26 aa, Staphylococcus aureus
SLNPPHLKAMIPWEGLNDMYREVAFH

SEQ ID NO: 1648764 - protein, 18 aa, Staphylococcus aureus
SNIYFLIEGNIIREHYNQ

SEQ ID NO: 1648765 - protein, 22 aa, Staphylococcus aureus
SQPLFEGIEWIIVSLGAQGAFA

SEQ ID NO: 1648766 - protein, 17 aa, Staphylococcus aureus
SRKTFAIISHPDAGKTT

SEQ ID NO: 1648767 - protein, 20 aa, Staphylococcus aureus
SRLFIPLTVGGGIQSLDDIT

SEQ ID NO: 1648768 - protein, 21 aa, Staphylococcus aureus
SRNINNIMVLFSLTSKLNITI

SEQ ID NO: 1648769 - protein, 26 aa, Staphylococcus aureus
STALGFAGGFPGKFIIDTLNNSAIQS

SEQ ID NO: 1648770 - protein, 27 aa, Staphylococcus aureus
STGMKMKLSLAVAFSHHAELYIFDEPT

SEQ ID NO: 1648771 - protein, 27 aa, Staphylococcus aureus
STHVIKRISMLEVMLPSAIKAKYKKAF

SEQ ID NO: 1648772 - protein, 20 aa, Staphylococcus aureus
STLHSFCLKLIQQHYDVLNI

SEQ ID NO: 1648773 - protein, 20 aa, Staphylococcus aureus
STPIFKEIIENVQADELPTE

SEQ ID NO: 1648774 - protein, 27 aa, Staphylococcus aureus
SVRSYNCLKRAGINSVQELADKSEADM

SEQ ID NO: 1648775 - protein, 26 aa, Staphylococcus aureus
SVSRDIFFEKALKVIRPVYLNQSTIP

SEQ ID NO: 1648776 - protein, 22 aa, Staphylococcus aureus
SYADIKYQLGLIGKNENEKLLK

SEQ ID NO: 1648777 - protein, 17 aa, Staphylococcus aureus
TAAGFLMDKEIKFIGGV

SEQ ID NO: 1648778 - protein, 24 aa, Staphylococcus aureus
TAMYISRLVKPIGIKVTRLAQGLS

SEQ ID NO: 1648779 - protein, 18 aa, Staphylococcus aureus
TAQRLAFHTLDMKEDDVV

SEQ ID NO: 1648780 - protein, 24 aa, Staphylococcus aureus
TAYQFTAGVLKNARGFTAVCNPLV

SEQ ID NO: 1648781 - protein, 20 aa, Staphylococcus aureus
TDEAIKVTLENGAVLESKTV

SEQ ID NO: 1648782 - protein, 18 aa, Staphylococcus aureus
TDLLFLYLEHAFLSQDFF

SEQ ID NO: 1648783 - protein, 20 aa, Staphylococcus aureus
TGLLPHEWHYHISPRGKADI

SEQ ID NO: 1648784 - protein, 17 aa, Staphylococcus aureus
TGLTISVDNAIWKVIDF

SEQ ID NO: 1648785 - protein, 18 aa, Staphylococcus aureus
TGTYALSDLVGLDIAVSV

SEQ ID NO: 1648786 - protein, 18 aa, Staphylococcus aureus
TIERAMKLIDEYDFLYGI

SEQ ID NO: 1648787 - protein, 17 aa, Staphylococcus aureus
TIFKASTSFNFDVLSER

SEQ ID NO: 1648788 - protein, 21 aa, Staphylococcus aureus
TIHTFLPLAHIVKVSDEELEF

SEQ ID NO: 1648789 - protein, 28 aa, Staphylococcus aureus
TKCSFEMAELKLGLKTISFETSTSSVSK

SEQ ID NO: 1648790 - protein, 17 aa, Staphylococcus aureus
TKMVSKFAIGAMELKDI

SEQ ID NO: 1648791 - protein, 18 aa, Staphylococcus aureus
TLFDSEKFEAIREILKEE

SEQ ID NO: 1648792 - protein, 19 aa, Staphylococcus aureus
TLNVPFAIADATSLTEAGY

SEQ ID NO: 1648793 - protein, 17 aa, Staphylococcus aureus
TMASITFQNYFRMYNKL

SEQ ID NO: 1648794 - protein, 24 aa, Staphylococcus aureus
TMLEQSSGHLINIASISGFEVTKS

SEQ ID NO: 1648795 - protein, 24 aa, Staphylococcus aureus
TQQIKIPVYFSALNMFRYESSQPI

SEQ ID NO: 1648796 - protein, 24 aa, Staphylococcus aureus
TRTYNNLVELEWIYKERPVDDERT

SEQ ID NO: 1648797 - protein, 26 aa, Staphylococcus aureus
TSKPMIRKGPNIKLPSVSLLEEPQVI

SEQ ID NO: 1648798 - protein, 24 aa, Staphylococcus aureus
TTAVCGLARCKKSDIDAVYEATKD

SEQ ID NO: 1648799 - protein, 23 aa, Staphylococcus aureus
TTFKTGYIYQEIILRPVDEVKVL

SEQ ID NO: 1648800 - protein, 17 aa, Staphylococcus aureus
TTLLRMINALEIPTEGT

SEQ ID NO: 1648801 - protein, 21 aa, Staphylococcus aureus
TTNGRLGFDYLIDNLADSAEG

SEQ ID NO: 1648802 - protein, 19 aa, Staphylococcus aureus
TVHTQGLLEICDRIIDQYD

SEQ ID NO: 1648803 - protein, 23 aa, Staphylococcus aureus
TVKRPYLIEYIDSFATPQGAKDT

SEQ ID NO: 1648804 - protein, 25 aa, Staphylococcus aureus
TVPCEISAVPVIHVDPFINQQSRQK

SEQ ID NO: 1648805 - protein, 17 aa, Staphylococcus aureus
TYFKMMQNFLKPNDVII

SEQ ID NO: 1648806 - protein, 17 aa, Staphylococcus aureus
TYLNALAGRGVHVITVN

SEQ ID NO: 1648807 - protein, 19 aa, Staphylococcus aureus
VALDGGFDCPNRDGTVAHG

SEQ ID NO: 1648808 - protein, 17 aa, Staphylococcus aureus
VALRLVIDRENEIRNFK

SEQ ID NO: 1648809 - protein, 25 aa, Staphylococcus aureus
VAMRFGDGIKAIFNYPSQETAEDKW

SEQ ID NO: 1648810 - protein, 20 aa, Staphylococcus aureus
VAVNWCPALGTVLSNEEVID

SEQ ID NO: 1648811 - protein, 21 aa, Staphylococcus aureus
VDEAVDRACYLLQTYANGKVL

SEQ ID NO: 1648812 - protein, 22 aa, Staphylococcus aureus
VDPAFRTGCKLAVINPFGTFIA

SEQ ID NO: 1648813 - protein, 33 aa, Staphylococcus aureus
VDPDVLRFFMISVHYRSPINYNLELVESARSGL

SEQ ID NO: 1648814 - protein, 20 aa, Staphylococcus aureus
VEDIRWLRCDIKSLNLLGNV

SEQ ID NO: 1648815 - protein, 19 aa, Staphylococcus aureus
VEEAEALKAHQEEQSVNVQ

SEQ ID NO: 1648816 - protein, 24 aa, Staphylococcus aureus
VEIADKLYKGKHLLNDVPSHTINY

SEQ ID NO: 1648817 - protein, 22 aa, Staphylococcus aureus
VEIAPGVQGLVHISEIAHKHIG

SEQ ID NO: 1648818 - protein, 17 aa, Staphylococcus aureus
VEIKAATIIDAEHVKKS

SEQ ID NO: 1648819 - protein, 19 aa, Staphylococcus aureus
VETESDFGLAFDGDGDRII

SEQ ID NO: 1648820 - protein, 19 aa, Staphylococcus aureus
VETIFDLALLTLLKGDLSI

SEQ ID NO: 1648821 - protein, 21 aa, Staphylococcus aureus
VETYVSDALRQVHLQSDIFAV

SEQ ID NO: 1648822 - protein, 27 aa, Staphylococcus aureus
VGCRIGCTFCASTLGGLKRNLEAGEIV

SEQ ID NO: 1648823 - protein, 17 aa, Staphylococcus aureus
VGITRSVIVNALRKLES

SEQ ID NO: 1648824 - protein, 20 aa, Staphylococcus aureus
VGSMAAVLGLDFDKVDEICK

SEQ ID NO: 1648825 - protein, 24 aa, Staphylococcus aureus
VGTKLKLAIDYGKHDSIGIDAVAM

SEQ ID NO: 1648826 - protein, 23 aa, Staphylococcus aureus
VHKLADIRWKELGQHVSQIVPIE

SEQ ID NO: 1648827 - protein, 18 aa, Staphylococcus aureus
VHQPELAIVFGRTKRRVD

SEQ ID NO: 1648828 - protein, 32 aa, Staphylococcus aureus
VHSRFSTNTFPSWKRAHPNRMLMHNGEINTIK

SEQ ID NO: 1648829 - protein, 19 aa, Staphylococcus aureus
VHSRGTGSWNLGEPPHEGT

SEQ ID NO: 1648830 - protein, 26 aa, Staphylococcus aureus
VILEYGESAPKIFRKVTELVKEQVKY

SEQ ID NO: 1648831 - protein, 19 aa, Staphylococcus aureus
VINIPVGYVANLKYQFDIN

SEQ ID NO: 1648832 - protein, 21 aa, Staphylococcus aureus
VKAGDLIKQMAPIVGGKGGGR

SEQ ID NO: 1648833 - protein, 17 aa, Staphylococcus aureus
VKGDGYVLALNVEALQD

SEQ ID NO: 1648834 - protein, 26 aa, Staphylococcus aureus
VKGYFIWSLMDVFSWSNGYEKRYGLF

SEQ ID NO: 1648835 - protein, 23 aa, Staphylococcus aureus
VKHKFSELHVFPYSPRIGTPAAR

SEQ ID NO: 1648836 - protein, 23 aa, Staphylococcus aureus
VKQKGADIARLWVSSTDYLADVR

SEQ ID NO: 1648837 - protein, 22 aa, Staphylococcus aureus
VKRGMAEMQKGGVIMDVVNAEQ

SEQ ID NO: 1648838 - protein, 18 aa, Staphylococcus aureus
VKTILVGYVIKFIRNKLS

SEQ ID NO: 1648839 - protein, 18 aa, Staphylococcus aureus
VKVAPEYQNIIGNLLGNT

SEQ ID NO: 1648840 - protein, 20 aa, Staphylococcus aureus
VLKYKKRKAESLNKLDQTED

SEQ ID NO: 1648841 - protein, 20 aa, Staphylococcus aureus
VLRLRFGLDDGRTRTLEEVG

SEQ ID NO: 1648842 - protein, 18 aa, Staphylococcus aureus
VLTDILPAIDNIERALQI

SEQ ID NO: 1648843 - protein, 24 aa, Staphylococcus aureus
VLTEFKEWVGDAIFVAHNASFDMG

SEQ ID NO: 1648844 - protein, 22 aa, Staphylococcus aureus
VNEVIKRLNYRPNAVARGLASK

SEQ ID NO: 1648845 - protein, 19 aa, Staphylococcus aureus
VNIVWSPPWTKDMMSRYAK

SEQ ID NO: 1648846 - protein, 21 aa, Staphylococcus aureus
VNKAAKFLLALYNVFIEKDCS

SEQ ID NO: 1648847 - protein, 25 aa, Staphylococcus aureus
VNPDEVVAMGAAIQGGVITGDVKDV

SEQ ID NO: 1648848 - protein, 20 aa, Staphylococcus aureus
VNPRSSRTVPFLSKITDIPM

SEQ ID NO: 1648849 - protein, 18 aa, Staphylococcus aureus
VNWGKTRIYNMVRDRGEW

SEQ ID NO: 1648850 - protein, 18 aa, Staphylococcus aureus
VPAGDGWDSNPFEPVVTE

SEQ ID NO: 1648851 - protein, 17 aa, Staphylococcus aureus
VPNKLTIKDIDKVFQSI

SEQ ID NO: 1648852 - protein, 17 aa, Staphylococcus aureus
VPQAGDRFVVFSDEKQA

SEQ ID NO: 1648853 - protein, 19 aa, Staphylococcus aureus
VPVTLEMGGKSPVIVDETA

SEQ ID NO: 1648854 - protein, 26 aa, Staphylococcus aureus
VQALNLKFYYGQEIRITDQILNDIDR

SEQ ID NO: 1648855 - protein, 23 aa, Staphylococcus aureus
VQGDLPLSVYHDMTFFIRHEDET

SEQ ID NO: 1648856 - protein, 19 aa, Staphylococcus aureus
VQILFQYLFSQGRLKDAKN

SEQ ID NO: 1648857 - protein, 25 aa, Staphylococcus aureus
VQTFKPELLSVLGRTHNTEDIYTSV

SEQ ID NO: 1648858 - protein, 19 aa, Staphylococcus aureus
VRIPEELLQFEGQTKSKLG

SEQ ID NO: 1648859 - protein, 20 aa, Staphylococcus aureus
VRNLLAMCYLYLGEYDTAKA

SEQ ID NO: 1648860 - protein, 22 aa, Staphylococcus aureus
VRSKGIVWLAQYNHVACLLSQA

SEQ ID NO: 1648861 - protein, 17 aa, Staphylococcus aureus
VRYLYDYNEQELIDLAQ

SEQ ID NO: 1648862 - protein, 19 aa, Staphylococcus aureus
VSIRFSVNQNVHFEVLLVK

SEQ ID NO: 1648863 - protein, 26 aa, Staphylococcus aureus
VSPILKCLILKGLVKKERCELDERRV

SEQ ID NO: 1648864 - protein, 20 aa, Staphylococcus aureus
VTAMVRWIREKEILEIQDIV

SEQ ID NO: 1648865 - protein, 24 aa, Staphylococcus aureus
VTSEPRIKIGTLESTNQWIANLIR

SEQ ID NO: 1648866 - protein, 26 aa, Staphylococcus aureus
VVSDDFKNHMLIAVTELRTKDEIDTF

SEQ ID NO: 1648867 - protein, 19 aa, Staphylococcus aureus
WEDKLPELAEHTSKRERRA

SEQ ID NO: 1648868 - protein, 30 aa, Staphylococcus aureus
WGFAHLQMAPKHWLCINEDDLVWATAAPGW

SEQ ID NO: 1648869 - protein, 25 aa, Staphylococcus aureus
WLKEMAHTFPGRIYLSVDAYGEDIK

SEQ ID NO: 1648870 - protein, 22 aa, Staphylococcus aureus
WLNQAPFSFDLSVMAIYPCLAS

SEQ ID NO: 1648871 - protein, 24 aa, Staphylococcus aureus
WLRCDIKSLNLLGNVLAKEYAVKY

SEQ ID NO: 1648872 - protein, 17 aa, Staphylococcus aureus
WLRDGLRMINSAPQSES

SEQ ID NO: 1648873 - protein, 19 aa, Staphylococcus aureus
WLSVLPIYHISGLSVLLRA

SEQ ID NO: 1648874 - protein, 36 aa, Staphylococcus aureus
WMSVVLRPNVAFSMISKFNLFIALGIRDAIQHFSQD

SEQ ID NO: 1648875 - protein, 20 aa, Staphylococcus aureus
WPVNREGAFVIHRLTGSKEY

SEQ ID NO: 1648876 - protein, 19 aa, Staphylococcus aureus
YEEMMEMSALGAGVLETRS

SEQ ID NO: 1648877 - protein, 17 aa, Staphylococcus aureus
YEISKRTVLFLIQKDIT

SEQ ID NO: 1648878 - protein, 17 aa, Staphylococcus aureus
YEKRLGPYTKIDIIEVP

SEQ ID NO: 1648879 - protein, 19 aa, Staphylococcus aureus
YEVNKSSLVKRIDELRADK

SEQ ID NO: 1648880 - protein, 25 aa, Staphylococcus aureus
YFAVYKWDIHGDLKFNKPHAYCLVT

SEQ ID NO: 1648881 - protein, 28 aa, Staphylococcus aureus
YGKFKGDLAEIVKAFLVEFQEKYESFYN

SEQ ID NO: 1648882 - protein, 31 aa, Staphylococcus aureus
YIATFIMPKFLKSFFNEHPFIDVSLHVKNEN

SEQ ID NO: 1648883 - protein, 17 aa, Staphylococcus aureus
YIDDAWKERVRQTIPEL

SEQ ID NO: 1648884 - protein, 18 aa, Staphylococcus aureus
YIEQLGFQHVSDFPRALF

SEQ ID NO: 1648885 - protein, 23 aa, Staphylococcus aureus
YIKKEPYGTVLIIAPFNYPFQLV

SEQ ID NO: 1648886 - protein, 27 aa, Staphylococcus aureus
YKDLVVSVRVGMEMDRSELLRKLVDVQ

SEQ ID NO: 1648887 - protein, 23 aa, Staphylococcus aureus
YLGKKYKVIASMGHVRDLPRSQM

SEQ ID NO: 1648888 - protein, 19 aa, Staphylococcus aureus
YLKEIGRVNLLSAQEEIEL

SEQ ID NO: 1648889 - protein, 26 aa, Staphylococcus aureus
YLKPALRLSSIMGLNATFIFTHDSIA

SEQ ID NO: 1648890 - protein, 17 aa, Staphylococcus aureus
YLNRGCTSAVVGYHPFG

SEQ ID NO: 1648891 - protein, 17 aa, Staphylococcus aureus
YNIICHYGEQAFFEKCR

SEQ ID NO: 1648892 - protein, 17 aa, Staphylococcus aureus
YNIPLYLGKTLSNVKGT

SEQ ID NO: 1648893 - protein, 29 aa, Staphylococcus aureus
YNKSIAQVILRWLVERDIVVLAKSVNPER

SEQ ID NO: 1648894 - protein, 36 aa, Staphylococcus aureus
YPFKELPLYEIGWRLLPEFWGKGLATEGAKATLKLA

SEQ ID NO: 1648895 - protein, 22 aa, Staphylococcus aureus
YPFPEEEIEALLAQLPNLEEVS

SEQ ID NO: 1648896 - protein, 26 aa, Staphylococcus aureus
YPMNWPIGMGQSFFGIIDRKSKTIEP

SEQ ID NO: 1648897 - protein, 25 aa, Staphylococcus aureus
YPSDSPGGWQIIGRTPLKVFSSERE

SEQ ID NO: 1648898 - protein, 23 aa, Staphylococcus aureus
YQFVLEPTYSFSIVTSATEEPDK

SEQ ID NO: 1648899 - protein, 24 aa, Staphylococcus aureus
YQNLTWDPPMVMFAANQSVLGDHE

SEQ ID NO: 1648900 - protein, 20 aa, Staphylococcus aureus
YRNLHLFKDLGIIENTELDG

SEQ ID NO: 1648901 - protein, 26 aa, Staphylococcus aureus
YRPKKVIDTLEIFKIAFPTDKSYQLS

SEQ ID NO: 1648902 - protein, 17 aa, Staphylococcus aureus
YTFHKIFSIITLSKELT

SEQ ID NO: 1648903 - protein, 17 aa, Staphylococcus aureus
YVDMAKLAEARQVDPNK

SEQ ID NO: 1648904 - protein, 18 aa, Staphylococcus aureus
YVVRPFIDKIKHFQETAN

SEQ ID NO: 1648905 - protein, 21 aa, Staphylococcus aureus
YYNTMIELIKPLGHITTIVAF

SEQ ID NO: 1648906 - protein, 17 aa, Staphylococcus aureus
AAKDLNDFLGINYYMSD

SEQ ID NO: 1648907 - protein, 27 aa, Staphylococcus aureus
AEDPFTCPHGRPIIINFSKYELEKLFK

SEQ ID NO: 1648908 - protein, 24 aa, Staphylococcus aureus
AENIKFFKSLCKNPINDTTINEYL

SEQ ID NO: 1648909 - protein, 18 aa, Staphylococcus aureus
AFELLKKQFIGEFISSLN

SEQ ID NO: 1648910 - protein, 30 aa, Staphylococcus aureus
AFTELFLFELRMQWLNRLEKSSDEAIEIDY

SEQ ID NO: 1648911 - protein, 18 aa, Staphylococcus aureus
AIEPPTFVVFVNDVELMH

SEQ ID NO: 1648912 - protein, 19 aa, Staphylococcus aureus
AILCGVCKHELTINEYMMV

SEQ ID NO: 1648913 - protein, 18 aa, Staphylococcus aureus
AKKTHTWLHTKDIPGSHV

SEQ ID NO: 1648914 - protein, 28 aa, Staphylococcus aureus
AKLNMGYRFPTQYGQSGYAAFVVFNMMF

SEQ ID NO: 1648915 - protein, 23 aa, Staphylococcus aureus
AKNGYYDGITFHRVINDFMIQGG

SEQ ID NO: 1648916 - protein, 24 aa, Staphylococcus aureus
ALRNPRMAETFTIARKMNPEGMIF

SEQ ID NO: 1648917 - protein, 25 aa, Staphylococcus aureus
AMMYRDEATWFALMNHLVDVSVKYV

SEQ ID NO: 1648918 - protein, 19 aa, Staphylococcus aureus
AMSPKDLKLIESIPQMMDI

SEQ ID NO: 1648919 - protein, 28 aa, Staphylococcus aureus
ARENYKLLIGSIIPRPIAFVTTLNQDAS

SEQ ID NO: 1648920 - protein, 25 aa, Staphylococcus aureus
ARPIKIGLAALVDRGHRELPIRADF

SEQ ID NO: 1648921 - protein, 18 aa, Staphylococcus aureus
ARTPLIISGEAEKSTSLY

SEQ ID NO: 1648922 - protein, 17 aa, Staphylococcus aureus
ARVPAGGALAVDRHDFS

SEQ ID NO: 1648923 - protein, 17 aa, Staphylococcus aureus
ASEGGMRDALSIMDQAI

SEQ ID NO: 1648924 - protein, 18 aa, Staphylococcus aureus
ASESAGWIKELESGGHAS

SEQ ID NO: 1648925 - protein, 22 aa, Staphylococcus aureus
ASKAGFYALMNALRLESPNLHI

SEQ ID NO: 1648926 - protein, 17 aa, Staphylococcus aureus
ASLETFGVDSNRLEIQI

SEQ ID NO: 1648927 - protein, 25 aa, Staphylococcus aureus
ATVSSLRLDVVIKEMIRKSRTIAKQ

SEQ ID NO: 1648928 - protein, 33 aa, Staphylococcus aureus
AVADALKAYPLLNSSWQGNEIVLHKDINISIAV

SEQ ID NO: 1648929 - protein, 23 aa, Staphylococcus aureus
AVGEAESSLSFIGELDNIDDKTY

SEQ ID NO: 1648930 - protein, 20 aa, Staphylococcus aureus
AYRELKMIVPTPHMVDDIQD

SEQ ID NO: 1648931 - protein, 18 aa, Staphylococcus aureus
CEVPKALEHLGFGALELG

SEQ ID NO: 1648932 - protein, 17 aa, Staphylococcus aureus
CHLAIGSAYAFNIQGGT

SEQ ID NO: 1648933 - protein, 26 aa, Staphylococcus aureus
CNISESYCSNLFVRYLSMNFKDYFTS

SEQ ID NO: 1648934 - protein, 17 aa, Staphylococcus aureus
CSEFKPYYLTKALQKLK

SEQ ID NO: 1648935 - protein, 32 aa, Staphylococcus aureus
DAVNRIVLKDGWLFRKMRIETMQKVLKYGTSK

SEQ ID NO: 1648936 - protein, 23 aa, Staphylococcus aureus
DDEIKPPFFIQWEESDSMRTKKL

SEQ ID NO: 1648937 - protein, 21 aa, Staphylococcus aureus
DDRFFRCHNSFVVNRHNIESI

SEQ ID NO: 1648938 - protein, 28 aa, Staphylococcus aureus
DEGLRTLLDFRYQRHFKASKGENGQSSN

SEQ ID NO: 1648939 - protein, 25 aa, Staphylococcus aureus
DENVLRKKLPMSLVHEAVGEVVFDS

SEQ ID NO: 1648940 - protein, 19 aa, Staphylococcus aureus
DGEMKFRIACTNHHHHHFI

SEQ ID NO: 1648941 - protein, 20 aa, Staphylococcus aureus
DGREGVLTYDVLDYIKEIIH

SEQ ID NO: 1648942 - protein, 20 aa, Staphylococcus aureus
DIEARIYPVGRLDYDTSGLL

SEQ ID NO: 1648943 - protein, 29 aa, Staphylococcus aureus
DITYRAVDVLKRVDMIACEDTRVTSKLCN

SEQ ID NO: 1648944 - protein, 17 aa, Staphylococcus aureus
DIYKVVMHFADKLCNKQ

SEQ ID NO: 1648945 - protein, 27 aa, Staphylococcus aureus
DKHGFISFTPVGGWWNQVMLSQKVTIT

SEQ ID NO: 1648946 - protein, 21 aa, Staphylococcus aureus
DLRGKELFNSLVAVVDKVKSE

SEQ ID NO: 1648947 - protein, 20 aa, Staphylococcus aureus
DLRLMLESFAFSRVKNQERL

SEQ ID NO: 1648948 - protein, 22 aa, Staphylococcus aureus
DNLILLGIKTRGEYLANRIQDK

SEQ ID NO: 1648949 - protein, 18 aa, Staphylococcus aureus
DNQDAVFFRSFSVDQRYR

SEQ ID NO: 1648950 - protein, 22 aa, Staphylococcus aureus
DPEYWKKLFKRYDDWINSFNAC

SEQ ID NO: 1648951 - protein, 27 aa, Staphylococcus aureus
DSKLTAKRKLSVFIYSVNDFTDFNARS

SEQ ID NO: 1648952 - protein, 26 aa, Staphylococcus aureus
DSNRGGCCQSCRWDYELLEVDDNGEL

SEQ ID NO: 1648953 - protein, 17 aa, Staphylococcus aureus
DTFTFDKVLFVGGDSVK

SEQ ID NO: 1648954 - protein, 21 aa, Staphylococcus aureus
DTIKQGLYFKPEVHLNERVVD

SEQ ID NO: 1648955 - protein, 27 aa, Staphylococcus aureus
DVFIPLKPLRQLEIISGEYNDVINEKV

SEQ ID NO: 1648956 - protein, 18 aa, Staphylococcus aureus
DVQTICIGMAASMGSFLL

SEQ ID NO: 1648957 - protein, 25 aa, Staphylococcus aureus
DYFKQEAIEFAWEFLTSDKWMGMEP

SEQ ID NO: 1648958 - protein, 32 aa, Staphylococcus aureus
EAGAKFNGVLCGRATWSGAVQVYIEQGEDAAR

SEQ ID NO: 1648959 - protein, 19 aa, Staphylococcus aureus
EALYARVGHILIEISTDGP

SEQ ID NO: 1648960 - protein, 25 aa, Staphylococcus aureus
ECYFKNMLGLKCELQSIDAFNFIQQ

SEQ ID NO: 1648961 - protein, 24 aa, Staphylococcus aureus
EDAAREWLRTTGFKNIDDLNKVLK

SEQ ID NO: 1648962 - protein, 22 aa, Staphylococcus aureus
EDFDMMSQFYLNKMAYIDHHPI

SEQ ID NO: 1648963 - protein, 19 aa, Staphylococcus aureus
EDRVMRPLHFAIIDEVDSI

SEQ ID NO: 1648964 - protein, 21 aa, Staphylococcus aureus
EEAKCPNIHECWGARRTATFM

SEQ ID NO: 1648965 - protein, 19 aa, Staphylococcus aureus
EEKERLLPGGYLFLSDLVG

SEQ ID NO: 1648966 - protein, 17 aa, Staphylococcus aureus
EELKMMINIMKPEYFIP

SEQ ID NO: 1648967 - protein, 17 aa, Staphylococcus aureus
EEMRRLNSIIIEAADKA

SEQ ID NO: 1648968 - protein, 18 aa, Staphylococcus aureus
EESLFPHIRAIKSEDDHE

SEQ ID NO: 1648969 - protein, 20 aa, Staphylococcus aureus
EGRLPDAIVACIGGGSNAIG

SEQ ID NO: 1648970 - protein, 23 aa, Staphylococcus aureus
EHISKAIATIGHFDLLTINDAGM

SEQ ID NO: 1648971 - protein, 21 aa, Staphylococcus aureus
EHYDLPILGKHNMKNATIAIA

SEQ ID NO: 1648972 - protein, 24 aa, Staphylococcus aureus
EINTIKGNVNWMRARQHKLIETLF

SEQ ID NO: 1648973 - protein, 24 aa, Staphylococcus aureus
EIQNRIIPRILKRTNLIGQSQTGT

SEQ ID NO: 1648974 - protein, 19 aa, Staphylococcus aureus
EIYCCLLNGHTLVIPDREE

SEQ ID NO: 1648975 - protein, 22 aa, Staphylococcus aureus
EKAMKVLKARLYDMKVQEEQQK

SEQ ID NO: 1648976 - protein, 38 aa, Staphylococcus aureus
EKEKYFEGCMPFEVMAERGRKTLLFGPMKPVGLEDPKT

SEQ ID NO: 1648977 - protein, 23 aa, Staphylococcus aureus
EKGPEVPRGLPVIPEAYTPKLKR

SEQ ID NO: 1648978 - protein, 24 aa, Staphylococcus aureus
EKYIPYCIEPSLGADRVTLAFLCD

SEQ ID NO: 1648979 - protein, 18 aa, Staphylococcus aureus
ELAHLIKGLNCHVNLIPV

SEQ ID NO: 1648980 - protein, 22 aa, Staphylococcus aureus
ELEIQFSDGLTVLSGETGSGKS

SEQ ID NO: 1648981 - protein, 33 aa, Staphylococcus aureus
ELHNLFKAITLKGPCYLHYYLQGYDEPMYTRQQ

SEQ ID NO: 1648982 - protein, 26 aa, Staphylococcus aureus
ELNPTPKWSIARYKGLGEMNADQLWE

SEQ ID NO: 1648983 - protein, 25 aa, Staphylococcus aureus
ENEEKYLRLYAEFENYKRRIQKENE

SEQ ID NO: 1648984 - protein, 18 aa, Staphylococcus aureus
ENMLKEAADELGLSYEEA

SEQ ID NO: 1648985 - protein, 17 aa, Staphylococcus aureus
EPDYLFEEKELLKKTQT

SEQ ID NO: 1648986 - protein, 20 aa, Staphylococcus aureus
EPTTYLDICHQLEILELVQK

SEQ ID NO: 1648987 - protein, 18 aa, Staphylococcus aureus
EQMPNYYDNFAIWSTQTN

SEQ ID NO: 1648988 - protein, 28 aa, Staphylococcus aureus
EQQRVALIRMMLKDPIVMLADEPTGALD

SEQ ID NO: 1648989 - protein, 24 aa, Staphylococcus aureus
ERGWLKRRIETPYKVTLNNNEKRA

SEQ ID NO: 1648990 - protein, 25 aa, Staphylococcus aureus
ESDYFAFEACEYRRHFLSYKPDYAI

SEQ ID NO: 1648991 - protein, 17 aa, Staphylococcus aureus
ESRMNLLNNLKRKYGKD

SEQ ID NO: 1648992 - protein, 30 aa, Staphylococcus aureus
ESTVLDCTSFPYKIARPGSITAAMITEILP

SEQ ID NO: 1648993 - protein, 23 aa, Staphylococcus aureus
EVEGADLPKVFHYFKEAHPYFDQ

SEQ ID NO: 1648994 - protein, 23 aa, Staphylococcus aureus
EVIDKFKAVYQIFSDVLGVPLKS

SEQ ID NO: 1648995 - protein, 22 aa, Staphylococcus aureus
FAKSGKMPWPMYHNERRYYRTY

SEQ ID NO: 1648996 - protein, 17 aa, Staphylococcus aureus
FDLSVMAIYPCLASGGT

SEQ ID NO: 1648997 - protein, 30 aa, Staphylococcus aureus
FDVEMPIVMPRLRITYLNDRIEKLLSKYNI

SEQ ID NO: 1648998 - protein, 18 aa, Staphylococcus aureus
FEALGVPAGQVYPIAYEK

SEQ ID NO: 1648999 - protein, 18 aa, Staphylococcus aureus
FETFLGFKGDKVPDIDLN

SEQ ID NO: 1649000 - protein, 21 aa, Staphylococcus aureus
FGKLRKVAMDKGFKHCQAGPL

SEQ ID NO: 1649001 - protein, 17 aa, Staphylococcus aureus
FGRVQGVGFRYFTQRIA

SEQ ID NO: 1649002 - protein, 20 aa, Staphylococcus aureus
FKDQHVITFSLEIVNERYLR

SEQ ID NO: 1649003 - protein, 17 aa, Staphylococcus aureus
FKHPKFYQQLFKLLEDM

SEQ ID NO: 1649004 - protein, 19 aa, Staphylococcus aureus
FKNATLLSETSTIYELITN

SEQ ID NO: 1649005 - protein, 20 aa, Staphylococcus aureus
FKVTIWYTAPTALRMLMSAG

SEQ ID NO: 1649006 - protein, 25 aa, Staphylococcus aureus
FLDEKGRRVLIGWMGLPEIEYPTDN

SEQ ID NO: 1649007 - protein, 27 aa, Staphylococcus aureus
FNLTKGRLQKDLINWFIDDQYKLFYKK

SEQ ID NO: 1649008 - protein, 27 aa, Staphylococcus aureus
FNQGEVCSAGSRLLVHEKIYDQLVPRL

SEQ ID NO: 1649009 - protein, 26 aa, Staphylococcus aureus
FNVDELRARIRVIERIAKSHQETNIV

SEQ ID NO: 1649010 - protein, 17 aa, Staphylococcus aureus
FQIKLNGYRMELEEIET

SEQ ID NO: 1649011 - protein, 22 aa, Staphylococcus aureus
FRFNAVSGGDAFYAIKTPTMTS

SEQ ID NO: 1649012 - protein, 17 aa, Staphylococcus aureus
FSDLEIGLGEWITITGA

SEQ ID NO: 1649013 - protein, 22 aa, Staphylococcus aureus
FSKDERLTHIALKLFETTDPVS

SEQ ID NO: 1649014 - protein, 18 aa, Staphylococcus aureus
FSRTGKKGGPFIDSLNHR

SEQ ID NO: 1649015 - protein, 19 aa, Staphylococcus aureus
FTGDIKTPVKYASSELKKL

SEQ ID NO: 1649016 - protein, 20 aa, Staphylococcus aureus
FTKAEFEGLIDFAITLKEYK

SEQ ID NO: 1649017 - protein, 24 aa, Staphylococcus aureus
FVCGKAEEVILQWKAQGIKPDVVM

SEQ ID NO: 1649018 - protein, 25 aa, Staphylococcus aureus
FYHFKYPYADGEGFIEIATTRPETM

SEQ ID NO: 1649019 - protein, 20 aa, Staphylococcus aureus
GAGDSFCAAVVYSWLNGMST

SEQ ID NO: 1649020 - protein, 22 aa, Staphylococcus aureus
GCTHYPLLYKPIYDYFGGKKTV

SEQ ID NO: 1649021 - protein, 18 aa, Staphylococcus aureus
GEEIMLLRHMILSHHGKL

SEQ ID NO: 1649022 - protein, 22 aa, Staphylococcus aureus
GENIIELMIPVFYFYQQDDDFF

SEQ ID NO: 1649023 - protein, 24 aa, Staphylococcus aureus
GESGCGKSILSKSIIKLLPEKISK

SEQ ID NO: 1649024 - protein, 21 aa, Staphylococcus aureus
GFHDLKINISKYVPKASSIYN

SEQ ID NO: 1649025 - protein, 24 aa, Staphylococcus aureus
GFLEARPRVGYYYSGKSKGKFFNE

SEQ ID NO: 1649026 - protein, 17 aa, Staphylococcus aureus
GGGLPIGGYGGRQDIME

SEQ ID NO: 1649027 - protein, 23 aa, Staphylococcus aureus
GGPHKAVCGFSKHNYALYQDDLP

SEQ ID NO: 1649028 - protein, 18 aa, Staphylococcus aureus
GIGRLTGKPGVVLVTSGP

SEQ ID NO: 1649029 - protein, 24 aa, Staphylococcus aureus
GIIKEALHKLGFDEGMYDLIKEPL

SEQ ID NO: 1649030 - protein, 27 aa, Staphylococcus aureus
GIPVYLGMPMGIVFEVEGKTIYHTGDT

SEQ ID NO: 1649031 - protein, 22 aa, Staphylococcus aureus
GKTTTFRMILGLSEPTEGHITY

SEQ ID NO: 1649032 - protein, 19 aa, Staphylococcus aureus
GKVTGIKKFGAFVELPEGK

SEQ ID NO: 1649033 - protein, 24 aa, Staphylococcus aureus
GLEKTGKQYVYFNGQLEQFKSNFY

SEQ ID NO: 1649034 - protein, 19 aa, Staphylococcus aureus
GLEVFRVLYHKYPDESELL

SEQ ID NO: 1649035 - protein, 22 aa, Staphylococcus aureus
GLFRYIQMFIISNGVETRYFSN

SEQ ID NO: 1649036 - protein, 24 aa, Staphylococcus aureus
GLKTDVMLAAYGYHMMDVQIVNEV

SEQ ID NO: 1649037 - protein, 23 aa, Staphylococcus aureus
GNIGRGFIGYILADNNVKVTFAD

SEQ ID NO: 1649038 - protein, 18 aa, Staphylococcus aureus
GNSLRRILLSSLPGAAVK

SEQ ID NO: 1649039 - protein, 18 aa, Staphylococcus aureus
GNYEYCFFESEGRGQFKP

SEQ ID NO: 1649040 - protein, 20 aa, Staphylococcus aureus
GPFETIGIAGFFGLPIQKDA

SEQ ID NO: 1649041 - protein, 18 aa, Staphylococcus aureus
GRIGRVVADIFANGYQSD

SEQ ID NO: 1649042 - protein, 21 aa, Staphylococcus aureus
GRNGIKATFKGLGTGPTIALR

SEQ ID NO: 1649043 - protein, 23 aa, Staphylococcus aureus
GRQCVAFFTLHRGKGVAPFSDNQ

SEQ ID NO: 1649044 - protein, 18 aa, Staphylococcus aureus
GSDQYRGWFNSSITTSVA

SEQ ID NO: 1649045 - protein, 24 aa, Staphylococcus aureus
GSGKTVVAAICMYALKTAGYQSAL

SEQ ID NO: 1649046 - protein, 20 aa, Staphylococcus aureus
GVGIGVPGPVDFEKGTVNGA

SEQ ID NO: 1649047 - protein, 24 aa, Staphylococcus aureus
HATDNWKTRLRMLNHFPKPTFEDI

SEQ ID NO: 1649048 - protein, 18 aa, Staphylococcus aureus
HDDLGMAVSNSLAAIEGG

SEQ ID NO: 1649049 - protein, 17 aa, Staphylococcus aureus
HDLPYCLHIGGQPIIHS

SEQ ID NO: 1649050 - protein, 26 aa, Staphylococcus aureus
HGNELPISAGFFFINPFEVVYYAGGT

SEQ ID NO: 1649051 - protein, 19 aa, Staphylococcus aureus
HKGLHMLTFEGINNINDIE

SEQ ID NO: 1649052 - protein, 28 aa, Staphylococcus aureus
HLKWPDDVEFVYTPYLLKCVTSEQTYTN

SEQ ID NO: 1649053 - protein, 17 aa, Staphylococcus aureus
HMNEWMASSQLMITKPG

SEQ ID NO: 1649054 - protein, 23 aa, Staphylococcus aureus
HNPANLMGIRAFRKLLPNIPHVA

SEQ ID NO: 1649055 - protein, 18 aa, Staphylococcus aureus
HRELPIRADFVGKNIPTS

SEQ ID NO: 1649056 - protein, 18 aa, Staphylococcus aureus
HSQFPYKNIEWLIKEGYG

SEQ ID NO: 1649057 - protein, 23 aa, Staphylococcus aureus
HVSDFPRALFMSTNHYHHHIAAN

SEQ ID NO: 1649058 - protein, 18 aa, Staphylococcus aureus
HYKHLFALLELAKKQGVE

SEQ ID NO: 1649059 - protein, 18 aa, Staphylococcus aureus
HYVMVSTYDSRRQAFDDS

SEQ ID NO: 1649060 - protein, 21 aa, Staphylococcus aureus
IAFELLAYALQYAFDNFDIRK

SEQ ID NO: 1649061 - protein, 23 aa, Staphylococcus aureus
IARALALRPSLIVADEPVSALDV

SEQ ID NO: 1649062 - protein, 21 aa, Staphylococcus aureus
IATGRPYRASQMYYHELNLTT

SEQ ID NO: 1649063 - protein, 19 aa, Staphylococcus aureus
IATSPIHLEHKLKMSQEDV

SEQ ID NO: 1649064 - protein, 30 aa, Staphylococcus aureus
ICASCVNAPTSKDIYDWLQPLLKRKYPNIS

SEQ ID NO: 1649065 - protein, 31 aa, Staphylococcus aureus
IDCMPKSEWLKRADIYIDGFHNFSTIEYLII

SEQ ID NO: 1649066 - protein, 17 aa, Staphylococcus aureus
IDEYVASIVSYIIEYTT

SEQ ID NO: 1649067 - protein, 31 aa, Staphylococcus aureus
IDKRISNPYLRQMLGYFIKYVGSSSYDAPAV

SEQ ID NO: 1649068 - protein, 19 aa, Staphylococcus aureus
IDQMRRLNQEIIDYIDTLN

SEQ ID NO: 1649069 - protein, 21 aa, Staphylococcus aureus
IEEFKKIILKTIFGETEVEEY

SEQ ID NO: 1649070 - protein, 24 aa, Staphylococcus aureus
IFFKMQKFNPEYVKLAVMPHNKND

SEQ ID NO: 1649071 - protein, 17 aa, Staphylococcus aureus
IHTSYGAIVYTGEFKFD

SEQ ID NO: 1649072 - protein, 17 aa, Staphylococcus aureus
IIETCKEVAPKLEIHLS

SEQ ID NO: 1649073 - protein, 18 aa, Staphylococcus aureus
IIGHTGWYDYSFAAQRFS

SEQ ID NO: 1649074 - protein, 24 aa, Staphylococcus aureus
IKDLKVAVIGTGRIGRVVADIFAN

SEQ ID NO: 1649075 - protein, 23 aa, Staphylococcus aureus
IKKLRLTNIKAFQHDATKPYDKT

SEQ ID NO: 1649076 - protein, 35 aa, Staphylococcus aureus
IKRQKAIEIANAMLKEGYLEKDVVPIAAKKAKDWY

SEQ ID NO: 1649077 - protein, 19 aa, Staphylococcus aureus
IKTPVKYASSELKKLFSQV

SEQ ID NO: 1649078 - protein, 24 aa, Staphylococcus aureus
IKYFSSHVDYRLKGIAFELLAYAL

SEQ ID NO: 1649079 - protein, 18 aa, Staphylococcus aureus
IMAGIPIDYIKQQLECQN

SEQ ID NO: 1649080 - protein, 18 aa, Staphylococcus aureus
IMTEIPFAFFKQHVTDFD

SEQ ID NO: 1649081 - protein, 25 aa, Staphylococcus aureus
INVIKWVHQFIESFGGDANNITLMG

SEQ ID NO: 1649082 - protein, 24 aa, Staphylococcus aureus
INVKEIRLSPTIEEHDFQTKLKNG

SEQ ID NO: 1649083 - protein, 25 aa, Staphylococcus aureus
IPAISWLEDFLINFDNTVIVVSHDR

SEQ ID NO: 1649084 - protein, 18 aa, Staphylococcus aureus
IPSKRVIREGDLVNIDVS

SEQ ID NO: 1649085 - protein, 24 aa, Staphylococcus aureus
IQSEDGVDIVIHIGVNTVDLEGKG

SEQ ID NO: 1649086 - protein, 19 aa, Staphylococcus aureus
IRATAYWAIGQILGEEARD

SEQ ID NO: 1649087 - protein, 19 aa, Staphylococcus aureus
IRVDIAGSVESIYDITKDD

SEQ ID NO: 1649088 - protein, 17 aa, Staphylococcus aureus
ISISYVIDDFNGQQAVE

SEQ ID NO: 1649089 - protein, 22 aa, Staphylococcus aureus
ISRQRVWGVPLPVFYAENGEII

SEQ ID NO: 1649090 - protein, 18 aa, Staphylococcus aureus
ISSIGVDVSKVYRTNEAN

SEQ ID NO: 1649091 - protein, 21 aa, Staphylococcus aureus
ISSKEIAKCSEFKPYYLTKAL

SEQ ID NO: 1649092 - protein, 19 aa, Staphylococcus aureus
IYCDNRVTLGYPLVRGAIR

SEQ ID NO: 1649093 - protein, 26 aa, Staphylococcus aureus
IYEYFNDALRAYGLTVKTGEFGTHMN

SEQ ID NO: 1649094 - protein, 22 aa, Staphylococcus aureus
IYNCKTPIISAVGHETDFTLSD

SEQ ID NO: 1649095 - protein, 26 aa, Staphylococcus aureus
KALLHETFKAYGVLFIDAQFEPLRKM

SEQ ID NO: 1649096 - protein, 24 aa, Staphylococcus aureus
KAMLNEGYQFFGVLYIGAILTKDG

SEQ ID NO: 1649097 - protein, 24 aa, Staphylococcus aureus
KASWPEVRESLIFEESKQTMQQLV

SEQ ID NO: 1649098 - protein, 27 aa, Staphylococcus aureus
KDKVIQIWPEFDIDGAVELQYTFRLIQ

SEQ ID NO: 1649099 - protein, 19 aa, Staphylococcus aureus
KEANIKHYVMVSTYDSRRQ

SEQ ID NO: 1649100 - protein, 18 aa, Staphylococcus aureus
KEARRMLDEAGFTETKII

SEQ ID NO: 1649101 - protein, 26 aa, Staphylococcus aureus
KEDLLRARRTYAFTELFLFELRMQWL

SEQ ID NO: 1649102 - protein, 18 aa, Staphylococcus aureus
KEIIKKVRGGNHVTSQNP

SEQ ID NO: 1649103 - protein, 24 aa, Staphylococcus aureus
KEIKFKAFLDHAMNLGADYVATGH

SEQ ID NO: 1649104 - protein, 22 aa, Staphylococcus aureus
KELAENLNVCFNCDHHIALTAY

SEQ ID NO: 1649105 - protein, 21 aa, Staphylococcus aureus
KESFIEYLLFQYRFKSRIAVW

SEQ ID NO: 1649106 - protein, 17 aa, Staphylococcus aureus
KESILSVILPQYVESLI

SEQ ID NO: 1649107 - protein, 17 aa, Staphylococcus aureus
KETEGIVEVSIKEEKEH

SEQ ID NO: 1649108 - protein, 27 aa, Staphylococcus aureus
KFYQQLFKLLEDMRVLNSIKVERPSTA

SEQ ID NO: 1649109 - protein, 19 aa, Staphylococcus aureus
KFYTGILKDREVVITQSGI

SEQ ID NO: 1649110 - protein, 22 aa, Staphylococcus aureus
KGHELYEIVCLDVQKLQQAVVA

SEQ ID NO: 1649111 - protein, 18 aa, Staphylococcus aureus
KGNITRFVAENDALTENL

SEQ ID NO: 1649112 - protein, 18 aa, Staphylococcus aureus
KGRHDLRDELTITIDGAD

SEQ ID NO: 1649113 - protein, 19 aa, Staphylococcus aureus
KGVVPFLKVDKGLAEEQNG

SEQ ID NO: 1649114 - protein, 20 aa, Staphylococcus aureus
KHEIRYALENNIGYFVIDSL

SEQ ID NO: 1649115 - protein, 19 aa, Staphylococcus aureus
KHVVISLGGIDSFDAGAGM

SEQ ID NO: 1649116 - protein, 19 aa, Staphylococcus aureus
KIADVCIASLIKEGVGLGV

SEQ ID NO: 1649117 - protein, 18 aa, Staphylococcus aureus
KIEGRMKSIHYIATVVSV

SEQ ID NO: 1649118 - protein, 19 aa, Staphylococcus aureus
KKALFIVYANPLALGLLTP

SEQ ID NO: 1649119 - protein, 22 aa, Staphylococcus aureus
KKDFRRLGVRGDFNDPYITLKP

SEQ ID NO: 1649120 - protein, 23 aa, Staphylococcus aureus
KKFNLNYEEIYILNHILRSESNE

SEQ ID NO: 1649121 - protein, 19 aa, Staphylococcus aureus
KKLRKSRQQYQMIFQDPYA

SEQ ID NO: 1649122 - protein, 17 aa, Staphylococcus aureus
KKVDNFYGLSSKNDKYV

SEQ ID NO: 1649123 - protein, 18 aa, Staphylococcus aureus
KLDAYKGDVMLIVNTASE

SEQ ID NO: 1649124 - protein, 19 aa, Staphylococcus aureus
KLYQAYRYTEKMKTRIDSL

SEQ ID NO: 1649125 - protein, 19 aa, Staphylococcus aureus
KPPVARIMDYGKFKFEQQK

SEQ ID NO: 1649126 - protein, 19 aa, Staphylococcus aureus
KPSADMLFEPSFVNDIDVN

SEQ ID NO: 1649127 - protein, 20 aa, Staphylococcus aureus
KQLKPFGFFDYNALQKDAFV

SEQ ID NO: 1649128 - protein, 33 aa, Staphylococcus aureus
KRDFEEMQPLYEWLGLTASLGFVDIVDYEYQKG

SEQ ID NO: 1649129 - protein, 25 aa, Staphylococcus aureus
KRDRKKRVYDLLETVGLSKEHANRY

SEQ ID NO: 1649130 - protein, 23 aa, Staphylococcus aureus
KRSSGKIAFLQLRDGTGFMQGVV

SEQ ID NO: 1649131 - protein, 32 aa, Staphylococcus aureus
KSAPSLPILRRGQHYKLHFDFDATPAGSVYFI

SEQ ID NO: 1649132 - protein, 19 aa, Staphylococcus aureus
KSIEDLNITKGHEVMEKYG

SEQ ID NO: 1649133 - protein, 17 aa, Staphylococcus aureus
KSIIEIMHNQILLEQPQ

SEQ ID NO: 1649134 - protein, 22 aa, Staphylococcus aureus
KSYVKHTLVFKGNFKMFYDKRG

SEQ ID NO: 1649135 - protein, 20 aa, Staphylococcus aureus
KTGICDLSSVIGCRDDIMVY

SEQ ID NO: 1649136 - protein, 17 aa, Staphylococcus aureus
KVSYNDRGYVFGDGIYE

SEQ ID NO: 1649137 - protein, 27 aa, Staphylococcus aureus
KVYLELWVKVQRDWRNKVNFIRQIGYV

SEQ ID NO: 1649138 - protein, 25 aa, Staphylococcus aureus
LAFCKAHHLKGRILVSTEGINGTLS

SEQ ID NO: 1649139 - protein, 18 aa, Staphylococcus aureus
LAVSGPFHSSLMKVIEED

SEQ ID NO: 1649140 - protein, 24 aa, Staphylococcus aureus
LDEANVIRYAKYLNELSDETQFIV

SEQ ID NO: 1649141 - protein, 17 aa, Staphylococcus aureus
LEEQGLQAIKEGQFAVL

SEQ ID NO: 1649142 - protein, 24 aa, Staphylococcus aureus
LEGAKRPGHFDGVVTVVNKLFNIV

SEQ ID NO: 1649143 - protein, 23 aa, Staphylococcus aureus
LEKRGRNYIGLCPFHDEKTPSFT

SEQ ID NO: 1649144 - protein, 21 aa, Staphylococcus aureus
LEKVKRVINRAVPDAPHEALL

SEQ ID NO: 1649145 - protein, 18 aa, Staphylococcus aureus
LELENVNLIMGFVRVFGK

SEQ ID NO: 1649146 - protein, 17 aa, Staphylococcus aureus
LEYGLKGLPSIKIKDSH

SEQ ID NO: 1649147 - protein, 18 aa, Staphylococcus aureus
LFGGPLYTFHKIFSIITL

SEQ ID NO: 1649148 - protein, 18 aa, Staphylococcus aureus
LFMDGARLGYGLMSDQSD

SEQ ID NO: 1649149 - protein, 27 aa, Staphylococcus aureus
LFQYRFKSRIAVWVLNYIKVNEAKLAN

SEQ ID NO: 1649150 - protein, 24 aa, Staphylococcus aureus
LFVLLCLANSMGIDMTESFNETME

SEQ ID NO: 1649151 - protein, 17 aa, Staphylococcus aureus
LGEGVEELGGLAVIGTE

SEQ ID NO: 1649152 - protein, 23 aa, Staphylococcus aureus
LGLPDKDGLCLISEIRQHTDIPI

SEQ ID NO: 1649153 - protein, 17 aa, Staphylococcus aureus
LGPEVNIINALMLLNQQ

SEQ ID NO: 1649154 - protein, 18 aa, Staphylococcus aureus
LHGAPGFEEEVKNYMTQQ

SEQ ID NO: 1649155 - protein, 19 aa, Staphylococcus aureus
LHMGGRIGVLTVVEGSTDE

SEQ ID NO: 1649156 - protein, 20 aa, Staphylococcus aureus
LKAKGIRFDKILKMSNRPKQ

SEQ ID NO: 1649157 - protein, 17 aa, Staphylococcus aureus
LKALEPMGEEYLNVVKE

SEQ ID NO: 1649158 - protein, 20 aa, Staphylococcus aureus
LKEIIIRTAEVLGTGIDEES

SEQ ID NO: 1649159 - protein, 26 aa, Staphylococcus aureus
LKGENTFKISAYRKAAQSLELDERPL

SEQ ID NO: 1649160 - protein, 18 aa, Staphylococcus aureus
LKMMINIMKPEYFIPVQG

SEQ ID NO: 1649161 - protein, 22 aa, Staphylococcus aureus
LKNRFVVIHVDYIDGDILKNVI

SEQ ID NO: 1649162 - protein, 17 aa, Staphylococcus aureus
LKRTYVFELNFDALMAV

SEQ ID NO: 1649163 - protein, 23 aa, Staphylococcus aureus
LKSHIPKDNFGRFKPVIKGGTVT

SEQ ID NO: 1649164 - protein, 19 aa, Staphylococcus aureus
LLRVFRFDNKPAKQVSNIH

SEQ ID NO: 1649165 - protein, 17 aa, Staphylococcus aureus
LLTRTIITHILKDDLGP

SEQ ID NO: 1649166 - protein, 26 aa, Staphylococcus aureus
LNGLKRNIVHIGHFKAGEAINTVPSN

SEQ ID NO: 1649167 - protein, 17 aa, Staphylococcus aureus
LNIIGLINIQFVIAHDG

SEQ ID NO: 1649168 - protein, 22 aa, Staphylococcus aureus
LNLKFQCGKSYALIGKSGCGKS

SEQ ID NO: 1649169 - protein, 19 aa, Staphylococcus aureus
LPNHAPLIVAEQFGTMATL

SEQ ID NO: 1649170 - protein, 17 aa, Staphylococcus aureus
LPNNDLCIDKIFEYKKR

SEQ ID NO: 1649171 - protein, 23 aa, Staphylococcus aureus
LREVRKRQLIELIDDALVNKDEA

SEQ ID NO: 1649172 - protein, 26 aa, Staphylococcus aureus
LRNELTVCGSWNCLSSNFPGKEWTAT

SEQ ID NO: 1649173 - protein, 20 aa, Staphylococcus aureus
LRYYEKVGVIPPVNRDENGY

SEQ ID NO: 1649174 - protein, 19 aa, Staphylococcus aureus
LSKREIEVLREMVKGKTNK

SEQ ID NO: 1649175 - protein, 18 aa, Staphylococcus aureus
LVGYNISPVLWKKVKKGL

SEQ ID NO: 1649176 - protein, 18 aa, Staphylococcus aureus
LVVWAIKEGRGVAKAVDQ

SEQ ID NO: 1649177 - protein, 26 aa, Staphylococcus aureus
MATLFPNRVDLGLGRAPGTDMMTASA

SEQ ID NO: 1649178 - protein, 24 aa, Staphylococcus aureus
MDYVKRGAANLALISEDPDLMDGI

SEQ ID NO: 1649179 - protein, 17 aa, Staphylococcus aureus
MEDELGDLPQWISDLDG

SEQ ID NO: 1649180 - protein, 17 aa, Staphylococcus aureus
MEGKAVLFKSFAGINGV

SEQ ID NO: 1649181 - protein, 21 aa, Staphylococcus aureus
MKHLHFKDIIEYFRPGDTLVL

SEQ ID NO: 1649182 - protein, 25 aa, Staphylococcus aureus
MLRLIKPKYFLPIHGEYRMLKAHGE

SEQ ID NO: 1649183 - protein, 17 aa, Staphylococcus aureus
MNLKEQFLVKLQERAIP

SEQ ID NO: 1649184 - protein, 21 aa, Staphylococcus aureus
MPKTDFPMRGGLPNKEPQIQE

SEQ ID NO: 1649185 - protein, 18 aa, Staphylococcus aureus
MSARMHKGTEQMLGMFAN

SEQ ID NO: 1649186 - protein, 19 aa, Staphylococcus aureus
MTERVLRSETDMLKKQDLI

SEQ ID NO: 1649187 - protein, 21 aa, Staphylococcus aureus
MTTIRVARAYTKRNKIIKFAG

SEQ ID NO: 1649188 - protein, 18 aa, Staphylococcus aureus
MVAKHLISPELIKQPAAA

SEQ ID NO: 1649189 - protein, 18 aa, Staphylococcus aureus
MVIDCAKGIEPQTLKLFK

SEQ ID NO: 1649190 - protein, 22 aa, Staphylococcus aureus
NAFVPSVVGLICASYVVNDVLK

SEQ ID NO: 1649191 - protein, 22 aa, Staphylococcus aureus
NDMGRLRGKIFYQSGERPRIVS

SEQ ID NO: 1649192 - protein, 18 aa, Staphylococcus aureus
NEEGLAFYDRIFDELIAQ

SEQ ID NO: 1649193 - protein, 24 aa, Staphylococcus aureus
NFEPEHLEALLAQVSIKPVINQVE

SEQ ID NO: 1649194 - protein, 17 aa, Staphylococcus aureus
NGYYADTGISFVVGESD

SEQ ID NO: 1649195 - protein, 17 aa, Staphylococcus aureus
NIGHRFNINVGIVGDSK

SEQ ID NO: 1649196 - protein, 22 aa, Staphylococcus aureus
NKKDIRTIIHFHLSTSPSNYIQ

SEQ ID NO: 1649197 - protein, 23 aa, Staphylococcus aureus
NLIPNSKCKLISATGHTIHVEDS

SEQ ID NO: 1649198 - protein, 20 aa, Staphylococcus aureus
NPDELMAFLKNKRKNILENA

SEQ ID NO: 1649199 - protein, 24 aa, Staphylococcus aureus
NTPARLKYIKSLYTELGKITDIVN

SEQ ID NO: 1649200 - protein, 19 aa, Staphylococcus aureus
NVNLIMGFVRVFGKGDKER

SEQ ID NO: 1649201 - protein, 25 aa, Staphylococcus aureus
PARIKCATLAWKALEKGTVAKEGKA

SEQ ID NO: 1649202 - protein, 21 aa, Staphylococcus aureus
PETFNDYEFYAMEGHQYHPSY

SEQ ID NO: 1649203 - protein, 23 aa, Staphylococcus aureus
PIRLEPMNTFPVIRDLQVDRSRM

SEQ ID NO: 1649204 - protein, 22 aa, Staphylococcus aureus
PKGVPMKVMLEGLEKKTGFTNA

SEQ ID NO: 1649205 - protein, 20 aa, Staphylococcus aureus
PKQFDVIVCENLFGDILSDE

SEQ ID NO: 1649206 - protein, 22 aa, Staphylococcus aureus
PLMRPIEACYARADEQQIAIIE

SEQ ID NO: 1649207 - protein, 18 aa, Staphylococcus aureus
PLSPYEIETLNQWIDVDK

SEQ ID NO: 1649208 - protein, 23 aa, Staphylococcus aureus
PNVTGKLHLGHAWDTTLQDIITR

SEQ ID NO: 1649209 - protein, 19 aa, Staphylococcus aureus
PNYYDNFAIWSTQTNAMHQ

SEQ ID NO: 1649210 - protein, 23 aa, Staphylococcus aureus
PSDIRAAGGVARMANPKIVEEVM

SEQ ID NO: 1649211 - protein, 23 aa, Staphylococcus aureus
PSIKEIRGRGLFIGIELNTDAAP

SEQ ID NO: 1649212 - protein, 19 aa, Staphylococcus aureus
PTAAFVAARAGAMAKHTDH

SEQ ID NO: 1649213 - protein, 18 aa, Staphylococcus aureus
PVGRLDYDTSGLLLLTND

SEQ ID NO: 1649214 - protein, 18 aa, Staphylococcus aureus
PVILEPMMKVTIEMPEEY

SEQ ID NO: 1649215 - protein, 22 aa, Staphylococcus aureus
PVPGGVGPLTITMVLNNTLLAE

SEQ ID NO: 1649216 - protein, 19 aa, Staphylococcus aureus
PYVIVCLNTIVAENDDEAQ

SEQ ID NO: 1649217 - protein, 18 aa, Staphylococcus aureus
QAISEVIEYCYREKLIDH

SEQ ID NO: 1649218 - protein, 22 aa, Staphylococcus aureus
QALKEIGYICAKVRNTMQAATK

SEQ ID NO: 1649219 - protein, 27 aa, Staphylococcus aureus
QCLYVKLDPYWLYHLYDKDIVPFEGRE

SEQ ID NO: 1649220 - protein, 19 aa, Staphylococcus aureus
QDIPFETFLGFKGDKVPDI

SEQ ID NO: 1649221 - protein, 17 aa, Staphylococcus aureus
QILTLLLQVMDDGNLTD

SEQ ID NO: 1649222 - protein, 20 aa, Staphylococcus aureus
QINNVLAFPGIFRGALEVEA

SEQ ID NO: 1649223 - protein, 17 aa, Staphylococcus aureus
QKIKVLLAQSLFGEPDV

SEQ ID NO: 1649224 - protein, 19 aa, Staphylococcus aureus
QLEFYSTQCDLELYFTSLS

SEQ ID NO: 1649225 - protein, 18 aa, Staphylococcus aureus
QLEKMIAPFYRKWDHQVF

SEQ ID NO: 1649226 - protein, 19 aa, Staphylococcus aureus
QNHVQIMAWSPFAGGKIFD

SEQ ID NO: 1649227 - protein, 23 aa, Staphylococcus aureus
QPFGATIPYYFTGHEGPDSCCID

SEQ ID NO: 1649228 - protein, 25 aa, Staphylococcus aureus
QPSPFHWRLLDKITLSTLYEVVLPI

SEQ ID NO: 1649229 - protein, 17 aa, Staphylococcus aureus
QQIEAIIVTGTRAEELQ

SEQ ID NO: 1649230 - protein, 27 aa, Staphylococcus aureus
QSCLTTGFCLWCQLAFSTYLENATQPH

SEQ ID NO: 1649231 - protein, 23 aa, Staphylococcus aureus
QTKISMVTAYDFPSAKQVEAAGI

SEQ ID NO: 1649232 - protein, 19 aa, Staphylococcus aureus
RAAAGGDEAAIFAGDLMRM

SEQ ID NO: 1649233 - protein, 19 aa, Staphylococcus aureus
RAYEMLDVVMHYKAREMAL

SEQ ID NO: 1649234 - protein, 20 aa, Staphylococcus aureus
RCPYGPRPGEQVKQYTVEIA

SEQ ID NO: 1649235 - protein, 22 aa, Staphylococcus aureus
RDILINECIYFASKNKKLVRLN

SEQ ID NO: 1649236 - protein, 18 aa, Staphylococcus aureus
RETYEIMTPQLVGVSTTE

SEQ ID NO: 1649237 - protein, 20 aa, Staphylococcus aureus
RFLIVFSDGEPSAFNYSQDG

SEQ ID NO: 1649238 - protein, 22 aa, Staphylococcus aureus
RGGFTTVCPMPNTRPVPDSVEH

SEQ ID NO: 1649239 - protein, 18 aa, Staphylococcus aureus
RGLANVRPALPVSDEYLA

SEQ ID NO: 1649240 - protein, 22 aa, Staphylococcus aureus
RHGQTLFNFKGLIQGFGDSPLT

SEQ ID NO: 1649241 - protein, 17 aa, Staphylococcus aureus
RIRNLEFQYVIASDLAS

SEQ ID NO: 1649242 - protein, 24 aa, Staphylococcus aureus
RITHGEINAVIALEPFTVEFEKIK

SEQ ID NO: 1649243 - protein, 21 aa, Staphylococcus aureus
RKIDMRLAAYIIGIKRTAEAA

SEQ ID NO: 1649244 - protein, 17 aa, Staphylococcus aureus
RLGAKRADGQFVTGGSI

SEQ ID NO: 1649245 - protein, 18 aa, Staphylococcus aureus
RLMLGFKNKPLQEAPQKY

SEQ ID NO: 1649246 - protein, 21 aa, Staphylococcus aureus
RMFRMEHNPLFEYIYQQKEDI

SEQ ID NO: 1649247 - protein, 23 aa, Staphylococcus aureus
RMKRAQKLFGQKIHVFDIRKHEM

SEQ ID NO: 1649248 - protein, 17 aa, Staphylococcus aureus
RMNELFGNVEVVNKDKG

SEQ ID NO: 1649249 - protein, 23 aa, Staphylococcus aureus
RNFKEVTNVTGIVLTKLDGTAKG

SEQ ID NO: 1649250 - protein, 19 aa, Staphylococcus aureus
RNKGIKILPFDANNIKEDM

SEQ ID NO: 1649251 - protein, 29 aa, Staphylococcus aureus
RNPENLPWKELDIDIAIDATGKFNHGDKA

SEQ ID NO: 1649252 - protein, 18 aa, Staphylococcus aureus
RPKGQRVSNMMIQGHAVD

SEQ ID NO: 1649253 - protein, 18 aa, Staphylococcus aureus
RPLLTYDKEEIIIKSKEI

SEQ ID NO: 1649254 - protein, 18 aa, Staphylococcus aureus
RPVVIRRELLDHYSDLGL

SEQ ID NO: 1649255 - protein, 27 aa, Staphylococcus aureus
RQKLKKLGIRKGIPVVFSDESPIVIRE

SEQ ID NO: 1649256 - protein, 18 aa, Staphylococcus aureus
RSLQWGNDAYTMILDRMN

SEQ ID NO: 1649257 - protein, 25 aa, Staphylococcus aureus
RTAPWLRRLGFENVKEVLLDPERQN

SEQ ID NO: 1649258 - protein, 20 aa, Staphylococcus aureus
RTRIIDCLETAHTRLQLLSK

SEQ ID NO: 1649259 - protein, 32 aa, Staphylococcus aureus
RTVGLELLEKGIARTGYEVMDLDGNIIGEVTS

SEQ ID NO: 1649260 - protein, 20 aa, Staphylococcus aureus
RVMNGEKMIHPKAQDVFETV

SEQ ID NO: 1649261 - protein, 31 aa, Staphylococcus aureus
RVQGVGFRYFTQRIAMNYNIVGTVQNVDDYV

SEQ ID NO: 1649262 - protein, 20 aa, Staphylococcus aureus
RYDPNQCILCGRCVEACQDI

SEQ ID NO: 1649263 - protein, 19 aa, Staphylococcus aureus
RYYIQRFLARAFGFEVDDI

SEQ ID NO: 1649264 - protein, 18 aa, Staphylococcus aureus
SDKTAFFLNGYVNEYDDT

SEQ ID NO: 1649265 - protein, 17 aa, Staphylococcus aureus
SDLKEIIIRTAEVLGTG

SEQ ID NO: 1649266 - protein, 20 aa, Staphylococcus aureus
SEGVIKVMAKMGISTVQSYQ

SEQ ID NO: 1649267 - protein, 31 aa, Staphylococcus aureus
SESGTGAGVRRIEALTGKAAFLYLEDIQEKF

SEQ ID NO: 1649268 - protein, 23 aa, Staphylococcus aureus
SEVKRLKSDPSFYGDFLEDSHRC

SEQ ID NO: 1649269 - protein, 18 aa, Staphylococcus aureus
SGAPRLQSNLFHIVKEFV

SEQ ID NO: 1649270 - protein, 18 aa, Staphylococcus aureus
SGQKAVLIPGDIRDEQFN

SEQ ID NO: 1649271 - protein, 28 aa, Staphylococcus aureus
SGVDIKEVFLKLPIIGTEVYDESNEIDF

SEQ ID NO: 1649272 - protein, 24 aa, Staphylococcus aureus
SHKKEHMIRAALEGVLYNLYTVYL

SEQ ID NO: 1649273 - protein, 24 aa, Staphylococcus aureus
SIRALLDLCDLITVMPVERAIKRT

SEQ ID NO: 1649274 - protein, 21 aa, Staphylococcus aureus
SKDGIKALLDHEQFNVDIQTG

SEQ ID NO: 1649275 - protein, 17 aa, Staphylococcus aureus
SKQFWAYLVKTGQLDNP

SEQ ID NO: 1649276 - protein, 24 aa, Staphylococcus aureus
SKSIFPSCRVAYMVLPYSIMKKYH

SEQ ID NO: 1649277 - protein, 26 aa, Staphylococcus aureus
SKVGRIINFFSLFSKFVINIPKMLKY

SEQ ID NO: 1649278 - protein, 19 aa, Staphylococcus aureus
SLFNQGLDLLQEIIWNPLI

SEQ ID NO: 1649279 - protein, 20 aa, Staphylococcus aureus
SLGSHDGVGMVFGKPIAGKK

SEQ ID NO: 1649280 - protein, 19 aa, Staphylococcus aureus
SLQYQRFIRHVQFLIRRLR

SEQ ID NO: 1649281 - protein, 20 aa, Staphylococcus aureus
SMIEDFKVTIWYTAPTALRM

SEQ ID NO: 1649282 - protein, 19 aa, Staphylococcus aureus
SNYAELRLSVDTSNIEAQV

SEQ ID NO: 1649283 - protein, 22 aa, Staphylococcus aureus
SPSIKPWILPNFTALVNHEKID

SEQ ID NO: 1649284 - protein, 25 aa, Staphylococcus aureus
SQHPQLKICACLGLTNDEQAKKLKS

SEQ ID NO: 1649285 - protein, 32 aa, Staphylococcus aureus
SRPESEVNYIMNLPVNFLKTFLPELIEKNVKV

SEQ ID NO: 1649286 - protein, 21 aa, Staphylococcus aureus
SRPNLSGNFKYVYDELLRQKV

SEQ ID NO: 1649287 - protein, 24 aa, Staphylococcus aureus
SSPRGIYCGAIGLLLPTEDDKMIF

SEQ ID NO: 1649288 - protein, 17 aa, Staphylococcus aureus
STGKRLQIGDLLQKPTV

SEQ ID NO: 1649289 - protein, 17 aa, Staphylococcus aureus
SVPQKSASRYTTTSEER

SEQ ID NO: 1649290 - protein, 35 aa, Staphylococcus aureus
TADHCHYIKDGSCWCVKAFNQRRLMKASNIVNCSR

SEQ ID NO: 1649291 - protein, 24 aa, Staphylococcus aureus
TAGWTGDVKYHLGGIKTTDSYGTM

SEQ ID NO: 1649292 - protein, 34 aa, Staphylococcus aureus
TATFMILGAVCTRACRFCAVKTGLPNELDLNEPE

SEQ ID NO: 1649293 - protein, 17 aa, Staphylococcus aureus
TAVQYDLPLTVFVLNNK

SEQ ID NO: 1649294 - protein, 22 aa, Staphylococcus aureus
TDKGRRLNVFYATQVAIEPPTF

SEQ ID NO: 1649295 - protein, 21 aa, Staphylococcus aureus
TDPHEIIGIIAGGQHAMTMAV

SEQ ID NO: 1649296 - protein, 23 aa, Staphylococcus aureus
TEKYSVLRALKAIERSNVVLVVI

SEQ ID NO: 1649297 - protein, 22 aa, Staphylococcus aureus
TELPMNPAISLFVTVKDTIEME

SEQ ID NO: 1649298 - protein, 20 aa, Staphylococcus aureus
TFEIKPKYDLNIMKSGQTLS

SEQ ID NO: 1649299 - protein, 26 aa, Staphylococcus aureus
TGEVIKAVPGFNVIAAINEGYVGTLP

SEQ ID NO: 1649300 - protein, 26 aa, Staphylococcus aureus
TIAIMSGNFVMRGEPAIYNKFTRAKM

SEQ ID NO: 1649301 - protein, 21 aa, Staphylococcus aureus
TIDLTELIVAYQRVKNRVELN

SEQ ID NO: 1649302 - protein, 26 aa, Staphylococcus aureus
TITEGFARCIPMIFLNPAPGQELENA

SEQ ID NO: 1649303 - protein, 20 aa, Staphylococcus aureus
TKLKNGRKFLTKGDKCKVSI

SEQ ID NO: 1649304 - protein, 26 aa, Staphylococcus aureus
TKLYFEGVSVFDMLDIVENITLDSIN

SEQ ID NO: 1649305 - protein, 18 aa, Staphylococcus aureus
TLRIKWVEKGNIESYDDF

SEQ ID NO: 1649306 - protein, 17 aa, Staphylococcus aureus
TMRARGAQVTDITILVV

SEQ ID NO: 1649307 - protein, 25 aa, Staphylococcus aureus
TQRIIKENIEVAAKYGAVDTVIEAI

SEQ ID NO: 1649308 - protein, 25 aa, Staphylococcus aureus
TRNIKKRMVKNICQSMITFDKEGMP

SEQ ID NO: 1649309 - protein, 18 aa, Staphylococcus aureus
TRQRKRAYEMLDVVMHYK

SEQ ID NO: 1649310 - protein, 24 aa, Staphylococcus aureus
TSEGKLLFNEALRIIEHLDSTIEQ

SEQ ID NO: 1649311 - protein, 18 aa, Staphylococcus aureus
TVIIPGIMEHIERAGVHS

SEQ ID NO: 1649312 - protein, 17 aa, Staphylococcus aureus
TVIRFAPPLIITKEELD

SEQ ID NO: 1649313 - protein, 18 aa, Staphylococcus aureus
TVTLKTLGLIIVMAQSGL

SEQ ID NO: 1649314 - protein, 18 aa, Staphylococcus aureus
TVTRFEPHQALFADNHGY

SEQ ID NO: 1649315 - protein, 43 aa, Staphylococcus aureus
TYVTQLICYDLRFPELLRYPARSGAKIAFYVAQWPMSRLQHWH

SEQ ID NO: 1649316 - protein, 20 aa, Staphylococcus aureus
VDRYLLNRLREFTASTINNY

SEQ ID NO: 1649317 - protein, 26 aa, Staphylococcus aureus
VEALRTLRLVIDMSKEPDLYLQISAI

SEQ ID NO: 1649318 - protein, 22 aa, Staphylococcus aureus
VEGIKIELEDKIYILFHKPTQV

SEQ ID NO: 1649319 - protein, 20 aa, Staphylococcus aureus
VFDRGGYLYHGRVKALAEAA

SEQ ID NO: 1649320 - protein, 22 aa, Staphylococcus aureus
VGYREVMGLNVAMLEIDVHLTK

SEQ ID NO: 1649321 - protein, 19 aa, Staphylococcus aureus
VHVAFKLAASRRGKLTSVD

SEQ ID NO: 1649322 - protein, 26 aa, Staphylococcus aureus
VIGAGRIGLGVAKRAQSFGMKILAFD

SEQ ID NO: 1649323 - protein, 18 aa, Staphylococcus aureus
VIGDYVAGPSHVLPTNRT

SEQ ID NO: 1649324 - protein, 25 aa, Staphylococcus aureus
VLDEAHCLSEWGYDFRPHYALIGKV

SEQ ID NO: 1649325 - protein, 17 aa, Staphylococcus aureus
VLLCGSGIGTSQLLKSK

SEQ ID NO: 1649326 - protein, 18 aa, Staphylococcus aureus
VMAKMGISTVQSYQGAQI

SEQ ID NO: 1649327 - protein, 19 aa, Staphylococcus aureus
VMPGFDFYFVPTVLNSTDV

SEQ ID NO: 1649328 - protein, 17 aa, Staphylococcus aureus
VPAGGALAVDRHDFSGY

SEQ ID NO: 1649329 - protein, 26 aa, Staphylococcus aureus
VQETEVINVFPIRFIVDKENEVSDPK

SEQ ID NO: 1649330 - protein, 17 aa, Staphylococcus aureus
VQPELGKTFQILREQGF

SEQ ID NO: 1649331 - protein, 21 aa, Staphylococcus aureus
VQVIHELPFDKGLSRVCTNIR

SEQ ID NO: 1649332 - protein, 23 aa, Staphylococcus aureus
VRFLERDEFNLFLDLYRETEERA

SEQ ID NO: 1649333 - protein, 26 aa, Staphylococcus aureus
VRFRPSQEIIQVWHAVGAFKTVGFSR

SEQ ID NO: 1649334 - protein, 18 aa, Staphylococcus aureus
VRPALPVSDEYLAVQDAM

SEQ ID NO: 1649335 - protein, 22 aa, Staphylococcus aureus
VSNRGHDSIAIFKVLDNGQHLE

SEQ ID NO: 1649336 - protein, 27 aa, Staphylococcus aureus
VSNVKPGQWLGVFGIGGLGNLALQYAK

SEQ ID NO: 1649337 - protein, 18 aa, Staphylococcus aureus
VSPTGQRAITHILTSKMI

SEQ ID NO: 1649338 - protein, 18 aa, Staphylococcus aureus
VSTLSKRPFNVVMTPSDK

SEQ ID NO: 1649339 - protein, 26 aa, Staphylococcus aureus
VTIPPWNFPFAIMAGTTLAPVVAGNT

SEQ ID NO: 1649340 - protein, 26 aa, Staphylococcus aureus
VVKIDRFPIFIPQALINEQIEYKIIK

SEQ ID NO: 1649341 - protein, 18 aa, Staphylococcus aureus
WHLAHNRIIIPKSQTPKR

SEQ ID NO: 1649342 - protein, 18 aa, Staphylococcus aureus
WIHPDERSAAFFAVGLIK

SEQ ID NO: 1649343 - protein, 17 aa, Staphylococcus aureus
WKAASRVIDAAVEKAYN

SEQ ID NO: 1649344 - protein, 17 aa, Staphylococcus aureus
WWEEVEKAYQFLVNEGY

SEQ ID NO: 1649345 - protein, 18 aa, Staphylococcus aureus
YALENNIGYFVIDSLEEI

SEQ ID NO: 1649346 - protein, 18 aa, Staphylococcus aureus
YDEVMRFGKYHPDYKKVM

SEQ ID NO: 1649347 - protein, 17 aa, Staphylococcus aureus
YDITSLYTFKQPVSPHL

SEQ ID NO: 1649348 - protein, 17 aa, Staphylococcus aureus
YEGGIAFASKPLIDADF

SEQ ID NO: 1649349 - protein, 18 aa, Staphylococcus aureus
YEKLAIATLGVRNGATFI

SEQ ID NO: 1649350 - protein, 17 aa, Staphylococcus aureus
YFKKTVNPFDHKAVPGG

SEQ ID NO: 1649351 - protein, 21 aa, Staphylococcus aureus
YGGEFQLKQGFSPAFTVEPKE

SEQ ID NO: 1649352 - protein, 24 aa, Staphylococcus aureus
YINCNHNLDFALAIRTMMIDEQYI

SEQ ID NO: 1649353 - protein, 17 aa, Staphylococcus aureus
YIVTWALGHLVTNATPE

SEQ ID NO: 1649354 - protein, 17 aa, Staphylococcus aureus
YKEAMRRYGSDKPDTRF

SEQ ID NO: 1649355 - protein, 23 aa, Staphylococcus aureus
YKKTPKFILGFGGIDDDALKPHV

SEQ ID NO: 1649356 - protein, 17 aa, Staphylococcus aureus
YKNIEWLIKEGYGKLTL

SEQ ID NO: 1649357 - protein, 19 aa, Staphylococcus aureus
YKTMQGFYAPYVPGWDTHG

SEQ ID NO: 1649358 - protein, 18 aa, Staphylococcus aureus
YLHQYPELSFEEFQTHDY

SEQ ID NO: 1649359 - protein, 33 aa, Staphylococcus aureus
YLKPFVKTKIKAWVRQLLWMSIYQYVYLDKVPN

SEQ ID NO: 1649360 - protein, 20 aa, Staphylococcus aureus
YMSKICSYAQGFAQMRKASE

SEQ ID NO: 1649361 - protein, 21 aa, Staphylococcus aureus
YPGRRYYGGCEFVDVTESIAI

SEQ ID NO: 1649362 - protein, 23 aa, Staphylococcus aureus
YPHKRGVYSGGVGYINCNHNLDF

SEQ ID NO: 1649363 - protein, 17 aa, Staphylococcus aureus
YPLNELISIGQMIKNAG

SEQ ID NO: 1649364 - protein, 18 aa, Staphylococcus aureus
YQPWPTYDEALLVDDEVE

SEQ ID NO: 1649365 - protein, 18 aa, Staphylococcus aureus
YRLGEALIEVSEIREPCW

SEQ ID NO: 1649366 - protein, 17 aa, Staphylococcus aureus
YRTPIGVFGGAFKDVPA

SEQ ID NO: 1649367 - protein, 17 aa, Staphylococcus aureus
YYADTGISFVVGESDDP

SEQ ID NO: 1649368 - protein, 20 aa, Staphylococcus aureus
ACQYPQLAHHNFFFTENAYL

SEQ ID NO: 1649369 - protein, 18 aa, Staphylococcus aureus
ADGNGFQCGIWYEGTLVG

SEQ ID NO: 1649370 - protein, 21 aa, Staphylococcus aureus
ADLSPKFVVGYVETKDKHPDA

SEQ ID NO: 1649371 - protein, 20 aa, Staphylococcus aureus
AEINTLPIVEQFQTSQYEAN

SEQ ID NO: 1649372 - protein, 19 aa, Staphylococcus aureus
AELEGEFAEMNGWNAEADA

SEQ ID NO: 1649373 - protein, 24 aa, Staphylococcus aureus
AGGKRIRPVLLLLTLDSLNTEYEL

SEQ ID NO: 1649374 - protein, 25 aa, Staphylococcus aureus
AIRLSCKGLQQFSHAKTKQIVLSID

SEQ ID NO: 1649375 - protein, 21 aa, Staphylococcus aureus
AKKEGQGCISLKSIAEENNLS

SEQ ID NO: 1649376 - protein, 19 aa, Staphylococcus aureus
ALEAVWDYSYDKVGYLGTN

SEQ ID NO: 1649377 - protein, 25 aa, Staphylococcus aureus
ALVKALQAWDIDHLYGIPGDSIDAV

SEQ ID NO: 1649378 - protein, 18 aa, Staphylococcus aureus
AMTDCLNYGSPEKKEIYQ

SEQ ID NO: 1649379 - protein, 19 aa, Staphylococcus aureus
ARHYAIRNALRSALKALDL

SEQ ID NO: 1649380 - protein, 17 aa, Staphylococcus aureus
ASALFIYNEHEVYYLSS

SEQ ID NO: 1649381 - protein, 19 aa, Staphylococcus aureus
AVVLPHGVLFRGAAEGVIR

SEQ ID NO: 1649382 - protein, 22 aa, Staphylococcus aureus
DAANLLSGLGIDPTLHDKKMAE

SEQ ID NO: 1649383 - protein, 17 aa, Staphylococcus aureus
DALDIRLEPKFTSDIVP

SEQ ID NO: 1649384 - protein, 20 aa, Staphylococcus aureus
DDRRGPHFISPKSEKADELI

SEQ ID NO: 1649385 - protein, 17 aa, Staphylococcus aureus
DEQVTYEKLAIATLGVR

SEQ ID NO: 1649386 - protein, 25 aa, Staphylococcus aureus
DGTIKFLFELQDGYTIETVLMRHDY

SEQ ID NO: 1649387 - protein, 24 aa, Staphylococcus aureus
DGYRIGYGGGYYDRFLANYQTKTI

SEQ ID NO: 1649388 - protein, 28 aa, Staphylococcus aureus
DIIKEGIPAKARRKGGHPAKRVFQALRI

SEQ ID NO: 1649389 - protein, 29 aa, Staphylococcus aureus
DIYSRPRGKFRFPMSVAYENENVEQSADT

SEQ ID NO: 1649390 - protein, 18 aa, Staphylococcus aureus
DLKGRSLLKESDFTKAEF

SEQ ID NO: 1649391 - protein, 17 aa, Staphylococcus aureus
DMQVFRFNFRHQIDKKI

SEQ ID NO: 1649392 - protein, 17 aa, Staphylococcus aureus
DNLKNVTGYIRGGCSPV

SEQ ID NO: 1649393 - protein, 17 aa, Staphylococcus aureus
DPNVRLPLWDNAEDLRQ

SEQ ID NO: 1649394 - protein, 18 aa, Staphylococcus aureus
DRFDIAKLVYMVWDDMEL

SEQ ID NO: 1649395 - protein, 18 aa, Staphylococcus aureus
DRLKLRKQTRQLAAIYLA

SEQ ID NO: 1649396 - protein, 23 aa, Staphylococcus aureus
DSKSISFGLGYQIQHLVELVKEG

SEQ ID NO: 1649397 - protein, 31 aa, Staphylococcus aureus
DTIMYKVHLMKECLDRGIKVISSMGAANKTD

SEQ ID NO: 1649398 - protein, 23 aa, Staphylococcus aureus
DVSEELRQGMKIIEIAEQENIQH

SEQ ID NO: 1649399 - protein, 20 aa, Staphylococcus aureus
DVYECRFLTIATGYYGQHNT

SEQ ID NO: 1649400 - protein, 24 aa, Staphylococcus aureus
EAKPEDYDALLIPGGFSPDHLRGD

SEQ ID NO: 1649401 - protein, 25 aa, Staphylococcus aureus
EALIKIIPSYHALIVRSQTTVTENI

SEQ ID NO: 1649402 - protein, 22 aa, Staphylococcus aureus
EDFQNLILLFLESWYLKASFSQ

SEQ ID NO: 1649403 - protein, 21 aa, Staphylococcus aureus
EDGYFWFQGRVDDVIMTAGER

SEQ ID NO: 1649404 - protein, 24 aa, Staphylococcus aureus
EDQNLKLLGEDEMDDDDDIPAQTD

SEQ ID NO: 1649405 - protein, 19 aa, Staphylococcus aureus
EKAERAFLKHLMRDKDTFL

SEQ ID NO: 1649406 - protein, 21 aa, Staphylococcus aureus
EKGKKSIAIRLNYLDTEETLT

SEQ ID NO: 1649407 - protein, 18 aa, Staphylococcus aureus
ELAIELQVGVPTLEDIIK

SEQ ID NO: 1649408 - protein, 20 aa, Staphylococcus aureus
ELCKVCKQYQLPLFMDGARL

SEQ ID NO: 1649409 - protein, 21 aa, Staphylococcus aureus
ELSDSLIRRTMEPTRQAMKDA

SEQ ID NO: 1649410 - protein, 23 aa, Staphylococcus aureus
ELTAYEIVNNWSYEALVKIFYRY

SEQ ID NO: 1649411 - protein, 22 aa, Staphylococcus aureus
EMDLMNAFYLLDAVNIPIGIVR

SEQ ID NO: 1649412 - protein, 18 aa, Staphylococcus aureus
ENLDICIFAESLGGTETL

SEQ ID NO: 1649413 - protein, 19 aa, Staphylococcus aureus
ENYPGISFDTIYRNLHLFK

SEQ ID NO: 1649414 - protein, 24 aa, Staphylococcus aureus
EPLRKMEAPMFKKILKKHQLLDDA

SEQ ID NO: 1649415 - protein, 17 aa, Staphylococcus aureus
EQLESVIQPGVRVIVPF

SEQ ID NO: 1649416 - protein, 20 aa, Staphylococcus aureus
EQYDKILLYSGNMGQLQDME

SEQ ID NO: 1649417 - protein, 18 aa, Staphylococcus aureus
ERMYEFLDKLISVSLPRV

SEQ ID NO: 1649418 - protein, 23 aa, Staphylococcus aureus
ESHKRFGGVVPEVASRHHVEGIT

SEQ ID NO: 1649419 - protein, 30 aa, Staphylococcus aureus
ETMNLYDIIDEFRALGDYEYEEIENRVVQF

SEQ ID NO: 1649420 - protein, 18 aa, Staphylococcus aureus
ETPIGRNGIKATFKGLGT

SEQ ID NO: 1649421 - protein, 17 aa, Staphylococcus aureus
EVMTLPSIKVVEHPDLF

SEQ ID NO: 1649422 - protein, 18 aa, Staphylococcus aureus
EVRNAFTPKTVAEMIDAF

SEQ ID NO: 1649423 - protein, 19 aa, Staphylococcus aureus
FDRDTNWLSVLPIYHISGL

SEQ ID NO: 1649424 - protein, 19 aa, Staphylococcus aureus
FDTTGEWLPQETLDTIKEY

SEQ ID NO: 1649425 - protein, 20 aa, Staphylococcus aureus
FEKDGPRIMALEPQDDNRDG

SEQ ID NO: 1649426 - protein, 18 aa, Staphylococcus aureus
FEMLRQMLGKHFISQDIV

SEQ ID NO: 1649427 - protein, 18 aa, Staphylococcus aureus
FGTGYALEFTGETIKNLS

SEQ ID NO: 1649428 - protein, 24 aa, Staphylococcus aureus
FIRKLTSNITLMFDGDFAGSEATL

SEQ ID NO: 1649429 - protein, 19 aa, Staphylococcus aureus
FKQSLMGGGFQIDNPNAIA

SEQ ID NO: 1649430 - protein, 17 aa, Staphylococcus aureus
FNGSDFGGFSGFGGGGF

SEQ ID NO: 1649431 - protein, 29 aa, Staphylococcus aureus
FNLDRAAIEFGKMDFNTHLDLKAYSDNIK

SEQ ID NO: 1649432 - protein, 20 aa, Staphylococcus aureus
FTPEREIGNDLLIVQNLSKT

SEQ ID NO: 1649433 - protein, 17 aa, Staphylococcus aureus
FVQAAFEKLDFMVVQDE

SEQ ID NO: 1649434 - protein, 20 aa, Staphylococcus aureus
FVYKVAAMDFIFKDDPAELR

SEQ ID NO: 1649435 - protein, 24 aa, Staphylococcus aureus
FYEGKPMLSYVYDYPHKKLYKAIR

SEQ ID NO: 1649436 - protein, 19 aa, Staphylococcus aureus
FYYSDIIGCTVFDDQETPI

SEQ ID NO: 1649437 - protein, 23 aa, Staphylococcus aureus
GALGRKTKQGFYKKDKETKARLV

SEQ ID NO: 1649438 - protein, 17 aa, Staphylococcus aureus
GEVIEENGLRMHATNLG

SEQ ID NO: 1649439 - protein, 27 aa, Staphylococcus aureus
GFDDGNRPIGSFLFVGPTGVGKTELAK

SEQ ID NO: 1649440 - protein, 23 aa, Staphylococcus aureus
GGANRLIKAGAFDKYPIEAVFGI

SEQ ID NO: 1649441 - protein, 17 aa, Staphylococcus aureus
GGIMLPNHAPLIVAEQF

SEQ ID NO: 1649442 - protein, 17 aa, Staphylococcus aureus
GKQILGVDPAFRTGCKL

SEQ ID NO: 1649443 - protein, 20 aa, Staphylococcus aureus
GLEPSMAFKIMESVRKGKGL

SEQ ID NO: 1649444 - protein, 23 aa, Staphylococcus aureus
GLKQYGIDIAERIEVIVPETVHN

SEQ ID NO: 1649445 - protein, 28 aa, Staphylococcus aureus
GNSGVILSQLFRGFCKNIESESEINSKL

SEQ ID NO: 1649446 - protein, 17 aa, Staphylococcus aureus
GPKVIEFNARFGDPEAQ

SEQ ID NO: 1649447 - protein, 20 aa, Staphylococcus aureus
GQALHAGLIGFEHPVTGEYI

SEQ ID NO: 1649448 - protein, 18 aa, Staphylococcus aureus
GQDIPLVINGEKIFKDDK

SEQ ID NO: 1649449 - protein, 19 aa, Staphylococcus aureus
GRTMPNFAIVERDYTKIYD

SEQ ID NO: 1649450 - protein, 23 aa, Staphylococcus aureus
GVHPYRVKLALGQVRHYQLDELL

SEQ ID NO: 1649451 - protein, 17 aa, Staphylococcus aureus
GYLKIKVNGGGCTGLTY

SEQ ID NO: 1649452 - protein, 18 aa, Staphylococcus aureus
HAIKLGKVTHIFITHMHG

SEQ ID NO: 1649453 - protein, 25 aa, Staphylococcus aureus
HDDYKAGQIIGEWIGQQGYQQVEVF

SEQ ID NO: 1649454 - protein, 18 aa, Staphylococcus aureus
HEALLCLDATTGQNALSQ

SEQ ID NO: 1649455 - protein, 26 aa, Staphylococcus aureus
HKGAYKDGKWKVLMIAAEERYVLLEN

SEQ ID NO: 1649456 - protein, 26 aa, Staphylococcus aureus
HLLNHGIPSYGYRVMAPETTGTINVE

SEQ ID NO: 1649457 - protein, 20 aa, Staphylococcus aureus
HNFASGLSYHVLTMLRIAKS

SEQ ID NO: 1649458 - protein, 25 aa, Staphylococcus aureus
HVSELKNRIPLVLEVKSDQYQSSTR

SEQ ID NO: 1649459 - protein, 24 aa, Staphylococcus aureus
IAEKLKLPMNYVRSSNKSHGKQNQ

SEQ ID NO: 1649460 - protein, 18 aa, Staphylococcus aureus
IDHLYGIPGDSIDAVVDS

SEQ ID NO: 1649461 - protein, 21 aa, Staphylococcus aureus
IDKLICSWLKQIDNVIPQLIM

SEQ ID NO: 1649462 - protein, 22 aa, Staphylococcus aureus
IDNGKVCGFLTEMVANNDGIEA

SEQ ID NO: 1649463 - protein, 19 aa, Staphylococcus aureus
IDRYNFYGVSGKFTEDAED

SEQ ID NO: 1649464 - protein, 31 aa, Staphylococcus aureus
IEPQTLKLFKVCKMRGIPIFTFINKLDRVGK

SEQ ID NO: 1649465 - protein, 19 aa, Staphylococcus aureus
IESAERLGLPEARIPLSQA

SEQ ID NO: 1649466 - protein, 17 aa, Staphylococcus aureus
IGIAGFFGLPIQKDAVD

SEQ ID NO: 1649467 - protein, 26 aa, Staphylococcus aureus
IGYHPDYEFLKSVGIQINTNEFGTAP

SEQ ID NO: 1649468 - protein, 23 aa, Staphylococcus aureus
IIASCSFAKHMLEKEDSYQDVYL

SEQ ID NO: 1649469 - protein, 23 aa, Staphylococcus aureus
IILHELCHYHLHIAGKGYQHKDQ

SEQ ID NO: 1649470 - protein, 22 aa, Staphylococcus aureus
IKGKDATPFLLGKIVEKTNGKS

SEQ ID NO: 1649471 - protein, 22 aa, Staphylococcus aureus
IKKHFDCAMIFISHDLTVINKI

SEQ ID NO: 1649472 - protein, 17 aa, Staphylococcus aureus
IKVEEGQEIFVEKLDVN

SEQ ID NO: 1649473 - protein, 22 aa, Staphylococcus aureus
IPEMLTENFIPRTELRETTMNI

SEQ ID NO: 1649474 - protein, 18 aa, Staphylococcus aureus
IPHDLFTPIFAVSRSAGW

SEQ ID NO: 1649475 - protein, 28 aa, Staphylococcus aureus
IRNFKPEEYWTIEGEFRYKKSKFNAKFL

SEQ ID NO: 1649476 - protein, 25 aa, Staphylococcus aureus
ISAMMFKGSASKLNFEPKEGDEVLL

SEQ ID NO: 1649477 - protein, 23 aa, Staphylococcus aureus
ITKEKYPRLLVTRTVKQGTGKYF

SEQ ID NO: 1649478 - protein, 18 aa, Staphylococcus aureus
IYNDIAITAQYLAKEYNQ

SEQ ID NO: 1649479 - protein, 22 aa, Staphylococcus aureus
IYYERCGGCQLQHLSYEAQLEM

SEQ ID NO: 1649480 - protein, 24 aa, Staphylococcus aureus
KAAKRSGTTIGFIPTMGALHDGHL

SEQ ID NO: 1649481 - protein, 24 aa, Staphylococcus aureus
KDGDPRAKYLREMSRQITKDAGRE

SEQ ID NO: 1649482 - protein, 20 aa, Staphylococcus aureus
KDKISRITIGYTRDRKPVTV

SEQ ID NO: 1649483 - protein, 18 aa, Staphylococcus aureus
KDSGLKYNISYASKAFTC

SEQ ID NO: 1649484 - protein, 19 aa, Staphylococcus aureus
KESVISAMMFKGSASKLNF

SEQ ID NO: 1649485 - protein, 19 aa, Staphylococcus aureus
KFLKYFTFLGKEEIDRLEQ

SEQ ID NO: 1649486 - protein, 28 aa, Staphylococcus aureus
KGVEINGAFPRMTYKEAMRRYGSDKPDT

SEQ ID NO: 1649487 - protein, 17 aa, Staphylococcus aureus
KGVLSPWSKREAEDYYE

SEQ ID NO: 1649488 - protein, 21 aa, Staphylococcus aureus
KHDLAALSYLTFVALDDEGKP

SEQ ID NO: 1649489 - protein, 19 aa, Staphylococcus aureus
KIMTEHLNIFVGLTDEAQN

SEQ ID NO: 1649490 - protein, 20 aa, Staphylococcus aureus
KKPMILFGHMSPYMIVGMIG

SEQ ID NO: 1649491 - protein, 26 aa, Staphylococcus aureus
KKSRLTGRLSGNIGYVASKVAQEVKP

SEQ ID NO: 1649492 - protein, 22 aa, Staphylococcus aureus
KKYVAKLKGYLMREEVKALEKG

SEQ ID NO: 1649493 - protein, 18 aa, Staphylococcus aureus
KLLSTAGAYWRGDSNNKM

SEQ ID NO: 1649494 - protein, 26 aa, Staphylococcus aureus
KLVEIFWPGPLNIILKNKTSYNYMLN

SEQ ID NO: 1649495 - protein, 30 aa, Staphylococcus aureus
KMSREEILILLTLWQKGSMTLKEMDRFVEV

SEQ ID NO: 1649496 - protein, 18 aa, Staphylococcus aureus
KNFMLNKAILEGYHTLLT

SEQ ID NO: 1649497 - protein, 25 aa, Staphylococcus aureus
KQSIYSLRFDEMQNWLVEQGQQKFR

SEQ ID NO: 1649498 - protein, 25 aa, Staphylococcus aureus
KSAIALEMIHTYSLIHDDLPAMDND

SEQ ID NO: 1649499 - protein, 17 aa, Staphylococcus aureus
KSLLQMLLLHAIPTPVI

SEQ ID NO: 1649500 - protein, 21 aa, Staphylococcus aureus
KSPFDFCGLVLDYNEDTKIAT

SEQ ID NO: 1649501 - protein, 23 aa, Staphylococcus aureus
KTLQRKLGKTFIFVTHDMDEAIK

SEQ ID NO: 1649502 - protein, 19 aa, Staphylococcus aureus
KVISRAQVILSEFEASAGK

SEQ ID NO: 1649503 - protein, 18 aa, Staphylococcus aureus
KVIYEKAKAINISSFTDL

SEQ ID NO: 1649504 - protein, 26 aa, Staphylococcus aureus
KYYVSHQWFPLGAVHGLKYWYNYTSD

SEQ ID NO: 1649505 - protein, 23 aa, Staphylococcus aureus
LAQPRVLICDEITSNLDVIAEQN

SEQ ID NO: 1649506 - protein, 26 aa, Staphylococcus aureus
LCNMRCSHCAVGYTLQTVDPEPLDMD

SEQ ID NO: 1649507 - protein, 23 aa, Staphylococcus aureus
LDGELFRKNFVGVHDGSTNKYIH

SEQ ID NO: 1649508 - protein, 19 aa, Staphylococcus aureus
LDKEFDFILIEGAGGIAVP

SEQ ID NO: 1649509 - protein, 23 aa, Staphylococcus aureus
LDPEVAGVLPVCIGNATRVSDYV

SEQ ID NO: 1649510 - protein, 23 aa, Staphylococcus aureus
LEKHNIYYGQWLILRDIAKHQPT

SEQ ID NO: 1649511 - protein, 17 aa, Staphylococcus aureus
LGDNLFVLLCLANSMGI

SEQ ID NO: 1649512 - protein, 21 aa, Staphylococcus aureus
LHPYGSWQEYWAFESRFITLN

SEQ ID NO: 1649513 - protein, 19 aa, Staphylococcus aureus
LIPEYQHLNIFPVGRLDKD

SEQ ID NO: 1649514 - protein, 19 aa, Staphylococcus aureus
LKEDETWMRDMIRSQDPIN

SEQ ID NO: 1649515 - protein, 24 aa, Staphylococcus aureus
LKFYKEQFDTLSYFQLKVLIVGFE

SEQ ID NO: 1649516 - protein, 18 aa, Staphylococcus aureus
LLDTPGILWPKFEDEEVG

SEQ ID NO: 1649517 - protein, 18 aa, Staphylococcus aureus
LLEKACERKGIPFEPKEI

SEQ ID NO: 1649518 - protein, 17 aa, Staphylococcus aureus
LNGRDGYKKVNRLFIDC

SEQ ID NO: 1649519 - protein, 26 aa, Staphylococcus aureus
LPENNKVLVFFVRYGGEFQLKQGFSP

SEQ ID NO: 1649520 - protein, 23 aa, Staphylococcus aureus
LPKKDRVVVEGVNIMKKHQKPTQ

SEQ ID NO: 1649521 - protein, 19 aa, Staphylococcus aureus
LPNKNLIYFESFHGKQYSD

SEQ ID NO: 1649522 - protein, 18 aa, Staphylococcus aureus
LQVNNCVTVEPGVYIEGL

SEQ ID NO: 1649523 - protein, 19 aa, Staphylococcus aureus
LRHEPLDHVLLFGPPGLGK

SEQ ID NO: 1649524 - protein, 17 aa, Staphylococcus aureus
LRTGAIQEKTFRAGEKV

SEQ ID NO: 1649525 - protein, 27 aa, Staphylococcus aureus
LRVTQELRKKGVVGKFVEFFGPGVQHL

SEQ ID NO: 1649526 - protein, 22 aa, Staphylococcus aureus
LSLKLSELAQWELVEKQIISTS

SEQ ID NO: 1649527 - protein, 18 aa, Staphylococcus aureus
LSSFQLLGIEKYKPHIAI

SEQ ID NO: 1649528 - protein, 25 aa, Staphylococcus aureus
LSSGGKRVRPAFVILSSQFGKDEQT

SEQ ID NO: 1649529 - protein, 20 aa, Staphylococcus aureus
LSYLKDLKFTGSIRSMQEGE

SEQ ID NO: 1649530 - protein, 17 aa, Staphylococcus aureus
LTPNVARVIKRLINETF

SEQ ID NO: 1649531 - protein, 23 aa, Staphylococcus aureus
LTRAKEQLYLIGRVKNDKSLLEL

SEQ ID NO: 1649532 - protein, 23 aa, Staphylococcus aureus
LVSKRLKKDYGLTFSPCNTKGLA

SEQ ID NO: 1649533 - protein, 18 aa, Staphylococcus aureus
MHRLGDILVQYGIQHDTG

SEQ ID NO: 1649534 - protein, 23 aa, Staphylococcus aureus
MIKRDEFEMGRELLVQVRKRQLK

SEQ ID NO: 1649535 - protein, 22 aa, Staphylococcus aureus
MKSLSIPLQYLVAAALEVTDVN

SEQ ID NO: 1649536 - protein, 26 aa, Staphylococcus aureus
MQEGELCFGNEPLLRVEAPLIQAQLI

SEQ ID NO: 1649537 - protein, 23 aa, Staphylococcus aureus
MRDQCSVCHAVLPQIEDLMQSYP

SEQ ID NO: 1649538 - protein, 24 aa, Staphylococcus aureus
NAFKEASEQLATWVQEGKIQSQVT

SEQ ID NO: 1649539 - protein, 28 aa, Staphylococcus aureus
NESSCVSCGQCATVCPCNAMMEVNMEGN

SEQ ID NO: 1649540 - protein, 17 aa, Staphylococcus aureus
NFHELKQQVRLHIIQMN

SEQ ID NO: 1649541 - protein, 24 aa, Staphylococcus aureus
NFMAKEARGLICAPVSKDIAQRLD

SEQ ID NO: 1649542 - protein, 26 aa, Staphylococcus aureus
NFTETGIFSVMWSEHCSYKHSKPFLK

SEQ ID NO: 1649543 - protein, 17 aa, Staphylococcus aureus
NGAVLVRYGDTVVLSTA

SEQ ID NO: 1649544 - protein, 18 aa, Staphylococcus aureus
NHLGELILTISKASNDSN

SEQ ID NO: 1649545 - protein, 20 aa, Staphylococcus aureus
NKHYISIFINGRYIKNFMLN

SEQ ID NO: 1649546 - protein, 20 aa, Staphylococcus aureus
NMNDIGCYFLDIQLSTDING

SEQ ID NO: 1649547 - protein, 20 aa, Staphylococcus aureus
NNYGVGLGMPSFESAVNPLH

SEQ ID NO: 1649548 - protein, 23 aa, Staphylococcus aureus
NPDLDFEFIHWLVSGVKDHEPVL

SEQ ID NO: 1649549 - protein, 46 aa, Staphylococcus aureus
NPLTDMIKFKYPRLFENVRLALNDCWPDLIFPESEIAFIVLHFGGS

SEQ ID NO: 1649550 - protein, 19 aa, Staphylococcus aureus
NPTGSFKDRGMVMAVTKAK

SEQ ID NO: 1649551 - protein, 29 aa, Staphylococcus aureus
NPYVRHIAHPTGRIIGRRDGYKPNIEQLM

SEQ ID NO: 1649552 - protein, 26 aa, Staphylococcus aureus
NQGSPKCIVFGCYENETLIATAALEQ

SEQ ID NO: 1649553 - protein, 26 aa, Staphylococcus aureus
NRMAMSHPDIRIALISDGKTMLSTNG

SEQ ID NO: 1649554 - protein, 27 aa, Staphylococcus aureus
NSHLLQFKNGRIIRGKSTLLSFSDLEI

SEQ ID NO: 1649555 - protein, 18 aa, Staphylococcus aureus
NSTMCQRISALAEQLKIQ

SEQ ID NO: 1649556 - protein, 24 aa, Staphylococcus aureus
PAQFGGPHCGYFATTKKLMRKVPG

SEQ ID NO: 1649557 - protein, 21 aa, Staphylococcus aureus
PDFIEKYRFFDMLQASLHPYG

SEQ ID NO: 1649558 - protein, 17 aa, Staphylococcus aureus
PDILQEYLLYVRYTAIL

SEQ ID NO: 1649559 - protein, 19 aa, Staphylococcus aureus
PDPELYLSAVQQLNYMPTQ

SEQ ID NO: 1649560 - protein, 20 aa, Staphylococcus aureus
PESEIAFIVLHFGGSIKNQG

SEQ ID NO: 1649561 - protein, 22 aa, Staphylococcus aureus
PEVHYLKQFIKHKIEQLLDEGL

SEQ ID NO: 1649562 - protein, 19 aa, Staphylococcus aureus
PFGACHFAVAAKPETTNYR

SEQ ID NO: 1649563 - protein, 18 aa, Staphylococcus aureus
PKRRIPYMEIVGQVHGTY

SEQ ID NO: 1649564 - protein, 19 aa, Staphylococcus aureus
PNLTYFCSYQLAKRTVDSY

SEQ ID NO: 1649565 - protein, 19 aa, Staphylococcus aureus
PQFTPEIFMKVSAKNVMKQ

SEQ ID NO: 1649566 - protein, 24 aa, Staphylococcus aureus
PQKIVRWRAAMFIFDEGNAEQLPA

SEQ ID NO: 1649567 - protein, 22 aa, Staphylococcus aureus
PRSYYTGLFIQCHFAENESRVL

SEQ ID NO: 1649568 - protein, 18 aa, Staphylococcus aureus
PSGAYYGGETLKPTKIYV

SEQ ID NO: 1649569 - protein, 17 aa, Staphylococcus aureus
PSTPSRQAVAMPASDVI

SEQ ID NO: 1649570 - protein, 20 aa, Staphylococcus aureus
QAAFEKLDFMVVQDEFLTFT

SEQ ID NO: 1649571 - protein, 20 aa, Staphylococcus aureus
QAKVASLVTAFARVRQDKEP

SEQ ID NO: 1649572 - protein, 29 aa, Staphylococcus aureus
QARAKVKHLRKSPCYNFELEVIAKNENND

SEQ ID NO: 1649573 - protein, 18 aa, Staphylococcus aureus
QASSLAMAIYFQDMNDDE

SEQ ID NO: 1649574 - protein, 17 aa, Staphylococcus aureus
QEVEFLLTLSEDLKRAK

SEQ ID NO: 1649575 - protein, 17 aa, Staphylococcus aureus
QEYKAMGKIDFQLTPMN

SEQ ID NO: 1649576 - protein, 24 aa, Staphylococcus aureus
QFAKREVYSHYALSDIPLPKKTKF

SEQ ID NO: 1649577 - protein, 24 aa, Staphylococcus aureus
QGTLIKKQVMMRGFLVSEFANAFK

SEQ ID NO: 1649578 - protein, 23 aa, Staphylococcus aureus
QKVKVHLKPSVQLIANVVQTKTL

SEQ ID NO: 1649579 - protein, 19 aa, Staphylococcus aureus
QSEFVKEAIVVPVYKNDKV

SEQ ID NO: 1649580 - protein, 17 aa, Staphylococcus aureus
RAFKSVDTPAIFMDHGK

SEQ ID NO: 1649581 - protein, 17 aa, Staphylococcus aureus
REEEIDYAIKHNIPVSI

SEQ ID NO: 1649582 - protein, 21 aa, Staphylococcus aureus
RFESAVGFVHLGLGYAIIPRF

SEQ ID NO: 1649583 - protein, 25 aa, Staphylococcus aureus
RFLEAYCERHHIDLHIKKLDLSHSL

SEQ ID NO: 1649584 - protein, 36 aa, Staphylococcus aureus
RISRETLEIYAPLAHRLGINTIKWELEDTALRYIDN

SEQ ID NO: 1649585 - protein, 21 aa, Staphylococcus aureus
RKIIEGFKHLTPNTNHYRTVM

SEQ ID NO: 1649586 - protein, 20 aa, Staphylococcus aureus
RKKYEMPIIMLTAKDSEIDK

SEQ ID NO: 1649587 - protein, 20 aa, Staphylococcus aureus
RRDGYKPNIEQLMALAEETN

SEQ ID NO: 1649588 - protein, 19 aa, Staphylococcus aureus
RRILLSSLPGAAVKYIEIE

SEQ ID NO: 1649589 - protein, 20 aa, Staphylococcus aureus
RRSLQIYGFSPCHEISIMLA

SEQ ID NO: 1649590 - protein, 22 aa, Staphylococcus aureus
RYKTDASFWKAVYNSILNKLEN

SEQ ID NO: 1649591 - protein, 19 aa, Staphylococcus aureus
SFTTYTITTVWGLGYKFER

SEQ ID NO: 1649592 - protein, 21 aa, Staphylococcus aureus
SGYAAFVVFNMMFGGDPSSVL

SEQ ID NO: 1649593 - protein, 17 aa, Staphylococcus aureus
SIEEARFLEAYCERHHI

SEQ ID NO: 1649594 - protein, 22 aa, Staphylococcus aureus
SIGVKCPKCNDGDVVERKSKKN

SEQ ID NO: 1649595 - protein, 25 aa, Staphylococcus aureus
SLLSKLLVRATKKWPTDKSFNNHLA

SEQ ID NO: 1649596 - protein, 28 aa, Staphylococcus aureus
SNINATVIKPSFFMDNFLRIAKVEDERI

SEQ ID NO: 1649597 - protein, 24 aa, Staphylococcus aureus
SNSFNISTTVAFVVASAGVKVIKH

SEQ ID NO: 1649598 - protein, 18 aa, Staphylococcus aureus
SQHPRLILQSNIQTENLR

SEQ ID NO: 1649599 - protein, 26 aa, Staphylococcus aureus
SQNAVLFFDEIHQIIGSGATGSDSGS

SEQ ID NO: 1649600 - protein, 20 aa, Staphylococcus aureus
SVKCCFDYLNNIIMMNQNKS

SEQ ID NO: 1649601 - protein, 23 aa, Staphylococcus aureus
TDAIRILVDRVWPRGISKRTANL

SEQ ID NO: 1649602 - protein, 26 aa, Staphylococcus aureus
TFVPSICYNESMGPIQTCDTCTVEID

SEQ ID NO: 1649603 - protein, 25 aa, Staphylococcus aureus
TIDNFRWAGVPFYIRTGKRMKSKTI

SEQ ID NO: 1649604 - protein, 17 aa, Staphylococcus aureus
TIIKPGLQASVVRVEGT

SEQ ID NO: 1649605 - protein, 19 aa, Staphylococcus aureus
TKFGIPSYYVIASSEASSN

SEQ ID NO: 1649606 - protein, 26 aa, Staphylococcus aureus
TKKPVIFRATPQWFASISKVRQDILD

SEQ ID NO: 1649607 - protein, 17 aa, Staphylococcus aureus
TLINLLIEQDILPSSPV

SEQ ID NO: 1649608 - protein, 25 aa, Staphylococcus aureus
TLKFMLKVFLDLKFVTQEDGLIRIN

SEQ ID NO: 1649609 - protein, 19 aa, Staphylococcus aureus
TNEPTRVGYKFVDGKKVRI

SEQ ID NO: 1649610 - protein, 32 aa, Staphylococcus aureus
TPFPRISYDDAIEFLKAEGFDDIEWGEDFGAP

SEQ ID NO: 1649611 - protein, 18 aa, Staphylococcus aureus
TRSGKIMRRVLKAWELNL

SEQ ID NO: 1649612 - protein, 20 aa, Staphylococcus aureus
TRVGYKFVDGKKVRIAKKSG

SEQ ID NO: 1649613 - protein, 23 aa, Staphylococcus aureus
TSARLHPWLLKIYEKRGYEIYSE

SEQ ID NO: 1649614 - protein, 32 aa, Staphylococcus aureus
TSDLISRYAGIRVPRNKAIVGQNAFSHESGIH

SEQ ID NO: 1649615 - protein, 30 aa, Staphylococcus aureus
TVASCAHMMIWEGIELIPVVSSNKKTVGVI

SEQ ID NO: 1649616 - protein, 19 aa, Staphylococcus aureus
TVFCYGLMVNYCLQAADIL

SEQ ID NO: 1649617 - protein, 26 aa, Staphylococcus aureus
TVKAEGFNHVIARHYAIRNALRSALK

SEQ ID NO: 1649618 - protein, 21 aa, Staphylococcus aureus
TVNRNDIFGVIGYSGAGKSTL

SEQ ID NO: 1649619 - protein, 23 aa, Staphylococcus aureus
VASEIMAILCLSRSIKDLKDKIS

SEQ ID NO: 1649620 - protein, 17 aa, Staphylococcus aureus
VATKAWFNTYLNIYAAT

SEQ ID NO: 1649621 - protein, 17 aa, Staphylococcus aureus
VDTPAIFMDHGKGSKIY

SEQ ID NO: 1649622 - protein, 24 aa, Staphylococcus aureus
VEIKWQIPEIEPQYVLEYQESKQD

SEQ ID NO: 1649623 - protein, 23 aa, Staphylococcus aureus
VELLNLGGGFGIKYVEGDESFPI

SEQ ID NO: 1649624 - protein, 20 aa, Staphylococcus aureus
VIQPGVRVIVPFGPRTIQGY

SEQ ID NO: 1649625 - protein, 18 aa, Staphylococcus aureus
VKEGSLYPLSYYDGDWYG

SEQ ID NO: 1649626 - protein, 21 aa, Staphylococcus aureus
VKELNRLLGKVIHAFDETKEK

SEQ ID NO: 1649627 - protein, 25 aa, Staphylococcus aureus
VKYAESFGAKGLRVTNQEELEAAIK

SEQ ID NO: 1649628 - protein, 22 aa, Staphylococcus aureus
VLASRLGGYAVDLLMQGETAKG

SEQ ID NO: 1649629 - protein, 29 aa, Staphylococcus aureus
VLKENVTTVLGFKSIRQGESITEMQQPFS

SEQ ID NO: 1649630 - protein, 25 aa, Staphylococcus aureus
VLMAVRIAYFKVHHPLYYYASYFTI

SEQ ID NO: 1649631 - protein, 20 aa, Staphylococcus aureus
VPEFGTGFVRQMLEDTKPTT

SEQ ID NO: 1649632 - protein, 17 aa, Staphylococcus aureus
VPGRTMPNFAIVERDYT

SEQ ID NO: 1649633 - protein, 21 aa, Staphylococcus aureus
VPMEPGCYLMKDRNDQVIYVG

SEQ ID NO: 1649634 - protein, 23 aa, Staphylococcus aureus
VPSIQAFHVNKCRFANRCNKKLD

SEQ ID NO: 1649635 - protein, 26 aa, Staphylococcus aureus
VRFRRSQEVIQVWHAVGAFKTVGFSR

SEQ ID NO: 1649636 - protein, 24 aa, Staphylococcus aureus
VRGVPLRLVDTAGIRETEDIVEKI

SEQ ID NO: 1649637 - protein, 17 aa, Staphylococcus aureus
VRYGGEFQLKQGFSPAF

SEQ ID NO: 1649638 - protein, 19 aa, Staphylococcus aureus
VSDEELEFITGIHDENEAI

SEQ ID NO: 1649639 - protein, 22 aa, Staphylococcus aureus
VVVLKPFRLGGIDKVQTAIDTL

SEQ ID NO: 1649640 - protein, 30 aa, Staphylococcus aureus
WEHNPRAQAFYKRHGFKVVGEHHFQTGDVT

SEQ ID NO: 1649641 - protein, 22 aa, Staphylococcus aureus
WLEVYNRNGVVTARAVISHRMP

SEQ ID NO: 1649642 - protein, 22 aa, Staphylococcus aureus
WVGTLLKMKPVLKFEDGKIIPE

SEQ ID NO: 1649643 - protein, 17 aa, Staphylococcus aureus
YDVMALVHECREAGYPC

SEQ ID NO: 1649644 - protein, 22 aa, Staphylococcus aureus
YEALVKIFYRYGEEKFSKQIAR

SEQ ID NO: 1649645 - protein, 21 aa, Staphylococcus aureus
YEWLQQSTFNFPGKEELKRMF

SEQ ID NO: 1649646 - protein, 27 aa, Staphylococcus aureus
YHTLLTIGRFPICYINIEMDPILVDVN

SEQ ID NO: 1649647 - protein, 17 aa, Staphylococcus aureus
YKAPAIFVIQNNNYAIS

SEQ ID NO: 1649648 - protein, 17 aa, Staphylococcus aureus
YLYKGLRDKSPAVRRTA

SEQ ID NO: 1649649 - protein, 26 aa, Staphylococcus aureus
YPTDNEGWAHCLTIPRVLNVENGQLK

SEQ ID NO: 1649650 - protein, 24 aa, Staphylococcus aureus
YPYFKEGLVLFTYLHLANEEKLTQ

SEQ ID NO: 1649651 - protein, 17 aa, Staphylococcus aureus
YRFFDMLQASLHPYGSW

SEQ ID NO: 1649652 - protein, 20 aa, Staphylococcus aureus
YRTAEGFEGYYMMKRMNAPF

SEQ ID NO: 1649653 - protein, 17 aa, Staphylococcus aureus
YTLLDYFGDDWLVMIDE

SEQ ID NO: 1649654 - protein, 24 aa, Staphylococcus aureus
YWDSEARGAIFGLTRGTEKEHFIR

SEQ ID NO: 1649655 - protein, 18 aa, Staphylococcus aureus
YYYNIFVQKVFLKAIDSC

SEQ ID NO: 1649656 - protein, 23 aa, Staphylococcus aureus
AAGDVKGGLQFTYISLDDYRIIK

SEQ ID NO: 1649657 - protein, 19 aa, Staphylococcus aureus
ADGAAVYLKNGINHYHSGY

SEQ ID NO: 1649658 - protein, 18 aa, Staphylococcus aureus
ADKNFPMDTYELQRELGG

SEQ ID NO: 1649659 - protein, 18 aa, Staphylococcus aureus
AGIKQLWAKLEISNDDFI

SEQ ID NO: 1649660 - protein, 31 aa, Staphylococcus aureus
AHYRSAYHILDMVFWFGNLQILAAHQYPTTA

SEQ ID NO: 1649661 - protein, 20 aa, Staphylococcus aureus
AKLGFKRVIIPKNNIGGWTY

SEQ ID NO: 1649662 - protein, 20 aa, Staphylococcus aureus
AKLVCYFFKELSKFIYKNRG

SEQ ID NO: 1649663 - protein, 19 aa, Staphylococcus aureus
ALLKLDFITHSYPHDWRTK

SEQ ID NO: 1649664 - protein, 18 aa, Staphylococcus aureus
ALSEFVVLGIDTTIPFHI

SEQ ID NO: 1649665 - protein, 24 aa, Staphylococcus aureus
ALSLNYLPSLKFDYAQNEAARLEE

SEQ ID NO: 1649666 - protein, 20 aa, Staphylococcus aureus
ANAIKRAFNPDGLNIIQNNG

SEQ ID NO: 1649667 - protein, 18 aa, Staphylococcus aureus
AQIKVIFKTVLKSADDHF

SEQ ID NO: 1649668 - protein, 22 aa, Staphylococcus aureus
ARKFMRMFFSGAVEVELDKQGR

SEQ ID NO: 1649669 - protein, 20 aa, Staphylococcus aureus
ARQTHLIGAIIPRMNSYAVD

SEQ ID NO: 1649670 - protein, 18 aa, Staphylococcus aureus
ASERICFGKFTNAGQTCV

SEQ ID NO: 1649671 - protein, 23 aa, Staphylococcus aureus
ASNRPASDLPNVFVSSKNDGDKL

SEQ ID NO: 1649672 - protein, 23 aa, Staphylococcus aureus
CMTGCPYKKVYFNWKTNKAEKCT

SEQ ID NO: 1649673 - protein, 21 aa, Staphylococcus aureus
CSTPLEYGDIFNYFVKKYSNI

SEQ ID NO: 1649674 - protein, 31 aa, Staphylococcus aureus
DEDLELLESVAFQLGSAIKRIYLTDREKEAA

SEQ ID NO: 1649675 - protein, 17 aa, Staphylococcus aureus
DNGLEVIKTEGEAFDPN

SEQ ID NO: 1649676 - protein, 26 aa, Staphylococcus aureus
DPKKRMAIEYSMPKWIIDHWATHYGL

SEQ ID NO: 1649677 - protein, 22 aa, Staphylococcus aureus
DQQEIFQLAEIVSGKNNKNLTL

SEQ ID NO: 1649678 - protein, 18 aa, Staphylococcus aureus
DRIILRMATYEILHSDTP

SEQ ID NO: 1649679 - protein, 22 aa, Staphylococcus aureus
DSDLTINEAISFIKDDNPDLDF

SEQ ID NO: 1649680 - protein, 25 aa, Staphylococcus aureus
DSEVLVCTVIGFPLGASTTATKAFE

SEQ ID NO: 1649681 - protein, 24 aa, Staphylococcus aureus
DSNAQLWLAEFAWHDTSSAHYRSA

SEQ ID NO: 1649682 - protein, 21 aa, Staphylococcus aureus
DYGTASGRVFLINTTNGQVVS

SEQ ID NO: 1649683 - protein, 27 aa, Staphylococcus aureus
DYIVSSYPVWFPKDEVEEIIKDMIELI

SEQ ID NO: 1649684 - protein, 28 aa, Staphylococcus aureus
DYKKGDVVVGMLPWRIINHVQADQITKV

SEQ ID NO: 1649685 - protein, 24 aa, Staphylococcus aureus
EAALKAGITLFQFREKGESALKGN

SEQ ID NO: 1649686 - protein, 19 aa, Staphylococcus aureus
EENDKIYGFIVVDQDQAEW

SEQ ID NO: 1649687 - protein, 19 aa, Staphylococcus aureus
EFRRKSFKSFSDGIRKYQH

SEQ ID NO: 1649688 - protein, 23 aa, Staphylococcus aureus
EKKPHIMPVWSIKNRALKVRDED

SEQ ID NO: 1649689 - protein, 17 aa, Staphylococcus aureus
EKVEAVAISGSLPKGLN

SEQ ID NO: 1649690 - protein, 18 aa, Staphylococcus aureus
ENGEALEISQLLKESSSG

SEQ ID NO: 1649691 - protein, 20 aa, Staphylococcus aureus
ENKGKVVLVTAMSPTPAGEG

SEQ ID NO: 1649692 - protein, 19 aa, Staphylococcus aureus
EPLTFPLIALIVSGGHTEL

SEQ ID NO: 1649693 - protein, 24 aa, Staphylococcus aureus
ESDILCPFHYFGVTDYVHQGIKED

SEQ ID NO: 1649694 - protein, 24 aa, Staphylococcus aureus
EVLLEARVSVFERRGNYQIYVNKM

SEQ ID NO: 1649695 - protein, 18 aa, Staphylococcus aureus
EVLSERFVNYFKHHQMEV

SEQ ID NO: 1649696 - protein, 18 aa, Staphylococcus aureus
FAIYYPVESALIIETDTP

SEQ ID NO: 1649697 - protein, 19 aa, Staphylococcus aureus
FARVFRKHLEGGIIESIKQ

SEQ ID NO: 1649698 - protein, 20 aa, Staphylococcus aureus
FDGYSDFKSYLKFESNKTHQ

SEQ ID NO: 1649699 - protein, 31 aa, Staphylococcus aureus
FEPESSQALGFGYRTGFLGMLHMEIIQERIE

SEQ ID NO: 1649700 - protein, 25 aa, Staphylococcus aureus
FHWYVKGPNFFSLHVKFEELYNEAS

SEQ ID NO: 1649701 - protein, 22 aa, Staphylococcus aureus
FINERIIPIIPQQGSLGASGDL

SEQ ID NO: 1649702 - protein, 17 aa, Staphylococcus aureus
FLQKLNGGMGILLGGVP

SEQ ID NO: 1649703 - protein, 17 aa, Staphylococcus aureus
FMFFMSVVMTLLSRYAR

SEQ ID NO: 1649704 - protein, 19 aa, Staphylococcus aureus
FNQPIKLKIVLIHSKLSRT

SEQ ID NO: 1649705 - protein, 26 aa, Staphylococcus aureus
FRAKQIFEWLYQKRVDSIDEMTNLSK

SEQ ID NO: 1649706 - protein, 18 aa, Staphylococcus aureus
GDGSYRGAQRISEECKEI

SEQ ID NO: 1649707 - protein, 17 aa, Staphylococcus aureus
GDRRVLCAMSGGVDSSV

SEQ ID NO: 1649708 - protein, 20 aa, Staphylococcus aureus
GDYCGYSFAFEVTKNNTKLA

SEQ ID NO: 1649709 - protein, 20 aa, Staphylococcus aureus
GEAIKAYLTIAPKNTVLITD

SEQ ID NO: 1649710 - protein, 26 aa, Staphylococcus aureus
GFQTHLKWGAQKEVIKLIPGLENVDI

SEQ ID NO: 1649711 - protein, 17 aa, Staphylococcus aureus
GLDEAGYYNIPIMSYGV

SEQ ID NO: 1649712 - protein, 24 aa, Staphylococcus aureus
GLGQMLLKYGINYASHTCDVMSLE

SEQ ID NO: 1649713 - protein, 27 aa, Staphylococcus aureus
GNTEAMIKYLLPKATVVTPNLFEAGQL

SEQ ID NO: 1649714 - protein, 19 aa, Staphylococcus aureus
GSFLLSESGYKIFVHESER

SEQ ID NO: 1649715 - protein, 19 aa, Staphylococcus aureus
GTESIDFIQEIKKKYSSIK

SEQ ID NO: 1649716 - protein, 20 aa, Staphylococcus aureus
HGDTELAVWSQANVAGISVY

SEQ ID NO: 1649717 - protein, 21 aa, Staphylococcus aureus
HGKEAFKQAIVDFYQRQYNVT

SEQ ID NO: 1649718 - protein, 21 aa, Staphylococcus aureus
HILEGLRIALDHIDEIISTIR

SEQ ID NO: 1649719 - protein, 26 aa, Staphylococcus aureus
HSYRELPIRIAELGTMHRYEASGAVS

SEQ ID NO: 1649720 - protein, 17 aa, Staphylococcus aureus
IAACLLTEARIFKFYKY

SEQ ID NO: 1649721 - protein, 21 aa, Staphylococcus aureus
IEDIYQLPGHVFIFGGQTLFE

SEQ ID NO: 1649722 - protein, 18 aa, Staphylococcus aureus
IGEHGDTELAVWSQANVA

SEQ ID NO: 1649723 - protein, 22 aa, Staphylococcus aureus
IGNMIIDAFILRDPGNYKDVID

SEQ ID NO: 1649724 - protein, 26 aa, Staphylococcus aureus
INPDIILRLPHGMPEEVKKMFQKEFK

SEQ ID NO: 1649725 - protein, 26 aa, Staphylococcus aureus
IPVPGSTLPSVIGWRTIDDTEQMMNI

SEQ ID NO: 1649726 - protein, 24 aa, Staphylococcus aureus
ISQRELAEAIGLSRPSVANIISGL

SEQ ID NO: 1649727 - protein, 32 aa, Staphylococcus aureus
IVAEGPGSYTGLRIGVTVAKTLAYALDVKLYG

SEQ ID NO: 1649728 - protein, 25 aa, Staphylococcus aureus
IVVGNTYGRIRAMVNDLGQRIKTAG

SEQ ID NO: 1649729 - protein, 24 aa, Staphylococcus aureus
IYIKDGFIVYKGVRIINTEDLVLP

SEQ ID NO: 1649730 - protein, 20 aa, Staphylococcus aureus
KDEVEEIIKDMIELILEEKK

SEQ ID NO: 1649731 - protein, 24 aa, Staphylococcus aureus
KDLESRIAKALPNVDRYDIVSKSI

SEQ ID NO: 1649732 - protein, 17 aa, Staphylococcus aureus
KELKRLGINATIRREQG

SEQ ID NO: 1649733 - protein, 20 aa, Staphylococcus aureus
KERLSHLDVDFKFNREEETL

SEQ ID NO: 1649734 - protein, 25 aa, Staphylococcus aureus
KGDKCKVSIRFRGRAITHKEIGQRV

SEQ ID NO: 1649735 - protein, 23 aa, Staphylococcus aureus
KGTFSYLACRQYFSENEATFQPK

SEQ ID NO: 1649736 - protein, 26 aa, Staphylococcus aureus
KLRKLNLKWYAVPIISNMDLKIGGIV

SEQ ID NO: 1649737 - protein, 18 aa, Staphylococcus aureus
KLWLHIKLDTGMGRLGIK

SEQ ID NO: 1649738 - protein, 24 aa, Staphylococcus aureus
KNGKKRISHQMDMLFTHFGISGPA

SEQ ID NO: 1649739 - protein, 18 aa, Staphylococcus aureus
KPGVGYPKRWEDQEHYKG

SEQ ID NO: 1649740 - protein, 19 aa, Staphylococcus aureus
KPNFSRIAQIASYVNPNYA

SEQ ID NO: 1649741 - protein, 24 aa, Staphylococcus aureus
KQNDIWKHFKAVKNNHVYDLEEVP

SEQ ID NO: 1649742 - protein, 21 aa, Staphylococcus aureus
KRAQSFGMKILAFDPYLTDEK

SEQ ID NO: 1649743 - protein, 26 aa, Staphylococcus aureus
KRMQGYNVLHPMGWDAFGLPAEQYAL

SEQ ID NO: 1649744 - protein, 21 aa, Staphylococcus aureus
KRSIDSSKVYQLRQQRMDVEK

SEQ ID NO: 1649745 - protein, 18 aa, Staphylococcus aureus
KSSMFVAHIMNVDRHDHV

SEQ ID NO: 1649746 - protein, 17 aa, Staphylococcus aureus
LADKICIMSEGKVVQFD

SEQ ID NO: 1649747 - protein, 19 aa, Staphylococcus aureus
LDGAPAYFSNLPVKAMTQS

SEQ ID NO: 1649748 - protein, 22 aa, Staphylococcus aureus
LDIQSGEFIAFIGTSGSGKTTA

SEQ ID NO: 1649749 - protein, 17 aa, Staphylococcus aureus
LDYDMINDLGFEIDYDT

SEQ ID NO: 1649750 - protein, 21 aa, Staphylococcus aureus
LGCRKLIDYEGIFAGGSTGSI

SEQ ID NO: 1649751 - protein, 18 aa, Staphylococcus aureus
LGKYWASLGDVFVNDAFG

SEQ ID NO: 1649752 - protein, 27 aa, Staphylococcus aureus
LKFGPDFVPNVKLQWLAIDKDKVETTV

SEQ ID NO: 1649753 - protein, 18 aa, Staphylococcus aureus
LKGGDPAIFGRVQEEVDT

SEQ ID NO: 1649754 - protein, 22 aa, Staphylococcus aureus
LKLKMKEAFVEKAVAINDISDE

SEQ ID NO: 1649755 - protein, 18 aa, Staphylococcus aureus
LKSLRQEIQMIFQDPFAS

SEQ ID NO: 1649756 - protein, 22 aa, Staphylococcus aureus
LLIKGHNAYGYLKAEKGVHRLV

SEQ ID NO: 1649757 - protein, 17 aa, Staphylococcus aureus
LNAPFTYDAEISNIFYD

SEQ ID NO: 1649758 - protein, 20 aa, Staphylococcus aureus
LNERFIITRGLDKCLFGYTL

SEQ ID NO: 1649759 - protein, 19 aa, Staphylococcus aureus
LPLEIYVELVYSIQQEMVY

SEQ ID NO: 1649760 - protein, 22 aa, Staphylococcus aureus
LQQYTCSFVGHFSAGKSTLINL

SEQ ID NO: 1649761 - protein, 27 aa, Staphylococcus aureus
LRDKTWSVHVPRRIKEIGPRIKKVSDE

SEQ ID NO: 1649762 - protein, 19 aa, Staphylococcus aureus
LRDLWQQKMLRDNPELSID

SEQ ID NO: 1649763 - protein, 17 aa, Staphylococcus aureus
LTHHIVRKSLTYLEEHI

SEQ ID NO: 1649764 - protein, 17 aa, Staphylococcus aureus
LTTHIDLIRGGNTHHEI

SEQ ID NO: 1649765 - protein, 26 aa, Staphylococcus aureus
LVKKEGLKGGGYYVEYRTDDARLTIE

SEQ ID NO: 1649766 - protein, 27 aa, Staphylococcus aureus
LVWATAAPGWQKWVWSPFLSVLGSGAT

SEQ ID NO: 1649767 - protein, 21 aa, Staphylococcus aureus
LYIAALKLGVAIIPCSEMLRT

SEQ ID NO: 1649768 - protein, 17 aa, Staphylococcus aureus
MCGWPYEYSNHKQVSKT

SEQ ID NO: 1649769 - protein, 17 aa, Staphylococcus aureus
MEGLLQLVNPKIISQSN

SEQ ID NO: 1649770 - protein, 19 aa, Staphylococcus aureus
MFDYSACKYPIGVVEDEIY

SEQ ID NO: 1649771 - protein, 19 aa, Staphylococcus aureus
MHIGHIKSIMELLKQNHIE

SEQ ID NO: 1649772 - protein, 17 aa, Staphylococcus aureus
MINDLGFEIDYDTCENK

SEQ ID NO: 1649773 - protein, 20 aa, Staphylococcus aureus
MIPVHPWQFEHVIQVDLAEE

SEQ ID NO: 1649774 - protein, 19 aa, Staphylococcus aureus
MSFDTMVLFGDHAASPHGT

SEQ ID NO: 1649775 - protein, 24 aa, Staphylococcus aureus
NDLKGAGFELGIATGRPYTETVVP

SEQ ID NO: 1649776 - protein, 21 aa, Staphylococcus aureus
NDSRDSFPLLTKVLDANDKLS

SEQ ID NO: 1649777 - protein, 18 aa, Staphylococcus aureus
NETIRIDWDREHPRVIWD

SEQ ID NO: 1649778 - protein, 35 aa, Staphylococcus aureus
NETNAMPGFTAFSMYPKLWENMGLSYPELITKLIE

SEQ ID NO: 1649779 - protein, 19 aa, Staphylococcus aureus
NFIGHTFAVYDGRKHVPVY

SEQ ID NO: 1649780 - protein, 23 aa, Staphylococcus aureus
NGQFKHMHRHSATIVGGALTLAD

SEQ ID NO: 1649781 - protein, 26 aa, Staphylococcus aureus
NIWFEREAKDLLPEGFTHPGSPNGTF

SEQ ID NO: 1649782 - protein, 23 aa, Staphylococcus aureus
NLDKGVAFGAMFSDSEDLMHQKN

SEQ ID NO: 1649783 - protein, 24 aa, Staphylococcus aureus
NLFSAVKIYGTFKHMHVRMMPAQQ

SEQ ID NO: 1649784 - protein, 24 aa, Staphylococcus aureus
NNISPCSGVICGMGESNQDIVDMA

SEQ ID NO: 1649785 - protein, 26 aa, Staphylococcus aureus
NVNKSLKGLDGFVVKGKRDRMYIELE

SEQ ID NO: 1649786 - protein, 19 aa, Staphylococcus aureus
PETLPVLNGVLDYRRQITN

SEQ ID NO: 1649787 - protein, 18 aa, Staphylococcus aureus
PTKLYVKPVLALKKEVSI

SEQ ID NO: 1649788 - protein, 21 aa, Staphylococcus aureus
PYIMKKLNAPFTYDAEISNIF

SEQ ID NO: 1649789 - protein, 18 aa, Staphylococcus aureus
PYNLKWSKGAYFNAKIDG

SEQ ID NO: 1649790 - protein, 21 aa, Staphylococcus aureus
QADGHTGVIAFEVKNTESAKQ

SEQ ID NO: 1649791 - protein, 17 aa, Staphylococcus aureus
QIHAGGRGKAGGVKIAK

SEQ ID NO: 1649792 - protein, 24 aa, Staphylococcus aureus
QKKHPKVLILMGVPGSYLVATDKS

SEQ ID NO: 1649793 - protein, 21 aa, Staphylococcus aureus
QLDFLLPERFDLTYIGQDGEH

SEQ ID NO: 1649794 - protein, 24 aa, Staphylococcus aureus
QNHIECFIHIDLIKGLSHDEFASE

SEQ ID NO: 1649795 - protein, 24 aa, Staphylococcus aureus
QYEANQLLKMFVSTMETRLNDHNK

SEQ ID NO: 1649796 - protein, 18 aa, Staphylococcus aureus
RDLDIFITHFKQIKDDYH

SEQ ID NO: 1649797 - protein, 18 aa, Staphylococcus aureus
RIHLKPTQLVGGYAQISY

SEQ ID NO: 1649798 - protein, 22 aa, Staphylococcus aureus
RKLYPESKIYVFGKTDYKLSHF

SEQ ID NO: 1649799 - protein, 25 aa, Staphylococcus aureus
RLNYKSEAYVGVWTEESVAVSFLTS

SEQ ID NO: 1649800 - protein, 20 aa, Staphylococcus aureus
RNQHQRFLIVFSDGEPSAFN

SEQ ID NO: 1649801 - protein, 20 aa, Staphylococcus aureus
RRVTFEYGLFGGVNDQLEHA

SEQ ID NO: 1649802 - protein, 21 aa, Staphylococcus aureus
RSRLMPINRAYNVEKLIEAIQ

SEQ ID NO: 1649803 - protein, 25 aa, Staphylococcus aureus
SAASSCYIISLAATLERAKFTDISI

SEQ ID NO: 1649804 - protein, 24 aa, Staphylococcus aureus
SEPIKRIANHRVLAVNRGEKEKVL

SEQ ID NO: 1649805 - protein, 18 aa, Staphylococcus aureus
SGATAFVFNGRFSPETYL

SEQ ID NO: 1649806 - protein, 18 aa, Staphylococcus aureus
SGKTMIFDAMTYALFGKA

SEQ ID NO: 1649807 - protein, 18 aa, Staphylococcus aureus
SGYRSYHVIIEYPIETLQ

SEQ ID NO: 1649808 - protein, 19 aa, Staphylococcus aureus
SHAFLLPLMQLIDSEIKEP

SEQ ID NO: 1649809 - protein, 17 aa, Staphylococcus aureus
SIVKYDVAFGLENHAVP

SEQ ID NO: 1649810 - protein, 21 aa, Staphylococcus aureus
SKCVYVKWNPYSYTYAKQHQI

SEQ ID NO: 1649811 - protein, 24 aa, Staphylococcus aureus
SKFIYKNRGVFILVDPYLIENLRD

SEQ ID NO: 1649812 - protein, 28 aa, Staphylococcus aureus
SKGYNMSGFRVGFAVGNKDMIQALKKYQ

SEQ ID NO: 1649813 - protein, 18 aa, Staphylococcus aureus
SLSARGVKFYEGIKLSEN

SEQ ID NO: 1649814 - protein, 25 aa, Staphylococcus aureus
SQGLLEGFKNLGFDTYFAVPKTPEE

SEQ ID NO: 1649815 - protein, 19 aa, Staphylococcus aureus
SRGSFPQDVNFYINKETGI

SEQ ID NO: 1649816 - protein, 23 aa, Staphylococcus aureus
SSILKFPGVLIRTSTERPEVLDK

SEQ ID NO: 1649817 - protein, 17 aa, Staphylococcus aureus
TDYKMCVLLDMHIGHIK

SEQ ID NO: 1649818 - protein, 26 aa, Staphylococcus aureus
TIHGKELESIFGLSRRQLGYRIQKIN

SEQ ID NO: 1649819 - protein, 29 aa, Staphylococcus aureus
TKFKHEVQCVICLPAALLNENSDAIRLSC

SEQ ID NO: 1649820 - protein, 20 aa, Staphylococcus aureus
TKLPPTPIFHKNHETGKEDF

SEQ ID NO: 1649821 - protein, 24 aa, Staphylococcus aureus
TNSTRAIHVLKHFDRIEDVVVKVI

SEQ ID NO: 1649822 - protein, 27 aa, Staphylococcus aureus
TRAEWLMLDVFQWTRTDFVVHMHDDMP

SEQ ID NO: 1649823 - protein, 20 aa, Staphylococcus aureus
TRPLSATKRFRLVEIVEESV

SEQ ID NO: 1649824 - protein, 24 aa, Staphylococcus aureus
TSRLLSTRLEQVFSEIERITQASV

SEQ ID NO: 1649825 - protein, 21 aa, Staphylococcus aureus
TYKLEAFRGKVILVVNTATEC

SEQ ID NO: 1649826 - protein, 18 aa, Staphylococcus aureus
VDELTSALISKGYKAEGL

SEQ ID NO: 1649827 - protein, 18 aa, Staphylococcus aureus
VDYIYWLLEIRMWGNAKD

SEQ ID NO: 1649828 - protein, 22 aa, Staphylococcus aureus
VEERSAVSIGRRVQDPLSELVK

SEQ ID NO: 1649829 - protein, 18 aa, Staphylococcus aureus
VENAKCISIGVATDNALV

SEQ ID NO: 1649830 - protein, 24 aa, Staphylococcus aureus
VFNYFKPKFMLGMTATPERSDELS

SEQ ID NO: 1649831 - protein, 23 aa, Staphylococcus aureus
VLAEALINEGFRIVSGGTDNHLV

SEQ ID NO: 1649832 - protein, 28 aa, Staphylococcus aureus
VNAKGRLPDCLVEWSAKRLKEQGANAVK

SEQ ID NO: 1649833 - protein, 19 aa, Staphylococcus aureus
VQEAAKLGFKRVIIPKNNI

SEQ ID NO: 1649834 - protein, 20 aa, Staphylococcus aureus
VSPRPIPGVKGGIHHITGVE

SEQ ID NO: 1649835 - protein, 25 aa, Staphylococcus aureus
VSTLNRITSAFVRLQYNIDTLHVTH

SEQ ID NO: 1649836 - protein, 23 aa, Staphylococcus aureus
VVMKEGHGAYLYDVDGNKFIDYL

SEQ ID NO: 1649837 - protein, 21 aa, Staphylococcus aureus
VYELPLAEVVFDFFDQLKSNT

SEQ ID NO: 1649838 - protein, 19 aa, Staphylococcus aureus
YDLDLAKKHNIVISNVPSY

SEQ ID NO: 1649839 - protein, 25 aa, Staphylococcus aureus
YDVMQRLKFHYYFIDIENSKTATHL

SEQ ID NO: 1649840 - protein, 24 aa, Staphylococcus aureus
YEQGFKNICLRTNDIEAVKNKLQS

SEQ ID NO: 1649841 - protein, 18 aa, Staphylococcus aureus
YGNYLGEVNLTFEAHKVV

SEQ ID NO: 1649842 - protein, 31 aa, Staphylococcus aureus
YKLAIEYKLAFPLHPEFRTMPMVWYCPPLSP

SEQ ID NO: 1649843 - protein, 17 aa, Staphylococcus aureus
YKNFEDEIEIDFTDSNH

SEQ ID NO: 1649844 - protein, 19 aa, Staphylococcus aureus
YKSEPGLLQAIQFLDDYYH

SEQ ID NO: 1649845 - protein, 17 aa, Staphylococcus aureus
YLHPHLEPILKNTYGVI

SEQ ID NO: 1649846 - protein, 21 aa, Staphylococcus aureus
YMDFTEIVPISALEGLNVDHF

SEQ ID NO: 1649847 - protein, 18 aa, Staphylococcus aureus
YNQYMGAYHLQWHMIKYA

SEQ ID NO: 1649848 - protein, 17 aa, Staphylococcus aureus
YRVKSLTTIASKKDDLI

SEQ ID NO: 1649849 - protein, 26 aa, Staphylococcus aureus
YSDFERWSFHLQIYFLAERFKEQKRM

SEQ ID NO: 1649850 - protein, 24 aa, Staphylococcus aureus
YSMGGRVALYYAINGHIPISNLIL

SEQ ID NO: 1649851 - protein, 17 aa, Staphylococcus aureus
AALTRRFNEVLVNEPSA

SEQ ID NO: 1649852 - protein, 17 aa, Staphylococcus aureus
ADTGISFVVGESDDPMK

SEQ ID NO: 1649853 - protein, 21 aa, Staphylococcus aureus
AERAGLGFVGRNGFVINPKLG

SEQ ID NO: 1649854 - protein, 26 aa, Staphylococcus aureus
AGIRHFGENRLEGFFQKKEALPSDAV

SEQ ID NO: 1649855 - protein, 18 aa, Staphylococcus aureus
AIFKAFSRALGIALTATD

SEQ ID NO: 1649856 - protein, 26 aa, Staphylococcus aureus
AIKKGWPSMMYRIWKNPEKYKSYFIG

SEQ ID NO: 1649857 - protein, 17 aa, Staphylococcus aureus
AKIKVVLNGAGAAGIAI

SEQ ID NO: 1649858 - protein, 17 aa, Staphylococcus aureus
ALNNPFLSPTRRDKLQK

SEQ ID NO: 1649859 - protein, 18 aa, Staphylococcus aureus
ALTFSYLTSHDVLGSIIV

SEQ ID NO: 1649860 - protein, 17 aa, Staphylococcus aureus
APIAPHIGEELWSKLGH

SEQ ID NO: 1649861 - protein, 23 aa, Staphylococcus aureus
AQHGIKAIIQPGGSIKDQDSIDM

SEQ ID NO: 1649862 - protein, 26 aa, Staphylococcus aureus
DASAALKICNYCFEHGVVIIAVAGNV

SEQ ID NO: 1649863 - protein, 19 aa, Staphylococcus aureus
DGIICYIQFQMKYLADKFD

SEQ ID NO: 1649864 - protein, 21 aa, Staphylococcus aureus
DLKPIKGDNIFVWQGDITTLK

SEQ ID NO: 1649865 - protein, 17 aa, Staphylococcus aureus
EFVDEAVDRACYLLQTY

SEQ ID NO: 1649866 - protein, 17 aa, Staphylococcus aureus
EGLKQLVQCGANIVGLN

SEQ ID NO: 1649867 - protein, 26 aa, Staphylococcus aureus
EIDAALWGARAAYIGGFDSTSNVRAG

SEQ ID NO: 1649868 - protein, 18 aa, Staphylococcus aureus
EIEDQFLNQEINGVTIDS

SEQ ID NO: 1649869 - protein, 18 aa, Staphylococcus aureus
EKNFKTFLSQYLPAQPGD

SEQ ID NO: 1649870 - protein, 19 aa, Staphylococcus aureus
EMNYSKVLVITEDWCGDAM

SEQ ID NO: 1649871 - protein, 24 aa, Staphylococcus aureus
ENINIPAQIFVEFDAASQGLGILL

SEQ ID NO: 1649872 - protein, 23 aa, Staphylococcus aureus
ENLKKYKHYVFFGNDKVFKNGKG

SEQ ID NO: 1649873 - protein, 19 aa, Staphylococcus aureus
EPDLHFTIIDFNQELLCIY

SEQ ID NO: 1649874 - protein, 19 aa, Staphylococcus aureus
EPFMYKLVDIVADIMEPYY

SEQ ID NO: 1649875 - protein, 22 aa, Staphylococcus aureus
EQKGVAVVICPNDLLTEKIKDT

SEQ ID NO: 1649876 - protein, 22 aa, Staphylococcus aureus
ERPESLFNYFKQLFAQVTNPPI

SEQ ID NO: 1649877 - protein, 19 aa, Staphylococcus aureus
ETGFSNYLEVELSNDSDSV

SEQ ID NO: 1649878 - protein, 19 aa, Staphylococcus aureus
FDFSAVPFKQVYKNEQDVV

SEQ ID NO: 1649879 - protein, 29 aa, Staphylococcus aureus
FGEVGRALYNFIWDDFCDWYIEMSKIPMN

SEQ ID NO: 1649880 - protein, 22 aa, Staphylococcus aureus
FIEMAKIPVIHSLPAKTILPDD

SEQ ID NO: 1649881 - protein, 20 aa, Staphylococcus aureus
FIENRMGGFFGVKKSKNPNA

SEQ ID NO: 1649882 - protein, 25 aa, Staphylococcus aureus
FKDRIWGGHALKAFNYDIPNETTGE

SEQ ID NO: 1649883 - protein, 21 aa, Staphylococcus aureus
FKLVATELLWFIKGDTNIQYL

SEQ ID NO: 1649884 - protein, 19 aa, Staphylococcus aureus
FKQLFRVLEDTFARPLSPY

SEQ ID NO: 1649885 - protein, 27 aa, Staphylococcus aureus
FNGLKRVIDFIEHFGFSESDLEYLKSI

SEQ ID NO: 1649886 - protein, 17 aa, Staphylococcus aureus
FNTLFEAIDKLAIDTDI

SEQ ID NO: 1649887 - protein, 21 aa, Staphylococcus aureus
FRKHLEGGIIESIKQIGNDRR

SEQ ID NO: 1649888 - protein, 17 aa, Staphylococcus aureus
FRTMPMVWYCPPLSPIM

SEQ ID NO: 1649889 - protein, 26 aa, Staphylococcus aureus
GESGCGKSTLASLVLGLFKPVKGEIY

SEQ ID NO: 1649890 - protein, 20 aa, Staphylococcus aureus
GIESVRWTGRIEQVHDKPLI

SEQ ID NO: 1649891 - protein, 38 aa, Staphylococcus aureus
GIFDRYPKLNMIIGHWGEFIPFFLERMDEALFAEHLNH

SEQ ID NO: 1649892 - protein, 27 aa, Staphylococcus aureus
GIKQSKHIGGFPVSGLFLRCTNQEVID

SEQ ID NO: 1649893 - protein, 18 aa, Staphylococcus aureus
GKTLAKYAASTGQHVAVI

SEQ ID NO: 1649894 - protein, 24 aa, Staphylococcus aureus
GRERKGVCSVHFAERIKPGDIVPI

SEQ ID NO: 1649895 - protein, 24 aa, Staphylococcus aureus
GYSGEILQGLIFVSSKKEAYDLAD

SEQ ID NO: 1649896 - protein, 18 aa, Staphylococcus aureus
GYTATDIISRYKRMQGYN

SEQ ID NO: 1649897 - protein, 22 aa, Staphylococcus aureus
HLANPKLPFGGVGASGMGRYHG

SEQ ID NO: 1649898 - protein, 26 aa, Staphylococcus aureus
HTIMRKRLDMLAAFIESKVPDVEIKS

SEQ ID NO: 1649899 - protein, 18 aa, Staphylococcus aureus
IANTVAFLASDKAKYITG

SEQ ID NO: 1649900 - protein, 29 aa, Staphylococcus aureus
IAQTCYQFNVPFVVVRAVSDLANGEAEMS

SEQ ID NO: 1649901 - protein, 30 aa, Staphylococcus aureus
IEREKMSFGVINILLQFVMLKEDMKLPKAY

SEQ ID NO: 1649902 - protein, 25 aa, Staphylococcus aureus
IERKGLKLVGGKLMQVPMELAETHY

SEQ ID NO: 1649903 - protein, 19 aa, Staphylococcus aureus
IFCEADDWKPFYEAYGSQF

SEQ ID NO: 1649904 - protein, 18 aa, Staphylococcus aureus
IIIDAIGQLIGMRASSDF

SEQ ID NO: 1649905 - protein, 19 aa, Staphylococcus aureus
IIKFARSFADVNVGEPLVY

SEQ ID NO: 1649906 - protein, 25 aa, Staphylococcus aureus
IKNGKAELLAPMSAIAGQRSAIMGA

SEQ ID NO: 1649907 - protein, 19 aa, Staphylococcus aureus
ILVNMFLYLPNFFQNQNSE

SEQ ID NO: 1649908 - protein, 18 aa, Staphylococcus aureus
IMMPRSIATYELYIAALK

SEQ ID NO: 1649909 - protein, 18 aa, Staphylococcus aureus
IQVPGAFPKFGTTDGTIT

SEQ ID NO: 1649910 - protein, 23 aa, Staphylococcus aureus
IQYIVGFASFYGRTFDVNSNCLI

SEQ ID NO: 1649911 - protein, 26 aa, Staphylococcus aureus
KATKPTRIKLKWTPQIMHQIRVLREL

SEQ ID NO: 1649912 - protein, 18 aa, Staphylococcus aureus
KEITSLKMGNIEDQVEEI

SEQ ID NO: 1649913 - protein, 20 aa, Staphylococcus aureus
KKETVDFYLAKGVVDRVSEK

SEQ ID NO: 1649914 - protein, 29 aa, Staphylococcus aureus
KKFFRPEFLNRFNGIVEFLHLDKDALQDI

SEQ ID NO: 1649915 - protein, 22 aa, Staphylococcus aureus
KKFYALDMFPYPSGAGLHVGHP

SEQ ID NO: 1649916 - protein, 19 aa, Staphylococcus aureus
KLFKGNAIVNGRKSPYTLY

SEQ ID NO: 1649917 - protein, 19 aa, Staphylococcus aureus
KLTDCADLVLLTTDQSRNT

SEQ ID NO: 1649918 - protein, 35 aa, Staphylococcus aureus
KNQFPWVVAAFPSKAWAKRVYPELSVEEAYIKFID

SEQ ID NO: 1649919 - protein, 17 aa, Staphylococcus aureus
KNQLPMVGTISLVPQIV

SEQ ID NO: 1649920 - protein, 25 aa, Staphylococcus aureus
KRWTPEYKQTLMLSRIQSTQALYEL

SEQ ID NO: 1649921 - protein, 18 aa, Staphylococcus aureus
KWANGLPLTDKRISPING

SEQ ID NO: 1649922 - protein, 20 aa, Staphylococcus aureus
LENGLRLFIIPKPGFQKTFV

SEQ ID NO: 1649923 - protein, 23 aa, Staphylococcus aureus
LIDKALKLISEFNLLKENGIIVC

SEQ ID NO: 1649924 - protein, 19 aa, Staphylococcus aureus
LKSLEIVHGNNLVVTIYHQ

SEQ ID NO: 1649925 - protein, 25 aa, Staphylococcus aureus
LPDAVTRFRQGLGRLIRNENDRGII

SEQ ID NO: 1649926 - protein, 18 aa, Staphylococcus aureus
LQESTGLEAMTIHRLIGW

SEQ ID NO: 1649927 - protein, 20 aa, Staphylococcus aureus
LYNMVRVLVAFLIEVGKGRH

SEQ ID NO: 1649928 - protein, 23 aa, Staphylococcus aureus
MDQFSFKVAQSLINNDGPAIEYT

SEQ ID NO: 1649929 - protein, 23 aa, Staphylococcus aureus
MGGLQERIWNPLQILNDFGTDVF

SEQ ID NO: 1649930 - protein, 19 aa, Staphylococcus aureus
MIISGLWTHFGYADEFDVS

SEQ ID NO: 1649931 - protein, 22 aa, Staphylococcus aureus
MLSTSKMEGFGLAILESLSVGT

SEQ ID NO: 1649932 - protein, 31 aa, Staphylococcus aureus
MMGAMLGRFKKCVIGLPGGCPLGPRPIDQHI

SEQ ID NO: 1649933 - protein, 19 aa, Staphylococcus aureus
NDIPMWLRECITSVNEEYQ

SEQ ID NO: 1649934 - protein, 26 aa, Staphylococcus aureus
NEDIPFSGAFSIEFRLSKQTITCTDY

SEQ ID NO: 1649935 - protein, 34 aa, Staphylococcus aureus
NKLKSLGLNSNWDMLFIVFSIHLIDILKKLSHDE

SEQ ID NO: 1649936 - protein, 23 aa, Staphylococcus aureus
NMAEKILPLPHIIDIPKRVFAKL

SEQ ID NO: 1649937 - protein, 23 aa, Staphylococcus aureus
NNRIKRYIAKYTINPAITHGISE

SEQ ID NO: 1649938 - protein, 17 aa, Staphylococcus aureus
NRPEVRNAFTPKTVAEM

SEQ ID NO: 1649939 - protein, 22 aa, Staphylococcus aureus
NRPKWMHHALKMYQIAPRFFER

SEQ ID NO: 1649940 - protein, 23 aa, Staphylococcus aureus
PAKLRWDNYYGCTHFIRPKYKSE

SEQ ID NO: 1649941 - protein, 23 aa, Staphylococcus aureus
PEKWKEFEVIKRQKAIEIANAML

SEQ ID NO: 1649942 - protein, 23 aa, Staphylococcus aureus
PEVEFKRTYVCEDMSKCICLYNA

SEQ ID NO: 1649943 - protein, 22 aa, Staphylococcus aureus
PKAVTHCHGWGFAHLQMAPKHW

SEQ ID NO: 1649944 - protein, 22 aa, Staphylococcus aureus
PKNPLCLFCPVQENCEAFDKGT

SEQ ID NO: 1649945 - protein, 25 aa, Staphylococcus aureus
PTTKFKTTTIVFKFMAPLEYDTITA

SEQ ID NO: 1649946 - protein, 21 aa, Staphylococcus aureus
PYANEIMIYQSMLDAVQLYPK

SEQ ID NO: 1649947 - protein, 20 aa, Staphylococcus aureus
PYMNSRKFELLIANIEQLSV

SEQ ID NO: 1649948 - protein, 38 aa, Staphylococcus aureus
QDELFDDVCAFMVNEGHISTSLIQRHFQIGYNRAARII

SEQ ID NO: 1649949 - protein, 18 aa, Staphylococcus aureus
QEIILRPVDEVKVLLNDL

SEQ ID NO: 1649950 - protein, 17 aa, Staphylococcus aureus
QQDEWHEFIAPNIRSKS

SEQ ID NO: 1649951 - protein, 21 aa, Staphylococcus aureus
QRTAAARAFVHKPQIIFADEP

SEQ ID NO: 1649952 - protein, 20 aa, Staphylococcus aureus
QSWIPCEIEDQFLNQEINGV

SEQ ID NO: 1649953 - protein, 21 aa, Staphylococcus aureus
QTKEGLKTGFVDIVVGTHKLL

SEQ ID NO: 1649954 - protein, 17 aa, Staphylococcus aureus
QYVESLIYGTILDAKAS

SEQ ID NO: 1649955 - protein, 18 aa, Staphylococcus aureus
RDTLLPAIGQGALGIECR

SEQ ID NO: 1649956 - protein, 19 aa, Staphylococcus aureus
RGSGKICLNGAASRLVEVG

SEQ ID NO: 1649957 - protein, 20 aa, Staphylococcus aureus
RKLGKYPPYYYLINFTISHK

SEQ ID NO: 1649958 - protein, 19 aa, Staphylococcus aureus
RNMAVFSMSVVSKLTDLTP

SEQ ID NO: 1649959 - protein, 18 aa, Staphylococcus aureus
RNPYSVILLDEVEKAHTD

SEQ ID NO: 1649960 - protein, 24 aa, Staphylococcus aureus
RRNRSKVRLALKRGTTVERSDREG

SEQ ID NO: 1649961 - protein, 25 aa, Staphylococcus aureus
RTADGEPVVYCLDKIAKKELTCTEY

SEQ ID NO: 1649962 - protein, 31 aa, Staphylococcus aureus
RVGAAKIALERAIEINDHVALVSDGFFPMGD

SEQ ID NO: 1649963 - protein, 17 aa, Staphylococcus aureus
RVIGFENQLPWHLPNDL

SEQ ID NO: 1649964 - protein, 26 aa, Staphylococcus aureus
SEVADELYHLFVLMHALGVDFSEIEA

SEQ ID NO: 1649965 - protein, 19 aa, Staphylococcus aureus
SIATYELYIAALKLGVAII

SEQ ID NO: 1649966 - protein, 28 aa, Staphylococcus aureus
SNIVYIRWFEDLRTAFINQHMNYSTMIN

SEQ ID NO: 1649967 - protein, 19 aa, Staphylococcus aureus
SPEQWYSMIEDFKVTIWYT

SEQ ID NO: 1649968 - protein, 24 aa, Staphylococcus aureus
SYQPKHLVIVGGGYIALEFASMFA

SEQ ID NO: 1649969 - protein, 25 aa, Staphylococcus aureus
THDPVAASFAERVIMLKDGQIHTQL

SEQ ID NO: 1649970 - protein, 24 aa, Staphylococcus aureus
TMILHEFLPFIEIKQVPSSSANYD

SEQ ID NO: 1649971 - protein, 18 aa, Staphylococcus aureus
TSHLNKSLVHKITNVLKD

SEQ ID NO: 1649972 - protein, 22 aa, Staphylococcus aureus
TVSELYAPISGKVVEVNEELED

SEQ ID NO: 1649973 - protein, 18 aa, Staphylococcus aureus
VAEIRRGLDEAGYYNIPI

SEQ ID NO: 1649974 - protein, 19 aa, Staphylococcus aureus
VFEIIDGWCRIYWNNHNEW

SEQ ID NO: 1649975 - protein, 25 aa, Staphylococcus aureus
VKVAQEAFESWSLTSKSERAQMLRD

SEQ ID NO: 1649976 - protein, 18 aa, Staphylococcus aureus
VMATITFQNLFKLFESFS

SEQ ID NO: 1649977 - protein, 21 aa, Staphylococcus aureus
VTEIPHAWMMIEVDATNLVNT

SEQ ID NO: 1649978 - protein, 27 aa, Staphylococcus aureus
VTEKPKPWDVYAFPYYYVYNDFSDHYP

SEQ ID NO: 1649979 - protein, 26 aa, Staphylococcus aureus
VVLIHGFKNYVALLFHKGAILEDKYH

SEQ ID NO: 1649980 - protein, 22 aa, Staphylococcus aureus
WTKQFLAVAIRPMIHMLYYHGI

SEQ ID NO: 1649981 - protein, 22 aa, Staphylococcus aureus
WVIKGSKEYLIPYIADVVKEVD

SEQ ID NO: 1649982 - protein, 17 aa, Staphylococcus aureus
WYAEKDFASLLHEDLKI

SEQ ID NO: 1649983 - protein, 18 aa, Staphylococcus aureus
YAEYCFKEFPEVKYWTTF

SEQ ID NO: 1649984 - protein, 28 aa, Staphylococcus aureus
YIVITTEYYWHWDLKNSKLDVFDYKKLM

SEQ ID NO: 1649985 - protein, 18 aa, Staphylococcus aureus
YKYLRALIFNETELEEAY

SEQ ID NO: 1649986 - protein, 18 aa, Staphylococcus aureus
YYGGEVIKGDKVMHGKVD

SEQ ID NO: 1649987 - protein, 21 aa, Staphylococcus aureus
ADPAIDIGMLLYNYVPQQQWS

SEQ ID NO: 1649988 - protein, 17 aa, Staphylococcus aureus
ALNIPIEDFHLIKEIIS

SEQ ID NO: 1649989 - protein, 23 aa, Staphylococcus aureus
APGDFEKRVTFGLTGSDANDGII

SEQ ID NO: 1649990 - protein, 35 aa, Staphylococcus aureus
AREASWRVLGMYPKEVQLIGAIVLHEGNIAEMQTG

SEQ ID NO: 1649991 - protein, 20 aa, Staphylococcus aureus
AYGIMKGVRAVRVHNVELNA

SEQ ID NO: 1649992 - protein, 19 aa, Staphylococcus aureus
CPLENGLEIFVGVPSERYP

SEQ ID NO: 1649993 - protein, 17 aa, Staphylococcus aureus
CTIQRRMQKLVEEAPSP

SEQ ID NO: 1649994 - protein, 22 aa, Staphylococcus aureus
DALRKKVKLMKMSIDELGPVNL

SEQ ID NO: 1649995 - protein, 24 aa, Staphylococcus aureus
DEKYKEALEIIATKFGLTVNEDLQ

SEQ ID NO: 1649996 - protein, 25 aa, Staphylococcus aureus
DLVNMFKGFVFKVNGTLPIDKAFVT

SEQ ID NO: 1649997 - protein, 17 aa, Staphylococcus aureus
DPLEIVQTISRNHCAYP

SEQ ID NO: 1649998 - protein, 24 aa, Staphylococcus aureus
DRDYEFAKKFDLPIIEVIEGGNVE

SEQ ID NO: 1649999 - protein, 23 aa, Staphylococcus aureus
DVVIGIRPGRSFDKAKEDGFDVF

SEQ ID NO: 1650000 - protein, 18 aa, Staphylococcus aureus
EAKLNKRGIFTIGDLAKY

SEQ ID NO: 1650001 - protein, 19 aa, Staphylococcus aureus
EAVKKLKPTHVLSVSTIKD

SEQ ID NO: 1650002 - protein, 18 aa, Staphylococcus aureus
EFMFNGKHVLIVYDDLTK

SEQ ID NO: 1650003 - protein, 20 aa, Staphylococcus aureus
EFNKVLKNVCIKIMHNDIKN

SEQ ID NO: 1650004 - protein, 19 aa, Staphylococcus aureus
EPPDNAWDFFEFLEDDNAP

SEQ ID NO: 1650005 - protein, 17 aa, Staphylococcus aureus
ESDLLPNQFVLIATGSS

SEQ ID NO: 1650006 - protein, 22 aa, Staphylococcus aureus
ESKRTAFDFRFEDLFSKEEWLS

SEQ ID NO: 1650007 - protein, 19 aa, Staphylococcus aureus
EVKTLRILHFVSGDGGKLK

SEQ ID NO: 1650008 - protein, 17 aa, Staphylococcus aureus
EVRAWTFKQGMTAPQCA

SEQ ID NO: 1650009 - protein, 19 aa, Staphylococcus aureus
FKIDFERLARYCEKNNAVV

SEQ ID NO: 1650010 - protein, 20 aa, Staphylococcus aureus
FPYYYVYNDFSDHYPIKAYS

SEQ ID NO: 1650011 - protein, 17 aa, Staphylococcus aureus
FQFCDSQFPTGAFSHSF

SEQ ID NO: 1650012 - protein, 18 aa, Staphylococcus aureus
GGIRCEKFSGWLLKEGFE

SEQ ID NO: 1650013 - protein, 19 aa, Staphylococcus aureus
GGVDRGALILLKHQIIPFF

SEQ ID NO: 1650014 - protein, 23 aa, Staphylococcus aureus
GIIDRVDHRYVYVNLGRIEAVLS

SEQ ID NO: 1650015 - protein, 20 aa, Staphylococcus aureus
GKTTLLDSIRHTKVTAGEAG

SEQ ID NO: 1650016 - protein, 18 aa, Staphylococcus aureus
GMLDAAVCGEVFTSPTPD

SEQ ID NO: 1650017 - protein, 29 aa, Staphylococcus aureus
GVVSINAFKGVSFGEGFKAAEKPGSEIQD

SEQ ID NO: 1650018 - protein, 20 aa, Staphylococcus aureus
HGADTLRLYEMFMGPLDAAI

SEQ ID NO: 1650019 - protein, 17 aa, Staphylococcus aureus
IASCCGKSREFYFQNDA

SEQ ID NO: 1650020 - protein, 20 aa, Staphylococcus aureus
IASGGELSRIMLALKSIFVK

SEQ ID NO: 1650021 - protein, 17 aa, Staphylococcus aureus
IDIPEVNQVVMLRPTES

SEQ ID NO: 1650022 - protein, 26 aa, Staphylococcus aureus
IEIGYLPGRLKWLVADLLTKQGLKVV

SEQ ID NO: 1650023 - protein, 21 aa, Staphylococcus aureus
IKEDLPLLSCIEPNDTFDFQK

SEQ ID NO: 1650024 - protein, 17 aa, Staphylococcus aureus
INKLMALIERTTTVNDI

SEQ ID NO: 1650025 - protein, 21 aa, Staphylococcus aureus
IPYHKGFYRAFSKLHTTTFKY

SEQ ID NO: 1650026 - protein, 24 aa, Staphylococcus aureus
ISKELRDKYEWNPSLLSKIDNYLK

SEQ ID NO: 1650027 - protein, 19 aa, Staphylococcus aureus
KALEHLGFGALELGGITPK

SEQ ID NO: 1650028 - protein, 20 aa, Staphylococcus aureus
KESLGFDRDTNWLSVLPIYH

SEQ ID NO: 1650029 - protein, 20 aa, Staphylococcus aureus
KMVRSLREMRIRGVKTNIPF

SEQ ID NO: 1650030 - protein, 18 aa, Staphylococcus aureus
KYDDLGKMYQIVRQYELG

SEQ ID NO: 1650031 - protein, 24 aa, Staphylococcus aureus
LAAMIEGCYVLRAIEMVEEGYEPQ

SEQ ID NO: 1650032 - protein, 29 aa, Staphylococcus aureus
LDNNIPMGRGMIKWAPFATLPEQFETIQQ

SEQ ID NO: 1650033 - protein, 17 aa, Staphylococcus aureus
LEIVQTISRNHCAYPNH

SEQ ID NO: 1650034 - protein, 17 aa, Staphylococcus aureus
LEPEIEFKAKVKMPTDF

SEQ ID NO: 1650035 - protein, 26 aa, Staphylococcus aureus
LGYASAEALKALGYKVYIGSRNDVRG

SEQ ID NO: 1650036 - protein, 17 aa, Staphylococcus aureus
LKGNDKLVLAKELQHLC

SEQ ID NO: 1650037 - protein, 17 aa, Staphylococcus aureus
LLKQSGIFRENEHVDER

SEQ ID NO: 1650038 - protein, 20 aa, Staphylococcus aureus
LLQASWKIAPALATGCSLVM

SEQ ID NO: 1650039 - protein, 25 aa, Staphylococcus aureus
LMNEKDIRAVLGRFLFVQDDVKKII

SEQ ID NO: 1650040 - protein, 30 aa, Staphylococcus aureus
LNEKVINMFSFFIAYHFNKLDIGIERIFIQ

SEQ ID NO: 1650041 - protein, 20 aa, Staphylococcus aureus
LRKPDWLKIKLNTNENYTGL

SEQ ID NO: 1650042 - protein, 23 aa, Staphylococcus aureus
LTEGCICCAMKADVSEQLHQLYL

SEQ ID NO: 1650043 - protein, 19 aa, Staphylococcus aureus
LVYYREVVKHHQLKVNAFE

SEQ ID NO: 1650044 - protein, 17 aa, Staphylococcus aureus
LYYTRNKLLSVEECTSC

SEQ ID NO: 1650045 - protein, 22 aa, Staphylococcus aureus
MFENLSRYRAIIVSTEQQKLDV

SEQ ID NO: 1650046 - protein, 24 aa, Staphylococcus aureus
MIGVLKAGGAYVPIDPNYPSDRQE

SEQ ID NO: 1650047 - protein, 33 aa, Staphylococcus aureus
MNRAMPLLKTFRLENELKVFPSHFSKGMKQKVM

SEQ ID NO: 1650048 - protein, 22 aa, Staphylococcus aureus
MPKWIIDHWATHYGLEETETIL

SEQ ID NO: 1650049 - protein, 18 aa, Staphylococcus aureus
MYMVKKLDAGNIISQQAI

SEQ ID NO: 1650050 - protein, 19 aa, Staphylococcus aureus
NEIMSFLIELNRQGKTIIM

SEQ ID NO: 1650051 - protein, 19 aa, Staphylococcus aureus
NKKVLLVMGGSLGSKKLNS

SEQ ID NO: 1650052 - protein, 19 aa, Staphylococcus aureus
NLDPSILLAPWNVIEERLK

SEQ ID NO: 1650053 - protein, 25 aa, Staphylococcus aureus
NTFDWKDVEQAFSWSETGKMNMAYE

SEQ ID NO: 1650054 - protein, 23 aa, Staphylococcus aureus
PAVEAGESLGFLPGDLKEKVDPY

SEQ ID NO: 1650055 - protein, 19 aa, Staphylococcus aureus
PKEEMKVVTEVAPTDEQWE

SEQ ID NO: 1650056 - protein, 20 aa, Staphylococcus aureus
QAEVRQTFKVSKVGTIAGCY

SEQ ID NO: 1650057 - protein, 26 aa, Staphylococcus aureus
QVNMTFKPLHIFSDLSSKMFTWNNGE

SEQ ID NO: 1650058 - protein, 24 aa, Staphylococcus aureus
RDMNRLRPFGTDFSRPIFEMDDLS

SEQ ID NO: 1650059 - protein, 20 aa, Staphylococcus aureus
REDAVWDLTQVFADFAEGDF

SEQ ID NO: 1650060 - protein, 22 aa, Staphylococcus aureus
RIQKINLWLEQEGYPKLERTSQ

SEQ ID NO: 1650061 - protein, 20 aa, Staphylococcus aureus
RKINWKSLYEKALNHDFAEV

SEQ ID NO: 1650062 - protein, 17 aa, Staphylococcus aureus
RKNEHVEIAMAQSDAMH

SEQ ID NO: 1650063 - protein, 18 aa, Staphylococcus aureus
RLGINATIRREQGSDIDA

SEQ ID NO: 1650064 - protein, 19 aa, Staphylococcus aureus
RLTNNITWADNRAAKYATV

SEQ ID NO: 1650065 - protein, 18 aa, Staphylococcus aureus
RRKDLIISGGENIYPYQI

SEQ ID NO: 1650066 - protein, 17 aa, Staphylococcus aureus
SCAGMFTANSMNCLMEV

SEQ ID NO: 1650067 - protein, 27 aa, Staphylococcus aureus
SDMERLIRLPGKFKYFEHNVAAHSFKV

SEQ ID NO: 1650068 - protein, 21 aa, Staphylococcus aureus
SGKARSQMALDVFASKIHKYI

SEQ ID NO: 1650069 - protein, 23 aa, Staphylococcus aureus
SLAGFKYNLARQMLNIGSTLTIS

SEQ ID NO: 1650070 - protein, 23 aa, Staphylococcus aureus
SSLGLEPWKFVVIQDQALRDELK

SEQ ID NO: 1650071 - protein, 24 aa, Staphylococcus aureus
TCGDRIRLTFDIEDGIIKDAKFEG

SEQ ID NO: 1650072 - protein, 30 aa, Staphylococcus aureus
TDDVKRRHIRHCYKADPEYGKGVAKALGID

SEQ ID NO: 1650073 - protein, 27 aa, Staphylococcus aureus
TEFEIITAMMFLYFGEIHPVDFVIVEA

SEQ ID NO: 1650074 - protein, 26 aa, Staphylococcus aureus
TFVDAFNFVCTFLAKAIARDGEGATK

SEQ ID NO: 1650075 - protein, 19 aa, Staphylococcus aureus
TKLNFLWVTDWPLLEYDED

SEQ ID NO: 1650076 - protein, 26 aa, Staphylococcus aureus
TRIDNKLIKIGVFGTFSAGKSSLINA

SEQ ID NO: 1650077 - protein, 25 aa, Staphylococcus aureus
VDYLNRYRILQSLQLLDRHYKHYEI

SEQ ID NO: 1650078 - protein, 17 aa, Staphylococcus aureus
VEELGGLAVIGTERHES

SEQ ID NO: 1650079 - protein, 20 aa, Staphylococcus aureus
VFFGSALANFGVQNFLNAYV

SEQ ID NO: 1650080 - protein, 19 aa, Staphylococcus aureus
VKHQYGHAFYDSASDQDIF

SEQ ID NO: 1650081 - protein, 21 aa, Staphylococcus aureus
VRRLYEGKVLAGFAGSVADAF

SEQ ID NO: 1650082 - protein, 18 aa, Staphylococcus aureus
VTIASVLVLNPEIIILDE

SEQ ID NO: 1650083 - protein, 26 aa, Staphylococcus aureus
VYMRLRRVGNKFSIKTWKFDHIKDPD

SEQ ID NO: 1650084 - protein, 34 aa, Staphylococcus aureus
WIHERTKFGIKPGVKRMEWMLAQFNNPQNNIKGI

SEQ ID NO: 1650085 - protein, 19 aa, Staphylococcus aureus
YGVDFGTGYALEFTGETIK

SEQ ID NO: 1650086 - protein, 21 aa, Staphylococcus aureus
YNLTYPQFLVLTILWDESPVN

SEQ ID NO: 1650087 - protein, 19 aa, Staphylococcus aureus
YVGLKTGRDGIHGATFASE

SEQ ID NO: 1650088 - protein, 21 aa, Staphylococcus aureus
AEQHYAPVLTHFLDPRGQYIL

SEQ ID NO: 1650089 - protein, 17 aa, Staphylococcus aureus
AETGMHFTITVKNGLTL

SEQ ID NO: 1650090 - protein, 17 aa, Staphylococcus aureus
AEVVIEVNIFDFEDNIY

SEQ ID NO: 1650091 - protein, 30 aa, Staphylococcus aureus
AKEQTALRKAYLESFRKGFKQQIENTKVID

SEQ ID NO: 1650092 - protein, 18 aa, Staphylococcus aureus
AKPPKLVTREMVKSMKKG

SEQ ID NO: 1650093 - protein, 25 aa, Staphylococcus aureus
AMGRDCGDLALWAGLSVGAETIVVP

SEQ ID NO: 1650094 - protein, 25 aa, Staphylococcus aureus
ASITNFKASKTFPLQQLSQDDVFAQ

SEQ ID NO: 1650095 - protein, 20 aa, Staphylococcus aureus
CEEDLQIFYSFIVLQNNEVY

SEQ ID NO: 1650096 - protein, 21 aa, Staphylococcus aureus
CYHYRRNNLKGAYKSFNKSKE

SEQ ID NO: 1650097 - protein, 26 aa, Staphylococcus aureus
DDQFRMIIKQLYFFSVANPNPTNWLD

SEQ ID NO: 1650098 - protein, 17 aa, Staphylococcus aureus
DEWHEFIAPNIRSKSTY

SEQ ID NO: 1650099 - protein, 30 aa, Staphylococcus aureus
DFSSYINQFEWRDAKFPVVQNVNAQGETDK

SEQ ID NO: 1650100 - protein, 21 aa, Staphylococcus aureus
DNIMRMLHPFMPFVTEKIWQS

SEQ ID NO: 1650101 - protein, 24 aa, Staphylococcus aureus
DQRREMIRQAAFKLVENIKNDLKP

SEQ ID NO: 1650102 - protein, 22 aa, Staphylococcus aureus
ECMACGYQSPKWMGKCPNCGAW

SEQ ID NO: 1650103 - protein, 24 aa, Staphylococcus aureus
EDVKRYGLNITEFAVLELLYNKGP

SEQ ID NO: 1650104 - protein, 17 aa, Staphylococcus aureus
EEFKAHLPVNENTPKLT

SEQ ID NO: 1650105 - protein, 24 aa, Staphylococcus aureus
EGKLKVSFDYIDWINTEFDQLGRE

SEQ ID NO: 1650106 - protein, 18 aa, Staphylococcus aureus
EKEMALNWGKKNNVEVTT

SEQ ID NO: 1650107 - protein, 26 aa, Staphylococcus aureus
EKSAQFYKALGFKINRNPQMLDKMVG

SEQ ID NO: 1650108 - protein, 18 aa, Staphylococcus aureus
ELEGKLHGMALRVPTKNV

SEQ ID NO: 1650109 - protein, 17 aa, Staphylococcus aureus
ESGCGKSTLGKVIIRLE

SEQ ID NO: 1650110 - protein, 20 aa, Staphylococcus aureus
EVACLNKHLHFHGTTDEFKS

SEQ ID NO: 1650111 - protein, 25 aa, Staphylococcus aureus
EVVRKSALERYEFTGDITYLNKGET

SEQ ID NO: 1650112 - protein, 18 aa, Staphylococcus aureus
FENQLPWHLPNDLKHVKK

SEQ ID NO: 1650113 - protein, 23 aa, Staphylococcus aureus
FETNKWINAYECYFKNMLGLKCE

SEQ ID NO: 1650114 - protein, 21 aa, Staphylococcus aureus
FIKSNRLKGLSLKDVELSVLK

SEQ ID NO: 1650115 - protein, 17 aa, Staphylococcus aureus
FSGLKSAVINQLHNQRQ

SEQ ID NO: 1650116 - protein, 19 aa, Staphylococcus aureus
FSRQRYWGEPIPVIHWEDG

SEQ ID NO: 1650117 - protein, 23 aa, Staphylococcus aureus
GIALSTDEKVLWVTETTANRLHR

SEQ ID NO: 1650118 - protein, 24 aa, Staphylococcus aureus
GKFYQRPASIIAIYSAKYNGYKWM

SEQ ID NO: 1650119 - protein, 17 aa, Staphylococcus aureus
GLESVQYACRMIQAGAG

SEQ ID NO: 1650120 - protein, 17 aa, Staphylococcus aureus
GNTYFDEHWLFYDLINK

SEQ ID NO: 1650121 - protein, 22 aa, Staphylococcus aureus
GYPMPSVGLGVYKISDEDMTKV

SEQ ID NO: 1650122 - protein, 24 aa, Staphylococcus aureus
GYSQHFPSVFALIGSHSEYDLHHP

SEQ ID NO: 1650123 - protein, 24 aa, Staphylococcus aureus
IDALYQFLFEFIFDIEERYIRMYV

SEQ ID NO: 1650124 - protein, 17 aa, Staphylococcus aureus
IEDVKRQLREVIERKVS

SEQ ID NO: 1650125 - protein, 17 aa, Staphylococcus aureus
IELNRQGKTIIMITHDM

SEQ ID NO: 1650126 - protein, 20 aa, Staphylococcus aureus
IGGWTYPEGIQVIGVTTVHE

SEQ ID NO: 1650127 - protein, 26 aa, Staphylococcus aureus
IKDAELRGVASSGMICSMKELNLPNA

SEQ ID NO: 1650128 - protein, 26 aa, Staphylococcus aureus
INKRRVKEWLKRTARKYGLEADDVVL

SEQ ID NO: 1650129 - protein, 18 aa, Staphylococcus aureus
IQAGLGRSGKLFATDWDN

SEQ ID NO: 1650130 - protein, 19 aa, Staphylococcus aureus
IQQQISYWLERFDITENRK

SEQ ID NO: 1650131 - protein, 20 aa, Staphylococcus aureus
IWKKEIWEDGSKWQGHQKGN

SEQ ID NO: 1650132 - protein, 18 aa, Staphylococcus aureus
IYGGPLALGLIRNKLEEH

SEQ ID NO: 1650133 - protein, 23 aa, Staphylococcus aureus
KDIPRNEIHFSYTHIAFTIDDSE

SEQ ID NO: 1650134 - protein, 22 aa, Staphylococcus aureus
KKKAAEKIGMISEIVHLEETAT

SEQ ID NO: 1650135 - protein, 17 aa, Staphylococcus aureus
KTGALLGKYNINIASMT

SEQ ID NO: 1650136 - protein, 21 aa, Staphylococcus aureus
KVDEAYNFLKQVSEDGGQVLF

SEQ ID NO: 1650137 - protein, 20 aa, Staphylococcus aureus
LAKGRPLFEAVHKAKKFISM

SEQ ID NO: 1650138 - protein, 17 aa, Staphylococcus aureus
LEKGFNIKGIKQIIYDS

SEQ ID NO: 1650139 - protein, 18 aa, Staphylococcus aureus
LELIDAIPEDENVTLYSQ

SEQ ID NO: 1650140 - protein, 18 aa, Staphylococcus aureus
LGGILIHRTPILILDEPL

SEQ ID NO: 1650141 - protein, 20 aa, Staphylococcus aureus
LRDWLFSRQRYWGEPIPVIH

SEQ ID NO: 1650142 - protein, 20 aa, Staphylococcus aureus
MFPYPSGAGLHVGHPEGYTA

SEQ ID NO: 1650143 - protein, 22 aa, Staphylococcus aureus
MGKCPNCGAWNQMEEIVEKAAN

SEQ ID NO: 1650144 - protein, 21 aa, Staphylococcus aureus
NDSIKAIILSFAYDKNKFKVI

SEQ ID NO: 1650145 - protein, 20 aa, Staphylococcus aureus
NEAQTLFFGGLARIDYVSGG

SEQ ID NO: 1650146 - protein, 17 aa, Staphylococcus aureus
NLTRVDLAFSRDQEHKE

SEQ ID NO: 1650147 - protein, 23 aa, Staphylococcus aureus
NQRSALYIKHLTAFIDQLISLEV

SEQ ID NO: 1650148 - protein, 22 aa, Staphylococcus aureus
NRNELGIALGKGERVNVGITDP

SEQ ID NO: 1650149 - protein, 22 aa, Staphylococcus aureus
NVPDYFKALVAIGTIADLVSLT

SEQ ID NO: 1650150 - protein, 24 aa, Staphylococcus aureus
PFSPREVVLRVKALLRRTQSTTVE

SEQ ID NO: 1650151 - protein, 25 aa, Staphylococcus aureus
PNFKFPMKQDIPVIMIGPGTGIAPF

SEQ ID NO: 1650152 - protein, 20 aa, Staphylococcus aureus
PQAYQILGIGPVELRVRNAA

SEQ ID NO: 1650153 - protein, 23 aa, Staphylococcus aureus
PTTSQPAIGEWITKYEMLRDQGY

SEQ ID NO: 1650154 - protein, 19 aa, Staphylococcus aureus
PTVSQGFYGAMFKDLDGHH

SEQ ID NO: 1650155 - protein, 18 aa, Staphylococcus aureus
QGILRTLFDSEKFEAIRE

SEQ ID NO: 1650156 - protein, 28 aa, Staphylococcus aureus
QHDIDYCIVVNFSSRFANVSVEDFVENY

SEQ ID NO: 1650157 - protein, 20 aa, Staphylococcus aureus
QLHSIFLEVIIAPKFTDEAL

SEQ ID NO: 1650158 - protein, 17 aa, Staphylococcus aureus
QPPMKGKQILGVDPAFR

SEQ ID NO: 1650159 - protein, 19 aa, Staphylococcus aureus
QVQFVGFVGEHSRYDLMLV

SEQ ID NO: 1650160 - protein, 20 aa, Staphylococcus aureus
QYCKHEFVLSGVRQKEFGVR

SEQ ID NO: 1650161 - protein, 17 aa, Staphylococcus aureus
RAFDMDVLYTGPNRKEE

SEQ ID NO: 1650162 - protein, 18 aa, Staphylococcus aureus
RCQDGIVLFWPIDGEIEL

SEQ ID NO: 1650163 - protein, 24 aa, Staphylococcus aureus
RDNHSAYAFIKRLIKQFGKPQKVI

SEQ ID NO: 1650164 - protein, 19 aa, Staphylococcus aureus
RIFCMTLGTGIGGAYKNNQ

SEQ ID NO: 1650165 - protein, 18 aa, Staphylococcus aureus
RIIFATFASNIYRVQQAV

SEQ ID NO: 1650166 - protein, 21 aa, Staphylococcus aureus
RLVKKGGIDQIVIESTGISEP

SEQ ID NO: 1650167 - protein, 18 aa, Staphylococcus aureus
RMICSSGNVDSNRLRTGT

SEQ ID NO: 1650168 - protein, 24 aa, Staphylococcus aureus
RNVHKSVLHALDISQQEGHFIETH

SEQ ID NO: 1650169 - protein, 20 aa, Staphylococcus aureus
RQGYGEVHHVSFRVKDHDAI

SEQ ID NO: 1650170 - protein, 23 aa, Staphylococcus aureus
RSAFYKYRETIFPVDDKMLDHRE

SEQ ID NO: 1650171 - protein, 25 aa, Staphylococcus aureus
RTVGIAISDIMGWTAQGLDTLRINE

SEQ ID NO: 1650172 - protein, 22 aa, Staphylococcus aureus
SIPLYEESYILLAPKETFKNQN

SEQ ID NO: 1650173 - protein, 25 aa, Staphylococcus aureus
SREKLKEYMEIISKYQVRTVTFADT

SEQ ID NO: 1650174 - protein, 25 aa, Staphylococcus aureus
TCGCAAGLARPAAVAVATQNEHRPT

SEQ ID NO: 1650175 - protein, 18 aa, Staphylococcus aureus
TDAIESPGVFSIKENDSI

SEQ ID NO: 1650176 - protein, 28 aa, Staphylococcus aureus
TDEVKIKVLQRLSIASGHVGMVGGQMLD

SEQ ID NO: 1650177 - protein, 25 aa, Staphylococcus aureus
TELNKRKSAVMSYEITSTDLEVTYP

SEQ ID NO: 1650178 - protein, 21 aa, Staphylococcus aureus
TLRMNYLFDFYQSLLTNKQRN

SEQ ID NO: 1650179 - protein, 19 aa, Staphylococcus aureus
TNAKFDVFEMVDGKYEIRE

SEQ ID NO: 1650180 - protein, 31 aa, Staphylococcus aureus
TYEAVEMSRKFGIEVFNVFLSQDPITEDVEQ

SEQ ID NO: 1650181 - protein, 25 aa, Staphylococcus aureus
VDVGQRGFVPASLISTDFIEDFSVF

SEQ ID NO: 1650182 - protein, 19 aa, Staphylococcus aureus
VHLVKAKRQGQSMIYSLDD

SEQ ID NO: 1650183 - protein, 18 aa, Staphylococcus aureus
VLKALNLTFEDIAYQKDK

SEQ ID NO: 1650184 - protein, 19 aa, Staphylococcus aureus
VNWHHFLRPEIKFDGIDPL

SEQ ID NO: 1650185 - protein, 20 aa, Staphylococcus aureus
VPSTISGTITEILVEAGQTV

SEQ ID NO: 1650186 - protein, 23 aa, Staphylococcus aureus
VSNERAKTLLGWEPIATQEEAIL

SEQ ID NO: 1650187 - protein, 28 aa, Staphylococcus aureus
VSRSHPGLLKRLFEQEVPEIYDGTVIVK

SEQ ID NO: 1650188 - protein, 19 aa, Staphylococcus aureus
YAKELNLKSKEIIDELKSM

SEQ ID NO: 1650189 - protein, 18 aa, Staphylococcus aureus
YALLFALSSGRTFIGQTT

SEQ ID NO: 1650190 - protein, 25 aa, Staphylococcus aureus
YNEARWILIDLADVVVHVFHKDERN

SEQ ID NO: 1650191 - protein, 25 aa, Staphylococcus aureus
YNEIHMWDYKALPAVFGGKNVEIHD

SEQ ID NO: 1650192 - protein, 24 aa, Staphylococcus aureus
AERIKPGDIVPIYLKKNPNFKFPM

SEQ ID NO: 1650193 - protein, 17 aa, Staphylococcus aureus
AGDRFVVFSDEKQARRI

SEQ ID NO: 1650194 - protein, 22 aa, Staphylococcus aureus
AGGCFWCMTKPFDTFDGIEKVT

SEQ ID NO: 1650195 - protein, 21 aa, Staphylococcus aureus
AKIMALMGLELITNQDVYQDI

SEQ ID NO: 1650196 - protein, 26 aa, Staphylococcus aureus
AKYNGYKWMEMNGLGSFNTEILPKPK

SEQ ID NO: 1650197 - protein, 17 aa, Staphylococcus aureus
ASGGVRNLEDFNKMVEA

SEQ ID NO: 1650198 - protein, 26 aa, Staphylococcus aureus
CLLTEARIFKFYKYFYSHRGPLLDYF

SEQ ID NO: 1650199 - protein, 17 aa, Staphylococcus aureus
CLNFYELIQSLIKEQEF

SEQ ID NO: 1650200 - protein, 26 aa, Staphylococcus aureus
CNEKFKKELLSAGIIDDAWLAEIEAE

SEQ ID NO: 1650201 - protein, 23 aa, Staphylococcus aureus
DAVQIVPLIIKYASELKLYGKTL

SEQ ID NO: 1650202 - protein, 19 aa, Staphylococcus aureus
DIIEYFRPGDTLVLNDTRV

SEQ ID NO: 1650203 - protein, 25 aa, Staphylococcus aureus
DNITICGMGGPLIAKILKDGQDKLS

SEQ ID NO: 1650204 - protein, 23 aa, Staphylococcus aureus
EALKKKLTEEGCFDKANKKSIPK

SEQ ID NO: 1650205 - protein, 17 aa, Staphylococcus aureus
EALSLLDKVGLKEKADV

SEQ ID NO: 1650206 - protein, 17 aa, Staphylococcus aureus
EEFFWSMMDEINEEEDF

SEQ ID NO: 1650207 - protein, 23 aa, Staphylococcus aureus
EEVWLADKRVELVTRHIINNHDK

SEQ ID NO: 1650208 - protein, 19 aa, Staphylococcus aureus
EQLVGFAFVNTTPFQRIKH

SEQ ID NO: 1650209 - protein, 17 aa, Staphylococcus aureus
FFVLIGPSGCGKTTTLK

SEQ ID NO: 1650210 - protein, 25 aa, Staphylococcus aureus
FGNTKTIWVWTGFLYEYLANDCTER

SEQ ID NO: 1650211 - protein, 17 aa, Staphylococcus aureus
FLLALYNVFIEKDCSIV

SEQ ID NO: 1650212 - protein, 20 aa, Staphylococcus aureus
FVGEHSRYDLMLVHTNRHYG

SEQ ID NO: 1650213 - protein, 17 aa, Staphylococcus aureus
FVHKPQIIFADEPTGAL

SEQ ID NO: 1650214 - protein, 25 aa, Staphylococcus aureus
GAERICKRVDCDIDYEEDAEKWMAD

SEQ ID NO: 1650215 - protein, 17 aa, Staphylococcus aureus
GALRATLDYVTERKQFG

SEQ ID NO: 1650216 - protein, 17 aa, Staphylococcus aureus
GHMGKISPFDILSVVSA

SEQ ID NO: 1650217 - protein, 20 aa, Staphylococcus aureus
GKSLAYLLAALMYNIETGKH

SEQ ID NO: 1650218 - protein, 20 aa, Staphylococcus aureus
GKSTLLKALSRLLAVKEGEV

SEQ ID NO: 1650219 - protein, 17 aa, Staphylococcus aureus
GPWHIHRMLEAAEGLPI

SEQ ID NO: 1650220 - protein, 17 aa, Staphylococcus aureus
GRKCIYVQPHSYTIENQ

SEQ ID NO: 1650221 - protein, 20 aa, Staphylococcus aureus
GYQQCPFKHYASHGLKLNER

SEQ ID NO: 1650222 - protein, 28 aa, Staphylococcus aureus
HIHRMLEAAEGLPINVGFTGKGQATNPT

SEQ ID NO: 1650223 - protein, 18 aa, Staphylococcus aureus
IDETKLNFLWVTDWPLLE

SEQ ID NO: 1650224 - protein, 21 aa, Staphylococcus aureus
IEENKYVFVLKHSETCPISAN

SEQ ID NO: 1650225 - protein, 17 aa, Staphylococcus aureus
IGNVTINGFPNVEKRPK

SEQ ID NO: 1650226 - protein, 23 aa, Staphylococcus aureus
IKVHYAGICGTDIHTYEGHYKVN

SEQ ID NO: 1650227 - protein, 19 aa, Staphylococcus aureus
IMFPLEIAGVPRRRAKQKA

SEQ ID NO: 1650228 - protein, 17 aa, Staphylococcus aureus
INLALRAQYLFESNVDY

SEQ ID NO: 1650229 - protein, 19 aa, Staphylococcus aureus
IPSVILGVGYEKIHTTNER

SEQ ID NO: 1650230 - protein, 20 aa, Staphylococcus aureus
IRVLFDEGFIALRPSGTEPK

SEQ ID NO: 1650231 - protein, 20 aa, Staphylococcus aureus
KDELREFIEMAKIPVIHSLP

SEQ ID NO: 1650232 - protein, 32 aa, Staphylococcus aureus
KEMGRPAQCVFLSWNRYLYRNAQNYITSSDYI

SEQ ID NO: 1650233 - protein, 22 aa, Staphylococcus aureus
KHLDIPAGAAVRFEPGDKKEVQ

SEQ ID NO: 1650234 - protein, 18 aa, Staphylococcus aureus
KIDFERLARYCEKHNAVV

SEQ ID NO: 1650235 - protein, 17 aa, Staphylococcus aureus
KIYAHYGKNGGYQIQQA

SEQ ID NO: 1650236 - protein, 18 aa, Staphylococcus aureus
KKAETLLTREEYAQCEDM

SEQ ID NO: 1650237 - protein, 26 aa, Staphylococcus aureus
KNNVKEVIAGFDFTFGKFGKGNMTVL

SEQ ID NO: 1650238 - protein, 24 aa, Staphylococcus aureus
KNSLFKGKEIEYGKDLVGLTRKID

SEQ ID NO: 1650239 - protein, 19 aa, Staphylococcus aureus
KSMSESKCYKNRQVFPQDT

SEQ ID NO: 1650240 - protein, 24 aa, Staphylococcus aureus
KYRFNRLKLTTIHNGIADVPAVKQ

SEQ ID NO: 1650241 - protein, 21 aa, Staphylococcus aureus
LALRAQYLFESNVDYFVYNGD

SEQ ID NO: 1650242 - protein, 21 aa, Staphylococcus aureus
LEAYPSIEIVMWDERLSTMAA

SEQ ID NO: 1650243 - protein, 27 aa, Staphylococcus aureus
LGYPFIVKTRFGGYDGKGQVLINNEKD

SEQ ID NO: 1650244 - protein, 19 aa, Staphylococcus aureus
LKSGEGIKALLKPLDLDEN

SEQ ID NO: 1650245 - protein, 19 aa, Staphylococcus aureus
LMVNYCLQAADILAADGIN

SEQ ID NO: 1650246 - protein, 24 aa, Staphylococcus aureus
LPNRTKLLGVGLWLVPKPVRNFGY

SEQ ID NO: 1650247 - protein, 18 aa, Staphylococcus aureus
LRQEIQMIFQDPFASINP

SEQ ID NO: 1650248 - protein, 19 aa, Staphylococcus aureus
LRRYNDVSPFELFVISCPL

SEQ ID NO: 1650249 - protein, 20 aa, Staphylococcus aureus
MHNRMRMVVSQFLTKDLFID

SEQ ID NO: 1650250 - protein, 19 aa, Staphylococcus aureus
MKSKTIQVVVEFKEVPMNL

SEQ ID NO: 1650251 - protein, 17 aa, Staphylococcus aureus
MREMLRSYLESMSQDFN

SEQ ID NO: 1650252 - protein, 17 aa, Staphylococcus aureus
MSRRKKTAAKKLLEVSN

SEQ ID NO: 1650253 - protein, 17 aa, Staphylococcus aureus
MVQDLGVDVIVTDHHEI

SEQ ID NO: 1650254 - protein, 18 aa, Staphylococcus aureus
NEWKMTAKELNYFINELV

SEQ ID NO: 1650255 - protein, 18 aa, Staphylococcus aureus
NMALEAFKATDCSGLVRA

SEQ ID NO: 1650256 - protein, 18 aa, Staphylococcus aureus
PIAGRRILLKEVRDSIFR

SEQ ID NO: 1650257 - protein, 24 aa, Staphylococcus aureus
PKQQLPYFISFLSFHQYSIFQVLS

SEQ ID NO: 1650258 - protein, 19 aa, Staphylococcus aureus
PLMRRDLDVLIAKLNQIDG

SEQ ID NO: 1650259 - protein, 21 aa, Staphylococcus aureus
PLPNRRNVVLTSDTSFNVEGV

SEQ ID NO: 1650260 - protein, 19 aa, Staphylococcus aureus
PLTDKRISPINGTIEGLPP

SEQ ID NO: 1650261 - protein, 21 aa, Staphylococcus aureus
PMLDILKKLDVHNACVVVTRY

SEQ ID NO: 1650262 - protein, 25 aa, Staphylococcus aureus
PYYQLCKAKGLLSIIDNTFLTPYLS

SEQ ID NO: 1650263 - protein, 17 aa, Staphylococcus aureus
QQQRTAAARAFVHKPQI

SEQ ID NO: 1650264 - protein, 25 aa, Staphylococcus aureus
QYITEDVAMAFGFFDGMHKGHDKVF

SEQ ID NO: 1650265 - protein, 23 aa, Staphylococcus aureus
RCNFRCDYCMPKEVFGDDFVFLP

SEQ ID NO: 1650266 - protein, 22 aa, Staphylococcus aureus
RDVSKRVLSHILGVELPNPSMI

SEQ ID NO: 1650267 - protein, 18 aa, Staphylococcus aureus
RKEVMKYINKESADIDKE

SEQ ID NO: 1650268 - protein, 20 aa, Staphylococcus aureus
RRPVHLHLPIDVAISEIEIP

SEQ ID NO: 1650269 - protein, 17 aa, Staphylococcus aureus
RVCPAPCESACVMKINR

SEQ ID NO: 1650270 - protein, 19 aa, Staphylococcus aureus
SESGYKIFVHESERKAEPR

SEQ ID NO: 1650271 - protein, 21 aa, Staphylococcus aureus
SIPKFPKKIAVLTASTGAAIR

SEQ ID NO: 1650272 - protein, 19 aa, Staphylococcus aureus
SKEILPYLYKGLRDKSPAV

SEQ ID NO: 1650273 - protein, 18 aa, Staphylococcus aureus
TALMLFVQRCKDMQDAGQ

SEQ ID NO: 1650274 - protein, 32 aa, Staphylococcus aureus
TDIEYKFPFGWGELWGIASRTDFDLRKHAEHS

SEQ ID NO: 1650275 - protein, 22 aa, Staphylococcus aureus
THFLDPRGQYILEVICGSYEDL

SEQ ID NO: 1650276 - protein, 23 aa, Staphylococcus aureus
TQDRVFRSLGILQNCRMITMEEA

SEQ ID NO: 1650277 - protein, 22 aa, Staphylococcus aureus
TRKLLEALILVGAFDAFGKTRS

SEQ ID NO: 1650278 - protein, 17 aa, Staphylococcus aureus
VDLAFSRDQEHKEYVQH

SEQ ID NO: 1650279 - protein, 17 aa, Staphylococcus aureus
VEKARRLAFQTEDMKRQ

SEQ ID NO: 1650280 - protein, 17 aa, Staphylococcus aureus
VYRGMGSLGAMEKGSND

SEQ ID NO: 1650281 - protein, 17 aa, Staphylococcus aureus
YKAIQLFKNNSKNKQSI

SEQ ID NO: 1650282 - protein, 21 aa, Staphylococcus aureus
YKESFEYRSLEKLAEVEQTQM

SEQ ID NO: 1650283 - protein, 19 aa, Staphylococcus aureus
YKVSWLLNDVDYCHNKVKF

SEQ ID NO: 1650284 - protein, 18 aa, Staphylococcus aureus
YKYFYSHRGPLLDYFDAK

SEQ ID NO: 1650285 - protein, 18 aa, Staphylococcus aureus
YLIEKSMDNKEVKRWEDK

SEQ ID NO: 1650286 - protein, 25 aa, Staphylococcus aureus
YQYFKKNQIIWGFLHLASSKEIVEK

SEQ ID NO: 1650287 - protein, 25 aa, Staphylococcus aureus
YYLFYLKNWNYAYAYSLKLIDAYAS

SEQ ID NO: 1650288 - protein, 19 aa, Staphylococcus aureus
YYRYLSRRIGAIVETTLSA

SEQ ID NO: 1650289 - protein, 24 aa, Staphylococcus aureus
AGQPVELCGTYVLLASEESSYTTG

SEQ ID NO: 1650290 - protein, 25 aa, Staphylococcus aureus
ALEVIPGKMSLVIADIMDETTTKDK

SEQ ID NO: 1650291 - protein, 27 aa, Staphylococcus aureus
ALPFNSRKLILRRAAQFLTYGDTISIG

SEQ ID NO: 1650292 - protein, 29 aa, Staphylococcus aureus
AQQHIAGFWQRCYQEGVIADLQLKNNGDL

SEQ ID NO: 1650293 - protein, 25 aa, Staphylococcus aureus
ASFESRSFLFKAIFNITKLLHIKRS

SEQ ID NO: 1650294 - protein, 19 aa, Staphylococcus aureus
AYQHLKSGEGIKALLKPLD

SEQ ID NO: 1650295 - protein, 17 aa, Staphylococcus aureus
CRFGTQYTTRLGIRLEK

SEQ ID NO: 1650296 - protein, 23 aa, Staphylococcus aureus
DDQNSAWMTTHFDFHSIHDNVLK

SEQ ID NO: 1650297 - protein, 23 aa, Staphylococcus aureus
DDYMKHIQNMIGYIPKSDLQVVF

SEQ ID NO: 1650298 - protein, 18 aa, Staphylococcus aureus
DGWYSLHLFYAVDWASLR

SEQ ID NO: 1650299 - protein, 23 aa, Staphylococcus aureus
DGYKFAQDLGHTITELFPTEVPI

SEQ ID NO: 1650300 - protein, 24 aa, Staphylococcus aureus
DPASLHKPKAFFGAARNIEAGGSL

SEQ ID NO: 1650301 - protein, 22 aa, Staphylococcus aureus
DSLIEGFIHWIKDEKIDWPGED

SEQ ID NO: 1650302 - protein, 18 aa, Staphylococcus aureus
EALYPPSYSSYIDFLYTC

SEQ ID NO: 1650303 - protein, 24 aa, Staphylococcus aureus
EHARDMLKRERLFFDKMQAHIGEV

SEQ ID NO: 1650304 - protein, 19 aa, Staphylococcus aureus
EINAYIPGIGHNLQEHSVV

SEQ ID NO: 1650305 - protein, 17 aa, Staphylococcus aureus
ENEAAYFTNDWTNKDID

SEQ ID NO: 1650306 - protein, 17 aa, Staphylococcus aureus
FNSLASFNTNINIIPME

SEQ ID NO: 1650307 - protein, 20 aa, Staphylococcus aureus
GEIKRVIAHLPNFESDTDTF

SEQ ID NO: 1650308 - protein, 21 aa, Staphylococcus aureus
GLKKMGYKVSWLLNDVDYCHN

SEQ ID NO: 1650309 - protein, 22 aa, Staphylococcus aureus
GSDRRSIACLTYSGHYIITPDN

SEQ ID NO: 1650310 - protein, 24 aa, Staphylococcus aureus
GSEAAYQLAERGIKVNLIEMRPVK

SEQ ID NO: 1650311 - protein, 20 aa, Staphylococcus aureus
HKEGKWTGMCGEMAGDETAI

SEQ ID NO: 1650312 - protein, 25 aa, Staphylococcus aureus
HVLIFRTKDVFPWRQHDVKLVFFLA

SEQ ID NO: 1650313 - protein, 18 aa, Staphylococcus aureus
ILLCDEATSALDPATTAS

SEQ ID NO: 1650314 - protein, 18 aa, Staphylococcus aureus
IRGLSPWPVAYTTMDDTN

SEQ ID NO: 1650315 - protein, 20 aa, Staphylococcus aureus
KIAISFREDDELIAVRLTSG

SEQ ID NO: 1650316 - protein, 18 aa, Staphylococcus aureus
KPHIVFMMTFPEDIKPII

SEQ ID NO: 1650317 - protein, 40 aa, Staphylococcus aureus
KRQSKVFRSRFRMLVEAQLDLLKNEDWDYLLNYDLDAEQV

SEQ ID NO: 1650318 - protein, 19 aa, Staphylococcus aureus
KVAELLLERAKRLVEIGED

SEQ ID NO: 1650319 - protein, 22 aa, Staphylococcus aureus
LDYRSKRKSLPFTENDENIVVL

SEQ ID NO: 1650320 - protein, 24 aa, Staphylococcus aureus
LETLARSKVDGIVLMATDITERHI

SEQ ID NO: 1650321 - protein, 22 aa, Staphylococcus aureus
LKRAGLDYWEFVNITYHDSIEA

SEQ ID NO: 1650322 - protein, 19 aa, Staphylococcus aureus
LNAFNLYGALSMANSGPNT

SEQ ID NO: 1650323 - protein, 19 aa, Staphylococcus aureus
LYDTLLMNYNFVIIDTPPV

SEQ ID NO: 1650324 - protein, 26 aa, Staphylococcus aureus
LYLSSDWFAELGFTFFNYHYTAKLIK

SEQ ID NO: 1650325 - protein, 28 aa, Staphylococcus aureus
NAKMPSQLFQFFMSYLLARFDISLATLL

SEQ ID NO: 1650326 - protein, 20 aa, Staphylococcus aureus
NCIYCYNYVIWLIQHDLPRN

SEQ ID NO: 1650327 - protein, 34 aa, Staphylococcus aureus
NHDVDMLRMCRYPWKTKQRILGDMGHVSNEDAGH

SEQ ID NO: 1650328 - protein, 28 aa, Staphylococcus aureus
NLPAEESYFLFYINRPSIIVGKNQNTIE

SEQ ID NO: 1650329 - protein, 23 aa, Staphylococcus aureus
NSMNCLMEVLGLALPYNGTALAV

SEQ ID NO: 1650330 - protein, 19 aa, Staphylococcus aureus
PHEIISIGDTVRVKHRDFN

SEQ ID NO: 1650331 - protein, 19 aa, Staphylococcus aureus
PHGVLFRGAAEGVIRRYLI

SEQ ID NO: 1650332 - protein, 28 aa, Staphylococcus aureus
PRFKVIDVIKRPLIIHGKVKDNDDIIKT

SEQ ID NO: 1650333 - protein, 23 aa, Staphylococcus aureus
QHKVWRKRVMKDMGVRKGTKALD

SEQ ID NO: 1650334 - protein, 24 aa, Staphylococcus aureus
QHLPFKKERISEVELHQYIDGLID

SEQ ID NO: 1650335 - protein, 24 aa, Staphylococcus aureus
QYRFNIMLEDIKAYLPKEKIWDVF

SEQ ID NO: 1650336 - protein, 26 aa, Staphylococcus aureus
RCAEEGIKFIGPHLEHLDMFGDKVKA

SEQ ID NO: 1650337 - protein, 18 aa, Staphylococcus aureus
RLRTGTMTEEDWSRFTIA

SEQ ID NO: 1650338 - protein, 20 aa, Staphylococcus aureus
RRFEIKRGDKVTGKVRKPKD

SEQ ID NO: 1650339 - protein, 18 aa, Staphylococcus aureus
RSWNGLIINYLSRCNDCS

SEQ ID NO: 1650340 - protein, 21 aa, Staphylococcus aureus
RTALIEKCWESENFIDDNTLA

SEQ ID NO: 1650341 - protein, 27 aa, Staphylococcus aureus
RVYLAVGGGFELDAWLGSNSTDFNVKI

SEQ ID NO: 1650342 - protein, 23 aa, Staphylococcus aureus
SDDDIFMINRFVSAVEREIGYRL

SEQ ID NO: 1650343 - protein, 18 aa, Staphylococcus aureus
SIIDGCRLSKAKIIRVNH

SEQ ID NO: 1650344 - protein, 19 aa, Staphylococcus aureus
SRYDLMLVHTNRHYGKTLV

SEQ ID NO: 1650345 - protein, 18 aa, Staphylococcus aureus
SSICKHLSIQLSENEGDI

SEQ ID NO: 1650346 - protein, 17 aa, Staphylococcus aureus
TDFMFFMSVVMTLLSRY

SEQ ID NO: 1650347 - protein, 32 aa, Staphylococcus aureus
TFGTAGIRGKFGLGEGRLNKFTIEKLALGLAR

SEQ ID NO: 1650348 - protein, 27 aa, Staphylococcus aureus
TGTMTEEDWSRFTIAVGKLSRTKIFID

SEQ ID NO: 1650349 - protein, 24 aa, Staphylococcus aureus
TLKGIECIYALYKKNRRSLQIYGF

SEQ ID NO: 1650350 - protein, 22 aa, Staphylococcus aureus
TRTELPFLVKCVQTAVDAGATV

SEQ ID NO: 1650351 - protein, 22 aa, Staphylococcus aureus
TWNLKYKQLKNINIDIPVLEEQ

SEQ ID NO: 1650352 - protein, 17 aa, Staphylococcus aureus
VDAPSYWYKNINYQHDL

SEQ ID NO: 1650353 - protein, 19 aa, Staphylococcus aureus
VGDSIRLGDTNLFAQIEKD

SEQ ID NO: 1650354 - protein, 24 aa, Staphylococcus aureus
VGGTTCKLGIFTPELEQLHKWSIH

SEQ ID NO: 1650355 - protein, 18 aa, Staphylococcus aureus
VKDAWYKQIEDLLEFAKK

SEQ ID NO: 1650356 - protein, 19 aa, Staphylococcus aureus
YDFDILVVALGFVSETFGI

SEQ ID NO: 1650357 - protein, 19 aa, Staphylococcus aureus
YFLCHDILEDAWKAENNYS

SEQ ID NO: 1650358 - protein, 18 aa, Staphylococcus aureus
YINEHGGMIIYLPQEGRG

SEQ ID NO: 1650359 - protein, 21 aa, Staphylococcus aureus
AAVRAVVRTAIYNEIEVYGVY

SEQ ID NO: 1650360 - protein, 20 aa, Staphylococcus aureus
DELQFIFFKMQKFNPEYVKL

SEQ ID NO: 1650361 - protein, 29 aa, Staphylococcus aureus
DESAKKYLWRVLVTQLKKLELNYDVYLER

SEQ ID NO: 1650362 - protein, 21 aa, Staphylococcus aureus
DFQDALGLSSADSFRDLIKVL

SEQ ID NO: 1650363 - protein, 26 aa, Staphylococcus aureus
DQHMRSRLAGYKVPRMYVPVTHMPLN

SEQ ID NO: 1650364 - protein, 18 aa, Staphylococcus aureus
DSYLEWLNQGITKESITT

SEQ ID NO: 1650365 - protein, 18 aa, Staphylococcus aureus
EATEKGFKCPNCGNDNPK

SEQ ID NO: 1650366 - protein, 17 aa, Staphylococcus aureus
EFERCINDLGFKGALIM

SEQ ID NO: 1650367 - protein, 21 aa, Staphylococcus aureus
EINLTRLSIFIFIINILNQLR

SEQ ID NO: 1650368 - protein, 26 aa, Staphylococcus aureus
EIREPCWKIQAKYNIPDLVKRMSTSG

SEQ ID NO: 1650369 - protein, 19 aa, Staphylococcus aureus
EKGFKCPNCGNDNPKTVDV

SEQ ID NO: 1650370 - protein, 21 aa, Staphylococcus aureus
ETIEYATPVSHFVKDELWDKG

SEQ ID NO: 1650371 - protein, 22 aa, Staphylococcus aureus
FEEFRPRIKAQIGGRRNGALIS

SEQ ID NO: 1650372 - protein, 19 aa, Staphylococcus aureus
FLIAKARYSRSIKGTKPIF

SEQ ID NO: 1650373 - protein, 20 aa, Staphylococcus aureus
FLSSLPVGGLGLDFVHDNGY

SEQ ID NO: 1650374 - protein, 26 aa, Staphylococcus aureus
FNKYWPADIHLMAKEIVRFHSIIWPI

SEQ ID NO: 1650375 - protein, 21 aa, Staphylococcus aureus
FPESFSTQIAHYYKNQPTITW

SEQ ID NO: 1650376 - protein, 18 aa, Staphylococcus aureus
FPKLQSIQLEDHKQHDVR

SEQ ID NO: 1650377 - protein, 19 aa, Staphylococcus aureus
GGLGLDFVHDNGYNLKQIE

SEQ ID NO: 1650378 - protein, 18 aa, Staphylococcus aureus
GKTFSKGLLMGARGNSGV

SEQ ID NO: 1650379 - protein, 23 aa, Staphylococcus aureus
GTYDICKPLTIYGNTTLLLDNET

SEQ ID NO: 1650380 - protein, 19 aa, Staphylococcus aureus
GVYICNECIELCSEIVEEE

SEQ ID NO: 1650381 - protein, 27 aa, Staphylococcus aureus
GYLPEALFNFIALLGWSPEGEEEIFSK

SEQ ID NO: 1650382 - protein, 25 aa, Staphylococcus aureus
HDGVRFKREHLSEAASHLTLKPMPE

SEQ ID NO: 1650383 - protein, 19 aa, Staphylococcus aureus
INNEFRFQILVKYKSEPGL

SEQ ID NO: 1650384 - protein, 20 aa, Staphylococcus aureus
IPGNGKFLYSPFSIFDNESI

SEQ ID NO: 1650385 - protein, 18 aa, Staphylococcus aureus
IPLYLGKTLSNVKGTWIM

SEQ ID NO: 1650386 - protein, 19 aa, Staphylococcus aureus
IRLKYRYLDLRRQELAQTF

SEQ ID NO: 1650387 - protein, 22 aa, Staphylococcus aureus
KADGKMLVIDGGFSKAYQSTTG

SEQ ID NO: 1650388 - protein, 24 aa, Staphylococcus aureus
KAQFSINLTDKWIIQIAYGKLIIM

SEQ ID NO: 1650389 - protein, 24 aa, Staphylococcus aureus
KCRPIEGWSTVAFAKDWQGPPRLQ

SEQ ID NO: 1650390 - protein, 20 aa, Staphylococcus aureus
KEIFRSMGVAVPEGRVAFTA

SEQ ID NO: 1650391 - protein, 20 aa, Staphylococcus aureus
KGKKVILLTAHRRENIGEPM

SEQ ID NO: 1650392 - protein, 18 aa, Staphylococcus aureus
KHVEHLSSYYKFKQPTLL

SEQ ID NO: 1650393 - protein, 20 aa, Staphylococcus aureus
KLALELYNSPWIAWYHQQMQ

SEQ ID NO: 1650394 - protein, 24 aa, Staphylococcus aureus
KRMTRIAQTINRFGYTIRGIYGEG

SEQ ID NO: 1650395 - protein, 22 aa, Staphylococcus aureus
KYNIPVKSILGFGDSGNDEAYL

SEQ ID NO: 1650396 - protein, 23 aa, Staphylococcus aureus
LALKEEGYRVILVNSNPATIMTD

SEQ ID NO: 1650397 - protein, 24 aa, Staphylococcus aureus
LDGDTRGGAALSIRSVTQKPIKFV

SEQ ID NO: 1650398 - protein, 27 aa, Staphylococcus aureus
LFGLGIRHLGVKASQVLAEKYETIDRL

SEQ ID NO: 1650399 - protein, 24 aa, Staphylococcus aureus
LFIGYKFKTHRMIHKFKINSQGLT

SEQ ID NO: 1650400 - protein, 18 aa, Staphylococcus aureus
LGADAIMLITPYYNKTNQ

SEQ ID NO: 1650401 - protein, 17 aa, Staphylococcus aureus
LGFPRLGRKREWKKAIE

SEQ ID NO: 1650402 - protein, 20 aa, Staphylococcus aureus
LIGAIIPRMNSYAVDETIKG

SEQ ID NO: 1650403 - protein, 18 aa, Staphylococcus aureus
LLEMIGLVAEVQELKANP

SEQ ID NO: 1650404 - protein, 18 aa, Staphylococcus aureus
LLKEAKKPVVLAGAGINQ

SEQ ID NO: 1650405 - protein, 18 aa, Staphylococcus aureus
LLLPELSGPFLSLSTIVN

SEQ ID NO: 1650406 - protein, 20 aa, Staphylococcus aureus
LSSYYKFKQPTLLYDQQIQR

SEQ ID NO: 1650407 - protein, 23 aa, Staphylococcus aureus
LWSHIRRGLVLPAIIPNRKQIIK

SEQ ID NO: 1650408 - protein, 19 aa, Staphylococcus aureus
LYNSPWIAWYHQQMQDKKA

SEQ ID NO: 1650409 - protein, 19 aa, Staphylococcus aureus
NATIAIAVGHELGLTYNTI

SEQ ID NO: 1650410 - protein, 21 aa, Staphylococcus aureus
PESQLPVLVKHALEENHATNN

SEQ ID NO: 1650411 - protein, 19 aa, Staphylococcus aureus
PKAKPFAKRGFSQRTTSTK

SEQ ID NO: 1650412 - protein, 17 aa, Staphylococcus aureus
PKEAYAYLEKLRSIIQY

SEQ ID NO: 1650413 - protein, 18 aa, Staphylococcus aureus
PSILRLVKQVIEASHKEG

SEQ ID NO: 1650414 - protein, 19 aa, Staphylococcus aureus
PYLKDWTIARLLKTDRIIL

SEQ ID NO: 1650415 - protein, 17 aa, Staphylococcus aureus
PYSGVTMGEEFMFNGKH

SEQ ID NO: 1650416 - protein, 32 aa, Staphylococcus aureus
QDMLIPWEMIPRCPKCDAPMEVNKRKAEVGMV

SEQ ID NO: 1650417 - protein, 23 aa, Staphylococcus aureus
QNLYCEASLLAKRLKAYQQSRVG

SEQ ID NO: 1650418 - protein, 17 aa, Staphylococcus aureus
QVRWMGVLNLEGKTPET

SEQ ID NO: 1650419 - protein, 25 aa, Staphylococcus aureus
QYWEKSCRYTLKFVENSNDVRIYDE

SEQ ID NO: 1650420 - protein, 23 aa, Staphylococcus aureus
SDAPIAFQEFMILPVGATTFKES

SEQ ID NO: 1650421 - protein, 18 aa, Staphylococcus aureus
SKNILDFSDYEHFALQIL

SEQ ID NO: 1650422 - protein, 18 aa, Staphylococcus aureus
SLSDSYPTLAMIYVTHFI

SEQ ID NO: 1650423 - protein, 25 aa, Staphylococcus aureus
STPSFMEMCLLLPTLNEEQYGSLNE

SEQ ID NO: 1650424 - protein, 22 aa, Staphylococcus aureus
TGKDLSVVLVDFGKKQNIVREL

SEQ ID NO: 1650425 - protein, 17 aa, Staphylococcus aureus
TKHAVGIQSEDGVDIVI

SEQ ID NO: 1650426 - protein, 18 aa, Staphylococcus aureus
TTVTYLFDMCHKVRPDNP

SEQ ID NO: 1650427 - protein, 18 aa, Staphylococcus aureus
VECAIPMIQGILGKIPFF

SEQ ID NO: 1650428 - protein, 18 aa, Staphylococcus aureus
VNEAMKLFSEPRFNVDVL

SEQ ID NO: 1650429 - protein, 17 aa, Staphylococcus aureus
VRHKERIKTLKHNVDVL

SEQ ID NO: 1650430 - protein, 17 aa, Staphylococcus aureus
VRLEVRRAEQLKQGQEI

SEQ ID NO: 1650431 - protein, 22 aa, Staphylococcus aureus
WILHIPSCYLGIAQAARNYAVD

SEQ ID NO: 1650432 - protein, 30 aa, Staphylococcus aureus
YEASLSRLGLKYLDLYLVHWPGTNEAVMVD

SEQ ID NO: 1650433 - protein, 34 aa, Staphylococcus aureus
YFCPVCGKQVILKRGLKVISHFAHKHLAEQKCFN

SEQ ID NO: 1650434 - protein, 23 aa, Staphylococcus aureus
YKATNFPDAKGWVGAGTKRGLPK

SEQ ID NO: 1650435 - protein, 19 aa, Staphylococcus aureus
YLVGLMRSVIYQFKEDELA

SEQ ID NO: 1650436 - protein, 21 aa, Staphylococcus aureus
AEKDFFIFFRNFFTKKFQREI

SEQ ID NO: 1650437 - protein, 17 aa, Staphylococcus aureus
AERLVIHGFLDPVVREL

SEQ ID NO: 1650438 - protein, 20 aa, Staphylococcus aureus
ARFTNGLSVNDFLTRNTVIH

SEQ ID NO: 1650439 - protein, 19 aa, Staphylococcus aureus
ASDGVGLGHQFLRHVERTK

SEQ ID NO: 1650440 - protein, 17 aa, Staphylococcus aureus
ASYRLYQTVKYWPKGTV

SEQ ID NO: 1650441 - protein, 20 aa, Staphylococcus aureus
CGGVSKLIQSGFETLVEAGY

SEQ ID NO: 1650442 - protein, 17 aa, Staphylococcus aureus
DENISFYKLVNKFSPEV

SEQ ID NO: 1650443 - protein, 20 aa, Staphylococcus aureus
DILSPEKELVVLTRLNEKEI

SEQ ID NO: 1650444 - protein, 22 aa, Staphylococcus aureus
DTYCGIGTIGLYMAPHAKHVYG

SEQ ID NO: 1650445 - protein, 25 aa, Staphylococcus aureus
DYLKDLGIDVIWLSPMFKSPNDDNG

SEQ ID NO: 1650446 - protein, 28 aa, Staphylococcus aureus
DYLPEIYKAVKAEVLFNKVAMRPGSVTT

SEQ ID NO: 1650447 - protein, 19 aa, Staphylococcus aureus
EELGVKFADRGLLEVDKQS

SEQ ID NO: 1650448 - protein, 25 aa, Staphylococcus aureus
EGSMLPKIEAAIRFVESGENKKVII

SEQ ID NO: 1650449 - protein, 23 aa, Staphylococcus aureus
EKDMYLKYIDIFKEASIQYLKEK

SEQ ID NO: 1650450 - protein, 23 aa, Staphylococcus aureus
ENNVRIALTEVWEKGGKGGVDLA

SEQ ID NO: 1650451 - protein, 24 aa, Staphylococcus aureus
EQSYRLVIPSIQFESNLKLICDTI

SEQ ID NO: 1650452 - protein, 21 aa, Staphylococcus aureus
ERAHLKFLSSLPVGGLGLDFV

SEQ ID NO: 1650453 - protein, 18 aa, Staphylococcus aureus
FEVPHQWQHNAYSEIPQA

SEQ ID NO: 1650454 - protein, 23 aa, Staphylococcus aureus
FIKKWQRELEALYHIKSKLNTEQ

SEQ ID NO: 1650455 - protein, 25 aa, Staphylococcus aureus
FKNVIIIEFSKFIPSMVLKRHIYKQ

SEQ ID NO: 1650456 - protein, 18 aa, Staphylococcus aureus
FLVRRSGKMYFNIKDVLD

SEQ ID NO: 1650457 - protein, 33 aa, Staphylococcus aureus
GKERMPIEVVYGFAQLKRAAALANFDLGKLSEA

SEQ ID NO: 1650458 - protein, 18 aa, Staphylococcus aureus
GKWSYLYRAIDAEGHTLD

SEQ ID NO: 1650459 - protein, 25 aa, Staphylococcus aureus
HKTPAQVVLRWHLAHNRIIIPKSQT

SEQ ID NO: 1650460 - protein, 25 aa, Staphylococcus aureus
HRIKYDMLQPNPLRQEVMRRYPQII

SEQ ID NO: 1650461 - protein, 26 aa, Staphylococcus aureus
HTRSSIGGFKGRKLLANDVITVKINN

SEQ ID NO: 1650462 - protein, 21 aa, Staphylococcus aureus
HVERVSKRLGINRWKDNVRQV

SEQ ID NO: 1650463 - protein, 25 aa, Staphylococcus aureus
HYICPNCKTSEFFNDGSVGSGFDLP

SEQ ID NO: 1650464 - protein, 18 aa, Staphylococcus aureus
IDKLDYLKDLGIDVIWLS

SEQ ID NO: 1650465 - protein, 20 aa, Staphylococcus aureus
IDPKKCIALKISEEKLNRIR

SEQ ID NO: 1650466 - protein, 18 aa, Staphylococcus aureus
IEDFHLIKEIISKKELDG

SEQ ID NO: 1650467 - protein, 25 aa, Staphylococcus aureus
IEGTLTGRVKFIFQPAEELGHGAFK

SEQ ID NO: 1650468 - protein, 17 aa, Staphylococcus aureus
IELAHRMKLGQKIDITQ

SEQ ID NO: 1650469 - protein, 18 aa, Staphylococcus aureus
IGQKRRLSVATALSSKAD

SEQ ID NO: 1650470 - protein, 18 aa, Staphylococcus aureus
ILGKIPFFGICLGHQLFA

SEQ ID NO: 1650471 - protein, 24 aa, Staphylococcus aureus
INKEMFKRQGGYGRGRRMQIEKDT

SEQ ID NO: 1650472 - protein, 18 aa, Staphylococcus aureus
ITPFETRQSPNISSQLME

SEQ ID NO: 1650473 - protein, 23 aa, Staphylococcus aureus
KAILRCDPDVILIGEIRDKDVAK

SEQ ID NO: 1650474 - protein, 18 aa, Staphylococcus aureus
KDTRVVFTAHGWAFTEGV

SEQ ID NO: 1650475 - protein, 20 aa, Staphylococcus aureus
KEIISKKELDGFNITIPHKE

SEQ ID NO: 1650476 - protein, 34 aa, Staphylococcus aureus
KESDIKIRVENVLKICGLYAFRNWPIAALSYGQK

SEQ ID NO: 1650477 - protein, 27 aa, Staphylococcus aureus
KIPFFGICLGHQLFALSQGASSFKMKF

SEQ ID NO: 1650478 - protein, 21 aa, Staphylococcus aureus
KISFNDIEFLPPVTPPNNVIA

SEQ ID NO: 1650479 - protein, 18 aa, Staphylococcus aureus
KKELDGFNITIPHKERII

SEQ ID NO: 1650480 - protein, 25 aa, Staphylococcus aureus
KLIDRSVRIIQEICAITYDEAMALY

SEQ ID NO: 1650481 - protein, 19 aa, Staphylococcus aureus
KQKSGAWLVKVKDLETNET

SEQ ID NO: 1650482 - protein, 21 aa, Staphylococcus aureus
KRQGKSYLEILEMGGGILSTV

SEQ ID NO: 1650483 - protein, 18 aa, Staphylococcus aureus
KSRRLGISLSGTGKELEK

SEQ ID NO: 1650484 - protein, 18 aa, Staphylococcus aureus
LENLKVVLEEAGSDLNSV

SEQ ID NO: 1650485 - protein, 22 aa, Staphylococcus aureus
LIKYEGFTGHDIQNWFMNAHIY

SEQ ID NO: 1650486 - protein, 17 aa, Staphylococcus aureus
LLHIKRSKTILFTSDSR

SEQ ID NO: 1650487 - protein, 18 aa, Staphylococcus aureus
LNNIISFEQHKVWRKRVM

SEQ ID NO: 1650488 - protein, 24 aa, Staphylococcus aureus
LNSEKPEENWLFKLDDVDKEAFLA

SEQ ID NO: 1650489 - protein, 23 aa, Staphylococcus aureus
LSKIGGGVAINLSKLRARGEAIK

SEQ ID NO: 1650490 - protein, 17 aa, Staphylococcus aureus
MIADPAIDIGMLLYNYV

SEQ ID NO: 1650491 - protein, 25 aa, Staphylococcus aureus
NDFAYKHRIPWIYGGVVQSTYTEAA

SEQ ID NO: 1650492 - protein, 17 aa, Staphylococcus aureus
NGIQRRIDNGTLKVVDN

SEQ ID NO: 1650493 - protein, 18 aa, Staphylococcus aureus
NMQSAYYYNIFVQKVFLK

SEQ ID NO: 1650494 - protein, 23 aa, Staphylococcus aureus
NQEGRRVFVTEVVCDSVQFLEPK

SEQ ID NO: 1650495 - protein, 17 aa, Staphylococcus aureus
NTQLNIWGGALASGHPY

SEQ ID NO: 1650496 - protein, 20 aa, Staphylococcus aureus
PEDRIKMIINKVQPEFVFNT

SEQ ID NO: 1650497 - protein, 18 aa, Staphylococcus aureus
PLNNDILLKFDRVSVDYT

SEQ ID NO: 1650498 - protein, 17 aa, Staphylococcus aureus
PQRIGSMGKGIPGSSVT

SEQ ID NO: 1650499 - protein, 21 aa, Staphylococcus aureus
PTRQIILNFGHYRFTDLKESG

SEQ ID NO: 1650500 - protein, 20 aa, Staphylococcus aureus
QEIDSTFSYLERVDYQLLTE

SEQ ID NO: 1650501 - protein, 26 aa, Staphylococcus aureus
QFYKGEFKSASAFPLPNTEYTPLYLN

SEQ ID NO: 1650502 - protein, 24 aa, Staphylococcus aureus
QIDYAQCLVQLGIAKKAEHLFYDN

SEQ ID NO: 1650503 - protein, 18 aa, Staphylococcus aureus
QIGGAPCNVACTVQKLGQ

SEQ ID NO: 1650504 - protein, 24 aa, Staphylococcus aureus
QINRLKLFKQHGISSKCVYVKWNP

SEQ ID NO: 1650505 - protein, 23 aa, Staphylococcus aureus
QLEVPIPAIISAFEIAKAHGVTT

SEQ ID NO: 1650506 - protein, 19 aa, Staphylococcus aureus
RFDIVDGKLNIQFNEGEPY

SEQ ID NO: 1650507 - protein, 20 aa, Staphylococcus aureus
RGALILLKHQIIPFFSVGDF

SEQ ID NO: 1650508 - protein, 17 aa, Staphylococcus aureus
RKIESYADIKVERRVNE

SEQ ID NO: 1650509 - protein, 17 aa, Staphylococcus aureus
RLQEAFSNIKVGDPQDE

SEQ ID NO: 1650510 - protein, 20 aa, Staphylococcus aureus
RSEYHHCPVILGSATPCLES

SEQ ID NO: 1650511 - protein, 24 aa, Staphylococcus aureus
SEEIPHAIGVNVDRMVKESEDRVH

SEQ ID NO: 1650512 - protein, 27 aa, Staphylococcus aureus
SEKQAQAILDMRLRRLTGLERDKIEAE

SEQ ID NO: 1650513 - protein, 17 aa, Staphylococcus aureus
SELTPNVARVIKRLINE

SEQ ID NO: 1650514 - protein, 28 aa, Staphylococcus aureus
SKDLKQYGFKFLGPVTVFSFLEAAGLYD

SEQ ID NO: 1650515 - protein, 20 aa, Staphylococcus aureus
SLFVKVGMELFYQEGPQLIN

SEQ ID NO: 1650516 - protein, 27 aa, Staphylococcus aureus
SRAVKPPIIYGDVKWTAPLTVDETVYA

SEQ ID NO: 1650517 - protein, 18 aa, Staphylococcus aureus
TLQSFAESFMRPCQLAKM

SEQ ID NO: 1650518 - protein, 28 aa, Staphylococcus aureus
TNTHLHLIKPLGFRTDDKMLKRAGLDYW

SEQ ID NO: 1650519 - protein, 19 aa, Staphylococcus aureus
VAGSGVYICNECIELCSEI

SEQ ID NO: 1650520 - protein, 19 aa, Staphylococcus aureus
VFTAHGWAFTEGVKPAKKF

SEQ ID NO: 1650521 - protein, 26 aa, Staphylococcus aureus
VGASVFTGFGPRIVRINNFSVDLKPN

SEQ ID NO: 1650522 - protein, 25 aa, Staphylococcus aureus
VLHLLYARFWHKVLYDLGIVPTKEP

SEQ ID NO: 1650523 - protein, 17 aa, Staphylococcus aureus
WKKSRRLGISLSGTGKE

SEQ ID NO: 1650524 - protein, 27 aa, Staphylococcus aureus
YIYSRPRSGYFVSEIESLTILNNQPIP

SEQ ID NO: 1650525 - protein, 20 aa, Staphylococcus aureus
YKQPVCKVCGSQIETKIIAT

SEQ ID NO: 1650526 - protein, 23 aa, Staphylococcus aureus
YYAKERPSAFIYTGAAVEDGEIY

SEQ ID NO: 1650527 - protein, 19 aa, Staphylococcus aureus
AFEESYGFLSEPFVRDKDA

SEQ ID NO: 1650528 - protein, 17 aa, Staphylococcus aureus
AGFDYKLNADLSPKFVV

SEQ ID NO: 1650529 - protein, 17 aa, Staphylococcus aureus
AKETLEQIISEMDQEVT

SEQ ID NO: 1650530 - protein, 23 aa, Staphylococcus aureus
ASGVPDFRSMGGLFDEISKDGLS

SEQ ID NO: 1650531 - protein, 17 aa, Staphylococcus aureus
ATEEQMLYFGLPRINKY

SEQ ID NO: 1650532 - protein, 20 aa, Staphylococcus aureus
ATGLPTHLCSVAIPHTDVEH

SEQ ID NO: 1650533 - protein, 18 aa, Staphylococcus aureus
AVALELIHMATLVHDDVI

SEQ ID NO: 1650534 - protein, 17 aa, Staphylococcus aureus
AVCGEVFTSPTPDKILE

SEQ ID NO: 1650535 - protein, 28 aa, Staphylococcus aureus
CKVYLKREDLQWVRSFKLRGAYNAISVL

SEQ ID NO: 1650536 - protein, 20 aa, Staphylococcus aureus
DHKTRMALHPLKEFAKSKLI

SEQ ID NO: 1650537 - protein, 19 aa, Staphylococcus aureus
DPKNGVVFYNLANVYYNQQ

SEQ ID NO: 1650538 - protein, 22 aa, Staphylococcus aureus
EIPFAFFKQHVTDFDIPGEGEY

SEQ ID NO: 1650539 - protein, 23 aa, Staphylococcus aureus
EKFRGIRSNIMFANPDSAVQSIV

SEQ ID NO: 1650540 - protein, 22 aa, Staphylococcus aureus
EMRVIKDICNRVAVMEKGQVVE

SEQ ID NO: 1650541 - protein, 35 aa, Staphylococcus aureus
EVCGSPMVIKMGRYGKFMACSNFPDCRNTKAIVKS

SEQ ID NO: 1650542 - protein, 22 aa, Staphylococcus aureus
FAATIRPQFIAYQIPIGLGSIK

SEQ ID NO: 1650543 - protein, 18 aa, Staphylococcus aureus
FASLMIDLGVDVTVIEAG

SEQ ID NO: 1650544 - protein, 25 aa, Staphylococcus aureus
FKCNSEAKYYLNIIEGEWHPQDLND

SEQ ID NO: 1650545 - protein, 24 aa, Staphylococcus aureus
FKEKEIPLVDYIFCTYNTDLYYNT

SEQ ID NO: 1650546 - protein, 20 aa, Staphylococcus aureus
FRFQILVKYKSEPGLLQAIQ

SEQ ID NO: 1650547 - protein, 17 aa, Staphylococcus aureus
FRNWPIAALSYGQKKRV

SEQ ID NO: 1650548 - protein, 18 aa, Staphylococcus aureus
GEVKDCIDYALCVNEQGS

SEQ ID NO: 1650549 - protein, 20 aa, Staphylococcus aureus
GEVPKLYLTSHMDTVVPAIN

SEQ ID NO: 1650550 - protein, 25 aa, Staphylococcus aureus
GGQQQRVCIARCLAIEPEVILMDEP

SEQ ID NO: 1650551 - protein, 21 aa, Staphylococcus aureus
GHLLIQWYSKGIYKFKYAILE

SEQ ID NO: 1650552 - protein, 17 aa, Staphylococcus aureus
HGLKAFLSEYAKVDDGL

SEQ ID NO: 1650553 - protein, 24 aa, Staphylococcus aureus
IDSVNELGPYIVIAPEIAIAHARP

SEQ ID NO: 1650554 - protein, 23 aa, Staphylococcus aureus
IPIDLLPYLFFQFAKDGKRLYSD

SEQ ID NO: 1650555 - protein, 24 aa, Staphylococcus aureus
IRLKSKKGTLLWLMDETKTPMGAR

SEQ ID NO: 1650556 - protein, 18 aa, Staphylococcus aureus
IVTMAGLVNALRVVNKDI

SEQ ID NO: 1650557 - protein, 22 aa, Staphylococcus aureus
KIAKKVFPELAAKGGNAKQIME

SEQ ID NO: 1650558 - protein, 30 aa, Staphylococcus aureus
KLKEILMQWQRGIYDGGGWNAIFWCNHDQP

SEQ ID NO: 1650559 - protein, 19 aa, Staphylococcus aureus
KRNEVLNIVNVLKKYPIFI

SEQ ID NO: 1650560 - protein, 18 aa, Staphylococcus aureus
KYTIAKFYKLYIERSNNG

SEQ ID NO: 1650561 - protein, 18 aa, Staphylococcus aureus
LEGICLSRTIATEKQLVP

SEQ ID NO: 1650562 - protein, 20 aa, Staphylococcus aureus
LFAAFAEFERNLILERSSAG

SEQ ID NO: 1650563 - protein, 23 aa, Staphylococcus aureus
LGAQALTCYYGGEVIKGDKVMHG

SEQ ID NO: 1650564 - protein, 20 aa, Staphylococcus aureus
LHKANEVGYLLYRPTENTTF

SEQ ID NO: 1650565 - protein, 24 aa, Staphylococcus aureus
LHTKDIPGSHVVIFNDAPSDTTIK

SEQ ID NO: 1650566 - protein, 18 aa, Staphylococcus aureus
LQHLATKHGINFQEVAFK

SEQ ID NO: 1650567 - protein, 22 aa, Staphylococcus aureus
LSLQAIKLTFEYLKSSVEKGDK

SEQ ID NO: 1650568 - protein, 18 aa, Staphylococcus aureus
LSRKTIVYKGWLRSDQIK

SEQ ID NO: 1650569 - protein, 20 aa, Staphylococcus aureus
MSKGSFKRAIGHLYKQKIIN

SEQ ID NO: 1650570 - protein, 20 aa, Staphylococcus aureus
NSIMPRKSRASLQKIKQKWL

SEQ ID NO: 1650571 - protein, 25 aa, Staphylococcus aureus
PDEVWKERLELLKPYQVNKEMMDKT

SEQ ID NO: 1650572 - protein, 18 aa, Staphylococcus aureus
PETEIVKGRVRYEQNNKE

SEQ ID NO: 1650573 - protein, 24 aa, Staphylococcus aureus
PFDDSFSGFIFKIQANMDPKHRDR

SEQ ID NO: 1650574 - protein, 18 aa, Staphylococcus aureus
PGLPMGAAPMAYTLWTRH

SEQ ID NO: 1650575 - protein, 17 aa, Staphylococcus aureus
PMAYTLWTRHLNFNPQS

SEQ ID NO: 1650576 - protein, 21 aa, Staphylococcus aureus
QFRLHSLGLMHVINYLSTSET

SEQ ID NO: 1650577 - protein, 24 aa, Staphylococcus aureus
QQHSYWKANFIERNIYDHSLMVSS

SEQ ID NO: 1650578 - protein, 17 aa, Staphylococcus aureus
QYAELLVKVGMNVQPKQ

SEQ ID NO: 1650579 - protein, 19 aa, Staphylococcus aureus
REVLVPWEDLPKVKSLWPQ

SEQ ID NO: 1650580 - protein, 20 aa, Staphylococcus aureus
RKLYPEAKIYVFGKTDYKLS

SEQ ID NO: 1650581 - protein, 17 aa, Staphylococcus aureus
RKYYRPRKMNRFLKHVV

SEQ ID NO: 1650582 - protein, 26 aa, Staphylococcus aureus
SGGEKARLQLALLMLQRDNVLILDEP

SEQ ID NO: 1650583 - protein, 24 aa, Staphylococcus aureus
SNQTFKIFLEDLIELSKYNNEKYQ

SEQ ID NO: 1650584 - protein, 19 aa, Staphylococcus aureus
THLESIKASLKRLEDEIER

SEQ ID NO: 1650585 - protein, 35 aa, Staphylococcus aureus
TLDPRVEKLMQAFWPGPISFILPLKPGYLCRKVSG

SEQ ID NO: 1650586 - protein, 23 aa, Staphylococcus aureus
VGNLTSPYNGRWHMRNIKTNRFS

SEQ ID NO: 1650587 - protein, 32 aa, Staphylococcus aureus
VKPLLTKEIEGFGELFRYLSYVEDVGTRALLS

SEQ ID NO: 1650588 - protein, 23 aa, Staphylococcus aureus
VRYPEFTSSLMLVNPTSIEGELP

SEQ ID NO: 1650589 - protein, 25 aa, Staphylococcus aureus
VSPSEFKFGLSFLTRSIALARFPWL

SEQ ID NO: 1650590 - protein, 17 aa, Staphylococcus aureus
VVINIDIYQHFRQEEYE

SEQ ID NO: 1650591 - protein, 20 aa, Staphylococcus aureus
WSTGNLPYLIELGAIEVSIN

SEQ ID NO: 1650592 - protein, 17 aa, Staphylococcus aureus
YVACELYKEMAFNQHCK

SEQ ID NO: 1650593 - protein, 19 aa, Staphylococcus aureus
AFADGKYLFGLSGNPSACF

SEQ ID NO: 1650594 - protein, 21 aa, Staphylococcus aureus
AIRKGETLGIVGESGSGKSTL

SEQ ID NO: 1650595 - protein, 17 aa, Staphylococcus aureus
AKPSLQIINVARGGIID

SEQ ID NO: 1650596 - protein, 17 aa, Staphylococcus aureus
ALGGLAVIIHEHMENSR

SEQ ID NO: 1650597 - protein, 21 aa, Staphylococcus aureus
ARSLLSEAICNLDNNQIETLQ

SEQ ID NO: 1650598 - protein, 19 aa, Staphylococcus aureus
CKAYVEAHAKFAAENVEKV

SEQ ID NO: 1650599 - protein, 19 aa, Staphylococcus aureus
CKYPIGVVEDEIYYFNEEN

SEQ ID NO: 1650600 - protein, 19 aa, Staphylococcus aureus
DGNLGYITAILLRKLYPEA

SEQ ID NO: 1650601 - protein, 22 aa, Staphylococcus aureus
DLKIDHAFECVGGKGSQVALQQ

SEQ ID NO: 1650602 - protein, 24 aa, Staphylococcus aureus
DNERLKAALLYTLEEECIKQGHTY

SEQ ID NO: 1650603 - protein, 22 aa, Staphylococcus aureus
DSSIEAGLRRVLAETSQYITNE

SEQ ID NO: 1650604 - protein, 34 aa, Staphylococcus aureus
EDIRFGIKENVDFIAASFVRRPSDVLEIREILEE

SEQ ID NO: 1650605 - protein, 24 aa, Staphylococcus aureus
EDSSRPNVNISIIYFEDVSTETIL

SEQ ID NO: 1650606 - protein, 18 aa, Staphylococcus aureus
EGVLKDKLFIDGKYYDDY

SEQ ID NO: 1650607 - protein, 23 aa, Staphylococcus aureus
EIGRGRGPVNHFAYLKKEGLDDE

SEQ ID NO: 1650608 - protein, 17 aa, Staphylococcus aureus
ELISLKKDIGYLLLDVN

SEQ ID NO: 1650609 - protein, 18 aa, Staphylococcus aureus
ERNEPFDWLSYWTDECHY

SEQ ID NO: 1650610 - protein, 20 aa, Staphylococcus aureus
EVEVPIIVERDIYKATAKTM

SEQ ID NO: 1650611 - protein, 21 aa, Staphylococcus aureus
EVGQGLSCIAVRADIDALPIQ

SEQ ID NO: 1650612 - protein, 17 aa, Staphylococcus aureus
EYLGEGVADDVKEAVQN

SEQ ID NO: 1650613 - protein, 18 aa, Staphylococcus aureus
FDEACHVMNTIAPEHASI

SEQ ID NO: 1650614 - protein, 26 aa, Staphylococcus aureus
FIGKRISSAFLKIVIRDVAKRTAAKQ

SEQ ID NO: 1650615 - protein, 20 aa, Staphylococcus aureus
FKLAASRRGKLTSVDKENVL

SEQ ID NO: 1650616 - protein, 17 aa, Staphylococcus aureus
FSAQMHSLIAMDQQHQR

SEQ ID NO: 1650617 - protein, 19 aa, Staphylococcus aureus
FYRTPRIPRSLLDEYREGL

SEQ ID NO: 1650618 - protein, 25 aa, Staphylococcus aureus
GASGMGRYHGKYSFDTFTHEKSYIF

SEQ ID NO: 1650619 - protein, 19 aa, Staphylococcus aureus
GEAHFQVWEKVVASYSGCC

SEQ ID NO: 1650620 - protein, 24 aa, Staphylococcus aureus
GEVSEGRGIISYEMGSDGTGGKHL

SEQ ID NO: 1650621 - protein, 17 aa, Staphylococcus aureus
GGMVVCLETSQPTLPVF

SEQ ID NO: 1650622 - protein, 25 aa, Staphylococcus aureus
GKNPIKVILSKSGNIHFNQQIYQDE

SEQ ID NO: 1650623 - protein, 20 aa, Staphylococcus aureus
GKTGAFGIPLIEKVVGKQGV

SEQ ID NO: 1650624 - protein, 19 aa, Staphylococcus aureus
GKYLFGLSGNPSACFTGFE

SEQ ID NO: 1650625 - protein, 21 aa, Staphylococcus aureus
HFKYVFEVLHDFYAENDQYNI

SEQ ID NO: 1650626 - protein, 17 aa, Staphylococcus aureus
IANDVRWLASGPRAGLA

SEQ ID NO: 1650627 - protein, 17 aa, Staphylococcus aureus
IEQAPSLVFFSEDVHEE

SEQ ID NO: 1650628 - protein, 23 aa, Staphylococcus aureus
IHLPNGIKISNRFVLSPMTVNAS

SEQ ID NO: 1650629 - protein, 21 aa, Staphylococcus aureus
IKKDEVLAGFLYLTDLEEDMP

SEQ ID NO: 1650630 - protein, 17 aa, Staphylococcus aureus
IVERDIYKATAKTMDYK

SEQ ID NO: 1650631 - protein, 23 aa, Staphylococcus aureus
KAIMLPPGLAFVAYSHRAKERFK

SEQ ID NO: 1650632 - protein, 17 aa, Staphylococcus aureus
KEMKRYQTKWTELYDIW

SEQ ID NO: 1650633 - protein, 18 aa, Staphylococcus aureus
KGKFLSIQMYNALAYNYY

SEQ ID NO: 1650634 - protein, 24 aa, Staphylococcus aureus
KQPRVKFEKVFAEHFLNLYEKTKD

SEQ ID NO: 1650635 - protein, 35 aa, Staphylococcus aureus; identical to SEQ ID NO: 1580265

SEQ ID NO: 1650636 - protein, 41 aa, Staphylococcus aureus
LEAGRSDYFWDLFIQMPAALMFPSGNKFYDWIYSTDEEPHM

SEQ ID NO: 1650637 - protein, 21 aa, Staphylococcus aureus
LKPDLILMDLLMEDMDGVEAT

SEQ ID NO: 1650638 - protein, 19 aa, Staphylococcus aureus
LKVQGALAMILKDAIKPNL

SEQ ID NO: 1650639 - protein, 18 aa, Staphylococcus aureus
LLKSYGFLIYFKNPEDMY

SEQ ID NO: 1650640 - protein, 19 aa, Staphylococcus aureus
LQSSRHILFAGLGSSGLSA

SEQ ID NO: 1650641 - protein, 17 aa, Staphylococcus aureus
LSGEKVQIWIADYVLST

SEQ ID NO: 1650642 - protein, 20 aa, Staphylococcus aureus
LYILGVSDRIGRLFEITGLK

SEQ ID NO: 1650643 - protein, 17 aa, Staphylococcus aureus
NENNYGVGLGMPSFESA

SEQ ID NO: 1650644 - protein, 17 aa, Staphylococcus aureus
NPSQGFRAFKKAKVGDQ

SEQ ID NO: 1650645 - protein, 18 aa, Staphylococcus aureus
NVSFYGATGGKAFINGSA

SEQ ID NO: 1650646 - protein, 17 aa, Staphylococcus aureus
PKSVTPFDLHLISINPK

SEQ ID NO: 1650647 - protein, 21 aa, Staphylococcus aureus
PLKPGYLCRKVSGGLSSVAVR

SEQ ID NO: 1650648 - protein, 21 aa, Staphylococcus aureus
PNKLIPLTFFVKKFKQAKSSI

SEQ ID NO: 1650649 - protein, 18 aa, Staphylococcus aureus
PPWFKVSPTHFVKSWLLD

SEQ ID NO: 1650650 - protein, 18 aa, Staphylococcus aureus
QKVKEGKSYPRIISELLE

SEQ ID NO: 1650651 - protein, 19 aa, Staphylococcus aureus
QPEIRRALEQLGRGSFLKR

SEQ ID NO: 1650652 - protein, 21 aa, Staphylococcus aureus
REVVKHHQLKVNAFEEVLTVK

SEQ ID NO: 1650653 - protein, 18 aa, Staphylococcus aureus
RKEIKCYLEQATDESAFV

SEQ ID NO: 1650654 - protein, 25 aa, Staphylococcus aureus
RLQGDLEKRESLNLDTSALVRQLKD

SEQ ID NO: 1650655 - protein, 26 aa, Staphylococcus aureus
RTLKHCDNCGGAIRPDIVLYGEMLDQ

SEQ ID NO: 1650656 - protein, 19 aa, Staphylococcus aureus
RYLLIEFPSNEVPHYTDQL

SEQ ID NO: 1650657 - protein, 24 aa, Staphylococcus aureus
SEALKDVLSDTGWEVSEQTEYDGL

SEQ ID NO: 1650658 - protein, 20 aa, Staphylococcus aureus
SKEVQKILSHRAKGIKMYIF

SEQ ID NO: 1650659 - protein, 24 aa, Staphylococcus aureus
SKLFDIVIQWGVLALIVIFQPEIR

SEQ ID NO: 1650660 - protein, 18 aa, Staphylococcus aureus
SNSYMVMFEFKGHRIVAF

SEQ ID NO: 1650661 - protein, 19 aa, Staphylococcus aureus
SNTAEFGDYVSGPRVITPD

SEQ ID NO: 1650662 - protein, 21 aa, Staphylococcus aureus
SSLPSNCQMYYAMKANSERTI

SEQ ID NO: 1650663 - protein, 21 aa, Staphylococcus aureus
TESYPIMKYMQPVRKMIGKPT

SEQ ID NO: 1650664 - protein, 19 aa, Staphylococcus aureus
TFSRTQAFLNEFAESLSKA

SEQ ID NO: 1650665 - protein, 19 aa, Staphylococcus aureus
TLHPMGGLQERIWNPLQIL

SEQ ID NO: 1650666 - protein, 18 aa, Staphylococcus aureus
TSIPEDRIKMIINKVQPE

SEQ ID NO: 1650667 - protein, 22 aa, Staphylococcus aureus
VGEKGDVALFFGLSGTGKTTLS

SEQ ID NO: 1650668 - protein, 26 aa, Staphylococcus aureus
VRKKRTRSSLALFIMICTGCRVSGAR

SEQ ID NO: 1650669 - protein, 18 aa, Staphylococcus aureus
VSKGLHYQALQVLHTYAK

SEQ ID NO: 1650670 - protein, 19 aa, Staphylococcus aureus
WTQVKMKAVLHNEAIKNVL

SEQ ID NO: 1650671 - protein, 17 aa, Staphylococcus aureus
YDIPVIMLTARDALSDK

SEQ ID NO: 1650672 - protein, 18 aa, Staphylococcus aureus
YFAARSLLSEAICNLDNN

SEQ ID NO: 1650673 - protein, 25 aa, Staphylococcus aureus
YPVYEMRWDIGYVLQQIALFPHMTI

SEQ ID NO: 1650674 - protein, 29 aa, Staphylococcus aureus
ARFDVSRMTLRQAIKLLAEDGIVESTRGK

SEQ ID NO: 1650675 - protein, 31 aa, Staphylococcus aureus
ARLRWYQGRYIDFDGWYGYQCADLAVDYIYW

SEQ ID NO: 1650676 - protein, 21 aa, Staphylococcus aureus
AVLKEKWYVSIQAIAMRAYYL

SEQ ID NO: 1650677 - protein, 18 aa, Staphylococcus aureus
AWLEVEILACEAWSELGH

SEQ ID NO: 1650678 - protein, 29 aa, Staphylococcus aureus
AYLIEALQGYSHRIYCFIRADNEEIAWYK

SEQ ID NO: 1650679 - protein, 19 aa, Staphylococcus aureus
CGKSTLGKVIIRLEDATSG

SEQ ID NO: 1650680 - protein, 18 aa, Staphylococcus aureus
DAYENLLFDCLKGDATNF

SEQ ID NO: 1650681 - protein, 17 aa, Staphylococcus aureus
DEADRLQNITSFKDIAK

SEQ ID NO: 1650682 - protein, 19 aa, Staphylococcus aureus
DGSPAVTPRNYRWTSRTGT

SEQ ID NO: 1650683 - protein, 23 aa, Staphylococcus aureus
DIGDLRQGYEYSRTANPTRSSVE

SEQ ID NO: 1650684 - protein, 25 aa, Staphylococcus aureus
DKLNELRSGFNIDNYITLEEYFENW

SEQ ID NO: 1650685 - protein, 18 aa, Staphylococcus aureus
DPVNIVGIGIDFTSSTII

SEQ ID NO: 1650686 - protein, 17 aa, Staphylococcus aureus
DQFKLMFKDGEIIDFSA

SEQ ID NO: 1650687 - protein, 23 aa, Staphylococcus aureus
DYTHARFYTRAMTRKELDILTEK

SEQ ID NO: 1650688 - protein, 18 aa, Staphylococcus aureus
EKEREIGAKYVDLDTLLK

SEQ ID NO: 1650689 - protein, 23 aa, Staphylococcus aureus
EKQLPQHFIRISKSEIVNKYYIE

SEQ ID NO: 1650690 - protein, 18 aa, Staphylococcus aureus
ELGLGCMSLGTDLKKAEQ

SEQ ID NO: 1650691 - protein, 19 aa, Staphylococcus aureus
ELKDILFGPTITVKALLNM

SEQ ID NO: 1650692 - protein, 22 aa, Staphylococcus aureus
ELKEEIRLFVKEGLSAHAAPRE

SEQ ID NO: 1650693 - protein, 32 aa, Staphylococcus aureus
ENGDLLFGTIDTWLVWKLSGKAAHITDYSNAS

SEQ ID NO: 1650694 - protein, 22 aa, Staphylococcus aureus
EQFGLSVMVAFGYRQQDPPKNK

SEQ ID NO: 1650695 - protein, 18 aa, Staphylococcus aureus
EVSIKFRINDNLEQYEQI

SEQ ID NO: 1650696 - protein, 17 aa, Staphylococcus aureus
FAKDRIIKLLCHLCQTV

SEQ ID NO: 1650697 - protein, 20 aa, Staphylococcus aureus
FEVRKKLFLKLQRIKNNAFY

SEQ ID NO: 1650698 - protein, 17 aa, Staphylococcus aureus
FKAGHTVDIILTESDAA

SEQ ID NO: 1650699 - protein, 20 aa, Staphylococcus aureus
FKLMFKDGEIIDFSAEKGEA

SEQ ID NO: 1650700 - protein, 17 aa, Staphylococcus aureus
FNGLKGQGVLLVNHIQN

SEQ ID NO: 1650701 - protein, 31 aa, Staphylococcus aureus
GAHIRTLLLTFFYRFMRPLIEAGYVYIAQPP

SEQ ID NO: 1650702 - protein, 23 aa, Staphylococcus aureus
GEVSRIYLNFSDPWPKNRHAKRR

SEQ ID NO: 1650703 - protein, 18 aa, Staphylococcus aureus
GGCTFCSAAGSGDFAGNR

SEQ ID NO: 1650704 - protein, 24 aa, Staphylococcus aureus
GQASRRICEAIEYYFGLRSDKPDE

SEQ ID NO: 1650705 - protein, 18 aa, Staphylococcus aureus
HFIRATLESLCYQTRDVM

SEQ ID NO: 1650706 - protein, 22 aa, Staphylococcus aureus
IAGSYAERIPVIAITGAPTRAV

SEQ ID NO: 1650707 - protein, 21 aa, Staphylococcus aureus
IKMSDEILQQFEAVKDDKAKT

SEQ ID NO: 1650708 - protein, 20 aa, Staphylococcus aureus
ITHEMHVIRRICDEVAVMES

SEQ ID NO: 1650709 - protein, 20 aa, Staphylococcus aureus
KAYYKWRIDETYIKIKGKWS

SEQ ID NO: 1650710 - protein, 25 aa, Staphylococcus aureus
KGVSWDYFDIGLFEFDSGYVEAIEA

SEQ ID NO: 1650711 - protein, 26 aa, Staphylococcus aureus
KQLCTTYKMVLDFYIELSSNTVKGRY

SEQ ID NO: 1650712 - protein, 17 aa, Staphylococcus aureus
LITQLATLYGLTADGMK

SEQ ID NO: 1650713 - protein, 34 aa, Staphylococcus aureus
LKSRLPEYMIPRKFEWMEQLPLTSNGKIDRKKIA

SEQ ID NO: 1650714 - protein, 26 aa, Staphylococcus aureus
LNANYIKARLSEHFEIPYKQYCKHEF

SEQ ID NO: 1650715 - protein, 23 aa, Staphylococcus aureus
LYEEMNHLLYCSSAGHEPGYIYR

SEQ ID NO: 1650716 - protein, 21 aa, Staphylococcus aureus
MGAALLAFCETTLTKGIDVVF

SEQ ID NO: 1650717 - protein, 19 aa, Staphylococcus aureus
MTGKTWLFFGDQHRSSDFL

SEQ ID NO: 1650718 - protein, 17 aa, Staphylococcus aureus
NEKVRFARFRPFPFWKR

SEQ ID NO: 1650719 - protein, 17 aa, Staphylococcus aureus
NELPEFEDYVVLTQQQN

SEQ ID NO: 1650720 - protein, 26 aa, Staphylococcus aureus
NFVRRVCDCKGQWTMENFIEIEIEKI

SEQ ID NO: 1650721 - protein, 28 aa, Staphylococcus aureus
PLNPEVIKWAKKVYGLTVLDTWWMTETG

SEQ ID NO: 1650722 - protein, 17 aa, Staphylococcus aureus
PNGYFVTSNFGAYRETS

SEQ ID NO: 1650723 - protein, 19 aa, Staphylococcus aureus
QHALDVWLLGKLQFAEFEH

SEQ ID NO: 1650724 - protein, 23 aa, Staphylococcus aureus
QHDAANAWGSWNPDEFTVEDSAF

SEQ ID NO: 1650725 - protein, 17 aa, Staphylococcus aureus
QNIYPAHVERLLTQSSS

SEQ ID NO: 1650726 - protein, 18 aa, Staphylococcus aureus
QNKTEFDDMISLMGMHLE

SEQ ID NO: 1650727 - protein, 31 aa, Staphylococcus aureus
RATATYKFAGGKGINVSRVLKTLDVESTALG

SEQ ID NO: 1650728 - protein, 24 aa, Staphylococcus aureus
RIIKLLCHLCQTVGYDQDEFYEIK

SEQ ID NO: 1650729 - protein, 22 aa, Staphylococcus aureus
RKLDEIVLLEGFMDVIKSDTAG

SEQ ID NO: 1650730 - protein, 19 aa, Staphylococcus aureus
RLIERRLLRHFSKKGYITW

SEQ ID NO: 1650731 - protein, 19 aa, Staphylococcus aureus
RSQEMPIFITYDKHEDISD

SEQ ID NO: 1650732 - protein, 19 aa, Staphylococcus aureus
RYEGFGPSGSMLIVDALTN

SEQ ID NO: 1650733 - protein, 19 aa, Staphylococcus aureus
SIHLIDILKKLSHDEIEAF

SEQ ID NO: 1650734 - protein, 18 aa, Staphylococcus aureus
SNEALLFMLEKAGIVIYE

SEQ ID NO: 1650735 - protein, 17 aa, Staphylococcus aureus
TAYSEIYDYQWNEKLIP

SEQ ID NO: 1650736 - protein, 19 aa, Staphylococcus aureus
TDLLKCHYCGYQETPPNQC

SEQ ID NO: 1650737 - protein, 17 aa, Staphylococcus aureus
VNFSEPFPEINDINDQR

SEQ ID NO: 1650738 - protein, 18 aa, Staphylococcus aureus
VNNIPIITSHALRHTHCS

SEQ ID NO: 1650739 - protein, 18 aa, Staphylococcus aureus
YFGQSSINIADWAQNNNY

SEQ ID NO: 1650740 - protein, 18 aa, Staphylococcus aureus
YTLDFYLKPFVKTKIKAW

SEQ ID NO: 1650741 - protein, 21 aa, Staphylococcus aureus
AEGRLVLADAVYYANQYQPSV

SEQ ID NO: 1650742 - protein, 25 aa, Staphylococcus aureus
AEIYGMKVARDLVHISGDTSDYHIE

SEQ ID NO: 1650743 - protein, 23 aa, Staphylococcus aureus
AGAEVLGVVAIFTYGLKKADDTF

SEQ ID NO: 1650744 - protein, 17 aa, Staphylococcus aureus
AKLANIHFVDTKINHHE

SEQ ID NO: 1650745 - protein, 19 aa, Staphylococcus aureus
ALKSACRVNNIPIITSHAL

SEQ ID NO: 1650746 - protein, 17 aa, Staphylococcus aureus
ALNKAYDLFSMMDGVDK

SEQ ID NO: 1650747 - protein, 25 aa, Staphylococcus aureus
ANEVLKMPFHYVLSIYQNKNNDISE

SEQ ID NO: 1650748 - protein, 18 aa, Staphylococcus aureus
ARHEILRTQYIVVDDEVR

SEQ ID NO: 1650749 - protein, 25 aa, Staphylococcus aureus
ASRLANEKHIDWLVKAVIVAKRQVP

SEQ ID NO: 1650750 - protein, 27 aa, Staphylococcus aureus
ATEAKRKGLEPLAIWMKARKHEVSIEE

SEQ ID NO: 1650751 - protein, 17 aa, Staphylococcus aureus
DAIPELKKVATTDERPM

SEQ ID NO: 1650752 - protein, 24 aa, Staphylococcus aureus
DEGSFKWGVTTSLSYFPKDNSEFF

SEQ ID NO: 1650753 - protein, 22 aa, Staphylococcus aureus
DGDHGVNMVRGFSSLKDKLDDS

SEQ ID NO: 1650754 - protein, 19 aa, Staphylococcus aureus
DHLIDYFILPLRQIEQVSI

SEQ ID NO: 1650755 - protein, 17 aa, Staphylococcus aureus
DPMKFLPEDGSLQLTAG

SEQ ID NO: 1650756 - protein, 19 aa, Staphylococcus aureus
DTYSFPRVWLDKDSYDFSF

SEQ ID NO: 1650757 - protein, 18 aa, Staphylococcus aureus
EIRLRPSYFPFTEPSVEV

SEQ ID NO: 1650758 - protein, 26 aa, Staphylococcus aureus
ELLRFRYWDCPIGCYEWEDIAHYFGT

SEQ ID NO: 1650759 - protein, 24 aa, Staphylococcus aureus
EQMSQCFKQSLGATEEQMLYFGLP

SEQ ID NO: 1650760 - protein, 24 aa, Staphylococcus aureus
ESKIKTVLHGLNFSEEDFNKPIND

SEQ ID NO: 1650761 - protein, 20 aa, Staphylococcus aureus
ETLKTLSLDGYMVVIDTGVK

SEQ ID NO: 1650762 - protein, 21 aa, Staphylococcus aureus
EVSEAAVLNANYIKARLSEHF

SEQ ID NO: 1650763 - protein, 23 aa, Staphylococcus aureus
EYKDVVFIYPMHRNPKVRAIAEK

SEQ ID NO: 1650764 - protein, 19 aa, Staphylococcus aureus
EYYQLLLIKMWQLSQIYKP

SEQ ID NO: 1650765 - protein, 17 aa, Staphylococcus aureus
FDEWRYLPDGSDNPDFN

SEQ ID NO: 1650766 - protein, 17 aa, Staphylococcus aureus
FIICTAPLTKETHHKFN

SEQ ID NO: 1650767 - protein, 18 aa, Staphylococcus aureus
FNRQVFQQVVDYLNMNQS

SEQ ID NO: 1650768 - protein, 20 aa, Staphylococcus aureus
GDLTPVFFGSALANFGVQNF

SEQ ID NO: 1650769 - protein, 36 aa, Staphylococcus aureus
GGERALTAIALLFAILKVRSAPFVILDEVEAALDEA

SEQ ID NO: 1650770 - protein, 17 aa, Staphylococcus aureus
GQILLPHHTHARVGIAL

SEQ ID NO: 1650771 - protein, 23 aa, Staphylococcus aureus
HDIKSPMVGTFFLQDSKELTEPI

SEQ ID NO: 1650772 - protein, 20 aa, Staphylococcus aureus
IALALMRISKAILNNENNVL

SEQ ID NO: 1650773 - protein, 24 aa, Staphylococcus aureus
IFKEERTVYLPKAYHPLLNRETVV

SEQ ID NO: 1650774 - protein, 18 aa, Staphylococcus aureus
IIDESGLHFRVGPLETTV

SEQ ID NO: 1650775 - protein, 19 aa, Staphylococcus aureus
IITSHALRHTHCSYLLAKG

SEQ ID NO: 1650776 - protein, 17 aa, Staphylococcus aureus
IIVICLSSGISGSYQSS

SEQ ID NO: 1650777 - protein, 17 aa, Staphylococcus aureus
IRGSDAFIFESNHDVDM

SEQ ID NO: 1650778 - protein, 22 aa, Staphylococcus aureus
IRTNLEIPPFIQALTSIEENML

SEQ ID NO: 1650779 - protein, 18 aa, Staphylococcus aureus
ITSLKKRGAKNIRFMCLI

SEQ ID NO: 1650780 - protein, 23 aa, Staphylococcus aureus
KDGRRAPFSSIYFLLTDDNISHF

SEQ ID NO: 1650781 - protein, 26 aa, Staphylococcus aureus
KENAGPSWKYLKFIFNKDEEKNNIMF

SEQ ID NO: 1650782 - protein, 22 aa, Staphylococcus aureus
KENFRRNHCETLIEAVPGNLLK

SEQ ID NO: 1650783 - protein, 26 aa, Staphylococcus aureus
KIAPALATGCSLVMKPSEITPLTTIR

SEQ ID NO: 1650784 - protein, 22 aa, Staphylococcus aureus
KKFPDALFIFLAPPSLDHLRER

SEQ ID NO: 1650785 - protein, 24 aa, Staphylococcus aureus
KQLNDLYCSRILRYNEIAFKKFDS

SEQ ID NO: 1650786 - protein, 18 aa, Staphylococcus aureus
KRGQIVGLVGANGAGKTT

SEQ ID NO: 1650787 - protein, 23 aa, Staphylococcus aureus
KTTTIGKLAYRYKMEGKKVMLAA

SEQ ID NO: 1650788 - protein, 25 aa, Staphylococcus aureus
LEHIPFKNVCQAVVYISGQKKGDVV

SEQ ID NO: 1650789 - protein, 21 aa, Staphylococcus aureus
LELYKNYKGNITRFVAENDAL

SEQ ID NO: 1650790 - protein, 18 aa, Staphylococcus aureus
LKNRERQLLLSVDNIECI

SEQ ID NO: 1650791 - protein, 23 aa, Staphylococcus aureus
LLGYGDMLYLGSGMNKPIRVQGT

SEQ ID NO: 1650792 - protein, 26 aa, Staphylococcus aureus
LMPSGLPIHEWLMLKQFSKYKSAPSL

SEQ ID NO: 1650793 - protein, 18 aa, Staphylococcus aureus
LQQDGIICYIQFQMKYLA

SEQ ID NO: 1650794 - protein, 17 aa, Staphylococcus aureus
MDMLKKHQKQAVNFQNY

SEQ ID NO: 1650795 - protein, 26 aa, Staphylococcus aureus
MHIGLRANKKDFGWIYSSSLASSAAV

SEQ ID NO: 1650796 - protein, 17 aa, Staphylococcus aureus
MNNRIYGGYSLLLDVNY

SEQ ID NO: 1650797 - protein, 27 aa, Staphylococcus aureus
NFDLAHELGHLVLHRHIQFDLLSPEEY

SEQ ID NO: 1650798 - protein, 21 aa, Staphylococcus aureus
NSITRPSFRVPNDDALMYYEQ

SEQ ID NO: 1650799 - protein, 17 aa, Staphylococcus aureus
PEDAVTYHMPTHCPSCG

SEQ ID NO: 1650800 - protein, 17 aa, Staphylococcus aureus
PFYEDVLGLNIINETLT

SEQ ID NO: 1650801 - protein, 19 aa, Staphylococcus aureus
PGKLDRLTAAFKNNDNIDM

SEQ ID NO: 1650802 - protein, 23 aa, Staphylococcus aureus
PHTEFKAEVYVLSKDEGGRHTPF

SEQ ID NO: 1650803 - protein, 19 aa, Staphylococcus aureus
PKFFKQMLVDFMDKTNYTC

SEQ ID NO: 1650804 - protein, 20 aa, Staphylococcus aureus
PKFKDAMHLADFFDAPYEMF

SEQ ID NO: 1650805 - protein, 19 aa, Staphylococcus aureus
PKTTIAQNFVSTVIQTEPS

SEQ ID NO: 1650806 - protein, 23 aa, Staphylococcus aureus
PLDESLYPIIRDICQEVKVHGDK

SEQ ID NO: 1650807 - protein, 21 aa, Staphylococcus aureus
PRAEENIQLIIMIIEDGTYVM

SEQ ID NO: 1650808 - protein, 25 aa, Staphylococcus aureus
QTYNFKNAIIATGSRPIEIPNFKFG

SEQ ID NO: 1650809 - protein, 24 aa, Staphylococcus aureus
RINDSIDAYSFWSKDQTPFIILGT

SEQ ID NO: 1650810 - protein, 19 aa, Staphylococcus aureus
RKANEIGTLMHTVMQHLPF

SEQ ID NO: 1650811 - protein, 19 aa, Staphylococcus aureus
RPAIDVIIPGAKRAEQVIE

SEQ ID NO: 1650812 - protein, 22 aa, Staphylococcus aureus
RYPIRALMMSHMFVEVDGNVHA

SEQ ID NO: 1650813 - protein, 18 aa, Staphylococcus aureus
SKFDGIFLVATNPVDILA

SEQ ID NO: 1650814 - protein, 33 aa, Staphylococcus aureus
SQYSNCPIFTFGRSSGAYLSLLIARDRDIDGVI

SEQ ID NO: 1650815 - protein, 19 aa, Staphylococcus aureus
STQYRYFWASLNKKGYKSK

SEQ ID NO: 1650816 - protein, 20 aa, Staphylococcus aureus
STYYGIALALMRISKAILNN

SEQ ID NO: 1650817 - protein, 26 aa, Staphylococcus aureus
TAMKLRQRVWRRLAKDLKPENLHEIK

SEQ ID NO: 1650818 - protein, 17 aa, Staphylococcus aureus
TKVGIGPGRVCITKIKT

SEQ ID NO: 1650819 - protein, 26 aa, Staphylococcus aureus
VELDNGFDFYAPQTFLDEKGRRVLIG

SEQ ID NO: 1650820 - protein, 27 aa, Staphylococcus aureus
VGASTYRKQFCKLLLKSAKVSVIKGNA

SEQ ID NO: 1650821 - protein, 19 aa, Staphylococcus aureus
VLREPGFFRHLKVMPHAQE

SEQ ID NO: 1650822 - protein, 19 aa, Staphylococcus aureus
VNAGLKVKLLDIVVDKNDP

SEQ ID NO: 1650823 - protein, 18 aa, Staphylococcus aureus
VQYESVFDFEEMINRAVE

SEQ ID NO: 1650824 - protein, 25 aa, Staphylococcus aureus
VTAQYPPQLAFAIGNAIKYLSRAPL

SEQ ID NO: 1650825 - protein, 18 aa, Staphylococcus aureus
WVQEYAPILYQIWKKKHK

SEQ ID NO: 1650826 - protein, 19 aa, Staphylococcus aureus
YDCYFCIVDQHAITMPQDR

SEQ ID NO: 1650827 - protein, 25 aa, Staphylococcus aureus
YFNKLSVFRKLFGNLTYSNTLYENN

SEQ ID NO: 1650828 - protein, 17 aa, Staphylococcus aureus
YHQAGFNHVHYHTGPMS

SEQ ID NO: 1650829 - protein, 27 aa, Staphylococcus aureus
YKTSKKLVKFMLVFCSNSMTAEEIHLC

SEQ ID NO: 1650830 - protein, 18 aa, Staphylococcus aureus
YLASSYFRSSGYDGFMQD

SEQ ID NO: 1650831 - protein, 30 aa, Staphylococcus aureus
YPIKEKIQHVFKSGCGFDNDSNKGFVYTKI

SEQ ID NO: 1650832 - protein, 20 aa, Staphylococcus aureus
YSTSIFQHAFHVSRDKILET

SEQ ID NO: 1650833 - protein, 22 aa, Staphylococcus aureus
AALARSEADWIVGINATRALTT

SEQ ID NO: 1650834 - protein, 17 aa, Staphylococcus aureus
ADRLMDVLFEMRKVNIE

SEQ ID NO: 1650835 - protein, 20 aa, Staphylococcus aureus
AIREKLNIVNQGLLDPEKYK

SEQ ID NO: 1650836 - protein, 17 aa, Staphylococcus aureus
ANYGGVRAFTASAGPGL

SEQ ID NO: 1650837 - protein, 22 aa, Staphylococcus aureus
DEVAVGFGRTGKMFACNHEDVQ

SEQ ID NO: 1650838 - protein, 23 aa, Staphylococcus aureus
DGTAIHIIVPIAAVDKVTHLRAL

SEQ ID NO: 1650839 - protein, 18 aa, Staphylococcus aureus
DKGKRLELVVTDDEAQSQ

SEQ ID NO: 1650840 - protein, 18 aa, Staphylococcus aureus
DVFIGVSVANALSQDMVK

SEQ ID NO: 1650841 - protein, 21 aa, Staphylococcus aureus
EEDTCKFILKSVVQVEDNIER

SEQ ID NO: 1650842 - protein, 20 aa, Staphylococcus aureus
ELLRQKVDFDYDIKTVFKAN

SEQ ID NO: 1650843 - protein, 20 aa, Staphylococcus aureus
FDDFWKQRQVPLSQIKTPLL

SEQ ID NO: 1650844 - protein, 18 aa, Staphylococcus aureus
FEALRAWLDDEIVADSWL

SEQ ID NO: 1650845 - protein, 23 aa, Staphylococcus aureus
FKELKIKAFEAHASQTGPFLKQL

SEQ ID NO: 1650846 - protein, 19 aa, Staphylococcus aureus
FNAEKGFGFIEVEGENDVF

SEQ ID NO: 1650847 - protein, 17 aa, Staphylococcus aureus
FRPSYQNVISKVFTLPQ

SEQ ID NO: 1650848 - protein, 19 aa, Staphylococcus aureus
FTPNFNFNDYHIMIVHPWQ

SEQ ID NO: 1650849 - protein, 26 aa, Staphylococcus aureus
GCGSIGLLAIQWARIFGAAHIIAIDI

SEQ ID NO: 1650850 - protein, 25 aa, Staphylococcus aureus
GCVIFDEIHYFFGPEMVNVKRGGLG

SEQ ID NO: 1650851 - protein, 18 aa, Staphylococcus aureus
GKIPGGFKKREGRPGDDA

SEQ ID NO: 1650852 - protein, 23 aa, Staphylococcus aureus
GKTRLRPGGKEATDWLIQQGAFS

SEQ ID NO: 1650853 - protein, 24 aa, Staphylococcus aureus
GMDSTCPKDVLTQLEFSDEDVDII

SEQ ID NO: 1650854 - protein, 18 aa, Staphylococcus aureus
GVFGGALTYGCIGEPQAP

SEQ ID NO: 1650855 - protein, 17 aa, Staphylococcus aureus
HDFRPSYQNVISKVFTL

SEQ ID NO: 1650856 - protein, 26 aa, Staphylococcus aureus
HMHGDHIFGLPGLLSSRSFQGGEQKP

SEQ ID NO: 1650857 - protein, 24 aa, Staphylococcus aureus
HQVVIRCLMVYFNKVSREEAVDLK

SEQ ID NO: 1650858 - protein, 17 aa, Staphylococcus aureus
HRAAVGISEVSDAFTVI

SEQ ID NO: 1650859 - protein, 17 aa, Staphylococcus aureus
ICGDDTCLIICRSKEAS

SEQ ID NO: 1650860 - protein, 23 aa, Staphylococcus aureus
IEDLKEGMKLSGTVRNVVDFGAF

SEQ ID NO: 1650861 - protein, 24 aa, Staphylococcus aureus
IGDQCPICGNEIQDLGHHIDFDSI

SEQ ID NO: 1650862 - protein, 17 aa, Staphylococcus aureus
IKAGVHLNKLTEERSKR

SEQ ID NO: 1650863 - protein, 22 aa, Staphylococcus aureus
IKLEVLRNPKAIHGLLAPRIDT

SEQ ID NO: 1650864 - protein, 25 aa, Staphylococcus aureus
IKNAGLRLKFLKSETSGVAVWGKIY

SEQ ID NO: 1650865 - protein, 17 aa, Staphylococcus aureus
INRNGKIAISFREDDEL

SEQ ID NO: 1650866 - protein, 26 aa, Staphylococcus aureus
IPEWTNGKFLPKRKVVKIEQFENEIK

SEQ ID NO: 1650867 - protein, 23 aa, Staphylococcus aureus
ISPVLWKKVKKGLSAGRVQSVAL

SEQ ID NO: 1650868 - protein, 21 aa, Staphylococcus aureus
KAYNFKSVCVNPTHVKYAAER

SEQ ID NO: 1650869 - protein, 19 aa, Staphylococcus aureus
KHSKDMAKNHYFDHTNLKG

SEQ ID NO: 1650870 - protein, 18 aa, Staphylococcus aureus
KIWERWLHTQGYKDIHLD

SEQ ID NO: 1650871 - protein, 18 aa, Staphylococcus aureus
KMETARIQVMSDFSSRLY

SEQ ID NO: 1650872 - protein, 17 aa, Staphylococcus aureus
KSEVWRQMMSDIFDTEL

SEQ ID NO: 1650873 - protein, 24 aa, Staphylococcus aureus
LNFECGRFIVAHIGYYVTEVLDIK

SEQ ID NO: 1650874 - protein, 21 aa, Staphylococcus aureus
LSLLLRRPPGREAYPGDVFYL

SEQ ID NO: 1650875 - protein, 25 aa, Staphylococcus aureus
LVIEIKKLYPFVFNTLFEAIDKLAI

SEQ ID NO: 1650876 - protein, 25 aa, Staphylococcus aureus
LVMKQLFEHRGLPQLPYISFLRSEY

SEQ ID NO: 1650877 - protein, 17 aa, Staphylococcus aureus
LYFDRNILTPQKLLNYL

SEQ ID NO: 1650878 - protein, 30 aa, Staphylococcus aureus
MKIVKKDFTGISFLNLVDFDALYGHRRDKP

SEQ ID NO: 1650879 - protein, 18 aa, Staphylococcus aureus
NYTALTFSYVINRNKSKY

SEQ ID NO: 1650880 - protein, 18 aa, Staphylococcus aureus
PAAPAAVSLEGDFPETTE

SEQ ID NO: 1650881 - protein, 31 aa, Staphylococcus aureus
QKYVHLLSEYGVWHPRAWEFAPSRVDFPTTN

SEQ ID NO: 1650882 - protein, 18 aa, Staphylococcus aureus
RPMIRATAYWAIGQILGE

SEQ ID NO: 1650883 - protein, 17 aa, Staphylococcus aureus
RQMKTFKTELIKMNASY

SEQ ID NO: 1650884 - protein, 18 aa, Staphylococcus aureus
RVQQAIVEGETYQVNYTA

SEQ ID NO: 1650885 - protein, 22 aa, Staphylococcus aureus
SEDAYYKYAHEFSGGQRQRVGI

SEQ ID NO: 1650886 - protein, 20 aa, Staphylococcus aureus
SEIRCRLRSKGQLIINDIAQ

SEQ ID NO: 1650887 - protein, 18 aa, Staphylococcus aureus
SETSGVAVWGKIYGEIKG

SEQ ID NO: 1650888 - protein, 25 aa, Staphylococcus aureus
SNEDKWVYEMLGMDSTCPKDVLTQL

SEQ ID NO: 1650889 - protein, 25 aa, Staphylococcus aureus
SSYNLKCLLLKLTYRYLDNQPLNDA

SEQ ID NO: 1650890 - protein, 18 aa, Staphylococcus aureus
TAGFDMYDLDLAKKHNIV

SEQ ID NO: 1650891 - protein, 26 aa, Staphylococcus aureus
TGDALKPLIKEGIKLNGLISNPPYID

SEQ ID NO: 1650892 - protein, 21 aa, Staphylococcus aureus
VEEQKVIIIYALIQAKEPVKQ

SEQ ID NO: 1650893 - protein, 25 aa, Staphylococcus aureus
VKNSRLFAFYCKLDDPKEVDDRQTW

SEQ ID NO: 1650894 - protein, 17 aa, Staphylococcus aureus
WKETEIFFEKLTDLLDF

SEQ ID NO: 1650895 - protein, 17 aa, Staphylococcus aureus
YDLFSMMDGVDKHLAVI

SEQ ID NO: 1650896 - protein, 19 aa, Staphylococcus aureus
YDMTHVFHIQGEYILQQCS

SEQ ID NO: 1650897 - protein, 18 aa, Staphylococcus aureus
YKDYGIRKYGFHGTSHKF

SEQ ID NO: 1650898 - protein, 17 aa, Staphylococcus aureus
YPDIKVEVSEPLGTHPL

SEQ ID NO: 1650899 - protein, 28 aa, Staphylococcus aureus
AAGYKPGEEVFLGFDCASSEFYENGVYD

SEQ ID NO: 1650900 - protein, 22 aa, Staphylococcus aureus
ADIKGLKIWVFAVDEGSEIRCR

SEQ ID NO: 1650901 - protein, 18 aa, Staphylococcus aureus
AIKNNRKIVTFGRSMENN

SEQ ID NO: 1650902 - protein, 20 aa, Staphylococcus aureus
CSKYPECDFISWDKPIGRDC

SEQ ID NO: 1650903 - protein, 20 aa, Staphylococcus aureus
DGVWLRELEQAISNGTQNDI

SEQ ID NO: 1650904 - protein, 17 aa, Staphylococcus aureus
DLLNNFVRRVCDCKGQW

SEQ ID NO: 1650905 - protein, 18 aa, Staphylococcus aureus
DLTELVLTLGSQMVVLAN

SEQ ID NO: 1650906 - protein, 23 aa, Staphylococcus aureus
DTADFPYTIRIVSEVLESNGSSS

SEQ ID NO: 1650907 - protein, 20 aa, Staphylococcus aureus
EALLKKGIKTIMLGGQVKEN

SEQ ID NO: 1650908 - protein, 20 aa, Staphylococcus aureus
ECAYSYIVQIDVFVKYNDEY

SEQ ID NO: 1650909 - protein, 26 aa, Staphylococcus aureus
EKLLYSCWASIDGVWLRELEQAISNG

SEQ ID NO: 1650910 - protein, 19 aa, Staphylococcus aureus
ELSALIRMNGALSLSNQQF

SEQ ID NO: 1650911 - protein, 19 aa, Staphylococcus aureus
ETLMPAIIELKKAYKEAKA

SEQ ID NO: 1650912 - protein, 24 aa, Staphylococcus aureus
EVARLDYISKLGFSYADMEKQGII

SEQ ID NO: 1650913 - protein, 17 aa, Staphylococcus aureus
FNPPMFARVFRKHLEGG

SEQ ID NO: 1650914 - protein, 26 aa, Staphylococcus aureus
FTQKSPRWAIAYKFPAEEVVTKLLDI

SEQ ID NO: 1650915 - protein, 24 aa, Staphylococcus aureus
FVRYLSMNFKDYFTSIKLVNAINL

SEQ ID NO: 1650916 - protein, 19 aa, Staphylococcus aureus
GLGEPFSKEVALVMMILRL

SEQ ID NO: 1650917 - protein, 19 aa, Staphylococcus aureus
GMKQRVALCRAHVHKPNVI

SEQ ID NO: 1650918 - protein, 28 aa, Staphylococcus aureus
IKDTMFAPFIDYKCVTTMRLEDEAHHYT

SEQ ID NO: 1650919 - protein, 17 aa, Staphylococcus aureus
ILKIGAITKGARGYLTF

SEQ ID NO: 1650920 - protein, 22 aa, Staphylococcus aureus
IMICTGCRVSGARNIKIEHINQ

SEQ ID NO: 1650921 - protein, 17 aa, Staphylococcus aureus
INGCHYCVDIHKKELKE

SEQ ID NO: 1650922 - protein, 24 aa, Staphylococcus aureus
IQAARLRVMLDYMWEDIKEKGDYD

SEQ ID NO: 1650923 - protein, 17 aa, Staphylococcus aureus
IRNELHIPVKYVGLGEQ

SEQ ID NO: 1650924 - protein, 20 aa, Staphylococcus aureus
KAVHMGDIFPTTAHKNPLWV

SEQ ID NO: 1650925 - protein, 23 aa, Staphylococcus aureus
KELLDLLRLHLSLFNKYEKDEIR

SEQ ID NO: 1650926 - protein, 20 aa, Staphylococcus aureus
KLGAINVHASLLPKYRGGAP

SEQ ID NO: 1650927 - protein, 21 aa, Staphylococcus aureus
KLKVVDGLIIQAARLRVMLDY

SEQ ID NO: 1650928 - protein, 19 aa, Staphylococcus aureus
KTAQELADFLGRPVDEIVK

SEQ ID NO: 1650929 - protein, 20 aa, Staphylococcus aureus
KVFIHHVALHVSHRKDLKFN

SEQ ID NO: 1650930 - protein, 17 aa, Staphylococcus aureus
LAEEKGHEIVGVIENTP

SEQ ID NO: 1650931 - protein, 19 aa, Staphylococcus aureus
LFSLKGALWTLAQEVYQEW

SEQ ID NO: 1650932 - protein, 18 aa, Staphylococcus aureus
LFSQGRLKDAKNYVLHQP

SEQ ID NO: 1650933 - protein, 18 aa, Staphylococcus aureus
LPSSVKRGDYLAILSTGA

SEQ ID NO: 1650934 - protein, 17 aa, Staphylococcus aureus
LQVNLIRSHACGLGEPF

SEQ ID NO: 1650935 - protein, 21 aa, Staphylococcus aureus
LRPEIKFDGIDPLVKQMNDDK

SEQ ID NO: 1650936 - protein, 25 aa, Staphylococcus aureus
MDDGRCYLCPCLGYPRQWRSEDIYQ

SEQ ID NO: 1650937 - protein, 17 aa, Staphylococcus aureus
MEMEGLLQLVNPKIISQ

SEQ ID NO: 1650938 - protein, 23 aa, Staphylococcus aureus
NAIYEFQYAYGLPDYGIIGMQLP

SEQ ID NO: 1650939 - protein, 20 aa, Staphylococcus aureus
NCVAPGPFWSPLQISGGQPQ

SEQ ID NO: 1650940 - protein, 20 aa, Staphylococcus aureus
NECDLSYDITSLYTFKQPVS

SEQ ID NO: 1650941 - protein, 28 aa, Staphylococcus aureus
PKDLNDFGPAWIERFVRVQIEEAFAVAL

SEQ ID NO: 1650942 - protein, 28 aa, Staphylococcus aureus
PYVTKFSMKWFLAMPRAKAWMINTRTPD

SEQ ID NO: 1650943 - protein, 24 aa, Staphylococcus aureus
QSMYLKDTRIEIVGVNKKDPLQYA

SEQ ID NO: 1650944 - protein, 23 aa, Staphylococcus aureus
QYNGKRPVYFTALLFNKLTSNIL

SEQ ID NO: 1650945 - protein, 26 aa, Staphylococcus aureus
RDQAKKRKKACIIVTHDERLKAYCDR

SEQ ID NO: 1650946 - protein, 18 aa, Staphylococcus aureus
RESGGLLMYGIPNMKLDK

SEQ ID NO: 1650947 - protein, 18 aa, Staphylococcus aureus
RKKAKAFIDDYLASFPGV

SEQ ID NO: 1650948 - protein, 20 aa, Staphylococcus aureus
SDAQLIWGVKKGYEHIFQQH

SEQ ID NO: 1650949 - protein, 25 aa, Staphylococcus aureus
SFISEIKSAVKIGDQCPICGNEIQD

SEQ ID NO: 1650950 - protein, 23 aa, Staphylococcus aureus
SRGMRMKIALTIALSHDVKLLIL

SEQ ID NO: 1650951 - protein, 20 aa, Staphylococcus aureus
SRLESFIMLELQRIKGASVK

SEQ ID NO: 1650952 - protein, 25 aa, Staphylococcus aureus
SSGSFTRNEVRIMLGEEPSDNPELD

SEQ ID NO: 1650953 - protein, 17 aa, Staphylococcus aureus
TSAHGRTLLAIKDEQQM

SEQ ID NO: 1650954 - protein, 21 aa, Staphylococcus aureus
TVTTLCPCSKEISEYSAHNQR

SEQ ID NO: 1650955 - protein, 18 aa, Staphylococcus aureus
TWKDLFNDFEMHFYRYVF

SEQ ID NO: 1650956 - protein, 23 aa, Staphylococcus aureus
VFQGEALLFFLGLTNSMAGFEKL

SEQ ID NO: 1650957 - protein, 17 aa, Staphylococcus aureus
VILAEIFDKVGVPKGVF

SEQ ID NO: 1650958 - protein, 19 aa, Staphylococcus aureus
YIDAFKVFIHHVALHVSHR

SEQ ID NO: 1650959 - protein, 24 aa, Staphylococcus aureus
AAGYACGYHLVKYFLQKTNIPIEV

SEQ ID NO: 1650960 - protein, 18 aa, Staphylococcus aureus
AEELYKYPVQDIMTEEFS

SEQ ID NO: 1650961 - protein, 24 aa, Staphylococcus aureus
AIQLALNVVEPFASGIGGGGYLLY

SEQ ID NO: 1650962 - protein, 24 aa, Staphylococcus aureus
ARRVLAIECVIALQAAELKGVEGL

SEQ ID NO: 1650963 - protein, 20 aa, Staphylococcus aureus
CIEFVARAVAQSHFKVLEGN

SEQ ID NO: 1650964 - protein, 17 aa, Staphylococcus aureus
CNYLKDLFDKYDIKSEI

SEQ ID NO: 1650965 - protein, 18 aa, Staphylococcus aureus
DIENGLKGEEKVLIEQMA

SEQ ID NO: 1650966 - protein, 20 aa, Staphylococcus aureus
DIFLGIPYAEPPVHDNRFKH

SEQ ID NO: 1650967 - protein, 19 aa, Staphylococcus aureus
DKGLIYKGKKPVYWSPSSE

SEQ ID NO: 1650968 - protein, 17 aa, Staphylococcus aureus
DKSYPYISFIPMTDDVE

SEQ ID NO: 1650969 - protein, 20 aa, Staphylococcus aureus
DTIEMERLFNGLKDEGAILM

SEQ ID NO: 1650970 - protein, 25 aa, Staphylococcus aureus
DTMALPPCHTMFQFYVQDGKLSCQL

SEQ ID NO: 1650971 - protein, 18 aa, Staphylococcus aureus
DVGNLYLNRGCTSAVVGY

SEQ ID NO: 1650972 - protein, 20 aa, Staphylococcus aureus
EALMGKYRISGVPIVDNKED

SEQ ID NO: 1650973 - protein, 17 aa, Staphylococcus aureus
EDIAFADSRIRKETIAA

SEQ ID NO: 1650974 - protein, 23 aa, Staphylococcus aureus
EEFYKVAQALLINIGTLTAQNEQ

SEQ ID NO: 1650975 - protein, 20 aa, Staphylococcus aureus
EEVEKAYQFLVNEGYESISA

SEQ ID NO: 1650976 - protein, 25 aa, Staphylococcus aureus
EFYPHLNTGMSFIRGVGYPKQQFAN

SEQ ID NO: 1650977 - protein, 27 aa, Staphylococcus aureus
EGPERFWPADLVLLSIGFEGTEPTVPN

SEQ ID NO: 1650978 - protein, 19 aa, Staphylococcus aureus
EHYAIEAKPGICIIGEVVG

SEQ ID NO: 1650979 - protein, 24 aa, Staphylococcus aureus
EKHHLRVVGGFQFSSHKSDDEWRE

SEQ ID NO: 1650980 - protein, 18 aa, Staphylococcus aureus
ENRLPFILFSASGGARMQ

SEQ ID NO: 1650981 - protein, 26 aa, Staphylococcus aureus
ESLPVYKPTLPPMVFGNRDKKIKGGT

SEQ ID NO: 1650982 - protein, 18 aa, Staphylococcus aureus
FEERLKAVLKEVKESDGR

SEQ ID NO: 1650983 - protein, 18 aa, Staphylococcus aureus
FINPFEVVYYAGGTSNAF

SEQ ID NO: 1650984 - protein, 17 aa, Staphylococcus aureus
FNAKLLAMICNRPNVRQ

SEQ ID NO: 1650985 - protein, 20 aa, Staphylococcus aureus
FTPKYHKLAEAERNWINSQK

SEQ ID NO: 1650986 - protein, 18 aa, Staphylococcus aureus
GRDGFVMGEGAGILVIES

SEQ ID NO: 1650987 - protein, 17 aa, Staphylococcus aureus
GTASIGVFNNYQRNDAC

SEQ ID NO: 1650988 - protein, 27 aa, Staphylococcus aureus
GTYRALTKVFTRFGIEVDFVDTTHTDS

SEQ ID NO: 1650989 - protein, 19 aa, Staphylococcus aureus
GTYYPRTFIQQLFVDGYFG

SEQ ID NO: 1650990 - protein, 19 aa, Staphylococcus aureus
IAISDRFKLLQSQYTDEKY

SEQ ID NO: 1650991 - protein, 19 aa, Staphylococcus aureus
IDEGCLIEDGHCIRTIHAE

SEQ ID NO: 1650992 - protein, 22 aa, Staphylococcus aureus
IDKSNVRFVIHYNMPGDLESYY

SEQ ID NO: 1650993 - protein, 23 aa, Staphylococcus aureus
IHEKLYDLIMCHLQRYKNENDQI

SEQ ID NO: 1650994 - protein, 17 aa, Staphylococcus aureus
IIDRQGNVVNRFLPMED

SEQ ID NO: 1650995 - protein, 20 aa, Staphylococcus aureus
ILGICLGAQALTCYYGGEVI

SEQ ID NO: 1650996 - protein, 22 aa, Staphylococcus aureus
IMKEEKDRLSGEDTREGMTAII

SEQ ID NO: 1650997 - protein, 20 aa, Staphylococcus aureus
IRLLYARVGKPYCPNHNIEI

SEQ ID NO: 1650998 - protein, 19 aa, Staphylococcus aureus
KAQIYGFIVGSGLRGPLHK

SEQ ID NO: 1650999 - protein, 19 aa, Staphylococcus aureus
KEQLRTNVGMVFQQPNPFP

SEQ ID NO: 1651000 - protein, 17 aa, Staphylococcus aureus
KEVAPKLEIHLSTQQSL

SEQ ID NO: 1651001 - protein, 20 aa, Staphylococcus aureus
KGTVEAILFQNSDNFYTVLK

SEQ ID NO: 1651002 - protein, 21 aa, Staphylococcus aureus
KLEDDALCFYDIGSSEMNVDM

SEQ ID NO: 1651003 - protein, 25 aa, Staphylococcus aureus
KLILFEKHFEPVPGIKMQHSGGHSF

SEQ ID NO: 1651004 - protein, 18 aa, Staphylococcus aureus
KMGLQIRHYTVQSLKLLK

SEQ ID NO: 1651005 - protein, 19 aa, Staphylococcus aureus
LANFLYFVAQKNMGIGAGD

SEQ ID NO: 1651006 - protein, 21 aa, Staphylococcus aureus
LDTESLLGFKTIKTNAEGQQE

SEQ ID NO: 1651007 - protein, 23 aa, Staphylococcus aureus
LEKLQKILILKSFDFDIAKIKQY

SEQ ID NO: 1651008 - protein, 19 aa, Staphylococcus aureus
LEKTRKALEDYGIDYDQII

SEQ ID NO: 1651009 - protein, 21 aa, Staphylococcus aureus
LETFLFFSGFYYPLYLAGQGK

SEQ ID NO: 1651010 - protein, 17 aa, Staphylococcus aureus
LKAREKYGLEKVIADNY

SEQ ID NO: 1651011 - protein, 25 aa, Staphylococcus aureus
LKKRTHFNIAGAFNPNVRKLDGAVK

SEQ ID NO: 1651012 - protein, 25 aa, Staphylococcus aureus
LKNVFDLLPVNAFRDKVIGLVATAG

SEQ ID NO: 1651013 - protein, 26 aa, Staphylococcus aureus
LNGPKARLKLLVALSNNLDKAEIKSY

SEQ ID NO: 1651014 - protein, 17 aa, Staphylococcus aureus
LVVSGRMPAVSNIQEDH

SEQ ID NO: 1651015 - protein, 18 aa, Staphylococcus aureus
MGIIKMKLPIEDLEKKQK

SEQ ID NO: 1651016 - protein, 23 aa, Staphylococcus aureus
MPKEERPRLTLVAFSNDATEALG

SEQ ID NO: 1651017 - protein, 18 aa, Staphylococcus aureus
MYIIVSYGVKISEVANNV

SEQ ID NO: 1651018 - protein, 17 aa, Staphylococcus aureus
NEIKATHIYNAISGQQQ

SEQ ID NO: 1651019 - protein, 17 aa, Staphylococcus aureus
NEYQGAVVVFTGHVREW

SEQ ID NO: 1651020 - protein, 18 aa, Staphylococcus aureus
NSNEYPEIVFVGNHLSST

SEQ ID NO: 1651021 - protein, 24 aa, Staphylococcus aureus
NYYMYKKFGVIPEMEYEMEEVKEI

SEQ ID NO: 1651022 - protein, 24 aa, Staphylococcus aureus
PGAAVKYIEIEGVLHEFSAVDNVV

SEQ ID NO: 1651023 - protein, 19 aa, Staphylococcus aureus
PKLGQSTGFDYTRTKNPTR

SEQ ID NO: 1651024 - protein, 17 aa, Staphylococcus aureus
PTNLKIIKSYGANVEMV

SEQ ID NO: 1651025 - protein, 17 aa, Staphylococcus aureus
QEMEYRKLGKYPPYYYL

SEQ ID NO: 1651026 - protein, 19 aa, Staphylococcus aureus
QHAPGWGLDALKYLIEERR

SEQ ID NO: 1651027 - protein, 26 aa, Staphylococcus aureus
QHCEAFKANFKGAAQGDWVKSAMSEI

SEQ ID NO: 1651028 - protein, 18 aa, Staphylococcus aureus
QIEARLDIVDEFSAHFIE

SEQ ID NO: 1651029 - protein, 18 aa, Staphylococcus aureus
QLVPRLQEAFSNIKVGDP

SEQ ID NO: 1651030 - protein, 24 aa, Staphylococcus aureus
QVANCPKQYLAHVLSKHGFTCKKE

SEQ ID NO: 1651031 - protein, 18 aa, Staphylococcus aureus
RAYLKERNAIMTDIAQDI

SEQ ID NO: 1651032 - protein, 25 aa, Staphylococcus aureus
RESDGFKDIRDVLGQVYETAEELDQ

SEQ ID NO: 1651033 - protein, 23 aa, Staphylococcus aureus
RVGRSSRIGYAYFLHPANKVLTE

SEQ ID NO: 1651034 - protein, 24 aa, Staphylococcus aureus
SGNGFIGQSFIKYDDFETLIEGYP

SEQ ID NO: 1651035 - protein, 22 aa, Staphylococcus aureus
SHLVPYLKVIEQLTLVGQEAGM

SEQ ID NO: 1651036 - protein, 24 aa, Staphylococcus aureus
SIESKEHYRILCIDGGSTDQTIPM

SEQ ID NO: 1651037 - protein, 17 aa, Staphylococcus aureus
SITPYEGGIAFASKPLI

SEQ ID NO: 1651038 - protein, 19 aa, Staphylococcus aureus
SLISTDFIEDFSVFDGQTI

SEQ ID NO: 1651039 - protein, 18 aa, Staphylococcus aureus
SQQQLRYFFSHNHSLPSS

SEQ ID NO: 1651040 - protein, 18 aa, Staphylococcus aureus
SSVMFDFGVLKRPQIFYA

SEQ ID NO: 1651041 - protein, 18 aa, Staphylococcus aureus
TAVGFIRNGGFNIYSHPE

SEQ ID NO: 1651042 - protein, 19 aa, Staphylococcus aureus
TLMPGGVNSPVRAFKSVDT

SEQ ID NO: 1651043 - protein, 19 aa, Staphylococcus aureus
TNDVVKNFTANGLLSIGAS

SEQ ID NO: 1651044 - protein, 23 aa, Staphylococcus aureus
TPMIKYKVPRAFVEISPELAEDR

SEQ ID NO: 1651045 - protein, 26 aa, Staphylococcus aureus
VECHFKRTSRKLFIEKLKSVQYDLQN

SEQ ID NO: 1651046 - protein, 20 aa, Staphylococcus aureus
VQPNAKFPPSLRNMYKELAD

SEQ ID NO: 1651047 - protein, 25 aa, Staphylococcus aureus
WMAMFKDMNFELGIMELYAIESDAL

SEQ ID NO: 1651048 - protein, 19 aa, Staphylococcus aureus
YLDKDLETIVGVQTEKPFK

SEQ ID NO: 1651049 - protein, 17 aa, Staphylococcus aureus
YQGAVVVFTGHVREWTK

SEQ ID NO: 1651050 - protein, 19 aa, Staphylococcus aureus
YQLMFRMGKDSNIHEKLYD

SEQ ID NO: 1651051 - protein, 23 aa, Staphylococcus aureus
ADFADIFCETGVFTIEQSQHYMQ

SEQ ID NO: 1651052 - protein, 18 aa, Staphylococcus aureus
AEHGSNIWFEREAKDLLP

SEQ ID NO: 1651053 - protein, 23 aa, Staphylococcus aureus
AIQEYYPNFTLDYDVDPIRQGIA

SEQ ID NO: 1651054 - protein, 17 aa, Staphylococcus aureus
AIRIFRAAAELDISTVA

SEQ ID NO: 1651055 - protein, 24 aa, Staphylococcus aureus
AIRRRAVPTWGVFLDEEAQGGGPL

SEQ ID NO: 1651056 - protein, 23 aa, Staphylococcus aureus
AIVSVKFDINYSLKPLKLSNRQV

SEQ ID NO: 1651057 - protein, 25 aa, Staphylococcus aureus
AKKRALEILNLVGLPNAEKRFKAYP

SEQ ID NO: 1651058 - protein, 19 aa, Staphylococcus aureus
AKLSLLAEELLRDINKETV

SEQ ID NO: 1651059 - protein, 19 aa, Staphylococcus aureus
ARLDIVDEFSAHFIERDTL

SEQ ID NO: 1651060 - protein, 23 aa, Staphylococcus aureus
ASDLRAGACLIIAGLIAEGVTTI

SEQ ID NO: 1651061 - protein, 25 aa, Staphylococcus aureus
AVIAEKSIEMIIAMIGVLKAGGAYV

SEQ ID NO: 1651062 - protein, 21 aa, Staphylococcus aureus
DEKILKVDGFLNHQIDAKLMN

SEQ ID NO: 1651063 - protein, 22 aa, Staphylococcus aureus
DFEKHMYAIHILTSLYASTSNT

SEQ ID NO: 1651064 - protein, 22 aa, Staphylococcus aureus
DFGYMWECPDYFNVDNQDVILI

SEQ ID NO: 1651065 - protein, 22 aa, Staphylococcus aureus
DIVELLKYLYIEEVAFVCHEMG

SEQ ID NO: 1651066 - protein, 22 aa, Staphylococcus aureus
DKESKQLAAIKQWLPNPETNSA

SEQ ID NO: 1651067 - protein, 25 aa, Staphylococcus aureus
DRIRRLLKMYLERESFEIHEASNGQ

SEQ ID NO: 1651068 - protein, 20 aa, Staphylococcus aureus
DRPLIKPAAFASEIHGESGL

SEQ ID NO: 1651069 - protein, 23 aa, Staphylococcus aureus
DSKELLIADSFYREEYALYDDIF

SEQ ID NO: 1651070 - protein, 18 aa, Staphylococcus aureus
DSPVKYTKHIGGTHHFKY

SEQ ID NO: 1651071 - protein, 27 aa, Staphylococcus aureus
DVKLEPPIKEWEKMGLLTIVDDDVIEI

SEQ ID NO: 1651072 - protein, 19 aa, Staphylococcus aureus
EDKGCPWDKVQTHETLKRY

SEQ ID NO: 1651073 - protein, 19 aa, Staphylococcus aureus
EEEPDIIVIAGDLYDTTYP

SEQ ID NO: 1651074 - protein, 24 aa, Staphylococcus aureus
EENFKRLNNSLARLEMPQVDEAEL

SEQ ID NO: 1651075 - protein, 20 aa, Staphylococcus aureus
EFIHQYPLAVVHVMRDQCSV

SEQ ID NO: 1651076 - protein, 22 aa, Staphylococcus aureus
EFLNKPPSAWVILAKPNLGISS

SEQ ID NO: 1651077 - protein, 19 aa, Staphylococcus aureus
EFTKLTLPLLKNADIYFDN

SEQ ID NO: 1651078 - protein, 24 aa, Staphylococcus aureus
EGELKVSFDYIDWINTEFDQLGRQ

SEQ ID NO: 1651079 - protein, 19 aa, Staphylococcus aureus
EILEMGGGILSTVNATRET

SEQ ID NO: 1651080 - protein, 20 aa, Staphylococcus aureus
EKRDVMISGLGFITIGPGAK

SEQ ID NO: 1651081 - protein, 26 aa, Staphylococcus aureus
ELMLEFQKRGAVAFDYGNNIRQVAFN

SEQ ID NO: 1651082 - protein, 18 aa, Staphylococcus aureus
FAVSRSAGWIAHILEQYK

SEQ ID NO: 1651083 - protein, 17 aa, Staphylococcus aureus
FDHMWGYFKKCANEEER

SEQ ID NO: 1651084 - protein, 19 aa, Staphylococcus aureus
FDKQLALKYRFNRLKLTTI

SEQ ID NO: 1651085 - protein, 30 aa, Staphylococcus aureus
FLTKDLFIDWTWGEKFFRKHLIDYDAASNI

SEQ ID NO: 1651086 - protein, 19 aa, Staphylococcus aureus
GDVVFRKGDKVLQLVNRPN

SEQ ID NO: 1651087 - protein, 18 aa, Staphylococcus aureus
GEKKRAAITHLLNQEISV

SEQ ID NO: 1651088 - protein, 25 aa, Staphylococcus aureus
GGHAPDLIKSAAFSNILPSSTNPTL

SEQ ID NO: 1651089 - protein, 18 aa, Staphylococcus aureus
GKEIHFAHFFEFENHKKD

SEQ ID NO: 1651090 - protein, 23 aa, Staphylococcus aureus
GKFKDFFDFARRIPKRVKTRKLL

SEQ ID NO: 1651091 - protein, 19 aa, Staphylococcus aureus
GKQPMSVTFEFQLNHRIYK

SEQ ID NO: 1651092 - protein, 24 aa, Staphylococcus aureus
HDGKERLNYGASWFEHNQLFIRTD

SEQ ID NO: 1651093 - protein, 17 aa, Staphylococcus aureus
HVEELKRMGANIEVDEG

SEQ ID NO: 1651094 - protein, 32 aa, Staphylococcus aureus
IAIERAAKVLGSWRLEGCTLYVTLEPCVMCAG

SEQ ID NO: 1651095 - protein, 22 aa, Staphylococcus aureus
IDTSCSRGEWGFDPKYDLASMT

SEQ ID NO: 1651096 - protein, 24 aa, Staphylococcus aureus
IGSSEMNVDMAIEMYDGNHRVLKV

SEQ ID NO: 1651097 - protein, 24 aa, Staphylococcus aureus
IIDETLCTMWQGFNYEIDMNQEPG

SEQ ID NO: 1651098 - protein, 21 aa, Staphylococcus aureus
IITKEQLKMFVYDYDTNLIKN

SEQ ID NO: 1651099 - protein, 20 aa, Staphylococcus aureus
IKEHMASLVYKLEEMGVELD

SEQ ID NO: 1651100 - protein, 18 aa, Staphylococcus aureus
IKVVKAVKEATGLGLKDA

SEQ ID NO: 1651101 - protein, 18 aa, Staphylococcus aureus
ILFNYDRLSQYDLTMKIS

SEQ ID NO: 1651102 - protein, 22 aa, Staphylococcus aureus
ILTSICKKWYINSFKYFRNMYK

SEQ ID NO: 1651103 - protein, 24 aa, Staphylococcus aureus
IMEKDMAYELGFEHGLLFKDGVTV

SEQ ID NO: 1651104 - protein, 21 aa, Staphylococcus aureus
INFAAAYKAPAIFVIQNNNYA

SEQ ID NO: 1651105 - protein, 24 aa, Staphylococcus aureus
INQYLEYDVEAFKKRYRQLREEYY

SEQ ID NO: 1651106 - protein, 18 aa, Staphylococcus aureus
INRMFWRARRRESIFIQY

SEQ ID NO: 1651107 - protein, 19 aa, Staphylococcus aureus
IQFTPVIKCIAGDRTIVES

SEQ ID NO: 1651108 - protein, 23 aa, Staphylococcus aureus
IQKALDIISDVPLFKRTKQDIHE

SEQ ID NO: 1651109 - protein, 19 aa, Staphylococcus aureus
KAQAFDEILEGLPNAMQDA

SEQ ID NO: 1651110 - protein, 22 aa, Staphylococcus aureus
KAQNLRFAQDVTQARDEVGKSI

SEQ ID NO: 1651111 - protein, 21 aa, Staphylococcus aureus
KDAEIPFDMEKVIQKEITVVG

SEQ ID NO: 1651112 - protein, 17 aa, Staphylococcus aureus
KLYKAIRGEGAFCNGIK

SEQ ID NO: 1651113 - protein, 37 aa, Staphylococcus aureus
KNLIGAFYRPTAVIYDLDFLKTLPFEQILSGYAEVYK

SEQ ID NO: 1651114 - protein, 18 aa, Staphylococcus aureus
KSLIIKKEVLKQINKLNI

SEQ ID NO: 1651115 - protein, 19 aa, Staphylococcus aureus
KSYPMIPGIDLAGTIVESE

SEQ ID NO: 1651116 - protein, 29 aa, Staphylococcus aureus
KWYINSFKYFRNMYKGFYYSRPDKLDKCF

SEQ ID NO: 1651117 - protein, 19 aa, Staphylococcus aureus
LDGYASLWVNVHGHNNKYL

SEQ ID NO: 1651118 - protein, 18 aa, Staphylococcus aureus
LDVDFKFNREEETLRIYR

SEQ ID NO: 1651119 - protein, 18 aa, Staphylococcus aureus
LEDLAGEDFILFNKDFYL

SEQ ID NO: 1651120 - protein, 21 aa, Staphylococcus aureus
LGIKLAERGHEVHFITSNIPF

SEQ ID NO: 1651121 - protein, 17 aa, Staphylococcus aureus
LIKRLIQVQNQFKTFYN

SEQ ID NO: 1651122 - protein, 18 aa, Staphylococcus aureus
LKEKYTIIMVTHNMQQAA

SEQ ID NO: 1651123 - protein, 21 aa, Staphylococcus aureus
LKIDLHIAREMEIEQAPSLVF

SEQ ID NO: 1651124 - protein, 19 aa, Staphylococcus aureus
LKRRGIDINEAFNQVKRYR

SEQ ID NO: 1651125 - protein, 24 aa, Staphylococcus aureus
LLHRENEAVLQYCVDHQITFIPYF

SEQ ID NO: 1651126 - protein, 22 aa, Staphylococcus aureus
LLKRLEPHIDHFVFDANSNDAV

SEQ ID NO: 1651127 - protein, 19 aa, Staphylococcus aureus
LPQVDSFVNLMASFVEQPK

SEQ ID NO: 1651128 - protein, 17 aa, Staphylococcus aureus
LQPAAGAHGEWTALMIF

SEQ ID NO: 1651129 - protein, 17 aa, Staphylococcus aureus
LQYNLPIYNSFGMTETC

SEQ ID NO: 1651130 - protein, 17 aa, Staphylococcus aureus
LSGKAAHITDYSNASRT

SEQ ID NO: 1651131 - protein, 25 aa, Staphylococcus aureus
LSTGEPCLRYHQTFYTMTGKPFDSS

SEQ ID NO: 1651132 - protein, 17 aa, Staphylococcus aureus
LVGCEQMSQCFKQSLGA

SEQ ID NO: 1651133 - protein, 17 aa, Staphylococcus aureus
LVHCPERVLPGKILEEL

SEQ ID NO: 1651134 - protein, 23 aa, Staphylococcus aureus
LWNKVNPSFALKSMFGGYDELME

SEQ ID NO: 1651135 - protein, 19 aa, Staphylococcus aureus
LYPDLTIYLNVSAEVGRER

SEQ ID NO: 1651136 - protein, 18 aa, Staphylococcus aureus
MAIYPCLASGGTLNLVDK

SEQ ID NO: 1651137 - protein, 24 aa, Staphylococcus aureus
NIHEKMAVFDLYFRKMPFNSGYAV

SEQ ID NO: 1651138 - protein, 18 aa, Staphylococcus aureus
NQSAFSITVYTNLDYTAD

SEQ ID NO: 1651139 - protein, 24 aa, Staphylococcus aureus
NREVVDYFVHFARVVFERYKDKVT

SEQ ID NO: 1651140 - protein, 18 aa, Staphylococcus aureus
PDMYKRVMDLGVHCSVVG

SEQ ID NO: 1651141 - protein, 20 aa, Staphylococcus aureus
PEAIERPAVVTIMGHVDHGK

SEQ ID NO: 1651142 - protein, 27 aa, Staphylococcus aureus
PLVDFYNRMAFDFGTLGNHEFNYGLPY

SEQ ID NO: 1651143 - protein, 25 aa, Staphylococcus aureus
PRIYSSHPNRIEWEPQFSQSTILAL

SEQ ID NO: 1651144 - protein, 25 aa, Staphylococcus aureus
PTLKEILRHRGIDAGLPKRPFKPFN

SEQ ID NO: 1651145 - protein, 18 aa, Staphylococcus aureus
QAIKDTIKKASIASGVDI

SEQ ID NO: 1651146 - protein, 26 aa, Staphylococcus aureus
QAYVKRLAIDSCIEFVARAVAQSHFK

SEQ ID NO: 1651147 - protein, 34 aa, Staphylococcus aureus
QKVSMIFQHFNLLWSRTVLKNIMFPLEIAGVPRR

SEQ ID NO: 1651148 - protein, 21 aa, Staphylococcus aureus
QLCTPKDVFAREVQIDAISTG

SEQ ID NO: 1651149 - protein, 18 aa, Staphylococcus aureus
QLENKGWNALFIENHDQP

SEQ ID NO: 1651150 - protein, 20 aa, Staphylococcus aureus
QPEGAFYIFPSIKHITDDDF

SEQ ID NO: 1651151 - protein, 17 aa, Staphylococcus aureus
RAYNYHGEWKLKSADEF

SEQ ID NO: 1651152 - protein, 20 aa, Staphylococcus aureus
RDAIKNVALMIGIPPGLIYG

SEQ ID NO: 1651153 - protein, 20 aa, Staphylococcus aureus
REIPADLVVMAVGIRPYTEV

SEQ ID NO: 1651154 - protein, 21 aa, Staphylococcus aureus
RVIEGNSGLFVAMPSKRTPDG

SEQ ID NO: 1651155 - protein, 17 aa, Staphylococcus aureus
RVLLALINKGMVREEAY

SEQ ID NO: 1651156 - protein, 22 aa, Staphylococcus aureus
SDFDKMRFVHHSIPSINVNDID

SEQ ID NO: 1651157 - protein, 21 aa, Staphylococcus aureus
SENWFKQTVASWCYYSDMPSD

SEQ ID NO: 1651158 - protein, 24 aa, Staphylococcus aureus
SFSPDKILGAILFEQTMDREVEGK

SEQ ID NO: 1651159 - protein, 19 aa, Staphylococcus aureus
SGNRNWGLNFAKAGRTISE

SEQ ID NO: 1651160 - protein, 18 aa, Staphylococcus aureus
SHVLKYCQYIYVLKEGQI

SEQ ID NO: 1651161 - protein, 17 aa, Staphylococcus aureus
SKEIVALYDYLPSEMER

SEQ ID NO: 1651162 - protein, 19 aa, Staphylococcus aureus
SKPFFLEFMAKDVSKGNAI

SEQ ID NO: 1651163 - protein, 26 aa, Staphylococcus aureus
SKSLTIKTLLTWLARHHFNYQEINER

SEQ ID NO: 1651164 - protein, 23 aa, Staphylococcus aureus
SLLNSAQMNIVFGGHSDEDERYI

SEQ ID NO: 1651165 - protein, 23 aa, Staphylococcus aureus
SLTEIKSRVEALLPEIKSIGMAI

SEQ ID NO: 1651166 - protein, 25 aa, Staphylococcus aureus
SPYTRSKFYSELKVLEAVNNGLDGR

SEQ ID NO: 1651167 - protein, 22 aa, Staphylococcus aureus
SRYQMYWQIYFHPVSRGGEVLL

SEQ ID NO: 1651168 - protein, 22 aa, Staphylococcus aureus
SVPEIAEKYIAAFHEDVGALNV

SEQ ID NO: 1651169 - protein, 18 aa, Staphylococcus aureus
TAVVKFFNVFGPRQDPKS

SEQ ID NO: 1651170 - protein, 24 aa, Staphylococcus aureus
TEMKLVFLEGIFKTLLNKNSQVVF

SEQ ID NO: 1651171 - protein, 18 aa, Staphylococcus aureus
TGIFDLFGYDLKDYDELF

SEQ ID NO: 1651172 - protein, 20 aa, Staphylococcus aureus
TGNVRRFIKRTELENTLEIT

SEQ ID NO: 1651173 - protein, 29 aa, Staphylococcus aureus
TLVKRIFNEWQIPIIFVTHSNYEAEQMAH

SEQ ID NO: 1651174 - protein, 25 aa, Staphylococcus aureus
TLWKKAKPGEISWDSPFGEGRPGWH

SEQ ID NO: 1651175 - protein, 27 aa, Staphylococcus aureus
TMKQKALAKVRMSEIGFILQATNLVPF

SEQ ID NO: 1651176 - protein, 24 aa, Staphylococcus aureus
TNGEYFRGGIIIEQLLKLSSKVEG

SEQ ID NO: 1651177 - protein, 25 aa, Staphylococcus aureus
TNKGRYLFIPVHKLADIRWKELGQH

SEQ ID NO: 1651178 - protein, 17 aa, Staphylococcus aureus
TPITPVIIGDEKTTQEF

SEQ ID NO: 1651179 - protein, 21 aa, Staphylococcus aureus
TQTICRDLLDLIGHSSQPQEI

SEQ ID NO: 1651180 - protein, 27 aa, Staphylococcus aureus
TRKIDMSEIKTALIAVGPENDKGKRLE

SEQ ID NO: 1651181 - protein, 18 aa, Staphylococcus aureus
TTEIPRLINTAIAERRPV

SEQ ID NO: 1651182 - protein, 22 aa, Staphylococcus aureus
VAESRLDNIISIADQDLTYTLL

SEQ ID NO: 1651183 - protein, 27 aa, Staphylococcus aureus
VEEFFRAVVINARLTTHIDLIRGGNTH

SEQ ID NO: 1651184 - protein, 18 aa, Staphylococcus aureus
VGNADVTYGLAIDGDKVT

SEQ ID NO: 1651185 - protein, 21 aa, Staphylococcus aureus
VLDSARLQYLISQELGVAPSS

SEQ ID NO: 1651186 - protein, 25 aa, Staphylococcus aureus
VNPMLRLLKTDVLTASYLKSAYLVD

SEQ ID NO: 1651187 - protein, 23 aa, Staphylococcus aureus
VSQIKRLKFDSLIIDNANLSSPY

SEQ ID NO: 1651188 - protein, 19 aa, Staphylococcus aureus
VSRLSDILEEFLSADKYVF

SEQ ID NO: 1651189 - protein, 23 aa, Staphylococcus aureus
VTLEPCVMCAGTIVMSRIPRVVY

SEQ ID NO: 1651190 - protein, 23 aa, Staphylococcus aureus
VVECSGAVPAARQGLDILRKKGF

SEQ ID NO: 1651191 - protein, 17 aa, Staphylococcus aureus
VVETFQGAGVISRELEN

SEQ ID NO: 1651192 - protein, 17 aa, Staphylococcus aureus
WAPSLAMRLILGQMSTV

SEQ ID NO: 1651193 - protein, 18 aa, Staphylococcus aureus
YATLCGRDTVQYENASIT

SEQ ID NO: 1651194 - protein, 18 aa, Staphylococcus aureus
YDSTVFFDKRAQLIECLE

SEQ ID NO: 1651195 - protein, 26 aa, Staphylococcus aureus
YEAWTKKDLLKQWFMTSARTNKEIEA

SEQ ID NO: 1651196 - protein, 24 aa, Staphylococcus aureus
YLKHLKTAFPERQYITNINKSNAH

SEQ ID NO: 1651197 - protein, 25 aa, Staphylococcus aureus
YLVDRVIPMIPHRLSNGICSLNPHV

SEQ ID NO: 1651198 - protein, 18 aa, Staphylococcus aureus
YWYNYTSDDLINFKAEGP

SEQ ID NO: 1651199 - protein, 17 aa, Staphylococcus aureus
AAFASEIHGESGLDGPK

SEQ ID NO: 1651200 - protein, 17 aa, Staphylococcus aureus
ADAAGMDAVIMEKGTTD

SEQ ID NO: 1651201 - protein, 20 aa, Staphylococcus aureus
ADKHSLVLFDELGAGTDPSE

SEQ ID NO: 1651202 - protein, 25 aa, Staphylococcus aureus
ADVNFKVVKEFIKTVSERALGSDVM

SEQ ID NO: 1651203 - protein, 18 aa, Staphylococcus aureus
AFIHRADIGGVLNVSELN

SEQ ID NO: 1651204 - protein, 24 aa, Staphylococcus aureus
AILKAEGNMNIFIIEYDDVNKDIA

SEQ ID NO: 1651205 - protein, 19 aa, Staphylococcus aureus
ALSSGRTFIGQTTFHPEKL

SEQ ID NO: 1651206 - protein, 24 aa, Staphylococcus aureus
APVIWRGPMLGKMLTNFFTEVKWG

SEQ ID NO: 1651207 - protein, 18 aa, Staphylococcus aureus
AQEGVTFLISSHILSELV

SEQ ID NO: 1651208 - protein, 24 aa, Staphylococcus aureus
ASDKFGRQCICIAIDSYYDPERKA

SEQ ID NO: 1651209 - protein, 25 aa, Staphylococcus aureus
ASIPLQMCSVMEDFYIEKLITGGAT

SEQ ID NO: 1651210 - protein, 18 aa, Staphylococcus aureus
CSHFGSTPPCVNKIIDCK

SEQ ID NO: 1651211 - protein, 25 aa, Staphylococcus aureus
DAEKELAESVLPYHPLFIKPNKDEL

SEQ ID NO: 1651212 - protein, 25 aa, Staphylococcus aureus
DAVKIVRKRGQLMAQAFPTGVGSMA

SEQ ID NO: 1651213 - protein, 23 aa, Staphylococcus aureus
DDETKAVVMIGEIGGTAEEEAAE

SEQ ID NO: 1651214 - protein, 26 aa, Staphylococcus aureus
DGKVARLTQFGAFIDIGGVDGLVHVS

SEQ ID NO: 1651215 - protein, 18 aa, Staphylococcus aureus
DIRIAFSCVEKEDIPHVF

SEQ ID NO: 1651216 - protein, 23 aa, Staphylococcus aureus
DKDYATISFLNWFLDEQVEEESM

SEQ ID NO: 1651217 - protein, 21 aa, Staphylococcus aureus
DKITLAFDMNKCHFFDEKTGN

SEQ ID NO: 1651218 - protein, 20 aa, Staphylococcus aureus
DKRSASIYVAFDVKDDKGVV

SEQ ID NO: 1651219 - protein, 23 aa, Staphylococcus aureus
DQYMSIEALRAFLEDLNQPFIYI

SEQ ID NO: 1651220 - protein, 17 aa, Staphylococcus aureus
DVVACCLDVGEGKDLDI

SEQ ID NO: 1651221 - protein, 24 aa, Staphylococcus aureus
EAYDLGIRAIMFFGVPNSKDDIGT

SEQ ID NO: 1651222 - protein, 21 aa, Staphylococcus aureus
EDGLTGPIGRFFETENVETLL

SEQ ID NO: 1651223 - protein, 35 aa, Staphylococcus aureus
EEAQRFASDWSEVRPEWGLAKNASFIIGRRQLTKG

SEQ ID NO: 1651224 - protein, 19 aa, Staphylococcus aureus
EGTIAEWLKNVGDSVEKGE

SEQ ID NO: 1651225 - protein, 23 aa, Staphylococcus aureus
EKLSDRALGYGIHGEQVDGNDPL

SEQ ID NO: 1651226 - protein, 21 aa, Staphylococcus aureus
ELRVANILMPLVKNIRNKSAH

SEQ ID NO: 1651227 - protein, 27 aa, Staphylococcus aureus
ENPDELFDAVLMTIKYIMRESKVNQDD

SEQ ID NO: 1651228 - protein, 18 aa, Staphylococcus aureus
EQLLKPLFQHFKEKYPEV

SEQ ID NO: 1651229 - protein, 25 aa, Staphylococcus aureus
ETIGCPIGNYIPEWNDLVYHQDFKT

SEQ ID NO: 1651230 - protein, 25 aa, Staphylococcus aureus
FKQSFKRKQLGFFRMIGYCKLDQCR

SEQ ID NO: 1651231 - protein, 24 aa, Staphylococcus aureus
FQHREPGVFGAAWLNDALHTEMIV

SEQ ID NO: 1651232 - protein, 25 aa, Staphylococcus aureus
FVYGLFIYNQWRGMGTLNSVDVISQ

SEQ ID NO: 1651233 - protein, 22 aa, Staphylococcus aureus
GEIAKGLAFKPANHIIFGGPGK

SEQ ID NO: 1651234 - protein, 25 aa, Staphylococcus aureus
GICPENCGYCGQSRDIKQKQRYALI

SEQ ID NO: 1651235 - protein, 17 aa, Staphylococcus aureus
GIHPEWLYCAKANLVLE

SEQ ID NO: 1651236 - protein, 24 aa, Staphylococcus aureus
GKDLKVAIVVSRFNDFITGRLLEG

SEQ ID NO: 1651237 - protein, 18 aa, Staphylococcus aureus
GKSLELLEKVGLTHVKDQ

SEQ ID NO: 1651238 - protein, 21 aa, Staphylococcus aureus
GNAVMKRFLDSNIKEIRIFSR

SEQ ID NO: 1651239 - protein, 25 aa, Staphylococcus aureus
GRVVKGIQFKGLRDIGNPVDLAMYY

SEQ ID NO: 1651240 - protein, 21 aa, Staphylococcus aureus
GVDFRLIEPRAFYHTLQHFTG

SEQ ID NO: 1651241 - protein, 17 aa, Staphylococcus aureus
HLNGVMFYDHIDKDHPL

SEQ ID NO: 1651242 - protein, 19 aa, Staphylococcus aureus
HPFGGFKMSGTDAKTGSPD

SEQ ID NO: 1651243 - protein, 26 aa, Staphylococcus aureus
HYLIPEMHLKPILSYMKAHTMQTYVF

SEQ ID NO: 1651244 - protein, 26 aa, Staphylococcus aureus
IGTDIPFCIYNKTALCTGRGEKIEFL

SEQ ID NO: 1651245 - protein, 26 aa, Staphylococcus aureus
IGTICIKSNMMFSGYVSEQCINNDEW

SEQ ID NO: 1651246 - protein, 17 aa, Staphylococcus aureus
IHDSRLPFLKDGIDYLT

SEQ ID NO: 1651247 - protein, 18 aa, Staphylococcus aureus
IIDMEMEGLLQLVNPKII

SEQ ID NO: 1651248 - protein, 21 aa, Staphylococcus aureus
IKALADKGTKVIAVVDDAYYG

SEQ ID NO: 1651249 - protein, 19 aa, Staphylococcus aureus
IKATHIYNAISGQQQTDFN

SEQ ID NO: 1651250 - protein, 19 aa, Staphylococcus aureus
ILSVILPQYVESLIYGTIL

SEQ ID NO: 1651251 - protein, 23 aa, Staphylococcus aureus
INPDLIGGFRVKVGTTVLDGSVR

SEQ ID NO: 1651252 - protein, 20 aa, Staphylococcus aureus
IPENQKYGAFHGKEAFKQAI

SEQ ID NO: 1651253 - protein, 18 aa, Staphylococcus aureus
IRMYRSVQTFDFSGEQPF

SEQ ID NO: 1651254 - protein, 18 aa, Staphylococcus aureus
IRYIEQFGLSNSLKRKVH

SEQ ID NO: 1651255 - protein, 30 aa, Staphylococcus aureus
ISEKLVVLLPLKFGDYLSSSSMRSLIDIGA

SEQ ID NO: 1651256 - protein, 22 aa, Staphylococcus aureus
ISKSFDGEDIFTDVDFEVKTGE

SEQ ID NO: 1651257 - protein, 18 aa, Staphylococcus aureus
IYGGVSYTIHVGRPKGQR

SEQ ID NO: 1651258 - protein, 19 aa, Staphylococcus aureus
KAAELQGRVRAERFIHLMQ

SEQ ID NO: 1651259 - protein, 18 aa, Staphylococcus aureus
KAAPLIVTEDTLQKSKGK

SEQ ID NO: 1651260 - protein, 25 aa, Staphylococcus aureus
KDCKYVLSVASPVFFGKTDDAEVMA

SEQ ID NO: 1651261 - protein, 17 aa, Staphylococcus aureus
KELCARFDVSRMTLRQA

SEQ ID NO: 1651262 - protein, 23 aa, Staphylococcus aureus
KESLKPAVIMNEFGKMSVDGALV

SEQ ID NO: 1651263 - protein, 18 aa, Staphylococcus aureus
KGTNFKRLLKSLSPYVKV

SEQ ID NO: 1651264 - protein, 25 aa, Staphylococcus aureus
KHNIKCLRHSRFIFLSPEFLLQPSN

SEQ ID NO: 1651265 - protein, 25 aa, Staphylococcus aureus
KKGLMRHLVVRTGYHTDEMMIIFVT

SEQ ID NO: 1651266 - protein, 23 aa, Staphylococcus aureus
KNTLVFEKFCLTPLLKKIQNELN

SEQ ID NO: 1651267 - protein, 23 aa, Staphylococcus aureus
KPGIKGKEVIPVERHGVKVISMA

SEQ ID NO: 1651268 - protein, 20 aa, Staphylococcus aureus
KRGGTIYAHVMHTHLLINFV

SEQ ID NO: 1651269 - protein, 20 aa, Staphylococcus aureus
KRYQSAASLSDFESSAKSWI

SEQ ID NO: 1651270 - protein, 17 aa, Staphylococcus aureus
KRYTKRSQLRDFNVDVL

SEQ ID NO: 1651271 - protein, 18 aa, Staphylococcus aureus
KSAGTKVVPFISVKESTD

SEQ ID NO: 1651272 - protein, 20 aa, Staphylococcus aureus
KSLADLLPEHRIIINKQPLS

SEQ ID NO: 1651273 - protein, 17 aa, Staphylococcus aureus
KTLPSSIGIIGGGVIGM

SEQ ID NO: 1651274 - protein, 23 aa, Staphylococcus aureus
KVRRAKLYYLRSLRGKAARIQEI

SEQ ID NO: 1651275 - protein, 18 aa, Staphylococcus aureus
LADGREIPADLVVMAVGI

SEQ ID NO: 1651276 - protein, 17 aa, Staphylococcus aureus
LAGLRAIPNMNVIRPAD

SEQ ID NO: 1651277 - protein, 20 aa, Staphylococcus aureus
LEAVELLEAQALQIHVNSPQ

SEQ ID NO: 1651278 - protein, 21 aa, Staphylococcus aureus
LEKSQAFEFIIEGDTLIPPFI

SEQ ID NO: 1651279 - protein, 20 aa, Staphylococcus aureus
LEVIIAPKFTDEALDILKQK

SEQ ID NO: 1651280 - protein, 17 aa, Staphylococcus aureus
LLPEHRIIINKQPLSIE

SEQ ID NO: 1651281 - protein, 18 aa, Staphylococcus aureus
LNQSFPLMVAAVKKTHMI

SEQ ID NO: 1651282 - protein, 18 aa, Staphylococcus aureus
LPSSIGIIGGGVIGMEFA

SEQ ID NO: 1651283 - protein, 19 aa, Staphylococcus aureus
LQEGFKLIETSECVAEKYL

SEQ ID NO: 1651284 - protein, 26 aa, Staphylococcus aureus
LQPLLKRKYPNISFKYTYIDITKDND

SEQ ID NO: 1651285 - protein, 21 aa, Staphylococcus aureus
LREKTGAGMMDCKKALTETDG

SEQ ID NO: 1651286 - protein, 19 aa, Staphylococcus aureus
LTAPVRQIAENAGLEGSVI

SEQ ID NO: 1651287 - protein, 22 aa, Staphylococcus aureus
LVEGFKNADFEKVVVYRNEEEL

SEQ ID NO: 1651288 - protein, 20 aa, Staphylococcus aureus
LVNEEIWKGIDVNIQEMDIA

SEQ ID NO: 1651289 - protein, 32 aa, Staphylococcus aureus
MALAAKDIRIEAPIPGTSRVGIEVPNQNPTTV

SEQ ID NO: 1651290 - protein, 24 aa, Staphylococcus aureus
MAVHKRITLLIGDLSFYHDMNGLL

SEQ ID NO: 1651291 - protein, 17 aa, Staphylococcus aureus
MGFYRQRSHDIIDMESC

SEQ ID NO: 1651292 - protein, 17 aa, Staphylococcus aureus
MGYGIVFLGSLRNDVER

SEQ ID NO: 1651293 - protein, 25 aa, Staphylococcus aureus
MKDNANYFLSLGIKTVLITLGKQGT

SEQ ID NO: 1651294 - protein, 17 aa, Staphylococcus aureus
MNVKRIWESNTQCYQML

SEQ ID NO: 1651295 - protein, 21 aa, Staphylococcus aureus
MSAGLFIVGRIKGVARPALVV

SEQ ID NO: 1651296 - protein, 18 aa, Staphylococcus aureus
MTPYFPKPDVMIYLECNY

SEQ ID NO: 1651297 - protein, 17 aa, Staphylococcus aureus
MVQVCFLGQAPWGYKKV

SEQ ID NO: 1651298 - protein, 21 aa, Staphylococcus aureus
NGYLFVFVIDYYRHHLVDQHA

SEQ ID NO: 1651299 - protein, 25 aa, Staphylococcus aureus
NHVDARYNLGLALFMKNEDIDEAIT

SEQ ID NO: 1651300 - protein, 27 aa, Staphylococcus aureus
NKEPYRIGLKLSNGGWVYVQGLTHFEV

SEQ ID NO: 1651301 - protein, 18 aa, Staphylococcus aureus
NNLGQSFSFIKHLAEKYK

SEQ ID NO: 1651302 - protein, 21 aa, Staphylococcus aureus
NPEKYKSYFIGDWYVSGDSAY

SEQ ID NO: 1651303 - protein, 23 aa, Staphylococcus aureus
PEGTKYLAWSLIDYDAIPVCGFA

SEQ ID NO: 1651304 - protein, 25 aa, Staphylococcus aureus
PEVTAATFACFGYGWHIDVGIHAIH

SEQ ID NO: 1651305 - protein, 25 aa, Staphylococcus aureus
PHIDHFPEMWLLSSSATSAKIAAEL

SEQ ID NO: 1651306 - protein, 24 aa, Staphylococcus aureus
PMIERLQRELKHISLIQLQNASIA

SEQ ID NO: 1651307 - protein, 25 aa, Staphylococcus aureus
PVHTYKMKFIKSFEAIDLHHNIYEN

SEQ ID NO: 1651308 - protein, 19 aa, Staphylococcus aureus
PVSETWDLVDLFKDDQQYY

SEQ ID NO: 1651309 - protein, 23 aa, Staphylococcus aureus
PYTDKWKRVSVVLNKNTKQSQKE

SEQ ID NO: 1651310 - protein, 21 aa, Staphylococcus aureus
PYYASGGFIHYCEYPKLQHNL

SEQ ID NO: 1651311 - protein, 18 aa, Staphylococcus aureus
QDIVPSYRAVLIYFDEQA

SEQ ID NO: 1651312 - protein, 23 aa, Staphylococcus aureus
QIHQRLFLEQSLITERIKKYFNK

SEQ ID NO: 1651313 - protein, 24 aa, Staphylococcus aureus
QLIDFCKHRHFTLCIEEVFDTTVT

SEQ ID NO: 1651314 - protein, 18 aa, Staphylococcus aureus
QLLLAIRTVYKGETYVDM

SEQ ID NO: 1651315 - protein, 25 aa, Staphylococcus aureus
QSNYIDEFILYYAPKLIGGSGNYQF

SEQ ID NO: 1651316 - protein, 28 aa, Staphylococcus aureus
QVYHLNARLKLQLLDDVKSVFNSQMTQN

SEQ ID NO: 1651317 - protein, 22 aa, Staphylococcus aureus
RDINSYFLIITYRIDKESKQLA

SEQ ID NO: 1651318 - protein, 23 aa, Staphylococcus aureus
RDKPKIVFADAVATTKTSILVGE

SEQ ID NO: 1651319 - protein, 21 aa, Staphylococcus aureus
RKQLEDWLDYEITTLPYDMTI

SEQ ID NO: 1651320 - protein, 18 aa, Staphylococcus aureus
RLALLEADVNFKVVKEFI

SEQ ID NO: 1651321 - protein, 26 aa, Staphylococcus aureus
RLKYYKDRVLVPLAYINFDEYIKELN

SEQ ID NO: 1651322 - protein, 26 aa, Staphylococcus aureus
RQQLNVFRMELLGAKVVAVEDGQGTL

SEQ ID NO: 1651323 - protein, 17 aa, Staphylococcus aureus
RSFEMIAAMLATVKVGA

SEQ ID NO: 1651324 - protein, 18 aa, Staphylococcus aureus
RTEFKWKNESIVGVMLAS

SEQ ID NO: 1651325 - protein, 25 aa, Staphylococcus aureus
RVGRKLECPTGKVLFFHEGVSMNMI

SEQ ID NO: 1651326 - protein, 29 aa, Staphylococcus aureus
RYYFNEGFVPKFKSYFAIGEQTARTIKSY

SEQ ID NO: 1651327 - protein, 24 aa, Staphylococcus aureus
SEKSLKRTPSFSVNRPGEETGVTF

SEQ ID NO: 1651328 - protein, 17 aa, Staphylococcus aureus
SEVLKALNLTFEDIAYQ

SEQ ID NO: 1651329 - protein, 18 aa, Staphylococcus aureus
SMIKGTVEAILFQNSDNF

SEQ ID NO: 1651330 - protein, 18 aa, Staphylococcus aureus
SSRKLDAIKDFKEIDSTD

SEQ ID NO: 1651331 - protein, 21 aa, Staphylococcus aureus
STKAQIAFCIDVRSEPFRRHI

SEQ ID NO: 1651332 - protein, 23 aa, Staphylococcus aureus
STSGKTGFYFRVLKQGYVSPNDQ

SEQ ID NO: 1651333 - protein, 19 aa, Staphylococcus aureus
SVDISYPLTALKLDDVNRV

SEQ ID NO: 1651334 - protein, 18 aa, Staphylococcus aureus
SYFRSSGYDGFMQDYVVM

SEQ ID NO: 1651335 - protein, 18 aa, Staphylococcus aureus
TDKMGVIYHGNYATWFEV

SEQ ID NO: 1651336 - protein, 23 aa, Staphylococcus aureus
TDYAKSIPFNFASYMSASKFFKD

SEQ ID NO: 1651337 - protein, 20 aa, Staphylococcus aureus
TIEPSPIWMQARLIKAGIRP

SEQ ID NO: 1651338 - protein, 19 aa, Staphylococcus aureus
TLEPCSHFGSTPPCVNKII

SEQ ID NO: 1651339 - protein, 24 aa, Staphylococcus aureus
TNRIIKIPVQYGGTYGPDIEEVAK

SEQ ID NO: 1651340 - protein, 25 aa, Staphylococcus aureus
TPVIVKFEAGWCPDCRAMDLWIDPI

SEQ ID NO: 1651341 - protein, 21 aa, Staphylococcus aureus
TSPNPFHLIYSILSKHQSASI

SEQ ID NO: 1651342 - protein, 23 aa, Staphylococcus aureus
TTSFPTPKIFDWLQQQGNIDTNE

SEQ ID NO: 1651343 - protein, 20 aa, Staphylococcus aureus
TVLHLAEWLMEMQLDRKAGN

SEQ ID NO: 1651344 - protein, 18 aa, Staphylococcus aureus
TYGTGGFMLMNTGDKAVK

SEQ ID NO: 1651345 - protein, 22 aa, Staphylococcus aureus
VFHKNHIYTTVFYDKHRRNNVT

SEQ ID NO: 1651346 - protein, 25 aa, Staphylococcus aureus
VFHYFKEAHPYFDQDVVIIGGKNSA

SEQ ID NO: 1651347 - protein, 17 aa, Staphylococcus aureus
VGTAGTILSFFEIPNAG

SEQ ID NO: 1651348 - protein, 18 aa, Staphylococcus aureus
VHFVFDLSLMEIRTIYRM

SEQ ID NO: 1651349 - protein, 29 aa, Staphylococcus aureus
VIMFGGGGYNIWRVVPRAWSHVFLSLIDQ

SEQ ID NO: 1651350 - protein, 18 aa, Staphylococcus aureus
VSDVIPVFAVNKETGKPH

SEQ ID NO: 1651351 - protein, 20 aa, Staphylococcus aureus
VSPIAGRVDNVFPTKHAIGL

SEQ ID NO: 1651352 - protein, 22 aa, Staphylococcus aureus
VTAKFDLSFIIEEDRDDYTINI

SEQ ID NO: 1651353 - protein, 17 aa, Staphylococcus aureus
VVVGIAGKDGEHLDLLS

SEQ ID NO: 1651354 - protein, 25 aa, Staphylococcus aureus
WPRLKEIKVPTLILAGEYDEKFVQI

SEQ ID NO: 1651355 - protein, 17 aa, Staphylococcus aureus
YAALLVPFDENGQVNEQ

SEQ ID NO: 1651356 - protein, 17 aa, Staphylococcus aureus
YDKGGKGLSVIDVMTSG

SEQ ID NO: 1651357 - protein, 26 aa, Staphylococcus aureus
YGHFGRTDVLFPWEKLDKVEELKDAV

SEQ ID NO: 1651358 - protein, 19 aa, Staphylococcus aureus
YLLEHNHLPFSQSDIQFNG

SEQ ID NO: 1651359 - protein, 26 aa, Staphylococcus aureus
YNYHGEWKLKSADEFIKDNRIVTLTE

SEQ ID NO: 1651360 - protein, 26 aa, Staphylococcus aureus
YQRGMKLSAACDTTLKNAEKKVNDLI

SEQ ID NO: 1651361 - protein, 19 aa, Staphylococcus aureus
YRKAYAHFIHQYMKQAAPF

SEQ ID NO: 1651362 - protein, 25 aa, Staphylococcus aureus
YVSGGKRPLVCFFSNDLNIHRTKTE

SEQ ID NO: 1651363 - protein, 25 aa, Staphylococcus aureus
AEQRPRLNHPSLYVDLGDHVDLSAP

SEQ ID NO: 1651364 - protein, 20 aa, Staphylococcus aureus
AESVKLLFNVDCEVKFAEGY

SEQ ID NO: 1651365 - protein, 25 aa, Staphylococcus aureus
AFALKKRGKNAVAITYTGDGGSSQG

SEQ ID NO: 1651366 - protein, 25 aa, Staphylococcus aureus
AGGCFWCMVKPFTSYPGIKSVVSGY

SEQ ID NO: 1651367 - protein, 26 aa, Staphylococcus aureus
AISGKRLDSFGQRGIRATHFSFEDIN

SEQ ID NO: 1651368 - protein, 19 aa, Staphylococcus aureus
AKAKQLPQITVKVSASLDG

SEQ ID NO: 1651369 - protein, 21 aa, Staphylococcus aureus
AKIISELDCLQSFAEIAQKYN

SEQ ID NO: 1651370 - protein, 18 aa, Staphylococcus aureus
ALESAGNMTKFWEIFYER

SEQ ID NO: 1651371 - protein, 19 aa, Staphylococcus aureus
ANLGMAIGVLTGIATKEEL

SEQ ID NO: 1651372 - protein, 23 aa, Staphylococcus aureus
ATEHSLAMLLSMARNIPQAHQSL

SEQ ID NO: 1651373 - protein, 31 aa, Staphylococcus aureus
ATGHIVNLYFPFVEVETMLTLLDMAQIYVSS

SEQ ID NO: 1651374 - protein, 18 aa, Staphylococcus aureus
ATIVMALYQMFHVLPSFS

SEQ ID NO: 1651375 - protein, 26 aa, Staphylococcus aureus
CAGGIARPAASHALHYDVLPDRLVTV

SEQ ID NO: 1651376 - protein, 20 aa, Staphylococcus aureus
CDFYIKIPMVGHVNSLNASV

SEQ ID NO: 1651377 - protein, 24 aa, Staphylococcus aureus
DEAYCLDCKFLSAHFNLMEQLYCQ

SEQ ID NO: 1651378 - protein, 22 aa, Staphylococcus aureus
DIIFKITGIKVMSFHSDLSTVT

SEQ ID NO: 1651379 - protein, 19 aa, Staphylococcus aureus
DKEVTRMSSMRAERVGEQM

SEQ ID NO: 1651380 - protein, 20 aa, Staphylococcus aureus
DKKHFVRYGTMYIPMDETLA

SEQ ID NO: 1651381 - protein, 17 aa, Staphylococcus aureus
DNAELIASFSRALASDL

SEQ ID NO: 1651382 - protein, 22 aa, Staphylococcus aureus
DRLTLSCRMEIDASGRVVKHEI

SEQ ID NO: 1651383 - protein, 19 aa, Staphylococcus aureus
DTFIYCMSGQITLNLGKEI

SEQ ID NO: 1651384 - protein, 36 aa, Staphylococcus aureus
DVFVSGVSIDHLWLYETNKYYALAMELIHQRVKFSA

SEQ ID NO: 1651385 - protein, 26 aa, Staphylococcus aureus
EDLDPTFMWHLAFAYGQEERDKEAQH

SEQ ID NO: 1651386 - protein, 22 aa, Staphylococcus aureus
EDQEVKFEFALFDSDMDNLKHM

SEQ ID NO: 1651387 - protein, 22 aa, Staphylococcus aureus
EEALGYGKWAFRSITEDKHLDL

SEQ ID NO: 1651388 - protein, 23 aa, Staphylococcus aureus
EELESVGFFLVDRNLPGVEIADN

SEQ ID NO: 1651389 - protein, 30 aa, Staphylococcus aureus
EFYHSNPFKFGASIGRYSGRIDNAKFKLKG

SEQ ID NO: 1651390 - protein, 19 aa, Staphylococcus aureus
EHEDCLYLNIWKQHNDQTK

SEQ ID NO: 1651391 - protein, 24 aa, Staphylococcus aureus
EHFSKLDVPFIYRVHEQPKSDRLR

SEQ ID NO: 1651392 - protein, 25 aa, Staphylococcus aureus
ELPNGVELRNRFVLAPLTHISSNDD

SEQ ID NO: 1651393 - protein, 22 aa, Staphylococcus aureus
ENDEVLEYFGLKVLVDKKDAPV

SEQ ID NO: 1651394 - protein, 23 aa, Staphylococcus aureus
ENEGQLIAFIWGHFSNEKSMVNI

SEQ ID NO: 1651395 - protein, 25 aa, Staphylococcus aureus
ENMNAWLKPYRRALHLEEPVVKITE

SEQ ID NO: 1651396 - protein, 19 aa, Staphylococcus aureus
EQLKIRYIEQFGLSNSLKR

SEQ ID NO: 1651397 - protein, 23 aa, Staphylococcus aureus
ERKSIPLKTSFGIWGDGNLGYIT

SEQ ID NO: 1651398 - protein, 18 aa, Staphylococcus aureus
ETDVLFKYVENILNKDKD

SEQ ID NO: 1651399 - protein, 20 aa, Staphylococcus aureus
ETFHAIQGHFTAVFKQLFGG

SEQ ID NO: 1651400 - protein, 25 aa, Staphylococcus aureus
FDSLFKRIPVKPGDFYYVPAGTVHA

SEQ ID NO: 1651401 - protein, 19 aa, Staphylococcus aureus
FIGTFTVEFFIDSNNQLYV

SEQ ID NO: 1651402 - protein, 20 aa, Staphylococcus aureus
FIKDKVIDIMNMFQNHTDIT

SEQ ID NO: 1651403 - protein, 17 aa, Staphylococcus aureus
FISYHIFFETLVRKYNE

SEQ ID NO: 1651404 - protein, 17 aa, Staphylococcus aureus
FKSTIIMVTHDPVAASY

SEQ ID NO: 1651405 - protein, 18 aa, Staphylococcus aureus
FKVYEDDYVYAFLDISQV

SEQ ID NO: 1651406 - protein, 21 aa, Staphylococcus aureus
FKYSTEPILDILVGVENLHDI

SEQ ID NO: 1651407 - protein, 18 aa, Staphylococcus aureus
GAGTVKHFGLQDKIDFQI

SEQ ID NO: 1651408 - protein, 23 aa, Staphylococcus aureus
GASGPLYGFSFVKMSAVTKDDMD

SEQ ID NO: 1651409 - protein, 22 aa, Staphylococcus aureus
GCLGSMHGIEILKTGKEIHFAH

SEQ ID NO: 1651410 - protein, 17 aa, Staphylococcus aureus
GDIIALVGPSGSGKSTF

SEQ ID NO: 1651411 - protein, 18 aa, Staphylococcus aureus
GFNVKAFIRSGVTDEELK

SEQ ID NO: 1651412 - protein, 23 aa, Staphylococcus aureus
GIGTCWKSPLYIYDPKVRKTLGI

SEQ ID NO: 1651413 - protein, 17 aa, Staphylococcus aureus
GKEATDWLIQQGAFSQD

SEQ ID NO: 1651414 - protein, 17 aa, Staphylococcus aureus
GKSIQVLVPKSVENYIK

SEQ ID NO: 1651415 - protein, 18 aa, Staphylococcus aureus
GKYLGVSFHPELTDDYRV

SEQ ID NO: 1651416 - protein, 20 aa, Staphylococcus aureus
GQWFIQGRIDFQIKLNGYRM

SEQ ID NO: 1651417 - protein, 22 aa, Staphylococcus aureus
GRIGAATAKIYAGFGATITAYD

SEQ ID NO: 1651418 - protein, 19 aa, Staphylococcus aureus
GTEAAIAYQSGFNCNMAAI

SEQ ID NO: 1651419 - protein, 18 aa, Staphylococcus aureus
HDRGMKLILDLVVNHTSD

SEQ ID NO: 1651420 - protein, 26 aa, Staphylococcus aureus
HFGISGPAALRCSQFVYKEQKNQKTQ

SEQ ID NO: 1651421 - protein, 19 aa, Staphylococcus aureus
HKPKLIVAGASAYSRTIDF

SEQ ID NO: 1651422 - protein, 18 aa, Staphylococcus aureus
HPSAVIAMERYYQKKDNH

SEQ ID NO: 1651423 - protein, 24 aa, Staphylococcus aureus
HSGILKEGRLEFRPPLVDITQLQP

SEQ ID NO: 1651424 - protein, 34 aa, Staphylococcus aureus
HYLFNAELFKHFKKGAVFVNCARGSLVDTKALLD

SEQ ID NO: 1651425 - protein, 19 aa, Staphylococcus aureus
IASDTIVYYGMKAHAHEFE

SEQ ID NO: 1651426 - protein, 19 aa, Staphylococcus aureus
IDEDKCLVVIPLNKAISES

SEQ ID NO: 1651427 - protein, 17 aa, Staphylococcus aureus
IDMYIIVSYGVKISEVA

SEQ ID NO: 1651428 - protein, 18 aa, Staphylococcus aureus
IEADVPIYYYGFKDSDDI

SEQ ID NO: 1651429 - protein, 18 aa, Staphylococcus aureus
IEIPEGFEVIADSPSTDY

SEQ ID NO: 1651430 - protein, 24 aa, Staphylococcus aureus
IIAIPDWFWSYQMAMTLDEETCFE

SEQ ID NO: 1651431 - protein, 19 aa, Staphylococcus aureus
IICNDAIELNEYFKDGEVS

SEQ ID NO: 1651432 - protein, 25 aa, Staphylococcus aureus
IKLHREFIIEVPYMNSRKFELLIAN

SEQ ID NO: 1651433 - protein, 33 aa, Staphylococcus aureus
IKNLEGSFHFETFISLTCQKCPDVVQALNLMSV

SEQ ID NO: 1651434 - protein, 20 aa, Staphylococcus aureus
IKPGIPLKDIDHIARNIISE

SEQ ID NO: 1651435 - protein, 19 aa, Staphylococcus aureus
IKSKLNIPSVRFVGESNQK

SEQ ID NO: 1651436 - protein, 17 aa, Staphylococcus aureus
ILMISRAVLTPGDTIVT

SEQ ID NO: 1651437 - protein, 25 aa, Staphylococcus aureus
INEFIKPKISVPIHYDTFPLIEQDP

SEQ ID NO: 1651438 - protein, 26 aa, Staphylococcus aureus
INEITYRLSKIFGIKSISPVLKVEKT

SEQ ID NO: 1651439 - protein, 25 aa, Staphylococcus aureus
INPNIKFTMISSIDIAKIASYIFAH

SEQ ID NO: 1651440 - protein, 26 aa, Staphylococcus aureus
KDGRLFVCYLGDFKSTGGIFAATENG

SEQ ID NO: 1651441 - protein, 24 aa, Staphylococcus aureus
KELEREGFHILAIKDMAGLLKPKA

SEQ ID NO: 1651442 - protein, 25 aa, Staphylococcus aureus
KESLRKVKGGFTFAILTKDALYGAV

SEQ ID NO: 1651443 - protein, 24 aa, Staphylococcus aureus
KGFQKKIMYCFNKINAKAQKNHQK

SEQ ID NO: 1651444 - protein, 25 aa, Staphylococcus aureus
KKIVEAWPAGLIVLSGQSGVGKSTF

SEQ ID NO: 1651445 - protein, 18 aa, Staphylococcus aureus
KLLLHKREIIKLGDQTRE

SEQ ID NO: 1651446 - protein, 19 aa, Staphylococcus aureus
KLSGLEKVIYKHLDIADLE

SEQ ID NO: 1651447 - protein, 24 aa, Staphylococcus aureus
KNGFKTTLGLILEKFIEYVSKPKY

SEQ ID NO: 1651448 - protein, 24 aa, Staphylococcus aureus
KNVEQAGAVALVLEAIPNDLAEEI

SEQ ID NO: 1651449 - protein, 23 aa, Staphylococcus aureus
KPIRLDRYFPDWHEAYSKVQTLN

SEQ ID NO: 1651450 - protein, 36 aa, Staphylococcus aureus
KQYFRMLQRPILYTGLTRAKTSLVLLGDPEAFDIGL

SEQ ID NO: 1651451 - protein, 31 aa, Staphylococcus aureus
KRIKLFKPDYIFVGMGFPKQEEWIMTHENQF

SEQ ID NO: 1651452 - protein, 24 aa, Staphylococcus aureus
KRYQKLIVVPLFLYDGRLVNKVKQ

SEQ ID NO: 1651453 - protein, 17 aa, Staphylococcus aureus
KSMTHRAIMLASLAEGV

SEQ ID NO: 1651454 - protein, 23 aa, Staphylococcus aureus
KSSAIEAVIGFLYLEKREERLEA

SEQ ID NO: 1651455 - protein, 24 aa, Staphylococcus aureus
KTYLSWLAQVGFKHVETFTDFNID

SEQ ID NO: 1651456 - protein, 35 aa, Staphylococcus aureus
KVTGCPAIPCYQCEYCLKGEYARCEKLFVIGSYEP

SEQ ID NO: 1651457 - protein, 24 aa, Staphylococcus aureus
KWNIIRPPFNVTRISEYAAVAALE

SEQ ID NO: 1651458 - protein, 22 aa, Staphylococcus aureus
LARFDISLATLLGVHQGLGHNT

SEQ ID NO: 1651459 - protein, 18 aa, Staphylococcus aureus
LDSRLVEVFEQLKDIQGQ

SEQ ID NO: 1651460 - protein, 21 aa, Staphylococcus aureus
LESLTALTIAQSFSQLIDDEI

SEQ ID NO: 1651461 - protein, 24 aa, Staphylococcus aureus
LEVDLNHGLPILVVDGNMTKAQVN

SEQ ID NO: 1651462 - protein, 24 aa, Staphylococcus aureus
LIQICGREVKILFSSMSEIQGNTV

SEQ ID NO: 1651463 - protein, 22 aa, Staphylococcus aureus
LKEGIKEAFQFDRKLVIEQGVN

SEQ ID NO: 1651464 - protein, 24 aa, Staphylococcus aureus
LLEQHMKSCIMNKVNQGAQEEAME

SEQ ID NO: 1651465 - protein, 25 aa, Staphylococcus aureus
LLITLAKLSAHYGLGLKSSIDITNA

SEQ ID NO: 1651466 - protein, 19 aa, Staphylococcus aureus
LLMIKSKMLLPQSTSDMDV

SEQ ID NO: 1651467 - protein, 18 aa, Staphylococcus aureus
LNIEAIPSNVLLKNLSDG

SEQ ID NO: 1651468 - protein, 20 aa, Staphylococcus aureus
LNPHVDRLTLSCRMEIDASG

SEQ ID NO: 1651469 - protein, 22 aa, Staphylococcus aureus
LSNDKYRTWEWNYGRNPKYNFE

SEQ ID NO: 1651470 - protein, 20 aa, Staphylococcus aureus
LVREYISAIVNIRINDMYFA

SEQ ID NO: 1651471 - protein, 17 aa, Staphylococcus aureus
LVSEAIVAKAPHNISAN

SEQ ID NO: 1651472 - protein, 27 aa, Staphylococcus aureus
MFEFKGHRIVAFKGGRFLIHGMTRTSD

SEQ ID NO: 1651473 - protein, 19 aa, Staphylococcus aureus
MIAPFYRKWDHQVFEFYLE

SEQ ID NO: 1651474 - protein, 18 aa, Staphylococcus aureus
MLKIWGHLFQYIKSEHIE

SEQ ID NO: 1651475 - protein, 21 aa, Staphylococcus aureus
MVCDETAWWSYMGQDNDIFKD

SEQ ID NO: 1651476 - protein, 25 aa, Staphylococcus aureus
NAKSGPWLKDVLRQIEIAIVTGKVS

SEQ ID NO: 1651477 - protein, 19 aa, Staphylococcus aureus
NGYKVAICEQMEDPKQTKG

SEQ ID NO: 1651478 - protein, 18 aa, Staphylococcus aureus
NHVYVLPQLHTLLWSNKK

SEQ ID NO: 1651479 - protein, 19 aa, Staphylococcus aureus
NHYPKLRKLNLKWYAVPII

SEQ ID NO: 1651480 - protein, 23 aa, Staphylococcus aureus
NKDKLKGIFLTHGHEHAIGAVSY

SEQ ID NO: 1651481 - protein, 18 aa, Staphylococcus aureus
NREFVTWLDNIASIVSRV

SEQ ID NO: 1651482 - protein, 17 aa, Staphylococcus aureus
NSLGFGGHNAVLVFKKF

SEQ ID NO: 1651483 - protein, 23 aa, Staphylococcus aureus
NTFKVLAVSGAKLKEAIERSAEY

SEQ ID NO: 1651484 - protein, 25 aa, Staphylococcus aureus
NVKLGLNITCLFEKPSVFKSLVSQI

SEQ ID NO: 1651485 - protein, 24 aa, Staphylococcus aureus
NYACILLDLMLPEMDGIQVATKLR

SEQ ID NO: 1651486 - protein, 19 aa, Staphylococcus aureus
PAFEFKQFELFKQSELITQ

SEQ ID NO: 1651487 - protein, 19 aa, Staphylococcus aureus
PDKTVVCFVGDGGFQMTNQ

SEQ ID NO: 1651488 - protein, 20 aa, Staphylococcus aureus
PEWLYCAKANLVLEPAYTGE

SEQ ID NO: 1651489 - protein, 23 aa, Staphylococcus aureus
PKMLPFQGYVLQHFELMDDGFCQ

SEQ ID NO: 1651490 - protein, 27 aa, Staphylococcus aureus
PNLCIEMRSDIPLARGLGSSASALVGA

SEQ ID NO: 1651491 - protein, 23 aa, Staphylococcus aureus
PSSKEITHYMGIPIEESFLKLAD

SEQ ID NO: 1651492 - protein, 19 aa, Staphylococcus aureus
QARGMGGHVRSNWKDVTEI

SEQ ID NO: 1651493 - protein, 20 aa, Staphylococcus aureus
QEKIELFKKLEFKQLLADID

SEQ ID NO: 1651494 - protein, 19 aa, Staphylococcus aureus
QFLKKKVKRYEIPSMIHHV

SEQ ID NO: 1651495 - protein, 18 aa, Staphylococcus aureus
QHAREFDYIKSLRRLTTK

SEQ ID NO: 1651496 - protein, 26 aa, Staphylococcus aureus
QKQKLKLLSFLLEDHDLIILDEVTNA

SEQ ID NO: 1651497 - protein, 19 aa, Staphylococcus aureus
QQLCFPEKLTFHPKTFEET

SEQ ID NO: 1651498 - protein, 18 aa, Staphylococcus aureus
RAKRYNRWLQFDYVIHSA

SEQ ID NO: 1651499 - protein, 25 aa, Staphylococcus aureus
RDGRARVSVGARSSVFAPFKNLGLI

SEQ ID NO: 1651500 - protein, 18 aa, Staphylococcus aureus
RDTSWIYDADFEKLSKQQ

SEQ ID NO: 1651501 - protein, 19 aa, Staphylococcus aureus
RKHDIGFIFQEYNLLHTLT

SEQ ID NO: 1651502 - protein, 20 aa, Staphylococcus aureus
RKVLQKRRFKKALQQKREEH

SEQ ID NO: 1651503 - protein, 21 aa, Staphylococcus aureus
RSSVETLELTHLIVEEAYHCG

SEQ ID NO: 1651504 - protein, 21 aa, Staphylococcus aureus
SAGNMTKFWEIFYERIDVLHD

SEQ ID NO: 1651505 - protein, 27 aa, Staphylococcus aureus
SDLIPELQGRFPIRVELDSLSVEDFVR

SEQ ID NO: 1651506 - protein, 23 aa, Staphylococcus aureus
SEAGQAKGYRRVTINDGIINDVF

SEQ ID NO: 1651507 - protein, 25 aa, Staphylococcus aureus
SIKVYKLFFIEAYKTVFQMTSMVSG

SEQ ID NO: 1651508 - protein, 21 aa, Staphylococcus aureus
SLLALPKLGAINVHASLLPKY

SEQ ID NO: 1651509 - protein, 20 aa, Staphylococcus aureus
SLPYHYYKDYGIRKYGFHGT

SEQ ID NO: 1651510 - protein, 20 aa, Staphylococcus aureus
SLVNELDMRILISSHKLEDI

SEQ ID NO: 1651511 - protein, 26 aa, Staphylococcus aureus
SMNRIAKELGIGMGTLYRHFKDKSDL

SEQ ID NO: 1651512 - protein, 27 aa, Staphylococcus aureus
SNYILKYVFANGIAREIIYALLEEMDL

SEQ ID NO: 1651513 - protein, 17 aa, Staphylococcus aureus
SSEILIKAAKIGVGVIL

SEQ ID NO: 1651514 - protein, 22 aa, Staphylococcus aureus
TGKSHLAYAIAKAVKAKGHTVA

SEQ ID NO: 1651515 - protein, 18 aa, Staphylococcus aureus
TIHLLKKKHFELMKDEAL

SEQ ID NO: 1651516 - protein, 17 aa, Staphylococcus aureus
TKTQLNVVIACYYGLGV

SEQ ID NO: 1651517 - protein, 18 aa, Staphylococcus aureus
TLNQFKAAPLIVTEDTLQ

SEQ ID NO: 1651518 - protein, 18 aa, Staphylococcus aureus
TPLIKSMYLSQSITKGNV

SEQ ID NO: 1651519 - protein, 25 aa, Staphylococcus aureus
TTGEMKKRYGLIYVDRDNDGHGTME

SEQ ID NO: 1651520 - protein, 22 aa, Staphylococcus aureus
TYYRLLVEWNEKMNLTSITDEH

SEQ ID NO: 1651521 - protein, 20 aa, Staphylococcus aureus
VAHTCAYLYHPNARSVTGTI

SEQ ID NO: 1651522 - protein, 18 aa, Staphylococcus aureus
VDNALMISLGLNAVAHQK

SEQ ID NO: 1651523 - protein, 24 aa, Staphylococcus aureus
VEHKAKFVKQFADFSVGVDGLKQY

SEQ ID NO: 1651524 - protein, 20 aa, Staphylococcus aureus
VFSYGIDEEAQFMAKNIQES

SEQ ID NO: 1651525 - protein, 20 aa, Staphylococcus aureus
VGGSVNPGGGMPMVTLSGQQ

SEQ ID NO: 1651526 - protein, 17 aa, Staphylococcus aureus
VIYQCILRDGSEVTVDN

SEQ ID NO: 1651527 - protein, 17 aa, Staphylococcus aureus
VKQFLKKKVKRYEIPSM

SEQ ID NO: 1651528 - protein, 17 aa, Staphylococcus aureus
VKTKNGQMLVCQDPSCK

SEQ ID NO: 1651529 - protein, 25 aa, Staphylococcus aureus
VLCCTPTEYRMMAKLQNLNDYDLTH

SEQ ID NO: 1651530 - protein, 19 aa, Staphylococcus aureus
VLSELCLPLVKKGGQFVAL

SEQ ID NO: 1651531 - protein, 24 aa, Staphylococcus aureus
VMEELRLLARAVFVLDADNKVVYK

SEQ ID NO: 1651532 - protein, 24 aa, Staphylococcus aureus
VPEGLIPLLKIQGLGSKKIAKLYK

SEQ ID NO: 1651533 - protein, 19 aa, Staphylococcus aureus
VVGISMSKLGLISRTAQGV

SEQ ID NO: 1651534 - protein, 17 aa, Staphylococcus aureus
VVMHFADKLCNKQALYR

SEQ ID NO: 1651535 - protein, 17 aa, Staphylococcus aureus
WANERQYTGIDFLGVSY

SEQ ID NO: 1651536 - protein, 17 aa, Staphylococcus aureus
WLVKAVIVAKRQVPELT

SEQ ID NO: 1651537 - protein, 28 aa, Staphylococcus aureus
WLYSTKFMLPKWLYKIAKQRADNKQLQN

SEQ ID NO: 1651538 - protein, 18 aa, Staphylococcus aureus
WNSPEMIMQRALKIANNT

SEQ ID NO: 1651539 - protein, 21 aa, Staphylococcus aureus
YFSYEELTILGGSKLPLVNFE

SEQ ID NO: 1651540 - protein, 24 aa, Staphylococcus aureus
YGENGFGYDPIFYVPKLDKTMAQL

SEQ ID NO: 1651541 - protein, 19 aa, Staphylococcus aureus
YIQAAGVAFALKKRGKNAV

SEQ ID NO: 1651542 - protein, 29 aa, Staphylococcus aureus
YKMPKKMRRLALRSALSFKAQENGLTVVD

SEQ ID NO: 1651543 - protein, 20 aa, Staphylococcus aureus
YQDLNGRIDGIVQAEQSEEG

SEQ ID NO: 1651544 - protein, 17 aa, Staphylococcus aureus
YYEHSIEKIVFADDNGK

SEQ ID NO: 1651545 - protein, 22 aa, Staphylococcus aureus
AAGGHAVMLGSLLAGTEESPGA

SEQ ID NO: 1651546 - protein, 23 aa, Staphylococcus aureus
AANYRSAGTIEFLVTDTAHYFIE

SEQ ID NO: 1651547 - protein, 22 aa, Staphylococcus aureus
AEAAEYFSKVLFQMDIPNNLLI

SEQ ID NO: 1651548 - protein, 24 aa, Staphylococcus aureus
AEGIEVGQVFKLGTKYSESMNATF

SEQ ID NO: 1651549 - protein, 19 aa, Staphylococcus aureus
AFFEKCRDTGVYGLIIPDL

SEQ ID NO: 1651550 - protein, 20 aa, Staphylococcus aureus
AFFTEFAIFMGRGGGKNGLI

SEQ ID NO: 1651551 - protein, 21 aa, Staphylococcus aureus
AIENGCPKVIIASGNKPNIIE

SEQ ID NO: 1651552 - protein, 20 aa, Staphylococcus aureus
AKALVSRFPSATIYNTYGPT

SEQ ID NO: 1651553 - protein, 21 aa, Staphylococcus aureus
ALQRMAMMRSYMRSQVTQQPF

SEQ ID NO: 1651554 - protein, 22 aa, Staphylococcus aureus
ANQYKFPVAVIEEVLKAKEAYG

SEQ ID NO: 1651555 - protein, 21 aa, Staphylococcus aureus
ARRMAKVVGAPFIKVEATKFT

SEQ ID NO: 1651556 - protein, 19 aa, Staphylococcus aureus
ASDIGVKYLTLYAFSTENW

SEQ ID NO: 1651557 - protein, 21 aa, Staphylococcus aureus
ASKAFTCIQMVKLVAEEDLQL

SEQ ID NO: 1651558 - protein, 35 aa, Staphylococcus aureus
AYMGMPGDIFSFYSREGIDGMVIEALGQGNIPPSA

SEQ ID NO: 1651559 - protein, 25 aa, Staphylococcus aureus
CDYLFCKAFGKLASNIEKYTNQGTL

SEQ ID NO: 1651560 - protein, 17 aa, Staphylococcus aureus
CGLPKEMALELFKPFVM

SEQ ID NO: 1651561 - protein, 17 aa, Staphylococcus aureus
CPNCKKKLTLFGKGKEA

SEQ ID NO: 1651562 - protein, 19 aa, Staphylococcus aureus
DLEYLKYAKDYGFSDKTIA

SEQ ID NO: 1651563 - protein, 19 aa, Staphylococcus aureus
DVAKGFGIDEDVARRLASK

SEQ ID NO: 1651564 - protein, 20 aa, Staphylococcus aureus
DVAVLRRYWNGRWIEATPND

SEQ ID NO: 1651565 - protein, 23 aa, Staphylococcus aureus
DYYRTAMIQHIGKMLGIKTPMID

SEQ ID NO: 1651566 - protein, 25 aa, Staphylococcus aureus
EAVEAAIKIARKWGSEVKGITDGQV

SEQ ID NO: 1651567 - protein, 18 aa, Staphylococcus aureus
EDFKRYYPTNALVTGYDI

SEQ ID NO: 1651568 - protein, 23 aa, Staphylococcus aureus
EELESALLKADFVVHLAGVNRPE

SEQ ID NO: 1651569 - protein, 20 aa, Staphylococcus aureus
EEQMLYFGLPRINKYYTADR

SEQ ID NO: 1651570 - protein, 19 aa, Staphylococcus aureus
EKFRERHRVIIRDSNKQWR

SEQ ID NO: 1651571 - protein, 26 aa, Staphylococcus aureus
EKLYKFSPELVYEAWTKKDLLKQWFM

SEQ ID NO: 1651572 - protein, 20 aa, Staphylococcus aureus
ELRYAVSEGVQRIHVESMHE

SEQ ID NO: 1651573 - protein, 18 aa, Staphylococcus aureus
ESELIKFAEECAKAESVV

SEQ ID NO: 1651574 - protein, 20 aa, Staphylococcus aureus
ETYTDFKMGLQIRHYTVQSL

SEQ ID NO: 1651575 - protein, 27 aa, Staphylococcus aureus
EVYKMIKQRMVDAFILLYSKENDPIKQ

SEQ ID NO: 1651576 - protein, 18 aa, Staphylococcus aureus
FARCFEMKEACYAATPAI

SEQ ID NO: 1651577 - protein, 18 aa, Staphylococcus aureus
FATLKGEVGQQFFKQHPE

SEQ ID NO: 1651578 - protein, 22 aa, Staphylococcus aureus
FDIYKGETLGLVGESGCGKSTT

SEQ ID NO: 1651579 - protein, 22 aa, Staphylococcus aureus
FDLNDFIRLKVFSSYNNIHDKI

SEQ ID NO: 1651580 - protein, 18 aa, Staphylococcus aureus
FEEISVRGRVLGISSQTR

SEQ ID NO: 1651581 - protein, 21 aa, Staphylococcus aureus
FGLNKRQGRQLLAYLGAPKEL

SEQ ID NO: 1651582 - protein, 22 aa, Staphylococcus aureus
FKMRGNIFLEEGIEHIEMTKKL

SEQ ID NO: 1651583 - protein, 19 aa, Staphylococcus aureus
FKSNENVLILGYTKHMNEW

SEQ ID NO: 1651584 - protein, 20 aa, Staphylococcus aureus
FKVATLVREYISAIVNIRIN

SEQ ID NO: 1651585 - protein, 20 aa, Staphylococcus aureus
FLNHMLTLFTFHSGLSLNIE

SEQ ID NO: 1651586 - protein, 17 aa, Staphylococcus aureus
FNHYSRFIHLFKETYGN

SEQ ID NO: 1651587 - protein, 23 aa, Staphylococcus aureus
FSLFRKPSEVLRHIEEIANELNI

SEQ ID NO: 1651588 - protein, 22 aa, Staphylococcus aureus
GAIRGRQVIINKFAVELNKDIY

SEQ ID NO: 1651589 - protein, 17 aa, Staphylococcus aureus
GEVFNSKTSFRIEEKVE

SEQ ID NO: 1651590 - protein, 19 aa, Staphylococcus aureus
GINKARGIEQVRQFLNIDR

SEQ ID NO: 1651591 - protein, 20 aa, Staphylococcus aureus
GLSLLKLNQHVAFCDEDHYA

SEQ ID NO: 1651592 - protein, 19 aa, Staphylococcus aureus
GMNGIEITEYIKAHYPDIK

SEQ ID NO: 1651593 - protein, 19 aa, Staphylococcus aureus
GPRILRAETAPLYALSAIS

SEQ ID NO: 1651594 - protein, 19 aa, Staphylococcus aureus
GTKLTFLPYVVKALVSALK

SEQ ID NO: 1651595 - protein, 33 aa, Staphylococcus aureus
GVKNAFDFPGFVPAYIRPLFCEGKGPFRFAALS

SEQ ID NO: 1651596 - protein, 21 aa, Staphylococcus aureus
HFKDKSDLCYYVIQRDLDIFI

SEQ ID NO: 1651597 - protein, 17 aa, Staphylococcus aureus
HFTAVFKQLFGGGDAEL

SEQ ID NO: 1651598 - protein, 18 aa, Staphylococcus aureus
HNQLFIRTDFTSINSPIE

SEQ ID NO: 1651599 - protein, 32 aa, Staphylococcus aureus
HSSSGRSPSQLGFRYYVNRLLEQTSHQKTNKL

SEQ ID NO: 1651600 - protein, 18 aa, Staphylococcus aureus
HVRSNWKDVTEIIAAQLL

SEQ ID NO: 1651601 - protein, 20 aa, Staphylococcus aureus
HYFIEMNARIQVEHTVTEMR

SEQ ID NO: 1651602 - protein, 25 aa, Staphylococcus aureus
IALAKRLKLPIIIHNREATQDCIDI

SEQ ID NO: 1651603 - protein, 19 aa, Staphylococcus aureus
IAPIFGLNKRQGRQLLAYL

SEQ ID NO: 1651604 - protein, 29 aa, Staphylococcus aureus
IDAYLKVAYQFSLPFGKDYADAHEEMVRE

SEQ ID NO: 1651605 - protein, 17 aa, Staphylococcus aureus
IDQNIPYTVLRDNIYTH

SEQ ID NO: 1651606 - protein, 18 aa, Staphylococcus aureus
IEGFTVRIVDKFNAEQIL

SEQ ID NO: 1651607 - protein, 19 aa, Staphylococcus aureus
IELIKRLVSYVPKIELHMY

SEQ ID NO: 1651608 - protein, 24 aa, Staphylococcus aureus
IELVKVDGRISVITFHSLEDRLCK

SEQ ID NO: 1651609 - protein, 20 aa, Staphylococcus aureus
IENNRFPLVLGGDHSIAVGS

SEQ ID NO: 1651610 - protein, 25 aa, Staphylococcus aureus
IEQKKGPFAPDFIKVWKERYKKIRQ

SEQ ID NO: 1651611 - protein, 18 aa, Staphylococcus aureus
IESQCEVIALDATLQQRP

SEQ ID NO: 1651612 - protein, 28 aa, Staphylococcus aureus
IFKEEGYEPWTSCEFDFTKEGELKVSFD

SEQ ID NO: 1651613 - protein, 21 aa, Staphylococcus aureus
IGHYHCQCGFKREQAKYEISS

SEQ ID NO: 1651614 - protein, 20 aa, Staphylococcus aureus
IGYSFKFDGAISRQEASKDV

SEQ ID NO: 1651615 - protein, 23 aa, Staphylococcus aureus
IIEKGDMITLDFGAYYNGYCSDI

SEQ ID NO: 1651616 - protein, 18 aa, Staphylococcus aureus
IIPLEVVVRNIASGSITK

SEQ ID NO: 1651617 - protein, 17 aa, Staphylococcus aureus
IKDGRLYHEIYRGEESQ

SEQ ID NO: 1651618 - protein, 26 aa, Staphylococcus aureus
IPHGHAVMVGIIYQFIVANALFDSKH

SEQ ID NO: 1651619 - protein, 19 aa, Staphylococcus aureus
IREKFALKPFDKHQFQHST

SEQ ID NO: 1651620 - protein, 21 aa, Staphylococcus aureus
ITAFLKNEFPQSDILMSILSN

SEQ ID NO: 1651621 - protein, 17 aa, Staphylococcus aureus
ITEYIKAHYPDIKVLVL

SEQ ID NO: 1651622 - protein, 17 aa, Staphylococcus aureus
IVKEVLKHVNFDLKDLH

SEQ ID NO: 1651623 - protein, 17 aa, Staphylococcus aureus
IYCLAPFAETVKKQLRK

SEQ ID NO: 1651624 - protein, 21 aa, Staphylococcus aureus
KAKLNPAICFTMLGHHLGVDI

SEQ ID NO: 1651625 - protein, 18 aa, Staphylococcus aureus
KALFKLLALESQHAGLSW

SEQ ID NO: 1651626 - protein, 24 aa, Staphylococcus aureus
KASIKPFIRRTPLIKSMYLSQSIT

SEQ ID NO: 1651627 - protein, 22 aa, Staphylococcus aureus
KDRSQRAKVFVRFSNFNELFQF

SEQ ID NO: 1651628 - protein, 24 aa, Staphylococcus aureus
KDVCQRFTTDFNKCVLQNMSQLQC

SEQ ID NO: 1651629 - protein, 18 aa, Staphylococcus aureus
KEHLLSPLFKDWHKYNTD

SEQ ID NO: 1651630 - protein, 23 aa, Staphylococcus aureus
KEIKRLYIEEGCAIQKEYYVGFV

SEQ ID NO: 1651631 - protein, 21 aa, Staphylococcus aureus
KEKNHIISIARLVENKQIKHQ

SEQ ID NO: 1651632 - protein, 20 aa, Staphylococcus aureus
KKFAEQALQELISDSFKVAI

SEQ ID NO: 1651633 - protein, 28 aa, Staphylococcus aureus
KLQTYLTPHFISFEIVYEAMDLIDDIED

SEQ ID NO: 1651634 - protein, 26 aa, Staphylococcus aureus
KNGMATMKFDMCGAANVVGIIEAASR

SEQ ID NO: 1651635 - protein, 23 aa, Staphylococcus aureus
KPILIHTIEKFILVSEFNEIIIA

SEQ ID NO: 1651636 - protein, 18 aa, Staphylococcus aureus
KRLLELYKNYKGNITRFV

SEQ ID NO: 1651637 - protein, 19 aa, Staphylococcus aureus
KRYYPTNALVTGYDIIFFW

SEQ ID NO: 1651638 - protein, 27 aa, Staphylococcus aureus
KSPLAEISVKVFNEFNISEREASDIIN

SEQ ID NO: 1651639 - protein, 22 aa, Staphylococcus aureus
KVLYLEIGIGYTTPQFVKHPFQ

SEQ ID NO: 1651640 - protein, 25 aa, Staphylococcus aureus
KVNLKKIYTCLVYGKTHTSGIIEAN

SEQ ID NO: 1651641 - protein, 26 aa, Staphylococcus aureus
KWYFPTLPFQRFIIANIFLIDKNTDE

SEQ ID NO: 1651642 - protein, 20 aa, Staphylococcus aureus
KYSLCKVHLHTGRTHQIRVH

SEQ ID NO: 1651643 - protein, 17 aa, Staphylococcus aureus
LADQHSLNHVAFCCIST

SEQ ID NO: 1651644 - protein, 24 aa, Staphylococcus aureus
LAELNIRLHEALQYAQPVEVKFYN

SEQ ID NO: 1651645 - protein, 19 aa, Staphylococcus aureus
LDVLQEIVKGFGYSYRDYQ

SEQ ID NO: 1651646 - protein, 29 aa, Staphylococcus aureus
LEKWYQIEYLKEMVTFVVVNRDKNSQNVE

SEQ ID NO: 1651647 - protein, 18 aa, Staphylococcus aureus
LFPRELLVEKGILTTFEH

SEQ ID NO: 1651648 - protein, 24 aa, Staphylococcus aureus
LIELKDGIPDVCFVRDLEGICLSR

SEQ ID NO: 1651649 - protein, 25 aa, Staphylococcus aureus
LKIKSERDYLFFKLAIHSGLKVSEL

SEQ ID NO: 1651650 - protein, 20 aa, Staphylococcus aureus
LKLPEHHSYIISYNGSKTIN

SEQ ID NO: 1651651 - protein, 24 aa, Staphylococcus aureus
LKNVVNHFIAWMGYTKGTFVKTEK

SEQ ID NO: 1651652 - protein, 17 aa, Staphylococcus aureus
LLAPRIDTMFAKHNVIY

SEQ ID NO: 1651653 - protein, 18 aa, Staphylococcus aureus
LMPPHEYDAITVTLEVAG

SEQ ID NO: 1651654 - protein, 24 aa, Staphylococcus aureus
LMSRVRRYPLPLVLEISNIESVMP

SEQ ID NO: 1651655 - protein, 23 aa, Staphylococcus aureus
LNHIRLEHCLIDILTSKKPIEEI

SEQ ID NO: 1651656 - protein, 18 aa, Staphylococcus aureus
LNYFKLKKFIVALESKTA

SEQ ID NO: 1651657 - protein, 18 aa, Staphylococcus aureus
LPEDQRKAVWAIYAVCRK

SEQ ID NO: 1651658 - protein, 25 aa, Staphylococcus aureus
LPFVHAKGGIYVWLETPPGYDSEQF

SEQ ID NO: 1651659 - protein, 17 aa, Staphylococcus aureus
LREKLNRVSSEAAHMIQ

SEQ ID NO: 1651660 - protein, 23 aa, Staphylococcus aureus
LSYRLLPEVSLDCIIEDVYASFD

SEQ ID NO: 1651661 - protein, 23 aa, Staphylococcus aureus
LTKFPGIGKKTARQIVLDLKGKV

SEQ ID NO: 1651662 - protein, 21 aa, Staphylococcus aureus
MLPHYRPYKIAEHFRMMAALY

SEQ ID NO: 1651663 - protein, 17 aa, Staphylococcus aureus
MMREVRLALLEADVNFK

SEQ ID NO: 1651664 - protein, 22 aa, Staphylococcus aureus
MQRLMATGGLEIFATDDPEITS

SEQ ID NO: 1651665 - protein, 22 aa, Staphylococcus aureus
NDSLCVLNHLYINEGQEETFEQ

SEQ ID NO: 1651666 - protein, 18 aa, Staphylococcus aureus
NGHIPRLTYHTNRIKCSS

SEQ ID NO: 1651667 - protein, 25 aa, Staphylococcus aureus
NKTIPWLYVERGFEIPSFNYVLKTE

SEQ ID NO: 1651668 - protein, 22 aa, Staphylococcus aureus
NLMQAEALRSLKAIRDKAKDKA

SEQ ID NO: 1651669 - protein, 17 aa, Staphylococcus aureus
NNYPFPNTFKVLAVSGA

SEQ ID NO: 1651670 - protein, 25 aa, Staphylococcus aureus
NRYGCALAVEVLKRLKDENIGINLY

SEQ ID NO: 1651671 - protein, 20 aa, Staphylococcus aureus
NSELLDADFGYAIDASADVG

SEQ ID NO: 1651672 - protein, 20 aa, Staphylococcus aureus
PAVAFRLFKQLVEERYGKEE

SEQ ID NO: 1651673 - protein, 18 aa, Staphylococcus aureus
PDCRAMDLWIDPIVEQYN

SEQ ID NO: 1651674 - protein, 17 aa, Staphylococcus aureus
PDLIILDVMLPKKDGID

SEQ ID NO: 1651675 - protein, 19 aa, Staphylococcus aureus
PFQEGRDGFVMGEGAGILV

SEQ ID NO: 1651676 - protein, 19 aa, Staphylococcus aureus
PYLPELMNMHKLIYPAGDG

SEQ ID NO: 1651677 - protein, 24 aa, Staphylococcus aureus
QENFAISIGIYIDGKPYAGFVYDV

SEQ ID NO: 1651678 - protein, 21 aa, Staphylococcus aureus
QEVLEDLGIEEAEFEQAFLNS

SEQ ID NO: 1651679 - protein, 21 aa, Staphylococcus aureus
QGEALKSIILNKFPDKKIDII

SEQ ID NO: 1651680 - protein, 17 aa, Staphylococcus aureus
QGVSFDFVTPFGTYPVK

SEQ ID NO: 1651681 - protein, 20 aa, Staphylococcus aureus
QHILLRVNLAGPFPNATLHM

SEQ ID NO: 1651682 - protein, 17 aa, Staphylococcus aureus
QNGKFKDFFDFARRIPK

SEQ ID NO: 1651683 - protein, 22 aa, Staphylococcus aureus
QRLNLDYLDLVLIHQPYNDVYG

SEQ ID NO: 1651684 - protein, 21 aa, Staphylococcus aureus
QRVHGGAMLKENRMVEANLTE

SEQ ID NO: 1651685 - protein, 17 aa, Staphylococcus aureus
RARDGLNQTQLAKQAGV

SEQ ID NO: 1651686 - protein, 17 aa, Staphylococcus aureus
RDELKSVLIDDSKGFAH

SEQ ID NO: 1651687 - protein, 20 aa, Staphylococcus aureus
RELLLDYQFVEKIKDGREDE

SEQ ID NO: 1651688 - protein, 28 aa, Staphylococcus aureus
RKNDDYIWLGHSFVRQGFLDDVKLEPPI

SEQ ID NO: 1651689 - protein, 21 aa, Staphylococcus aureus
RLMKQAEKFNRPIFTFIDTKG

SEQ ID NO: 1651690 - protein, 25 aa, Staphylococcus aureus
RNNILKFSLFTGEKHIVINADDINN

SEQ ID NO: 1651691 - protein, 17 aa, Staphylococcus aureus
RQAVYTGIFQWQNGQLV

SEQ ID NO: 1651692 - protein, 24 aa, Staphylococcus aureus
RTWKGKRSTDDIFTRLKDGHLRFR

SEQ ID NO: 1651693 - protein, 27 aa, Staphylococcus aureus
RVDNVFPTKHAIGLKADNGLELLVHIG

SEQ ID NO: 1651694 - protein, 21 aa, Staphylococcus aureus
SFDFVTPFGTYPVKSPYVGKF

SEQ ID NO: 1651695 - protein, 18 aa, Staphylococcus aureus
SLFEDYGKIFGRMIGAQL

SEQ ID NO: 1651696 - protein, 18 aa, Staphylococcus aureus
SLLDIPTIFYVYDEGTYD

SEQ ID NO: 1651697 - protein, 18 aa, Staphylococcus aureus
SSAASFARTFKHFTHQTP

SEQ ID NO: 1651698 - protein, 19 aa, Staphylococcus aureus
STRNKLGFDELSKRKGYQI

SEQ ID NO: 1651699 - protein, 25 aa, Staphylococcus aureus
SYCGPGRRKTFTFVNNRPLAALTEE

SEQ ID NO: 1651700 - protein, 26 aa, Staphylococcus aureus
TGLPMKRVDDIKAYIQGDVPKVMGVD

SEQ ID NO: 1651701 - protein, 17 aa, Staphylococcus aureus
TKHQFVMIARFAYPKLP

SEQ ID NO: 1651702 - protein, 19 aa, Staphylococcus aureus
TMPQIGLGTFRVENDENCM

SEQ ID NO: 1651703 - protein, 23 aa, Staphylococcus aureus
TMRKEVIGGLGGFGATFDLSQLN

SEQ ID NO: 1651704 - protein, 22 aa, Staphylococcus aureus
VASTFRILIKYLIYSKIKQQSY

SEQ ID NO: 1651705 - protein, 23 aa, Staphylococcus aureus
VEAFKGMDTVVFIPSIIHPSFKR

SEQ ID NO: 1651706 - protein, 18 aa, Staphylococcus aureus
VERTNLPVVETFQGAGVI

SEQ ID NO: 1651707 - protein, 17 aa, Staphylococcus aureus
VFMKDGRMILTEQKDIL

SEQ ID NO: 1651708 - protein, 21 aa, Staphylococcus aureus
VKVTTPILVKAPIAGRRILLK

SEQ ID NO: 1651709 - protein, 19 aa, Staphylococcus aureus
VNAALHYLARLIEAGDLPT

SEQ ID NO: 1651710 - protein, 18 aa, Staphylococcus aureus
VPSSLNLKVVVFDDKDYD

SEQ ID NO: 1651711 - protein, 22 aa, Staphylococcus aureus
VQDLLIPLTFHFSKDEQLVIDQ

SEQ ID NO: 1651712 - protein, 28 aa, Staphylococcus aureus
VRLDGATKEFFAWGFRVGFMTFGTSDQT

SEQ ID NO: 1651713 - protein, 30 aa, Staphylococcus aureus
VSDTAVMIAWLVKIPHRIMPILGTSQLKRI

SEQ ID NO: 1651714 - protein, 18 aa, Staphylococcus aureus
VTGIGPKSALAILATSTP

SEQ ID NO: 1651715 - protein, 24 aa, Staphylococcus aureus
VVDISGRPYLSFNASLSKEKVGTF

SEQ ID NO: 1651716 - protein, 26 aa, Staphylococcus aureus
WAETKKLTGWYARRIAVGRDGEVQGV

SEQ ID NO: 1651717 - protein, 19 aa, Staphylococcus aureus
YAVCRKIDDSIDVYGDIQF

SEQ ID NO: 1651718 - protein, 17 aa, Staphylococcus aureus
YDEPVMKGYVRYSIATA

SEQ ID NO: 1651719 - protein, 23 aa, Staphylococcus aureus
YDKNKFKVIGPFVADNYVLSVDT

SEQ ID NO: 1651720 - protein, 21 aa, Staphylococcus aureus
YGFHIIIAGSFSDIFYMNCTK

SEQ ID NO: 1651721 - protein, 23 aa, Staphylococcus aureus
YKAIRGEGAFCNGIKMEEPPSLK

SEQ ID NO: 1651722 - protein, 19 aa, Staphylococcus aureus
YNISYASKAFTCIQMVKLV

SEQ ID NO: 1651723 - protein, 17 aa, Staphylococcus aureus
YQESFGYMAQQLCFPEK

SEQ ID NO: 1651724 - protein, 20 aa, Staphylococcus aureus
YQFDFKRFNSVSEFKNATLL

SEQ ID NO: 1651725 - protein, 30 aa, Staphylococcus aureus
YRKEVPPLMCASLWPKFDLFKKYANSELIL

SEQ ID NO: 1651726 - protein, 21 aa, Staphylococcus aureus
YSTQNLDLWYGENHALQNINL

SEQ ID NO: 1651727 - protein, 28 aa, Staphylococcus aureus
AAGDTFRAGAIDQLKVWGERVGVDVISQ

SEQ ID NO: 1651728 - protein, 17 aa, Staphylococcus aureus
AEFAALAFKVMTDPYVG

SEQ ID NO: 1651729 - protein, 19 aa, Staphylococcus aureus
AGLLKPKAAYELIGELKSA

SEQ ID NO: 1651730 - protein, 22 aa, Staphylococcus aureus
AIPVCGFAWIHWSVANVSVSGN

SEQ ID NO: 1651731 - protein, 30 aa, Staphylococcus aureus
AKLADRLGFKRIWFTEHHNVPAFACSSPEL

SEQ ID NO: 1651732 - protein, 22 aa, Staphylococcus aureus
AKRAQRGITLLKELKKNPHRIV

SEQ ID NO: 1651733 - protein, 23 aa, Staphylococcus aureus
AMNLKLVDFKIEFGKTETGQILL

SEQ ID NO: 1651734 - protein, 17 aa, Staphylococcus aureus
ATLELVRQLQFFINERI

SEQ ID NO: 1651735 - protein, 18 aa, Staphylococcus aureus
AYLQQKGFNPELMSATIH

SEQ ID NO: 1651736 - protein, 19 aa, Staphylococcus aureus
CFNCLVPQLPALNLTCDTV

SEQ ID NO: 1651737 - protein, 17 aa, Staphylococcus aureus
DDVHCLYFHLTDATTTK

SEQ ID NO: 1651738 - protein, 26 aa, Staphylococcus aureus
DELNEGVAPGVPWKNGPVPVDKAIYG

SEQ ID NO: 1651739 - protein, 18 aa, Staphylococcus aureus
DFFAKAKPSLQIINVARG

SEQ ID NO: 1651740 - protein, 23 aa, Staphylococcus aureus
DKRVDELLEMVGLEPEKYKNRKP

SEQ ID NO: 1651741 - protein, 20 aa, Staphylococcus aureus
DLVFEWKAFMNTIADFDDET

SEQ ID NO: 1651742 - protein, 18 aa, Staphylococcus aureus
DSLQYFIDCMPKSEWLKR

SEQ ID NO: 1651743 - protein, 17 aa, Staphylococcus aureus
DTLDHLWRVTSLNQAIA

SEQ ID NO: 1651744 - protein, 18 aa, Staphylococcus aureus
DYILPGYRDVPQIIWHGL

SEQ ID NO: 1651745 - protein, 23 aa, Staphylococcus aureus
EALKRGTAILITGGFKPSNKVIN

SEQ ID NO: 1651746 - protein, 22 aa, Staphylococcus aureus
EAQREIGLVLAPVSVDIHHQNK

SEQ ID NO: 1651747 - protein, 19 aa, Staphylococcus aureus
ECEYCKSKDYNLCNHRKGI

SEQ ID NO: 1651748 - protein, 21 aa, Staphylococcus aureus
EEFKVAIEGVIFDINLKELKS

SEQ ID NO: 1651749 - protein, 25 aa, Staphylococcus aureus
EHFARKVSNHWLRLMSVNEEGRFKS

SEQ ID NO: 1651750 - protein, 20 aa, Staphylococcus aureus
EKEPKLAIIAEIKSKSPTVN

SEQ ID NO: 1651751 - protein, 21 aa, Staphylococcus aureus
EKKIPRAVLIDAIEAALITAY

SEQ ID NO: 1651752 - protein, 24 aa, Staphylococcus aureus
EKTLIEYMDYLSLKDPKRILKSYP

SEQ ID NO: 1651753 - protein, 21 aa, Staphylococcus aureus
ELDVAPMFKSLIGKEISEEDA

SEQ ID NO: 1651754 - protein, 25 aa, Staphylococcus aureus
ENEIKNWEFPLVIKPGDDLPTAGGY

SEQ ID NO: 1651755 - protein, 17 aa, Staphylococcus aureus
ERGLLPGNGAITSVVSV

SEQ ID NO: 1651756 - protein, 23 aa, Staphylococcus aureus
ESYKEGVKAFAKMKGNLPDAILC

SEQ ID NO: 1651757 - protein, 20 aa, Staphylococcus aureus
ETVKTFLARHDFSKKTVSAI

SEQ ID NO: 1651758 - protein, 22 aa, Staphylococcus aureus
EVIKLCGALMQYYRETGIYAER

SEQ ID NO: 1651759 - protein, 20 aa, Staphylococcus aureus
EVNEDTSLVWLCNPNNPTGT

SEQ ID NO: 1651760 - protein, 23 aa, Staphylococcus aureus
FAEHLNHPVSYYFKNNFYITPSG

SEQ ID NO: 1651761 - protein, 21 aa, Staphylococcus aureus
FGDSRIVGLIGKNGVGKTTVM

SEQ ID NO: 1651762 - protein, 17 aa, Staphylococcus aureus
FIETAKIVLRWLKEQGI

SEQ ID NO: 1651763 - protein, 17 aa, Staphylococcus aureus
FLAGLAVGFWESKDDIA

SEQ ID NO: 1651764 - protein, 20 aa, Staphylococcus aureus
FNYFSTPSFVTNIYETDELY

SEQ ID NO: 1651765 - protein, 22 aa, Staphylococcus aureus
FPCLNCTKSIIQAGIKRIYYAE

SEQ ID NO: 1651766 - protein, 18 aa, Staphylococcus aureus
FTKANPFTRFIRAKATLT

SEQ ID NO: 1651767 - protein, 24 aa, Staphylococcus aureus
FVIDKRHFSAFVGTDLDLQLRRRG

SEQ ID NO: 1651768 - protein, 26 aa, Staphylococcus aureus
FYATEFDFPKALRKEEIVGSIENDEI

SEQ ID NO: 1651769 - protein, 18 aa, Staphylococcus aureus
GDFIFVGDIGRPDLLEKS

SEQ ID NO: 1651770 - protein, 21 aa, Staphylococcus aureus
GEFRYWSAMGHHMYHPEVWLI

SEQ ID NO: 1651771 - protein, 23 aa, Staphylococcus aureus
GHGAGSPCGKALGAIPISTIGYE

SEQ ID NO: 1651772 - protein, 21 aa, Staphylococcus aureus
GIKVGMIHGGLTPRERKQQMK

SEQ ID NO: 1651773 - protein, 19 aa, Staphylococcus aureus
GKQVFNYFSTPSFVTNIYE

SEQ ID NO: 1651774 - protein, 20 aa, Staphylococcus aureus
GKTPYVIGGLTFANTIGATT

SEQ ID NO: 1651775 - protein, 23 aa, Staphylococcus aureus
GMGDIGKAFARRLQGFNTNILYH

SEQ ID NO: 1651776 - protein, 21 aa, Staphylococcus aureus
GMPPTGGLGIGIDRLVMLLTD

SEQ ID NO: 1651777 - protein, 27 aa, Staphylococcus aureus
GMQTLGVALPWAISAALVRPNTQVVSV

SEQ ID NO: 1651778 - protein, 18 aa, Staphylococcus aureus
GPQIRRLPVSKMNQDLLA

SEQ ID NO: 1651779 - protein, 25 aa, Staphylococcus aureus
GTGTRVLGGLSYRESHFALELLHQS

SEQ ID NO: 1651780 - protein, 19 aa, Staphylococcus aureus
HPPMIAIAVQRAGGKRKDT

SEQ ID NO: 1651781 - protein, 24 aa, Staphylococcus aureus
HTLYDYPSHQLVTFGVTGTNGKTS

SEQ ID NO: 1651782 - protein, 18 aa, Staphylococcus aureus
IAGFKEIEYEVMRDKNDN

SEQ ID NO: 1651783 - protein, 23 aa, Staphylococcus aureus
IDVVKARGAEVILTDTFALNKPA

SEQ ID NO: 1651784 - protein, 25 aa, Staphylococcus aureus
IEFARSGDTIVVWRLDRLGRNMEDL

SEQ ID NO: 1651785 - protein, 25 aa, Staphylococcus aureus
IEIIYLKSCDLTTILHNLYKRGVGT

SEQ ID NO: 1651786 - protein, 22 aa, Staphylococcus aureus
IESKRGGGGYIRITKIENKDAT

SEQ ID NO: 1651787 - protein, 17 aa, Staphylococcus aureus
IFPEAYVPFLQKYNPNI

SEQ ID NO: 1651788 - protein, 23 aa, Staphylococcus aureus
ILSKRELEILPLIAKGYGNKEIA

SEQ ID NO: 1651789 - protein, 17 aa, Staphylococcus aureus
IMGMNFHLVCPKELNPT

SEQ ID NO: 1651790 - protein, 17 aa, Staphylococcus aureus
INDMYFAPFSYEKDEYI

SEQ ID NO: 1651791 - protein, 18 aa, Staphylococcus aureus
IPEGVLIRAIEPEEGLSA

SEQ ID NO: 1651792 - protein, 25 aa, Staphylococcus aureus
IQPILKEKFIALGLDVKEDEAAKHP

SEQ ID NO: 1651793 - protein, 18 aa, Staphylococcus aureus
ISKNMLFIPFKGENVDGH

SEQ ID NO: 1651794 - protein, 24 aa, Staphylococcus aureus
IYYIVCAGGVRSAKVVEYLEANGI

SEQ ID NO: 1651795 - protein, 22 aa, Staphylococcus aureus
KAEIMPTFKALGLDDYIEVVVG

SEQ ID NO: 1651796 - protein, 21 aa, Staphylococcus aureus
KAKHTLQLIGFDKVAGYRLPK

SEQ ID NO: 1651797 - protein, 18 aa, Staphylococcus aureus
KARKAIESFVAETTEKYG

SEQ ID NO: 1651798 - protein, 17 aa, Staphylococcus aureus
KDIPYLIAGGINSENIQ

SEQ ID NO: 1651799 - protein, 20 aa, Staphylococcus aureus
KEAYGNKDFIVGYRLSPEEA

SEQ ID NO: 1651800 - protein, 20 aa, Staphylococcus aureus
KETVDLPVIGIVKRDYDHSD

SEQ ID NO: 1651801 - protein, 39 aa, Staphylococcus aureus
KFDHPNVICTYDLLFRSGLDLNVDFVIRVGKPVISKKLN

SEQ ID NO: 1651802 - protein, 19 aa, Staphylococcus aureus
KKAAALVGEKKLQLMPLDN

SEQ ID NO: 1651803 - protein, 20 aa, Staphylococcus aureus
KKDVIDKILHFEKQMSQAET

SEQ ID NO: 1651804 - protein, 21 aa, Staphylococcus aureus
KKMLARKGYDVGWQEGDDSIL

SEQ ID NO: 1651805 - protein, 25 aa, Staphylococcus aureus
KLEQPLTIAGIFTFKPNEDDRDGEV

SEQ ID NO: 1651806 - protein, 19 aa, Staphylococcus aureus
KLLYRHMGPQNWWPADNDI

SEQ ID NO: 1651807 - protein, 22 aa, Staphylococcus aureus
KNLKEWRLEDLPIIPKYMKTVV

SEQ ID NO: 1651808 - protein, 18 aa, Staphylococcus aureus
KQIMLRLEKELSKLHEAF

SEQ ID NO: 1651809 - protein, 18 aa, Staphylococcus aureus
KRLFLARKQLEFYSTQCD

SEQ ID NO: 1651810 - protein, 17 aa, Staphylococcus aureus
KSGCGKSTLLNTIAGLE

SEQ ID NO: 1651811 - protein, 19 aa, Staphylococcus aureus
KSQGPKRLLAQFAPIEKKE

SEQ ID NO: 1651812 - protein, 17 aa, Staphylococcus aureus
KTIVYKGWLRSDQIKKL

SEQ ID NO: 1651813 - protein, 20 aa, Staphylococcus aureus
KVKPGEFYFIPAGTVHTISS

SEQ ID NO: 1651814 - protein, 17 aa, Staphylococcus aureus
KYRILDYVNHFDSQRRK

SEQ ID NO: 1651815 - protein, 18 aa, Staphylococcus aureus
LEVFKNECDLSYDITSLY

SEQ ID NO: 1651816 - protein, 19 aa, Staphylococcus aureus
LFGPTITVKALLNMRMENK

SEQ ID NO: 1651817 - protein, 23 aa, Staphylococcus aureus
LFSKEEWLSMSLAERQKAEKAFR

SEQ ID NO: 1651818 - protein, 25 aa, Staphylococcus aureus
LGLPYRRVILCTGDIGFSASKTYDL

SEQ ID NO: 1651819 - protein, 17 aa, Staphylococcus aureus
LHQSHLISSMDLVEVNP

SEQ ID NO: 1651820 - protein, 18 aa, Staphylococcus aureus
LIKYCFEELDLNRIEISA

SEQ ID NO: 1651821 - protein, 34 aa, Staphylococcus aureus
LITNPQAFNLLDWKKRRSLLFEIAKPINDEDVIK

SEQ ID NO: 1651822 - protein, 18 aa, Staphylococcus aureus
LKGVEGLSPKTRRKYDEF

SEQ ID NO: 1651823 - protein, 20 aa, Staphylococcus aureus
LKLQRERGITFLFIAHDLSM

SEQ ID NO: 1651824 - protein, 21 aa, Staphylococcus aureus
LKLYKFFIIIAKYIKHNEQFF

SEQ ID NO: 1651825 - protein, 19 aa, Staphylococcus aureus
LKMLAHKMNKAIVIVLHDI

SEQ ID NO: 1651826 - protein, 19 aa, Staphylococcus aureus
LKRLLDLGAPGIIVQNEKR

SEQ ID NO: 1651827 - protein, 18 aa, Staphylococcus aureus
LKSKALKINNVLKQLMDA

SEQ ID NO: 1651828 - protein, 20 aa, Staphylococcus aureus
LKTKRYTYTHIQRLLMNVLL

SEQ ID NO: 1651829 - protein, 18 aa, Staphylococcus aureus
LNNQITSIIFKYLQENGI

SEQ ID NO: 1651830 - protein, 26 aa, Staphylococcus aureus
LSGGQRQRAYIAMTIAQDTEYILLDE

SEQ ID NO: 1651831 - protein, 19 aa, Staphylococcus aureus
LSSEIKMNALEHVSFELLK

SEQ ID NO: 1651832 - protein, 21 aa, Staphylococcus aureus
LSSLPYVLCVIRRRIQSGHVM

SEQ ID NO: 1651833 - protein, 19 aa, Staphylococcus aureus
MMARETWLNADEAIEQGFA

SEQ ID NO: 1651834 - protein, 19 aa, Staphylococcus aureus
MNPQLPIVAIGGINTNNVA

SEQ ID NO: 1651835 - protein, 18 aa, Staphylococcus aureus
MRLPIEYLANIFTAGDTE

SEQ ID NO: 1651836 - protein, 26 aa, Staphylococcus aureus
MSQLQCAKSSLSLETIFHCYHHMMSC

SEQ ID NO: 1651837 - protein, 17 aa, Staphylococcus aureus
MYREVAFHGGIPDTGFY

SEQ ID NO: 1651838 - protein, 26 aa, Staphylococcus aureus
NEDKVEWIILAGYMRLIGPDLLASFE

SEQ ID NO: 1651839 - protein, 22 aa, Staphylococcus aureus
NEWISMLGVVPVIRALREKAMA

SEQ ID NO: 1651840 - protein, 26 aa, Staphylococcus aureus
NIYEATDFHHFVKLLKTKRYTYTHIQ

SEQ ID NO: 1651841 - protein, 20 aa, Staphylococcus aureus
NKLAAELAKSFQVVLIDLRG

SEQ ID NO: 1651842 - protein, 17 aa, Staphylococcus aureus
NKVEVIKEIIKKVRGGN

SEQ ID NO: 1651843 - protein, 18 aa, Staphylococcus aureus
NLEDGRLNVILMVGVNGV

SEQ ID NO: 1651844 - protein, 23 aa, Staphylococcus aureus
NQKIKRIAIIGGSGIGYEYQAVQ

SEQ ID NO: 1651845 - protein, 20 aa, Staphylococcus aureus
NRPNVRQGLKQSGVYIPETT

SEQ ID NO: 1651846 - protein, 19 aa, Staphylococcus aureus
NSKEALAYYEEVFGATDVK

SEQ ID NO: 1651847 - protein, 18 aa, Staphylococcus aureus
NYVQSHSFIKSLVLGISG

SEQ ID NO: 1651848 - protein, 17 aa, Staphylococcus aureus
PHVSTLYVDDGPDAVDY

SEQ ID NO: 1651849 - protein, 17 aa, Staphylococcus aureus
PKIKAKPAITQMKYSLD

SEQ ID NO: 1651850 - protein, 18 aa, Staphylococcus aureus
PSHLWWQGIDPIAAIRIL

SEQ ID NO: 1651851 - protein, 26 aa, Staphylococcus aureus
PSMGPRSVDYLHHLIQAMHLAYSDRA

SEQ ID NO: 1651852 - protein, 27 aa, Staphylococcus aureus
PSQMGIRKPEFSSAISTISSSIAFDEL

SEQ ID NO: 1651853 - protein, 18 aa, Staphylococcus aureus
PSYALFKGQDLVYFMPRE

SEQ ID NO: 1651854 - protein, 19 aa, Staphylococcus aureus
PVIASHVGGISELVADNGI

SEQ ID NO: 1651855 - protein, 20 aa, Staphylococcus aureus
QELVEMMARETWLNADEAIE

SEQ ID NO: 1651856 - protein, 18 aa, Staphylococcus aureus
QLFMPIRVAVTGQMHGPE

SEQ ID NO: 1651857 - protein, 18 aa, Staphylococcus aureus
QNIKLIACTMSMDVMGIQ

SEQ ID NO: 1651858 - protein, 21 aa, Staphylococcus aureus
QRIRQNLDRIVKSQANQKKLS

SEQ ID NO: 1651859 - protein, 18 aa, Staphylococcus aureus
QTSNIVIEGAIFDPVSIR

SEQ ID NO: 1651860 - protein, 24 aa, Staphylococcus aureus
QYMAKRRIGALIVFEKETGLQDYI

SEQ ID NO: 1651861 - protein, 20 aa, Staphylococcus aureus
RASGFCIYNDIAITAQYLAK

SEQ ID NO: 1651862 - protein, 20 aa, Staphylococcus aureus
RENYEALLIYYKNSIDNPIV

SEQ ID NO: 1651863 - protein, 17 aa, Staphylococcus aureus
RILRNFPEKLSKYVAKW

SEQ ID NO: 1651864 - protein, 17 aa, Staphylococcus aureus
RKIIGNEFVYVFDDEAS

SEQ ID NO: 1651865 - protein, 25 aa, Staphylococcus aureus
RMHKGTEQMLGMFANTLVYRGQPSP

SEQ ID NO: 1651866 - protein, 23 aa, Staphylococcus aureus
RNLMKQKLEMLGEDIDKNKESLQ

SEQ ID NO: 1651867 - protein, 19 aa, Staphylococcus aureus
RNLSKYNKCLMLKPEPLVG

SEQ ID NO: 1651868 - protein, 26 aa, Staphylococcus aureus
RPDKLDKCFYKYYGLNKLINLLIKEK

SEQ ID NO: 1651869 - protein, 24 aa, Staphylococcus aureus
RQMIKWTKLYIDQFLSSWTMPKRE

SEQ ID NO: 1651870 - protein, 20 aa, Staphylococcus aureus
SESKYKVYIIDEVHMLTTGA

SEQ ID NO: 1651871 - protein, 19 aa, Staphylococcus aureus
SHSFIKSLVLGISGGQDST

SEQ ID NO: 1651872 - protein, 18 aa, Staphylococcus aureus
SKDYNLCNHRKGIGTQVD

SEQ ID NO: 1651873 - protein, 18 aa, Staphylococcus aureus
SKISFIDKTRVLFNDINK

SEQ ID NO: 1651874 - protein, 21 aa, Staphylococcus aureus
SLETIFHCYHHMMSCCNDVIE

SEQ ID NO: 1651875 - protein, 21 aa, Staphylococcus aureus
SLKYSRKHGYEIVGDEFEVRR

SEQ ID NO: 1651876 - protein, 20 aa, Staphylococcus aureus
SLLKHYKIKLETFIELHSKA

SEQ ID NO: 1651877 - protein, 21 aa, Staphylococcus aureus
SLMSIEGIIVLVIYHGHSEGQ

SEQ ID NO: 1651878 - protein, 20 aa, Staphylococcus aureus
SRSVGTFAIKTGAITSAVDR

SEQ ID NO: 1651879 - protein, 18 aa, Staphylococcus aureus
STLTGRRILILGDVLELG

SEQ ID NO: 1651880 - protein, 19 aa, Staphylococcus aureus
SYFGYKAIQLFKNNSKNKQ

SEQ ID NO: 1651881 - protein, 19 aa, Staphylococcus aureus
SYKRTSCRLEVITKRGKSP

SEQ ID NO: 1651882 - protein, 19 aa, Staphylococcus aureus
TCTKHIAVSLKIDGKTVTI

SEQ ID NO: 1651883 - protein, 21 aa, Staphylococcus aureus
TEADISIQLVKEVRLVGKDLD

SEQ ID NO: 1651884 - protein, 19 aa, Staphylococcus aureus
TFKTELIKMNASYQTRLKN

SEQ ID NO: 1651885 - protein, 18 aa, Staphylococcus aureus
TIKTHVSHIFSKLQVSDR

SEQ ID NO: 1651886 - protein, 25 aa, Staphylococcus aureus
TKELLFKRRIDIGGVNNNFKGDFQE

SEQ ID NO: 1651887 - protein, 20 aa, Staphylococcus aureus
TKYKGDLLVLDKSEYFDTTD

SEQ ID NO: 1651888 - protein, 25 aa, Staphylococcus aureus
TLSKHFKVTAPIFIDNAESVTELIK

SEQ ID NO: 1651889 - protein, 24 aa, Staphylococcus aureus
TPGHTPESISFLLTDLGGGSSVPM

SEQ ID NO: 1651890 - protein, 29 aa, Staphylococcus aureus
TSDNPRFKRWVIGSILSRTYYHNMVTHLL

SEQ ID NO: 1651891 - protein, 17 aa, Staphylococcus aureus
TSYFKKTVNPFDHKAVP

SEQ ID NO: 1651892 - protein, 23 aa, Staphylococcus aureus
TTAELGFTLMLAIARRIVEAEKY

SEQ ID NO: 1651893 - protein, 25 aa, Staphylococcus aureus
TTEIQRKWIEKFKVIRDTFKAKAEY

SEQ ID NO: 1651894 - protein, 22 aa, Staphylococcus aureus
TTSWTSYQTRYEVLKQLCTTYK

SEQ ID NO: 1651895 - protein, 23 aa, Staphylococcus aureus
VEVVDLRTVYPLDKETIIDRAKH

SEQ ID NO: 1651896 - protein, 17 aa, Staphylococcus aureus
VGIGPGRVCITKIKTGF

SEQ ID NO: 1651897 - protein, 22 aa, Staphylococcus aureus
VIKPENIVLIGMRDLDKGERQF

SEQ ID NO: 1651898 - protein, 17 aa, Staphylococcus aureus
VNFGRFPYSKGRLTKED

SEQ ID NO: 1651899 - protein, 20 aa, Staphylococcus aureus
VNGRRARKIFDLARQGQIQE

SEQ ID NO: 1651900 - protein, 28 aa, Staphylococcus aureus
VPDEASLEFNVRPVPEYDNDFIESFFQN

SEQ ID NO: 1651901 - protein, 25 aa, Staphylococcus aureus
VPDTLRVASILAHTLYDYPSHQLVT

SEQ ID NO: 1651902 - protein, 21 aa, Staphylococcus aureus
WNIPEGITMDQYLARKKKNSV

SEQ ID NO: 1651903 - protein, 25 aa, Staphylococcus aureus
WRDKFRLPYLLGKADYIFVDDFHPL

SEQ ID NO: 1651904 - protein, 24 aa, Staphylococcus aureus
WRQHDVKLVFFLAISHKDKAFTKQ

SEQ ID NO: 1651905 - protein, 24 aa, Staphylococcus aureus
YAVTPEHLEHFIADKNMQTRTKNK

SEQ ID NO: 1651906 - protein, 18 aa, Staphylococcus aureus
YFLPSQTNFIFVKTKRVN

SEQ ID NO: 1651907 - protein, 23 aa, Staphylococcus aureus
YFNDRLNGCGGFIDITQSVNKII

SEQ ID NO: 1651908 - protein, 23 aa, Staphylococcus aureus
YLVKASKMKWVFQFEIVSAHGVH

SEQ ID NO: 1651909 - protein, 25 aa, Staphylococcus aureus
YTAAILKQFEQFGSYMVISPHIALI

SEQ ID NO: 1651910 - protein, 18 aa, Staphylococcus aureus
AAILSGKINNKWLEDKNV

SEQ ID NO: 1651911 - protein, 22 aa, Staphylococcus aureus
AANEAYKSWKTWSANDRAELML

SEQ ID NO: 1651912 - protein, 27 aa, Staphylococcus aureus
AEKGLELGCLFAFYGHTHVAKYEYING

SEQ ID NO: 1651913 - protein, 18 aa, Staphylococcus aureus
AGINYCIVGTKGIQDTDW

SEQ ID NO: 1651914 - protein, 18 aa, Staphylococcus aureus
AHQICSLNDFYQIWTQKE

SEQ ID NO: 1651915 - protein, 17 aa, Staphylococcus aureus
AHVDYLVTWNIPEGITM

SEQ ID NO: 1651916 - protein, 23 aa, Staphylococcus aureus
AIGLCGLDAQLFEITSFDQQYGY

SEQ ID NO: 1651917 - protein, 22 aa, Staphylococcus aureus
AMAPCPYIYAELAKRSQSDHKL

SEQ ID NO: 1651918 - protein, 23 aa, Staphylococcus aureus
ANVPVVAGFGIRTPQHVADIKEV

SEQ ID NO: 1651919 - protein, 27 aa, Staphylococcus aureus
AQSQFNLPMRYIWGIYEPQSDDQNMNE

SEQ ID NO: 1651920 - protein, 21 aa, Staphylococcus aureus
ARVAVGALCKVLLQQLDIDIY

SEQ ID NO: 1651921 - protein, 17 aa, Staphylococcus aureus
ATAIGIPVVAHLGLTPQ

SEQ ID NO: 1651922 - protein, 18 aa, Staphylococcus aureus
AVRDVRELIVQKAQEGVT

SEQ ID NO: 1651923 - protein, 18 aa, Staphylococcus aureus
CDTSIKKLLSNEVEVFTT

SEQ ID NO: 1651924 - protein, 18 aa, Staphylococcus aureus
CLQKGAFVSDKDGDMHYD

SEQ ID NO: 1651925 - protein, 24 aa, Staphylococcus aureus
CNARHGVCEKCYGKNLATGEKVEV

SEQ ID NO: 1651926 - protein, 26 aa, Staphylococcus aureus
DACIANNIKPIFGMTIYVTNGLNTVE

SEQ ID NO: 1651927 - protein, 17 aa, Staphylococcus aureus
DDFKELNNILGDHEIET

SEQ ID NO: 1651928 - protein, 22 aa, Staphylococcus aureus
DDYRKMFAHITVAQGYITPENA

SEQ ID NO: 1651929 - protein, 17 aa, Staphylococcus aureus
DGLNRATATYKFAGGKG

SEQ ID NO: 1651930 - protein, 18 aa, Staphylococcus aureus
DIEKMTAIVNIVKGDRDN

SEQ ID NO: 1651931 - protein, 23 aa, Staphylococcus aureus
DILNPYLCIIFCNSRDNANDLAR

SEQ ID NO: 1651932 - protein, 18 aa, Staphylococcus aureus
DKRFHFEIDETWKNKLVN

SEQ ID NO: 1651933 - protein, 19 aa, Staphylococcus aureus
DNCDLNFYLGQINHIVGKN

SEQ ID NO: 1651934 - protein, 19 aa, Staphylococcus aureus
DPHYIEVWGKFTPRGGISI

SEQ ID NO: 1651935 - protein, 19 aa, Staphylococcus aureus
DTVEVGQAIAIIGEGSGNA

SEQ ID NO: 1651936 - protein, 21 aa, Staphylococcus aureus
DVDGFHPINIGKLYIDEQTFV

SEQ ID NO: 1651937 - protein, 27 aa, Staphylococcus aureus
DVFAHGEIRLDINFALYGNGTDSISDI

SEQ ID NO: 1651938 - protein, 18 aa, Staphylococcus aureus
DVSFKLKRGQIVGLVGAN

SEQ ID NO: 1651939 - protein, 28 aa, Staphylococcus aureus
DYDAIILAAAGLRRMGWSDDIVTSYLDR

SEQ ID NO: 1651940 - protein, 18 aa, Staphylococcus aureus
EEIFINKLLNTMNNHISN

SEQ ID NO: 1651941 - protein, 21 aa, Staphylococcus aureus
EGELVARLILDKVGNKKPIRR

SEQ ID NO: 1651942 - protein, 19 aa, Staphylococcus aureus
EIRQKYLDFFVEKGHMVEP

SEQ ID NO: 1651943 - protein, 22 aa, Staphylococcus aureus
EKLRRHMSFLMRKGSLYLPYNG

SEQ ID NO: 1651944 - protein, 18 aa, Staphylococcus aureus
ELNNILGDHEIETKKKIL

SEQ ID NO: 1651945 - protein, 19 aa, Staphylococcus aureus
ERIKNLIIEVLRGHRKIKK

SEQ ID NO: 1651946 - protein, 19 aa, Staphylococcus aureus
ERILKTVIDLVDKRVPVIA

SEQ ID NO: 1651947 - protein, 20 aa, Staphylococcus aureus
ESELKLCRDLITEFETLSKY

SEQ ID NO: 1651948 - protein, 25 aa, Staphylococcus aureus
ETLEEARALLIEAINSGAALEKFKT

SEQ ID NO: 1651949 - protein, 26 aa, Staphylococcus aureus
EVLTFKAIQACKEYGVQRLIVAGGVA

SEQ ID NO: 1651950 - protein, 18 aa, Staphylococcus aureus
EVQQWFNYTYMVILTNGV

SEQ ID NO: 1651951 - protein, 20 aa, Staphylococcus aureus
FARLKLGDNIKFRPINENEL

SEQ ID NO: 1651952 - protein, 24 aa, Staphylococcus aureus
FCASPYFTHSYVFISWTGKMAEAF

SEQ ID NO: 1651953 - protein, 23 aa, Staphylococcus aureus
FDSKGGFYFTDFRGYSTNPLGGV

SEQ ID NO: 1651954 - protein, 24 aa, Staphylococcus aureus
FERSREGRYAYSLPKSDIKTNSVE

SEQ ID NO: 1651955 - protein, 19 aa, Staphylococcus aureus
FGHSLGHGIGLEIHEGPML

SEQ ID NO: 1651956 - protein, 17 aa, Staphylococcus aureus
FGKRAMTTFERYFIADK

SEQ ID NO: 1651957 - protein, 17 aa, Staphylococcus aureus
FKAPIATSASIWETIKT

SEQ ID NO: 1651958 - protein, 17 aa, Staphylococcus aureus
FLNGRAVTVIGQQRGKD

SEQ ID NO: 1651959 - protein, 23 aa, Staphylococcus aureus
FNQELLCIYIDFDSGLRHSNMAT

SEQ ID NO: 1651960 - protein, 28 aa, Staphylococcus aureus
FNQPIIWLCGGLDRGNEFDELIPYMENV

SEQ ID NO: 1651961 - protein, 19 aa, Staphylococcus aureus
FSEHHFYCAIFIPSTEDHA

SEQ ID NO: 1651962 - protein, 18 aa, Staphylococcus aureus
FSRGGLQGLLTFQDLPVT

SEQ ID NO: 1651963 - protein, 31 aa, Staphylococcus aureus
FSSKEDPELCVLRVVPQSIKLMNDKSLDTPI

SEQ ID NO: 1651964 - protein, 28 aa, Staphylococcus aureus
GALWTLAQEVYQEWYLGSKLYEDVEKKI

SEQ ID NO: 1651965 - protein, 19 aa, Staphylococcus aureus
GDLSIDGHVVFDFKAPIAT

SEQ ID NO: 1651966 - protein, 22 aa, Staphylococcus aureus
GELDEHFPLVVWQTGSGTQSNM

SEQ ID NO: 1651967 - protein, 17 aa, Staphylococcus aureus
GGSLTILATALVDTGSR

SEQ ID NO: 1651968 - protein, 21 aa, Staphylococcus aureus
GHLLALPGWAGMLYYRSQQHH

SEQ ID NO: 1651969 - protein, 21 aa, Staphylococcus aureus
GIEAIICGIGINLTQQLENFD

SEQ ID NO: 1651970 - protein, 20 aa, Staphylococcus aureus
GKAYAYLIFVQETWTMLHEN

SEQ ID NO: 1651971 - protein, 19 aa, Staphylococcus aureus
GLCIPELDGKMSYMIAVTG

SEQ ID NO: 1651972 - protein, 18 aa, Staphylococcus aureus
GQEIEFFGPEIETFTQVV

SEQ ID NO: 1651973 - protein, 17 aa, Staphylococcus aureus
GVVGAVVAWNFPMLLAA

SEQ ID NO: 1651974 - protein, 17 aa, Staphylococcus aureus
GYFKRYALTSNGVSPRP

SEQ ID NO: 1651975 - protein, 24 aa, Staphylococcus aureus
HLNIKVIIVTTFKRPGYFEKAVVN

SEQ ID NO: 1651976 - protein, 26 aa, Staphylococcus aureus
HPENELEVLSSYLISLDQHRETIEDY

SEQ ID NO: 1651977 - protein, 17 aa, Staphylococcus aureus
HSLIKIRLPETLSKELL

SEQ ID NO: 1651978 - protein, 25 aa, Staphylococcus aureus
IASSLKAPIYVLSNIAGVLINDVVI

SEQ ID NO: 1651979 - protein, 30 aa, Staphylococcus aureus
IDILDIRFGSLWTNIPLAFLKSLEIVHGNN

SEQ ID NO: 1651980 - protein, 19 aa, Staphylococcus aureus
IFELFDYNIAYEIRLQAAL

SEQ ID NO: 1651981 - protein, 18 aa, Staphylococcus aureus
ILFNNSLKYYMNEHPAVT

SEQ ID NO: 1651982 - protein, 26 aa, Staphylococcus aureus
IMKFTEGSFKQWGYDLALSEFGDQVF

SEQ ID NO: 1651983 - protein, 23 aa, Staphylococcus aureus
IQYLKKEIAEFIGDHEIKSIGVA

SEQ ID NO: 1651984 - protein, 34 aa, Staphylococcus aureus
IRDVFGYSVDKGWMCIQVFFIRQGNMIKRDTTMI

SEQ ID NO: 1651985 - protein, 18 aa, Staphylococcus aureus
ISEAKVLVNEDGIPTDVQ

SEQ ID NO: 1651986 - protein, 19 aa, Staphylococcus aureus
ITRRIREMGVYSELHDHEI

SEQ ID NO: 1651987 - protein, 19 aa, Staphylococcus aureus
KDTGAFCASPYFTHSYVFI

SEQ ID NO: 1651988 - protein, 21 aa, Staphylococcus aureus
KEAKFKTIIKLYEYQRTLENK

SEQ ID NO: 1651989 - protein, 20 aa, Staphylococcus aureus
KIKDDILYCYTEDSIKGLSE

SEQ ID NO: 1651990 - protein, 18 aa, Staphylococcus aureus
KIRPNLGRKIYINYHKKR

SEQ ID NO: 1651991 - protein, 22 aa, Staphylococcus aureus
KKGDLFLLLAKENWHEGVLGIV

SEQ ID NO: 1651992 - protein, 24 aa, Staphylococcus aureus
KLKHWLPVDLYIGGVEHAVLHLLY

SEQ ID NO: 1651993 - protein, 26 aa, Staphylococcus aureus
KMMRDIKKDIGMIFQHFNLLNSATVF

SEQ ID NO: 1651994 - protein, 22 aa, Staphylococcus aureus
KNNYFFKLAYFRKNFEKKNGGY

SEQ ID NO: 1651995 - protein, 39 aa, Staphylococcus aureus
KQVLEKFKSLIFISGTLKFNHSFEAFKQLFNKDVHFNTF

SEQ ID NO: 1651996 - protein, 23 aa, Staphylococcus aureus
KRFNSVSEFKNATLLSETSTIYE

SEQ ID NO: 1651997 - protein, 18 aa, Staphylococcus aureus
KSMNIEVSNHMQALEDDQ

SEQ ID NO: 1651998 - protein, 21 aa, Staphylococcus aureus
KTYIFYHLFDTYIIDYSMASA

SEQ ID NO: 1651999 - protein, 26 aa, Staphylococcus aureus
KTYSLGMKQKLGIAIAFLNEPQFIIL

SEQ ID NO: 1652000 - protein, 24 aa, Staphylococcus aureus
KVIDEMASRFVVVVDETKIVQYLG

SEQ ID NO: 1652001 - protein, 23 aa, Staphylococcus aureus
KVSKVGTIAGCYVTEGKITRNAG

SEQ ID NO: 1652002 - protein, 23 aa, Staphylococcus aureus
LFIDEIKRQLTYYDETIATNNAD

SEQ ID NO: 1652003 - protein, 23 aa, Staphylococcus aureus
LFSGELDKAVAALIIANGARAAG

SEQ ID NO: 1652004 - protein, 25 aa, Staphylococcus aureus
LGPTAIRYAGLISRLKQLDLDVYDK

SEQ ID NO: 1652005 - protein, 23 aa, Staphylococcus aureus
LLADLELPLAKILSEMEEIGIFT

SEQ ID NO: 1652006 - protein, 25 aa, Staphylococcus aureus
LMRKGSLYLPYNGNLLIHGCIPVDE

SEQ ID NO: 1652007 - protein, 17 aa, Staphylococcus aureus
LNHQSGHTIQWYIMTSD

SEQ ID NO: 1652008 - protein, 17 aa, Staphylococcus aureus
LNKGRIGAKEGPDAIKQ

SEQ ID NO: 1652009 - protein, 27 aa, Staphylococcus aureus
LNRYEKRLNPTYFIRIHRSYIINTKHI

SEQ ID NO: 1652010 - protein, 18 aa, Staphylococcus aureus
LPLATGLVAEVGQGLSCI

SEQ ID NO: 1652011 - protein, 17 aa, Staphylococcus aureus
LPSVSLLEEPQVIESDE

SEQ ID NO: 1652012 - protein, 38 aa, Staphylococcus aureus
LRSIIESPSFKNAESKLTVAMGYRINNEPLLMDIAKTP

SEQ ID NO: 1652013 - protein, 24 aa, Staphylococcus aureus
LTDEKYFGGSFERLQALTTKTTLP

SEQ ID NO: 1652014 - protein, 17 aa, Staphylococcus aureus
LTEVMGLPKDFKTHPHY

SEQ ID NO: 1652015 - protein, 19 aa, Staphylococcus aureus
LWWQGIDPIAAIRILGQAN

SEQ ID NO: 1652016 - protein, 25 aa, Staphylococcus aureus
LYHALKTRGHRVCIFKPFQTEERQD

SEQ ID NO: 1652017 - protein, 23 aa, Staphylococcus aureus
LYQDIPEQFSIMRYHSLISNPDN

SEQ ID NO: 1652018 - protein, 18 aa, Staphylococcus aureus
MCKAHFHSLIKIRLPETL

SEQ ID NO: 1652019 - protein, 17 aa, Staphylococcus aureus
MFANTLVYRGQPSPDKM

SEQ ID NO: 1652020 - protein, 23 aa, Staphylococcus aureus
MKLPYEYYIGGKLGSGQQWYSWI

SEQ ID NO: 1652021 - protein, 24 aa, Staphylococcus aureus
MKMFEFKQGVKLFGANVILSQSGY

SEQ ID NO: 1652022 - protein, 17 aa, Staphylococcus aureus
MMMEGKWQSTIHRQLIE

SEQ ID NO: 1652023 - protein, 24 aa, Staphylococcus aureus
MNPVELRRNIGYVIQQIGLMPHMT

SEQ ID NO: 1652024 - protein, 21 aa, Staphylococcus aureus
MQFTGSFKFRGASNKINHLTD

SEQ ID NO: 1652025 - protein, 20 aa, Staphylococcus aureus
MSRSEGFGKEVKRRIFLGTF

SEQ ID NO: 1652026 - protein, 20 aa, Staphylococcus aureus
NAHPEFGDKVAHYISENTGY

SEQ ID NO: 1652027 - protein, 23 aa, Staphylococcus aureus
NGDLAGILGLCIPELDGKMSYMI

SEQ ID NO: 1652028 - protein, 23 aa, Staphylococcus aureus
NGEAEMSFEAFLEKAAVSSSQTV

SEQ ID NO: 1652029 - protein, 17 aa, Staphylococcus aureus
NIFEISKDITIEEKGHI

SEQ ID NO: 1652030 - protein, 23 aa, Staphylococcus aureus
NKKPIRRLWISSVTKKAIQQGFK

SEQ ID NO: 1652031 - protein, 19 aa, Staphylococcus aureus
NKSQIRWISVLDLKDKDEN

SEQ ID NO: 1652032 - protein, 25 aa, Staphylococcus aureus
NNQSPKMHVCEDVIVRCHLYKNEYK

SEQ ID NO: 1652033 - protein, 27 aa, Staphylococcus aureus
NPIPIKALTSYLGFGNYELRLPLVSLE

SEQ ID NO: 1652034 - protein, 24 aa, Staphylococcus aureus
NRKNIPFDELVLFSSARSAGQEVE

SEQ ID NO: 1652035 - protein, 17 aa, Staphylococcus aureus
NSIRLVTEIVRSLNDES

SEQ ID NO: 1652036 - protein, 17 aa, Staphylococcus aureus
PDTGLSVDLVNKKNELI

SEQ ID NO: 1652037 - protein, 25 aa, Staphylococcus aureus
PGLPDLKGFGRRNIDISNDEIYNLM

SEQ ID NO: 1652038 - protein, 23 aa, Staphylococcus aureus
PKGTLIPHRGIVRLVHQNHYVPL

SEQ ID NO: 1652039 - protein, 19 aa, Staphylococcus aureus
PNKRQGAILEDAKVTAVMS

SEQ ID NO: 1652040 - protein, 25 aa, Staphylococcus aureus
PNMDIFKKCYKALITKQETNIQKEG

SEQ ID NO: 1652041 - protein, 25 aa, Staphylococcus aureus
PPSVREIGEAVGLASSSTVHGHLSR

SEQ ID NO: 1652042 - protein, 32 aa, Staphylococcus aureus
PYELSQRLKQQFSHYGVKIISLVAMTTDDKRI

SEQ ID NO: 1652043 - protein, 25 aa, Staphylococcus aureus
PYNKNFINQIGWYLDFEKDIDLIGD

SEQ ID NO: 1652044 - protein, 18 aa, Staphylococcus aureus
QCPLTIRAPFGGGVHGGL

SEQ ID NO: 1652045 - protein, 35 aa, Staphylococcus aureus
QDEQLKSLPFISGYVGTCSFDLVRHEFPKLQSIQL

SEQ ID NO: 1652046 - protein, 23 aa, Staphylococcus aureus
QEGRRFLFETVVKVNHPKYDITI

SEQ ID NO: 1652047 - protein, 19 aa, Staphylococcus aureus
QNGIAEWRYQDVPTKLWPI

SEQ ID NO: 1652048 - protein, 28 aa, Staphylococcus aureus
QPVSPHLAFKMTDQIFLNKQRVLDKVKV

SEQ ID NO: 1652049 - protein, 25 aa, Staphylococcus aureus
QQAVSRISPKMGMMKNSVLNQSRNF

SEQ ID NO: 1652050 - protein, 26 aa, Staphylococcus aureus
QQTKGRYSVVIFDIYGTLTLDNDVLS

SEQ ID NO: 1652051 - protein, 23 aa, Staphylococcus aureus
QQWSHKYKTVGMMLFDEQRQFLQ

SEQ ID NO: 1652052 - protein, 23 aa, Staphylococcus aureus
QSKHLKLKGVHCHIGSQIEGTEA

SEQ ID NO: 1652053 - protein, 17 aa, Staphylococcus aureus
QVVGSGFEGRVTKKDIM

SEQ ID NO: 1652054 - protein, 25 aa, Staphylococcus aureus
QYMSHVKHIGKLVLRASDVIEHHNF

SEQ ID NO: 1652055 - protein, 17 aa, Staphylococcus aureus
RAGAKARTTKQQARINR

SEQ ID NO: 1652056 - protein, 20 aa, Staphylococcus aureus
RAKMALSTADLVIELPATAS

SEQ ID NO: 1652057 - protein, 26 aa, Staphylococcus aureus
RFHKKSLPVPKYRYFKLNNNKIQKML

SEQ ID NO: 1652058 - protein, 17 aa, Staphylococcus aureus
RGSQLIELAEKIAQEHN

SEQ ID NO: 1652059 - protein, 20 aa, Staphylococcus aureus
RSKLRKALPKQYVYIIEELL

SEQ ID NO: 1652060 - protein, 23 aa, Staphylococcus aureus
RVAFDLRSKEAFHGGHTKGTINI

SEQ ID NO: 1652061 - protein, 19 aa, Staphylococcus aureus
RVVIGRFGIILSNEGGALQ

SEQ ID NO: 1652062 - protein, 17 aa, Staphylococcus aureus
SECWYIIDAEEDAEIVI

SEQ ID NO: 1652063 - protein, 24 aa, Staphylococcus aureus
SFNKRCVLKNISFDIEQGKCIALI

SEQ ID NO: 1652064 - protein, 21 aa, Staphylococcus aureus
SGTVTPQGFFAIIEKPHYDIS

SEQ ID NO: 1652065 - protein, 25 aa, Staphylococcus aureus
SKMIKEAVCQLEIKLDTGRTHQIRV

SEQ ID NO: 1652066 - protein, 27 aa, Staphylococcus aureus
SKVCLANLLRICARYDNLDIIEDAYGI

SEQ ID NO: 1652067 - protein, 24 aa, Staphylococcus aureus
SNMKLRIGFSDIFFNVDQLTSSEA

SEQ ID NO: 1652068 - protein, 17 aa, Staphylococcus aureus
SNVKRAIEHLGYEVVVS

SEQ ID NO: 1652069 - protein, 21 aa, Staphylococcus aureus
SYLVGCQRTGEAIIIDPVRDL

SEQ ID NO: 1652070 - protein, 20 aa, Staphylococcus aureus
TEHSRRYLLDEGFNKANIFV

SEQ ID NO: 1652071 - protein, 21 aa, Staphylococcus aureus
TFYHPSNMVLFVVGDVDPEAI

SEQ ID NO: 1652072 - protein, 19 aa, Staphylococcus aureus
TIEDGVVCFYSRSKQRLWT

SEQ ID NO: 1652073 - protein, 22 aa, Staphylococcus aureus
TIEHLIELIKYCSSKYTRSKLR

SEQ ID NO: 1652074 - protein, 22 aa, Staphylococcus aureus
TKARAYLPGILVEKLLIKIDDM

SEQ ID NO: 1652075 - protein, 17 aa, Staphylococcus aureus
TKFVPIINSIGFNNHDG

SEQ ID NO: 1652076 - protein, 27 aa, Staphylococcus aureus
TLYYTCEKFKLLVLQGNVLGVQIITNN

SEQ ID NO: 1652077 - protein, 18 aa, Staphylococcus aureus
TNMGALWPTLGAIPTSSF

SEQ ID NO: 1652078 - protein, 25 aa, Staphylococcus aureus
VDGEIIFKHGLSLAQVQQITNLAKR

SEQ ID NO: 1652079 - protein, 25 aa, Staphylococcus aureus
VDKVTHLRALLQLRDVAQDNDAIKR

SEQ ID NO: 1652080 - protein, 17 aa, Staphylococcus aureus
VEADAWQSWGPYLLSGK

SEQ ID NO: 1652081 - protein, 19 aa, Staphylococcus aureus
VFFLNGFQMKGVIEEYDKY

SEQ ID NO: 1652082 - protein, 22 aa, Staphylococcus aureus
VKKWLEEDIDVIITTGGTGIAQ

SEQ ID NO: 1652083 - protein, 17 aa, Staphylococcus aureus
VNGETFYSRVIKTLEST

SEQ ID NO: 1652084 - protein, 18 aa, Staphylococcus aureus
VPSMPFSPVLENEIMMNP

SEQ ID NO: 1652085 - protein, 28 aa, Staphylococcus aureus
VSGHAIDACGINGLYIKSCSFEGFIDYS

SEQ ID NO: 1652086 - protein, 21 aa, Staphylococcus aureus
VSIPQRKGEPIVVTKDEGVRE

SEQ ID NO: 1652087 - protein, 19 aa, Staphylococcus aureus
VVDISNYVLLEYGQPLHMF

SEQ ID NO: 1652088 - protein, 18 aa, Staphylococcus aureus
VVRYLEAHEGFKVKYVDV

SEQ ID NO: 1652089 - protein, 25 aa, Staphylococcus aureus
VVTRPLMEEWLFNTVAFVGGPSEIK

SEQ ID NO: 1652090 - protein, 24 aa, Staphylococcus aureus
WKDVTEIIAAQLLYTIKKYGPDRI

SEQ ID NO: 1652091 - protein, 19 aa, Staphylococcus aureus
YFNRDRFVLSAGHGSALLY

SEQ ID NO: 1652092 - protein, 23 aa, Staphylococcus aureus
YGINLRPLLTLAEKYYDADNPAF

SEQ ID NO: 1652093 - protein, 19 aa, Staphylococcus aureus
YLLPYSKFEVFWKRYKDNI

SEQ ID NO: 1652094 - protein, 27 aa, Staphylococcus aureus
YNDSDLNWIYLVKNLRNAGVSIESLIE

SEQ ID NO: 1652095 - protein, 26 aa, Staphylococcus aureus
YPDKGVRLKAYFNEMTYDDKLRQQIK

SEQ ID NO: 1652096 - protein, 26 aa, Staphylococcus aureus
YPHQPCYEGAMCVCGTGGDKSNSFNI

SEQ ID NO: 1652097 - protein, 38 aa, Staphylococcus aureus
YPLAKGASYRLEFYRLYLLMVHLLKFGEMYRDSVAHSM

SEQ ID NO: 1652098 - protein, 18 aa, Staphylococcus aureus
YRLLRPAKGTTYKIYFGF

SEQ ID NO: 1652099 - protein, 17 aa, Staphylococcus aureus
YVANLKYQFDINQKEKN

SEQ ID NO: 1652100 - protein, 21 aa, Staphylococcus aureus
YYKNVHIYDVTWGEAVDVKDF

SEQ ID NO: 1652101 - protein, 26 aa, Staphylococcus aureus
AAYLKEFTNLYALLIPKMNSMNDVKF

SEQ ID NO: 1652102 - protein, 23 aa, Staphylococcus aureus
ADQAICIGEANALDSYLNIDRII

SEQ ID NO: 1652103 - protein, 18 aa, Staphylococcus aureus
AETDYKLKSSYMDKQLIL

SEQ ID NO: 1652104 - protein, 17 aa, Staphylococcus aureus
AKAKKGTDILVESLFYN

SEQ ID NO: 1652105 - protein, 24 aa, Staphylococcus aureus
AKGSQLPKMFGFQAEGASPIVQNK

SEQ ID NO: 1652106 - protein, 22 aa, Staphylococcus aureus
AMIQFKLEIPIIKRRPNFEMEE

SEQ ID NO: 1652107 - protein, 26 aa, Staphylococcus aureus
ARHIVPYPPGIPIIFKGETITENMIE

SEQ ID NO: 1652108 - protein, 19 aa, Staphylococcus aureus
ARQNLKALMTKVNDDSDMV

SEQ ID NO: 1652109 - protein, 25 aa, Staphylococcus aureus
ATGIDHNRLSLLMAVLEKKENYLLQ

SEQ ID NO: 1652110 - protein, 34 aa, Staphylococcus aureus
ATPIKLGQEISGWRYMLDRCETMLSESKKHILNL

SEQ ID NO: 1652111 - protein, 18 aa, Staphylococcus aureus
AYDAKVFRKGGVSQHTVY

SEQ ID NO: 1652112 - protein, 21 aa, Staphylococcus aureus
CINDLGFKGALIMGRAQDGFL

SEQ ID NO: 1652113 - protein, 17 aa, Staphylococcus aureus
DAYQLNYNQFFVTDMMS

SEQ ID NO: 1652114 - protein, 20 aa, Staphylococcus aureus
DKKYKNWDWNYGKSPKYEYN

SEQ ID NO: 1652115 - protein, 25 aa, Staphylococcus aureus
DLIEEVARIYGYDDIPSTLPVFDKV

SEQ ID NO: 1652116 - protein, 20 aa, Staphylococcus aureus
DRTTAIFPKLVFSIKKGTNF

SEQ ID NO: 1652117 - protein, 22 aa, Staphylococcus aureus
DSMSQIRWLSVLDLKDKTEDQL

SEQ ID NO: 1652118 - protein, 18 aa, Staphylococcus aureus
EAEFKPKQIEDFNSNIEY

SEQ ID NO: 1652119 - protein, 19 aa, Staphylococcus aureus
EELRKHLIEKYSIGVIALN

SEQ ID NO: 1652120 - protein, 23 aa, Staphylococcus aureus
EQYKRTMFWSEFEIRQYTHSDIT

SEQ ID NO: 1652121 - protein, 24 aa, Staphylococcus aureus
ESDDRKLRESAFRNVYKAYGAHNN

SEQ ID NO: 1652122 - protein, 24 aa, Staphylococcus aureus
EVAEACLKLGVDMINDQWAGLYDH

SEQ ID NO: 1652123 - protein, 20 aa, Staphylococcus aureus
FDRKRAKQLIKDVGLGHYQL

SEQ ID NO: 1652124 - protein, 24 aa, Staphylococcus aureus
FIGPNCGFYTATHPLNFHHRNEGF

SEQ ID NO: 1652125 - protein, 18 aa, Staphylococcus aureus
FKAHLPVNENTPKLTLNE

SEQ ID NO: 1652126 - protein, 19 aa, Staphylococcus aureus
FKGALIMGRAQDGFLDQDK

SEQ ID NO: 1652127 - protein, 19 aa, Staphylococcus aureus
FVNKVEMISGMTFADLDTL

SEQ ID NO: 1652128 - protein, 17 aa, Staphylococcus aureus
GCLWGVEAFFATIPGII

SEQ ID NO: 1652129 - protein, 19 aa, Staphylococcus aureus
GGTIKIKGIHINGLEVDLN

SEQ ID NO: 1652130 - protein, 21 aa, Staphylococcus aureus
GKSLIAKALLEYLPFDLSCTY

SEQ ID NO: 1652131 - protein, 20 aa, Staphylococcus aureus
GLEAMTIHRLIGWNQDTKPE

SEQ ID NO: 1652132 - protein, 17 aa, Staphylococcus aureus
GLRYCINSAAIQFIPYE

SEQ ID NO: 1652133 - protein, 24 aa, Staphylococcus aureus
GNNYIDRWCKIRNSHIGEYSYIGF

SEQ ID NO: 1652134 - protein, 18 aa, Staphylococcus aureus
GSHYIWMARNFRSYNPRH

SEQ ID NO: 1652135 - protein, 19 aa, Staphylococcus aureus
GTQYRGAFEENIQKLIEGV

SEQ ID NO: 1652136 - protein, 24 aa, Staphylococcus aureus
GTYMCIAAACGENVILNNIVPKHV

SEQ ID NO: 1652137 - protein, 17 aa, Staphylococcus aureus
GVFTDKYGVRWMLHGQD

SEQ ID NO: 1652138 - protein, 31 aa, Staphylococcus aureus
GYVAGTKELIDWLKAQSRPFLFSTSLAPGDT

SEQ ID NO: 1652139 - protein, 20 aa, Staphylococcus aureus
HASLVVSINDVFYVTDVGFG

SEQ ID NO: 1652140 - protein, 17 aa, Staphylococcus aureus
HIHILKPKDVVLDVDSI

SEQ ID NO: 1652141 - protein, 20 aa, Staphylococcus aureus
HRKDLKFNLYVTTLHTSLIE

SEQ ID NO: 1652142 - protein, 21 aa, Staphylococcus aureus
HSELTYLTFVYKVAAMDFIFK

SEQ ID NO: 1652143 - protein, 17 aa, Staphylococcus aureus
HVIRRICDEVAVMESGK

SEQ ID NO: 1652144 - protein, 17 aa, Staphylococcus aureus
IDEYTDLALVYPMHKNP

SEQ ID NO: 1652145 - protein, 17 aa, Staphylococcus aureus
IELPFADQFWGGKMGVF

SEQ ID NO: 1652146 - protein, 27 aa, Staphylococcus aureus
IEMIDYFKALFPNGGLYIHLDQATERH

SEQ ID NO: 1652147 - protein, 25 aa, Staphylococcus aureus
IFEKEDRKIATFCVATHRNYKDENG

SEQ ID NO: 1652148 - protein, 18 aa, Staphylococcus aureus
IHAGLPVILSPVKEHIYL

SEQ ID NO: 1652149 - protein, 26 aa, Staphylococcus aureus
IPHENIIKLPARFHKKSLPVPKYRYF

SEQ ID NO: 1652150 - protein, 27 aa, Staphylococcus aureus
IQQWCQKFNIALTIKKKQGIVVDGTDN

SEQ ID NO: 1652151 - protein, 24 aa, Staphylococcus aureus
IRHLEKKRVVIFAAGIGNPYFSTD

SEQ ID NO: 1652152 - protein, 20 aa, Staphylococcus aureus
IRPMIHMLYYHGIAFESHAQ

SEQ ID NO: 1652153 - protein, 17 aa, Staphylococcus aureus
ISCSPKLLIADEPTTAL

SEQ ID NO: 1652154 - protein, 17 aa, Staphylococcus aureus
ISKRIKDAFLNEDIDIL

SEQ ID NO: 1652155 - protein, 19 aa, Staphylococcus aureus
KARRCSRCLKHLNQDEAYC

SEQ ID NO: 1652156 - protein, 18 aa, Staphylococcus aureus
KDKYGITNKLVLYVPTYR

SEQ ID NO: 1652157 - protein, 19 aa, Staphylococcus aureus
KEELKRMFEEAGFINVRVR

SEQ ID NO: 1652158 - protein, 18 aa, Staphylococcus aureus
KEFYKLREEQHGHQIEKV

SEQ ID NO: 1652159 - protein, 18 aa, Staphylococcus aureus
KINNKWLEDKNVVALVSG

SEQ ID NO: 1652160 - protein, 19 aa, Staphylococcus aureus
KKIDCEYTYAMPIAILIRH

SEQ ID NO: 1652161 - protein, 32 aa, Staphylococcus aureus
KKLASAVPNHIDKVCVMVNPDLTTIEHVLSNT

SEQ ID NO: 1652162 - protein, 24 aa, Staphylococcus aureus
KLSSKVEGIGYWLNYDLHVSHCKN

SEQ ID NO: 1652163 - protein, 17 aa, Staphylococcus aureus
KSKELKRSLTAKFKSNE

SEQ ID NO: 1652164 - protein, 18 aa, Staphylococcus aureus
KTPDKLKGFSVEYLNKKD

SEQ ID NO: 1652165 - protein, 18 aa, Staphylococcus aureus
KYDIDFITGHSLGGRDAV

SEQ ID NO: 1652166 - protein, 23 aa, Staphylococcus aureus
KYNNNIWNEWAFENYIKSDEYKG

SEQ ID NO: 1652167 - protein, 23 aa, Staphylococcus aureus
KYPHAFIHMVGFSRGGLQGLLTF

SEQ ID NO: 1652168 - protein, 22 aa, Staphylococcus aureus
LDKEDEVCILYGTKNGLVAVPT

SEQ ID NO: 1652169 - protein, 23 aa, Staphylococcus aureus
LDMAKRLLDFGVHPPTIYFPLNV

SEQ ID NO: 1652170 - protein, 18 aa, Staphylococcus aureus
LECPSIISQVKFYHVPDG

SEQ ID NO: 1652171 - protein, 19 aa, Staphylococcus aureus
LECVKRKEIELVSDESFNE

SEQ ID NO: 1652172 - protein, 22 aa, Staphylococcus aureus
LKFNKPHAYCLVTIIDGTGTLT

SEQ ID NO: 1652173 - protein, 19 aa, Staphylococcus aureus
LKVIARAGVGVDNINIDAA

SEQ ID NO: 1652174 - protein, 24 aa, Staphylococcus aureus
LNLKDLFESIRFMYPQIVRSVNRL

SEQ ID NO: 1652175 - protein, 18 aa, Staphylococcus aureus
LSDELEVLDYIRTKTLTC

SEQ ID NO: 1652176 - protein, 24 aa, Staphylococcus aureus
LYHSLPLLKYPSFELFLEKINEFN

SEQ ID NO: 1652177 - protein, 28 aa, Staphylococcus aureus
MRTDVYDFYSLGFGEPYPISGSHGLGLG

SEQ ID NO: 1652178 - protein, 23 aa, Staphylococcus aureus
MSEIKRLNLNAILAKNTDKKMIG

SEQ ID NO: 1652179 - protein, 19 aa, Staphylococcus aureus
MTNIKRVQQAIVEGETYQV

SEQ ID NO: 1652180 - protein, 21 aa, Staphylococcus aureus
NDALIAPAVKVWIETYGGKHD

SEQ ID NO: 1652181 - protein, 23 aa, Staphylococcus aureus
NDDFTHWRKIMGAAPISEEEREN

SEQ ID NO: 1652182 - protein, 21 aa, Staphylococcus aureus
NKIFECIHAGLPVILSPVKEH

SEQ ID NO: 1652183 - protein, 20 aa, Staphylococcus aureus
NKNGFKEFYKLREEQHGHQI

SEQ ID NO: 1652184 - protein, 17 aa, Staphylococcus aureus
NPMTACYFVTDDRRGPH

SEQ ID NO: 1652185 - protein, 20 aa, Staphylococcus aureus
NSNAILPVRLDGATKEFFAW

SEQ ID NO: 1652186 - protein, 24 aa, Staphylococcus aureus
NVGCITRPFPTGVRITIGFKEQND

SEQ ID NO: 1652187 - protein, 26 aa, Staphylococcus aureus
NVHLIRANPNLVIMVIVFSSGHVEHV

SEQ ID NO: 1652188 - protein, 19 aa, Staphylococcus aureus
NYVLMTYYNIICHYGEQAF

SEQ ID NO: 1652189 - protein, 26 aa, Staphylococcus aureus
PFQGHPACVHIPIGKGVCGTAVSERR

SEQ ID NO: 1652190 - protein, 21 aa, Staphylococcus aureus
PHKLASCIDVANIDTPIKIIL

SEQ ID NO: 1652191 - protein, 21 aa, Staphylococcus aureus
PHVPVIIDEAYFEFVTAEDYP

SEQ ID NO: 1652192 - protein, 22 aa, Staphylococcus aureus
PMDRVLRPLKLMDANIEGIEDN

SEQ ID NO: 1652193 - protein, 26 aa, Staphylococcus aureus
PQMVLRFKRRFGDDVAVLHSGLSNGE

SEQ ID NO: 1652194 - protein, 20 aa, Staphylococcus aureus
PQSKRQVMRLLKSLQTDENK

SEQ ID NO: 1652195 - protein, 23 aa, Staphylococcus aureus
PTEKKGPSVLGIIEYQVQGENEF

SEQ ID NO: 1652196 - protein, 18 aa, Staphylococcus aureus
PVVACATILNSNHNYLGL

SEQ ID NO: 1652197 - protein, 19 aa, Staphylococcus aureus
PYIKGMPFGHEFSGVVDAI

SEQ ID NO: 1652198 - protein, 20 aa, Staphylococcus aureus
QAENWLRNNIKDINFQLYHY

SEQ ID NO: 1652199 - protein, 26 aa, Staphylococcus aureus
QPGTETIYRFSLLVPNQAALHYFEKR

SEQ ID NO: 1652200 - protein, 19 aa, Staphylococcus aureus
QSKVIFCEADDWKPFYEAY

SEQ ID NO: 1652201 - protein, 18 aa, Staphylococcus aureus
RAIEHLGYEVVVSNTSKI

SEQ ID NO: 1652202 - protein, 17 aa, Staphylococcus aureus
RDNLEMFNDLDVAVYGI

SEQ ID NO: 1652203 - protein, 23 aa, Staphylococcus aureus
REKFRHYCEHEVLSSIINGSYII

SEQ ID NO: 1652204 - protein, 18 aa, Staphylococcus aureus
RFAKEVSNNIVFIHEGMI

SEQ ID NO: 1652205 - protein, 19 aa, Staphylococcus aureus
RINNEPLLMDIAKTPHALI

SEQ ID NO: 1652206 - protein, 17 aa, Staphylococcus aureus
RTHQKYSPFPEELNRVM

SEQ ID NO: 1652207 - protein, 20 aa, Staphylococcus aureus
SCSFEGFIDYSGERFYSEAI

SEQ ID NO: 1652208 - protein, 26 aa, Staphylococcus aureus
SFVYKRRLPFHAKRFNDWLESMPNNV

SEQ ID NO: 1652209 - protein, 20 aa, Staphylococcus aureus
SIETRRYYLMLMLFSKENAM

SEQ ID NO: 1652210 - protein, 17 aa, Staphylococcus aureus
SPLFKVKLFQFADAAYI

SEQ ID NO: 1652211 - protein, 23 aa, Staphylococcus aureus
STLAKAICGFLDITGNIQFCNRG

SEQ ID NO: 1652212 - protein, 17 aa, Staphylococcus aureus
SVKTRLGYYEIDEWKDW

SEQ ID NO: 1652213 - protein, 17 aa, Staphylococcus aureus
SVSNYIMRVRLSINEIV

SEQ ID NO: 1652214 - protein, 24 aa, Staphylococcus aureus
SYDRLEGFNSLQWPVQPDGTDEPI

SEQ ID NO: 1652215 - protein, 24 aa, Staphylococcus aureus
TAKIVLRWLKEQGIQVELLNLGGG

SEQ ID NO: 1652216 - protein, 21 aa, Staphylococcus aureus
TDIKYELLSSYSEREIQQQEL

SEQ ID NO: 1652217 - protein, 17 aa, Staphylococcus aureus
TFMKSNMPYTMVGGQKF

SEQ ID NO: 1652218 - protein, 17 aa, Staphylococcus aureus
TGPHFEVLAKIENRLME

SEQ ID NO: 1652219 - protein, 19 aa, Staphylococcus aureus
TIFFTFWGLNALKKVQTVN

SEQ ID NO: 1652220 - protein, 18 aa, Staphylococcus aureus
VALMIGIPPGLIYGETAD

SEQ ID NO: 1652221 - protein, 19 aa, Staphylococcus aureus
VNGTISIGCSSLIGQTLLP

SEQ ID NO: 1652222 - protein, 20 aa, Staphylococcus aureus
VPSYRAVLIYFDEQAITSSK

SEQ ID NO: 1652223 - protein, 20 aa, Staphylococcus aureus
VSALLGRMPSAVGYQPTLAT

SEQ ID NO: 1652224 - protein, 17 aa, Staphylococcus aureus
VSRTALIEKCWESENFI

SEQ ID NO: 1652225 - protein, 18 aa, Staphylococcus aureus
VTDELKSRFEAENLIEQH

SEQ ID NO: 1652226 - protein, 22 aa, Staphylococcus aureus
VVKPLLKYAHHRGIYTQMNSNL

SEQ ID NO: 1652227 - protein, 22 aa, Staphylococcus aureus
WEESGRWGAYGPELMRLQDRHG

SEQ ID NO: 1652228 - protein, 24 aa, Staphylococcus aureus
YDGYAECVKLHFDDRMLTITDIMN

SEQ ID NO: 1652229 - protein, 24 aa, Staphylococcus aureus
YERYLKELSHDISLMKSSILQQKA

SEQ ID NO: 1652230 - protein, 20 aa, Staphylococcus aureus
YLRRINRKTALLIQISTEVG

SEQ ID NO: 1652231 - protein, 24 aa, Staphylococcus aureus
YNATLILDVSHSFGIENYSNYQGV

SEQ ID NO: 1652232 - protein, 18 aa, Staphylococcus aureus
YRNVTAMVRWIREKEILE

SEQ ID NO: 1652233 - protein, 18 aa, Staphylococcus aureus
YRPRKMNRFLKHVVDTNE

SEQ ID NO: 1652234 - protein, 17 aa, Staphylococcus aureus
YVSYAIKGNLMYENAYP

SEQ ID NO: 1652235 - protein, 25 aa, Staphylococcus aureus
AIKELICQFKYLSAFEKDVMYLMCE

SEQ ID NO: 1652236 - protein, 20 aa, Staphylococcus aureus
AKPAGICGCTDLTRDQIVTQ

SEQ ID NO: 1652237 - protein, 18 aa, Staphylococcus aureus
AKQKFKQREYKRAAEYFE

SEQ ID NO: 1652238 - protein, 22 aa, Staphylococcus aureus
AKQLRKGAVKRIVLTRPAVEAG

SEQ ID NO: 1652239 - protein, 17 aa, Staphylococcus aureus
AQHALDLLGLATLSLLD

SEQ ID NO: 1652240 - protein, 18 aa, Staphylococcus aureus
ARASFYIYNTKEDVDQLI

SEQ ID NO: 1652241 - protein, 24 aa, Staphylococcus aureus
ATAIRIGNPASWDKATNALKESNG

SEQ ID NO: 1652242 - protein, 19 aa, Staphylococcus aureus
AYVPCKEAVLPIFDQIFTR

SEQ ID NO: 1652243 - protein, 31 aa, Staphylococcus aureus
DDPEGFINFCHKRLLFVDTMPNIVHDWIAKL

SEQ ID NO: 1652244 - protein, 18 aa, Staphylococcus aureus
DELIGYSLDPVWNMSDLK

SEQ ID NO: 1652245 - protein, 22 aa, Staphylococcus aureus
DEVLQKSGYREMLERENTLESR

SEQ ID NO: 1652246 - protein, 24 aa, Staphylococcus aureus
DKLPYRAKRHYSIVSGEKNHLTFG

SEQ ID NO: 1652247 - protein, 23 aa, Staphylococcus aureus
DNDRAMFEFGHYTVAMKNARPEI

SEQ ID NO: 1652248 - protein, 23 aa, Staphylococcus aureus
DRHDIKVTAWMPLMRNRGLLDDP

SEQ ID NO: 1652249 - protein, 30 aa, Staphylococcus aureus
EAIEIAALAGMVVLSCINPVAGAVAIGAYS

SEQ ID NO: 1652250 - protein, 24 aa, Staphylococcus aureus
EDIWRHLSKIWYTDRQLLINNLIS

SEQ ID NO: 1652251 - protein, 26 aa, Staphylococcus aureus
EDTYKLDRYVGLIAEEVENLGLKEFV

SEQ ID NO: 1652252 - protein, 19 aa, Staphylococcus aureus
EERFIEMIQYFKEKITEGD

SEQ ID NO: 1652253 - protein, 22 aa, Staphylococcus aureus
EGEVPFKPSRVILQDFTGVPAV

SEQ ID NO: 1652254 - protein, 20 aa, Staphylococcus aureus
EGKGFKCFVKQNDHVEAGQT

SEQ ID NO: 1652255 - protein, 17 aa, Staphylococcus aureus
EKADELINSARVVIVEN

SEQ ID NO: 1652256 - protein, 17 aa, Staphylococcus aureus
ELFDFYYDLFKSDDDTY

SEQ ID NO: 1652257 - protein, 23 aa, Staphylococcus aureus
ELNGFRALTKIDWENVTINNEIT

SEQ ID NO: 1652258 - protein, 19 aa, Staphylococcus aureus
ERDTLRTYLNQVYDIERLV

SEQ ID NO: 1652259 - protein, 19 aa, Staphylococcus aureus
ERLYYLGQEGVVFKDEDDL

SEQ ID NO: 1652260 - protein, 24 aa, Staphylococcus aureus
ETALPEFYERASFAPEMSDPSMIQ

SEQ ID NO: 1652261 - protein, 22 aa, Staphylococcus aureus
EVENLGLKEFVTYDDKGEIEGI

SEQ ID NO: 1652262 - protein, 21 aa, Staphylococcus aureus
EYELKKGKMNTLIDEYSAVHY

SEQ ID NO: 1652263 - protein, 19 aa, Staphylococcus aureus
FEHIRFPVFGVQYHPESIL

SEQ ID NO: 1652264 - protein, 33 aa, Staphylococcus aureus
FKDIAHWEVPSGGYFVWLVFKIDIDIKYLFYEL

SEQ ID NO: 1652265 - protein, 20 aa, Staphylococcus aureus
FKGLKEWHFGIFEGESVYLF

SEQ ID NO: 1652266 - protein, 28 aa, Staphylococcus aureus
FNMTPYKVQIMGGIAIHKGDIAEMRTGE

SEQ ID NO: 1652267 - protein, 23 aa, Staphylococcus aureus
FRDDVICRRCFRLKNYNEVQDVG

SEQ ID NO: 1652268 - protein, 21 aa, Staphylococcus aureus
GATFPNCLKITAKNDEAIIMA

SEQ ID NO: 1652269 - protein, 19 aa, Staphylococcus aureus
GDEGSHCQIARNIATTMSH

SEQ ID NO: 1652270 - protein, 18 aa, Staphylococcus aureus
GEDIVECITTFADDQDLT

SEQ ID NO: 1652271 - protein, 26 aa, Staphylococcus aureus
GGINAGIATCWFNFRGFDHNPGIIPD

SEQ ID NO: 1652272 - protein, 18 aa, Staphylococcus aureus
GGQSYTYDTIKAFKEQHK

SEQ ID NO: 1652273 - protein, 19 aa, Staphylococcus aureus
GHLHHPFSIEDDKIKYSGS

SEQ ID NO: 1652274 - protein, 20 aa, Staphylococcus aureus
GKDFYMFAPHTVKEEYGVTL

SEQ ID NO: 1652275 - protein, 17 aa, Staphylococcus aureus
GKPEHLDYIFTDKDHKQ

SEQ ID NO: 1652276 - protein, 21 aa, Staphylococcus aureus
GNSKYLFTYFVKHNPMTACYF

SEQ ID NO: 1652277 - protein, 25 aa, Staphylococcus aureus
GSEKWPIFLERRLVDGIFTIKDQDA

SEQ ID NO: 1652278 - protein, 25 aa, Staphylococcus aureus
GTEPKIKLYVSLKCPDFDDVAQKIN

SEQ ID NO: 1652279 - protein, 25 aa, Staphylococcus aureus
GTGIKEMIAHFGIHQEETLVIGDSD

SEQ ID NO: 1652280 - protein, 18 aa, Staphylococcus aureus
HDQPRVVSRFGDDTSEEM

SEQ ID NO: 1652281 - protein, 27 aa, Staphylococcus aureus
HLIPETRRSTILSSKKLGDKVHLETDV

SEQ ID NO: 1652282 - protein, 21 aa, Staphylococcus aureus
HPANCLMARIGKNITLEQQQA

SEQ ID NO: 1652283 - protein, 26 aa, Staphylococcus aureus
IAKDRNKVTWGYAKSILNTWLNANLK

SEQ ID NO: 1652284 - protein, 17 aa, Staphylococcus aureus
IDNVFPLMGQTITTNDF

SEQ ID NO: 1652285 - protein, 27 aa, Staphylococcus aureus
IFREKMVGEGLAIKAHEESKVIAPFNG

SEQ ID NO: 1652286 - protein, 17 aa, Staphylococcus aureus
IKAKYKKAFKMKDDIEL

SEQ ID NO: 1652287 - protein, 23 aa, Staphylococcus aureus
IKLFPGQEIRITDSILKGLDNGS

SEQ ID NO: 1652288 - protein, 20 aa, Staphylococcus aureus
ILSEYGYRQVELFLSKVGDY
